United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 113

SEQ ID NO: 4004868 - RNA, 15 nt, Staphylococcus aureus subsp. aureus MW2
uaauuggaaucaucu

SEQ ID NO: 4004869 - RNA, 17 nt, Staphylococcus aureus subsp. aureus MW2
uaauuggaaucaucuuu

SEQ ID NO: 4004870 - RNA, 21 nt, Staphylococcus aureus subsp. aureus MW2
uaauuggaaucaucuuuuuga

SEQ ID NO: 4004871 - RNA, 15 nt, Staphylococcus aureus subsp. aureus MW2
uaauuggauuaaaua

SEQ ID NO: 4004872 - RNA, 19 nt, Staphylococcus aureus subsp. aureus MW2
uaauuguaaucuauuuucu

SEQ ID NO: 4004873 - RNA, 15 nt, Staphylococcus aureus subsp. aureus MW2
uaauuguaaugcuuc

SEQ ID NO: 4004874 - RNA, 17 nt, Staphylococcus aureus subsp. aureus MW2
uaauuguacuuaaaccu

SEQ ID NO: 4004875 - RNA, 23 nt, Staphylococcus aureus subsp. aureus MW2
uaauuguacuuaaaccuaacaua

SEQ ID NO: 4004876 - RNA, 17 nt, Staphylococcus aureus subsp. aureus MW2
uaauuguugcauuacuu

SEQ ID NO: 4004877 - RNA, 18 nt, Staphylococcus aureus subsp. aureus MW2
uaauuguuguaauucuuu

SEQ ID NO: 4004878 - RNA, 23 nt, Staphylococcus aureus subsp. aureus MW2
uaauuuaaaggcauaauaaccau

SEQ ID NO: 4004879 - RNA, 14 nt, Staphylococcus aureus subsp. aureus MW2
uaauuuaaaugcuu

SEQ ID NO: 4004880 - RNA, 20 nt, Staphylococcus aureus subsp. aureus MW2
uaauuuaaauuacaauuagu

SEQ ID NO: 4004881 - RNA, 23 nt, Staphylococcus aureus subsp. aureus MW2
uaauuuaacaacuguucuaaaau

SEQ ID NO: 4004882 - RNA, 13 nt, Staphylococcus aureus subsp. aureus MW2
uaauuuaauaauu

SEQ ID NO: 4004883 - RNA, 15 nt, Staphylococcus aureus subsp. aureus MW2
uaauuuauaaaaaga

SEQ ID NO: 4004884 - RNA, 13 nt, Staphylococcus aureus subsp. aureus MW2
uaauuuauaauuu

SEQ ID NO: 4004885 - RNA, 14 nt, Staphylococcus aureus subsp. aureus MW2
uaauuuaucauuau

SEQ ID NO: 4004886 - RNA, 16 nt, Staphylococcus aureus subsp. aureus MW2
uaauuuauugauaagc

SEQ ID NO: 4004887 - RNA, 14 nt, Staphylococcus aureus subsp. aureus MW2
uaauuuauuuauuu

SEQ ID NO: 4004888 - RNA, 17 nt, Staphylococcus aureus subsp. aureus MW2
uaauuuccaauaucuuc

SEQ ID NO: 4004889 - RNA, 21 nt, Staphylococcus aureus subsp. aureus MW2
uaauuucugguaaaaaaauaa

SEQ ID NO: 4004890 - RNA, 11 nt, Staphylococcus aureus subsp. aureus MW2
uaauuugauua

SEQ ID NO: 4004891 - RNA, 12 nt, Staphylococcus aureus subsp. aureus MW2
uaauuugauuaa

SEQ ID NO: 4004892 - RNA, 16 nt, Staphylococcus aureus subsp. aureus MW2
uaauuuguuuuaaaua

SEQ ID NO: 4004893 - RNA, 15 nt, Staphylococcus aureus subsp. aureus MW2
uaauuuuaaaaauaa

SEQ ID NO: 4004894 - RNA, 17 nt, Staphylococcus aureus subsp. aureus MW2
uaauuuuaaaaauaaaa

SEQ ID NO: 4004895 - RNA, 17 nt, Staphylococcus aureus subsp. aureus MW2
uaauuuuaacuuuauag

SEQ ID NO: 4004896 - RNA, 16 nt, Staphylococcus aureus subsp. aureus MW2
uaauuuuacucuguau

SEQ ID NO: 4004897 - RNA, 17 nt, Staphylococcus aureus subsp. aureus MW2
uaauuuuauuuugugcu

SEQ ID NO: 4004898 - RNA, 21 nt, Staphylococcus aureus subsp. aureus MW2
uaauuuucacuuucaaugaca

SEQ ID NO: 4004899 - RNA, 12 nt, Staphylococcus aureus subsp. aureus MW2
uacacuuaauau

SEQ ID NO: 4004900 - RNA, 16 nt, Staphylococcus aureus subsp. aureus MW2
uacacuuaauauauuc

SEQ ID NO: 4004901 - RNA, 16 nt, Staphylococcus aureus subsp. aureus MW2
uacacuugguuaucau

SEQ ID NO: 4004902 - RNA, 14 nt, Staphylococcus aureus subsp. aureus MW2
uacacuuuaaauac

SEQ ID NO: 4004903 - RNA, 15 nt, Staphylococcus aureus subsp. aureus MW2
uacacuuuucuuauc

SEQ ID NO: 4004904 - RNA, 16 nt, Staphylococcus aureus subsp. aureus MW2
uacacuuuugauuguu

SEQ ID NO: 4004905 - RNA, 23 nt, Staphylococcus aureus subsp. aureus MW2
uacacuuuugauuguuuaaacau

SEQ ID NO: 4004906 - RNA, 18 nt, Staphylococcus aureus subsp. aureus MW2
uacagaaguggugcuuua

SEQ ID NO: 4004907 - RNA, 16 nt, Staphylococcus aureus subsp. aureus MW2
uacagacaaacauuac

SEQ ID NO: 4004908 - RNA, 14 nt, Staphylococcus aureus subsp. aureus MW2
uacagagaaucaau

SEQ ID NO: 4004909 - RNA, 17 nt, Staphylococcus aureus subsp. aureus MW2
uacagagaaucaauuau

SEQ ID NO: 4004910 - RNA, 17 nt, Staphylococcus aureus subsp. aureus MW2
uacagauaagaauauuu

SEQ ID NO: 4004911 - RNA, 15 nt, Staphylococcus aureus subsp. aureus MW2
uacagauaauuauuu

SEQ ID NO: 4004912 - RNA, 17 nt, Staphylococcus aureus subsp. aureus MW2
uacagauaggaaacuua

SEQ ID NO: 4004913 - RNA, 22 nt, Staphylococcus aureus subsp. aureus MW2
uacagauaggaaacuuaaauau

SEQ ID NO: 4004914 - RNA, 16 nt, Staphylococcus aureus subsp. aureus MW2
uacagaucucaaucca

SEQ ID NO: 4004915 - RNA, 20 nt, Staphylococcus aureus subsp. aureus MW2
uacagaucucaauccaauua

SEQ ID NO: 4004916 - RNA, 17 nt, Staphylococcus aureus subsp. aureus MW2
uacagauuuuaaaaauu

SEQ ID NO: 4004917 - RNA, 19 nt, Staphylococcus aureus subsp. aureus MW2
uacagauuuuaaaaauuca

SEQ ID NO: 4004918 - RNA, 16 nt, Staphylococcus aureus subsp. aureus MW2
uacagccauugacaca

SEQ ID NO: 4004919 - RNA, 23 nt, Staphylococcus aureus subsp. aureus MW2
uacagcguauuuuaaugauuuuu

SEQ ID NO: 4004920 - RNA, 18 nt, Staphylococcus aureus subsp. aureus MW2
uacagcuagcaagaauag

SEQ ID NO: 4004921 - RNA, 15 nt, Staphylococcus aureus subsp. aureus MW2
uacaggcaaugcaag

SEQ ID NO: 4004922 - RNA, 15 nt, Staphylococcus aureus subsp. aureus MW2
uacagguuuaauaaa

SEQ ID NO: 4004923 - RNA, 18 nt, Staphylococcus aureus subsp. aureus MW2
uacagguuuuaaaauuaa

SEQ ID NO: 4004924 - RNA, 22 nt, Staphylococcus aureus subsp. aureus MW2
uacaguguuauauuggcgggcc

SEQ ID NO: 4004925 - RNA, 18 nt, Staphylococcus aureus subsp. aureus MW2
uacauaaaauggcaucug

SEQ ID NO: 4004926 - RNA, 12 nt, Staphylococcus aureus subsp. aureus MW2
uacauaaaucua

SEQ ID NO: 4004927 - RNA, 13 nt, Staphylococcus aureus subsp. aureus MW2
uacauaaaucuaa

SEQ ID NO: 4004928 - RNA, 15 nt, Staphylococcus aureus subsp. aureus MW2
uacauaaaucuaaua

SEQ ID NO: 4004929 - RNA, 17 nt, Staphylococcus aureus subsp. aureus MW2
uacauaaaucuaauacu

SEQ ID NO: 4004930 - RNA, 14 nt, Staphylococcus aureus subsp. aureus MW2
uacauaaugguuca

SEQ ID NO: 4004931 - RNA, 21 nt, Staphylococcus aureus subsp. aureus MW2
uacauaccacacuuuaaacaa

SEQ ID NO: 4004932 - RNA, 15 nt, Staphylococcus aureus subsp. aureus MW2
uacauaggauaucua

SEQ ID NO: 4004933 - RNA, 16 nt, Staphylococcus aureus subsp. aureus MW2
uacauaggauaucuac

SEQ ID NO: 4004934 - RNA, 17 nt, Staphylococcus aureus subsp. aureus MW2
uacauauaagaauuguu

SEQ ID NO: 4004935 - RNA, 14 nt, Staphylococcus aureus subsp. aureus MW2
uacauauaauaugu

SEQ ID NO: 4004936 - RNA, 13 nt, Staphylococcus aureus subsp. aureus MW2
uacauauacaaau

SEQ ID NO: 4004937 - RNA, 18 nt, Staphylococcus aureus subsp. aureus MW2
uacauauacaaauuuaua

SEQ ID NO: 4004938 - RNA, 14 nt, Staphylococcus aureus subsp. aureus MW2
uacauauaguacuu

SEQ ID NO: 4004939 - RNA, 16 nt, Staphylococcus aureus subsp. aureus MW2
uacauauaucaacaug

SEQ ID NO: 4004940 - RNA, 14 nt, Staphylococcus aureus subsp. aureus MW2
uacauaugaaaaau

SEQ ID NO: 4004941 - RNA, 16 nt, Staphylococcus aureus subsp. aureus MW2
uacauauggcaaaauc

SEQ ID NO: 4004942 - RNA, 14 nt, Staphylococcus aureus subsp. aureus MW2
uacauauguguaug

SEQ ID NO: 4004943 - RNA, 17 nt, Staphylococcus aureus subsp. aureus MW2
uacauauucucugcuuc

SEQ ID NO: 4004944 - RNA, 14 nt, Staphylococcus aureus subsp. aureus MW2
uacauauuggcuug

SEQ ID NO: 4004945 - RNA, 15 nt, Staphylococcus aureus subsp. aureus MW2
uacauauuuauauuu

SEQ ID NO: 4004946 - RNA, 17 nt, Staphylococcus aureus subsp. aureus MW2
uacaucaacaucgaauu

SEQ ID NO: 4004947 - RNA, 16 nt, Staphylococcus aureus subsp. aureus MW2
uacaucaauauugucu

SEQ ID NO: 4004948 - RNA, 15 nt, Staphylococcus aureus subsp. aureus MW2
uacaucaauuucuag

SEQ ID NO: 4004949 - RNA, 18 nt, Staphylococcus aureus subsp. aureus MW2
uacaucauaaacgaaaau

SEQ ID NO: 4004950 - RNA, 14 nt, Staphylococcus aureus subsp. aureus MW2
uacaucauuaaaua

SEQ ID NO: 4004951 - RNA, 15 nt, Staphylococcus aureus subsp. aureus MW2
uacaucauuaaauau

SEQ ID NO: 4004952 - RNA, 16 nt, Staphylococcus aureus subsp. aureus MW2
uacaucauuaaauauu

SEQ ID NO: 4004953 - RNA, 17 nt, Staphylococcus aureus subsp. aureus MW2
uacaucauuaaauauuu

SEQ ID NO: 4004954 - RNA, 18 nt, Staphylococcus aureus subsp. aureus MW2
uacaucguugccauuagu

SEQ ID NO: 4004955 - RNA, 14 nt, Staphylococcus aureus subsp. aureus MW2
uacaucuaauaaau

SEQ ID NO: 4004956 - RNA, 14 nt, Staphylococcus aureus subsp. aureus MW2
uacaucuuuaagcu

SEQ ID NO: 4004957 - RNA, 21 nt, Staphylococcus aureus subsp. aureus MW2
uacaucuuuaagcucuuaauc

SEQ ID NO: 4004958 - RNA, 14 nt, Staphylococcus aureus subsp. aureus MW2
uacaugacauucau

SEQ ID NO: 4004959 - RNA, 17 nt, Staphylococcus aureus subsp. aureus MW2
uacaugacauucauuua

SEQ ID NO: 4004960 - RNA, 19 nt, Staphylococcus aureus subsp. aureus MW2
uacaugacauucauuuagu

SEQ ID NO: 4004961 - RNA, 17 nt, Staphylococcus aureus subsp. aureus MW2
uacaugcccaaauugcc

SEQ ID NO: 4004962 - RNA, 14 nt, Staphylococcus aureus subsp. aureus MW2
uacauguauaaaag

SEQ ID NO: 4004963 - RNA, 16 nt, Staphylococcus aureus subsp. aureus MW2
uacauguauaaaagau

SEQ ID NO: 4004964 - RNA, 14 nt, Staphylococcus aureus subsp. aureus MW2
uacaugugcuuuaa

SEQ ID NO: 4004965 - RNA, 17 nt, Staphylococcus aureus subsp. aureus MW2
uacaugugcuuuaaagg

SEQ ID NO: 4004966 - RNA, 12 nt, Staphylococcus aureus subsp. aureus MW2
uacauuaaaaau

SEQ ID NO: 4004967 - RNA, 17 nt, Staphylococcus aureus subsp. aureus MW2
uacauuaacgauuaaua

SEQ ID NO: 4004968 - RNA, 20 nt, Staphylococcus aureus subsp. aureus MW2
uacauuaacgauuaauauaa

SEQ ID NO: 4004969 - RNA, 15 nt, Staphylococcus aureus subsp. aureus MW2
uacauuaauauaaau

SEQ ID NO: 4004970 - RNA, 17 nt, Staphylococcus aureus subsp. aureus MW2
uacauuaguuugaucau

SEQ ID NO: 4004971 - RNA, 22 nt, Staphylococcus aureus subsp. aureus MW2
uacauuaguuugaucauuuacu

SEQ ID NO: 4004972 - RNA, 12 nt, Staphylococcus aureus subsp. aureus MW2
uacauuauuaau

SEQ ID NO: 4004973 - RNA, 13 nt, Staphylococcus aureus subsp. aureus MW2
uacauuauuaaua

SEQ ID NO: 4004974 - RNA, 14 nt, Staphylococcus aureus subsp. aureus MW2
uacauugauaaaau

SEQ ID NO: 4004975 - RNA, 20 nt, Staphylococcus aureus subsp. aureus MW2
uacauuuauuuucaauaaau

SEQ ID NO: 4004976 - RNA, 21 nt, Staphylococcus aureus subsp. aureus MW2
uacauuuauuuucaauaaaua

SEQ ID NO: 4004977 - RNA, 14 nt, Staphylococcus aureus subsp. aureus MW2
uacauuucuguaua

SEQ ID NO: 4004978 - RNA, 16 nt, Staphylococcus aureus subsp. aureus MW2
uacauuuuaauaaaau

SEQ ID NO: 4004979 - RNA, 22 nt, Staphylococcus aureus subsp. aureus MW2
uacauuuuaauaaaaucaucuu

SEQ ID NO: 4004980 - RNA, 21 nt, Staphylococcus aureus subsp. aureus MW2
uacauuuugaaacaucuaaau

SEQ ID NO: 4004981 - RNA, 17 nt, Staphylococcus aureus subsp. aureus MW2
uacauuuugcucuaaac

SEQ ID NO: 4004982 - RNA, 17 nt, Staphylococcus aureus subsp. aureus MW2
uaccaaaaaguauugcc

SEQ ID NO: 4004983 - RNA, 14 nt, Staphylococcus aureus subsp. aureus MW2
uaccaaacaauaca

SEQ ID NO: 4004984 - RNA, 14 nt, Staphylococcus aureus subsp. aureus MW2
uaccaaauauauuu

SEQ ID NO: 4004985 - RNA, 22 nt, Staphylococcus aureus subsp. aureus MW2
uaccaaauauauuuuuauuaau

SEQ ID NO: 4004986 - RNA, 21 nt, Staphylococcus aureus subsp. aureus MW2
uaccaaauuuauaauuuguau

SEQ ID NO: 4004987 - RNA, 18 nt, Staphylococcus aureus subsp. aureus MW2
uaccaacucgcuauaugu

SEQ ID NO: 4004988 - RNA, 19 nt, Staphylococcus aureus subsp. aureus MW2
uacguuauuucaauaauaa

SEQ ID NO: 4004989 - RNA, 14 nt, Staphylococcus aureus subsp. aureus MW2
uacguucuaauaau

SEQ ID NO: 4004990 - RNA, 16 nt, Staphylococcus aureus subsp. aureus MW2
uacguucuaauaauuu

SEQ ID NO: 4004991 - RNA, 13 nt, Staphylococcus aureus subsp. aureus MW2
uacguugaauguu

SEQ ID NO: 4004992 - RNA, 19 nt, Staphylococcus aureus subsp. aureus MW2
uacguuuaauaaugguucu

SEQ ID NO: 4004993 - RNA, 18 nt, Staphylococcus aureus subsp. aureus MW2
uacguuuagugaaaauac

SEQ ID NO: 4004994 - RNA, 17 nt, Staphylococcus aureus subsp. aureus MW2
uacguuugcauauccuu

SEQ ID NO: 4004995 - RNA, 14 nt, Staphylococcus aureus subsp. aureus MW2
uacguuuuaaauaa

SEQ ID NO: 4004996 - RNA, 19 nt, Staphylococcus aureus subsp. aureus MW2
uacguuuuuuuaaauacau

SEQ ID NO: 4004997 - RNA, 11 nt, Staphylococcus aureus subsp. aureus MW2
uacuaaaacau

SEQ ID NO: 4004998 - RNA, 12 nt, Staphylococcus aureus subsp. aureus MW2
uacuaaaacaug

SEQ ID NO: 4004999 - RNA, 18 nt, Staphylococcus aureus subsp. aureus MW2
uacuaaaaggacucauac

SEQ ID NO: 4005000 - RNA, 22 nt, Staphylococcus aureus subsp. aureus MW2
uacuaaaaggacucauacaugu

SEQ ID NO: 4005001 - RNA, 18 nt, Staphylococcus aureus subsp. aureus MW2
uacuaaaaguguuaugaa

SEQ ID NO: 4005002 - RNA, 21 nt, Staphylococcus aureus subsp. aureus MW2
uacuaaaaguguuaugaauua

SEQ ID NO: 4005003 - RNA, 16 nt, Staphylococcus aureus subsp. aureus MW2
uacuaaaauaucaaaa

SEQ ID NO: 4005004 - RNA, 20 nt, Staphylococcus aureus subsp. aureus MW2
uacuaaaaucacuugguaaa

SEQ ID NO: 4005005 - RNA, 14 nt, Staphylococcus aureus subsp. aureus MW2
uacuaaaauggauu

SEQ ID NO: 4005006 - RNA, 17 nt, Staphylococcus aureus subsp. aureus MW2
uacuaaacgauaaauua

SEQ ID NO: 4005007 - RNA, 19 nt, Staphylococcus aureus subsp. aureus MW2
uacuaaacgauaaauuaau

SEQ ID NO: 4005008 - RNA, 17 nt, Staphylococcus aureus subsp. aureus MW2
uacuaaaggaauuucaa

SEQ ID NO: 4005009 - RNA, 19 nt, Staphylococcus aureus subsp. aureus MW2
uacuaaauaaguaguucaa

SEQ ID NO: 4005010 - RNA, 14 nt, Staphylococcus aureus subsp. aureus MW2
uacuaaauugagaa

SEQ ID NO: 4005011 - RNA, 15 nt, Staphylococcus aureus subsp. aureus MW2
uacuaaauugagaag

SEQ ID NO: 4005012 - RNA, 22 nt, Staphylococcus aureus subsp. aureus MW2
uacuaaauugagaaguauuaug

SEQ ID NO: 4005013 - RNA, 18 nt, Staphylococcus aureus subsp. aureus MW2
uacuaacaauuacgacaa

SEQ ID NO: 4005014 - RNA, 14 nt, Staphylococcus aureus subsp. aureus MW2
uacuaauaaugauu

SEQ ID NO: 4005015 - RNA, 13 nt, Staphylococcus aureus subsp. aureus MW2
uacuaauaucuuc

SEQ ID NO: 4005016 - RNA, 15 nt, Staphylococcus aureus subsp. aureus MW2
uacuaaucaauacua

SEQ ID NO: 4005017 - RNA, 13 nt, Staphylococcus aureus subsp. aureus MW2
uacuaauuaaagc

SEQ ID NO: 4005018 - RNA, 20 nt, Staphylococcus aureus subsp. aureus MW2
uacuacaaacuugauuaugu

SEQ ID NO: 4005019 - RNA, 18 nt, Staphylococcus aureus subsp. aureus MW2
uacuacaaagcacaccua

SEQ ID NO: 4005020 - RNA, 21 nt, Staphylococcus aureus subsp. aureus MW2
uacuacacuccccuuaucaaa

SEQ ID NO: 4005021 - RNA, 22 nt, Staphylococcus aureus subsp. aureus MW2
uacuaccguuuuuauauacuug

SEQ ID NO: 4005022 - RNA, 16 nt, Staphylococcus aureus subsp. aureus MW2
uacuacucauuauuaa

SEQ ID NO: 4005023 - RNA, 16 nt, Staphylococcus aureus subsp. aureus MW2
uacuacuuaauuaaua

SEQ ID NO: 4005024 - RNA, 23 nt, Staphylococcus aureus subsp. aureus MW2
uacuacuugauucuacuucaccu

SEQ ID NO: 4005025 - RNA, 14 nt, Staphylococcus aureus subsp. aureus MW2
uacuagaauaacuu

SEQ ID NO: 4005026 - RNA, 16 nt, Staphylococcus aureus subsp. aureus MW2
uacuagaauaacuuga

SEQ ID NO: 4005027 - RNA, 15 nt, Staphylococcus aureus subsp. aureus MW2
uacuaguaauaauag

SEQ ID NO: 4005028 - RNA, 20 nt, Staphylococcus aureus subsp. aureus MW2
uacuauaaaaucaucguauu

SEQ ID NO: 4005029 - RNA, 22 nt, Staphylococcus aureus subsp. aureus MW2
uacuauaaauacgucaucuuua

SEQ ID NO: 4005030 - RNA, 15 nt, Staphylococcus aureus subsp. aureus MW2
uacuauaauaauuaa

SEQ ID NO: 4005031 - RNA, 13 nt, Staphylococcus aureus subsp. aureus MW2
uacuauacaaugu

SEQ ID NO: 4005032 - RNA, 18 nt, Staphylococcus aureus subsp. aureus MW2
uacuauacaauguauuuu

SEQ ID NO: 4005033 - RNA, 21 nt, Staphylococcus aureus subsp. aureus MW2
uacuauacaauguauuuugau

SEQ ID NO: 4005034 - RNA, 13 nt, Staphylococcus aureus subsp. aureus MW2
uacuauacugaug

SEQ ID NO: 4005035 - RNA, 13 nt, Staphylococcus aureus subsp. aureus MW2
uacuauacuuuga

SEQ ID NO: 4005036 - RNA, 15 nt, Staphylococcus aureus subsp. aureus MW2
uacuauauucaauga

SEQ ID NO: 4005037 - RNA, 14 nt, Staphylococcus aureus subsp. aureus MW2
uacuauauuuaaau

SEQ ID NO: 4005038 - RNA, 19 nt, Staphylococcus aureus subsp. aureus MW2
uacuaucuucaucauauuc

SEQ ID NO: 4005039 - RNA, 15 nt, Staphylococcus aureus subsp. aureus MW2
uacuauggcauuauu

SEQ ID NO: 4005040 - RNA, 12 nt, Staphylococcus aureus subsp. aureus MW2
uacuauuaaagg

SEQ ID NO: 4005041 - RNA, 19 nt, Staphylococcus aureus subsp. aureus MW2
uacuauuaaaggaaaucaa

SEQ ID NO: 4005042 - RNA, 15 nt, Staphylococcus aureus subsp. aureus MW2
uacucauauugaaua

SEQ ID NO: 4005043 - RNA, 17 nt, Staphylococcus aureus subsp. aureus MW2
uacucauauugaauacu

SEQ ID NO: 4005044 - RNA, 20 nt, Staphylococcus aureus subsp. aureus MW2
uacucauguaacguaaaaau

SEQ ID NO: 4005045 - RNA, 16 nt, Staphylococcus aureus subsp. aureus MW2
uacuccuuucauacau

SEQ ID NO: 4005046 - RNA, 20 nt, Staphylococcus aureus subsp. aureus MW2
uacucuaaaggaaagccauu

SEQ ID NO: 4005047 - RNA, 14 nt, Staphylococcus aureus subsp. aureus MW2
uacucuaacuuacc

SEQ ID NO: 4005048 - RNA, 16 nt, Staphylococcus aureus subsp. aureus MW2
uacucuaacuuaccau

SEQ ID NO: 4005049 - RNA, 14 nt, Staphylococcus aureus subsp. aureus MW2
uacucuagcggaac

SEQ ID NO: 4005050 - RNA, 19 nt, Staphylococcus aureus subsp. aureus MW2
uacucuauagucaucuguu

SEQ ID NO: 4005051 - RNA, 17 nt, Staphylococcus aureus subsp. aureus MW2
uacucuggucugugaua

SEQ ID NO: 4005052 - RNA, 19 nt, Staphylococcus aureus subsp. aureus MW2
uacucuuuuuaauauuuuu

SEQ ID NO: 4005053 - RNA, 12 nt, Staphylococcus aureus subsp. aureus MW2
uacugaaacaug

SEQ ID NO: 4005054 - RNA, 23 nt, Staphylococcus aureus subsp. aureus MW2
uacugcaccgauaucauauaaug

SEQ ID NO: 4005055 - RNA, 22 nt, Staphylococcus aureus subsp. aureus MW2
uacugcccaauguguuuaacuu

SEQ ID NO: 4005056 - RNA, 13 nt, Staphylococcus aureus subsp. aureus MW2
uacugcuguugaa

SEQ ID NO: 4005057 - RNA, 15 nt, Staphylococcus aureus subsp. aureus MW2
uacugcuguuuuuau

SEQ ID NO: 4005058 - RNA, 21 nt, Staphylococcus aureus subsp. aureus MW2
uacuguaguacuauagucauu

SEQ ID NO: 4005059 - RNA, 15 nt, Staphylococcus aureus subsp. aureus MW2
uacugugaaaauacc

SEQ ID NO: 4005060 - RNA, 16 nt, Staphylococcus aureus subsp. aureus MW2
uacugugaaaauacca

SEQ ID NO: 4005061 - RNA, 16 nt, Staphylococcus aureus subsp. aureus MW2
uacuguuuaaauaaaa

SEQ ID NO: 4005062 - RNA, 14 nt, Staphylococcus aureus subsp. aureus MW2
uacuguuuucauuu

SEQ ID NO: 4005063 - RNA, 18 nt, Staphylococcus aureus subsp. aureus MW2
uacuuaaaauaaguauuu

SEQ ID NO: 4005064 - RNA, 18 nt, Staphylococcus aureus subsp. aureus MW2
uacuuaaagcuaauaaug

SEQ ID NO: 4005065 - RNA, 16 nt, Staphylococcus aureus subsp. aureus MW2
uacuuaauuaauaauu

SEQ ID NO: 4005066 - RNA, 21 nt, Staphylococcus aureus subsp. aureus MW2
uacuuaauuuaaaucuguacu

SEQ ID NO: 4005067 - RNA, 18 nt, Staphylococcus aureus subsp. aureus MW2
uacuuacgaauagaaaau

SEQ ID NO: 4005068 - RNA, 17 nt, Staphylococcus aureus subsp. aureus MW2
uacuuacgccaaucaca

SEQ ID NO: 4005069 - RNA, 15 nt, Staphylococcus aureus subsp. aureus MW2
uacuuauucaaaugu

SEQ ID NO: 4005070 - RNA, 23 nt, Staphylococcus aureus subsp. aureus MW2
uacuuauucaaauguuuacuguc

SEQ ID NO: 4005071 - RNA, 13 nt, Staphylococcus aureus subsp. aureus MW2
uacuuauuucuuu

SEQ ID NO: 4005072 - RNA, 19 nt, Staphylococcus aureus subsp. aureus MW2
uacuuauuucuuuucauua

SEQ ID NO: 4005073 - RNA, 14 nt, Staphylococcus aureus subsp. aureus MW2
uacuucaauaacaa

SEQ ID NO: 4005074 - RNA, 20 nt, Staphylococcus aureus subsp. aureus MW2
uacuucaguuugguuugcuu

SEQ ID NO: 4005075 - RNA, 14 nt, Staphylococcus aureus subsp. aureus MW2
uacuuccauugcuu

SEQ ID NO: 4005076 - RNA, 21 nt, Staphylococcus aureus subsp. aureus MW2
uacuucuaacgcaacugaaac

SEQ ID NO: 4005077 - RNA, 17 nt, Staphylococcus aureus subsp. aureus MW2
uagauacuucuuuagca

SEQ ID NO: 4005078 - RNA, 13 nt, Staphylococcus aureus subsp. aureus MW2
uagauagcggauu

SEQ ID NO: 4005079 - RNA, 17 nt, Staphylococcus aureus subsp. aureus MW2
uagauagcggauuuauu

SEQ ID NO: 4005080 - RNA, 22 nt, Staphylococcus aureus subsp. aureus MW2
uagauaucuuaaucuaaaaaua

SEQ ID NO: 4005081 - RNA, 21 nt, Staphylococcus aureus subsp. aureus MW2
uagaucuaucgguauaucuaa

SEQ ID NO: 4005082 - RNA, 15 nt, Staphylococcus aureus subsp. aureus MW2
uagaugaaaauuuaa

SEQ ID NO: 4005083 - RNA, 11 nt, Staphylococcus aureus subsp. aureus MW2
uagaugaaaug

SEQ ID NO: 4005084 - RNA, 14 nt, Staphylococcus aureus subsp. aureus MW2
uagaugauacauuc

SEQ ID NO: 4005085 - RNA, 11 nt, Staphylococcus aureus subsp. aureus MW2
uagaugcauaa

SEQ ID NO: 4005086 - RNA, 19 nt, Staphylococcus aureus subsp. aureus MW2
uagaugcauaaaaaaagaa

SEQ ID NO: 4005087 - RNA, 19 nt, Staphylococcus aureus subsp. aureus MW2
uagaugcuggcuuaguaag

SEQ ID NO: 4005088 - RNA, 18 nt, Staphylococcus aureus subsp. aureus MW2
uagaugcuugaccuucag

SEQ ID NO: 4005089 - RNA, 20 nt, Staphylococcus aureus subsp. aureus MW2
uagauucugauacagaacca

SEQ ID NO: 4005090 - RNA, 12 nt, Staphylococcus aureus subsp. aureus MW2
uagauucuuuuc

SEQ ID NO: 4005091 - RNA, 17 nt, Staphylococcus aureus subsp. aureus MW2
uagauucuuuucugaau

SEQ ID NO: 4005092 - RNA, 13 nt, Staphylococcus aureus subsp. aureus MW2
uagauugaaaaaa

SEQ ID NO: 4005093 - RNA, 18 nt, Staphylococcus aureus subsp. aureus MW2
uagauugacuaaguuugu

SEQ ID NO: 4005094 - RNA, 16 nt, Staphylococcus aureus subsp. aureus MW2
uagauugauaucccua

SEQ ID NO: 4005095 - RNA, 16 nt, Staphylococcus aureus subsp. aureus MW2
uagauugauuguauuu

SEQ ID NO: 4005096 - RNA, 18 nt, Staphylococcus aureus subsp. aureus MW2
uagauuguauguuauagc

SEQ ID NO: 4005097 - RNA, 18 nt, Staphylococcus aureus subsp. aureus MW2
uagauuguauuuaauaag

SEQ ID NO: 4005098 - RNA, 15 nt, Staphylococcus aureus subsp. aureus MW2
uagauuuaaaauguc

SEQ ID NO: 4005099 - RNA, 13 nt, Staphylococcus aureus subsp. aureus MW2
uagauuuaggaga

SEQ ID NO: 4005100 - RNA, 21 nt, Staphylococcus aureus subsp. aureus MW2
uagauuucaaacgauuuucaa

SEQ ID NO: 4005101 - RNA, 14 nt, Staphylococcus aureus subsp. aureus MW2
uagauuuguguguc

SEQ ID NO: 4005102 - RNA, 12 nt, Staphylococcus aureus subsp. aureus MW2
uagauuuuaaac

SEQ ID NO: 4005103 - RNA, 14 nt, Staphylococcus aureus subsp. aureus MW2
uagauuuuauaaaa

SEQ ID NO: 4005104 - RNA, 14 nt, Staphylococcus aureus subsp. aureus MW2
uagauuuuauauaa

SEQ ID NO: 4005105 - RNA, 17 nt, Staphylococcus aureus subsp. aureus MW2
uagauuuuauauaaaaa

SEQ ID NO: 4005106 - RNA, 18 nt, Staphylococcus aureus subsp. aureus MW2
uagauuuuaugcuuuacu

SEQ ID NO: 4005107 - RNA, 19 nt, Staphylococcus aureus subsp. aureus MW2
uagauuuuguauuagcauc

SEQ ID NO: 4005108 - RNA, 14 nt, Staphylococcus aureus subsp. aureus MW2
uagcaaaaauacuu

SEQ ID NO: 4005109 - RNA, 15 nt, Staphylococcus aureus subsp. aureus MW2
uagcaaaaauacuuu

SEQ ID NO: 4005110 - RNA, 16 nt, Staphylococcus aureus subsp. aureus MW2
uagcaaaauuauguaa

SEQ ID NO: 4005111 - RNA, 21 nt, Staphylococcus aureus subsp. aureus MW2
uagcaaaauuauguaaaaaau

SEQ ID NO: 4005112 - RNA, 22 nt, Staphylococcus aureus subsp. aureus MW2
uagcaaauauuauuaaaucaaa

SEQ ID NO: 4005113 - RNA, 15 nt, Staphylococcus aureus subsp. aureus MW2
uagcaaauauuucug

SEQ ID NO: 4005114 - RNA, 20 nt, Staphylococcus aureus subsp. aureus MW2
uagcaaccauauuuuuagaa

SEQ ID NO: 4005115 - RNA, 20 nt, Staphylococcus aureus subsp. aureus MW2
uagcaacugaucauuuucau

SEQ ID NO: 4005116 - RNA, 19 nt, Staphylococcus aureus subsp. aureus MW2
uagcaagaauagauugauu

SEQ ID NO: 4005117 - RNA, 12 nt, Staphylococcus aureus subsp. aureus MW2
uagcaauaucau

SEQ ID NO: 4005118 - RNA, 14 nt, Staphylococcus aureus subsp. aureus MW2
uagcaauaucauca

SEQ ID NO: 4005119 - RNA, 16 nt, Staphylococcus aureus subsp. aureus MW2
uagcaaugaauuaaua

SEQ ID NO: 4005120 - RNA, 16 nt, Staphylococcus aureus subsp. aureus MW2
uagcacgcuuauugaa

SEQ ID NO: 4005121 - RNA, 18 nt, Staphylococcus aureus subsp. aureus MW2
uagcacgcuuauugaaaa

SEQ ID NO: 4005122 - RNA, 21 nt, Staphylococcus aureus subsp. aureus MW2
uagcacgcuuauugaaaagau

SEQ ID NO: 4005123 - RNA, 16 nt, Staphylococcus aureus subsp. aureus MW2
uagcacugaaaucuag

SEQ ID NO: 4005124 - RNA, 22 nt, Staphylococcus aureus subsp. aureus MW2
uagcacuuggauuuuaauuauu

SEQ ID NO: 4005125 - RNA, 12 nt, Staphylococcus aureus subsp. aureus MW2
uagcauaaaauu

SEQ ID NO: 4005126 - RNA, 15 nt, Staphylococcus aureus subsp. aureus MW2
uagcauaaaauuucu

SEQ ID NO: 4005127 - RNA, 16 nt, Staphylococcus aureus subsp. aureus MW2
uagcauauugauguuc

SEQ ID NO: 4005128 - RNA, 19 nt, Staphylococcus aureus subsp. aureus MW2
uagcaucaaaaauaaaaau

SEQ ID NO: 4005129 - RNA, 20 nt, Staphylococcus aureus subsp. aureus MW2
uagcaucuuuaccauauaau

SEQ ID NO: 4005130 - RNA, 19 nt, Staphylococcus aureus subsp. aureus MW2
uagcauguuauauuaugaa

SEQ ID NO: 4005131 - RNA, 12 nt, Staphylococcus aureus subsp. aureus MW2
uagccaaauaaa

SEQ ID NO: 4005132 - RNA, 21 nt, Staphylococcus aureus subsp. aureus MW2
uagccaaauaaauuuugacgc

SEQ ID NO: 4005133 - RNA, 13 nt, Staphylococcus aureus subsp. aureus MW2
uagccaauaaaau

SEQ ID NO: 4005134 - RNA, 16 nt, Staphylococcus aureus subsp. aureus MW2
uagccaauaucauauu

SEQ ID NO: 4005135 - RNA, 23 nt, Staphylococcus aureus subsp. aureus MW2
uagccaaugcuuccaucacauca

SEQ ID NO: 4005136 - RNA, 15 nt, Staphylococcus aureus subsp. aureus MW2
uagccauaucauauu

SEQ ID NO: 4005137 - RNA, 12 nt, Staphylococcus aureus subsp. aureus MW2
uagccauuucaa

SEQ ID NO: 4005138 - RNA, 13 nt, Staphylococcus aureus subsp. aureus MW2
uagccauuucaau

SEQ ID NO: 4005139 - RNA, 17 nt, Staphylococcus aureus subsp. aureus MW2
uagccccaguauagaag

SEQ ID NO: 4005140 - RNA, 15 nt, Staphylococcus aureus subsp. aureus MW2
uagccuagauaccaa

SEQ ID NO: 4005141 - RNA, 16 nt, Staphylococcus aureus subsp. aureus MW2
uagccuagauaccaaa

SEQ ID NO: 4005142 - RNA, 20 nt, Staphylococcus aureus subsp. aureus MW2
uagcgaaaguaucuaugaaa

SEQ ID NO: 4005143 - RNA, 20 nt, Staphylococcus aureus subsp. aureus MW2
uagcgauaagcaugauaaaa

SEQ ID NO: 4005144 - RNA, 22 nt, Staphylococcus aureus subsp. aureus MW2
uagcgauaagcaugauaaaaau

SEQ ID NO: 4005145 - RNA, 22 nt, Staphylococcus aureus subsp. aureus MW2
uagcgcaagagauaagaaaaua

SEQ ID NO: 4005146 - RNA, 22 nt, Staphylococcus aureus subsp. aureus MW2
uagcuaaugcauuauuauaaua

SEQ ID NO: 4005147 - RNA, 18 nt, Staphylococcus aureus subsp. aureus MW2
uagcuauauuuuuguauu

SEQ ID NO: 4005148 - RNA, 13 nt, Staphylococcus aureus subsp. aureus MW2
uagcuauuaaaau

SEQ ID NO: 4005149 - RNA, 14 nt, Staphylococcus aureus subsp. aureus MW2
uagcuccuccaaag

SEQ ID NO: 4005150 - RNA, 12 nt, Staphylococcus aureus subsp. aureus MW2
uagcucuucuuu

SEQ ID NO: 4005151 - RNA, 15 nt, Staphylococcus aureus subsp. aureus MW2
uagcucuuuuuugau

SEQ ID NO: 4005152 - RNA, 16 nt, Staphylococcus aureus subsp. aureus MW2
uagcuggcuuuuuaau

SEQ ID NO: 4005153 - RNA, 20 nt, Staphylococcus aureus subsp. aureus MW2
uagcuggcuuuuuaauuguu

SEQ ID NO: 4005154 - RNA, 16 nt, Staphylococcus aureus subsp. aureus MW2
uagcugggaauacagc

SEQ ID NO: 4005155 - RNA, 13 nt, Staphylococcus aureus subsp. aureus MW2
uagcuuaauaauu

SEQ ID NO: 4005156 - RNA, 13 nt, Staphylococcus aureus subsp. aureus MW2
uagcuuaaugcau

SEQ ID NO: 4005157 - RNA, 15 nt, Staphylococcus aureus subsp. aureus MW2
uagcuuauuuagaaa

SEQ ID NO: 4005158 - RNA, 21 nt, Staphylococcus aureus subsp. aureus MW2
uagcuucuuaaaucaacauca

SEQ ID NO: 4005159 - RNA, 13 nt, Staphylococcus aureus subsp. aureus MW2
uagcuugaauaau

SEQ ID NO: 4005160 - RNA, 18 nt, Staphylococcus aureus subsp. aureus MW2
uagcuugaauaauauauu

SEQ ID NO: 4005161 - RNA, 16 nt, Staphylococcus aureus subsp. aureus MW2
uagcuuucguuucuuu

SEQ ID NO: 4005162 - RNA, 16 nt, Staphylococcus aureus subsp. aureus MW2
uagcuuucuuuuucau

SEQ ID NO: 4005163 - RNA, 16 nt, Staphylococcus aureus subsp. aureus MW2
uaggaauccaauuucu

SEQ ID NO: 4005164 - RNA, 18 nt, Staphylococcus aureus subsp. aureus MW2
uaggaaugacauuuaaag

SEQ ID NO: 4005165 - RNA, 19 nt, Staphylococcus aureus subsp. aureus MW2
uaggaaugacauuuaaaga

SEQ ID NO: 4005166 - RNA, 21 nt, Staphylococcus aureus subsp. aureus MW2
uaguugccccuagcaaaaaua

SEQ ID NO: 4005167 - RNA, 20 nt, Staphylococcus aureus subsp. aureus MW2
uaguuguaucguuaauugga

SEQ ID NO: 4005168 - RNA, 12 nt, Staphylococcus aureus subsp. aureus MW2
uaguuguuuauu

SEQ ID NO: 4005169 - RNA, 23 nt, Staphylococcus aureus subsp. aureus MW2
uaguuuacggggugcuuuuuaug

SEQ ID NO: 4005170 - RNA, 14 nt, Staphylococcus aureus subsp. aureus MW2
uaguuuagguugau

SEQ ID NO: 4005171 - RNA, 14 nt, Staphylococcus aureus subsp. aureus MW2
uaguuuuuaaaauu

SEQ ID NO: 4005172 - RNA, 18 nt, Staphylococcus aureus subsp. aureus MW2
uaguuuuuacguuuucua

SEQ ID NO: 4005173 - RNA, 22 nt, Staphylococcus aureus subsp. aureus MW2
uauaaaaaaccguaauuuuaau

SEQ ID NO: 4005174 - RNA, 20 nt, Staphylococcus aureus subsp. aureus MW2
uauaaaaaagcgccaauaca

SEQ ID NO: 4005175 - RNA, 21 nt, Staphylococcus aureus subsp. aureus MW2
uauaaaaaccaguuugauuaa

SEQ ID NO: 4005176 - RNA, 23 nt, Staphylococcus aureus subsp. aureus MW2
uauaaaaagaauaugauauugau

SEQ ID NO: 4005177 - RNA, 19 nt, Staphylococcus aureus subsp. aureus MW2
uauaaaaagauauaagaaa

SEQ ID NO: 4005178 - RNA, 20 nt, Staphylococcus aureus subsp. aureus MW2
uauaaaaaguuauuuaaguu

SEQ ID NO: 4005179 - RNA, 13 nt, Staphylococcus aureus subsp. aureus MW2
uauaaaaguacuu

SEQ ID NO: 4005180 - RNA, 14 nt, Staphylococcus aureus subsp. aureus MW2
uauaaaagucagcg

SEQ ID NO: 4005181 - RNA, 21 nt, Staphylococcus aureus subsp. aureus MW2
uauaaaauaaugcuuauuaaa

SEQ ID NO: 4005182 - RNA, 23 nt, Staphylococcus aureus subsp. aureus MW2
uauaaaauaaugcuuauuaaaau

SEQ ID NO: 4005183 - RNA, 23 nt, Staphylococcus aureus subsp. aureus MW2
uauaaaauggugcgaauaauaau

SEQ ID NO: 4005184 - RNA, 12 nt, Staphylococcus aureus subsp. aureus MW2
uauaaaauucac

SEQ ID NO: 4005185 - RNA, 21 nt, Staphylococcus aureus subsp. aureus MW2
uauaaacaauuacaaaaucac

SEQ ID NO: 4005186 - RNA, 13 nt, Staphylococcus aureus subsp. aureus MW2
uauaaacauuuau

SEQ ID NO: 4005187 - RNA, 17 nt, Staphylococcus aureus subsp. aureus MW2
uauaaacgcaaauuaaa

SEQ ID NO: 4005188 - RNA, 17 nt, Staphylococcus aureus subsp. aureus MW2
uauaaacgucacuuuau

SEQ ID NO: 4005189 - RNA, 22 nt, Staphylococcus aureus subsp. aureus MW2
uauaaacgucacuuuauuaaau

SEQ ID NO: 4005190 - RNA, 14 nt, Staphylococcus aureus subsp. aureus MW2
uauaaacuauuaaa

SEQ ID NO: 4005191 - RNA, 15 nt, Staphylococcus aureus subsp. aureus MW2
uauaaacuauuaaau

SEQ ID NO: 4005192 - RNA, 10 nt, Staphylococcus aureus subsp. aureus MW2
uauaaagaau

SEQ ID NO: 4005193 - RNA, 23 nt, Staphylococcus aureus subsp. aureus MW2
uauaaagaaugauuuauaaaaaa

SEQ ID NO: 4005194 - RNA, 18 nt, Staphylococcus aureus subsp. aureus MW2
uauaaaggaauagcuaca

SEQ ID NO: 4005195 - RNA, 18 nt, Staphylococcus aureus subsp. aureus MW2
uauaaaguugacaauaca

SEQ ID NO: 4005196 - RNA, 13 nt, Staphylococcus aureus subsp. aureus MW2
uauaaauaaaaau

SEQ ID NO: 4005197 - RNA, 18 nt, Staphylococcus aureus subsp. aureus MW2
uauaaauaaaaauacaua

SEQ ID NO: 4005198 - RNA, 20 nt, Staphylococcus aureus subsp. aureus MW2
uauaaauaaaaauacauaau

SEQ ID NO: 4005199 - RNA, 19 nt, Staphylococcus aureus subsp. aureus MW2
uauaaauaaaaauauaucu

SEQ ID NO: 4005200 - RNA, 14 nt, Staphylococcus aureus subsp. aureus MW2
uauaaauaaacaua

SEQ ID NO: 4005201 - RNA, 22 nt, Staphylococcus aureus subsp. aureus MW2
uauaaaucauucuuuauagaaa

SEQ ID NO: 4005202 - RNA, 20 nt, Staphylococcus aureus subsp. aureus MW2
uauaaaugauuucuucauua

SEQ ID NO: 4005203 - RNA, 19 nt, Staphylococcus aureus subsp. aureus MW2
uauaaaugcagcuguauaa

SEQ ID NO: 4005204 - RNA, 19 nt, Staphylococcus aureus subsp. aureus MW2
uauaaauguuuauaucuuu

SEQ ID NO: 4005205 - RNA, 22 nt, Staphylococcus aureus subsp. aureus MW2
uauaaauguuuauaucuuuuau

SEQ ID NO: 4005206 - RNA, 17 nt, Staphylococcus aureus subsp. aureus MW2
uauaaauuaaaugcaau

SEQ ID NO: 4005207 - RNA, 15 nt, Staphylococcus aureus subsp. aureus MW2
uauaaauuuugaauu

SEQ ID NO: 4005208 - RNA, 18 nt, Staphylococcus aureus subsp. aureus MW2
uauaacaauaguuuucuu

SEQ ID NO: 4005209 - RNA, 16 nt, Staphylococcus aureus subsp. aureus MW2
uauaacaccaauuaaa

SEQ ID NO: 4005210 - RNA, 14 nt, Staphylococcus aureus subsp. aureus MW2
uauaacauuaaaau

SEQ ID NO: 4005211 - RNA, 16 nt, Staphylococcus aureus subsp. aureus MW2
uauaacauucuucaaa

SEQ ID NO: 4005212 - RNA, 20 nt, Staphylococcus aureus subsp. aureus MW2
uauaacauucuucaaaaaau

SEQ ID NO: 4005213 - RNA, 21 nt, Staphylococcus aureus subsp. aureus MW2
uauaacauucuucaaaaaaua

SEQ ID NO: 4005214 - RNA, 22 nt, Staphylococcus aureus subsp. aureus MW2
uauaaccauaguaacaaaauga

SEQ ID NO: 4005215 - RNA, 21 nt, Staphylococcus aureus subsp. aureus MW2
uauaacccuaauguguggauu

SEQ ID NO: 4005216 - RNA, 14 nt, Staphylococcus aureus subsp. aureus MW2
uauaaccgcuacaa

SEQ ID NO: 4005217 - RNA, 15 nt, Staphylococcus aureus subsp. aureus MW2
uauaaccuauuaaau

SEQ ID NO: 4005218 - RNA, 17 nt, Staphylococcus aureus subsp. aureus MW2
uauaaccuauuaaaucu

SEQ ID NO: 4005219 - RNA, 22 nt, Staphylococcus aureus subsp. aureus MW2
uauaaccuuaauuauuuucucg

SEQ ID NO: 4005220 - RNA, 17 nt, Staphylococcus aureus subsp. aureus MW2
uauaaccuuguucuuua

SEQ ID NO: 4005221 - RNA, 24 nt, Staphylococcus aureus subsp. aureus MW2
uauaaccuuguucuuuacuccaaa

SEQ ID NO: 4005222 - RNA, 15 nt, Staphylococcus aureus subsp. aureus MW2
uauaacgauagauuu

SEQ ID NO: 4005223 - RNA, 16 nt, Staphylococcus aureus subsp. aureus MW2
uauaacucuaaauaua

SEQ ID NO: 4005224 - RNA, 18 nt, Staphylococcus aureus subsp. aureus MW2
uauaacugauaauacugu

SEQ ID NO: 4005225 - RNA, 13 nt, Staphylococcus aureus subsp. aureus MW2
uauaacugcaugu

SEQ ID NO: 4005226 - RNA, 13 nt, Staphylococcus aureus subsp. aureus MW2
uauaacuuuaaaa

SEQ ID NO: 4005227 - RNA, 17 nt, Staphylococcus aureus subsp. aureus MW2
uauaagauagauaaauc

SEQ ID NO: 4005228 - RNA, 15 nt, Staphylococcus aureus subsp. aureus MW2
uauaagauaguuuga

SEQ ID NO: 4005229 - RNA, 21 nt, Staphylococcus aureus subsp. aureus MW2
uauaagauaguuugagaaaau

SEQ ID NO: 4005230 - RNA, 18 nt, Staphylococcus aureus subsp. aureus MW2
uauaagccuuuucaaaca

SEQ ID NO: 4005231 - RNA, 20 nt, Staphylococcus aureus subsp. aureus MW2
uauaagccuuuucaaacaua

SEQ ID NO: 4005232 - RNA, 14 nt, Staphylococcus aureus subsp. aureus MW2
uauaaggauaucug

SEQ ID NO: 4005233 - RNA, 19 nt, Staphylococcus aureus subsp. aureus MW2
uauaaguaagcguaauauu

SEQ ID NO: 4005234 - RNA, 23 nt, Staphylococcus aureus subsp. aureus MW2
uauaaguaagcguaauauuuaag

SEQ ID NO: 4005235 - RNA, 19 nt, Staphylococcus aureus subsp. aureus MW2
uauaaguaaucauaauaau

SEQ ID NO: 4005236 - RNA, 12 nt, Staphylococcus aureus subsp. aureus MW2
uauaaguacaaa

SEQ ID NO: 4005237 - RNA, 14 nt, Staphylococcus aureus subsp. aureus MW2
uauaaguacaaaua

SEQ ID NO: 4005238 - RNA, 15 nt, Staphylococcus aureus subsp. aureus MW2
uauaaguacaaauaa

SEQ ID NO: 4005239 - RNA, 18 nt, Staphylococcus aureus subsp. aureus MW2
uauaaguagcucaaaaca

SEQ ID NO: 4005240 - RNA, 21 nt, Staphylococcus aureus subsp. aureus MW2
uauaaguagcucaaaacaauu

SEQ ID NO: 4005241 - RNA, 23 nt, Staphylococcus aureus subsp. aureus MW2
uauaaguagugauuuuuuacauu

SEQ ID NO: 4005242 - RNA, 18 nt, Staphylococcus aureus subsp. aureus MW2
uauaaguauuuuaggguu

SEQ ID NO: 4005243 - RNA, 18 nt, Staphylococcus aureus subsp. aureus MW2
uauaagucugauuugaua

SEQ ID NO: 4005244 - RNA, 14 nt, Staphylococcus aureus subsp. aureus MW2
uauaaguuaaaaau

SEQ ID NO: 4005245 - RNA, 18 nt, Staphylococcus aureus subsp. aureus MW2
uauaaguuaaaaauguaa

SEQ ID NO: 4005246 - RNA, 14 nt, Staphylococcus aureus subsp. aureus MW2
uauaaguuaaaauu

SEQ ID NO: 4005247 - RNA, 18 nt, Staphylococcus aureus subsp. aureus MW2
uauaaguugcauauaaaa

SEQ ID NO: 4005248 - RNA, 19 nt, Staphylococcus aureus subsp. aureus MW2
uauaaguugcauauaaaaa

SEQ ID NO: 4005249 - RNA, 19 nt, Staphylococcus aureus subsp. aureus MW2
uauaaguuuguuuguaaaa

SEQ ID NO: 4005250 - RNA, 20 nt, Staphylococcus aureus subsp. aureus MW2
uauaauaaccuacauuaauu

SEQ ID NO: 4005251 - RNA, 21 nt, Staphylococcus aureus subsp. aureus MW2
uauaauaaccuacauuaauuu

SEQ ID NO: 4005252 - RNA, 16 nt, Staphylococcus aureus subsp. aureus MW2
uauaauaauauugaaa

SEQ ID NO: 4005253 - RNA, 17 nt, Staphylococcus aureus subsp. aureus MW2
uauaauaauauugaaag

SEQ ID NO: 4005254 - RNA, 13 nt, Staphylococcus aureus subsp. aureus MW2
uauagucauucau

SEQ ID NO: 4005255 - RNA, 16 nt, Staphylococcus aureus subsp. aureus MW2
uauagucuuaaacaua

SEQ ID NO: 4005256 - RNA, 18 nt, Staphylococcus aureus subsp. aureus MW2
uauagucuuaaacauaac

SEQ ID NO: 4005257 - RNA, 13 nt, Staphylococcus aureus subsp. aureus MW2
uauaguuuagauu

SEQ ID NO: 4005258 - RNA, 14 nt, Staphylococcus aureus subsp. aureus MW2
uauauaaaaacugu

SEQ ID NO: 4005259 - RNA, 19 nt, Staphylococcus aureus subsp. aureus MW2
uauauaaaaucauuaauaa

SEQ ID NO: 4005260 - RNA, 11 nt, Staphylococcus aureus subsp. aureus MW2
uauauaaauua

SEQ ID NO: 4005261 - RNA, 20 nt, Staphylococcus aureus subsp. aureus MW2
uauauaacaaguacaauaau

SEQ ID NO: 4005262 - RNA, 16 nt, Staphylococcus aureus subsp. aureus MW2
uauauaauuuauaaaa

SEQ ID NO: 4005263 - RNA, 15 nt, Staphylococcus aureus subsp. aureus MW2
uauauacaaauaaac

SEQ ID NO: 4005264 - RNA, 16 nt, Staphylococcus aureus subsp. aureus MW2
uauauacaaauaaaca

SEQ ID NO: 4005265 - RNA, 17 nt, Staphylococcus aureus subsp. aureus MW2
uauauacaaauaaacac

SEQ ID NO: 4005266 - RNA, 16 nt, Staphylococcus aureus subsp. aureus MW2
uauauaccuugaacau

SEQ ID NO: 4005267 - RNA, 23 nt, Staphylococcus aureus subsp. aureus MW2
uauauacgauugaguugaaaaua

SEQ ID NO: 4005268 - RNA, 13 nt, Staphylococcus aureus subsp. aureus MW2
uauauacucacca

SEQ ID NO: 4005269 - RNA, 15 nt, Staphylococcus aureus subsp. aureus MW2
uauauaguaaaauaa

SEQ ID NO: 4005270 - RNA, 20 nt, Staphylococcus aureus subsp. aureus MW2
uauauaguaggguauugaaa

SEQ ID NO: 4005271 - RNA, 14 nt, Staphylococcus aureus subsp. aureus MW2
uauauauauuaaag

SEQ ID NO: 4005272 - RNA, 12 nt, Staphylococcus aureus subsp. aureus MW2
uauauaucaaau

SEQ ID NO: 4005273 - RNA, 16 nt, Staphylococcus aureus subsp. aureus MW2
uauauaucaaauacau

SEQ ID NO: 4005274 - RNA, 18 nt, Staphylococcus aureus subsp. aureus MW2
uauauaucaaauacauuu

SEQ ID NO: 4005275 - RNA, 17 nt, Staphylococcus aureus subsp. aureus MW2
uauauauuaucguaauu

SEQ ID NO: 4005276 - RNA, 20 nt, Staphylococcus aureus subsp. aureus MW2
uauauauucguuacaaauga

SEQ ID NO: 4005277 - RNA, 15 nt, Staphylococcus aureus subsp. aureus MW2
uauauauuuaaauca

SEQ ID NO: 4005278 - RNA, 18 nt, Staphylococcus aureus subsp. aureus MW2
uauauauuuaaaucaaua

SEQ ID NO: 4005279 - RNA, 23 nt, Staphylococcus aureus subsp. aureus MW2
uauaucacaacacauaaauuaag

SEQ ID NO: 4005280 - RNA, 19 nt, Staphylococcus aureus subsp. aureus MW2
uauauccauucuuuuucaa

SEQ ID NO: 4005281 - RNA, 17 nt, Staphylococcus aureus subsp. aureus MW2
uauauccgcaucuuuug

SEQ ID NO: 4005282 - RNA, 15 nt, Staphylococcus aureus subsp. aureus MW2
uauaucgcuuuugaa

SEQ ID NO: 4005283 - RNA, 16 nt, Staphylococcus aureus subsp. aureus MW2
uauaucuaaaugauca

SEQ ID NO: 4005284 - RNA, 24 nt, Staphylococcus aureus subsp. aureus MW2
uauaucuaauucguaauuuaugau

SEQ ID NO: 4005285 - RNA, 21 nt, Staphylococcus aureus subsp. aureus MW2
uauaucuauuuaucauacuuc

SEQ ID NO: 4005286 - RNA, 15 nt, Staphylococcus aureus subsp. aureus MW2
uauaucuuaugauac

SEQ ID NO: 4005287 - RNA, 12 nt, Staphylococcus aureus subsp. aureus MW2
uauaucuuuauu

SEQ ID NO: 4005288 - RNA, 13 nt, Staphylococcus aureus subsp. aureus MW2
uauaucuuuuaua

SEQ ID NO: 4005289 - RNA, 22 nt, Staphylococcus aureus subsp. aureus MW2
uauaucuuuuuuauguuuugaa

SEQ ID NO: 4005290 - RNA, 14 nt, Staphylococcus aureus subsp. aureus MW2
uauaugaauuuuau

SEQ ID NO: 4005291 - RNA, 17 nt, Staphylococcus aureus subsp. aureus MW2
uauaugauaaauauugu

SEQ ID NO: 4005292 - RNA, 17 nt, Staphylococcus aureus subsp. aureus MW2
uauaugauguucaauau

SEQ ID NO: 4005293 - RNA, 21 nt, Staphylococcus aureus subsp. aureus MW2
uauauggagcuacccuauuuu

SEQ ID NO: 4005294 - RNA, 20 nt, Staphylococcus aureus subsp. aureus MW2
uauauguauaacaauauuaa

SEQ ID NO: 4005295 - RNA, 14 nt, Staphylococcus aureus subsp. aureus MW2
uauauuaaaguaaa

SEQ ID NO: 4005296 - RNA, 14 nt, Staphylococcus aureus subsp. aureus MW2
uauauuaaauacua

SEQ ID NO: 4005297 - RNA, 17 nt, Staphylococcus aureus subsp. aureus MW2
uauauuaaauacuauau

SEQ ID NO: 4005298 - RNA, 21 nt, Staphylococcus aureus subsp. aureus MW2
uauauuaauauuugauuauuc

SEQ ID NO: 4005299 - RNA, 18 nt, Staphylococcus aureus subsp. aureus MW2
uauauuacccuccuauua

SEQ ID NO: 4005300 - RNA, 22 nt, Staphylococcus aureus subsp. aureus MW2
uauauuacuaaccuauuaaaau

SEQ ID NO: 4005301 - RNA, 17 nt, Staphylococcus aureus subsp. aureus MW2
uauauuaguagaaaccu

SEQ ID NO: 4005302 - RNA, 14 nt, Staphylococcus aureus subsp. aureus MW2
uauauuaguauaau

SEQ ID NO: 4005303 - RNA, 17 nt, Staphylococcus aureus subsp. aureus MW2
uauauuaucauugauau

SEQ ID NO: 4005304 - RNA, 12 nt, Staphylococcus aureus subsp. aureus MW2
uauauuaugaac

SEQ ID NO: 4005305 - RNA, 22 nt, Staphylococcus aureus subsp. aureus MW2
uauauuaugaacaugaaauuaa

SEQ ID NO: 4005306 - RNA, 23 nt, Staphylococcus aureus subsp. aureus MW2
uauauuaugaacaugaaauuaau

SEQ ID NO: 4005307 - RNA, 15 nt, Staphylococcus aureus subsp. aureus MW2
uauauuccauuucaa

SEQ ID NO: 4005308 - RNA, 20 nt, Staphylococcus aureus subsp. aureus MW2
uauauucggauccaaucuaa

SEQ ID NO: 4005309 - RNA, 17 nt, Staphylococcus aureus subsp. aureus MW2
uauauucguuacaaaug

SEQ ID NO: 4005310 - RNA, 15 nt, Staphylococcus aureus subsp. aureus MW2
uauauucuaauugca

SEQ ID NO: 4005311 - RNA, 23 nt, Staphylococcus aureus subsp. aureus MW2
uauauugacugccugacauucau

SEQ ID NO: 4005312 - RNA, 16 nt, Staphylococcus aureus subsp. aureus MW2
uauauugauagcaccg

SEQ ID NO: 4005313 - RNA, 23 nt, Staphylococcus aureus subsp. aureus MW2
uauauugcacauaaaaaauguga

SEQ ID NO: 4005314 - RNA, 22 nt, Staphylococcus aureus subsp. aureus MW2
uauauuggcaguucugaaacau

SEQ ID NO: 4005315 - RNA, 19 nt, Staphylococcus aureus subsp. aureus MW2
uauauuggcgggccccaac

SEQ ID NO: 4005316 - RNA, 21 nt, Staphylococcus aureus subsp. aureus MW2
uauauuguauuuuauuuauuu

SEQ ID NO: 4005317 - RNA, 17 nt, Staphylococcus aureus subsp. aureus MW2
uauauuuaaacucucua

SEQ ID NO: 4005318 - RNA, 18 nt, Staphylococcus aureus subsp. aureus MW2
uauauuuaaaucaauauu

SEQ ID NO: 4005319 - RNA, 14 nt, Staphylococcus aureus subsp. aureus MW2
uauauuuaaauugg

SEQ ID NO: 4005320 - RNA, 12 nt, Staphylococcus aureus subsp. aureus MW2
uauauuuaauuu

SEQ ID NO: 4005321 - RNA, 12 nt, Staphylococcus aureus subsp. aureus MW2
uauauuuagauc

SEQ ID NO: 4005322 - RNA, 23 nt, Staphylococcus aureus subsp. aureus MW2
uauauuuaguuagcccuauucaa

SEQ ID NO: 4005323 - RNA, 18 nt, Staphylococcus aureus subsp. aureus MW2
uauauuuaugauaauuaa

SEQ ID NO: 4005324 - RNA, 13 nt, Staphylococcus aureus subsp. aureus MW2
uauauuugugaau

SEQ ID NO: 4005325 - RNA, 18 nt, Staphylococcus aureus subsp. aureus MW2
uauauuuuauuuaaaaau

SEQ ID NO: 4005326 - RNA, 19 nt, Staphylococcus aureus subsp. aureus MW2
uauauuuuauuuaaaaaua

SEQ ID NO: 4005327 - RNA, 15 nt, Staphylococcus aureus subsp. aureus MW2
uauauuuugaaucag

SEQ ID NO: 4005328 - RNA, 11 nt, Staphylococcus aureus subsp. aureus MW2
uauauuuuuau

SEQ ID NO: 4005329 - RNA, 14 nt, Staphylococcus aureus subsp. aureus MW2
uauauuuuuauuaa

SEQ ID NO: 4005330 - RNA, 10 nt, Staphylococcus aureus subsp. aureus MW2
uauauuuuuu

SEQ ID NO: 4005331 - RNA, 23 nt, Staphylococcus aureus subsp. aureus MW2
uauauuuuuuguacauuauuaau

SEQ ID NO: 4005332 - RNA, 19 nt, Staphylococcus aureus subsp. aureus MW2
uaucaaaaaaacaaaaaau

SEQ ID NO: 4005333 - RNA, 22 nt, Staphylococcus aureus subsp. aureus MW2
uaucaaaaaauauguuuaaugu

SEQ ID NO: 4005334 - RNA, 20 nt, Staphylococcus aureus subsp. aureus MW2
uaucaaaaccgcuauaaaau

SEQ ID NO: 4005335 - RNA, 15 nt, Staphylococcus aureus subsp. aureus MW2
uaucaaaauauaaaa

SEQ ID NO: 4005336 - RNA, 13 nt, Staphylococcus aureus subsp. aureus MW2
uaucaaagucucu

SEQ ID NO: 4005337 - RNA, 15 nt, Staphylococcus aureus subsp. aureus MW2
uaucaaauuacuuau

SEQ ID NO: 4005338 - RNA, 21 nt, Staphylococcus aureus subsp. aureus MW2
uaucaaauuacuuauucaaau

SEQ ID NO: 4005339 - RNA, 21 nt, Staphylococcus aureus subsp. aureus MW2
uaucaacaaauuuucugguca

SEQ ID NO: 4005340 - RNA, 21 nt, Staphylococcus aureus subsp. aureus MW2
uaucaacagaacuaauggcaa

SEQ ID NO: 4005341 - RNA, 17 nt, Staphylococcus aureus subsp. aureus MW2
uaucaacagcuucaaaa

SEQ ID NO: 4005342 - RNA, 20 nt, Staphylococcus aureus subsp. aureus MW2
uaucaacauuaauaaauaau

SEQ ID NO: 4005343 - RNA, 20 nt, Staphylococcus aureus subsp. aureus MW2
uaucugaaguagauugauau

SEQ ID NO: 4005344 - RNA, 18 nt, Staphylococcus aureus subsp. aureus MW2
uaucugacauuguugcua

SEQ ID NO: 4005345 - RNA, 14 nt, Staphylococcus aureus subsp. aureus MW2
uaucugacauuuaa

SEQ ID NO: 4005346 - RNA, 14 nt, Staphylococcus aureus subsp. aureus MW2
uaucugcucuuuau

SEQ ID NO: 4005347 - RNA, 15 nt, Staphylococcus aureus subsp. aureus MW2
uaucuguauaaaaac

SEQ ID NO: 4005348 - RNA, 13 nt, Staphylococcus aureus subsp. aureus MW2
uaucuguugucau

SEQ ID NO: 4005349 - RNA, 19 nt, Staphylococcus aureus subsp. aureus MW2
uaucuuaaagaauuaagua

SEQ ID NO: 4005350 - RNA, 22 nt, Staphylococcus aureus subsp. aureus MW2
uaucuuaaucagcuauaaaagu

SEQ ID NO: 4005351 - RNA, 19 nt, Staphylococcus aureus subsp. aureus MW2
uaucuuacuacuuaauuaa

SEQ ID NO: 4005352 - RNA, 17 nt, Staphylococcus aureus subsp. aureus MW2
uaucuuauaacaaaaau

SEQ ID NO: 4005353 - RNA, 18 nt, Staphylococcus aureus subsp. aureus MW2
uaucuuauaacaaaaauu

SEQ ID NO: 4005354 - RNA, 19 nt, Staphylococcus aureus subsp. aureus MW2
uaucuucacucuuuuagaa

SEQ ID NO: 4005355 - RNA, 15 nt, Staphylococcus aureus subsp. aureus MW2
uaucuucuaauucca

SEQ ID NO: 4005356 - RNA, 12 nt, Staphylococcus aureus subsp. aureus MW2
uaucuucuucua

SEQ ID NO: 4005357 - RNA, 18 nt, Staphylococcus aureus subsp. aureus MW2
uaucuucuuuuaauauuu

SEQ ID NO: 4005358 - RNA, 15 nt, Staphylococcus aureus subsp. aureus MW2
uaucuuguucuucuu

SEQ ID NO: 4005359 - RNA, 17 nt, Staphylococcus aureus subsp. aureus MW2
uaucuuuauuugauucu

SEQ ID NO: 4005360 - RNA, 19 nt, Staphylococcus aureus subsp. aureus MW2
uaucuuucaaauuaauuaa

SEQ ID NO: 4005361 - RNA, 12 nt, Staphylococcus aureus subsp. aureus MW2
uaucuuuucauc

SEQ ID NO: 4005362 - RNA, 13 nt, Staphylococcus aureus subsp. aureus MW2
uaucuuuuuuaug

SEQ ID NO: 4005363 - RNA, 12 nt, Staphylococcus aureus subsp. aureus MW2
uaugaaaagaau

SEQ ID NO: 4005364 - RNA, 23 nt, Staphylococcus aureus subsp. aureus MW2
uaugaaaagagaaacaaaacaaa

SEQ ID NO: 4005365 - RNA, 19 nt, Staphylococcus aureus subsp. aureus MW2
uaugaaaagagauuuuuuu

SEQ ID NO: 4005366 - RNA, 18 nt, Staphylococcus aureus subsp. aureus MW2
uaugaaaccuuugguuca

SEQ ID NO: 4005367 - RNA, 23 nt, Staphylococcus aureus subsp. aureus MW2
uaugaaacuggauaaauaaagau

SEQ ID NO: 4005368 - RNA, 14 nt, Staphylococcus aureus subsp. aureus MW2
uaugaaauaacaau

SEQ ID NO: 4005369 - RNA, 14 nt, Staphylococcus aureus subsp. aureus MW2
uaugaaauaacuag

SEQ ID NO: 4005370 - RNA, 16 nt, Staphylococcus aureus subsp. aureus MW2
uaugaagggaaaaaau

SEQ ID NO: 4005371 - RNA, 15 nt, Staphylococcus aureus subsp. aureus MW2
uaugaauaaugcaau

SEQ ID NO: 4005372 - RNA, 22 nt, Staphylococcus aureus subsp. aureus MW2
uaugaauccugugacucaauga

SEQ ID NO: 4005373 - RNA, 23 nt, Staphylococcus aureus subsp. aureus MW2
uaugaaucgaagcccuuugauuu

SEQ ID NO: 4005374 - RNA, 16 nt, Staphylococcus aureus subsp. aureus MW2
uaugaaucgauauaau

SEQ ID NO: 4005375 - RNA, 13 nt, Staphylococcus aureus subsp. aureus MW2
uaugaaugaaauc

SEQ ID NO: 4005376 - RNA, 23 nt, Staphylococcus aureus subsp. aureus MW2
uaugaauggcaaucuauauaaau

SEQ ID NO: 4005377 - RNA, 17 nt, Staphylococcus aureus subsp. aureus MW2
uaugaauggcauuuaau

SEQ ID NO: 4005378 - RNA, 13 nt, Staphylococcus aureus subsp. aureus MW2
uaugaauuuuaua

SEQ ID NO: 4005379 - RNA, 15 nt, Staphylococcus aureus subsp. aureus MW2
uaugaauuuuauaaa

SEQ ID NO: 4005380 - RNA, 13 nt, Staphylococcus aureus subsp. aureus MW2
uaugacaaauuaa

SEQ ID NO: 4005381 - RNA, 12 nt, Staphylococcus aureus subsp. aureus MW2
uaugacaacaua

SEQ ID NO: 4005382 - RNA, 18 nt, Staphylococcus aureus subsp. aureus MW2
uaugacaacauaacaaag

SEQ ID NO: 4005383 - RNA, 21 nt, Staphylococcus aureus subsp. aureus MW2
uaugacgcgugaauuaaaaaa

SEQ ID NO: 4005384 - RNA, 22 nt, Staphylococcus aureus subsp. aureus MW2
uaugacuaacgaaaaagauggu

SEQ ID NO: 4005385 - RNA, 19 nt, Staphylococcus aureus subsp. aureus MW2
uaugacugcaaauacgagu

SEQ ID NO: 4005386 - RNA, 18 nt, Staphylococcus aureus subsp. aureus MW2
uaugacugcuuuuuauua

SEQ ID NO: 4005387 - RNA, 23 nt, Staphylococcus aureus subsp. aureus MW2
uaugacugguacauuaguuugau

SEQ ID NO: 4005388 - RNA, 15 nt, Staphylococcus aureus subsp. aureus MW2
uaugacuuuuuauua

SEQ ID NO: 4005389 - RNA, 16 nt, Staphylococcus aureus subsp. aureus MW2
uaugagagauagaaag

SEQ ID NO: 4005390 - RNA, 18 nt, Staphylococcus aureus subsp. aureus MW2
uaugauagaauacuaaaa

SEQ ID NO: 4005391 - RNA, 19 nt, Staphylococcus aureus subsp. aureus MW2
uaugauauauguaacauaa

SEQ ID NO: 4005392 - RNA, 21 nt, Staphylococcus aureus subsp. aureus MW2
uaugaucaauaagauuuugcu

SEQ ID NO: 4005393 - RNA, 14 nt, Staphylococcus aureus subsp. aureus MW2
uaugaugcuucuaa

SEQ ID NO: 4005394 - RNA, 21 nt, Staphylococcus aureus subsp. aureus MW2
uaugauguguuacacaugcau

SEQ ID NO: 4005395 - RNA, 16 nt, Staphylococcus aureus subsp. aureus MW2
uaugauguuaaaaaau

SEQ ID NO: 4005396 - RNA, 12 nt, Staphylococcus aureus subsp. aureus MW2
uaugauguucaa

SEQ ID NO: 4005397 - RNA, 19 nt, Staphylococcus aureus subsp. aureus MW2
uaugauuaauaaaguaauc

SEQ ID NO: 4005398 - RNA, 23 nt, Staphylococcus aureus subsp. aureus MW2
uaugauucuaacggcguuuguuu

SEQ ID NO: 4005399 - RNA, 12 nt, Staphylococcus aureus subsp. aureus MW2
uaugauuuaaaa

SEQ ID NO: 4005400 - RNA, 17 nt, Staphylococcus aureus subsp. aureus MW2
uaugauuuaaaauauaa

SEQ ID NO: 4005401 - RNA, 23 nt, Staphylococcus aureus subsp. aureus MW2
uaugauuugccccgccauucaua

SEQ ID NO: 4005402 - RNA, 16 nt, Staphylococcus aureus subsp. aureus MW2
uaugcaaaauuaauga

SEQ ID NO: 4005403 - RNA, 16 nt, Staphylococcus aureus subsp. aureus MW2
uaugcacaucauugau

SEQ ID NO: 4005404 - RNA, 20 nt, Staphylococcus aureus subsp. aureus MW2
uaugcagguauguucaucag

SEQ ID NO: 4005405 - RNA, 20 nt, Staphylococcus aureus subsp. aureus MW2
uaugcaguuuuaauuaaacu

SEQ ID NO: 4005406 - RNA, 18 nt, Staphylococcus aureus subsp. aureus MW2
uaugcauauguaauacaa

SEQ ID NO: 4005407 - RNA, 21 nt, Staphylococcus aureus subsp. aureus MW2
uaugcauauguaauacaaaag

SEQ ID NO: 4005408 - RNA, 23 nt, Staphylococcus aureus subsp. aureus MW2
uaugcauccuaaaaaggcaagca

SEQ ID NO: 4005409 - RNA, 19 nt, Staphylococcus aureus subsp. aureus MW2
uaugcaugccagaugcaau

SEQ ID NO: 4005410 - RNA, 22 nt, Staphylococcus aureus subsp. aureus MW2
uaugccaaaguaauaauggcaa

SEQ ID NO: 4005411 - RNA, 18 nt, Staphylococcus aureus subsp. aureus MW2
uaugccaaauaacguuaa

SEQ ID NO: 4005412 - RNA, 21 nt, Staphylococcus aureus subsp. aureus MW2
uaugccgccuaauaauaaaau

SEQ ID NO: 4005413 - RNA, 13 nt, Staphylococcus aureus subsp. aureus MW2
uaugcguauaugu

SEQ ID NO: 4005414 - RNA, 22 nt, Staphylococcus aureus subsp. aureus MW2
uaugcugaaacuaaguuuaaug

SEQ ID NO: 4005415 - RNA, 19 nt, Staphylococcus aureus subsp. aureus MW2
uaugcugcaagucucauau

SEQ ID NO: 4005416 - RNA, 17 nt, Staphylococcus aureus subsp. aureus MW2
uaugcuguguaucauca

SEQ ID NO: 4005417 - RNA, 20 nt, Staphylococcus aureus subsp. aureus MW2
uaugcuuauucugaaaaaua

SEQ ID NO: 4005418 - RNA, 22 nt, Staphylococcus aureus subsp. aureus MW2
uaugcuugcugugaauaaaauu

SEQ ID NO: 4005419 - RNA, 16 nt, Staphylococcus aureus subsp. aureus MW2
uaugcuuuuauagauu

SEQ ID NO: 4005420 - RNA, 18 nt, Staphylococcus aureus subsp. aureus MW2
uauggaaaauuuuaucaa

SEQ ID NO: 4005421 - RNA, 14 nt, Staphylococcus aureus subsp. aureus MW2
uauggaauaaaugg

SEQ ID NO: 4005422 - RNA, 20 nt, Staphylococcus aureus subsp. aureus MW2
uauggagcuacccuauuuua

SEQ ID NO: 4005423 - RNA, 13 nt, Staphylococcus aureus subsp. aureus MW2
uauggauaaaauu

SEQ ID NO: 4005424 - RNA, 16 nt, Staphylococcus aureus subsp. aureus MW2
uauggauaaaauuuaa

SEQ ID NO: 4005425 - RNA, 16 nt, Staphylococcus aureus subsp. aureus MW2
uauggauguauuucug

SEQ ID NO: 4005426 - RNA, 21 nt, Staphylococcus aureus subsp. aureus MW2
uauggcguauucagcuaucaa

SEQ ID NO: 4005427 - RNA, 21 nt, Staphylococcus aureus subsp. aureus MW2
uauggucuugaguacuaauca

SEQ ID NO: 4005428 - RNA, 16 nt, Staphylococcus aureus subsp. aureus MW2
uaugguuagaaaaaaa

SEQ ID NO: 4005429 - RNA, 16 nt, Staphylococcus aureus subsp. aureus MW2
uaugguuguuuuccaa

SEQ ID NO: 4005430 - RNA, 21 nt, Staphylococcus aureus subsp. aureus MW2
uauguaaauugguauaacaau

SEQ ID NO: 4005431 - RNA, 17 nt, Staphylococcus aureus subsp. aureus MW2
uauuauccaaggauguu

SEQ ID NO: 4005432 - RNA, 15 nt, Staphylococcus aureus subsp. aureus MW2
uauuaucuauccauu

SEQ ID NO: 4005433 - RNA, 21 nt, Staphylococcus aureus subsp. aureus MW2
uauuaugaacaugaaauuaau

SEQ ID NO: 4005434 - RNA, 17 nt, Staphylococcus aureus subsp. aureus MW2
uauuaugaauuauuaau

SEQ ID NO: 4005435 - RNA, 22 nt, Staphylococcus aureus subsp. aureus MW2
uauuaugauugcuuauuuauuu

SEQ ID NO: 4005436 - RNA, 18 nt, Staphylococcus aureus subsp. aureus MW2
uauuauguaccaaauuua

SEQ ID NO: 4005437 - RNA, 16 nt, Staphylococcus aureus subsp. aureus MW2
uauuauguguauauua

SEQ ID NO: 4005438 - RNA, 23 nt, Staphylococcus aureus subsp. aureus MW2
uauuauguuauaaauucuaucua

SEQ ID NO: 4005439 - RNA, 18 nt, Staphylococcus aureus subsp. aureus MW2
uauuauuaccauaaauuu

SEQ ID NO: 4005440 - RNA, 14 nt, Staphylococcus aureus subsp. aureus MW2
uauuauuauaauuu

SEQ ID NO: 4005441 - RNA, 18 nt, Staphylococcus aureus subsp. aureus MW2
uauuauuauaauuuuguu

SEQ ID NO: 4005442 - RNA, 14 nt, Staphylococcus aureus subsp. aureus MW2
uauuauuauguuaa

SEQ ID NO: 4005443 - RNA, 15 nt, Staphylococcus aureus subsp. aureus MW2
uauuauuauguuaau

SEQ ID NO: 4005444 - RNA, 15 nt, Staphylococcus aureus subsp. aureus MW2
uauuauuauguuaua

SEQ ID NO: 4005445 - RNA, 15 nt, Staphylococcus aureus subsp. aureus MW2
uauuauuauugaaau

SEQ ID NO: 4005446 - RNA, 17 nt, Staphylococcus aureus subsp. aureus MW2
uauuauucauaauauau

SEQ ID NO: 4005447 - RNA, 18 nt, Staphylococcus aureus subsp. aureus MW2
uauuauucauaauauauu

SEQ ID NO: 4005448 - RNA, 13 nt, Staphylococcus aureus subsp. aureus MW2
uauuauucucuca

SEQ ID NO: 4005449 - RNA, 21 nt, Staphylococcus aureus subsp. aureus MW2
uauuauugaaacuaauaauuu

SEQ ID NO: 4005450 - RNA, 12 nt, Staphylococcus aureus subsp. aureus MW2
uauuauugaaau

SEQ ID NO: 4005451 - RNA, 22 nt, Staphylococcus aureus subsp. aureus MW2
uauuauugaaaucgauacuaau

SEQ ID NO: 4005452 - RNA, 14 nt, Staphylococcus aureus subsp. aureus MW2
uauuauugcuguga

SEQ ID NO: 4005453 - RNA, 16 nt, Staphylococcus aureus subsp. aureus MW2
uauuauugucaucaug

SEQ ID NO: 4005454 - RNA, 14 nt, Staphylococcus aureus subsp. aureus MW2
uauuauuuuacuuu

SEQ ID NO: 4005455 - RNA, 18 nt, Staphylococcus aureus subsp. aureus MW2
uauucaaaaaaauauuua

SEQ ID NO: 4005456 - RNA, 12 nt, Staphylococcus aureus subsp. aureus MW2
uauucaaaauaa

SEQ ID NO: 4005457 - RNA, 23 nt, Staphylococcus aureus subsp. aureus MW2
uauucaaaggacgucuuuuuaga

SEQ ID NO: 4005458 - RNA, 18 nt, Staphylococcus aureus subsp. aureus MW2
uauucaaauaaacacauc

SEQ ID NO: 4005459 - RNA, 14 nt, Staphylococcus aureus subsp. aureus MW2
uauucaaaugauuu

SEQ ID NO: 4005460 - RNA, 21 nt, Staphylococcus aureus subsp. aureus MW2
uauucaaauguuuacugucau

SEQ ID NO: 4005461 - RNA, 15 nt, Staphylococcus aureus subsp. aureus MW2
uauucaaauuuacca

SEQ ID NO: 4005462 - RNA, 14 nt, Staphylococcus aureus subsp. aureus MW2
uauucaauucugug

SEQ ID NO: 4005463 - RNA, 23 nt, Staphylococcus aureus subsp. aureus MW2
uauucacauagccucuuaaaaua

SEQ ID NO: 4005464 - RNA, 19 nt, Staphylococcus aureus subsp. aureus MW2
uauucacgcguucaaaugu

SEQ ID NO: 4005465 - RNA, 21 nt, Staphylococcus aureus subsp. aureus MW2
uauucaguugguauaucgaaa

SEQ ID NO: 4005466 - RNA, 22 nt, Staphylococcus aureus subsp. aureus MW2
uauucauaauaucgaugacuuu

SEQ ID NO: 4005467 - RNA, 15 nt, Staphylococcus aureus subsp. aureus MW2
uauucauacguucaa

SEQ ID NO: 4005468 - RNA, 20 nt, Staphylococcus aureus subsp. aureus MW2
uauucauagaccuaugaauu

SEQ ID NO: 4005469 - RNA, 15 nt, Staphylococcus aureus subsp. aureus MW2
uauucaucauauaua

SEQ ID NO: 4005470 - RNA, 13 nt, Staphylococcus aureus subsp. aureus MW2
uauucauuuuaaa

SEQ ID NO: 4005471 - RNA, 14 nt, Staphylococcus aureus subsp. aureus MW2
uauuccauuucaaa

SEQ ID NO: 4005472 - RNA, 24 nt, Staphylococcus aureus subsp. aureus MW2
uauucccaccggacaauguagaua

SEQ ID NO: 4005473 - RNA, 21 nt, Staphylococcus aureus subsp. aureus MW2
uauuccgagaauuauuauucu

SEQ ID NO: 4005474 - RNA, 17 nt, Staphylococcus aureus subsp. aureus MW2
uauuccuaauaaauauc

SEQ ID NO: 4005475 - RNA, 14 nt, Staphylococcus aureus subsp. aureus MW2
uauuccuaguucua

SEQ ID NO: 4005476 - RNA, 14 nt, Staphylococcus aureus subsp. aureus MW2
uauuccuauuacua

SEQ ID NO: 4005477 - RNA, 14 nt, Staphylococcus aureus subsp. aureus MW2
uauucgauaauaua

SEQ ID NO: 4005478 - RNA, 18 nt, Staphylococcus aureus subsp. aureus MW2
uauucgcuuaaaaacgcu

SEQ ID NO: 4005479 - RNA, 12 nt, Staphylococcus aureus subsp. aureus MW2
uauucggcaaaa

SEQ ID NO: 4005480 - RNA, 21 nt, Staphylococcus aureus subsp. aureus MW2
uauucguaucuaguguucuca

SEQ ID NO: 4005481 - RNA, 14 nt, Staphylococcus aureus subsp. aureus MW2
uauucguuucuuua

SEQ ID NO: 4005482 - RNA, 19 nt, Staphylococcus aureus subsp. aureus MW2
uauucucagucucuuugaa

SEQ ID NO: 4005483 - RNA, 17 nt, Staphylococcus aureus subsp. aureus MW2
uauucugaaaaauauuu

SEQ ID NO: 4005484 - RNA, 20 nt, Staphylococcus aureus subsp. aureus MW2
uauucugaaaaauauuuaaa

SEQ ID NO: 4005485 - RNA, 17 nt, Staphylococcus aureus subsp. aureus MW2
uauucuguaacguuacu

SEQ ID NO: 4005486 - RNA, 17 nt, Staphylococcus aureus subsp. aureus MW2
uauucuuaaaagacauc

SEQ ID NO: 4005487 - RNA, 19 nt, Staphylococcus aureus subsp. aureus MW2
uauucuucauuuauaacau

SEQ ID NO: 4005488 - RNA, 20 nt, Staphylococcus aureus subsp. aureus MW2
uauucuuggcguauuuuuug

SEQ ID NO: 4005489 - RNA, 14 nt, Staphylococcus aureus subsp. aureus MW2
uauucuuuaauuaa

SEQ ID NO: 4005490 - RNA, 14 nt, Staphylococcus aureus subsp. aureus MW2
uauucuuuauauuu

SEQ ID NO: 4005491 - RNA, 15 nt, Staphylococcus aureus subsp. aureus MW2
uauugaaaagauaaa

SEQ ID NO: 4005492 - RNA, 19 nt, Staphylococcus aureus subsp. aureus MW2
uauugaaaguguaugcaug

SEQ ID NO: 4005493 - RNA, 14 nt, Staphylococcus aureus subsp. aureus MW2
uauugaauugaaaa

SEQ ID NO: 4005494 - RNA, 18 nt, Staphylococcus aureus subsp. aureus MW2
uauugacccccuguaucu

SEQ ID NO: 4005495 - RNA, 21 nt, Staphylococcus aureus subsp. aureus MW2
uauugauagcaccguaacaua

SEQ ID NO: 4005496 - RNA, 15 nt, Staphylococcus aureus subsp. aureus MW2
uauugauauuaauau

SEQ ID NO: 4005497 - RNA, 14 nt, Staphylococcus aureus subsp. aureus MW2
uauugauauucuaa

SEQ ID NO: 4005498 - RNA, 19 nt, Staphylococcus aureus subsp. aureus MW2
uauugauauucuaaaaaau

SEQ ID NO: 4005499 - RNA, 23 nt, Staphylococcus aureus subsp. aureus MW2
uauugaucugauuucacuucuaa

SEQ ID NO: 4005500 - RNA, 21 nt, Staphylococcus aureus subsp. aureus MW2
uauugaugaauaaauagauaa

SEQ ID NO: 4005501 - RNA, 13 nt, Staphylococcus aureus subsp. aureus MW2
uauugauuauucu

SEQ ID NO: 4005502 - RNA, 23 nt, Staphylococcus aureus subsp. aureus MW2
uauugauuauucuuuaauuaaau

SEQ ID NO: 4005503 - RNA, 21 nt, Staphylococcus aureus subsp. aureus MW2
uauugauuugauucauuacau

SEQ ID NO: 4005504 - RNA, 23 nt, Staphylococcus aureus subsp. aureus MW2
uauugauuugauucauuacaugu

SEQ ID NO: 4005505 - RNA, 14 nt, Staphylococcus aureus subsp. aureus MW2
uauugcaaaaauaa

SEQ ID NO: 4005506 - RNA, 15 nt, Staphylococcus aureus subsp. aureus MW2
uauugcaaaaauaau

SEQ ID NO: 4005507 - RNA, 15 nt, Staphylococcus aureus subsp. aureus MW2
uauugcauuguauau

SEQ ID NO: 4005508 - RNA, 17 nt, Staphylococcus aureus subsp. aureus MW2
uauugcauuguauaugu

SEQ ID NO: 4005509 - RNA, 17 nt, Staphylococcus aureus subsp. aureus MW2
uauugcauuuagacuug

SEQ ID NO: 4005510 - RNA, 23 nt, Staphylococcus aureus subsp. aureus MW2
uauugccguuauuuucaauaaau

SEQ ID NO: 4005511 - RNA, 22 nt, Staphylococcus aureus subsp. aureus MW2
uauugcuacccaccuuucuuua

SEQ ID NO: 4005512 - RNA, 18 nt, Staphylococcus aureus subsp. aureus MW2
uauugcuuauguuuuuaa

SEQ ID NO: 4005513 - RNA, 17 nt, Staphylococcus aureus subsp. aureus MW2
uauuggaauacucuuua

SEQ ID NO: 4005514 - RNA, 22 nt, Staphylococcus aureus subsp. aureus MW2
uauugguaucuccaauauuuua

SEQ ID NO: 4005515 - RNA, 14 nt, Staphylococcus aureus subsp. aureus MW2
uauugguuauauau

SEQ ID NO: 4005516 - RNA, 13 nt, Staphylococcus aureus subsp. aureus MW2
uauugguugaaau

SEQ ID NO: 4005517 - RNA, 17 nt, Staphylococcus aureus subsp. aureus MW2
uauugguugaaauuaau

SEQ ID NO: 4005518 - RNA, 20 nt, Staphylococcus aureus subsp. aureus MW2
uauuguaaucacuauuuguu

SEQ ID NO: 4005519 - RNA, 14 nt, Staphylococcus aureus subsp. aureus MW2
uauuguauuuuaau

SEQ ID NO: 4005520 - RNA, 19 nt, Staphylococcus aureus subsp. aureus MW2
uauuuuagcucuuguucaa

SEQ ID NO: 4005521 - RNA, 22 nt, Staphylococcus aureus subsp. aureus MW2
uauuuuagcucuuguucaagua

SEQ ID NO: 4005522 - RNA, 22 nt, Staphylococcus aureus subsp. aureus MW2
uauuuuaguacuuaauacuaau

SEQ ID NO: 4005523 - RNA, 14 nt, Staphylococcus aureus subsp. aureus MW2
uauuuuauaagaau

SEQ ID NO: 4005524 - RNA, 16 nt, Staphylococcus aureus subsp. aureus MW2
uauuuuauaauaaccu

SEQ ID NO: 4005525 - RNA, 13 nt, Staphylococcus aureus subsp. aureus MW2
uauuuuauacaua

SEQ ID NO: 4005526 - RNA, 19 nt, Staphylococcus aureus subsp. aureus MW2
uauuuuaucaucuauucaa

SEQ ID NO: 4005527 - RNA, 12 nt, Staphylococcus aureus subsp. aureus MW2
uauuuuaugauu

SEQ ID NO: 4005528 - RNA, 13 nt, Staphylococcus aureus subsp. aureus MW2
uauuuuauuuaaa

SEQ ID NO: 4005529 - RNA, 15 nt, Staphylococcus aureus subsp. aureus MW2
uauuuuauuuaaaaa

SEQ ID NO: 4005530 - RNA, 16 nt, Staphylococcus aureus subsp. aureus MW2
uauuuuauuuaaaaau

SEQ ID NO: 4005531 - RNA, 17 nt, Staphylococcus aureus subsp. aureus MW2
uauuuuauuuaaaaaua

SEQ ID NO: 4005532 - RNA, 22 nt, Staphylococcus aureus subsp. aureus MW2
uauuuuauuuaaaaauagccuu

SEQ ID NO: 4005533 - RNA, 14 nt, Staphylococcus aureus subsp. aureus MW2
uauuuucaaaugug

SEQ ID NO: 4005534 - RNA, 16 nt, Staphylococcus aureus subsp. aureus MW2
uauuuucaauaaauuu

SEQ ID NO: 4005535 - RNA, 21 nt, Staphylococcus aureus subsp. aureus MW2
uauuuucaauaaauuuuauau

SEQ ID NO: 4005536 - RNA, 18 nt, Staphylococcus aureus subsp. aureus MW2
uauuuucaauauuugaua

SEQ ID NO: 4005537 - RNA, 17 nt, Staphylococcus aureus subsp. aureus MW2
uauuuucaauuagaaaa

SEQ ID NO: 4005538 - RNA, 20 nt, Staphylococcus aureus subsp. aureus MW2
uauuuucauaaacucuuaua

SEQ ID NO: 4005539 - RNA, 13 nt, Staphylococcus aureus subsp. aureus MW2
uauuuucauuuua

SEQ ID NO: 4005540 - RNA, 14 nt, Staphylococcus aureus subsp. aureus MW2
uauuuucauuuuag

SEQ ID NO: 4005541 - RNA, 16 nt, Staphylococcus aureus subsp. aureus MW2
uauuuucauuuuucuu

SEQ ID NO: 4005542 - RNA, 13 nt, Staphylococcus aureus subsp. aureus MW2
uauuuucucuaua

SEQ ID NO: 4005543 - RNA, 17 nt, Staphylococcus aureus subsp. aureus MW2
uauuuucucuauaauuu

SEQ ID NO: 4005544 - RNA, 19 nt, Staphylococcus aureus subsp. aureus MW2
uauuuucugccauaaacau

SEQ ID NO: 4005545 - RNA, 21 nt, Staphylococcus aureus subsp. aureus MW2
uauuuucuuguguauuuuuau

SEQ ID NO: 4005546 - RNA, 13 nt, Staphylococcus aureus subsp. aureus MW2
uauuuucuuuuuc

SEQ ID NO: 4005547 - RNA, 21 nt, Staphylococcus aureus subsp. aureus MW2
uauuuucuuuuucuaaauaaa

SEQ ID NO: 4005548 - RNA, 14 nt, Staphylococcus aureus subsp. aureus MW2
uauuuugacguuuu

SEQ ID NO: 4005549 - RNA, 13 nt, Staphylococcus aureus subsp. aureus MW2
uauuuugcaauaa

SEQ ID NO: 4005550 - RNA, 17 nt, Staphylococcus aureus subsp. aureus MW2
uauuuugcgcuucuagu

SEQ ID NO: 4005551 - RNA, 16 nt, Staphylococcus aureus subsp. aureus MW2
uauuuuuaagcugcuc

SEQ ID NO: 4005552 - RNA, 13 nt, Staphylococcus aureus subsp. aureus MW2
uauuuuuaaucuu

SEQ ID NO: 4005553 - RNA, 14 nt, Staphylococcus aureus subsp. aureus MW2
uauuuuuacauauu

SEQ ID NO: 4005554 - RNA, 13 nt, Staphylococcus aureus subsp. aureus MW2
uauuuuuauagau

SEQ ID NO: 4005555 - RNA, 16 nt, Staphylococcus aureus subsp. aureus MW2
uauuuuuaugauucua

SEQ ID NO: 4005556 - RNA, 11 nt, Staphylococcus aureus subsp. aureus MW2
uauuuuucuuu

SEQ ID NO: 4005557 - RNA, 23 nt, Staphylococcus aureus subsp. aureus MW2
uauuuuugauagugguagccaau

SEQ ID NO: 4005558 - RNA, 15 nt, Staphylococcus aureus subsp. aureus MW2
uauuuuuuaaaauga

SEQ ID NO: 4005559 - RNA, 21 nt, Staphylococcus aureus subsp. aureus MW2
uauuuuuuaaaaugauagcua

SEQ ID NO: 4005560 - RNA, 14 nt, Staphylococcus aureus subsp. aureus MW2
uauuuuuuaaaugc

SEQ ID NO: 4005561 - RNA, 23 nt, Staphylococcus aureus subsp. aureus MW2
uauuuuuuauguuuuaauuucuu

SEQ ID NO: 4005562 - RNA, 21 nt, Staphylococcus aureus subsp. aureus MW2
uauuuuuugagcacuuaauaa

SEQ ID NO: 4005563 - RNA, 20 nt, Staphylococcus aureus subsp. aureus MW2
uauuuuuugauauuugaucc

SEQ ID NO: 4005564 - RNA, 16 nt, Staphylococcus aureus subsp. aureus MW2
uauuuuuuuauaauuu

SEQ ID NO: 4005565 - RNA, 17 nt, Staphylococcus aureus subsp. aureus MW2
uauuuuuuuauguuaua

SEQ ID NO: 4005566 - RNA, 15 nt, Staphylococcus aureus subsp. aureus MW2
uauuuuuuucaagau

SEQ ID NO: 4005567 - RNA, 22 nt, Staphylococcus aureus subsp. aureus MW2
uauuuuuuuguccaauaaauuu

SEQ ID NO: 4005568 - RNA, 13 nt, Staphylococcus aureus subsp. aureus MW2
ucaaaaaauaaua

SEQ ID NO: 4005569 - RNA, 20 nt, Staphylococcus aureus subsp. aureus MW2
ucaaaaaauauguuuaaugu

SEQ ID NO: 4005570 - RNA, 14 nt, Staphylococcus aureus subsp. aureus MW2
ucaaaaaauuaauc

SEQ ID NO: 4005571 - RNA, 17 nt, Staphylococcus aureus subsp. aureus MW2
ucaaaaauuguuaauac

SEQ ID NO: 4005572 - RNA, 18 nt, Staphylococcus aureus subsp. aureus MW2
ucaaaaccgcuauaaaau

SEQ ID NO: 4005573 - RNA, 18 nt, Staphylococcus aureus subsp. aureus MW2
ucaaaacguuuaauugca

SEQ ID NO: 4005574 - RNA, 13 nt, Staphylococcus aureus subsp. aureus MW2
ucaaaauauaaaa

SEQ ID NO: 4005575 - RNA, 19 nt, Staphylococcus aureus subsp. aureus MW2
ucaaaaucggauuaacauu

SEQ ID NO: 4005576 - RNA, 21 nt, Staphylococcus aureus subsp. aureus MW2
ucaaaaugguuauauaaacaa

SEQ ID NO: 4005577 - RNA, 18 nt, Staphylococcus aureus subsp. aureus MW2
ucaaaauguuuaacaaua

SEQ ID NO: 4005578 - RNA, 21 nt, Staphylococcus aureus subsp. aureus MW2
ucaaaauguuuaacaauaaua

SEQ ID NO: 4005579 - RNA, 13 nt, Staphylococcus aureus subsp. aureus MW2
ucaaaauuuaauu

SEQ ID NO: 4005580 - RNA, 21 nt, Staphylococcus aureus subsp. aureus MW2
ucaaaauuucgauuuucacca

SEQ ID NO: 4005581 - RNA, 13 nt, Staphylococcus aureus subsp. aureus MW2
ucaaaauuuugac

SEQ ID NO: 4005582 - RNA, 21 nt, Staphylococcus aureus subsp. aureus MW2
ucaaaauuuugacuauucuca

SEQ ID NO: 4005583 - RNA, 11 nt, Staphylococcus aureus subsp. aureus MW2
ucaaacaacau

SEQ ID NO: 4005584 - RNA, 14 nt, Staphylococcus aureus subsp. aureus MW2
ucaaacagacuuaa

SEQ ID NO: 4005585 - RNA, 19 nt, Staphylococcus aureus subsp. aureus MW2
ucaaacaguccuuauuaua

SEQ ID NO: 4005586 - RNA, 14 nt, Staphylococcus aureus subsp. aureus MW2
ucaaacauauucau

SEQ ID NO: 4005587 - RNA, 23 nt, Staphylococcus aureus subsp. aureus MW2
ucaaacgaaggucuacuaaauaa

SEQ ID NO: 4005588 - RNA, 18 nt, Staphylococcus aureus subsp. aureus MW2
ucaaacgcaccuggcaca

SEQ ID NO: 4005589 - RNA, 22 nt, Staphylococcus aureus subsp. aureus MW2
ucaaacggcacuaauauuuaaa

SEQ ID NO: 4005590 - RNA, 14 nt, Staphylococcus aureus subsp. aureus MW2
ucaaacuuaaaacu

SEQ ID NO: 4005591 - RNA, 15 nt, Staphylococcus aureus subsp. aureus MW2
ucaaacuuaaaacua

SEQ ID NO: 4005592 - RNA, 21 nt, Staphylococcus aureus subsp. aureus MW2
ucaaacuuaaaacuauaaccu

SEQ ID NO: 4005593 - RNA, 12 nt, Staphylococcus aureus subsp. aureus MW2
ucaaagaaaaag

SEQ ID NO: 4005594 - RNA, 17 nt, Staphylococcus aureus subsp. aureus MW2
ucaaagaguaaaguuaa

SEQ ID NO: 4005595 - RNA, 12 nt, Staphylococcus aureus subsp. aureus MW2
ucaaaguagaca

SEQ ID NO: 4005596 - RNA, 14 nt, Staphylococcus aureus subsp. aureus MW2
ucaaaguagacauu

SEQ ID NO: 4005597 - RNA, 16 nt, Staphylococcus aureus subsp. aureus MW2
ucaaaguagacauuga

SEQ ID NO: 4005598 - RNA, 21 nt, Staphylococcus aureus subsp. aureus MW2
ucaaaguaucagucauugcaa

SEQ ID NO: 4005599 - RNA, 21 nt, Staphylococcus aureus subsp. aureus MW2
ucaaaguaucuuuugcaccuu

SEQ ID NO: 4005600 - RNA, 21 nt, Staphylococcus aureus subsp. aureus MW2
ucaaagucucuaguaucugau

SEQ ID NO: 4005601 - RNA, 21 nt, Staphylococcus aureus subsp. aureus MW2
ucaaaguuuucaggaauuguu

SEQ ID NO: 4005602 - RNA, 21 nt, Staphylococcus aureus subsp. aureus MW2
ucaaaguuuucauuuaacaug

SEQ ID NO: 4005603 - RNA, 17 nt, Staphylococcus aureus subsp. aureus MW2
ucaaauaacugaguuaa

SEQ ID NO: 4005604 - RNA, 21 nt, Staphylococcus aureus subsp. aureus MW2
ucaaauaaugugaaaaaucuu

SEQ ID NO: 4005605 - RNA, 17 nt, Staphylococcus aureus subsp. aureus MW2
ucaaauacauuucaaaa

SEQ ID NO: 4005606 - RNA, 21 nt, Staphylococcus aureus subsp. aureus MW2
ucaaauacauuucaaaaaaag

SEQ ID NO: 4005607 - RNA, 21 nt, Staphylococcus aureus subsp. aureus MW2
ucaaauagacaccaaaaacag

SEQ ID NO: 4005608 - RNA, 17 nt, Staphylococcus aureus subsp. aureus MW2
ucaaauagcccuuuaua

SEQ ID NO: 4005609 - RNA, 16 nt, Staphylococcus aureus subsp. aureus MW2
ucaauaacuauaauca

SEQ ID NO: 4005610 - RNA, 12 nt, Staphylococcus aureus subsp. aureus MW2
ucaauaaucuua

SEQ ID NO: 4005611 - RNA, 14 nt, Staphylococcus aureus subsp. aureus MW2
ucaauaauuucuug

SEQ ID NO: 4005612 - RNA, 14 nt, Staphylococcus aureus subsp. aureus MW2
ucaauacaaaacau

SEQ ID NO: 4005613 - RNA, 15 nt, Staphylococcus aureus subsp. aureus MW2
ucaauacaaaacauu

SEQ ID NO: 4005614 - RNA, 17 nt, Staphylococcus aureus subsp. aureus MW2
ucaauacaaaacauuac

SEQ ID NO: 4005615 - RNA, 15 nt, Staphylococcus aureus subsp. aureus MW2
ucaauacuugaaaga

SEQ ID NO: 4005616 - RNA, 14 nt, Staphylococcus aureus subsp. aureus MW2
ucaauacuuucagu

SEQ ID NO: 4005617 - RNA, 22 nt, Staphylococcus aureus subsp. aureus MW2
ucaauaggaauaccacuuaauc

SEQ ID NO: 4005618 - RNA, 21 nt, Staphylococcus aureus subsp. aureus MW2
ucaauaguaguauuaucuuuc

SEQ ID NO: 4005619 - RNA, 14 nt, Staphylococcus aureus subsp. aureus MW2
ucaauaguuucaau

SEQ ID NO: 4005620 - RNA, 21 nt, Staphylococcus aureus subsp. aureus MW2
ucaauauaaccgugaugaugu

SEQ ID NO: 4005621 - RNA, 14 nt, Staphylococcus aureus subsp. aureus MW2
ucaauaucauucau

SEQ ID NO: 4005622 - RNA, 23 nt, Staphylococcus aureus subsp. aureus MW2
ucaauaucuguagcgauaccuuu

SEQ ID NO: 4005623 - RNA, 14 nt, Staphylococcus aureus subsp. aureus MW2
ucaauaugaccuuu

SEQ ID NO: 4005624 - RNA, 21 nt, Staphylococcus aureus subsp. aureus MW2
ucaaucacuauauuucacaca

SEQ ID NO: 4005625 - RNA, 21 nt, Staphylococcus aureus subsp. aureus MW2
ucaauccaauuaaauauuuaa

SEQ ID NO: 4005626 - RNA, 22 nt, Staphylococcus aureus subsp. aureus MW2
ucaauccaucaauaccauaauu

SEQ ID NO: 4005627 - RNA, 16 nt, Staphylococcus aureus subsp. aureus MW2
ucaauccuaaauuaua

SEQ ID NO: 4005628 - RNA, 15 nt, Staphylococcus aureus subsp. aureus MW2
ucaaucgcauuuugu

SEQ ID NO: 4005629 - RNA, 15 nt, Staphylococcus aureus subsp. aureus MW2
ucaaucguuaauuuc

SEQ ID NO: 4005630 - RNA, 12 nt, Staphylococcus aureus subsp. aureus MW2
ucaaugacuaag

SEQ ID NO: 4005631 - RNA, 18 nt, Staphylococcus aureus subsp. aureus MW2
ucaaugacugagaaaaau

SEQ ID NO: 4005632 - RNA, 23 nt, Staphylococcus aureus subsp. aureus MW2
ucaaugacugagaaaaauauuuc

SEQ ID NO: 4005633 - RNA, 19 nt, Staphylococcus aureus subsp. aureus MW2
ucaaugacuuaacaucuuu

SEQ ID NO: 4005634 - RNA, 22 nt, Staphylococcus aureus subsp. aureus MW2
ucaaugagcaagucuucuaaaa

SEQ ID NO: 4005635 - RNA, 12 nt, Staphylococcus aureus subsp. aureus MW2
ucaaugauuuuu

SEQ ID NO: 4005636 - RNA, 14 nt, Staphylococcus aureus subsp. aureus MW2
ucaaugcauauucu

SEQ ID NO: 4005637 - RNA, 14 nt, Staphylococcus aureus subsp. aureus MW2
ucaaugcuuucauc

SEQ ID NO: 4005638 - RNA, 16 nt, Staphylococcus aureus subsp. aureus MW2
ucaauguaagcaacau

SEQ ID NO: 4005639 - RNA, 17 nt, Staphylococcus aureus subsp. aureus MW2
ucaauguaagcaacaua

SEQ ID NO: 4005640 - RNA, 14 nt, Staphylococcus aureus subsp. aureus MW2
ucaauguaauuuuc

SEQ ID NO: 4005641 - RNA, 16 nt, Staphylococcus aureus subsp. aureus MW2
ucaaugugagauauaa

SEQ ID NO: 4005642 - RNA, 20 nt, Staphylococcus aureus subsp. aureus MW2
ucaaugugagauauaaagga

SEQ ID NO: 4005643 - RNA, 14 nt, Staphylococcus aureus subsp. aureus MW2
ucaauguuauuaaa

SEQ ID NO: 4005644 - RNA, 15 nt, Staphylococcus aureus subsp. aureus MW2
ucaauguuauuaaac

SEQ ID NO: 4005645 - RNA, 17 nt, Staphylococcus aureus subsp. aureus MW2
ucaauguuauuaaacgc

SEQ ID NO: 4005646 - RNA, 23 nt, Staphylococcus aureus subsp. aureus MW2
ucaauguucuaggcuccuaaaug

SEQ ID NO: 4005647 - RNA, 20 nt, Staphylococcus aureus subsp. aureus MW2
ucaauguuuaauuuucuaaa

SEQ ID NO: 4005648 - RNA, 19 nt, Staphylococcus aureus subsp. aureus MW2
ucaauuaaacuuaagaaua

SEQ ID NO: 4005649 - RNA, 15 nt, Staphylococcus aureus subsp. aureus MW2
ucaauuaaugauuca

SEQ ID NO: 4005650 - RNA, 14 nt, Staphylococcus aureus subsp. aureus MW2
ucaauuaauuuaaa

SEQ ID NO: 4005651 - RNA, 19 nt, Staphylococcus aureus subsp. aureus MW2
ucaauuaauuuaaaugcuu

SEQ ID NO: 4005652 - RNA, 15 nt, Staphylococcus aureus subsp. aureus MW2
ucaauuauuucaucg

SEQ ID NO: 4005653 - RNA, 20 nt, Staphylococcus aureus subsp. aureus MW2
ucaauucuagucaaccuugc

SEQ ID NO: 4005654 - RNA, 12 nt, Staphylococcus aureus subsp. aureus MW2
ucaauucucuaa

SEQ ID NO: 4005655 - RNA, 15 nt, Staphylococcus aureus subsp. aureus MW2
ucaauugcacuuacu

SEQ ID NO: 4005656 - RNA, 22 nt, Staphylococcus aureus subsp. aureus MW2
ucaauugcaugucuuaaauucu

SEQ ID NO: 4005657 - RNA, 16 nt, Staphylococcus aureus subsp. aureus MW2
ucaauugcgauauacg

SEQ ID NO: 4005658 - RNA, 19 nt, Staphylococcus aureus subsp. aureus MW2
ucaauugucguuuaauaau

SEQ ID NO: 4005659 - RNA, 20 nt, Staphylococcus aureus subsp. aureus MW2
ucaauuuaaauaaguuacuc

SEQ ID NO: 4005660 - RNA, 12 nt, Staphylococcus aureus subsp. aureus MW2
ucaauuuaagug

SEQ ID NO: 4005661 - RNA, 11 nt, Staphylococcus aureus subsp. aureus MW2
ucaauuuaaug

SEQ ID NO: 4005662 - RNA, 13 nt, Staphylococcus aureus subsp. aureus MW2
ucaauuuaauuaa

SEQ ID NO: 4005663 - RNA, 22 nt, Staphylococcus aureus subsp. aureus MW2
ucaauuuaguucacaauuucgu

SEQ ID NO: 4005664 - RNA, 20 nt, Staphylococcus aureus subsp. aureus MW2
ucaauuuaucgagaacauca

SEQ ID NO: 4005665 - RNA, 22 nt, Staphylococcus aureus subsp. aureus MW2
ucaauuucaccuuguaaauuga

SEQ ID NO: 4005666 - RNA, 16 nt, Staphylococcus aureus subsp. aureus MW2
ucaauuucauuugaaa

SEQ ID NO: 4005667 - RNA, 14 nt, Staphylococcus aureus subsp. aureus MW2
ucaauuucauuuuu

SEQ ID NO: 4005668 - RNA, 14 nt, Staphylococcus aureus subsp. aureus MW2
ucaauuucuauuuc

SEQ ID NO: 4005669 - RNA, 14 nt, Staphylococcus aureus subsp. aureus MW2
ucaauuucuguaau

SEQ ID NO: 4005670 - RNA, 14 nt, Staphylococcus aureus subsp. aureus MW2
ucaauuuggaaaua

SEQ ID NO: 4005671 - RNA, 18 nt, Staphylococcus aureus subsp. aureus MW2
ucaauuuggaaauaucuu

SEQ ID NO: 4005672 - RNA, 19 nt, Staphylococcus aureus subsp. aureus MW2
ucaauuuuaccauguuuua

SEQ ID NO: 4005673 - RNA, 18 nt, Staphylococcus aureus subsp. aureus MW2
ucacaaacaagaauaaau

SEQ ID NO: 4005674 - RNA, 13 nt, Staphylococcus aureus subsp. aureus MW2
ucacaaagaaauu

SEQ ID NO: 4005675 - RNA, 22 nt, Staphylococcus aureus subsp. aureus MW2
ucacaaauucuuuuacagcaag

SEQ ID NO: 4005676 - RNA, 19 nt, Staphylococcus aureus subsp. aureus MW2
ucacaacaguauuaauuac

SEQ ID NO: 4005677 - RNA, 16 nt, Staphylococcus aureus subsp. aureus MW2
ucacaacggcauaaua

SEQ ID NO: 4005678 - RNA, 17 nt, Staphylococcus aureus subsp. aureus MW2
ucacaacggcauaauac

SEQ ID NO: 4005679 - RNA, 22 nt, Staphylococcus aureus subsp. aureus MW2
ucacaauacgaaaccaaaaaua

SEQ ID NO: 4005680 - RNA, 14 nt, Staphylococcus aureus subsp. aureus MW2
ucacaauauaacau

SEQ ID NO: 4005681 - RNA, 15 nt, Staphylococcus aureus subsp. aureus MW2
ucacaauauacauuu

SEQ ID NO: 4005682 - RNA, 21 nt, Staphylococcus aureus subsp. aureus MW2
ucacaaugaccauugucaugc

SEQ ID NO: 4005683 - RNA, 14 nt, Staphylococcus aureus subsp. aureus MW2
ucacagcaauaaua

SEQ ID NO: 4005684 - RNA, 14 nt, Staphylococcus aureus subsp. aureus MW2
ucacaguguaauca

SEQ ID NO: 4005685 - RNA, 13 nt, Staphylococcus aureus subsp. aureus MW2
ucacauacauuuu

SEQ ID NO: 4005686 - RNA, 16 nt, Staphylococcus aureus subsp. aureus MW2
ucacauacauuuugaa

SEQ ID NO: 4005687 - RNA, 22 nt, Staphylococcus aureus subsp. aureus MW2
ucacauacauuuugaaacaucu

SEQ ID NO: 4005688 - RNA, 22 nt, Staphylococcus aureus subsp. aureus MW2
ucacauagccucuuaaaauacc

SEQ ID NO: 4005689 - RNA, 18 nt, Staphylococcus aureus subsp. aureus MW2
ucacauaugacuuuauuu

SEQ ID NO: 4005690 - RNA, 23 nt, Staphylococcus aureus subsp. aureus MW2
ucacaucacguugugcaauaccu

SEQ ID NO: 4005691 - RNA, 19 nt, Staphylococcus aureus subsp. aureus MW2
ucacaugccaucuuuguaa

SEQ ID NO: 4005692 - RNA, 18 nt, Staphylococcus aureus subsp. aureus MW2
ucacauguaccacauuuu

SEQ ID NO: 4005693 - RNA, 22 nt, Staphylococcus aureus subsp. aureus MW2
ucacauguaccacauuuuccuu

SEQ ID NO: 4005694 - RNA, 15 nt, Staphylococcus aureus subsp. aureus MW2
ucacauuaaguuaaa

SEQ ID NO: 4005695 - RNA, 18 nt, Staphylococcus aureus subsp. aureus MW2
ucacauuaaguuaaacgu

SEQ ID NO: 4005696 - RNA, 13 nt, Staphylococcus aureus subsp. aureus MW2
ucacauuauacaa

SEQ ID NO: 4005697 - RNA, 18 nt, Staphylococcus aureus subsp. aureus MW2
ucacauucuugaauaaau

SEQ ID NO: 4005698 - RNA, 16 nt, Staphylococcus aureus subsp. aureus MW2
ucaggguuuaagauuu

SEQ ID NO: 4005699 - RNA, 18 nt, Staphylococcus aureus subsp. aureus MW2
ucagguguaucuuugaua

SEQ ID NO: 4005700 - RNA, 14 nt, Staphylococcus aureus subsp. aureus MW2
ucagguuaacauuu

SEQ ID NO: 4005701 - RNA, 21 nt, Staphylococcus aureus subsp. aureus MW2
ucaguaacaguauaaauauuu

SEQ ID NO: 4005702 - RNA, 22 nt, Staphylococcus aureus subsp. aureus MW2
ucaguaacaguauaaauauuuu

SEQ ID NO: 4005703 - RNA, 15 nt, Staphylococcus aureus subsp. aureus MW2
ucaguaauaauguag

SEQ ID NO: 4005704 - RNA, 15 nt, Staphylococcus aureus subsp. aureus MW2
ucaguaccauguuuu

SEQ ID NO: 4005705 - RNA, 18 nt, Staphylococcus aureus subsp. aureus MW2
ucaguauuaggauuuacu

SEQ ID NO: 4005706 - RNA, 22 nt, Staphylococcus aureus subsp. aureus MW2
ucaguauuuguauugacaucuu

SEQ ID NO: 4005707 - RNA, 14 nt, Staphylococcus aureus subsp. aureus MW2
ucagucaauucaaa

SEQ ID NO: 4005708 - RNA, 15 nt, Staphylococcus aureus subsp. aureus MW2
ucagucauucacaua

SEQ ID NO: 4005709 - RNA, 20 nt, Staphylococcus aureus subsp. aureus MW2
ucaguccgcuuuuucauaga

SEQ ID NO: 4005710 - RNA, 21 nt, Staphylococcus aureus subsp. aureus MW2
ucagucucuaaaacuuuuuca

SEQ ID NO: 4005711 - RNA, 16 nt, Staphylococcus aureus subsp. aureus MW2
ucaguuaaaucuuuaa

SEQ ID NO: 4005712 - RNA, 13 nt, Staphylococcus aureus subsp. aureus MW2
ucaguuaauaauu

SEQ ID NO: 4005713 - RNA, 17 nt, Staphylococcus aureus subsp. aureus MW2
ucaguuagaagaugauu

SEQ ID NO: 4005714 - RNA, 13 nt, Staphylococcus aureus subsp. aureus MW2
ucaguuaggauga

SEQ ID NO: 4005715 - RNA, 18 nt, Staphylococcus aureus subsp. aureus MW2
ucaguuauaccauauuua

SEQ ID NO: 4005716 - RNA, 19 nt, Staphylococcus aureus subsp. aureus MW2
ucaguugcccgauuuuaaa

SEQ ID NO: 4005717 - RNA, 16 nt, Staphylococcus aureus subsp. aureus MW2
ucaguuguguaauaaa

SEQ ID NO: 4005718 - RNA, 19 nt, Staphylococcus aureus subsp. aureus MW2
ucauaaaaaucauaaauaa

SEQ ID NO: 4005719 - RNA, 20 nt, Staphylococcus aureus subsp. aureus MW2
ucauaaaaaucauaaauaac

SEQ ID NO: 4005720 - RNA, 13 nt, Staphylococcus aureus subsp. aureus MW2
ucauaaaauacca

SEQ ID NO: 4005721 - RNA, 20 nt, Staphylococcus aureus subsp. aureus MW2
ucauaaaauaccagaugaac

SEQ ID NO: 4005722 - RNA, 18 nt, Staphylococcus aureus subsp. aureus MW2
ucauaaaauuuaaaacaa

SEQ ID NO: 4005723 - RNA, 18 nt, Staphylococcus aureus subsp. aureus MW2
ucauaaacugaaucgauu

SEQ ID NO: 4005724 - RNA, 17 nt, Staphylococcus aureus subsp. aureus MW2
ucauaaaguuuauuuau

SEQ ID NO: 4005725 - RNA, 18 nt, Staphylococcus aureus subsp. aureus MW2
ucauaaaguuuauuuaug

SEQ ID NO: 4005726 - RNA, 18 nt, Staphylococcus aureus subsp. aureus MW2
ucauaaauauaaaauaug

SEQ ID NO: 4005727 - RNA, 12 nt, Staphylococcus aureus subsp. aureus MW2
ucauaaauauuu

SEQ ID NO: 4005728 - RNA, 18 nt, Staphylococcus aureus subsp. aureus MW2
ucauaaauauuuaaaaua

SEQ ID NO: 4005729 - RNA, 19 nt, Staphylococcus aureus subsp. aureus MW2
ucauaaaucaugaaauuaa

SEQ ID NO: 4005730 - RNA, 20 nt, Staphylococcus aureus subsp. aureus MW2
ucauaaauguuagauuucaa

SEQ ID NO: 4005731 - RNA, 22 nt, Staphylococcus aureus subsp. aureus MW2
ucauaaccgcuucuuuuaaguu

SEQ ID NO: 4005732 - RNA, 19 nt, Staphylococcus aureus subsp. aureus MW2
ucauaacgacaacuugaac

SEQ ID NO: 4005733 - RNA, 18 nt, Staphylococcus aureus subsp. aureus MW2
ucauaagaugcaugccaa

SEQ ID NO: 4005734 - RNA, 22 nt, Staphylococcus aureus subsp. aureus MW2
ucauaagucuuaacaaauuaaa

SEQ ID NO: 4005735 - RNA, 15 nt, Staphylococcus aureus subsp. aureus MW2
ucauaaguuaaaguu

SEQ ID NO: 4005736 - RNA, 17 nt, Staphylococcus aureus subsp. aureus MW2
ucauaauauauuaacaa

SEQ ID NO: 4005737 - RNA, 21 nt, Staphylococcus aureus subsp. aureus MW2
ucauaauauugaugaauaaau

SEQ ID NO: 4005738 - RNA, 13 nt, Staphylococcus aureus subsp. aureus MW2
ucauaaucaaguc

SEQ ID NO: 4005739 - RNA, 16 nt, Staphylococcus aureus subsp. aureus MW2
ucauaaucaagucugc

SEQ ID NO: 4005740 - RNA, 17 nt, Staphylococcus aureus subsp. aureus MW2
ucauaaucauaaaaauc

SEQ ID NO: 4005741 - RNA, 15 nt, Staphylococcus aureus subsp. aureus MW2
ucauaaucuacugcu

SEQ ID NO: 4005742 - RNA, 17 nt, Staphylococcus aureus subsp. aureus MW2
ucauaaugaucaaguag

SEQ ID NO: 4005743 - RNA, 11 nt, Staphylococcus aureus subsp. aureus MW2
ucauaauuaau

SEQ ID NO: 4005744 - RNA, 14 nt, Staphylococcus aureus subsp. aureus MW2
ucauaauuaauaac

SEQ ID NO: 4005745 - RNA, 16 nt, Staphylococcus aureus subsp. aureus MW2
ucauaauuaauaacau

SEQ ID NO: 4005746 - RNA, 15 nt, Staphylococcus aureus subsp. aureus MW2
ucauaauucaguguu

SEQ ID NO: 4005747 - RNA, 17 nt, Staphylococcus aureus subsp. aureus MW2
ucauaauuuucuauuau

SEQ ID NO: 4005748 - RNA, 22 nt, Staphylococcus aureus subsp. aureus MW2
ucauacacaaugauuauaaaua

SEQ ID NO: 4005749 - RNA, 17 nt, Staphylococcus aureus subsp. aureus MW2
ucauacacaaugccuuu

SEQ ID NO: 4005750 - RNA, 21 nt, Staphylococcus aureus subsp. aureus MW2
ucauacacuaucauuaucaaa

SEQ ID NO: 4005751 - RNA, 15 nt, Staphylococcus aureus subsp. aureus MW2
ucauacauaugcuau

SEQ ID NO: 4005752 - RNA, 18 nt, Staphylococcus aureus subsp. aureus MW2
ucauacauauuuauauuu

SEQ ID NO: 4005753 - RNA, 14 nt, Staphylococcus aureus subsp. aureus MW2
ucauacgagaaauu

SEQ ID NO: 4005754 - RNA, 17 nt, Staphylococcus aureus subsp. aureus MW2
ucauacuucaaacguua

SEQ ID NO: 4005755 - RNA, 20 nt, Staphylococcus aureus subsp. aureus MW2
ucauagaugacgaucuauaa

SEQ ID NO: 4005756 - RNA, 21 nt, Staphylococcus aureus subsp. aureus MW2
ucauagcaaauaaaacgcuuc

SEQ ID NO: 4005757 - RNA, 16 nt, Staphylococcus aureus subsp. aureus MW2
ucauagccuauuuaaa

SEQ ID NO: 4005758 - RNA, 23 nt, Staphylococcus aureus subsp. aureus MW2
ucauagucgguuauuacaaaauu

SEQ ID NO: 4005759 - RNA, 16 nt, Staphylococcus aureus subsp. aureus MW2
ucauagugaaauucga

SEQ ID NO: 4005760 - RNA, 15 nt, Staphylococcus aureus subsp. aureus MW2
ucauaguuaucgauu

SEQ ID NO: 4005761 - RNA, 14 nt, Staphylococcus aureus subsp. aureus MW2
ucauaguuauuaaa

SEQ ID NO: 4005762 - RNA, 16 nt, Staphylococcus aureus subsp. aureus MW2
ucauaguucaaauuga

SEQ ID NO: 4005763 - RNA, 14 nt, Staphylococcus aureus subsp. aureus MW2
ucauaguugucuuu

SEQ ID NO: 4005764 - RNA, 13 nt, Staphylococcus aureus subsp. aureus MW2
ucauauaaauagc

SEQ ID NO: 4005765 - RNA, 14 nt, Staphylococcus aureus subsp. aureus MW2
ucauauaaugaaug

SEQ ID NO: 4005766 - RNA, 19 nt, Staphylococcus aureus subsp. aureus MW2
ucauauaaugguugaauaa

SEQ ID NO: 4005767 - RNA, 21 nt, Staphylococcus aureus subsp. aureus MW2
ucauauauugacucgaccuuu

SEQ ID NO: 4005768 - RNA, 17 nt, Staphylococcus aureus subsp. aureus MW2
ucauauauuuuguuaau

SEQ ID NO: 4005769 - RNA, 22 nt, Staphylococcus aureus subsp. aureus MW2
ucauaucauaccaaaaaguauu

SEQ ID NO: 4005770 - RNA, 11 nt, Staphylococcus aureus subsp. aureus MW2
ucauaucuuua

SEQ ID NO: 4005771 - RNA, 17 nt, Staphylococcus aureus subsp. aureus MW2
ucauaucuuuauuugau

SEQ ID NO: 4005772 - RNA, 22 nt, Staphylococcus aureus subsp. aureus MW2
ucauaucuuuauuugauucuuc

SEQ ID NO: 4005773 - RNA, 14 nt, Staphylococcus aureus subsp. aureus MW2
ucauaucuuucaau

SEQ ID NO: 4005774 - RNA, 20 nt, Staphylococcus aureus subsp. aureus MW2
ucauaucuuucaauuaauuu

SEQ ID NO: 4005775 - RNA, 15 nt, Staphylococcus aureus subsp. aureus MW2
ucauaugcaucaaca

SEQ ID NO: 4005776 - RNA, 20 nt, Staphylococcus aureus subsp. aureus MW2
ucauaugguuaucuuaucga

SEQ ID NO: 4005777 - RNA, 18 nt, Staphylococcus aureus subsp. aureus MW2
ucauauguuuuauaauaa

SEQ ID NO: 4005778 - RNA, 20 nt, Staphylococcus aureus subsp. aureus MW2
ucauauguuuuauaauaaau

SEQ ID NO: 4005779 - RNA, 15 nt, Staphylococcus aureus subsp. aureus MW2
ucauauuaauauuuu

SEQ ID NO: 4005780 - RNA, 19 nt, Staphylococcus aureus subsp. aureus MW2
ucauauucaaaauaacuua

SEQ ID NO: 4005781 - RNA, 13 nt, Staphylococcus aureus subsp. aureus MW2
ucauauucacauc

SEQ ID NO: 4005782 - RNA, 15 nt, Staphylococcus aureus subsp. aureus MW2
ucauauucacaucuu

SEQ ID NO: 4005783 - RNA, 13 nt, Staphylococcus aureus subsp. aureus MW2
ucauauugaauac

SEQ ID NO: 4005784 - RNA, 12 nt, Staphylococcus aureus subsp. aureus MW2
ucauauuuaaug

SEQ ID NO: 4005785 - RNA, 17 nt, Staphylococcus aureus subsp. aureus MW2
ucauauuuaauguuuca

SEQ ID NO: 4005786 - RNA, 18 nt, Staphylococcus aureus subsp. aureus MW2
ucauauuuagguaauaca

SEQ ID NO: 4005787 - RNA, 18 nt, Staphylococcus aureus subsp. aureus MW2
ucauuggcaauauacuuu

SEQ ID NO: 4005788 - RNA, 23 nt, Staphylococcus aureus subsp. aureus MW2
ucauuggcaauauacuuuuuaaa

SEQ ID NO: 4005789 - RNA, 12 nt, Staphylococcus aureus subsp. aureus MW2
ucauuguauaaa

SEQ ID NO: 4005790 - RNA, 15 nt, Staphylococcus aureus subsp. aureus MW2
ucauuguauaaaaag

SEQ ID NO: 4005791 - RNA, 16 nt, Staphylococcus aureus subsp. aureus MW2
ucauuguauaaaaagu

SEQ ID NO: 4005792 - RNA, 19 nt, Staphylococcus aureus subsp. aureus MW2
ucauuguguccauaaauau

SEQ ID NO: 4005793 - RNA, 16 nt, Staphylococcus aureus subsp. aureus MW2
ucauuguuuuaaauuu

SEQ ID NO: 4005794 - RNA, 17 nt, Staphylococcus aureus subsp. aureus MW2
ucauuguuuuaaauuuu

SEQ ID NO: 4005795 - RNA, 12 nt, Staphylococcus aureus subsp. aureus MW2
ucauuuaaaaua

SEQ ID NO: 4005796 - RNA, 13 nt, Staphylococcus aureus subsp. aureus MW2
ucauuuaaaauau

SEQ ID NO: 4005797 - RNA, 13 nt, Staphylococcus aureus subsp. aureus MW2
ucauuuaaauauu

SEQ ID NO: 4005798 - RNA, 22 nt, Staphylococcus aureus subsp. aureus MW2
ucauuuaaauuaguuauacuaa

SEQ ID NO: 4005799 - RNA, 20 nt, Staphylococcus aureus subsp. aureus MW2
ucauuuaacauguauuuagu

SEQ ID NO: 4005800 - RNA, 13 nt, Staphylococcus aureus subsp. aureus MW2
ucauuuauaacau

SEQ ID NO: 4005801 - RNA, 20 nt, Staphylococcus aureus subsp. aureus MW2
ucauuucaaauaagaaugug

SEQ ID NO: 4005802 - RNA, 22 nt, Staphylococcus aureus subsp. aureus MW2
ucauuucaauauuaaaauacgg

SEQ ID NO: 4005803 - RNA, 17 nt, Staphylococcus aureus subsp. aureus MW2
ucauuucaguauauuuu

SEQ ID NO: 4005804 - RNA, 16 nt, Staphylococcus aureus subsp. aureus MW2
ucauuucgauuaauuu

SEQ ID NO: 4005805 - RNA, 19 nt, Staphylococcus aureus subsp. aureus MW2
ucauuucgauuaauuuaau

SEQ ID NO: 4005806 - RNA, 16 nt, Staphylococcus aureus subsp. aureus MW2
ucauuuggcguucaac

SEQ ID NO: 4005807 - RNA, 14 nt, Staphylococcus aureus subsp. aureus MW2
ucauuuucaaauaa

SEQ ID NO: 4005808 - RNA, 12 nt, Staphylococcus aureus subsp. aureus MW2
ucauuuucaaua

SEQ ID NO: 4005809 - RNA, 16 nt, Staphylococcus aureus subsp. aureus MW2
ucauuuucauuguaug

SEQ ID NO: 4005810 - RNA, 14 nt, Staphylococcus aureus subsp. aureus MW2
ucauuuucuugauu

SEQ ID NO: 4005811 - RNA, 13 nt, Staphylococcus aureus subsp. aureus MW2
ucauuuuggcaaa

SEQ ID NO: 4005812 - RNA, 11 nt, Staphylococcus aureus subsp. aureus MW2
ucauuuuuaau

SEQ ID NO: 4005813 - RNA, 12 nt, Staphylococcus aureus subsp. aureus MW2
ucauuuuucgcc

SEQ ID NO: 4005814 - RNA, 13 nt, Staphylococcus aureus subsp. aureus MW2
ucauuuuuggaug

SEQ ID NO: 4005815 - RNA, 12 nt, Staphylococcus aureus subsp. aureus MW2
ucauuuuuucaa

SEQ ID NO: 4005816 - RNA, 13 nt, Staphylococcus aureus subsp. aureus MW2
ucauuuuuucaau

SEQ ID NO: 4005817 - RNA, 22 nt, Staphylococcus aureus subsp. aureus MW2
ucauuuuuucgagaugauauua

SEQ ID NO: 4005818 - RNA, 18 nt, Staphylococcus aureus subsp. aureus MW2
ucauuuuuugcaaaauuu

SEQ ID NO: 4005819 - RNA, 13 nt, Staphylococcus aureus subsp. aureus MW2
uccaaaaauugua

SEQ ID NO: 4005820 - RNA, 19 nt, Staphylococcus aureus subsp. aureus MW2
uccaaaaauuguaaaaccu

SEQ ID NO: 4005821 - RNA, 13 nt, Staphylococcus aureus subsp. aureus MW2
uccaaaauccuga

SEQ ID NO: 4005822 - RNA, 16 nt, Staphylococcus aureus subsp. aureus MW2
uccaaaauccugaaau

SEQ ID NO: 4005823 - RNA, 13 nt, Staphylococcus aureus subsp. aureus MW2
uccaaacauagag

SEQ ID NO: 4005824 - RNA, 15 nt, Staphylococcus aureus subsp. aureus MW2
uccaaagaaacggaa

SEQ ID NO: 4005825 - RNA, 21 nt, Staphylococcus aureus subsp. aureus MW2
uccaaagcuugauuuaacaac

SEQ ID NO: 4005826 - RNA, 22 nt, Staphylococcus aureus subsp. aureus MW2
uccaaaguaacauaugcaagua

SEQ ID NO: 4005827 - RNA, 14 nt, Staphylococcus aureus subsp. aureus MW2
uccaaauaaauaua

SEQ ID NO: 4005828 - RNA, 14 nt, Staphylococcus aureus subsp. aureus MW2
uccaaauauuaaaa

SEQ ID NO: 4005829 - RNA, 16 nt, Staphylococcus aureus subsp. aureus MW2
uccaaauauuaaaaac

SEQ ID NO: 4005830 - RNA, 18 nt, Staphylococcus aureus subsp. aureus MW2
uccaaaucgugauaucuu

SEQ ID NO: 4005831 - RNA, 21 nt, Staphylococcus aureus subsp. aureus MW2
uccaacacccauauaauuugg

SEQ ID NO: 4005832 - RNA, 18 nt, Staphylococcus aureus subsp. aureus MW2
uccaacauguaacaaaau

SEQ ID NO: 4005833 - RNA, 17 nt, Staphylococcus aureus subsp. aureus MW2
uccaacucuaacagcuu

SEQ ID NO: 4005834 - RNA, 16 nt, Staphylococcus aureus subsp. aureus MW2
uccaagauuaugacaa

SEQ ID NO: 4005835 - RNA, 16 nt, Staphylococcus aureus subsp. aureus MW2
uccaagcaaucuuagu

SEQ ID NO: 4005836 - RNA, 22 nt, Staphylococcus aureus subsp. aureus MW2
uccaagcgcuucaggcauaacu

SEQ ID NO: 4005837 - RNA, 22 nt, Staphylococcus aureus subsp. aureus MW2
uccaaggauguuauaaaaugaa

SEQ ID NO: 4005838 - RNA, 15 nt, Staphylococcus aureus subsp. aureus MW2
uccaagugacaacau

SEQ ID NO: 4005839 - RNA, 19 nt, Staphylococcus aureus subsp. aureus MW2
uccaagugacaacauuauu

SEQ ID NO: 4005840 - RNA, 14 nt, Staphylococcus aureus subsp. aureus MW2
uccaauaaacguug

SEQ ID NO: 4005841 - RNA, 19 nt, Staphylococcus aureus subsp. aureus MW2
uccaauacuuuuuauauaa

SEQ ID NO: 4005842 - RNA, 16 nt, Staphylococcus aureus subsp. aureus MW2
uccaaucaucauuaaa

SEQ ID NO: 4005843 - RNA, 20 nt, Staphylococcus aureus subsp. aureus MW2
uccaaucaucauuaaaucug

SEQ ID NO: 4005844 - RNA, 17 nt, Staphylococcus aureus subsp. aureus MW2
uccaaucuuuuuaauug

SEQ ID NO: 4005845 - RNA, 20 nt, Staphylococcus aureus subsp. aureus MW2
uccaauuaaauauuuaaccu

SEQ ID NO: 4005846 - RNA, 15 nt, Staphylococcus aureus subsp. aureus MW2
uccaauuaccaauga

SEQ ID NO: 4005847 - RNA, 21 nt, Staphylococcus aureus subsp. aureus MW2
uccaauuaccaaugaauaaau

SEQ ID NO: 4005848 - RNA, 15 nt, Staphylococcus aureus subsp. aureus MW2
uccaauuauguuuau

SEQ ID NO: 4005849 - RNA, 15 nt, Staphylococcus aureus subsp. aureus MW2
uccaauuuauaauga

SEQ ID NO: 4005850 - RNA, 16 nt, Staphylococcus aureus subsp. aureus MW2
uccaauuuauaaugau

SEQ ID NO: 4005851 - RNA, 18 nt, Staphylococcus aureus subsp. aureus MW2
uccaauuuauaaugauua

SEQ ID NO: 4005852 - RNA, 14 nt, Staphylococcus aureus subsp. aureus MW2
uccaauuucucuau

SEQ ID NO: 4005853 - RNA, 15 nt, Staphylococcus aureus subsp. aureus MW2
uccacaaauaacacc

SEQ ID NO: 4005854 - RNA, 17 nt, Staphylococcus aureus subsp. aureus MW2
uccacaucccaauuuaa

SEQ ID NO: 4005855 - RNA, 22 nt, Staphylococcus aureus subsp. aureus MW2
uccaccugauaacgagcuaaua

SEQ ID NO: 4005856 - RNA, 18 nt, Staphylococcus aureus subsp. aureus MW2
uccagacuccuaaauuau

SEQ ID NO: 4005857 - RNA, 23 nt, Staphylococcus aureus subsp. aureus MW2
uccaguccuuuuuuuauguuuaa

SEQ ID NO: 4005858 - RNA, 14 nt, Staphylococcus aureus subsp. aureus MW2
uccaguuuucaauu

SEQ ID NO: 4005859 - RNA, 16 nt, Staphylococcus aureus subsp. aureus MW2
uccaguuuucaauuua

SEQ ID NO: 4005860 - RNA, 16 nt, Staphylococcus aureus subsp. aureus MW2
uccauaaauaaaaugc

SEQ ID NO: 4005861 - RNA, 18 nt, Staphylococcus aureus subsp. aureus MW2
uccauaaauaaaaugcua

SEQ ID NO: 4005862 - RNA, 17 nt, Staphylococcus aureus subsp. aureus MW2
uccauaaauauuaaauu

SEQ ID NO: 4005863 - RNA, 18 nt, Staphylococcus aureus subsp. aureus MW2
uccauaaucuuuauuaau

SEQ ID NO: 4005864 - RNA, 20 nt, Staphylococcus aureus subsp. aureus MW2
uccauagaaauuguaguauu

SEQ ID NO: 4005865 - RNA, 12 nt, Staphylococcus aureus subsp. aureus MW2
uccauaguaauc

SEQ ID NO: 4005866 - RNA, 21 nt, Staphylococcus aureus subsp. aureus MW2
uccauaguaaucgauugguaa

SEQ ID NO: 4005867 - RNA, 17 nt, Staphylococcus aureus subsp. aureus MW2
uccauaguauguaucuu

SEQ ID NO: 4005868 - RNA, 17 nt, Staphylococcus aureus subsp. aureus MW2
uccauauaaccuauuuc

SEQ ID NO: 4005869 - RNA, 18 nt, Staphylococcus aureus subsp. aureus MW2
uccaucaauaccauaauu

SEQ ID NO: 4005870 - RNA, 16 nt, Staphylococcus aureus subsp. aureus MW2
uccaucaucucugcuu

SEQ ID NO: 4005871 - RNA, 21 nt, Staphylococcus aureus subsp. aureus MW2
uccaucauuuguguaaaugaa

SEQ ID NO: 4005872 - RNA, 17 nt, Staphylococcus aureus subsp. aureus MW2
uccaucgucaucacuuu

SEQ ID NO: 4005873 - RNA, 19 nt, Staphylococcus aureus subsp. aureus MW2
uccaucgucaucacuuuuu

SEQ ID NO: 4005874 - RNA, 22 nt, Staphylococcus aureus subsp. aureus MW2
uccaucgucaucacuuuuuaaa

SEQ ID NO: 4005875 - RNA, 15 nt, Staphylococcus aureus subsp. aureus MW2
uccaucuacacccau

SEQ ID NO: 4005876 - RNA, 17 nt, Staphylococcus aureus subsp. aureus MW2
uccuuuagcaaaaauau

SEQ ID NO: 4005877 - RNA, 15 nt, Staphylococcus aureus subsp. aureus MW2
uccuuuauacguuac

SEQ ID NO: 4005878 - RNA, 15 nt, Staphylococcus aureus subsp. aureus MW2
uccuuuauauuuagu

SEQ ID NO: 4005879 - RNA, 17 nt, Staphylococcus aureus subsp. aureus MW2
uccuuucaauaauaaau

SEQ ID NO: 4005880 - RNA, 14 nt, Staphylococcus aureus subsp. aureus MW2
uccuuuguuuguaa

SEQ ID NO: 4005881 - RNA, 14 nt, Staphylococcus aureus subsp. aureus MW2
uccuuuuacuuaau

SEQ ID NO: 4005882 - RNA, 16 nt, Staphylococcus aureus subsp. aureus MW2
uccuuuugaauaauaa

SEQ ID NO: 4005883 - RNA, 13 nt, Staphylococcus aureus subsp. aureus MW2
ucgaaaagaaauu

SEQ ID NO: 4005884 - RNA, 23 nt, Staphylococcus aureus subsp. aureus MW2
ucgaaaauagcuauuaaaauaga

SEQ ID NO: 4005885 - RNA, 14 nt, Staphylococcus aureus subsp. aureus MW2
ucgaaaauuucagg

SEQ ID NO: 4005886 - RNA, 20 nt, Staphylococcus aureus subsp. aureus MW2
ucgaaaugccuucuguacgu

SEQ ID NO: 4005887 - RNA, 15 nt, Staphylococcus aureus subsp. aureus MW2
ucgaaauucucugug

SEQ ID NO: 4005888 - RNA, 12 nt, Staphylococcus aureus subsp. aureus MW2
ucgaacagaaaa

SEQ ID NO: 4005889 - RNA, 17 nt, Staphylococcus aureus subsp. aureus MW2
ucgaacguuugaaaaau

SEQ ID NO: 4005890 - RNA, 18 nt, Staphylococcus aureus subsp. aureus MW2
ucgaacguuugaaaaauu

SEQ ID NO: 4005891 - RNA, 17 nt, Staphylococcus aureus subsp. aureus MW2
ucgaacugauggaaaag

SEQ ID NO: 4005892 - RNA, 20 nt, Staphylococcus aureus subsp. aureus MW2
ucgaauaacuguuuaucaug

SEQ ID NO: 4005893 - RNA, 21 nt, Staphylococcus aureus subsp. aureus MW2
ucgaauguauugcuauaagaa

SEQ ID NO: 4005894 - RNA, 17 nt, Staphylococcus aureus subsp. aureus MW2
ucgaauuaaccccuuca

SEQ ID NO: 4005895 - RNA, 15 nt, Staphylococcus aureus subsp. aureus MW2
ucgaauucauuugca

SEQ ID NO: 4005896 - RNA, 20 nt, Staphylococcus aureus subsp. aureus MW2
ucgacaacugauuuaauauc

SEQ ID NO: 4005897 - RNA, 20 nt, Staphylococcus aureus subsp. aureus MW2
ucgacuaauuuuucuuucag

SEQ ID NO: 4005898 - RNA, 22 nt, Staphylococcus aureus subsp. aureus MW2
ucgacuaauuuuucuuucaggc

SEQ ID NO: 4005899 - RNA, 14 nt, Staphylococcus aureus subsp. aureus MW2
ucgacuuuucuauc

SEQ ID NO: 4005900 - RNA, 15 nt, Staphylococcus aureus subsp. aureus MW2
ucgagaggguacacu

SEQ ID NO: 4005901 - RNA, 14 nt, Staphylococcus aureus subsp. aureus MW2
ucgaguaauacuuu

SEQ ID NO: 4005902 - RNA, 23 nt, Staphylococcus aureus subsp. aureus MW2
ucgauaacguugccauacccaua

SEQ ID NO: 4005903 - RNA, 14 nt, Staphylococcus aureus subsp. aureus MW2
ucgauaauauaacu

SEQ ID NO: 4005904 - RNA, 17 nt, Staphylococcus aureus subsp. aureus MW2
ucgauaccuaaaauacc

SEQ ID NO: 4005905 - RNA, 15 nt, Staphylococcus aureus subsp. aureus MW2
ucgauaugaauaacc

SEQ ID NO: 4005906 - RNA, 16 nt, Staphylococcus aureus subsp. aureus MW2
ucgauaugaccauagu

SEQ ID NO: 4005907 - RNA, 22 nt, Staphylococcus aureus subsp. aureus MW2
ucgauauggucuuuuaauauuu

SEQ ID NO: 4005908 - RNA, 23 nt, Staphylococcus aureus subsp. aureus MW2
ucgauauggucuuuuaauauuuu

SEQ ID NO: 4005909 - RNA, 20 nt, Staphylococcus aureus subsp. aureus MW2
ucgauauuucuaguugcaau

SEQ ID NO: 4005910 - RNA, 17 nt, Staphylococcus aureus subsp. aureus MW2
ucgauauuuguuucgua

SEQ ID NO: 4005911 - RNA, 16 nt, Staphylococcus aureus subsp. aureus MW2
ucgaucgguauuuuca

SEQ ID NO: 4005912 - RNA, 17 nt, Staphylococcus aureus subsp. aureus MW2
ucgaucgguauuuucau

SEQ ID NO: 4005913 - RNA, 17 nt, Staphylococcus aureus subsp. aureus MW2
ucgaugacuuugucuuu

SEQ ID NO: 4005914 - RNA, 14 nt, Staphylococcus aureus subsp. aureus MW2
ucgauuaauucuuc

SEQ ID NO: 4005915 - RNA, 16 nt, Staphylococcus aureus subsp. aureus MW2
ucgauuaauucuucuu

SEQ ID NO: 4005916 - RNA, 17 nt, Staphylococcus aureus subsp. aureus MW2
ucgauuaauucuucuuc

SEQ ID NO: 4005917 - RNA, 19 nt, Staphylococcus aureus subsp. aureus MW2
ucgauuauucuuaauuuaa

SEQ ID NO: 4005918 - RNA, 14 nt, Staphylococcus aureus subsp. aureus MW2
ucgauuauuuagau

SEQ ID NO: 4005919 - RNA, 14 nt, Staphylococcus aureus subsp. aureus MW2
ucgauucgugauuu

SEQ ID NO: 4005920 - RNA, 21 nt, Staphylococcus aureus subsp. aureus MW2
ucgauucuccuuuuguuucaa

SEQ ID NO: 4005921 - RNA, 16 nt, Staphylococcus aureus subsp. aureus MW2
ucgauugcguuuucua

SEQ ID NO: 4005922 - RNA, 16 nt, Staphylococcus aureus subsp. aureus MW2
ucgauugguaaaucua

SEQ ID NO: 4005923 - RNA, 14 nt, Staphylococcus aureus subsp. aureus MW2
ucgauuuuuuaaug

SEQ ID NO: 4005924 - RNA, 22 nt, Staphylococcus aureus subsp. aureus MW2
ucgauuuuuuaaugucuaaaaa

SEQ ID NO: 4005925 - RNA, 13 nt, Staphylococcus aureus subsp. aureus MW2
ucgcaaaaacaua

SEQ ID NO: 4005926 - RNA, 18 nt, Staphylococcus aureus subsp. aureus MW2
ucgcaaaaacauaaucau

SEQ ID NO: 4005927 - RNA, 14 nt, Staphylococcus aureus subsp. aureus MW2
ucgcaaugucaucu

SEQ ID NO: 4005928 - RNA, 21 nt, Staphylococcus aureus subsp. aureus MW2
ucgcaaugucaucuugacaca

SEQ ID NO: 4005929 - RNA, 21 nt, Staphylococcus aureus subsp. aureus MW2
ucgcaccgucaaacuuaaaac

SEQ ID NO: 4005930 - RNA, 15 nt, Staphylococcus aureus subsp. aureus MW2
ucgcacucugcaucg

SEQ ID NO: 4005931 - RNA, 18 nt, Staphylococcus aureus subsp. aureus MW2
ucgcaucuuuguuuucaa

SEQ ID NO: 4005932 - RNA, 22 nt, Staphylococcus aureus subsp. aureus MW2
ucgcauucuugguuuuuuagau

SEQ ID NO: 4005933 - RNA, 15 nt, Staphylococcus aureus subsp. aureus MW2
ucgccaacuaaauca

SEQ ID NO: 4005934 - RNA, 20 nt, Staphylococcus aureus subsp. aureus MW2
ucgccuaaaaauaaaaucaa

SEQ ID NO: 4005935 - RNA, 17 nt, Staphylococcus aureus subsp. aureus MW2
ucgccuacuauaaauac

SEQ ID NO: 4005936 - RNA, 18 nt, Staphylococcus aureus subsp. aureus MW2
ucgccuuuuuuauuuuuc

SEQ ID NO: 4005937 - RNA, 16 nt, Staphylococcus aureus subsp. aureus MW2
ucgcgcucuucuucag

SEQ ID NO: 4005938 - RNA, 13 nt, Staphylococcus aureus subsp. aureus MW2
ucgcuaauacuuu

SEQ ID NO: 4005939 - RNA, 16 nt, Staphylococcus aureus subsp. aureus MW2
ucgcucacaugugaaa

SEQ ID NO: 4005940 - RNA, 21 nt, Staphylococcus aureus subsp. aureus MW2
ucgcucacaugugaaauaauc

SEQ ID NO: 4005941 - RNA, 17 nt, Staphylococcus aureus subsp. aureus MW2
ucgcucauccucauuaa

SEQ ID NO: 4005942 - RNA, 15 nt, Staphylococcus aureus subsp. aureus MW2
ucgcugcuacaccac

SEQ ID NO: 4005943 - RNA, 17 nt, Staphylococcus aureus subsp. aureus MW2
ucgcugcuacaccaccu

SEQ ID NO: 4005944 - RNA, 23 nt, Staphylococcus aureus subsp. aureus MW2
ucgcuugcuucuuuccucuccuu

SEQ ID NO: 4005945 - RNA, 19 nt, Staphylococcus aureus subsp. aureus MW2
ucgcuuuucuaauuuuucu

SEQ ID NO: 4005946 - RNA, 13 nt, Staphylococcus aureus subsp. aureus MW2
ucggaauaaaaua

SEQ ID NO: 4005947 - RNA, 14 nt, Staphylococcus aureus subsp. aureus MW2
ucggaauaaaauaa

SEQ ID NO: 4005948 - RNA, 18 nt, Staphylococcus aureus subsp. aureus MW2
ucggauaccaaaacucaa

SEQ ID NO: 4005949 - RNA, 16 nt, Staphylococcus aureus subsp. aureus MW2
ucggauuaaaaguauc

SEQ ID NO: 4005950 - RNA, 22 nt, Staphylococcus aureus subsp. aureus MW2
ucggauugaaccggaaauuaaa

SEQ ID NO: 4005951 - RNA, 13 nt, Staphylococcus aureus subsp. aureus MW2
ucggcucucgcuu

SEQ ID NO: 4005952 - RNA, 13 nt, Staphylococcus aureus subsp. aureus MW2
ucggcuuucuaag

SEQ ID NO: 4005953 - RNA, 18 nt, Staphylococcus aureus subsp. aureus MW2
ucgggaucuaauuuuucc

SEQ ID NO: 4005954 - RNA, 14 nt, Staphylococcus aureus subsp. aureus MW2
ucgggcuaguuuuu

SEQ ID NO: 4005955 - RNA, 21 nt, Staphylococcus aureus subsp. aureus MW2
ucggggccccaacacagagaa

SEQ ID NO: 4005956 - RNA, 18 nt, Staphylococcus aureus subsp. aureus MW2
ucgguacuugccuauuuu

SEQ ID NO: 4005957 - RNA, 14 nt, Staphylococcus aureus subsp. aureus MW2
ucgguaugauauuu

SEQ ID NO: 4005958 - RNA, 14 nt, Staphylococcus aureus subsp. aureus MW2
ucgguauucaauuc

SEQ ID NO: 4005959 - RNA, 15 nt, Staphylococcus aureus subsp. aureus MW2
ucgguucaucuaaaa

SEQ ID NO: 4005960 - RNA, 16 nt, Staphylococcus aureus subsp. aureus MW2
ucgguucaucuaaaau

SEQ ID NO: 4005961 - RNA, 17 nt, Staphylococcus aureus subsp. aureus MW2
ucgguucaucuaaaauu

SEQ ID NO: 4005962 - RNA, 15 nt, Staphylococcus aureus subsp. aureus MW2
ucgguuuauuuaaua

SEQ ID NO: 4005963 - RNA, 17 nt, Staphylococcus aureus subsp. aureus MW2
ucguaacucuuuaauuu

SEQ ID NO: 4005964 - RNA, 14 nt, Staphylococcus aureus subsp. aureus MW2
ucguaccugcucuu

SEQ ID NO: 4005965 - RNA, 22 nt, Staphylococcus aureus subsp. aureus MW2
ucuaauuuuuccaacuucuuuu

SEQ ID NO: 4005966 - RNA, 18 nt, Staphylococcus aureus subsp. aureus MW2
ucuaauuuuucuuuaagc

SEQ ID NO: 4005967 - RNA, 15 nt, Staphylococcus aureus subsp. aureus MW2
ucuacaaaguuaauc

SEQ ID NO: 4005968 - RNA, 18 nt, Staphylococcus aureus subsp. aureus MW2
ucuacaaaguuaaucaua

SEQ ID NO: 4005969 - RNA, 18 nt, Staphylococcus aureus subsp. aureus MW2
ucuacaauauuaaaauua

SEQ ID NO: 4005970 - RNA, 19 nt, Staphylococcus aureus subsp. aureus MW2
ucuacaauauuaaaauuaa

SEQ ID NO: 4005971 - RNA, 15 nt, Staphylococcus aureus subsp. aureus MW2
ucuacaauugcgacc

SEQ ID NO: 4005972 - RNA, 18 nt, Staphylococcus aureus subsp. aureus MW2
ucuacagacaaugcaagu

SEQ ID NO: 4005973 - RNA, 22 nt, Staphylococcus aureus subsp. aureus MW2
ucuacagacaaugcaaguuggc

SEQ ID NO: 4005974 - RNA, 21 nt, Staphylococcus aureus subsp. aureus MW2
ucuacagcgucaccuaaugcu

SEQ ID NO: 4005975 - RNA, 22 nt, Staphylococcus aureus subsp. aureus MW2
ucuacaggcaaugcaaguuggg

SEQ ID NO: 4005976 - RNA, 14 nt, Staphylococcus aureus subsp. aureus MW2
ucuacaguuuuaug

SEQ ID NO: 4005977 - RNA, 15 nt, Staphylococcus aureus subsp. aureus MW2
ucuacauaauuugaa

SEQ ID NO: 4005978 - RNA, 13 nt, Staphylococcus aureus subsp. aureus MW2
ucuacauauacaa

SEQ ID NO: 4005979 - RNA, 19 nt, Staphylococcus aureus subsp. aureus MW2
ucuacaugaaucaacaaua

SEQ ID NO: 4005980 - RNA, 24 nt, Staphylococcus aureus subsp. aureus MW2
ucuacauuaaagaaaauaucugaa

SEQ ID NO: 4005981 - RNA, 17 nt, Staphylococcus aureus subsp. aureus MW2
ucuaccaauaauucccu

SEQ ID NO: 4005982 - RNA, 22 nt, Staphylococcus aureus subsp. aureus MW2
ucuaccaauaauucccuaggaa

SEQ ID NO: 4005983 - RNA, 16 nt, Staphylococcus aureus subsp. aureus MW2
ucuaccaauacguuuc

SEQ ID NO: 4005984 - RNA, 15 nt, Staphylococcus aureus subsp. aureus MW2
ucuaccgaaugaguu

SEQ ID NO: 4005985 - RNA, 18 nt, Staphylococcus aureus subsp. aureus MW2
ucuacgaucaaaaucaug

SEQ ID NO: 4005986 - RNA, 22 nt, Staphylococcus aureus subsp. aureus MW2
ucuacucgaaaccagcuuacug

SEQ ID NO: 4005987 - RNA, 19 nt, Staphylococcus aureus subsp. aureus MW2
ucuacuuaaaauaaguauu

SEQ ID NO: 4005988 - RNA, 13 nt, Staphylococcus aureus subsp. aureus MW2
ucuacuuuguucu

SEQ ID NO: 4005989 - RNA, 19 nt, Staphylococcus aureus subsp. aureus MW2
ucuaggcuccuaaauguua

SEQ ID NO: 4005990 - RNA, 14 nt, Staphylococcus aureus subsp. aureus MW2
ucuagguuagaauu

SEQ ID NO: 4005991 - RNA, 22 nt, Staphylococcus aureus subsp. aureus MW2
ucuaguacaccucuaaguucac

SEQ ID NO: 4005992 - RNA, 20 nt, Staphylococcus aureus subsp. aureus MW2
ucuaguagcuagaacagaua

SEQ ID NO: 4005993 - RNA, 14 nt, Staphylococcus aureus subsp. aureus MW2
ucuauaaagaauga

SEQ ID NO: 4005994 - RNA, 12 nt, Staphylococcus aureus subsp. aureus MW2
ucuauaaauauc

SEQ ID NO: 4005995 - RNA, 13 nt, Staphylococcus aureus subsp. aureus MW2
ucuauaaauauca

SEQ ID NO: 4005996 - RNA, 15 nt, Staphylococcus aureus subsp. aureus MW2
ucuauaaauuauuuu

SEQ ID NO: 4005997 - RNA, 15 nt, Staphylococcus aureus subsp. aureus MW2
ucuauaauauucaau

SEQ ID NO: 4005998 - RNA, 19 nt, Staphylococcus aureus subsp. aureus MW2
ucuauaauauucaauaauu

SEQ ID NO: 4005999 - RNA, 23 nt, Staphylococcus aureus subsp. aureus MW2
ucuauacauuccaaaguaccauc

SEQ ID NO: 4006000 - RNA, 19 nt, Staphylococcus aureus subsp. aureus MW2
ucuauacuuuuaauuguau

SEQ ID NO: 4006001 - RNA, 15 nt, Staphylococcus aureus subsp. aureus MW2
ucuauagcacugaaa

SEQ ID NO: 4006002 - RNA, 19 nt, Staphylococcus aureus subsp. aureus MW2
ucuauagcacugaaaucua

SEQ ID NO: 4006003 - RNA, 16 nt, Staphylococcus aureus subsp. aureus MW2
ucuauauaaaaacugu

SEQ ID NO: 4006004 - RNA, 15 nt, Staphylococcus aureus subsp. aureus MW2
ucuauauaaauguuu

SEQ ID NO: 4006005 - RNA, 19 nt, Staphylococcus aureus subsp. aureus MW2
ucuauauaaauguuuauau

SEQ ID NO: 4006006 - RNA, 21 nt, Staphylococcus aureus subsp. aureus MW2
ucuauauaacgcuuuaaauca

SEQ ID NO: 4006007 - RNA, 19 nt, Staphylococcus aureus subsp. aureus MW2
ucuauaucgucgauuucau

SEQ ID NO: 4006008 - RNA, 21 nt, Staphylococcus aureus subsp. aureus MW2
ucuauaucgucgauuucauua

SEQ ID NO: 4006009 - RNA, 16 nt, Staphylococcus aureus subsp. aureus MW2
ucuauaugcauauauu

SEQ ID NO: 4006010 - RNA, 18 nt, Staphylococcus aureus subsp. aureus MW2
ucuauauuaauaaucuuc

SEQ ID NO: 4006011 - RNA, 13 nt, Staphylococcus aureus subsp. aureus MW2
ucuauauuuaauu

SEQ ID NO: 4006012 - RNA, 15 nt, Staphylococcus aureus subsp. aureus MW2
ucuauauuuuauuag

SEQ ID NO: 4006013 - RNA, 12 nt, Staphylococcus aureus subsp. aureus MW2
ucuaucaaauua

SEQ ID NO: 4006014 - RNA, 19 nt, Staphylococcus aureus subsp. aureus MW2
ucuaucaguaugaaguugc

SEQ ID NO: 4006015 - RNA, 20 nt, Staphylococcus aureus subsp. aureus MW2
ucuauccaaagacauacagu

SEQ ID NO: 4006016 - RNA, 23 nt, Staphylococcus aureus subsp. aureus MW2
ucuauccaaagacauacagucaa

SEQ ID NO: 4006017 - RNA, 16 nt, Staphylococcus aureus subsp. aureus MW2
ucuaucgccuaaaaau

SEQ ID NO: 4006018 - RNA, 17 nt, Staphylococcus aureus subsp. aureus MW2
ucuaucgccuaaaaaua

SEQ ID NO: 4006019 - RNA, 18 nt, Staphylococcus aureus subsp. aureus MW2
ucuaucgguauaucuaaa

SEQ ID NO: 4006020 - RNA, 16 nt, Staphylococcus aureus subsp. aureus MW2
ucuaucuauucaaaua

SEQ ID NO: 4006021 - RNA, 16 nt, Staphylococcus aureus subsp. aureus MW2
ucuaucuauuuuacuc

SEQ ID NO: 4006022 - RNA, 21 nt, Staphylococcus aureus subsp. aureus MW2
ucuaucuccgcuacaauuaua

SEQ ID NO: 4006023 - RNA, 14 nt, Staphylococcus aureus subsp. aureus MW2
ucuaucuuguucuu

SEQ ID NO: 4006024 - RNA, 14 nt, Staphylococcus aureus subsp. aureus MW2
ucuaugaaauuuuu

SEQ ID NO: 4006025 - RNA, 16 nt, Staphylococcus aureus subsp. aureus MW2
ucuaugaauaauguuu

SEQ ID NO: 4006026 - RNA, 16 nt, Staphylococcus aureus subsp. aureus MW2
ucuaugcuuuuauaga

SEQ ID NO: 4006027 - RNA, 17 nt, Staphylococcus aureus subsp. aureus MW2
ucuaugguuauggugug

SEQ ID NO: 4006028 - RNA, 13 nt, Staphylococcus aureus subsp. aureus MW2
ucuauguauaaua

SEQ ID NO: 4006029 - RNA, 22 nt, Staphylococcus aureus subsp. aureus MW2
ucuaugucucggggcagaucau

SEQ ID NO: 4006030 - RNA, 13 nt, Staphylococcus aureus subsp. aureus MW2
ucuauuaauaauu

SEQ ID NO: 4006031 - RNA, 15 nt, Staphylococcus aureus subsp. aureus MW2
ucuauuagauacaua

SEQ ID NO: 4006032 - RNA, 23 nt, Staphylococcus aureus subsp. aureus MW2
ucuauuauauugaauugaaaaau

SEQ ID NO: 4006033 - RNA, 15 nt, Staphylococcus aureus subsp. aureus MW2
ucuauucaaauauaa

SEQ ID NO: 4006034 - RNA, 21 nt, Staphylococcus aureus subsp. aureus MW2
ucuauugugauauaugaaaua

SEQ ID NO: 4006035 - RNA, 13 nt, Staphylococcus aureus subsp. aureus MW2
ucuauuuaauaau

SEQ ID NO: 4006036 - RNA, 16 nt, Staphylococcus aureus subsp. aureus MW2
ucuauuuaauaaugua

SEQ ID NO: 4006037 - RNA, 12 nt, Staphylococcus aureus subsp. aureus MW2
ucuauuucuaua

SEQ ID NO: 4006038 - RNA, 14 nt, Staphylococcus aureus subsp. aureus MW2
ucuauuucuauaua

SEQ ID NO: 4006039 - RNA, 16 nt, Staphylococcus aureus subsp. aureus MW2
ucuauuucuauauaca

SEQ ID NO: 4006040 - RNA, 17 nt, Staphylococcus aureus subsp. aureus MW2
ucuauuuuauaauaaau

SEQ ID NO: 4006041 - RNA, 19 nt, Staphylococcus aureus subsp. aureus MW2
ucuauuuuauaauaaauuu

SEQ ID NO: 4006042 - RNA, 22 nt, Staphylococcus aureus subsp. aureus MW2
ucucaaagguuuacuauuaaag

SEQ ID NO: 4006043 - RNA, 14 nt, Staphylococcus aureus subsp. aureus MW2
ucucaaauauuaau

SEQ ID NO: 4006044 - RNA, 18 nt, Staphylococcus aureus subsp. aureus MW2
ucucaaauuaaaucaccu

SEQ ID NO: 4006045 - RNA, 20 nt, Staphylococcus aureus subsp. aureus MW2
ucucaauccaauuaaauauu

SEQ ID NO: 4006046 - RNA, 15 nt, Staphylococcus aureus subsp. aureus MW2
ucucaccagcucguu

SEQ ID NO: 4006047 - RNA, 23 nt, Staphylococcus aureus subsp. aureus MW2
ucucacugcuguucuuuuuauuu

SEQ ID NO: 4006048 - RNA, 16 nt, Staphylococcus aureus subsp. aureus MW2
ucucacuuaauaaaua

SEQ ID NO: 4006049 - RNA, 14 nt, Staphylococcus aureus subsp. aureus MW2
ucucauagucaucu

SEQ ID NO: 4006050 - RNA, 17 nt, Staphylococcus aureus subsp. aureus MW2
ucucaucgaauucauuu

SEQ ID NO: 4006051 - RNA, 20 nt, Staphylococcus aureus subsp. aureus MW2
ucucaucuauuuaauaaugu

SEQ ID NO: 4006052 - RNA, 18 nt, Staphylococcus aureus subsp. aureus MW2
ucucaucuucuaaaucaa

SEQ ID NO: 4006053 - RNA, 21 nt, Staphylococcus aureus subsp. aureus MW2
ucucaugccaaaaacauuaac

SEQ ID NO: 4006054 - RNA, 15 nt, Staphylococcus aureus subsp. aureus MW2
ucuuaaacauaacau

SEQ ID NO: 4006055 - RNA, 21 nt, Staphylococcus aureus subsp. aureus MW2
ucuuaaaucacuagcuaaugc

SEQ ID NO: 4006056 - RNA, 22 nt, Staphylococcus aureus subsp. aureus MW2
ucuuaaaucacuagcuaaugca

SEQ ID NO: 4006057 - RNA, 14 nt, Staphylococcus aureus subsp. aureus MW2
ucuuaacaacauga

SEQ ID NO: 4006058 - RNA, 16 nt, Staphylococcus aureus subsp. aureus MW2
ucuuaacaacaugauu

SEQ ID NO: 4006059 - RNA, 15 nt, Staphylococcus aureus subsp. aureus MW2
ucuuaacaauaucau

SEQ ID NO: 4006060 - RNA, 18 nt, Staphylococcus aureus subsp. aureus MW2
ucuuaacaauuuuaauuu

SEQ ID NO: 4006061 - RNA, 14 nt, Staphylococcus aureus subsp. aureus MW2
ucuuaauauuuauu

SEQ ID NO: 4006062 - RNA, 21 nt, Staphylococcus aureus subsp. aureus MW2
ucuuaaucgagugauucagga

SEQ ID NO: 4006063 - RNA, 14 nt, Staphylococcus aureus subsp. aureus MW2
ucuuaauucuucug

SEQ ID NO: 4006064 - RNA, 17 nt, Staphylococcus aureus subsp. aureus MW2
ucuuaccauuuauccuu

SEQ ID NO: 4006065 - RNA, 23 nt, Staphylococcus aureus subsp. aureus MW2
ucuuacuacuuaauuaauaauuu

SEQ ID NO: 4006066 - RNA, 20 nt, Staphylococcus aureus subsp. aureus MW2
ucuuacugcuguucucuauu

SEQ ID NO: 4006067 - RNA, 18 nt, Staphylococcus aureus subsp. aureus MW2
ucuuacugcuuuuuuaaa

SEQ ID NO: 4006068 - RNA, 20 nt, Staphylococcus aureus subsp. aureus MW2
ucuuacuucguacaucguug

SEQ ID NO: 4006069 - RNA, 19 nt, Staphylococcus aureus subsp. aureus MW2
ucuuaguuuagguugauuu

SEQ ID NO: 4006070 - RNA, 16 nt, Staphylococcus aureus subsp. aureus MW2
ucuuauaaaagucagc

SEQ ID NO: 4006071 - RNA, 13 nt, Staphylococcus aureus subsp. aureus MW2
ucuuauaaaauaa

SEQ ID NO: 4006072 - RNA, 22 nt, Staphylococcus aureus subsp. aureus MW2
ucuuauaaagacaccuucaaua

SEQ ID NO: 4006073 - RNA, 13 nt, Staphylococcus aureus subsp. aureus MW2
ucuuauaacaaaa

SEQ ID NO: 4006074 - RNA, 17 nt, Staphylococcus aureus subsp. aureus MW2
ucuuauagauuuuucag

SEQ ID NO: 4006075 - RNA, 13 nt, Staphylococcus aureus subsp. aureus MW2
ucuuaucaacaac

SEQ ID NO: 4006076 - RNA, 17 nt, Staphylococcus aureus subsp. aureus MW2
ucuuaucaagaauauaa

SEQ ID NO: 4006077 - RNA, 21 nt, Staphylococcus aureus subsp. aureus MW2
ucuuaucaagaauauaacgaa

SEQ ID NO: 4006078 - RNA, 18 nt, Staphylococcus aureus subsp. aureus MW2
ucuuaucauuucaaauaa

SEQ ID NO: 4006079 - RNA, 22 nt, Staphylococcus aureus subsp. aureus MW2
ucuuaucgaaagaugauauauu

SEQ ID NO: 4006080 - RNA, 19 nt, Staphylococcus aureus subsp. aureus MW2
ucuuauuuguuuaauuauc

SEQ ID NO: 4006081 - RNA, 15 nt, Staphylococcus aureus subsp. aureus MW2
ucuuauuuuaaaaua

SEQ ID NO: 4006082 - RNA, 19 nt, Staphylococcus aureus subsp. aureus MW2
ucuuauuuuaaaauauuaa

SEQ ID NO: 4006083 - RNA, 18 nt, Staphylococcus aureus subsp. aureus MW2
ucuuauuuuguuuuaaaa

SEQ ID NO: 4006084 - RNA, 14 nt, Staphylococcus aureus subsp. aureus MW2
ucuucaaaaaauaa

SEQ ID NO: 4006085 - RNA, 15 nt, Staphylococcus aureus subsp. aureus MW2
ucuucaacuuucucu

SEQ ID NO: 4006086 - RNA, 16 nt, Staphylococcus aureus subsp. aureus MW2
ucuucaacuuucucua

SEQ ID NO: 4006087 - RNA, 13 nt, Staphylococcus aureus subsp. aureus MW2
ucuucaauauuua

SEQ ID NO: 4006088 - RNA, 21 nt, Staphylococcus aureus subsp. aureus MW2
ucuucaauauuuaaauuuuaa

SEQ ID NO: 4006089 - RNA, 17 nt, Staphylococcus aureus subsp. aureus MW2
ucuucaauucuuacacc

SEQ ID NO: 4006090 - RNA, 22 nt, Staphylococcus aureus subsp. aureus MW2
ucuucaauucuuacaccugcaa

SEQ ID NO: 4006091 - RNA, 13 nt, Staphylococcus aureus subsp. aureus MW2
ucuucaauugucu

SEQ ID NO: 4006092 - RNA, 9 nt, Staphylococcus aureus subsp. aureus MW2
ucuucacca

SEQ ID NO: 4006093 - RNA, 13 nt, Staphylococcus aureus subsp. aureus MW2
ucuucaccaucug

SEQ ID NO: 4006094 - RNA, 18 nt, Staphylococcus aureus subsp. aureus MW2
ucuucauaaucguauuca

SEQ ID NO: 4006095 - RNA, 23 nt, Staphylococcus aureus subsp. aureus MW2
ucuucaucaauaacuauaaucau

SEQ ID NO: 4006096 - RNA, 23 nt, Staphylococcus aureus subsp. aureus MW2
ucuucaucaugacuauuuuccau

SEQ ID NO: 4006097 - RNA, 17 nt, Staphylococcus aureus subsp. aureus MW2
ucuucaucuucuucaaa

SEQ ID NO: 4006098 - RNA, 12 nt, Staphylococcus aureus subsp. aureus MW2
ucuucaucuuua

SEQ ID NO: 4006099 - RNA, 14 nt, Staphylococcus aureus subsp. aureus MW2
ucuucaugaacagc

SEQ ID NO: 4006100 - RNA, 20 nt, Staphylococcus aureus subsp. aureus MW2
ucuucaugucguuuucuuaa

SEQ ID NO: 4006101 - RNA, 18 nt, Staphylococcus aureus subsp. aureus MW2
ucuucauuaacaucaugu

SEQ ID NO: 4006102 - RNA, 15 nt, Staphylococcus aureus subsp. aureus MW2
ucuucauuaucaaua

SEQ ID NO: 4006103 - RNA, 21 nt, Staphylococcus aureus subsp. aureus MW2
ucuucauuuucauuguauguu

SEQ ID NO: 4006104 - RNA, 13 nt, Staphylococcus aureus subsp. aureus MW2
ucuuccaaucaac

SEQ ID NO: 4006105 - RNA, 15 nt, Staphylococcus aureus subsp. aureus MW2
ucuuccaaucaacuu

SEQ ID NO: 4006106 - RNA, 18 nt, Staphylococcus aureus subsp. aureus MW2
ucuuccacacaaauguau

SEQ ID NO: 4006107 - RNA, 19 nt, Staphylococcus aureus subsp. aureus MW2
ucuuccacacaaauguaua

SEQ ID NO: 4006108 - RNA, 21 nt, Staphylococcus aureus subsp. aureus MW2
ucuuccccaccuaaucagaua

SEQ ID NO: 4006109 - RNA, 13 nt, Staphylococcus aureus subsp. aureus MW2
ucuuccgcacugc

SEQ ID NO: 4006110 - RNA, 13 nt, Staphylococcus aureus subsp. aureus MW2
ucuuccuaaauaa

SEQ ID NO: 4006111 - RNA, 15 nt, Staphylococcus aureus subsp. aureus MW2
ucuuccuaaauaauu

SEQ ID NO: 4006112 - RNA, 14 nt, Staphylococcus aureus subsp. aureus MW2
ucuucgauggcugc

SEQ ID NO: 4006113 - RNA, 13 nt, Staphylococcus aureus subsp. aureus MW2
ucuucuaauucug

SEQ ID NO: 4006114 - RNA, 17 nt, Staphylococcus aureus subsp. aureus MW2
ucuucuacauauacaaa

SEQ ID NO: 4006115 - RNA, 14 nt, Staphylococcus aureus subsp. aureus MW2
ucuucuaucuuuuc

SEQ ID NO: 4006116 - RNA, 20 nt, Staphylococcus aureus subsp. aureus MW2
ucuucuauuaaacauuuuug

SEQ ID NO: 4006117 - RNA, 15 nt, Staphylococcus aureus subsp. aureus MW2
ucuucucauaaaaua

SEQ ID NO: 4006118 - RNA, 17 nt, Staphylococcus aureus subsp. aureus MW2
ucuucugcauagcgcuc

SEQ ID NO: 4006119 - RNA, 16 nt, Staphylococcus aureus subsp. aureus MW2
ucuucugcuaacucug

SEQ ID NO: 4006120 - RNA, 13 nt, Staphylococcus aureus subsp. aureus MW2
ucuucuucaucau

SEQ ID NO: 4006121 - RNA, 13 nt, Staphylococcus aureus subsp. aureus MW2
ucuucuucuucag

SEQ ID NO: 4006122 - RNA, 15 nt, Staphylococcus aureus subsp. aureus MW2
ucuucuuuagcuauu

SEQ ID NO: 4006123 - RNA, 12 nt, Staphylococcus aureus subsp. aureus MW2
ucuucuuuuaau

SEQ ID NO: 4006124 - RNA, 13 nt, Staphylococcus aureus subsp. aureus MW2
ucuucuuuuaaua

SEQ ID NO: 4006125 - RNA, 18 nt, Staphylococcus aureus subsp. aureus MW2
ucuugaaacacaaaaagg

SEQ ID NO: 4006126 - RNA, 15 nt, Staphylococcus aureus subsp. aureus MW2
ucuugaaauaaacau

SEQ ID NO: 4006127 - RNA, 23 nt, Staphylococcus aureus subsp. aureus MW2
ucuugaaauaaacauaucaucau

SEQ ID NO: 4006128 - RNA, 15 nt, Staphylococcus aureus subsp. aureus MW2
ucuugaauaaauuuu

SEQ ID NO: 4006129 - RNA, 20 nt, Staphylococcus aureus subsp. aureus MW2
ucuugagcuguuacacuuuu

SEQ ID NO: 4006130 - RNA, 13 nt, Staphylococcus aureus subsp. aureus MW2
ucuugaguacuaa

SEQ ID NO: 4006131 - RNA, 14 nt, Staphylococcus aureus subsp. aureus MW2
ucuugauaaaauaa

SEQ ID NO: 4006132 - RNA, 15 nt, Staphylococcus aureus subsp. aureus MW2
ucuugauuauauuuu

SEQ ID NO: 4006133 - RNA, 19 nt, Staphylococcus aureus subsp. aureus MW2
ucuugauuauauuuuucuu

SEQ ID NO: 4006134 - RNA, 19 nt, Staphylococcus aureus subsp. aureus MW2
ucuugauuggcacagucaa

SEQ ID NO: 4006135 - RNA, 14 nt, Staphylococcus aureus subsp. aureus MW2
ucuugauuguaaau

SEQ ID NO: 4006136 - RNA, 15 nt, Staphylococcus aureus subsp. aureus MW2
ucuugcaaguauuuu

SEQ ID NO: 4006137 - RNA, 16 nt, Staphylococcus aureus subsp. aureus MW2
ucuugcuuaucuaugu

SEQ ID NO: 4006138 - RNA, 16 nt, Staphylococcus aureus subsp. aureus MW2
ucuuggacauuguaaa

SEQ ID NO: 4006139 - RNA, 21 nt, Staphylococcus aureus subsp. aureus MW2
ucuuggacauuguaaaaugcu

SEQ ID NO: 4006140 - RNA, 20 nt, Staphylococcus aureus subsp. aureus MW2
ucuuggcauuuuuucauuau

SEQ ID NO: 4006141 - RNA, 17 nt, Staphylococcus aureus subsp. aureus MW2
ucuuggccaauuaacuu

SEQ ID NO: 4006142 - RNA, 15 nt, Staphylococcus aureus subsp. aureus MW2
ucuuguaaacuucuu

SEQ ID NO: 4006143 - RNA, 16 nt, Staphylococcus aureus subsp. aureus MW2
ugaaaaaaauuuucau

SEQ ID NO: 4006144 - RNA, 14 nt, Staphylococcus aureus subsp. aureus MW2
ugaaaaaauaacug

SEQ ID NO: 4006145 - RNA, 22 nt, Staphylococcus aureus subsp. aureus MW2
ugaaaaaauaacuguaaaacau

SEQ ID NO: 4006146 - RNA, 20 nt, Staphylococcus aureus subsp. aureus MW2
ugaaaaacuucuuaacuuga

SEQ ID NO: 4006147 - RNA, 21 nt, Staphylococcus aureus subsp. aureus MW2
ugaaaaagacaauuucuauuu

SEQ ID NO: 4006148 - RNA, 17 nt, Staphylococcus aureus subsp. aureus MW2
ugaaaaagauucggaaa

SEQ ID NO: 4006149 - RNA, 13 nt, Staphylococcus aureus subsp. aureus MW2
ugaaaaaguggau

SEQ ID NO: 4006150 - RNA, 14 nt, Staphylococcus aureus subsp. aureus MW2
ugaaaacauuauua

SEQ ID NO: 4006151 - RNA, 16 nt, Staphylococcus aureus subsp. aureus MW2
ugaaaacuuaauagaa

SEQ ID NO: 4006152 - RNA, 17 nt, Staphylococcus aureus subsp. aureus MW2
ugaaaacuuaauagaaa

SEQ ID NO: 4006153 - RNA, 11 nt, Staphylococcus aureus subsp. aureus MW2
ugaaaacuucu

SEQ ID NO: 4006154 - RNA, 12 nt, Staphylococcus aureus subsp. aureus MW2
ugaaaacuucuc

SEQ ID NO: 4006155 - RNA, 13 nt, Staphylococcus aureus subsp. aureus MW2
ugaaaagauaaac

SEQ ID NO: 4006156 - RNA, 17 nt, Staphylococcus aureus subsp. aureus MW2
ugaaaaguaauuaaaua

SEQ ID NO: 4006157 - RNA, 14 nt, Staphylococcus aureus subsp. aureus MW2
ugaaaauaaccauu

SEQ ID NO: 4006158 - RNA, 18 nt, Staphylococcus aureus subsp. aureus MW2
ugaaaauaccaagugcuu

SEQ ID NO: 4006159 - RNA, 16 nt, Staphylococcus aureus subsp. aureus MW2
ugaaaauauuuuauua

SEQ ID NO: 4006160 - RNA, 17 nt, Staphylococcus aureus subsp. aureus MW2
ugaaaauauuuuauuau

SEQ ID NO: 4006161 - RNA, 13 nt, Staphylococcus aureus subsp. aureus MW2
ugaaaaucuuuaa

SEQ ID NO: 4006162 - RNA, 22 nt, Staphylococcus aureus subsp. aureus MW2
ugaaaaucuuuaacucuugaaa

SEQ ID NO: 4006163 - RNA, 14 nt, Staphylococcus aureus subsp. aureus MW2
ugaaacacaaaaag

SEQ ID NO: 4006164 - RNA, 14 nt, Staphylococcus aureus subsp. aureus MW2
ugaaacaucuugau

SEQ ID NO: 4006165 - RNA, 21 nt, Staphylococcus aureus subsp. aureus MW2
ugaaacaugagcucaucuguc

SEQ ID NO: 4006166 - RNA, 23 nt, Staphylococcus aureus subsp. aureus MW2
ugaaacauuuauaaaucuuugau

SEQ ID NO: 4006167 - RNA, 14 nt, Staphylococcus aureus subsp. aureus MW2
ugaaaccauacuaa

SEQ ID NO: 4006168 - RNA, 14 nt, Staphylococcus aureus subsp. aureus MW2
ugaaacugaaguug

SEQ ID NO: 4006169 - RNA, 18 nt, Staphylococcus aureus subsp. aureus MW2
ugaaacugaguucaauua

SEQ ID NO: 4006170 - RNA, 18 nt, Staphylococcus aureus subsp. aureus MW2
ugaaacuggauaaauaaa

SEQ ID NO: 4006171 - RNA, 14 nt, Staphylococcus aureus subsp. aureus MW2
ugaaagaaaaaacu

SEQ ID NO: 4006172 - RNA, 15 nt, Staphylococcus aureus subsp. aureus MW2
ugaaagaaaaaacuu

SEQ ID NO: 4006173 - RNA, 21 nt, Staphylococcus aureus subsp. aureus MW2
ugaaagaaaaaacuuuucaug

SEQ ID NO: 4006174 - RNA, 19 nt, Staphylococcus aureus subsp. aureus MW2
ugaaagaaaagugaaaacu

SEQ ID NO: 4006175 - RNA, 19 nt, Staphylococcus aureus subsp. aureus MW2
ugaaagcaccuaaaauaga

SEQ ID NO: 4006176 - RNA, 20 nt, Staphylococcus aureus subsp. aureus MW2
ugaaagcaccuaaaauagaa

SEQ ID NO: 4006177 - RNA, 21 nt, Staphylococcus aureus subsp. aureus MW2
ugaaagcaucuugcaagccau

SEQ ID NO: 4006178 - RNA, 23 nt, Staphylococcus aureus subsp. aureus MW2
ugaaaggaguauuuuugcguuaa

SEQ ID NO: 4006179 - RNA, 23 nt, Staphylococcus aureus subsp. aureus MW2
ugaaaguaccgguuuuucauaua

SEQ ID NO: 4006180 - RNA, 22 nt, Staphylococcus aureus subsp. aureus MW2
ugaaaguacuuggaaaauacua

SEQ ID NO: 4006181 - RNA, 13 nt, Staphylococcus aureus subsp. aureus MW2
ugaaaguauuaga

SEQ ID NO: 4006182 - RNA, 20 nt, Staphylococcus aureus subsp. aureus MW2
ugaaaguauuagauauauuu

SEQ ID NO: 4006183 - RNA, 22 nt, Staphylococcus aureus subsp. aureus MW2
ugaaagucguuguugaaauuaa

SEQ ID NO: 4006184 - RNA, 17 nt, Staphylococcus aureus subsp. aureus MW2
ugaaauaaacauaucau

SEQ ID NO: 4006185 - RNA, 21 nt, Staphylococcus aureus subsp. aureus MW2
ugaaauaaacauaucaucaua

SEQ ID NO: 4006186 - RNA, 22 nt, Staphylococcus aureus subsp. aureus MW2
ugaaauaggugcuuguaaaauu

SEQ ID NO: 4006187 - RNA, 20 nt, Staphylococcus aureus subsp. aureus MW2
ugaaauauaccaaccaaaac

SEQ ID NO: 4006188 - RNA, 18 nt, Staphylococcus aureus subsp. aureus MW2
ugaaauauagugauugaa

SEQ ID NO: 4006189 - RNA, 14 nt, Staphylococcus aureus subsp. aureus MW2
ugaaauaucaagau

SEQ ID NO: 4006190 - RNA, 16 nt, Staphylococcus aureus subsp. aureus MW2
ugaaauaucgagaggg

SEQ ID NO: 4006191 - RNA, 15 nt, Staphylococcus aureus subsp. aureus MW2
ugaaauauuuaucuu

SEQ ID NO: 4006192 - RNA, 16 nt, Staphylococcus aureus subsp. aureus MW2
ugaaauauuuaucuuu

SEQ ID NO: 4006193 - RNA, 19 nt, Staphylococcus aureus subsp. aureus MW2
ugaaauauuuaucuuuaga

SEQ ID NO: 4006194 - RNA, 14 nt, Staphylococcus aureus subsp. aureus MW2
ugaaaucauuuaaa

SEQ ID NO: 4006195 - RNA, 17 nt, Staphylococcus aureus subsp. aureus MW2
ugaaaucauuuaaauua

SEQ ID NO: 4006196 - RNA, 17 nt, Staphylococcus aureus subsp. aureus MW2
ugaaaucgauacuaaua

SEQ ID NO: 4006197 - RNA, 20 nt, Staphylococcus aureus subsp. aureus MW2
ugaaaucuauugugauauau

SEQ ID NO: 4006198 - RNA, 22 nt, Staphylococcus aureus subsp. aureus MW2
ugaaaugaaguauggaaguugu

SEQ ID NO: 4006199 - RNA, 19 nt, Staphylococcus aureus subsp. aureus MW2
ugaaaugauaaaaauccua

SEQ ID NO: 4006200 - RNA, 16 nt, Staphylococcus aureus subsp. aureus MW2
ugaaaugauacauuau

SEQ ID NO: 4006201 - RNA, 20 nt, Staphylococcus aureus subsp. aureus MW2
ugaaaugauacauuauuaaa

SEQ ID NO: 4006202 - RNA, 15 nt, Staphylococcus aureus subsp. aureus MW2
ugaaauggaaaguaa

SEQ ID NO: 4006203 - RNA, 17 nt, Staphylococcus aureus subsp. aureus MW2
ugaaauggaaaguaaua

SEQ ID NO: 4006204 - RNA, 21 nt, Staphylococcus aureus subsp. aureus MW2
ugaaaugguaucuaaauguga

SEQ ID NO: 4006205 - RNA, 22 nt, Staphylococcus aureus subsp. aureus MW2
ugaaauguagacaauaaaucuu

SEQ ID NO: 4006206 - RNA, 23 nt, Staphylococcus aureus subsp. aureus MW2
ugaaauguagacaauaaaucuuu

SEQ ID NO: 4006207 - RNA, 20 nt, Staphylococcus aureus subsp. aureus MW2
ugaaauguucccuucaaagu

SEQ ID NO: 4006208 - RNA, 12 nt, Staphylococcus aureus subsp. aureus MW2
ugaaauguuuaa

SEQ ID NO: 4006209 - RNA, 17 nt, Staphylococcus aureus subsp. aureus MW2
ugaaauguuuaucaauu

SEQ ID NO: 4006210 - RNA, 21 nt, Staphylococcus aureus subsp. aureus MW2
ugaaauuaacgucaacagcau

SEQ ID NO: 4006211 - RNA, 16 nt, Staphylococcus aureus subsp. aureus MW2
ugaaauuaauuaucuu

SEQ ID NO: 4006212 - RNA, 17 nt, Staphylococcus aureus subsp. aureus MW2
ugaaauuauuauuuaaa

SEQ ID NO: 4006213 - RNA, 21 nt, Staphylococcus aureus subsp. aureus MW2
ugaaauuauuauuuaaauuuu

SEQ ID NO: 4006214 - RNA, 22 nt, Staphylococcus aureus subsp. aureus MW2
ugaaauuauuauuuaaauuuuc

SEQ ID NO: 4006215 - RNA, 23 nt, Staphylococcus aureus subsp. aureus MW2
ugaaauucgaacuaucaauauaa

SEQ ID NO: 4006216 - RNA, 15 nt, Staphylococcus aureus subsp. aureus MW2
ugaaauucuuuugua

SEQ ID NO: 4006217 - RNA, 20 nt, Staphylococcus aureus subsp. aureus MW2
ugaaauugacaguuuccaua

SEQ ID NO: 4006218 - RNA, 21 nt, Staphylococcus aureus subsp. aureus MW2
ugaaauugcgugcguuuaaca

SEQ ID NO: 4006219 - RNA, 14 nt, Staphylococcus aureus subsp. aureus MW2
ugaaauuucauaaa

SEQ ID NO: 4006220 - RNA, 19 nt, Staphylococcus aureus subsp. aureus MW2
ugaaauuugguaggcauuu

SEQ ID NO: 4006221 - RNA, 22 nt, Staphylococcus aureus subsp. aureus MW2
ugaaauuugguaggcauuuuau

SEQ ID NO: 4006222 - RNA, 13 nt, Staphylococcus aureus subsp. aureus MW2
ugaacaauaauau

SEQ ID NO: 4006223 - RNA, 13 nt, Staphylococcus aureus subsp. aureus MW2
ugaacaauucuuc

SEQ ID NO: 4006224 - RNA, 15 nt, Staphylococcus aureus subsp. aureus MW2
ugaacagauucaccu

SEQ ID NO: 4006225 - RNA, 22 nt, Staphylococcus aureus subsp. aureus MW2
ugaacagauucaccuaaucuug

SEQ ID NO: 4006226 - RNA, 16 nt, Staphylococcus aureus subsp. aureus MW2
ugaacauauuauaaaa

SEQ ID NO: 4006227 - RNA, 20 nt, Staphylococcus aureus subsp. aureus MW2
ugaacauauuauaaaagugu

SEQ ID NO: 4006228 - RNA, 18 nt, Staphylococcus aureus subsp. aureus MW2
ugaacaucauuuaauuga

SEQ ID NO: 4006229 - RNA, 18 nt, Staphylococcus aureus subsp. aureus MW2
ugaaccaauccaauauac

SEQ ID NO: 4006230 - RNA, 19 nt, Staphylococcus aureus subsp. aureus MW2
ugaaccauuuaacucaccu

SEQ ID NO: 4006231 - RNA, 18 nt, Staphylococcus aureus subsp. aureus MW2
ugaauuaagaaaaguuac

SEQ ID NO: 4006232 - RNA, 15 nt, Staphylococcus aureus subsp. aureus MW2
ugaauuaucuauaua

SEQ ID NO: 4006233 - RNA, 17 nt, Staphylococcus aureus subsp. aureus MW2
ugaauuaugaucaauaa

SEQ ID NO: 4006234 - RNA, 14 nt, Staphylococcus aureus subsp. aureus MW2
ugaauucauuuuau

SEQ ID NO: 4006235 - RNA, 13 nt, Staphylococcus aureus subsp. aureus MW2
ugaauugaaaaau

SEQ ID NO: 4006236 - RNA, 14 nt, Staphylococcus aureus subsp. aureus MW2
ugaauugauuauaa

SEQ ID NO: 4006237 - RNA, 15 nt, Staphylococcus aureus subsp. aureus MW2
ugaauugauuauaau

SEQ ID NO: 4006238 - RNA, 15 nt, Staphylococcus aureus subsp. aureus MW2
ugaauuguaaaagug

SEQ ID NO: 4006239 - RNA, 18 nt, Staphylococcus aureus subsp. aureus MW2
ugaauuuacuccuuacaa

SEQ ID NO: 4006240 - RNA, 21 nt, Staphylococcus aureus subsp. aureus MW2
ugaauuuagcaucaaaaauaa

SEQ ID NO: 4006241 - RNA, 18 nt, Staphylococcus aureus subsp. aureus MW2
ugaauuuaggaaugaaua

SEQ ID NO: 4006242 - RNA, 14 nt, Staphylococcus aureus subsp. aureus MW2
ugaauuuauuuugu

SEQ ID NO: 4006243 - RNA, 21 nt, Staphylococcus aureus subsp. aureus MW2
ugaauuuauuuuguaguuccu

SEQ ID NO: 4006244 - RNA, 15 nt, Staphylococcus aureus subsp. aureus MW2
ugaauuuuauaaauu

SEQ ID NO: 4006245 - RNA, 14 nt, Staphylococcus aureus subsp. aureus MW2
ugaauuuucaucau

SEQ ID NO: 4006246 - RNA, 15 nt, Staphylococcus aureus subsp. aureus MW2
ugacaaauuaaaaag

SEQ ID NO: 4006247 - RNA, 14 nt, Staphylococcus aureus subsp. aureus MW2
ugacaacauaacaa

SEQ ID NO: 4006248 - RNA, 15 nt, Staphylococcus aureus subsp. aureus MW2
ugacaagagacugaa

SEQ ID NO: 4006249 - RNA, 18 nt, Staphylococcus aureus subsp. aureus MW2
ugacaaucgcuugcuucu

SEQ ID NO: 4006250 - RNA, 21 nt, Staphylococcus aureus subsp. aureus MW2
ugacacaaugauucaucagug

SEQ ID NO: 4006251 - RNA, 15 nt, Staphylococcus aureus subsp. aureus MW2
ugacacauuauugaa

SEQ ID NO: 4006252 - RNA, 19 nt, Staphylococcus aureus subsp. aureus MW2
ugacaccuaauaccauugu

SEQ ID NO: 4006253 - RNA, 21 nt, Staphylococcus aureus subsp. aureus MW2
ugacacgcucaggcuggaaca

SEQ ID NO: 4006254 - RNA, 16 nt, Staphylococcus aureus subsp. aureus MW2
ugacacuaauuugagu

SEQ ID NO: 4006255 - RNA, 13 nt, Staphylococcus aureus subsp. aureus MW2
ugacaguuuccau

SEQ ID NO: 4006256 - RNA, 22 nt, Staphylococcus aureus subsp. aureus MW2
ugacauaucgauauucuccaac

SEQ ID NO: 4006257 - RNA, 15 nt, Staphylococcus aureus subsp. aureus MW2
ugacaucuauuucuu

SEQ ID NO: 4006258 - RNA, 23 nt, Staphylococcus aureus subsp. aureus MW2
ugacauggaaaauauauuauaaa

SEQ ID NO: 4006259 - RNA, 23 nt, Staphylococcus aureus subsp. aureus MW2
ugacauucaucacaaauaaggaa

SEQ ID NO: 4006260 - RNA, 13 nt, Staphylococcus aureus subsp. aureus MW2
ugacauuuaaaga

SEQ ID NO: 4006261 - RNA, 18 nt, Staphylococcus aureus subsp. aureus MW2
ugacauuugaccaaguau

SEQ ID NO: 4006262 - RNA, 15 nt, Staphylococcus aureus subsp. aureus MW2
ugaccaccacuuuca

SEQ ID NO: 4006263 - RNA, 17 nt, Staphylococcus aureus subsp. aureus MW2
ugaccauuaucaagaac

SEQ ID NO: 4006264 - RNA, 22 nt, Staphylococcus aureus subsp. aureus MW2
ugaccauuaucaagaacuuuaa

SEQ ID NO: 4006265 - RNA, 14 nt, Staphylococcus aureus subsp. aureus MW2
ugacccuugucagu

SEQ ID NO: 4006266 - RNA, 18 nt, Staphylococcus aureus subsp. aureus MW2
ugaccuaacaauuugagg

SEQ ID NO: 4006267 - RNA, 13 nt, Staphylococcus aureus subsp. aureus MW2
ugaccuuauauuu

SEQ ID NO: 4006268 - RNA, 21 nt, Staphylococcus aureus subsp. aureus MW2
ugaccuuauauuuuauuuaaa

SEQ ID NO: 4006269 - RNA, 15 nt, Staphylococcus aureus subsp. aureus MW2
ugacgaaaagucagc

SEQ ID NO: 4006270 - RNA, 20 nt, Staphylococcus aureus subsp. aureus MW2
ugacgaaaagucagcuuaca

SEQ ID NO: 4006271 - RNA, 20 nt, Staphylococcus aureus subsp. aureus MW2
ugacgcggguaauauuuuug

SEQ ID NO: 4006272 - RNA, 21 nt, Staphylococcus aureus subsp. aureus MW2
ugacgcgugaauuaaaaaaug

SEQ ID NO: 4006273 - RNA, 18 nt, Staphylococcus aureus subsp. aureus MW2
ugacguauuacacgcauu

SEQ ID NO: 4006274 - RNA, 18 nt, Staphylococcus aureus subsp. aureus MW2
ugacguuuugguuguucu

SEQ ID NO: 4006275 - RNA, 19 nt, Staphylococcus aureus subsp. aureus MW2
ugacuaaguuuguuuucuu

SEQ ID NO: 4006276 - RNA, 15 nt, Staphylococcus aureus subsp. aureus MW2
ugacuaauaaaacuu

SEQ ID NO: 4006277 - RNA, 13 nt, Staphylococcus aureus subsp. aureus MW2
ugacuagggguuu

SEQ ID NO: 4006278 - RNA, 19 nt, Staphylococcus aureus subsp. aureus MW2
ugacuagggguuuuuaaua

SEQ ID NO: 4006279 - RNA, 21 nt, Staphylococcus aureus subsp. aureus MW2
ugacucggggaauuuuuaugc

SEQ ID NO: 4006280 - RNA, 14 nt, Staphylococcus aureus subsp. aureus MW2
ugacucuuuucugc

SEQ ID NO: 4006281 - RNA, 17 nt, Staphylococcus aureus subsp. aureus MW2
ugacugagaaaaauauu

SEQ ID NO: 4006282 - RNA, 16 nt, Staphylococcus aureus subsp. aureus MW2
ugacuguagaaaacau

SEQ ID NO: 4006283 - RNA, 22 nt, Staphylococcus aureus subsp. aureus MW2
ugacuuaauaucauauucaaaa

SEQ ID NO: 4006284 - RNA, 17 nt, Staphylococcus aureus subsp. aureus MW2
ugacuuacauuuuaaua

SEQ ID NO: 4006285 - RNA, 15 nt, Staphylococcus aureus subsp. aureus MW2
ugacuuccuuaguca

SEQ ID NO: 4006286 - RNA, 15 nt, Staphylococcus aureus subsp. aureus MW2
ugacuucguuuuacc

SEQ ID NO: 4006287 - RNA, 16 nt, Staphylococcus aureus subsp. aureus MW2
ugacuucuuuauauuu

SEQ ID NO: 4006288 - RNA, 14 nt, Staphylococcus aureus subsp. aureus MW2
ugacuuuaaaucuu

SEQ ID NO: 4006289 - RNA, 20 nt, Staphylococcus aureus subsp. aureus MW2
ugacuuuaaaucuuguucua

SEQ ID NO: 4006290 - RNA, 19 nt, Staphylococcus aureus subsp. aureus MW2
ugacuuuauuucuauaucu

SEQ ID NO: 4006291 - RNA, 23 nt, Staphylococcus aureus subsp. aureus MW2
ugacuuuuaaaaaacauaccugc

SEQ ID NO: 4006292 - RNA, 14 nt, Staphylococcus aureus subsp. aureus MW2
ugacuuuuauaauu

SEQ ID NO: 4006293 - RNA, 16 nt, Staphylococcus aureus subsp. aureus MW2
ugacuuuuauaauucu

SEQ ID NO: 4006294 - RNA, 14 nt, Staphylococcus aureus subsp. aureus MW2
ugagaaaauaucau

SEQ ID NO: 4006295 - RNA, 16 nt, Staphylococcus aureus subsp. aureus MW2
ugagaaacuuuuucga

SEQ ID NO: 4006296 - RNA, 14 nt, Staphylococcus aureus subsp. aureus MW2
ugagaaaguaaaag

SEQ ID NO: 4006297 - RNA, 15 nt, Staphylococcus aureus subsp. aureus MW2
ugagaauagacauug

SEQ ID NO: 4006298 - RNA, 17 nt, Staphylococcus aureus subsp. aureus MW2
ugagaauugcaacgcau

SEQ ID NO: 4006299 - RNA, 16 nt, Staphylococcus aureus subsp. aureus MW2
ugagagauuauuuaaa

SEQ ID NO: 4006300 - RNA, 15 nt, Staphylococcus aureus subsp. aureus MW2
ugagauaaaaucaua

SEQ ID NO: 4006301 - RNA, 18 nt, Staphylococcus aureus subsp. aureus MW2
ugagauaaacgcacugcu

SEQ ID NO: 4006302 - RNA, 22 nt, Staphylococcus aureus subsp. aureus MW2
ugagauaaacgcacugcugcaa

SEQ ID NO: 4006303 - RNA, 23 nt, Staphylococcus aureus subsp. aureus MW2
ugagauccaccguuaaaauauau

SEQ ID NO: 4006304 - RNA, 13 nt, Staphylococcus aureus subsp. aureus MW2
ugagauggucuuu

SEQ ID NO: 4006305 - RNA, 13 nt, Staphylococcus aureus subsp. aureus MW2
ugagauuaucuuu

SEQ ID NO: 4006306 - RNA, 16 nt, Staphylococcus aureus subsp. aureus MW2
ugagauuaucuuuaga

SEQ ID NO: 4006307 - RNA, 21 nt, Staphylococcus aureus subsp. aureus MW2
ugagauugcuaguuuuuuauu

SEQ ID NO: 4006308 - RNA, 14 nt, Staphylococcus aureus subsp. aureus MW2
ugagcaacaaaaga

SEQ ID NO: 4006309 - RNA, 14 nt, Staphylococcus aureus subsp. aureus MW2
ugagcaagucuucu

SEQ ID NO: 4006310 - RNA, 13 nt, Staphylococcus aureus subsp. aureus MW2
ugagcaaguuaua

SEQ ID NO: 4006311 - RNA, 17 nt, Staphylococcus aureus subsp. aureus MW2
ugagcaaguuauaucau

SEQ ID NO: 4006312 - RNA, 17 nt, Staphylococcus aureus subsp. aureus MW2
ugagcuaaccacaucau

SEQ ID NO: 4006313 - RNA, 20 nt, Staphylococcus aureus subsp. aureus MW2
ugagcuguuacacuuuucuu

SEQ ID NO: 4006314 - RNA, 17 nt, Staphylococcus aureus subsp. aureus MW2
ugagcuucuuuaaauac

SEQ ID NO: 4006315 - RNA, 17 nt, Staphylococcus aureus subsp. aureus MW2
ugagcuuuguuagcauc

SEQ ID NO: 4006316 - RNA, 18 nt, Staphylococcus aureus subsp. aureus MW2
ugagcuuuucuaaugcua

SEQ ID NO: 4006317 - RNA, 21 nt, Staphylococcus aureus subsp. aureus MW2
ugaggccauaagccauaugcu

SEQ ID NO: 4006318 - RNA, 19 nt, Staphylococcus aureus subsp. aureus MW2
ugaggcccauaaauuacuu

SEQ ID NO: 4006319 - RNA, 19 nt, Staphylococcus aureus subsp. aureus MW2
ugaggcguuucagaaguug

SEQ ID NO: 4006320 - RNA, 17 nt, Staphylococcus aureus subsp. aureus MW2
ugaugguguugcauuag

SEQ ID NO: 4006321 - RNA, 17 nt, Staphylococcus aureus subsp. aureus MW2
ugauguaacguuucuuu

SEQ ID NO: 4006322 - RNA, 12 nt, Staphylococcus aureus subsp. aureus MW2
ugauguaauucu

SEQ ID NO: 4006323 - RNA, 13 nt, Staphylococcus aureus subsp. aureus MW2
ugauguuacaauc

SEQ ID NO: 4006324 - RNA, 20 nt, Staphylococcus aureus subsp. aureus MW2
ugauuaaaaaucaaagaggc

SEQ ID NO: 4006325 - RNA, 23 nt, Staphylococcus aureus subsp. aureus MW2
ugauuaaaaguguugacuuuauc

SEQ ID NO: 4006326 - RNA, 20 nt, Staphylococcus aureus subsp. aureus MW2
ugauuaaaauccgcuuuauu

SEQ ID NO: 4006327 - RNA, 22 nt, Staphylococcus aureus subsp. aureus MW2
ugauuaaaguguuucaacauau

SEQ ID NO: 4006328 - RNA, 23 nt, Staphylococcus aureus subsp. aureus MW2
ugauuaaaguguuucaacauauu

SEQ ID NO: 4006329 - RNA, 16 nt, Staphylococcus aureus subsp. aureus MW2
ugauuaauaacauagu

SEQ ID NO: 4006330 - RNA, 18 nt, Staphylococcus aureus subsp. aureus MW2
ugauuaauuaaagauuaa

SEQ ID NO: 4006331 - RNA, 23 nt, Staphylococcus aureus subsp. aureus MW2
ugauuaauuauugagaauauuua

SEQ ID NO: 4006332 - RNA, 17 nt, Staphylococcus aureus subsp. aureus MW2
ugauuauaaauacauga

SEQ ID NO: 4006333 - RNA, 17 nt, Staphylococcus aureus subsp. aureus MW2
ugauuauaaugauuguc

SEQ ID NO: 4006334 - RNA, 16 nt, Staphylococcus aureus subsp. aureus MW2
ugauuauauuuuucuu

SEQ ID NO: 4006335 - RNA, 13 nt, Staphylococcus aureus subsp. aureus MW2
ugauuaucauaug

SEQ ID NO: 4006336 - RNA, 20 nt, Staphylococcus aureus subsp. aureus MW2
ugauuauguucagaacuaca

SEQ ID NO: 4006337 - RNA, 22 nt, Staphylococcus aureus subsp. aureus MW2
ugauucaaauaaaucaaacuuu

SEQ ID NO: 4006338 - RNA, 14 nt, Staphylococcus aureus subsp. aureus MW2
ugauucaauauagu

SEQ ID NO: 4006339 - RNA, 18 nt, Staphylococcus aureus subsp. aureus MW2
ugauucauuacaaccauu

SEQ ID NO: 4006340 - RNA, 22 nt, Staphylococcus aureus subsp. aureus MW2
ugauucauuucgauuaauuuaa

SEQ ID NO: 4006341 - RNA, 20 nt, Staphylococcus aureus subsp. aureus MW2
ugauuccaaguauuuucucu

SEQ ID NO: 4006342 - RNA, 23 nt, Staphylococcus aureus subsp. aureus MW2
ugauuccaaguauuuucucuaua

SEQ ID NO: 4006343 - RNA, 11 nt, Staphylococcus aureus subsp. aureus MW2
ugauucccaaa

SEQ ID NO: 4006344 - RNA, 19 nt, Staphylococcus aureus subsp. aureus MW2
ugauucgauaugaauaacc

SEQ ID NO: 4006345 - RNA, 14 nt, Staphylococcus aureus subsp. aureus MW2
ugauucuaaauaau

SEQ ID NO: 4006346 - RNA, 18 nt, Staphylococcus aureus subsp. aureus MW2
ugauugaacaauaauaug

SEQ ID NO: 4006347 - RNA, 22 nt, Staphylococcus aureus subsp. aureus MW2
ugauugaaugaagcuaguugaa

SEQ ID NO: 4006348 - RNA, 22 nt, Staphylococcus aureus subsp. aureus MW2
ugauugcugcuguacaauuucg

SEQ ID NO: 4006349 - RNA, 23 nt, Staphylococcus aureus subsp. aureus MW2
ugauuggcacagucaaugacuua

SEQ ID NO: 4006350 - RNA, 17 nt, Staphylococcus aureus subsp. aureus MW2
ugauuguucauguuuaa

SEQ ID NO: 4006351 - RNA, 12 nt, Staphylococcus aureus subsp. aureus MW2
ugauuuaaaaaa

SEQ ID NO: 4006352 - RNA, 22 nt, Staphylococcus aureus subsp. aureus MW2
ugauuuaaaaaaauuaauguuu

SEQ ID NO: 4006353 - RNA, 15 nt, Staphylococcus aureus subsp. aureus MW2
ugauuuaaaauauua

SEQ ID NO: 4006354 - RNA, 15 nt, Staphylococcus aureus subsp. aureus MW2
ugauuuaaaugcuuc

SEQ ID NO: 4006355 - RNA, 17 nt, Staphylococcus aureus subsp. aureus MW2
ugauuuaagauuuaaua

SEQ ID NO: 4006356 - RNA, 13 nt, Staphylococcus aureus subsp. aureus MW2
ugauuuaauaaua

SEQ ID NO: 4006357 - RNA, 16 nt, Staphylococcus aureus subsp. aureus MW2
ugauuuaauaauauuu

SEQ ID NO: 4006358 - RNA, 14 nt, Staphylococcus aureus subsp. aureus MW2
ugauuuacgugcau

SEQ ID NO: 4006359 - RNA, 21 nt, Staphylococcus aureus subsp. aureus MW2
ugauuuacgugcauuguaaua

SEQ ID NO: 4006360 - RNA, 19 nt, Staphylococcus aureus subsp. aureus MW2
ugauuuagcauacauuaag

SEQ ID NO: 4006361 - RNA, 13 nt, Staphylococcus aureus subsp. aureus MW2
ugauuuauaaaaa

SEQ ID NO: 4006362 - RNA, 12 nt, Staphylococcus aureus subsp. aureus MW2
ugauuucacuac

SEQ ID NO: 4006363 - RNA, 13 nt, Staphylococcus aureus subsp. aureus MW2
ugauuucuaucaa

SEQ ID NO: 4006364 - RNA, 15 nt, Staphylococcus aureus subsp. aureus MW2
ugauuugauaauauu

SEQ ID NO: 4006365 - RNA, 15 nt, Staphylococcus aureus subsp. aureus MW2
ugauuugauuuaaau

SEQ ID NO: 4006366 - RNA, 22 nt, Staphylococcus aureus subsp. aureus MW2
ugauuuggaauacuuuucuucc

SEQ ID NO: 4006367 - RNA, 15 nt, Staphylococcus aureus subsp. aureus MW2
ugauuuguuacuucu

SEQ ID NO: 4006368 - RNA, 19 nt, Staphylococcus aureus subsp. aureus MW2
ugauuuguuacuucuaaua

SEQ ID NO: 4006369 - RNA, 14 nt, Staphylococcus aureus subsp. aureus MW2
ugauuuguuugauu

SEQ ID NO: 4006370 - RNA, 18 nt, Staphylococcus aureus subsp. aureus MW2
ugauuuuaccuguuucua

SEQ ID NO: 4006371 - RNA, 20 nt, Staphylococcus aureus subsp. aureus MW2
ugauuuuaccuguuucuaua

SEQ ID NO: 4006372 - RNA, 21 nt, Staphylococcus aureus subsp. aureus MW2
ugauuuuaccuguuucuauau

SEQ ID NO: 4006373 - RNA, 15 nt, Staphylococcus aureus subsp. aureus MW2
ugauuuuacuugaau

SEQ ID NO: 4006374 - RNA, 15 nt, Staphylococcus aureus subsp. aureus MW2
ugauuuucaauuucu

SEQ ID NO: 4006375 - RNA, 14 nt, Staphylococcus aureus subsp. aureus MW2
ugauuuugaauaua

SEQ ID NO: 4006376 - RNA, 15 nt, Staphylococcus aureus subsp. aureus MW2
ugauuuugaauauaa

SEQ ID NO: 4006377 - RNA, 14 nt, Staphylococcus aureus subsp. aureus MW2
ugauuuugaaucac

SEQ ID NO: 4006378 - RNA, 17 nt, Staphylococcus aureus subsp. aureus MW2
ugauuuuggaacauauu

SEQ ID NO: 4006379 - RNA, 12 nt, Staphylococcus aureus subsp. aureus MW2
ugauuuuuaaaa

SEQ ID NO: 4006380 - RNA, 14 nt, Staphylococcus aureus subsp. aureus MW2
ugauuuuuaauaau

SEQ ID NO: 4006381 - RNA, 16 nt, Staphylococcus aureus subsp. aureus MW2
ugauuuuuaauaauuu

SEQ ID NO: 4006382 - RNA, 22 nt, Staphylococcus aureus subsp. aureus MW2
ugauuuuuauuauugucaucau

SEQ ID NO: 4006383 - RNA, 12 nt, Staphylococcus aureus subsp. aureus MW2
ugauuuuucaua

SEQ ID NO: 4006384 - RNA, 12 nt, Staphylococcus aureus subsp. aureus MW2
ugcaaaaucaac

SEQ ID NO: 4006385 - RNA, 12 nt, Staphylococcus aureus subsp. aureus MW2
ugcaaaauuaag

SEQ ID NO: 4006386 - RNA, 13 nt, Staphylococcus aureus subsp. aureus MW2
ugcaaaauuaaug

SEQ ID NO: 4006387 - RNA, 21 nt, Staphylococcus aureus subsp. aureus MW2
ugcaaaauuuugcaaaaaaau

SEQ ID NO: 4006388 - RNA, 22 nt, Staphylococcus aureus subsp. aureus MW2
ugcaaacgcguuauagauaagu

SEQ ID NO: 4006389 - RNA, 19 nt, Staphylococcus aureus subsp. aureus MW2
ugcaaacuugauucaauau

SEQ ID NO: 4006390 - RNA, 20 nt, Staphylococcus aureus subsp. aureus MW2
ugcaaagggcgaaauggauu

SEQ ID NO: 4006391 - RNA, 13 nt, Staphylococcus aureus subsp. aureus MW2
ugcaaauacgagu

SEQ ID NO: 4006392 - RNA, 20 nt, Staphylococcus aureus subsp. aureus MW2
ugcaaauacgaguguuuuaa

SEQ ID NO: 4006393 - RNA, 19 nt, Staphylococcus aureus subsp. aureus MW2
ugcaaauauaucaucucua

SEQ ID NO: 4006394 - RNA, 16 nt, Staphylococcus aureus subsp. aureus MW2
ugcaaaugaaauucuu

SEQ ID NO: 4006395 - RNA, 14 nt, Staphylococcus aureus subsp. aureus MW2
ugcaaaugccucuu

SEQ ID NO: 4006396 - RNA, 16 nt, Staphylococcus aureus subsp. aureus MW2
ugcaaaugccucuuuu

SEQ ID NO: 4006397 - RNA, 14 nt, Staphylococcus aureus subsp. aureus MW2
ugcaaaugcucuaa

SEQ ID NO: 4006398 - RNA, 17 nt, Staphylococcus aureus subsp. aureus MW2
ugcaaaugcucuaacag

SEQ ID NO: 4006399 - RNA, 16 nt, Staphylococcus aureus subsp. aureus MW2
ugcaaauuaucauuaa

SEQ ID NO: 4006400 - RNA, 22 nt, Staphylococcus aureus subsp. aureus MW2
ugcaaauuaucauuaaauugcu

SEQ ID NO: 4006401 - RNA, 15 nt, Staphylococcus aureus subsp. aureus MW2
ugcaacccauguggu

SEQ ID NO: 4006402 - RNA, 21 nt, Staphylococcus aureus subsp. aureus MW2
ugcaacgcaucacaaaauugu

SEQ ID NO: 4006403 - RNA, 19 nt, Staphylococcus aureus subsp. aureus MW2
ugcaacgucccaacaacau

SEQ ID NO: 4006404 - RNA, 22 nt, Staphylococcus aureus subsp. aureus MW2
ugcaacuaaguugacuauauaa

SEQ ID NO: 4006405 - RNA, 14 nt, Staphylococcus aureus subsp. aureus MW2
ugcaacuuauaaua

SEQ ID NO: 4006406 - RNA, 19 nt, Staphylococcus aureus subsp. aureus MW2
ugcaacuuauaauauuaaa

SEQ ID NO: 4006407 - RNA, 17 nt, Staphylococcus aureus subsp. aureus MW2
ugcaacuugaucauuau

SEQ ID NO: 4006408 - RNA, 16 nt, Staphylococcus aureus subsp. aureus MW2
ugcaagccaucaauau

SEQ ID NO: 4006409 - RNA, 20 nt, Staphylococcus aureus subsp. aureus MW2
ugcccucauaaaucaugaaa

SEQ ID NO: 4006410 - RNA, 16 nt, Staphylococcus aureus subsp. aureus MW2
ugcccugcuguuuuau

SEQ ID NO: 4006411 - RNA, 20 nt, Staphylococcus aureus subsp. aureus MW2
ugccgccuaauaauaaaaua

SEQ ID NO: 4006412 - RNA, 17 nt, Staphylococcus aureus subsp. aureus MW2
ugccguaucuauaaaaa

SEQ ID NO: 4006413 - RNA, 21 nt, Staphylococcus aureus subsp. aureus MW2
ugccguauuucaaauguaauu

SEQ ID NO: 4006414 - RNA, 15 nt, Staphylococcus aureus subsp. aureus MW2
ugccguccauuucca

SEQ ID NO: 4006415 - RNA, 23 nt, Staphylococcus aureus subsp. aureus MW2
ugccguuugaagucuguuuagaa

SEQ ID NO: 4006416 - RNA, 16 nt, Staphylococcus aureus subsp. aureus MW2
ugccuauuuuuuuaug

SEQ ID NO: 4006417 - RNA, 19 nt, Staphylococcus aureus subsp. aureus MW2
ugccugguaacguucuacu

SEQ ID NO: 4006418 - RNA, 17 nt, Staphylococcus aureus subsp. aureus MW2
ugccuuaacuucauaau

SEQ ID NO: 4006419 - RNA, 15 nt, Staphylococcus aureus subsp. aureus MW2
ugccuuaucagcauu

SEQ ID NO: 4006420 - RNA, 19 nt, Staphylococcus aureus subsp. aureus MW2
ugccuuaugucauauacua

SEQ ID NO: 4006421 - RNA, 17 nt, Staphylococcus aureus subsp. aureus MW2
ugccuugucuauuguaa

SEQ ID NO: 4006422 - RNA, 21 nt, Staphylococcus aureus subsp. aureus MW2
ugccuuuaccgugaauauaau

SEQ ID NO: 4006423 - RNA, 12 nt, Staphylococcus aureus subsp. aureus MW2
ugccuuucuaau

SEQ ID NO: 4006424 - RNA, 21 nt, Staphylococcus aureus subsp. aureus MW2
ugccuuuuguuacgauugggc

SEQ ID NO: 4006425 - RNA, 13 nt, Staphylococcus aureus subsp. aureus MW2
ugccuuuuuguaa

SEQ ID NO: 4006426 - RNA, 18 nt, Staphylococcus aureus subsp. aureus MW2
ugccuuuuuguaauugua

SEQ ID NO: 4006427 - RNA, 20 nt, Staphylococcus aureus subsp. aureus MW2
ugccuuuuuguaauuguaau

SEQ ID NO: 4006428 - RNA, 16 nt, Staphylococcus aureus subsp. aureus MW2
ugcgaagauuuuuaac

SEQ ID NO: 4006429 - RNA, 14 nt, Staphylococcus aureus subsp. aureus MW2
ugcgaauaauaaua

SEQ ID NO: 4006430 - RNA, 15 nt, Staphylococcus aureus subsp. aureus MW2
ugcgaauuguuagau

SEQ ID NO: 4006431 - RNA, 22 nt, Staphylococcus aureus subsp. aureus MW2
ugcgacaucgccaauuugauua

SEQ ID NO: 4006432 - RNA, 21 nt, Staphylococcus aureus subsp. aureus MW2
ugcgauggucauguguugcaa

SEQ ID NO: 4006433 - RNA, 15 nt, Staphylococcus aureus subsp. aureus MW2
ugcgauuacagugug

SEQ ID NO: 4006434 - RNA, 17 nt, Staphylococcus aureus subsp. aureus MW2
ugcgccaguuucuaaua

SEQ ID NO: 4006435 - RNA, 14 nt, Staphylococcus aureus subsp. aureus MW2
ugcgccuucuuuuu

SEQ ID NO: 4006436 - RNA, 19 nt, Staphylococcus aureus subsp. aureus MW2
ugcggauuaucuaacucau

SEQ ID NO: 4006437 - RNA, 20 nt, Staphylococcus aureus subsp. aureus MW2
ugcgguaauugaaucguauu

SEQ ID NO: 4006438 - RNA, 16 nt, Staphylococcus aureus subsp. aureus MW2
ugcggucuaaaugcuc

SEQ ID NO: 4006439 - RNA, 17 nt, Staphylococcus aureus subsp. aureus MW2
ugcgguuuaaucuauau

SEQ ID NO: 4006440 - RNA, 19 nt, Staphylococcus aureus subsp. aureus MW2
ugcguaagguauuucauug

SEQ ID NO: 4006441 - RNA, 13 nt, Staphylococcus aureus subsp. aureus MW2
ugcguuaaauaua

SEQ ID NO: 4006442 - RNA, 13 nt, Staphylococcus aureus subsp. aureus MW2
ugcguuaauaauu

SEQ ID NO: 4006443 - RNA, 16 nt, Staphylococcus aureus subsp. aureus MW2
ugcguugguauucauc

SEQ ID NO: 4006444 - RNA, 19 nt, Staphylococcus aureus subsp. aureus MW2
ugcguugguauucaucuuc

SEQ ID NO: 4006445 - RNA, 16 nt, Staphylococcus aureus subsp. aureus MW2
ugcuaaaaaguuagca

SEQ ID NO: 4006446 - RNA, 17 nt, Staphylococcus aureus subsp. aureus MW2
ugcuaaaaaguuagcaa

SEQ ID NO: 4006447 - RNA, 20 nt, Staphylococcus aureus subsp. aureus MW2
ugcuaaaaaguuagcaaaug

SEQ ID NO: 4006448 - RNA, 21 nt, Staphylococcus aureus subsp. aureus MW2
ugcuaaaguguagccaaauaa

SEQ ID NO: 4006449 - RNA, 21 nt, Staphylococcus aureus subsp. aureus MW2
ugcuaaauauuauaaaaagau

SEQ ID NO: 4006450 - RNA, 20 nt, Staphylococcus aureus subsp. aureus MW2
ugcuaacucugaucuaaaac

SEQ ID NO: 4006451 - RNA, 15 nt, Staphylococcus aureus subsp. aureus MW2
ugcuaaugcuaguaa

SEQ ID NO: 4006452 - RNA, 15 nt, Staphylococcus aureus subsp. aureus MW2
ugcuaauuuuuucau

SEQ ID NO: 4006453 - RNA, 13 nt, Staphylococcus aureus subsp. aureus MW2
ugcuacaauuucc

SEQ ID NO: 4006454 - RNA, 14 nt, Staphylococcus aureus subsp. aureus MW2
ugcuacaauuuccu

SEQ ID NO: 4006455 - RNA, 17 nt, Staphylococcus aureus subsp. aureus MW2
ugcuacaauuuccuacc

SEQ ID NO: 4006456 - RNA, 17 nt, Staphylococcus aureus subsp. aureus MW2
ugcuacaccaccugcag

SEQ ID NO: 4006457 - RNA, 14 nt, Staphylococcus aureus subsp. aureus MW2
ugcuauguaaaucg

SEQ ID NO: 4006458 - RNA, 17 nt, Staphylococcus aureus subsp. aureus MW2
ugcucaucuacuuaaaa

SEQ ID NO: 4006459 - RNA, 16 nt, Staphylococcus aureus subsp. aureus MW2
ugcucaucuucuaauu

SEQ ID NO: 4006460 - RNA, 14 nt, Staphylococcus aureus subsp. aureus MW2
ugcucguauagaaa

SEQ ID NO: 4006461 - RNA, 17 nt, Staphylococcus aureus subsp. aureus MW2
ugcucuaagcauucagu

SEQ ID NO: 4006462 - RNA, 14 nt, Staphylococcus aureus subsp. aureus MW2
ugcucuaugcuuuu

SEQ ID NO: 4006463 - RNA, 20 nt, Staphylococcus aureus subsp. aureus MW2
ugcugaaucgaguuugaaau

SEQ ID NO: 4006464 - RNA, 19 nt, Staphylococcus aureus subsp. aureus MW2
ugcugauaccuaagcugau

SEQ ID NO: 4006465 - RNA, 18 nt, Staphylococcus aureus subsp. aureus MW2
ugcugcuaaaauaacaac

SEQ ID NO: 4006466 - RNA, 17 nt, Staphylococcus aureus subsp. aureus MW2
ugcugcuuuuccauuau

SEQ ID NO: 4006467 - RNA, 20 nt, Staphylococcus aureus subsp. aureus MW2
ugcuggcuuaguaaguugua

SEQ ID NO: 4006468 - RNA, 15 nt, Staphylococcus aureus subsp. aureus MW2
ugcugguaacucuuc

SEQ ID NO: 4006469 - RNA, 19 nt, Staphylococcus aureus subsp. aureus MW2
ugcugguugcuucuuauca

SEQ ID NO: 4006470 - RNA, 13 nt, Staphylococcus aureus subsp. aureus MW2
ugcugugauuguc

SEQ ID NO: 4006471 - RNA, 13 nt, Staphylococcus aureus subsp. aureus MW2
ugcuguuacuucu

SEQ ID NO: 4006472 - RNA, 14 nt, Staphylococcus aureus subsp. aureus MW2
ugcuguuacuucuc

SEQ ID NO: 4006473 - RNA, 15 nt, Staphylococcus aureus subsp. aureus MW2
ugcuguucuguucca

SEQ ID NO: 4006474 - RNA, 22 nt, Staphylococcus aureus subsp. aureus MW2
ugcuguugaagaagguaauaaa

SEQ ID NO: 4006475 - RNA, 14 nt, Staphylococcus aureus subsp. aureus MW2
ugcuguuuuuauua

SEQ ID NO: 4006476 - RNA, 18 nt, Staphylococcus aureus subsp. aureus MW2
ugcuuaauuuguuuuaaa

SEQ ID NO: 4006477 - RNA, 19 nt, Staphylococcus aureus subsp. aureus MW2
ugcuuaauuuguuuuaaau

SEQ ID NO: 4006478 - RNA, 12 nt, Staphylococcus aureus subsp. aureus MW2
ugcuuacaauaa

SEQ ID NO: 4006479 - RNA, 14 nt, Staphylococcus aureus subsp. aureus MW2
ugcuuaguacacgu

SEQ ID NO: 4006480 - RNA, 19 nt, Staphylococcus aureus subsp. aureus MW2
ugcuuaguacacguguauu

SEQ ID NO: 4006481 - RNA, 14 nt, Staphylococcus aureus subsp. aureus MW2
ugcuuauuaaaauu

SEQ ID NO: 4006482 - RNA, 21 nt, Staphylococcus aureus subsp. aureus MW2
ugcuuauucugaaaaauauuu

SEQ ID NO: 4006483 - RNA, 19 nt, Staphylococcus aureus subsp. aureus MW2
ugcuuauuuuuguauucuu

SEQ ID NO: 4006484 - RNA, 12 nt, Staphylococcus aureus subsp. aureus MW2
ugcuucaacuac

SEQ ID NO: 4006485 - RNA, 18 nt, Staphylococcus aureus subsp. aureus MW2
ugcuucaacuucaucuaa

SEQ ID NO: 4006486 - RNA, 21 nt, Staphylococcus aureus subsp. aureus MW2
ugcuucaacuucaucuaaaug

SEQ ID NO: 4006487 - RNA, 22 nt, Staphylococcus aureus subsp. aureus MW2
ugcuucacuaaaaaucuauaua

SEQ ID NO: 4006488 - RNA, 16 nt, Staphylococcus aureus subsp. aureus MW2
ugcuucacuguuuuau

SEQ ID NO: 4006489 - RNA, 20 nt, Staphylococcus aureus subsp. aureus MW2
ugcuucauuauauaauucuu

SEQ ID NO: 4006490 - RNA, 18 nt, Staphylococcus aureus subsp. aureus MW2
ugcuuccaccgcugcucu

SEQ ID NO: 4006491 - RNA, 15 nt, Staphylococcus aureus subsp. aureus MW2
ugcuucgucauuagg

SEQ ID NO: 4006492 - RNA, 17 nt, Staphylococcus aureus subsp. aureus MW2
ugcuucucguaguucga

SEQ ID NO: 4006493 - RNA, 21 nt, Staphylococcus aureus subsp. aureus MW2
ugcuucuucagguguuuuacc

SEQ ID NO: 4006494 - RNA, 13 nt, Staphylococcus aureus subsp. aureus MW2
ugcuugcuuacaa

SEQ ID NO: 4006495 - RNA, 16 nt, Staphylococcus aureus subsp. aureus MW2
ugcuuggauaauugca

SEQ ID NO: 4006496 - RNA, 14 nt, Staphylococcus aureus subsp. aureus MW2
ugcuugguuugauu

SEQ ID NO: 4006497 - RNA, 17 nt, Staphylococcus aureus subsp. aureus MW2
ugcuuguccucuaaaac

SEQ ID NO: 4006498 - RNA, 18 nt, Staphylococcus aureus subsp. aureus MW2
uggcuuguuaagcagcuu

SEQ ID NO: 4006499 - RNA, 13 nt, Staphylococcus aureus subsp. aureus MW2
uggcuuuuuuaau

SEQ ID NO: 4006500 - RNA, 14 nt, Staphylococcus aureus subsp. aureus MW2
uggcuuuuuuauuu

SEQ ID NO: 4006501 - RNA, 14 nt, Staphylococcus aureus subsp. aureus MW2
ugggaauuguauua

SEQ ID NO: 4006502 - RNA, 16 nt, Staphylococcus aureus subsp. aureus MW2
ugggacauaaaucaau

SEQ ID NO: 4006503 - RNA, 17 nt, Staphylococcus aureus subsp. aureus MW2
ugggacauaaaucaaug

SEQ ID NO: 4006504 - RNA, 18 nt, Staphylococcus aureus subsp. aureus MW2
ugggacgacgaaauaaau

SEQ ID NO: 4006505 - RNA, 18 nt, Staphylococcus aureus subsp. aureus MW2
ugggacgacgaaauaauu

SEQ ID NO: 4006506 - RNA, 14 nt, Staphylococcus aureus subsp. aureus MW2
ugggacuuuuuaua

SEQ ID NO: 4006507 - RNA, 16 nt, Staphylococcus aureus subsp. aureus MW2
ugggauaauuuguauu

SEQ ID NO: 4006508 - RNA, 15 nt, Staphylococcus aureus subsp. aureus MW2
ugggccccaacaaag

SEQ ID NO: 4006509 - RNA, 19 nt, Staphylococcus aureus subsp. aureus MW2
ugggccccaacacagagaa

SEQ ID NO: 4006510 - RNA, 14 nt, Staphylococcus aureus subsp. aureus MW2
ugggcguucugcua

SEQ ID NO: 4006511 - RNA, 15 nt, Staphylococcus aureus subsp. aureus MW2
ugggcguucugcuaa

SEQ ID NO: 4006512 - RNA, 16 nt, Staphylococcus aureus subsp. aureus MW2
ugggcugacauuuuug

SEQ ID NO: 4006513 - RNA, 19 nt, Staphylococcus aureus subsp. aureus MW2
uggggcccauccccaacuu

SEQ ID NO: 4006514 - RNA, 20 nt, Staphylococcus aureus subsp. aureus MW2
uggggugggacgacgaaaua

SEQ ID NO: 4006515 - RNA, 13 nt, Staphylococcus aureus subsp. aureus MW2
ugggguuuuauuu

SEQ ID NO: 4006516 - RNA, 20 nt, Staphylococcus aureus subsp. aureus MW2
uggguaaggugauugaacaa

SEQ ID NO: 4006517 - RNA, 14 nt, Staphylococcus aureus subsp. aureus MW2
uggguaauguuuuu

SEQ ID NO: 4006518 - RNA, 16 nt, Staphylococcus aureus subsp. aureus MW2
ugguaaaaaugaacca

SEQ ID NO: 4006519 - RNA, 17 nt, Staphylococcus aureus subsp. aureus MW2
ugguaaaucaugacaua

SEQ ID NO: 4006520 - RNA, 20 nt, Staphylococcus aureus subsp. aureus MW2
ugguaacucuucaguacgaa

SEQ ID NO: 4006521 - RNA, 19 nt, Staphylococcus aureus subsp. aureus MW2
ugguaauucaccaucauau

SEQ ID NO: 4006522 - RNA, 19 nt, Staphylococcus aureus subsp. aureus MW2
ugguacuacuauccagucc

SEQ ID NO: 4006523 - RNA, 14 nt, Staphylococcus aureus subsp. aureus MW2
ugguaggcauuuua

SEQ ID NO: 4006524 - RNA, 12 nt, Staphylococcus aureus subsp. aureus MW2
ugguauaacaau

SEQ ID NO: 4006525 - RNA, 19 nt, Staphylococcus aureus subsp. aureus MW2
ugguauaacaauuuuagac

SEQ ID NO: 4006526 - RNA, 16 nt, Staphylococcus aureus subsp. aureus MW2
ugguauagauuuuaua

SEQ ID NO: 4006527 - RNA, 18 nt, Staphylococcus aureus subsp. aureus MW2
ugguaugacugcaaauac

SEQ ID NO: 4006528 - RNA, 19 nt, Staphylococcus aureus subsp. aureus MW2
ugguauuagaacuucucuu

SEQ ID NO: 4006529 - RNA, 22 nt, Staphylococcus aureus subsp. aureus MW2
ugguauuagaacuucucuuuga

SEQ ID NO: 4006530 - RNA, 18 nt, Staphylococcus aureus subsp. aureus MW2
ugguauuauucuuucaua

SEQ ID NO: 4006531 - RNA, 17 nt, Staphylococcus aureus subsp. aureus MW2
ugguauucgcaucauuc

SEQ ID NO: 4006532 - RNA, 15 nt, Staphylococcus aureus subsp. aureus MW2
ugguauuuuuuaaau

SEQ ID NO: 4006533 - RNA, 22 nt, Staphylococcus aureus subsp. aureus MW2
uggucaccuacagauaaagcuu

SEQ ID NO: 4006534 - RNA, 18 nt, Staphylococcus aureus subsp. aureus MW2
uggucacuaaugcauaau

SEQ ID NO: 4006535 - RNA, 16 nt, Staphylococcus aureus subsp. aureus MW2
uggucauguguugcaa

SEQ ID NO: 4006536 - RNA, 17 nt, Staphylococcus aureus subsp. aureus MW2
uggucauguguugcaau

SEQ ID NO: 4006537 - RNA, 18 nt, Staphylococcus aureus subsp. aureus MW2
uggucuaaagcuuauuaa

SEQ ID NO: 4006538 - RNA, 18 nt, Staphylococcus aureus subsp. aureus MW2
uggucugauuuugcauuu

SEQ ID NO: 4006539 - RNA, 13 nt, Staphylococcus aureus subsp. aureus MW2
uggucuuucuuag

SEQ ID NO: 4006540 - RNA, 13 nt, Staphylococcus aureus subsp. aureus MW2
uggucuuuuaaua

SEQ ID NO: 4006541 - RNA, 15 nt, Staphylococcus aureus subsp. aureus MW2
uggucuuuuaauauu

SEQ ID NO: 4006542 - RNA, 20 nt, Staphylococcus aureus subsp. aureus MW2
uggugacacugcuuuuaaau

SEQ ID NO: 4006543 - RNA, 24 nt, Staphylococcus aureus subsp. aureus MW2
uggugaguguuucauaaucucuuu

SEQ ID NO: 4006544 - RNA, 16 nt, Staphylococcus aureus subsp. aureus MW2
uggugaguuggcauca

SEQ ID NO: 4006545 - RNA, 17 nt, Staphylococcus aureus subsp. aureus MW2
uggugcuaaaaaauuug

SEQ ID NO: 4006546 - RNA, 17 nt, Staphylococcus aureus subsp. aureus MW2
uggugcuauuuuugacu

SEQ ID NO: 4006547 - RNA, 14 nt, Staphylococcus aureus subsp. aureus MW2
uggugcuuuuuuaa

SEQ ID NO: 4006548 - RNA, 22 nt, Staphylococcus aureus subsp. aureus MW2
ugguggagaaccauauuuacac

SEQ ID NO: 4006549 - RNA, 15 nt, Staphylococcus aureus subsp. aureus MW2
ugguuaacauccugc

SEQ ID NO: 4006550 - RNA, 18 nt, Staphylococcus aureus subsp. aureus MW2
ugguuagaaaaaaaucug

SEQ ID NO: 4006551 - RNA, 19 nt, Staphylococcus aureus subsp. aureus MW2
ugguuagaaaaaaaucugu

SEQ ID NO: 4006552 - RNA, 13 nt, Staphylococcus aureus subsp. aureus MW2
ugguuaucuuauc

SEQ ID NO: 4006553 - RNA, 17 nt, Staphylococcus aureus subsp. aureus MW2
ugguuauuaaaauuaaa

SEQ ID NO: 4006554 - RNA, 12 nt, Staphylococcus aureus subsp. aureus MW2
ugguuauuuccg

SEQ ID NO: 4006555 - RNA, 12 nt, Staphylococcus aureus subsp. aureus MW2
ugguucaaauau

SEQ ID NO: 4006556 - RNA, 17 nt, Staphylococcus aureus subsp. aureus MW2
ugguucaucaaacaaca

SEQ ID NO: 4006557 - RNA, 19 nt, Staphylococcus aureus subsp. aureus MW2
ugguucaucaaacaacauc

SEQ ID NO: 4006558 - RNA, 11 nt, Staphylococcus aureus subsp. aureus MW2
ugguucuucac

SEQ ID NO: 4006559 - RNA, 14 nt, Staphylococcus aureus subsp. aureus MW2
ugguugaauaacac

SEQ ID NO: 4006560 - RNA, 15 nt, Staphylococcus aureus subsp. aureus MW2
ugguugcuucuuauc

SEQ ID NO: 4006561 - RNA, 14 nt, Staphylococcus aureus subsp. aureus MW2
ugguuguucuuuuu

SEQ ID NO: 4006562 - RNA, 11 nt, Staphylococcus aureus subsp. aureus MW2
ugguuuaaaaa

SEQ ID NO: 4006563 - RNA, 22 nt, Staphylococcus aureus subsp. aureus MW2
ugguuuaaaaagucaaagagga

SEQ ID NO: 4006564 - RNA, 15 nt, Staphylococcus aureus subsp. aureus MW2
ugguuuaaugagcuu

SEQ ID NO: 4006565 - RNA, 15 nt, Staphylococcus aureus subsp. aureus MW2
ugguuuauuuuaaua

SEQ ID NO: 4006566 - RNA, 22 nt, Staphylococcus aureus subsp. aureus MW2
ugguuucaaaaucaauugaaaa

SEQ ID NO: 4006567 - RNA, 21 nt, Staphylococcus aureus subsp. aureus MW2
ugguuucuuaacauaaaauga

SEQ ID NO: 4006568 - RNA, 22 nt, Staphylococcus aureus subsp. aureus MW2
ugguuugcuuuaaaauucucua

SEQ ID NO: 4006569 - RNA, 20 nt, Staphylococcus aureus subsp. aureus MW2
ugguuugugauuuuuugaua

SEQ ID NO: 4006570 - RNA, 12 nt, Staphylococcus aureus subsp. aureus MW2
ugguuuuacugc

SEQ ID NO: 4006571 - RNA, 12 nt, Staphylococcus aureus subsp. aureus MW2
ugguuuuauuaa

SEQ ID NO: 4006572 - RNA, 17 nt, Staphylococcus aureus subsp. aureus MW2
ugguuuugauuaaacug

SEQ ID NO: 4006573 - RNA, 12 nt, Staphylococcus aureus subsp. aureus MW2
ugguuuuuaaaa

SEQ ID NO: 4006574 - RNA, 14 nt, Staphylococcus aureus subsp. aureus MW2
ugguuuuuaaaagu

SEQ ID NO: 4006575 - RNA, 12 nt, Staphylococcus aureus subsp. aureus MW2
uguaaaaaauau

SEQ ID NO: 4006576 - RNA, 13 nt, Staphylococcus aureus subsp. aureus MW2
uguaaaaaauauc

SEQ ID NO: 4006577 - RNA, 22 nt, Staphylococcus aureus subsp. aureus MW2
uguaaaacauucccuuaauaau

SEQ ID NO: 4006578 - RNA, 21 nt, Staphylococcus aureus subsp. aureus MW2
uguaaaaccuuacccaaaaaa

SEQ ID NO: 4006579 - RNA, 22 nt, Staphylococcus aureus subsp. aureus MW2
uguaaaaccuuacccaaaaaau

SEQ ID NO: 4006580 - RNA, 17 nt, Staphylococcus aureus subsp. aureus MW2
uguaaaacugaaguaaa

SEQ ID NO: 4006581 - RNA, 20 nt, Staphylococcus aureus subsp. aureus MW2
uguaaaaugaugauuuaaag

SEQ ID NO: 4006582 - RNA, 12 nt, Staphylococcus aureus subsp. aureus MW2
uguaaaaugcuc

SEQ ID NO: 4006583 - RNA, 20 nt, Staphylococcus aureus subsp. aureus MW2
uguaaaaugcucccuucaaa

SEQ ID NO: 4006584 - RNA, 21 nt, Staphylococcus aureus subsp. aureus MW2
uguaaaaugugccuuuuguua

SEQ ID NO: 4006585 - RNA, 18 nt, Staphylococcus aureus subsp. aureus MW2
uguaaacaguauguagcu

SEQ ID NO: 4006586 - RNA, 18 nt, Staphylococcus aureus subsp. aureus MW2
uguaaacuucuuuucuuu

SEQ ID NO: 4006587 - RNA, 18 nt, Staphylococcus aureus subsp. aureus MW2
uguaucucugaaaaacuu

SEQ ID NO: 4006588 - RNA, 20 nt, Staphylococcus aureus subsp. aureus MW2
uguaucucugaaaaacuucu

SEQ ID NO: 4006589 - RNA, 13 nt, Staphylococcus aureus subsp. aureus MW2
uguaucucuuauu

SEQ ID NO: 4006590 - RNA, 15 nt, Staphylococcus aureus subsp. aureus MW2
uguaucucuuauuuu

SEQ ID NO: 4006591 - RNA, 19 nt, Staphylococcus aureus subsp. aureus MW2
uguaugaaaggaguauuuu

SEQ ID NO: 4006592 - RNA, 14 nt, Staphylococcus aureus subsp. aureus MW2
uguaugaagauuua

SEQ ID NO: 4006593 - RNA, 22 nt, Staphylococcus aureus subsp. aureus MW2
uguaugacaggcguguugaaau

SEQ ID NO: 4006594 - RNA, 20 nt, Staphylococcus aureus subsp. aureus MW2
uguaugauagaauacuaaaa

SEQ ID NO: 4006595 - RNA, 19 nt, Staphylococcus aureus subsp. aureus MW2
uguaugccgccuaauaaua

SEQ ID NO: 4006596 - RNA, 16 nt, Staphylococcus aureus subsp. aureus MW2
uguaugcgagggcuuu

SEQ ID NO: 4006597 - RNA, 14 nt, Staphylococcus aureus subsp. aureus MW2
uguauggcauaacc

SEQ ID NO: 4006598 - RNA, 23 nt, Staphylococcus aureus subsp. aureus MW2
uguauguaagcagacuaaaagug

SEQ ID NO: 4006599 - RNA, 18 nt, Staphylococcus aureus subsp. aureus MW2
uguauguuuuaucaauau

SEQ ID NO: 4006600 - RNA, 16 nt, Staphylococcus aureus subsp. aureus MW2
uguauuaaucaaauau

SEQ ID NO: 4006601 - RNA, 17 nt, Staphylococcus aureus subsp. aureus MW2
uguauuaaucaaauauu

SEQ ID NO: 4006602 - RNA, 18 nt, Staphylococcus aureus subsp. aureus MW2
uguauucaacugcguuau

SEQ ID NO: 4006603 - RNA, 21 nt, Staphylococcus aureus subsp. aureus MW2
uguauucaacugcguuaugaa

SEQ ID NO: 4006604 - RNA, 18 nt, Staphylococcus aureus subsp. aureus MW2
uguauucgcuuacauuau

SEQ ID NO: 4006605 - RNA, 20 nt, Staphylococcus aureus subsp. aureus MW2
uguauucgcuuacauuauga

SEQ ID NO: 4006606 - RNA, 23 nt, Staphylococcus aureus subsp. aureus MW2
uguauucgcuuacauuaugaaca

SEQ ID NO: 4006607 - RNA, 16 nt, Staphylococcus aureus subsp. aureus MW2
uguauucugaaacuuu

SEQ ID NO: 4006608 - RNA, 19 nt, Staphylococcus aureus subsp. aureus MW2
uguauucuucuaauucuga

SEQ ID NO: 4006609 - RNA, 23 nt, Staphylococcus aureus subsp. aureus MW2
uguauugagaaagacuauauaac

SEQ ID NO: 4006610 - RNA, 16 nt, Staphylococcus aureus subsp. aureus MW2
uguauuguauuuuaau

SEQ ID NO: 4006611 - RNA, 19 nt, Staphylococcus aureus subsp. aureus MW2
uguauuguuugaaaauuaa

SEQ ID NO: 4006612 - RNA, 17 nt, Staphylococcus aureus subsp. aureus MW2
uguauuguuuguuuuua

SEQ ID NO: 4006613 - RNA, 14 nt, Staphylococcus aureus subsp. aureus MW2
uguauuuaguauca

SEQ ID NO: 4006614 - RNA, 20 nt, Staphylococcus aureus subsp. aureus MW2
uguauuuauacuauaaauaa

SEQ ID NO: 4006615 - RNA, 18 nt, Staphylococcus aureus subsp. aureus MW2
uguauuuuucauauugcu

SEQ ID NO: 4006616 - RNA, 21 nt, Staphylococcus aureus subsp. aureus MW2
uguauuuuucuuaauuaucau

SEQ ID NO: 4006617 - RNA, 16 nt, Staphylococcus aureus subsp. aureus MW2
ugucaauaaauuguuu

SEQ ID NO: 4006618 - RNA, 18 nt, Staphylococcus aureus subsp. aureus MW2
ugucaauauaacauugca

SEQ ID NO: 4006619 - RNA, 12 nt, Staphylococcus aureus subsp. aureus MW2
ugucacaggcug

SEQ ID NO: 4006620 - RNA, 23 nt, Staphylococcus aureus subsp. aureus MW2
ugucacauguaccacauuuuccu

SEQ ID NO: 4006621 - RNA, 23 nt, Staphylococcus aureus subsp. aureus MW2
ugucacuggguguuuuuuucuua

SEQ ID NO: 4006622 - RNA, 22 nt, Staphylococcus aureus subsp. aureus MW2
ugucacuuggauucaaaugaca

SEQ ID NO: 4006623 - RNA, 22 nt, Staphylococcus aureus subsp. aureus MW2
ugucagcauucauagcugcuuu

SEQ ID NO: 4006624 - RNA, 16 nt, Staphylococcus aureus subsp. aureus MW2
ugucaguaacuuuguc

SEQ ID NO: 4006625 - RNA, 21 nt, Staphylococcus aureus subsp. aureus MW2
ugucaguuuugaagaauaaaa

SEQ ID NO: 4006626 - RNA, 20 nt, Staphylococcus aureus subsp. aureus MW2
ugucauaauagauaaugcac

SEQ ID NO: 4006627 - RNA, 19 nt, Staphylococcus aureus subsp. aureus MW2
ugucauaauccauucuucu

SEQ ID NO: 4006628 - RNA, 12 nt, Staphylococcus aureus subsp. aureus MW2
ugucaucgcuuu

SEQ ID NO: 4006629 - RNA, 14 nt, Staphylococcus aureus subsp. aureus MW2
ugucaugaauuuuc

SEQ ID NO: 4006630 - RNA, 15 nt, Staphylococcus aureus subsp. aureus MW2
ugucaugccuucauu

SEQ ID NO: 4006631 - RNA, 15 nt, Staphylococcus aureus subsp. aureus MW2
ugucauguguucaaa

SEQ ID NO: 4006632 - RNA, 16 nt, Staphylococcus aureus subsp. aureus MW2
ugucauguguucaaau

SEQ ID NO: 4006633 - RNA, 14 nt, Staphylococcus aureus subsp. aureus MW2
ugucauuaacauaa

SEQ ID NO: 4006634 - RNA, 15 nt, Staphylococcus aureus subsp. aureus MW2
ugucauuaacauaau

SEQ ID NO: 4006635 - RNA, 18 nt, Staphylococcus aureus subsp. aureus MW2
ugucauuaacauaauaau

SEQ ID NO: 4006636 - RNA, 19 nt, Staphylococcus aureus subsp. aureus MW2
uguccagcuuaauuugaca

SEQ ID NO: 4006637 - RNA, 18 nt, Staphylococcus aureus subsp. aureus MW2
uguccauaguaaucgauu

SEQ ID NO: 4006638 - RNA, 19 nt, Staphylococcus aureus subsp. aureus MW2
uguccaucuuuuauuaaag

SEQ ID NO: 4006639 - RNA, 22 nt, Staphylococcus aureus subsp. aureus MW2
ugucccacucccaaaaagacag

SEQ ID NO: 4006640 - RNA, 18 nt, Staphylococcus aureus subsp. aureus MW2
uguccgagacuauauuca

SEQ ID NO: 4006641 - RNA, 14 nt, Staphylococcus aureus subsp. aureus MW2
uguccgauaucuuu

SEQ ID NO: 4006642 - RNA, 19 nt, Staphylococcus aureus subsp. aureus MW2
uguccgauuugauaaaaaa

SEQ ID NO: 4006643 - RNA, 17 nt, Staphylococcus aureus subsp. aureus MW2
uguccuaaguuaugacu

SEQ ID NO: 4006644 - RNA, 17 nt, Staphylococcus aureus subsp. aureus MW2
uguccuaauaaguuacc

SEQ ID NO: 4006645 - RNA, 17 nt, Staphylococcus aureus subsp. aureus MW2
uguccuagacucuaaaa

SEQ ID NO: 4006646 - RNA, 13 nt, Staphylococcus aureus subsp. aureus MW2
uguccucuaaaac

SEQ ID NO: 4006647 - RNA, 22 nt, Staphylococcus aureus subsp. aureus MW2
uguccucuaaaacauguugaua

SEQ ID NO: 4006648 - RNA, 14 nt, Staphylococcus aureus subsp. aureus MW2
ugucgauauuucua

SEQ ID NO: 4006649 - RNA, 15 nt, Staphylococcus aureus subsp. aureus MW2
ugucgguucaucuaa

SEQ ID NO: 4006650 - RNA, 14 nt, Staphylococcus aureus subsp. aureus MW2
ugucuaaaaauguc

SEQ ID NO: 4006651 - RNA, 16 nt, Staphylococcus aureus subsp. aureus MW2
ugucuagacuuauuug

SEQ ID NO: 4006652 - RNA, 17 nt, Staphylococcus aureus subsp. aureus MW2
ugucuagacuuauuuga

SEQ ID NO: 4006653 - RNA, 23 nt, Staphylococcus aureus subsp. aureus MW2
ugucuagacuuauuugaaugcaa

SEQ ID NO: 4006654 - RNA, 13 nt, Staphylococcus aureus subsp. aureus MW2
ugucuagauuuca

SEQ ID NO: 4006655 - RNA, 19 nt, Staphylococcus aureus subsp. aureus MW2
ugucuaguucgauuuuuua

SEQ ID NO: 4006656 - RNA, 19 nt, Staphylococcus aureus subsp. aureus MW2
ugucucaaauuaaaucacc

SEQ ID NO: 4006657 - RNA, 22 nt, Staphylococcus aureus subsp. aureus MW2
ugucucagauucauaucuuuca

SEQ ID NO: 4006658 - RNA, 17 nt, Staphylococcus aureus subsp. aureus MW2
ugucucucuuucuuauu

SEQ ID NO: 4006659 - RNA, 12 nt, Staphylococcus aureus subsp. aureus MW2
ugucuguagaaa

SEQ ID NO: 4006660 - RNA, 19 nt, Staphylococcus aureus subsp. aureus MW2
ugucuuaauucauuccaaa

SEQ ID NO: 4006661 - RNA, 20 nt, Staphylococcus aureus subsp. aureus MW2
ugucuuaucaauuagccaau

SEQ ID NO: 4006662 - RNA, 14 nt, Staphylococcus aureus subsp. aureus MW2
ugucuuugaacaua

SEQ ID NO: 4006663 - RNA, 20 nt, Staphylococcus aureus subsp. aureus MW2
ugucuuuucauuuuuuagau

SEQ ID NO: 4006664 - RNA, 15 nt, Staphylococcus aureus subsp. aureus MW2
ugugaauaaaauugu

SEQ ID NO: 4006665 - RNA, 18 nt, Staphylococcus aureus subsp. aureus MW2
ugugaauguuuucuaaau

SEQ ID NO: 4006666 - RNA, 13 nt, Staphylococcus aureus subsp. aureus MW2
ugugacaauuuaa

SEQ ID NO: 4006667 - RNA, 17 nt, Staphylococcus aureus subsp. aureus MW2
ugugacuuguaucaucg

SEQ ID NO: 4006668 - RNA, 20 nt, Staphylococcus aureus subsp. aureus MW2
ugugauaacuuguaauauaa

SEQ ID NO: 4006669 - RNA, 14 nt, Staphylococcus aureus subsp. aureus MW2
ugugauaauucuuc

SEQ ID NO: 4006670 - RNA, 17 nt, Staphylococcus aureus subsp. aureus MW2
ugugauaauucuucaac

SEQ ID NO: 4006671 - RNA, 18 nt, Staphylococcus aureus subsp. aureus MW2
ugugauauaugaaauauu

SEQ ID NO: 4006672 - RNA, 16 nt, Staphylococcus aureus subsp. aureus MW2
ugugauuaugcauaug

SEQ ID NO: 4006673 - RNA, 15 nt, Staphylococcus aureus subsp. aureus MW2
ugugauuuguuacuu

SEQ ID NO: 4006674 - RNA, 18 nt, Staphylococcus aureus subsp. aureus MW2
ugugauuuguuacuucua

SEQ ID NO: 4006675 - RNA, 15 nt, Staphylococcus aureus subsp. aureus MW2
uguugcaaaauacga

SEQ ID NO: 4006676 - RNA, 14 nt, Staphylococcus aureus subsp. aureus MW2
uguugcaaaauuaa

SEQ ID NO: 4006677 - RNA, 17 nt, Staphylococcus aureus subsp. aureus MW2
uguugcauuagaucaua

SEQ ID NO: 4006678 - RNA, 17 nt, Staphylococcus aureus subsp. aureus MW2
uguugcuaaucucagau

SEQ ID NO: 4006679 - RNA, 22 nt, Staphylococcus aureus subsp. aureus MW2
uguuggaagccuucaauaguuu

SEQ ID NO: 4006680 - RNA, 16 nt, Staphylococcus aureus subsp. aureus MW2
uguuggcaaacuauua

SEQ ID NO: 4006681 - RNA, 20 nt, Staphylococcus aureus subsp. aureus MW2
uguugguucaucaaacaaca

SEQ ID NO: 4006682 - RNA, 17 nt, Staphylococcus aureus subsp. aureus MW2
uguugugcaacauugau

SEQ ID NO: 4006683 - RNA, 14 nt, Staphylococcus aureus subsp. aureus MW2
uguuguuauauaaa

SEQ ID NO: 4006684 - RNA, 18 nt, Staphylococcus aureus subsp. aureus MW2
uguuguuuaaauuucaaa

SEQ ID NO: 4006685 - RNA, 11 nt, Staphylococcus aureus subsp. aureus MW2
uguuguuuuaa

SEQ ID NO: 4006686 - RNA, 15 nt, Staphylococcus aureus subsp. aureus MW2
uguuuaaauaaaauu

SEQ ID NO: 4006687 - RNA, 13 nt, Staphylococcus aureus subsp. aureus MW2
uguuuaaauuuaa

SEQ ID NO: 4006688 - RNA, 12 nt, Staphylococcus aureus subsp. aureus MW2
uguuuaauaaua

SEQ ID NO: 4006689 - RNA, 14 nt, Staphylococcus aureus subsp. aureus MW2
uguuuaauaauaca

SEQ ID NO: 4006690 - RNA, 12 nt, Staphylococcus aureus subsp. aureus MW2
uguuuaauuauc

SEQ ID NO: 4006691 - RNA, 14 nt, Staphylococcus aureus subsp. aureus MW2
uguuuaauuuucua

SEQ ID NO: 4006692 - RNA, 18 nt, Staphylococcus aureus subsp. aureus MW2
uguuuacuauacuuugag

SEQ ID NO: 4006693 - RNA, 22 nt, Staphylococcus aureus subsp. aureus MW2
uguuuagggaaucccauaccua

SEQ ID NO: 4006694 - RNA, 23 nt, Staphylococcus aureus subsp. aureus MW2
uguuuaguauggaauaaaugguu

SEQ ID NO: 4006695 - RNA, 16 nt, Staphylococcus aureus subsp. aureus MW2
uguuuauaauaauauu

SEQ ID NO: 4006696 - RNA, 16 nt, Staphylococcus aureus subsp. aureus MW2
uguuuauauugcaaaa

SEQ ID NO: 4006697 - RNA, 21 nt, Staphylococcus aureus subsp. aureus MW2
uguuuaucaugaugauaaauu

SEQ ID NO: 4006698 - RNA, 22 nt, Staphylococcus aureus subsp. aureus MW2
uguuuaucaugaugauaaauug

SEQ ID NO: 4006699 - RNA, 15 nt, Staphylococcus aureus subsp. aureus MW2
uguuuauccauauau

SEQ ID NO: 4006700 - RNA, 22 nt, Staphylococcus aureus subsp. aureus MW2
uguuuaugagcuuaauaaauug

SEQ ID NO: 4006701 - RNA, 19 nt, Staphylococcus aureus subsp. aureus MW2
uguuuaugucuugcucuau

SEQ ID NO: 4006702 - RNA, 16 nt, Staphylococcus aureus subsp. aureus MW2
uguuuauuacauaauu

SEQ ID NO: 4006703 - RNA, 20 nt, Staphylococcus aureus subsp. aureus MW2
uguuuauuacauaauuuauc

SEQ ID NO: 4006704 - RNA, 13 nt, Staphylococcus aureus subsp. aureus MW2
uguuuauucagau

SEQ ID NO: 4006705 - RNA, 16 nt, Staphylococcus aureus subsp. aureus MW2
uguuuauuuagaauaa

SEQ ID NO: 4006706 - RNA, 21 nt, Staphylococcus aureus subsp. aureus MW2
uguuuauuuguguuuuuauua

SEQ ID NO: 4006707 - RNA, 15 nt, Staphylococcus aureus subsp. aureus MW2
uguuucaaauuuugu

SEQ ID NO: 4006708 - RNA, 12 nt, Staphylococcus aureus subsp. aureus MW2
uguuucaacaua

SEQ ID NO: 4006709 - RNA, 14 nt, Staphylococcus aureus subsp. aureus MW2
uguuucaacauauu

SEQ ID NO: 4006710 - RNA, 19 nt, Staphylococcus aureus subsp. aureus MW2
uguuucaacauauuauaua

SEQ ID NO: 4006711 - RNA, 15 nt, Staphylococcus aureus subsp. aureus MW2
uguuucauauauauu

SEQ ID NO: 4006712 - RNA, 21 nt, Staphylococcus aureus subsp. aureus MW2
uguuucauaugcaucaacaga

SEQ ID NO: 4006713 - RNA, 14 nt, Staphylococcus aureus subsp. aureus MW2
uguuuccucuuuaa

SEQ ID NO: 4006714 - RNA, 14 nt, Staphylococcus aureus subsp. aureus MW2
uguuucgucagauu

SEQ ID NO: 4006715 - RNA, 15 nt, Staphylococcus aureus subsp. aureus MW2
uguuucuaaauucuu

SEQ ID NO: 4006716 - RNA, 18 nt, Staphylococcus aureus subsp. aureus MW2
uguuucuaaauucuuuuu

SEQ ID NO: 4006717 - RNA, 15 nt, Staphylococcus aureus subsp. aureus MW2
uguuucuauauuaau

SEQ ID NO: 4006718 - RNA, 17 nt, Staphylococcus aureus subsp. aureus MW2
uguuucuucaauuuaau

SEQ ID NO: 4006719 - RNA, 13 nt, Staphylococcus aureus subsp. aureus MW2
uguuucuuguucu

SEQ ID NO: 4006720 - RNA, 19 nt, Staphylococcus aureus subsp. aureus MW2
uguuucuuguucuaaaaaa

SEQ ID NO: 4006721 - RNA, 16 nt, Staphylococcus aureus subsp. aureus MW2
uguuugaagaccuucu

SEQ ID NO: 4006722 - RNA, 17 nt, Staphylococcus aureus subsp. aureus MW2
uguuugaagaccuucua

SEQ ID NO: 4006723 - RNA, 18 nt, Staphylococcus aureus subsp. aureus MW2
uguuugaauguuuuugau

SEQ ID NO: 4006724 - RNA, 22 nt, Staphylococcus aureus subsp. aureus MW2
uguuugagauauauuaauauuu

SEQ ID NO: 4006725 - RNA, 14 nt, Staphylococcus aureus subsp. aureus MW2
uguuugauuuugag

SEQ ID NO: 4006726 - RNA, 14 nt, Staphylococcus aureus subsp. aureus MW2
uguuugcuuuuugu

SEQ ID NO: 4006727 - RNA, 16 nt, Staphylococcus aureus subsp. aureus MW2
uguuuggaugaacaaa

SEQ ID NO: 4006728 - RNA, 13 nt, Staphylococcus aureus subsp. aureus MW2
uguuuggcauaau

SEQ ID NO: 4006729 - RNA, 21 nt, Staphylococcus aureus subsp. aureus MW2
uguuuguuacauauugcauuu

SEQ ID NO: 4006730 - RNA, 14 nt, Staphylococcus aureus subsp. aureus MW2
uguuuuaaauacuu

SEQ ID NO: 4006731 - RNA, 12 nt, Staphylococcus aureus subsp. aureus MW2
uguuuuaaauuu

SEQ ID NO: 4006732 - RNA, 21 nt, Staphylococcus aureus subsp. aureus MW2
uguuuuaacgaagccuaauuu

SEQ ID NO: 4006733 - RNA, 22 nt, Staphylococcus aureus subsp. aureus MW2
uguuuuaaguuguugauuuaaa

SEQ ID NO: 4006734 - RNA, 15 nt, Staphylococcus aureus subsp. aureus MW2
uguuuuaucaauauu

SEQ ID NO: 4006735 - RNA, 22 nt, Staphylococcus aureus subsp. aureus MW2
uguuuucaaacuuuucaauauu

SEQ ID NO: 4006736 - RNA, 20 nt, Staphylococcus aureus subsp. aureus MW2
uguuuucaacaguuuuaaag

SEQ ID NO: 4006737 - RNA, 21 nt, Staphylococcus aureus subsp. aureus MW2
uguuuucaacaguuuuaaaga

SEQ ID NO: 4006738 - RNA, 16 nt, Staphylococcus aureus subsp. aureus MW2
uguuuucauuuaaaag

SEQ ID NO: 4006739 - RNA, 21 nt, Staphylococcus aureus subsp. aureus MW2
uguuuuccuuuugaauaauaa

SEQ ID NO: 4006740 - RNA, 20 nt, Staphylococcus aureus subsp. aureus MW2
uguuuugagagauuauuuaa

SEQ ID NO: 4006741 - RNA, 12 nt, Staphylococcus aureus subsp. aureus MW2
uguuuuuaaaau

SEQ ID NO: 4006742 - RNA, 19 nt, Staphylococcus aureus subsp. aureus MW2
uguuuuuaauguuugcuuu

SEQ ID NO: 4006743 - RNA, 15 nt, Staphylococcus aureus subsp. aureus MW2
uguuuuuacaaaugu

SEQ ID NO: 4006744 - RNA, 14 nt, Staphylococcus aureus subsp. aureus MW2
uguuuuuaguaauu

SEQ ID NO: 4006745 - RNA, 13 nt, Staphylococcus aureus subsp. aureus MW2
uguuuuuauuaau

SEQ ID NO: 4006746 - RNA, 21 nt, Staphylococcus aureus subsp. aureus MW2
uguuuuucacuguuaaagucu

SEQ ID NO: 4006747 - RNA, 17 nt, Staphylococcus aureus subsp. aureus MW2
uguuuuucaucauuaaa

SEQ ID NO: 4006748 - RNA, 19 nt, Staphylococcus aureus subsp. aureus MW2
uguuuuucaucauuaaaau

SEQ ID NO: 4006749 - RNA, 20 nt, Staphylococcus aureus subsp. aureus MW2
uguuuuugauaguaauaguu

SEQ ID NO: 4006750 - RNA, 23 nt, Staphylococcus aureus subsp. aureus MW2
uguuuuuuuuauuaauuuaaaaa

SEQ ID NO: 4006751 - RNA, 14 nt, Staphylococcus aureus subsp. aureus MW2
uuaaaaaacaaaac

SEQ ID NO: 4006752 - RNA, 19 nt, Staphylococcus aureus subsp. aureus MW2
uuaaaaaacauaccugcau

SEQ ID NO: 4006753 - RNA, 12 nt, Staphylococcus aureus subsp. aureus MW2
uuaaaaaaggaa

SEQ ID NO: 4006754 - RNA, 21 nt, Staphylococcus aureus subsp. aureus MW2
uuaaaaagcaugauacucaau

SEQ ID NO: 4006755 - RNA, 16 nt, Staphylococcus aureus subsp. aureus MW2
uuaaaaauaguucuuu

SEQ ID NO: 4006756 - RNA, 15 nt, Staphylococcus aureus subsp. aureus MW2
uuaaaaaugaaauga

SEQ ID NO: 4006757 - RNA, 19 nt, Staphylococcus aureus subsp. aureus MW2
uuaaaaauugaaggaaaau

SEQ ID NO: 4006758 - RNA, 15 nt, Staphylococcus aureus subsp. aureus MW2
uuaaaacaucauuca

SEQ ID NO: 4006759 - RNA, 15 nt, Staphylococcus aureus subsp. aureus MW2
uuaaaaccuuuucaa

SEQ ID NO: 4006760 - RNA, 14 nt, Staphylococcus aureus subsp. aureus MW2
uuaaaacuuguaaa

SEQ ID NO: 4006761 - RNA, 20 nt, Staphylococcus aureus subsp. aureus MW2
uuaaaagacauccacagaau

SEQ ID NO: 4006762 - RNA, 19 nt, Staphylococcus aureus subsp. aureus MW2
uuaaaagagaauauaaaau

SEQ ID NO: 4006763 - RNA, 21 nt, Staphylococcus aureus subsp. aureus MW2
uuaaaagagaauauaaaauaa

SEQ ID NO: 4006764 - RNA, 22 nt, Staphylococcus aureus subsp. aureus MW2
uuaaauuccaugucaauuuuuu

SEQ ID NO: 4006765 - RNA, 18 nt, Staphylococcus aureus subsp. aureus MW2
uuaaauuggaaucccaau

SEQ ID NO: 4006766 - RNA, 13 nt, Staphylococcus aureus subsp. aureus MW2
uuaaauuuaaaag

SEQ ID NO: 4006767 - RNA, 14 nt, Staphylococcus aureus subsp. aureus MW2
uuaaauuuaaaaga

SEQ ID NO: 4006768 - RNA, 15 nt, Staphylococcus aureus subsp. aureus MW2
uuaaauuuaaaagaa

SEQ ID NO: 4006769 - RNA, 22 nt, Staphylococcus aureus subsp. aureus MW2
uuaaauuucaaaauaaauauga

SEQ ID NO: 4006770 - RNA, 14 nt, Staphylococcus aureus subsp. aureus MW2
uuaaauuucugaac

SEQ ID NO: 4006771 - RNA, 18 nt, Staphylococcus aureus subsp. aureus MW2
uuaaauuucugaacauaa

SEQ ID NO: 4006772 - RNA, 14 nt, Staphylococcus aureus subsp. aureus MW2
uuaaauuuuaaguu

SEQ ID NO: 4006773 - RNA, 15 nt, Staphylococcus aureus subsp. aureus MW2
uuaaauuuuuuaaua

SEQ ID NO: 4006774 - RNA, 15 nt, Staphylococcus aureus subsp. aureus MW2
uuaacaacaaauaua

SEQ ID NO: 4006775 - RNA, 16 nt, Staphylococcus aureus subsp. aureus MW2
uuaacaacaaauauaa

SEQ ID NO: 4006776 - RNA, 12 nt, Staphylococcus aureus subsp. aureus MW2
uuaacaacauga

SEQ ID NO: 4006777 - RNA, 15 nt, Staphylococcus aureus subsp. aureus MW2
uuaacaacuuuauua

SEQ ID NO: 4006778 - RNA, 16 nt, Staphylococcus aureus subsp. aureus MW2
uuaacaagauaacuag

SEQ ID NO: 4006779 - RNA, 18 nt, Staphylococcus aureus subsp. aureus MW2
uuaacaagugaugaaaaa

SEQ ID NO: 4006780 - RNA, 14 nt, Staphylococcus aureus subsp. aureus MW2
uuaacaaugaacca

SEQ ID NO: 4006781 - RNA, 18 nt, Staphylococcus aureus subsp. aureus MW2
uuaacaauugauugcucu

SEQ ID NO: 4006782 - RNA, 20 nt, Staphylococcus aureus subsp. aureus MW2
uuaacaauuuuaauuuuuca

SEQ ID NO: 4006783 - RNA, 18 nt, Staphylococcus aureus subsp. aureus MW2
uuaacaauuuuaucugaa

SEQ ID NO: 4006784 - RNA, 21 nt, Staphylococcus aureus subsp. aureus MW2
uuaacaauuuuaucugaaucu

SEQ ID NO: 4006785 - RNA, 19 nt, Staphylococcus aureus subsp. aureus MW2
uuaacauauagauaucugu

SEQ ID NO: 4006786 - RNA, 20 nt, Staphylococcus aureus subsp. aureus MW2
uuaacauccugcuuauuaau

SEQ ID NO: 4006787 - RNA, 14 nt, Staphylococcus aureus subsp. aureus MW2
uuaacaucugaauc

SEQ ID NO: 4006788 - RNA, 15 nt, Staphylococcus aureus subsp. aureus MW2
uuaacaucugaaucu

SEQ ID NO: 4006789 - RNA, 16 nt, Staphylococcus aureus subsp. aureus MW2
uuaacaucugaaucug

SEQ ID NO: 4006790 - RNA, 22 nt, Staphylococcus aureus subsp. aureus MW2
uuaacauuuacacgucuaauuu

SEQ ID NO: 4006791 - RNA, 21 nt, Staphylococcus aureus subsp. aureus MW2
uuaacauuuauuuuuucucua

SEQ ID NO: 4006792 - RNA, 12 nt, Staphylococcus aureus subsp. aureus MW2
uuaacauuuuuu

SEQ ID NO: 4006793 - RNA, 13 nt, Staphylococcus aureus subsp. aureus MW2
uuaacauuuuuuu

SEQ ID NO: 4006794 - RNA, 16 nt, Staphylococcus aureus subsp. aureus MW2
uuaacauuuuuuucaa

SEQ ID NO: 4006795 - RNA, 20 nt, Staphylococcus aureus subsp. aureus MW2
uuaaccaguauaauuuucug

SEQ ID NO: 4006796 - RNA, 15 nt, Staphylococcus aureus subsp. aureus MW2
uuaaccauuuaaaaa

SEQ ID NO: 4006797 - RNA, 20 nt, Staphylococcus aureus subsp. aureus MW2
uuaaccauuucuuuuuucaa

SEQ ID NO: 4006798 - RNA, 19 nt, Staphylococcus aureus subsp. aureus MW2
uuaacgaaaauuaagauga

SEQ ID NO: 4006799 - RNA, 15 nt, Staphylococcus aureus subsp. aureus MW2
uuaacgcuuauacua

SEQ ID NO: 4006800 - RNA, 18 nt, Staphylococcus aureus subsp. aureus MW2
uuaacguuauucauuugu

SEQ ID NO: 4006801 - RNA, 15 nt, Staphylococcus aureus subsp. aureus MW2
uuaacuaauaacuag

SEQ ID NO: 4006802 - RNA, 18 nt, Staphylococcus aureus subsp. aureus MW2
uuaacuauaaauagaaga

SEQ ID NO: 4006803 - RNA, 13 nt, Staphylococcus aureus subsp. aureus MW2
uuaacuauaacaa

SEQ ID NO: 4006804 - RNA, 15 nt, Staphylococcus aureus subsp. aureus MW2
uuaacuauaacaaua

SEQ ID NO: 4006805 - RNA, 18 nt, Staphylococcus aureus subsp. aureus MW2
uuaacucaacuuaaauau

SEQ ID NO: 4006806 - RNA, 20 nt, Staphylococcus aureus subsp. aureus MW2
uuaacucaccuuuaucauua

SEQ ID NO: 4006807 - RNA, 15 nt, Staphylococcus aureus subsp. aureus MW2
uuaacucuaucaaau

SEQ ID NO: 4006808 - RNA, 19 nt, Staphylococcus aureus subsp. aureus MW2
uuaacucuaucaaauuacu

SEQ ID NO: 4006809 - RNA, 15 nt, Staphylococcus aureus subsp. aureus MW2
uuaacugcaaacuug

SEQ ID NO: 4006810 - RNA, 14 nt, Staphylococcus aureus subsp. aureus MW2
uuaacugccauaua

SEQ ID NO: 4006811 - RNA, 20 nt, Staphylococcus aureus subsp. aureus MW2
uuaacugccauauagauauu

SEQ ID NO: 4006812 - RNA, 19 nt, Staphylococcus aureus subsp. aureus MW2
uuaacugggcgucucgaug

SEQ ID NO: 4006813 - RNA, 20 nt, Staphylococcus aureus subsp. aureus MW2
uuaacuguacgauucaauuu

SEQ ID NO: 4006814 - RNA, 21 nt, Staphylococcus aureus subsp. aureus MW2
uuaacuguaugccgccuaaua

SEQ ID NO: 4006815 - RNA, 15 nt, Staphylococcus aureus subsp. aureus MW2
uuaacuuaaaauuua

SEQ ID NO: 4006816 - RNA, 19 nt, Staphylococcus aureus subsp. aureus MW2
uuaacuuaaaauuuaaaua

SEQ ID NO: 4006817 - RNA, 14 nt, Staphylococcus aureus subsp. aureus MW2
uuaacuuauauacg

SEQ ID NO: 4006818 - RNA, 14 nt, Staphylococcus aureus subsp. aureus MW2
uuaacuucauaaua

SEQ ID NO: 4006819 - RNA, 12 nt, Staphylococcus aureus subsp. aureus MW2
uuaacuuuaaua

SEQ ID NO: 4006820 - RNA, 13 nt, Staphylococcus aureus subsp. aureus MW2
uuaacuuuaauua

SEQ ID NO: 4006821 - RNA, 17 nt, Staphylococcus aureus subsp. aureus MW2
uuaacuuucccuacugc

SEQ ID NO: 4006822 - RNA, 19 nt, Staphylococcus aureus subsp. aureus MW2
uuaacuuucccuacugcuu

SEQ ID NO: 4006823 - RNA, 20 nt, Staphylococcus aureus subsp. aureus MW2
uuaacuuuccgccuucaauc

SEQ ID NO: 4006824 - RNA, 19 nt, Staphylococcus aureus subsp. aureus MW2
uuaagaaaucaacaacuuu

SEQ ID NO: 4006825 - RNA, 21 nt, Staphylococcus aureus subsp. aureus MW2
uuaagacugauuaauuauuga

SEQ ID NO: 4006826 - RNA, 15 nt, Staphylococcus aureus subsp. aureus MW2
uuaagacuuuaaaau

SEQ ID NO: 4006827 - RNA, 15 nt, Staphylococcus aureus subsp. aureus MW2
uuaagauuuuaacuu

SEQ ID NO: 4006828 - RNA, 12 nt, Staphylococcus aureus subsp. aureus MW2
uuaagcauuugu

SEQ ID NO: 4006829 - RNA, 19 nt, Staphylococcus aureus subsp. aureus MW2
uuaagcucuuaaucuauaa

SEQ ID NO: 4006830 - RNA, 23 nt, Staphylococcus aureus subsp. aureus MW2
uuaaguaaucugcaaaugccucu

SEQ ID NO: 4006831 - RNA, 14 nt, Staphylococcus aureus subsp. aureus MW2
uuaaguacagcaua

SEQ ID NO: 4006832 - RNA, 16 nt, Staphylococcus aureus subsp. aureus MW2
uuaaguacuauuaaaa

SEQ ID NO: 4006833 - RNA, 14 nt, Staphylococcus aureus subsp. aureus MW2
uuaaguacuucaaa

SEQ ID NO: 4006834 - RNA, 13 nt, Staphylococcus aureus subsp. aureus MW2
uuaaguacuuuua

SEQ ID NO: 4006835 - RNA, 14 nt, Staphylococcus aureus subsp. aureus MW2
uuaaguauaucuuu

SEQ ID NO: 4006836 - RNA, 12 nt, Staphylococcus aureus subsp. aureus MW2
uuaagugaguuu

SEQ ID NO: 4006837 - RNA, 17 nt, Staphylococcus aureus subsp. aureus MW2
uuaagugaguuuuauuu

SEQ ID NO: 4006838 - RNA, 18 nt, Staphylococcus aureus subsp. aureus MW2
uuaagugcaauaacacca

SEQ ID NO: 4006839 - RNA, 22 nt, Staphylococcus aureus subsp. aureus MW2
uuaagugcaauaacaccaauug

SEQ ID NO: 4006840 - RNA, 21 nt, Staphylococcus aureus subsp. aureus MW2
uuaagugccagauuugaauuu

SEQ ID NO: 4006841 - RNA, 17 nt, Staphylococcus aureus subsp. aureus MW2
uuaagugggacuuuuua

SEQ ID NO: 4006842 - RNA, 24 nt, Staphylococcus aureus subsp. aureus MW2
uuaaguguauauaguaggagugaa

SEQ ID NO: 4006843 - RNA, 22 nt, Staphylococcus aureus subsp. aureus MW2
uuaaguucaucuggugcaauau

SEQ ID NO: 4006844 - RNA, 19 nt, Staphylococcus aureus subsp. aureus MW2
uuaaguugaaaaccucuuu

SEQ ID NO: 4006845 - RNA, 19 nt, Staphylococcus aureus subsp. aureus MW2
uuaaguuguugauuuaaaa

SEQ ID NO: 4006846 - RNA, 20 nt, Staphylococcus aureus subsp. aureus MW2
uuaaguuugucuuugaacau

SEQ ID NO: 4006847 - RNA, 13 nt, Staphylococcus aureus subsp. aureus MW2
uuaaguuuuucag

SEQ ID NO: 4006848 - RNA, 17 nt, Staphylococcus aureus subsp. aureus MW2
uuaauaaaaucaucuua

SEQ ID NO: 4006849 - RNA, 14 nt, Staphylococcus aureus subsp. aureus MW2
uuaauaaaauuacg

SEQ ID NO: 4006850 - RNA, 22 nt, Staphylococcus aureus subsp. aureus MW2
uuaauaaaauuacgcaaagaaa

SEQ ID NO: 4006851 - RNA, 12 nt, Staphylococcus aureus subsp. aureus MW2
uuaauaaaccua

SEQ ID NO: 4006852 - RNA, 22 nt, Staphylococcus aureus subsp. aureus MW2
uuaauaaauuguuaucguucaa

SEQ ID NO: 4006853 - RNA, 20 nt, Staphylococcus aureus subsp. aureus MW2
uuaauuacgucauaaaauac

SEQ ID NO: 4006854 - RNA, 17 nt, Staphylococcus aureus subsp. aureus MW2
uuaauuacuguaaauau

SEQ ID NO: 4006855 - RNA, 17 nt, Staphylococcus aureus subsp. aureus MW2
uuaauuaucauaaauau

SEQ ID NO: 4006856 - RNA, 20 nt, Staphylococcus aureus subsp. aureus MW2
uuaauuauguauuuuuauuu

SEQ ID NO: 4006857 - RNA, 15 nt, Staphylococcus aureus subsp. aureus MW2
uuaauuauuucccug

SEQ ID NO: 4006858 - RNA, 18 nt, Staphylococcus aureus subsp. aureus MW2
uuaauucgccuaaauggu

SEQ ID NO: 4006859 - RNA, 17 nt, Staphylococcus aureus subsp. aureus MW2
uuaauucugauuauguu

SEQ ID NO: 4006860 - RNA, 18 nt, Staphylococcus aureus subsp. aureus MW2
uuaauugaaaaaccaagu

SEQ ID NO: 4006861 - RNA, 16 nt, Staphylococcus aureus subsp. aureus MW2
uuaauugaaaugauaa

SEQ ID NO: 4006862 - RNA, 19 nt, Staphylococcus aureus subsp. aureus MW2
uuaauugaaaugauaaaaa

SEQ ID NO: 4006863 - RNA, 16 nt, Staphylococcus aureus subsp. aureus MW2
uuaauugaaguaugca

SEQ ID NO: 4006864 - RNA, 14 nt, Staphylococcus aureus subsp. aureus MW2
uuaauugcagguaa

SEQ ID NO: 4006865 - RNA, 17 nt, Staphylococcus aureus subsp. aureus MW2
uuaauugcguuuaauaa

SEQ ID NO: 4006866 - RNA, 18 nt, Staphylococcus aureus subsp. aureus MW2
uuaauugcuguaaauauu

SEQ ID NO: 4006867 - RNA, 22 nt, Staphylococcus aureus subsp. aureus MW2
uuaauuguugagaaacuuuuuc

SEQ ID NO: 4006868 - RNA, 18 nt, Staphylococcus aureus subsp. aureus MW2
uuaauuguuuaauaacaa

SEQ ID NO: 4006869 - RNA, 12 nt, Staphylococcus aureus subsp. aureus MW2
uuaauuuaaaaa

SEQ ID NO: 4006870 - RNA, 18 nt, Staphylococcus aureus subsp. aureus MW2
uuaauuuaaaucuguacu

SEQ ID NO: 4006871 - RNA, 14 nt, Staphylococcus aureus subsp. aureus MW2
uuaauuuaucauua

SEQ ID NO: 4006872 - RNA, 16 nt, Staphylococcus aureus subsp. aureus MW2
uuaauuucaacauuac

SEQ ID NO: 4006873 - RNA, 13 nt, Staphylococcus aureus subsp. aureus MW2
uuaauuucacuuu

SEQ ID NO: 4006874 - RNA, 22 nt, Staphylococcus aureus subsp. aureus MW2
uuaauuucacuuuaacuucuuu

SEQ ID NO: 4006875 - RNA, 16 nt, Staphylococcus aureus subsp. aureus MW2
uuaauuucaugugcaa

SEQ ID NO: 4006876 - RNA, 23 nt, Staphylococcus aureus subsp. aureus MW2
uuaauuuccaauaucuucuuuua

SEQ ID NO: 4006877 - RNA, 18 nt, Staphylococcus aureus subsp. aureus MW2
uuaauuucugguaaaaaa

SEQ ID NO: 4006878 - RNA, 19 nt, Staphylococcus aureus subsp. aureus MW2
uuaauuucugguaaaaaaa

SEQ ID NO: 4006879 - RNA, 23 nt, Staphylococcus aureus subsp. aureus MW2
uuaauuucugguaaaaaaauaac

SEQ ID NO: 4006880 - RNA, 17 nt, Staphylococcus aureus subsp. aureus MW2
uuaauuugaauaccuac

SEQ ID NO: 4006881 - RNA, 23 nt, Staphylococcus aureus subsp. aureus MW2
uuaauuugacaaucuaaauguaa

SEQ ID NO: 4006882 - RNA, 17 nt, Staphylococcus aureus subsp. aureus MW2
uuaauuuguuuuaaaua

SEQ ID NO: 4006883 - RNA, 19 nt, Staphylococcus aureus subsp. aureus MW2
uuaauuuguuuuaaauacu

SEQ ID NO: 4006884 - RNA, 15 nt, Staphylococcus aureus subsp. aureus MW2
uuaauuuuaaauauu

SEQ ID NO: 4006885 - RNA, 15 nt, Staphylococcus aureus subsp. aureus MW2
uuaauuuuaccauca

SEQ ID NO: 4006886 - RNA, 18 nt, Staphylococcus aureus subsp. aureus MW2
uuaauuuuaugucccaau

SEQ ID NO: 4006887 - RNA, 23 nt, Staphylococcus aureus subsp. aureus MW2
uuaauuuuaugucccaaugcuga

SEQ ID NO: 4006888 - RNA, 18 nt, Staphylococcus aureus subsp. aureus MW2
uuaauuuuauuauuaauc

SEQ ID NO: 4006889 - RNA, 18 nt, Staphylococcus aureus subsp. aureus MW2
uuaauuuucuaaagauau

SEQ ID NO: 4006890 - RNA, 14 nt, Staphylococcus aureus subsp. aureus MW2
uuaauuuugacaua

SEQ ID NO: 4006891 - RNA, 12 nt, Staphylococcus aureus subsp. aureus MW2
uuaauuuuucaa

SEQ ID NO: 4006892 - RNA, 14 nt, Staphylococcus aureus subsp. aureus MW2
uuaauuuuucauua

SEQ ID NO: 4006893 - RNA, 14 nt, Staphylococcus aureus subsp. aureus MW2
uuaauuuuuuuggu

SEQ ID NO: 4006894 - RNA, 13 nt, Staphylococcus aureus subsp. aureus MW2
uuacaaaaacuau

SEQ ID NO: 4006895 - RNA, 13 nt, Staphylococcus aureus subsp. aureus MW2
uuacaaacuucac

SEQ ID NO: 4006896 - RNA, 21 nt, Staphylococcus aureus subsp. aureus MW2
uuacaaagugauuuaaaaaaa

SEQ ID NO: 4006897 - RNA, 13 nt, Staphylococcus aureus subsp. aureus MW2
uuacaaauauacu

SEQ ID NO: 4006898 - RNA, 17 nt, Staphylococcus aureus subsp. aureus MW2
uuacaaaucaugacaua

SEQ ID NO: 4006899 - RNA, 17 nt, Staphylococcus aureus subsp. aureus MW2
uuacaaaugaagguguu

SEQ ID NO: 4006900 - RNA, 19 nt, Staphylococcus aureus subsp. aureus MW2
uuacaacaguaaucaugca

SEQ ID NO: 4006901 - RNA, 18 nt, Staphylococcus aureus subsp. aureus MW2
uuacaacuuuaguuguua

SEQ ID NO: 4006902 - RNA, 20 nt, Staphylococcus aureus subsp. aureus MW2
uuacaacuuuaguuguuagg

SEQ ID NO: 4006903 - RNA, 17 nt, Staphylococcus aureus subsp. aureus MW2
uuacaaguuguucaauu

SEQ ID NO: 4006904 - RNA, 17 nt, Staphylococcus aureus subsp. aureus MW2
uuacaauaaagacauau

SEQ ID NO: 4006905 - RNA, 12 nt, Staphylococcus aureus subsp. aureus MW2
uuacaauaaugu

SEQ ID NO: 4006906 - RNA, 19 nt, Staphylococcus aureus subsp. aureus MW2
uuacaauaaugugcaaguu

SEQ ID NO: 4006907 - RNA, 15 nt, Staphylococcus aureus subsp. aureus MW2
uuacaauaugauuaa

SEQ ID NO: 4006908 - RNA, 21 nt, Staphylococcus aureus subsp. aureus MW2
uuacaaugcgguauugcaugu

SEQ ID NO: 4006909 - RNA, 22 nt, Staphylococcus aureus subsp. aureus MW2
uuacaaugcgguauugcauguu

SEQ ID NO: 4006910 - RNA, 20 nt, Staphylococcus aureus subsp. aureus MW2
uuacaauuaguguuucaugu

SEQ ID NO: 4006911 - RNA, 14 nt, Staphylococcus aureus subsp. aureus MW2
uuacaauuguucuc

SEQ ID NO: 4006912 - RNA, 15 nt, Staphylococcus aureus subsp. aureus MW2
uuacaccuuuggcac

SEQ ID NO: 4006913 - RNA, 15 nt, Staphylococcus aureus subsp. aureus MW2
uuacagaacguucau

SEQ ID NO: 4006914 - RNA, 16 nt, Staphylococcus aureus subsp. aureus MW2
uuacagacaaacauua

SEQ ID NO: 4006915 - RNA, 23 nt, Staphylococcus aureus subsp. aureus MW2
uuacagguagauguaguguucaa

SEQ ID NO: 4006916 - RNA, 19 nt, Staphylococcus aureus subsp. aureus MW2
uuacagguuuuaaaauuaa

SEQ ID NO: 4006917 - RNA, 15 nt, Staphylococcus aureus subsp. aureus MW2
uuacauauugcauuu

SEQ ID NO: 4006918 - RNA, 22 nt, Staphylococcus aureus subsp. aureus MW2
uuacaucuauccuuguucaccc

SEQ ID NO: 4006919 - RNA, 12 nt, Staphylococcus aureus subsp. aureus MW2
uuacauuacaua

SEQ ID NO: 4006920 - RNA, 20 nt, Staphylococcus aureus subsp. aureus MW2
uuacauuuaguacauauguu

SEQ ID NO: 4006921 - RNA, 18 nt, Staphylococcus aureus subsp. aureus MW2
uuacauuuuaauaaaauc

SEQ ID NO: 4006922 - RNA, 19 nt, Staphylococcus aureus subsp. aureus MW2
uuacauuuuaauaaaauca

SEQ ID NO: 4006923 - RNA, 22 nt, Staphylococcus aureus subsp. aureus MW2
uuacauuuuaauaaaaucaucu

SEQ ID NO: 4006924 - RNA, 16 nt, Staphylococcus aureus subsp. aureus MW2
uuacauuuuaugucca

SEQ ID NO: 4006925 - RNA, 12 nt, Staphylococcus aureus subsp. aureus MW2
uuaccaaaauuu

SEQ ID NO: 4006926 - RNA, 16 nt, Staphylococcus aureus subsp. aureus MW2
uuaccaauaucaugca

SEQ ID NO: 4006927 - RNA, 23 nt, Staphylococcus aureus subsp. aureus MW2
uuaccaauaucaugcaaaauaau

SEQ ID NO: 4006928 - RNA, 23 nt, Staphylococcus aureus subsp. aureus MW2
uuaccacaaccagucagaaagaa

SEQ ID NO: 4006929 - RNA, 14 nt, Staphylococcus aureus subsp. aureus MW2
uuaccaucuuuaau

SEQ ID NO: 4006930 - RNA, 22 nt, Staphylococcus aureus subsp. aureus MW2
uuaccaugaugagauaaaauca

SEQ ID NO: 4006931 - RNA, 13 nt, Staphylococcus aureus subsp. aureus MW2
uuacccuuuaauc

SEQ ID NO: 4006932 - RNA, 23 nt, Staphylococcus aureus subsp. aureus MW2
uuaccuguuucuauauuaauaau

SEQ ID NO: 4006933 - RNA, 14 nt, Staphylococcus aureus subsp. aureus MW2
uuaccuuuccauuc

SEQ ID NO: 4006934 - RNA, 21 nt, Staphylococcus aureus subsp. aureus MW2
uuacgaaguuuaaaugugcaa

SEQ ID NO: 4006935 - RNA, 23 nt, Staphylococcus aureus subsp. aureus MW2
uuacgacauacuugucguauucu

SEQ ID NO: 4006936 - RNA, 14 nt, Staphylococcus aureus subsp. aureus MW2
uuacgauaaacuaa

SEQ ID NO: 4006937 - RNA, 21 nt, Staphylococcus aureus subsp. aureus MW2
uuacgaucauaaauauuuucu

SEQ ID NO: 4006938 - RNA, 18 nt, Staphylococcus aureus subsp. aureus MW2
uuacgauugggcaacuuu

SEQ ID NO: 4006939 - RNA, 14 nt, Staphylococcus aureus subsp. aureus MW2
uuacgcauccuaau

SEQ ID NO: 4006940 - RNA, 21 nt, Staphylococcus aureus subsp. aureus MW2
uuacgccaacaagguuucaag

SEQ ID NO: 4006941 - RNA, 18 nt, Staphylococcus aureus subsp. aureus MW2
uuagucauugaaaauauu

SEQ ID NO: 4006942 - RNA, 19 nt, Staphylococcus aureus subsp. aureus MW2
uuagucauugaaaauauuu

SEQ ID NO: 4006943 - RNA, 14 nt, Staphylococcus aureus subsp. aureus MW2
uuagugaaaauacc

SEQ ID NO: 4006944 - RNA, 19 nt, Staphylococcus aureus subsp. aureus MW2
uuaguucguguuugaaugu

SEQ ID NO: 4006945 - RNA, 14 nt, Staphylococcus aureus subsp. aureus MW2
uuauaaaaaacggu

SEQ ID NO: 4006946 - RNA, 21 nt, Staphylococcus aureus subsp. aureus MW2
uuauaaaaugaauaauuacua

SEQ ID NO: 4006947 - RNA, 23 nt, Staphylococcus aureus subsp. aureus MW2
uuauaaagauagaaugaauaauu

SEQ ID NO: 4006948 - RNA, 12 nt, Staphylococcus aureus subsp. aureus MW2
uuauaaagccug

SEQ ID NO: 4006949 - RNA, 13 nt, Staphylococcus aureus subsp. aureus MW2
uuauaaagcugcg

SEQ ID NO: 4006950 - RNA, 21 nt, Staphylococcus aureus subsp. aureus MW2
uuauaaagcugcgaaacuugu

SEQ ID NO: 4006951 - RNA, 20 nt, Staphylococcus aureus subsp. aureus MW2
uuauaaauagagaacagcag

SEQ ID NO: 4006952 - RNA, 18 nt, Staphylococcus aureus subsp. aureus MW2
uuauaaaucauucuuuau

SEQ ID NO: 4006953 - RNA, 19 nt, Staphylococcus aureus subsp. aureus MW2
uuauaaauucuaucuauaa

SEQ ID NO: 4006954 - RNA, 16 nt, Staphylococcus aureus subsp. aureus MW2
uuauaacaaaaauugc

SEQ ID NO: 4006955 - RNA, 16 nt, Staphylococcus aureus subsp. aureus MW2
uuauaacauucuucaa

SEQ ID NO: 4006956 - RNA, 12 nt, Staphylococcus aureus subsp. aureus MW2
uuauaacauuua

SEQ ID NO: 4006957 - RNA, 23 nt, Staphylococcus aureus subsp. aureus MW2
uuauaacccuaauucuuuaauaa

SEQ ID NO: 4006958 - RNA, 12 nt, Staphylococcus aureus subsp. aureus MW2
uuauaaguacaa

SEQ ID NO: 4006959 - RNA, 13 nt, Staphylococcus aureus subsp. aureus MW2
uuauaaguauuca

SEQ ID NO: 4006960 - RNA, 18 nt, Staphylococcus aureus subsp. aureus MW2
uuauaauaauauugaaag

SEQ ID NO: 4006961 - RNA, 18 nt, Staphylococcus aureus subsp. aureus MW2
uuauaauaucgacuuuuc

SEQ ID NO: 4006962 - RNA, 20 nt, Staphylococcus aureus subsp. aureus MW2
uuauacacaaaguauuugaa

SEQ ID NO: 4006963 - RNA, 14 nt, Staphylococcus aureus subsp. aureus MW2
uuauacacuuuuug

SEQ ID NO: 4006964 - RNA, 19 nt, Staphylococcus aureus subsp. aureus MW2
uuauacagugaaucuaaac

SEQ ID NO: 4006965 - RNA, 15 nt, Staphylococcus aureus subsp. aureus MW2
uuauacauaaauauu

SEQ ID NO: 4006966 - RNA, 19 nt, Staphylococcus aureus subsp. aureus MW2
uuauacauguaacagugug

SEQ ID NO: 4006967 - RNA, 12 nt, Staphylococcus aureus subsp. aureus MW2
uuauacauguac

SEQ ID NO: 4006968 - RNA, 22 nt, Staphylococcus aureus subsp. aureus MW2
uuauacgaaucacaguuauaua

SEQ ID NO: 4006969 - RNA, 13 nt, Staphylococcus aureus subsp. aureus MW2
uuauacuacuauu

SEQ ID NO: 4006970 - RNA, 23 nt, Staphylococcus aureus subsp. aureus MW2
uuauacuauaaauaaaaauauau

SEQ ID NO: 4006971 - RNA, 10 nt, Staphylococcus aureus subsp. aureus MW2
uuauacugug

SEQ ID NO: 4006972 - RNA, 20 nt, Staphylococcus aureus subsp. aureus MW2
uuauagccuucauuugcgau

SEQ ID NO: 4006973 - RNA, 22 nt, Staphylococcus aureus subsp. aureus MW2
uuauaguacguuugcauauccu

SEQ ID NO: 4006974 - RNA, 17 nt, Staphylococcus aureus subsp. aureus MW2
uuauagucuuaaacaua

SEQ ID NO: 4006975 - RNA, 15 nt, Staphylococcus aureus subsp. aureus MW2
uuauagugguaaaaa

SEQ ID NO: 4006976 - RNA, 15 nt, Staphylococcus aureus subsp. aureus MW2
uuauauaaagaggca

SEQ ID NO: 4006977 - RNA, 23 nt, Staphylococcus aureus subsp. aureus MW2
uuauauaagugaccgauugcacg

SEQ ID NO: 4006978 - RNA, 13 nt, Staphylococcus aureus subsp. aureus MW2
uuauauaauucuu

SEQ ID NO: 4006979 - RNA, 17 nt, Staphylococcus aureus subsp. aureus MW2
uuauauaauucuucaaa

SEQ ID NO: 4006980 - RNA, 21 nt, Staphylococcus aureus subsp. aureus MW2
uuauauagauugccauucaua

SEQ ID NO: 4006981 - RNA, 18 nt, Staphylococcus aureus subsp. aureus MW2
uuauauauauuaaaguaa

SEQ ID NO: 4006982 - RNA, 14 nt, Staphylococcus aureus subsp. aureus MW2
uuauauaucacaua

SEQ ID NO: 4006983 - RNA, 20 nt, Staphylococcus aureus subsp. aureus MW2
uuauaucaaaaaauauguuu

SEQ ID NO: 4006984 - RNA, 22 nt, Staphylococcus aureus subsp. aureus MW2
uuauaucauaacuuaacucuau

SEQ ID NO: 4006985 - RNA, 16 nt, Staphylococcus aureus subsp. aureus MW2
uuauaucuuaaguaca

SEQ ID NO: 4006986 - RNA, 14 nt, Staphylococcus aureus subsp. aureus MW2
uuauaugcaacuua

SEQ ID NO: 4006987 - RNA, 20 nt, Staphylococcus aureus subsp. aureus MW2
uuauauggaauacuacacuc

SEQ ID NO: 4006988 - RNA, 12 nt, Staphylococcus aureus subsp. aureus MW2
uuauauuaaaua

SEQ ID NO: 4006989 - RNA, 16 nt, Staphylococcus aureus subsp. aureus MW2
uuauauuauuucaaua

SEQ ID NO: 4006990 - RNA, 19 nt, Staphylococcus aureus subsp. aureus MW2
uuauauucaacuuauuauu

SEQ ID NO: 4006991 - RNA, 18 nt, Staphylococcus aureus subsp. aureus MW2
uuauauugcaaaaauaau

SEQ ID NO: 4006992 - RNA, 22 nt, Staphylococcus aureus subsp. aureus MW2
uuauauugcaaaaauaauauga

SEQ ID NO: 4006993 - RNA, 18 nt, Staphylococcus aureus subsp. aureus MW2
uuauauugcgaaaaauaa

SEQ ID NO: 4006994 - RNA, 19 nt, Staphylococcus aureus subsp. aureus MW2
uuauauuggcaguucugaa

SEQ ID NO: 4006995 - RNA, 16 nt, Staphylococcus aureus subsp. aureus MW2
uuauauuguauuuuau

SEQ ID NO: 4006996 - RNA, 16 nt, Staphylococcus aureus subsp. aureus MW2
uuauauuguuaaaauu

SEQ ID NO: 4006997 - RNA, 23 nt, Staphylococcus aureus subsp. aureus MW2
uuauauuuaugauaauuaauuaa

SEQ ID NO: 4006998 - RNA, 13 nt, Staphylococcus aureus subsp. aureus MW2
uuauauuuuauuu

SEQ ID NO: 4006999 - RNA, 17 nt, Staphylococcus aureus subsp. aureus MW2
uuauauuuuauuuaaaa

SEQ ID NO: 4007000 - RNA, 18 nt, Staphylococcus aureus subsp. aureus MW2
uuauauuuuucuucaguu

SEQ ID NO: 4007001 - RNA, 14 nt, Staphylococcus aureus subsp. aureus MW2
uuaucaaauugacc

SEQ ID NO: 4007002 - RNA, 13 nt, Staphylococcus aureus subsp. aureus MW2
uuaucacaacagu

SEQ ID NO: 4007003 - RNA, 22 nt, Staphylococcus aureus subsp. aureus MW2
uuaucagcauuaaucguauuuu

SEQ ID NO: 4007004 - RNA, 16 nt, Staphylococcus aureus subsp. aureus MW2
uuaucagcuuuaauaa

SEQ ID NO: 4007005 - RNA, 14 nt, Staphylococcus aureus subsp. aureus MW2
uuaucauuaaauug

SEQ ID NO: 4007006 - RNA, 22 nt, Staphylococcus aureus subsp. aureus MW2
uuaucauuaaauugcuugaaau

SEQ ID NO: 4007007 - RNA, 16 nt, Staphylococcus aureus subsp. aureus MW2
uuaucauuacagauaa

SEQ ID NO: 4007008 - RNA, 15 nt, Staphylococcus aureus subsp. aureus MW2
uuauccaaaacauuu

SEQ ID NO: 4007009 - RNA, 22 nt, Staphylococcus aureus subsp. aureus MW2
uuauccaaaccaauuuuaacuu

SEQ ID NO: 4007010 - RNA, 15 nt, Staphylococcus aureus subsp. aureus MW2
uuauccuacugcugu

SEQ ID NO: 4007011 - RNA, 14 nt, Staphylococcus aureus subsp. aureus MW2
uuauccuuuaaauc

SEQ ID NO: 4007012 - RNA, 22 nt, Staphylococcus aureus subsp. aureus MW2
uuaucgacuuugucauuuugau

SEQ ID NO: 4007013 - RNA, 19 nt, Staphylococcus aureus subsp. aureus MW2
uuaucgaucgguauuuuca

SEQ ID NO: 4007014 - RNA, 21 nt, Staphylococcus aureus subsp. aureus MW2
uuaucuaaaauuggugacacu

SEQ ID NO: 4007015 - RNA, 21 nt, Staphylococcus aureus subsp. aureus MW2
uuaucuaacaaucguuuuaau

SEQ ID NO: 4007016 - RNA, 14 nt, Staphylococcus aureus subsp. aureus MW2
uuaucuaacucaua

SEQ ID NO: 4007017 - RNA, 21 nt, Staphylococcus aureus subsp. aureus MW2
uuaucuacaguuuuaugaaua

SEQ ID NO: 4007018 - RNA, 15 nt, Staphylococcus aureus subsp. aureus MW2
uuaucugaaaauauc

SEQ ID NO: 4007019 - RNA, 13 nt, Staphylococcus aureus subsp. aureus MW2
uuaucugaaucug

SEQ ID NO: 4007020 - RNA, 18 nt, Staphylococcus aureus subsp. aureus MW2
uuaucuguaauuaaucca

SEQ ID NO: 4007021 - RNA, 19 nt, Staphylococcus aureus subsp. aureus MW2
uuaucuguagaaacacuuu

SEQ ID NO: 4007022 - RNA, 20 nt, Staphylococcus aureus subsp. aureus MW2
uuaucuguagauuagcuuaa

SEQ ID NO: 4007023 - RNA, 14 nt, Staphylococcus aureus subsp. aureus MW2
uuaucuuuaaauua

SEQ ID NO: 4007024 - RNA, 13 nt, Staphylococcus aureus subsp. aureus MW2
uuaucuuuaagua

SEQ ID NO: 4007025 - RNA, 19 nt, Staphylococcus aureus subsp. aureus MW2
uuaucuuuacgauaaacua

SEQ ID NO: 4007026 - RNA, 15 nt, Staphylococcus aureus subsp. aureus MW2
uuaugaaaacauuau

SEQ ID NO: 4007027 - RNA, 15 nt, Staphylococcus aureus subsp. aureus MW2
uuaugaaaagugaau

SEQ ID NO: 4007028 - RNA, 20 nt, Staphylococcus aureus subsp. aureus MW2
uuaugacaaaguucugcaau

SEQ ID NO: 4007029 - RNA, 15 nt, Staphylococcus aureus subsp. aureus MW2
uuaugagcuuaauaa

SEQ ID NO: 4007030 - RNA, 17 nt, Staphylococcus aureus subsp. aureus MW2
uuauuuauaaacaauaa

SEQ ID NO: 4007031 - RNA, 21 nt, Staphylococcus aureus subsp. aureus MW2
uuauuucuauaucuauuuauc

SEQ ID NO: 4007032 - RNA, 14 nt, Staphylococcus aureus subsp. aureus MW2
uuauuucugaaaac

SEQ ID NO: 4007033 - RNA, 19 nt, Staphylococcus aureus subsp. aureus MW2
uuauuucuuuucauuauca

SEQ ID NO: 4007034 - RNA, 13 nt, Staphylococcus aureus subsp. aureus MW2
uuauuugaaauaa

SEQ ID NO: 4007035 - RNA, 14 nt, Staphylococcus aureus subsp. aureus MW2
uuauuugaaauaau

SEQ ID NO: 4007036 - RNA, 22 nt, Staphylococcus aureus subsp. aureus MW2
uuauuugaaaugauaagaauca

SEQ ID NO: 4007037 - RNA, 17 nt, Staphylococcus aureus subsp. aureus MW2
uuauuugaaugcaaauc

SEQ ID NO: 4007038 - RNA, 18 nt, Staphylococcus aureus subsp. aureus MW2
uuauuugauaaugauagu

SEQ ID NO: 4007039 - RNA, 21 nt, Staphylococcus aureus subsp. aureus MW2
uuauuugauaaugauagugua

SEQ ID NO: 4007040 - RNA, 18 nt, Staphylococcus aureus subsp. aureus MW2
uuauuuggguaacauuag

SEQ ID NO: 4007041 - RNA, 18 nt, Staphylococcus aureus subsp. aureus MW2
uuauuuguuuaauuaucu

SEQ ID NO: 4007042 - RNA, 12 nt, Staphylococcus aureus subsp. aureus MW2
uuauuuuaaaau

SEQ ID NO: 4007043 - RNA, 13 nt, Staphylococcus aureus subsp. aureus MW2
uuauuuuaaaaua

SEQ ID NO: 4007044 - RNA, 23 nt, Staphylococcus aureus subsp. aureus MW2
uuauuuuaaaauauuaaucaauu

SEQ ID NO: 4007045 - RNA, 14 nt, Staphylococcus aureus subsp. aureus MW2
uuauuuuaaauuua

SEQ ID NO: 4007046 - RNA, 14 nt, Staphylococcus aureus subsp. aureus MW2
uuauuuuaauagcg

SEQ ID NO: 4007047 - RNA, 23 nt, Staphylococcus aureus subsp. aureus MW2
uuauuuucaauaaauuuuauaua

SEQ ID NO: 4007048 - RNA, 14 nt, Staphylococcus aureus subsp. aureus MW2
uuauuuuuaaauau

SEQ ID NO: 4007049 - RNA, 11 nt, Staphylococcus aureus subsp. aureus MW2
uuauuuuuaag

SEQ ID NO: 4007050 - RNA, 16 nt, Staphylococcus aureus subsp. aureus MW2
uuauuuuuauucaguu

SEQ ID NO: 4007051 - RNA, 10 nt, Staphylococcus aureus subsp. aureus MW2
uuauuuuuua

SEQ ID NO: 4007052 - RNA, 11 nt, Staphylococcus aureus subsp. aureus MW2
uucaaaaauag

SEQ ID NO: 4007053 - RNA, 20 nt, Staphylococcus aureus subsp. aureus MW2
uucaaaaauuguuaaucccg

SEQ ID NO: 4007054 - RNA, 19 nt, Staphylococcus aureus subsp. aureus MW2
uucaaaacguuuaauugca

SEQ ID NO: 4007055 - RNA, 20 nt, Staphylococcus aureus subsp. aureus MW2
uucaaaacuagcaguaauau

SEQ ID NO: 4007056 - RNA, 23 nt, Staphylococcus aureus subsp. aureus MW2
uucaaaagaaauuguguuucuuu

SEQ ID NO: 4007057 - RNA, 16 nt, Staphylococcus aureus subsp. aureus MW2
uucaaaauaacuuaug

SEQ ID NO: 4007058 - RNA, 18 nt, Staphylococcus aureus subsp. aureus MW2
uucaaaaucaauugaaaa

SEQ ID NO: 4007059 - RNA, 17 nt, Staphylococcus aureus subsp. aureus MW2
uucaaaaucuuuaucag

SEQ ID NO: 4007060 - RNA, 19 nt, Staphylococcus aureus subsp. aureus MW2
uucaaaaugccaagaagac

SEQ ID NO: 4007061 - RNA, 15 nt, Staphylococcus aureus subsp. aureus MW2
uucaaaauuuugacu

SEQ ID NO: 4007062 - RNA, 12 nt, Staphylococcus aureus subsp. aureus MW2
uucaaacauauu

SEQ ID NO: 4007063 - RNA, 21 nt, Staphylococcus aureus subsp. aureus MW2
uucaaacuuuucaauauuagg

SEQ ID NO: 4007064 - RNA, 23 nt, Staphylococcus aureus subsp. aureus MW2
uucaaagacacggccugcaaguc

SEQ ID NO: 4007065 - RNA, 13 nt, Staphylococcus aureus subsp. aureus MW2
uucaaauaaagau

SEQ ID NO: 4007066 - RNA, 19 nt, Staphylococcus aureus subsp. aureus MW2
uucaaauauaucuaauacu

SEQ ID NO: 4007067 - RNA, 19 nt, Staphylococcus aureus subsp. aureus MW2
uucaaauggacuaacguca

SEQ ID NO: 4007068 - RNA, 19 nt, Staphylococcus aureus subsp. aureus MW2
uucaaauguaacauuaaaa

SEQ ID NO: 4007069 - RNA, 13 nt, Staphylococcus aureus subsp. aureus MW2
uucaaauguugaa

SEQ ID NO: 4007070 - RNA, 14 nt, Staphylococcus aureus subsp. aureus MW2
uucaaauuaauuaa

SEQ ID NO: 4007071 - RNA, 15 nt, Staphylococcus aureus subsp. aureus MW2
uucaaauugguuuuc

SEQ ID NO: 4007072 - RNA, 13 nt, Staphylococcus aureus subsp. aureus MW2
uucaaauuuacca

SEQ ID NO: 4007073 - RNA, 22 nt, Staphylococcus aureus subsp. aureus MW2
uucaacacgacguucuucaauu

SEQ ID NO: 4007074 - RNA, 17 nt, Staphylococcus aureus subsp. aureus MW2
uucaacagggguaaaac

SEQ ID NO: 4007075 - RNA, 22 nt, Staphylococcus aureus subsp. aureus MW2
uucaacaguaauuuuuaaacaa

SEQ ID NO: 4007076 - RNA, 14 nt, Staphylococcus aureus subsp. aureus MW2
uucaacauaacuca

SEQ ID NO: 4007077 - RNA, 16 nt, Staphylococcus aureus subsp. aureus MW2
uucaacauauaaauca

SEQ ID NO: 4007078 - RNA, 15 nt, Staphylococcus aureus subsp. aureus MW2
uucaacauuacaugc

SEQ ID NO: 4007079 - RNA, 14 nt, Staphylococcus aureus subsp. aureus MW2
uucaaccaauuauu

SEQ ID NO: 4007080 - RNA, 17 nt, Staphylococcus aureus subsp. aureus MW2
uucaaccaauuauuaaa

SEQ ID NO: 4007081 - RNA, 15 nt, Staphylococcus aureus subsp. aureus MW2
uucaacuaauuuaaa

SEQ ID NO: 4007082 - RNA, 13 nt, Staphylococcus aureus subsp. aureus MW2
uucaacuacuuca

SEQ ID NO: 4007083 - RNA, 23 nt, Staphylococcus aureus subsp. aureus MW2
uucaacuaguaaaucaaagauga

SEQ ID NO: 4007084 - RNA, 16 nt, Staphylococcus aureus subsp. aureus MW2
uucaacuuauuauuua

SEQ ID NO: 4007085 - RNA, 14 nt, Staphylococcus aureus subsp. aureus MW2
uucaacuucaucua

SEQ ID NO: 4007086 - RNA, 18 nt, Staphylococcus aureus subsp. aureus MW2
uucaacuucaucuaaaug

SEQ ID NO: 4007087 - RNA, 18 nt, Staphylococcus aureus subsp. aureus MW2
uucaacuuguuuccuaca

SEQ ID NO: 4007088 - RNA, 19 nt, Staphylococcus aureus subsp. aureus MW2
uucaacuuuaguuguuagg

SEQ ID NO: 4007089 - RNA, 16 nt, Staphylococcus aureus subsp. aureus MW2
uucaagagaaccaccu

SEQ ID NO: 4007090 - RNA, 17 nt, Staphylococcus aureus subsp. aureus MW2
uucaagagguuuuauuu

SEQ ID NO: 4007091 - RNA, 14 nt, Staphylococcus aureus subsp. aureus MW2
uucaagcguuucuu

SEQ ID NO: 4007092 - RNA, 19 nt, Staphylococcus aureus subsp. aureus MW2
uucaaguaaucauuuuucg

SEQ ID NO: 4007093 - RNA, 14 nt, Staphylococcus aureus subsp. aureus MW2
uucaaguuuaaaau

SEQ ID NO: 4007094 - RNA, 16 nt, Staphylococcus aureus subsp. aureus MW2
uucaauaaauuuuaua

SEQ ID NO: 4007095 - RNA, 15 nt, Staphylococcus aureus subsp. aureus MW2
uucaauaauaaauca

SEQ ID NO: 4007096 - RNA, 16 nt, Staphylococcus aureus subsp. aureus MW2
uucaauaaucuuaggu

SEQ ID NO: 4007097 - RNA, 17 nt, Staphylococcus aureus subsp. aureus MW2
uucaauaaucuuaggug

SEQ ID NO: 4007098 - RNA, 18 nt, Staphylococcus aureus subsp. aureus MW2
uucaauacaaacacccac

SEQ ID NO: 4007099 - RNA, 23 nt, Staphylococcus aureus subsp. aureus MW2
uucaauaguaccaugcucuuuuu

SEQ ID NO: 4007100 - RNA, 21 nt, Staphylococcus aureus subsp. aureus MW2
uucaauaguaguauuaucuuu

SEQ ID NO: 4007101 - RNA, 19 nt, Staphylococcus aureus subsp. aureus MW2
uucaaucaucaagacauuu

SEQ ID NO: 4007102 - RNA, 12 nt, Staphylococcus aureus subsp. aureus MW2
uucaauccuuug

SEQ ID NO: 4007103 - RNA, 16 nt, Staphylococcus aureus subsp. aureus MW2
uucaaucgcauuuugu

SEQ ID NO: 4007104 - RNA, 22 nt, Staphylococcus aureus subsp. aureus MW2
uucaaucgcauuuuguuucaac

SEQ ID NO: 4007105 - RNA, 16 nt, Staphylococcus aureus subsp. aureus MW2
uucaaugaauucauuu

SEQ ID NO: 4007106 - RNA, 17 nt, Staphylococcus aureus subsp. aureus MW2
uucaaugcuuucaucuu

SEQ ID NO: 4007107 - RNA, 19 nt, Staphylococcus aureus subsp. aureus MW2
uucaauguaucaccuaauu

SEQ ID NO: 4007108 - RNA, 14 nt, Staphylococcus aureus subsp. aureus MW2
uucaaugucugcau

SEQ ID NO: 4007109 - RNA, 16 nt, Staphylococcus aureus subsp. aureus MW2
uucaauguucaauuca

SEQ ID NO: 4007110 - RNA, 16 nt, Staphylococcus aureus subsp. aureus MW2
uucaauuaaauguuua

SEQ ID NO: 4007111 - RNA, 19 nt, Staphylococcus aureus subsp. aureus MW2
uucaauuaaugcaucagua

SEQ ID NO: 4007112 - RNA, 20 nt, Staphylococcus aureus subsp. aureus MW2
uucaauuaauuuaaaugcuu

SEQ ID NO: 4007113 - RNA, 20 nt, Staphylococcus aureus subsp. aureus MW2
uucaauucuagucaaccuug

SEQ ID NO: 4007114 - RNA, 16 nt, Staphylococcus aureus subsp. aureus MW2
uucaauugacauuaau

SEQ ID NO: 4007115 - RNA, 13 nt, Staphylococcus aureus subsp. aureus MW2
uucaauugcacuu

SEQ ID NO: 4007116 - RNA, 22 nt, Staphylococcus aureus subsp. aureus MW2
uucaauuucauuuuugauaacu

SEQ ID NO: 4007117 - RNA, 14 nt, Staphylococcus aureus subsp. aureus MW2
uucaauuucucacc

SEQ ID NO: 4007118 - RNA, 17 nt, Staphylococcus aureus subsp. aureus MW2
uucaauuuggaaauauc

SEQ ID NO: 4007119 - RNA, 14 nt, Staphylococcus aureus subsp. aureus MW2
uucauuaucauuaa

SEQ ID NO: 4007120 - RNA, 16 nt, Staphylococcus aureus subsp. aureus MW2
uucauuauuuaaauaa

SEQ ID NO: 4007121 - RNA, 17 nt, Staphylococcus aureus subsp. aureus MW2
uucauugaagaauauaa

SEQ ID NO: 4007122 - RNA, 13 nt, Staphylococcus aureus subsp. aureus MW2
uucauugcuuggu

SEQ ID NO: 4007123 - RNA, 12 nt, Staphylococcus aureus subsp. aureus MW2
uucauuuaacau

SEQ ID NO: 4007124 - RNA, 17 nt, Staphylococcus aureus subsp. aureus MW2
uucauuuaguuaaauac

SEQ ID NO: 4007125 - RNA, 17 nt, Staphylococcus aureus subsp. aureus MW2
uucauuuucaaauaacu

SEQ ID NO: 4007126 - RNA, 19 nt, Staphylococcus aureus subsp. aureus MW2
uucauuuuggcaaaagcuu

SEQ ID NO: 4007127 - RNA, 21 nt, Staphylococcus aureus subsp. aureus MW2
uucauuuuucuuccuaaauaa

SEQ ID NO: 4007128 - RNA, 22 nt, Staphylococcus aureus subsp. aureus MW2
uucauuuuucuuccuaaauaau

SEQ ID NO: 4007129 - RNA, 11 nt, Staphylococcus aureus subsp. aureus MW2
uuccaaaaauu

SEQ ID NO: 4007130 - RNA, 18 nt, Staphylococcus aureus subsp. aureus MW2
uuccaaagaaagcuaaua

SEQ ID NO: 4007131 - RNA, 18 nt, Staphylococcus aureus subsp. aureus MW2
uuccaaauugaaauuauc

SEQ ID NO: 4007132 - RNA, 20 nt, Staphylococcus aureus subsp. aureus MW2
uuccaaauuggaaaucaacu

SEQ ID NO: 4007133 - RNA, 15 nt, Staphylococcus aureus subsp. aureus MW2
uuccaagcaucauug

SEQ ID NO: 4007134 - RNA, 20 nt, Staphylococcus aureus subsp. aureus MW2
uuccacagcuuguucaauac

SEQ ID NO: 4007135 - RNA, 15 nt, Staphylococcus aureus subsp. aureus MW2
uuccagacuccuaaa

SEQ ID NO: 4007136 - RNA, 17 nt, Staphylococcus aureus subsp. aureus MW2
uuccauaaauaaaaugc

SEQ ID NO: 4007137 - RNA, 21 nt, Staphylococcus aureus subsp. aureus MW2
uuccaucauuuguguaaauga

SEQ ID NO: 4007138 - RNA, 12 nt, Staphylococcus aureus subsp. aureus MW2
uuccauuucaaa

SEQ ID NO: 4007139 - RNA, 22 nt, Staphylococcus aureus subsp. aureus MW2
uucccagucaugucccauaaca

SEQ ID NO: 4007140 - RNA, 19 nt, Staphylococcus aureus subsp. aureus MW2
uucccauuuuuaaaauuau

SEQ ID NO: 4007141 - RNA, 16 nt, Staphylococcus aureus subsp. aureus MW2
uucccuaucauacaua

SEQ ID NO: 4007142 - RNA, 15 nt, Staphylococcus aureus subsp. aureus MW2
uucccuggaaaauga

SEQ ID NO: 4007143 - RNA, 17 nt, Staphylococcus aureus subsp. aureus MW2
uucccuguuaugaagua

SEQ ID NO: 4007144 - RNA, 23 nt, Staphylococcus aureus subsp. aureus MW2
uuccgcacugccuuuuuguaauu

SEQ ID NO: 4007145 - RNA, 16 nt, Staphylococcus aureus subsp. aureus MW2
uuccgccagucaucau

SEQ ID NO: 4007146 - RNA, 18 nt, Staphylococcus aureus subsp. aureus MW2
uuccuaaaccucuaaaua

SEQ ID NO: 4007147 - RNA, 18 nt, Staphylococcus aureus subsp. aureus MW2
uuccuaccccgugaaucu

SEQ ID NO: 4007148 - RNA, 16 nt, Staphylococcus aureus subsp. aureus MW2
uuccuauuacuacaua

SEQ ID NO: 4007149 - RNA, 20 nt, Staphylococcus aureus subsp. aureus MW2
uuccuccuaccgcuaaaauu

SEQ ID NO: 4007150 - RNA, 22 nt, Staphylococcus aureus subsp. aureus MW2
uuccucuccuucggcucucgcu

SEQ ID NO: 4007151 - RNA, 22 nt, Staphylococcus aureus subsp. aureus MW2
uuccucuggaacuuuaauacca

SEQ ID NO: 4007152 - RNA, 21 nt, Staphylococcus aureus subsp. aureus MW2
uuccugauauuucaacuuuuu

SEQ ID NO: 4007153 - RNA, 20 nt, Staphylococcus aureus subsp. aureus MW2
uuccugcuacaacuucuucu

SEQ ID NO: 4007154 - RNA, 22 nt, Staphylococcus aureus subsp. aureus MW2
uuccuuguuuuaaacuuauuaa

SEQ ID NO: 4007155 - RNA, 19 nt, Staphylococcus aureus subsp. aureus MW2
uuccuuuagcaaaaauauu

SEQ ID NO: 4007156 - RNA, 23 nt, Staphylococcus aureus subsp. aureus MW2
uuccuuuagcaaaaauauuuaaa

SEQ ID NO: 4007157 - RNA, 20 nt, Staphylococcus aureus subsp. aureus MW2
uucgaacgauauuuuaaaaa

SEQ ID NO: 4007158 - RNA, 23 nt, Staphylococcus aureus subsp. aureus MW2
uucgaacgauauuuuaaaaagua

SEQ ID NO: 4007159 - RNA, 17 nt, Staphylococcus aureus subsp. aureus MW2
uucgaacguuugaaaaa

SEQ ID NO: 4007160 - RNA, 21 nt, Staphylococcus aureus subsp. aureus MW2
uucgaacguuugaaaaauuuc

SEQ ID NO: 4007161 - RNA, 17 nt, Staphylococcus aureus subsp. aureus MW2
uucgaacuaucaauaua

SEQ ID NO: 4007162 - RNA, 20 nt, Staphylococcus aureus subsp. aureus MW2
uucgacuacaaguuuauaau

SEQ ID NO: 4007163 - RNA, 15 nt, Staphylococcus aureus subsp. aureus MW2
uucgacuaguuugga

SEQ ID NO: 4007164 - RNA, 19 nt, Staphylococcus aureus subsp. aureus MW2
uucgacucaaacaauaaag

SEQ ID NO: 4007165 - RNA, 18 nt, Staphylococcus aureus subsp. aureus MW2
uucgacuguauacgacgu

SEQ ID NO: 4007166 - RNA, 19 nt, Staphylococcus aureus subsp. aureus MW2
uucgauaccuaaaauaccc

SEQ ID NO: 4007167 - RNA, 15 nt, Staphylococcus aureus subsp. aureus MW2
uucgauuauucuuaa

SEQ ID NO: 4007168 - RNA, 13 nt, Staphylococcus aureus subsp. aureus MW2
uucgauucauaaa

SEQ ID NO: 4007169 - RNA, 19 nt, Staphylococcus aureus subsp. aureus MW2
uucgauucuccuuuuguuu

SEQ ID NO: 4007170 - RNA, 17 nt, Staphylococcus aureus subsp. aureus MW2
uucgauugguuuaaaaa

SEQ ID NO: 4007171 - RNA, 16 nt, Staphylococcus aureus subsp. aureus MW2
uucgauuuagaagaac

SEQ ID NO: 4007172 - RNA, 14 nt, Staphylococcus aureus subsp. aureus MW2
uucgcauacuuuuu

SEQ ID NO: 4007173 - RNA, 20 nt, Staphylococcus aureus subsp. aureus MW2
uucgcauacuuuuucagaau

SEQ ID NO: 4007174 - RNA, 17 nt, Staphylococcus aureus subsp. aureus MW2
uucgcaucauucccugc

SEQ ID NO: 4007175 - RNA, 21 nt, Staphylococcus aureus subsp. aureus MW2
uucgcaucuccgaaggccaug

SEQ ID NO: 4007176 - RNA, 23 nt, Staphylococcus aureus subsp. aureus MW2
uucgcaucuuuguuuucaaacuu

SEQ ID NO: 4007177 - RNA, 18 nt, Staphylococcus aureus subsp. aureus MW2
uucgccaacuaaaucacc

SEQ ID NO: 4007178 - RNA, 15 nt, Staphylococcus aureus subsp. aureus MW2
uucgcccuuccauuc

SEQ ID NO: 4007179 - RNA, 14 nt, Staphylococcus aureus subsp. aureus MW2
uucgccuaaauggu

SEQ ID NO: 4007180 - RNA, 19 nt, Staphylococcus aureus subsp. aureus MW2
uucgccuucuaauaaugcu

SEQ ID NO: 4007181 - RNA, 14 nt, Staphylococcus aureus subsp. aureus MW2
uucgccuuuuuuau

SEQ ID NO: 4007182 - RNA, 20 nt, Staphylococcus aureus subsp. aureus MW2
uucgcguaaucuauaauaca

SEQ ID NO: 4007183 - RNA, 19 nt, Staphylococcus aureus subsp. aureus MW2
uucggaauuugcacaaaga

SEQ ID NO: 4007184 - RNA, 16 nt, Staphylococcus aureus subsp. aureus MW2
uucggaugagaaaugu

SEQ ID NO: 4007185 - RNA, 17 nt, Staphylococcus aureus subsp. aureus MW2
uucguaaaugccaaugg

SEQ ID NO: 4007186 - RNA, 19 nt, Staphylococcus aureus subsp. aureus MW2
uucguaacauuuaaaaaau

SEQ ID NO: 4007187 - RNA, 19 nt, Staphylococcus aureus subsp. aureus MW2
uucguacaucguugccauu

SEQ ID NO: 4007188 - RNA, 23 nt, Staphylococcus aureus subsp. aureus MW2
uucguacuaguucgauucaugaa

SEQ ID NO: 4007189 - RNA, 23 nt, Staphylococcus aureus subsp. aureus MW2
uucguaguaaccuaauucuaagu

SEQ ID NO: 4007190 - RNA, 20 nt, Staphylococcus aureus subsp. aureus MW2
uucguaugucucuuuauuau

SEQ ID NO: 4007191 - RNA, 16 nt, Staphylococcus aureus subsp. aureus MW2
uucguauugaaugaau

SEQ ID NO: 4007192 - RNA, 21 nt, Staphylococcus aureus subsp. aureus MW2
uucgugauuacauucuauacu

SEQ ID NO: 4007193 - RNA, 18 nt, Staphylococcus aureus subsp. aureus MW2
uucguguuccaauuuuau

SEQ ID NO: 4007194 - RNA, 17 nt, Staphylococcus aureus subsp. aureus MW2
uucguuguucauaauca

SEQ ID NO: 4007195 - RNA, 14 nt, Staphylococcus aureus subsp. aureus MW2
uucguuuuaauaau

SEQ ID NO: 4007196 - RNA, 17 nt, Staphylococcus aureus subsp. aureus MW2
uucguuuuguuauugaa

SEQ ID NO: 4007197 - RNA, 15 nt, Staphylococcus aureus subsp. aureus MW2
uucuaaaacaucacu

SEQ ID NO: 4007198 - RNA, 22 nt, Staphylococcus aureus subsp. aureus MW2
uucuaaaagaauuauucaagua

SEQ ID NO: 4007199 - RNA, 18 nt, Staphylococcus aureus subsp. aureus MW2
uucuaaacaacuucugaa

SEQ ID NO: 4007200 - RNA, 14 nt, Staphylococcus aureus subsp. aureus MW2
uucuaaauguguua

SEQ ID NO: 4007201 - RNA, 22 nt, Staphylococcus aureus subsp. aureus MW2
uucuaaauuauuuauucauuau

SEQ ID NO: 4007202 - RNA, 21 nt, Staphylococcus aureus subsp. aureus MW2
uucuaacgguaaauaaccacu

SEQ ID NO: 4007203 - RNA, 13 nt, Staphylococcus aureus subsp. aureus MW2
uucuaagucucuu

SEQ ID NO: 4007204 - RNA, 19 nt, Staphylococcus aureus subsp. aureus MW2
uucuaagucucuugucauu

SEQ ID NO: 4007205 - RNA, 17 nt, Staphylococcus aureus subsp. aureus MW2
uucuaaguguugaccau

SEQ ID NO: 4007206 - RNA, 20 nt, Staphylococcus aureus subsp. aureus MW2
uucuaaucguuaauaaaccu

SEQ ID NO: 4007207 - RNA, 13 nt, Staphylococcus aureus subsp. aureus MW2
uucuugauuuuag

SEQ ID NO: 4007208 - RNA, 15 nt, Staphylococcus aureus subsp. aureus MW2
uucuuuaaauacauc

SEQ ID NO: 4007209 - RNA, 12 nt, Staphylococcus aureus subsp. aureus MW2
uucuuuaacaau

SEQ ID NO: 4007210 - RNA, 13 nt, Staphylococcus aureus subsp. aureus MW2
uucuuuaacaauu

SEQ ID NO: 4007211 - RNA, 22 nt, Staphylococcus aureus subsp. aureus MW2
uucuuuaacaauugauugcucu

SEQ ID NO: 4007212 - RNA, 17 nt, Staphylococcus aureus subsp. aureus MW2
uucuuuaagcuuucuau

SEQ ID NO: 4007213 - RNA, 23 nt, Staphylococcus aureus subsp. aureus MW2
uucuuuaugauaauaagaauauu

SEQ ID NO: 4007214 - RNA, 16 nt, Staphylococcus aureus subsp. aureus MW2
uucuuuauuagaauga

SEQ ID NO: 4007215 - RNA, 23 nt, Staphylococcus aureus subsp. aureus MW2
uucuuuauuucuuucgaaaacag

SEQ ID NO: 4007216 - RNA, 14 nt, Staphylococcus aureus subsp. aureus MW2
uucuuucaggcuuu

SEQ ID NO: 4007217 - RNA, 13 nt, Staphylococcus aureus subsp. aureus MW2
uucuuucuaaaau

SEQ ID NO: 4007218 - RNA, 19 nt, Staphylococcus aureus subsp. aureus MW2
uucuuucuaaaauaacuaa

SEQ ID NO: 4007219 - RNA, 15 nt, Staphylococcus aureus subsp. aureus MW2
uucuuugucaucuuu

SEQ ID NO: 4007220 - RNA, 17 nt, Staphylococcus aureus subsp. aureus MW2
uucuuuguguuugcuuu

SEQ ID NO: 4007221 - RNA, 17 nt, Staphylococcus aureus subsp. aureus MW2
uucuuuuaaguuaucaa

SEQ ID NO: 4007222 - RNA, 18 nt, Staphylococcus aureus subsp. aureus MW2
uucuuuuaaguuaucaaa

SEQ ID NO: 4007223 - RNA, 17 nt, Staphylococcus aureus subsp. aureus MW2
uucuuuucgaaauucuc

SEQ ID NO: 4007224 - RNA, 19 nt, Staphylococcus aureus subsp. aureus MW2
uucuuuuguaacguucuua

SEQ ID NO: 4007225 - RNA, 19 nt, Staphylococcus aureus subsp. aureus MW2
uucuuuuguaauugaaaug

SEQ ID NO: 4007226 - RNA, 23 nt, Staphylococcus aureus subsp. aureus MW2
uucuuuuguaauugaaaugauag

SEQ ID NO: 4007227 - RNA, 20 nt, Staphylococcus aureus subsp. aureus MW2
uucuuuuucagcuaauuguc

SEQ ID NO: 4007228 - RNA, 15 nt, Staphylococcus aureus subsp. aureus MW2
uucuuuuucaucuuu

SEQ ID NO: 4007229 - RNA, 15 nt, Staphylococcus aureus subsp. aureus MW2
uucuuuuucuauaca

SEQ ID NO: 4007230 - RNA, 22 nt, Staphylococcus aureus subsp. aureus MW2
uucuuuuugcguuuuuaaauaa

SEQ ID NO: 4007231 - RNA, 13 nt, Staphylococcus aureus subsp. aureus MW2
uucuuuuugcuuu

SEQ ID NO: 4007232 - RNA, 18 nt, Staphylococcus aureus subsp. aureus MW2
uucuuuuuguucggcuuu

SEQ ID NO: 4007233 - RNA, 18 nt, Staphylococcus aureus subsp. aureus MW2
uucuuuuuguuguuuuaa

SEQ ID NO: 4007234 - RNA, 12 nt, Staphylococcus aureus subsp. aureus MW2
uucuuuuuucaa

SEQ ID NO: 4007235 - RNA, 13 nt, Staphylococcus aureus subsp. aureus MW2
uugaaaaagacua

SEQ ID NO: 4007236 - RNA, 19 nt, Staphylococcus aureus subsp. aureus MW2
uugaaaaauuaaaaaacaa

SEQ ID NO: 4007237 - RNA, 19 nt, Staphylococcus aureus subsp. aureus MW2
uugaaaaguaauuaaauac

SEQ ID NO: 4007238 - RNA, 12 nt, Staphylococcus aureus subsp. aureus MW2
uugaaaaguuug

SEQ ID NO: 4007239 - RNA, 23 nt, Staphylococcus aureus subsp. aureus MW2
uugaaaauaaucgaacagaaaau

SEQ ID NO: 4007240 - RNA, 21 nt, Staphylococcus aureus subsp. aureus MW2
uugaaaauagccauaucauau

SEQ ID NO: 4007241 - RNA, 12 nt, Staphylococcus aureus subsp. aureus MW2
uugaaaaucuaa

SEQ ID NO: 4007242 - RNA, 16 nt, Staphylococcus aureus subsp. aureus MW2
uugaaaaucuaauccu

SEQ ID NO: 4007243 - RNA, 20 nt, Staphylococcus aureus subsp. aureus MW2
uugaaacugaguucaauuaa

SEQ ID NO: 4007244 - RNA, 15 nt, Staphylococcus aureus subsp. aureus MW2
uugaaacuguaucaa

SEQ ID NO: 4007245 - RNA, 17 nt, Staphylococcus aureus subsp. aureus MW2
uugaaacuguaucaaca

SEQ ID NO: 4007246 - RNA, 15 nt, Staphylococcus aureus subsp. aureus MW2
uugaaagauauuucu

SEQ ID NO: 4007247 - RNA, 17 nt, Staphylococcus aureus subsp. aureus MW2
uugaaauaaucuaguau

SEQ ID NO: 4007248 - RNA, 15 nt, Staphylococcus aureus subsp. aureus MW2
uugaaauuaauuauc

SEQ ID NO: 4007249 - RNA, 19 nt, Staphylococcus aureus subsp. aureus MW2
uugaaauuauuauuuaaau

SEQ ID NO: 4007250 - RNA, 16 nt, Staphylococcus aureus subsp. aureus MW2
uugaaauugacaguuu

SEQ ID NO: 4007251 - RNA, 20 nt, Staphylococcus aureus subsp. aureus MW2
uugaaauuugguaggcauuu

SEQ ID NO: 4007252 - RNA, 13 nt, Staphylococcus aureus subsp. aureus MW2
uugaacaauaaua

SEQ ID NO: 4007253 - RNA, 19 nt, Staphylococcus aureus subsp. aureus MW2
uugaacaauucuucaucau

SEQ ID NO: 4007254 - RNA, 13 nt, Staphylococcus aureus subsp. aureus MW2
uugaacagauuca

SEQ ID NO: 4007255 - RNA, 17 nt, Staphylococcus aureus subsp. aureus MW2
uugaacauauuauaaaa

SEQ ID NO: 4007256 - RNA, 23 nt, Staphylococcus aureus subsp. aureus MW2
uugaacauauuauaaaaguguaa

SEQ ID NO: 4007257 - RNA, 16 nt, Staphylococcus aureus subsp. aureus MW2
uugaaccggaaauuaa

SEQ ID NO: 4007258 - RNA, 22 nt, Staphylococcus aureus subsp. aureus MW2
uugaaccggaaauuaaaucuac

SEQ ID NO: 4007259 - RNA, 21 nt, Staphylococcus aureus subsp. aureus MW2
uugaacgaaagagaaaagcua

SEQ ID NO: 4007260 - RNA, 15 nt, Staphylococcus aureus subsp. aureus MW2
uugaacgagagagaa

SEQ ID NO: 4007261 - RNA, 21 nt, Staphylococcus aureus subsp. aureus MW2
uugaacgagagagaaaagcua

SEQ ID NO: 4007262 - RNA, 21 nt, Staphylococcus aureus subsp. aureus MW2
uugaacgauaacaauuuauua

SEQ ID NO: 4007263 - RNA, 19 nt, Staphylococcus aureus subsp. aureus MW2
uugaacuuuaguauauuca

SEQ ID NO: 4007264 - RNA, 11 nt, Staphylococcus aureus subsp. aureus MW2
uugaacuuuua

SEQ ID NO: 4007265 - RNA, 15 nt, Staphylococcus aureus subsp. aureus MW2
uugaagaauaaaaaa

SEQ ID NO: 4007266 - RNA, 17 nt, Staphylococcus aureus subsp. aureus MW2
uugaagaauauaaacua

SEQ ID NO: 4007267 - RNA, 18 nt, Staphylococcus aureus subsp. aureus MW2
uugaagaauguuucauau

SEQ ID NO: 4007268 - RNA, 18 nt, Staphylococcus aureus subsp. aureus MW2
uugaagaugcuuuaauua

SEQ ID NO: 4007269 - RNA, 20 nt, Staphylococcus aureus subsp. aureus MW2
uugaagaugcuuuaauuaaa

SEQ ID NO: 4007270 - RNA, 21 nt, Staphylococcus aureus subsp. aureus MW2
uugaagcauuaaguucaucau

SEQ ID NO: 4007271 - RNA, 18 nt, Staphylococcus aureus subsp. aureus MW2
uugaagcggguugaagca

SEQ ID NO: 4007272 - RNA, 20 nt, Staphylococcus aureus subsp. aureus MW2
uugaagggagcauuucauua

SEQ ID NO: 4007273 - RNA, 17 nt, Staphylococcus aureus subsp. aureus MW2
uugaauaaauuuuauuc

SEQ ID NO: 4007274 - RNA, 23 nt, Staphylococcus aureus subsp. aureus MW2
uugaauaauuggcugaugaacuu

SEQ ID NO: 4007275 - RNA, 22 nt, Staphylococcus aureus subsp. aureus MW2
uugaauacuuuuuaacugguug

SEQ ID NO: 4007276 - RNA, 11 nt, Staphylococcus aureus subsp. aureus MW2
uugaauauuuu

SEQ ID NO: 4007277 - RNA, 16 nt, Staphylococcus aureus subsp. aureus MW2
uugaaucaacaguuuu

SEQ ID NO: 4007278 - RNA, 20 nt, Staphylococcus aureus subsp. aureus MW2
uugaaucaacaguuuuauua

SEQ ID NO: 4007279 - RNA, 16 nt, Staphylococcus aureus subsp. aureus MW2
uugaaucguauugaaa

SEQ ID NO: 4007280 - RNA, 17 nt, Staphylococcus aureus subsp. aureus MW2
uugaaucguauugaaaa

SEQ ID NO: 4007281 - RNA, 12 nt, Staphylococcus aureus subsp. aureus MW2
uugaaugaaccu

SEQ ID NO: 4007282 - RNA, 18 nt, Staphylococcus aureus subsp. aureus MW2
uugaaugaaccuuuacuc

SEQ ID NO: 4007283 - RNA, 23 nt, Staphylococcus aureus subsp. aureus MW2
uugaaugauauuaacuguaccau

SEQ ID NO: 4007284 - RNA, 18 nt, Staphylococcus aureus subsp. aureus MW2
uugaaugguauaauuccu

SEQ ID NO: 4007285 - RNA, 15 nt, Staphylococcus aureus subsp. aureus MW2
uugaauguaagaagu

SEQ ID NO: 4007286 - RNA, 22 nt, Staphylococcus aureus subsp. aureus MW2
uugaauuaacaauauuaaauuu

SEQ ID NO: 4007287 - RNA, 17 nt, Staphylococcus aureus subsp. aureus MW2
uugaauugaaaaauuaa

SEQ ID NO: 4007288 - RNA, 17 nt, Staphylococcus aureus subsp. aureus MW2
uugaauugacuuacauu

SEQ ID NO: 4007289 - RNA, 13 nt, Staphylococcus aureus subsp. aureus MW2
uugaauuuaaaaa

SEQ ID NO: 4007290 - RNA, 13 nt, Staphylococcus aureus subsp. aureus MW2
uugaauuuaauuu

SEQ ID NO: 4007291 - RNA, 13 nt, Staphylococcus aureus subsp. aureus MW2
uugaauuuuauuu

SEQ ID NO: 4007292 - RNA, 19 nt, Staphylococcus aureus subsp. aureus MW2
uugacaaguugcugaauaa

SEQ ID NO: 4007293 - RNA, 14 nt, Staphylococcus aureus subsp. aureus MW2
uugacaaucuaaau

SEQ ID NO: 4007294 - RNA, 19 nt, Staphylococcus aureus subsp. aureus MW2
uugacacacccaaauuuag

SEQ ID NO: 4007295 - RNA, 15 nt, Staphylococcus aureus subsp. aureus MW2
uugacacauuauuga

SEQ ID NO: 4007296 - RNA, 20 nt, Staphylococcus aureus subsp. aureus MW2
uugcuagucauaauuuagaa

SEQ ID NO: 4007297 - RNA, 18 nt, Staphylococcus aureus subsp. aureus MW2
uugcuagugcucuugcaa

SEQ ID NO: 4007298 - RNA, 19 nt, Staphylococcus aureus subsp. aureus MW2
uugcuagugcucuugcaau

SEQ ID NO: 4007299 - RNA, 15 nt, Staphylococcus aureus subsp. aureus MW2
uugcuauaagaacua

SEQ ID NO: 4007300 - RNA, 18 nt, Staphylococcus aureus subsp. aureus MW2
uugcuauauuaguauaau

SEQ ID NO: 4007301 - RNA, 22 nt, Staphylococcus aureus subsp. aureus MW2
uugcuguaugacaggcguguug

SEQ ID NO: 4007302 - RNA, 13 nt, Staphylococcus aureus subsp. aureus MW2
uugcuuauguaca

SEQ ID NO: 4007303 - RNA, 14 nt, Staphylococcus aureus subsp. aureus MW2
uugcuuauguuuuu

SEQ ID NO: 4007304 - RNA, 18 nt, Staphylococcus aureus subsp. aureus MW2
uugcuucauaaauguuag

SEQ ID NO: 4007305 - RNA, 17 nt, Staphylococcus aureus subsp. aureus MW2
uugcuucuuaucaacaa

SEQ ID NO: 4007306 - RNA, 17 nt, Staphylococcus aureus subsp. aureus MW2
uugcuuggauaauugca

SEQ ID NO: 4007307 - RNA, 19 nt, Staphylococcus aureus subsp. aureus MW2
uugcuuguacgauaacuac

SEQ ID NO: 4007308 - RNA, 13 nt, Staphylococcus aureus subsp. aureus MW2
uugcuuuaauuug

SEQ ID NO: 4007309 - RNA, 16 nt, Staphylococcus aureus subsp. aureus MW2
uugcuuuagcucuuuu

SEQ ID NO: 4007310 - RNA, 18 nt, Staphylococcus aureus subsp. aureus MW2
uugcuuuuauuuuuaaug

SEQ ID NO: 4007311 - RNA, 14 nt, Staphylococcus aureus subsp. aureus MW2
uugcuuuuuacuau

SEQ ID NO: 4007312 - RNA, 19 nt, Staphylococcus aureus subsp. aureus MW2
uugcuuuuuauuuuguaua

SEQ ID NO: 4007313 - RNA, 19 nt, Staphylococcus aureus subsp. aureus MW2
uugcuuuuucguuaaauga

SEQ ID NO: 4007314 - RNA, 14 nt, Staphylococcus aureus subsp. aureus MW2
uuggaaaaauugug

SEQ ID NO: 4007315 - RNA, 16 nt, Staphylococcus aureus subsp. aureus MW2
uuggaagccuucaaua

SEQ ID NO: 4007316 - RNA, 17 nt, Staphylococcus aureus subsp. aureus MW2
uuggaaguauuuaugag

SEQ ID NO: 4007317 - RNA, 23 nt, Staphylococcus aureus subsp. aureus MW2
uuggaaucaucuuuuugaaauuu

SEQ ID NO: 4007318 - RNA, 18 nt, Staphylococcus aureus subsp. aureus MW2
uuggauaauuucuucuuc

SEQ ID NO: 4007319 - RNA, 17 nt, Staphylococcus aureus subsp. aureus MW2
uuggauagguaacuaaa

SEQ ID NO: 4007320 - RNA, 23 nt, Staphylococcus aureus subsp. aureus MW2
uuggaugaacaaaauaacauguu

SEQ ID NO: 4007321 - RNA, 15 nt, Staphylococcus aureus subsp. aureus MW2
uuggauuuuaacaag

SEQ ID NO: 4007322 - RNA, 17 nt, Staphylococcus aureus subsp. aureus MW2
uuggauuuuaacaagau

SEQ ID NO: 4007323 - RNA, 20 nt, Staphylococcus aureus subsp. aureus MW2
uuggauuuuuugguuucuau

SEQ ID NO: 4007324 - RNA, 24 nt, Staphylococcus aureus subsp. aureus MW2
uuggcaaacuauuaauagcaccau

SEQ ID NO: 4007325 - RNA, 23 nt, Staphylococcus aureus subsp. aureus MW2
uuggcaauuguuuaucuccuaaa

SEQ ID NO: 4007326 - RNA, 15 nt, Staphylococcus aureus subsp. aureus MW2
uuggcacauaaauca

SEQ ID NO: 4007327 - RNA, 19 nt, Staphylococcus aureus subsp. aureus MW2
uuggcauuagcuucuacuu

SEQ ID NO: 4007328 - RNA, 14 nt, Staphylococcus aureus subsp. aureus MW2
uuggcgggccccaa

SEQ ID NO: 4007329 - RNA, 20 nt, Staphylococcus aureus subsp. aureus MW2
uuggcgggccccaacauaga

SEQ ID NO: 4007330 - RNA, 15 nt, Staphylococcus aureus subsp. aureus MW2
uuggcggggccccaa

SEQ ID NO: 4007331 - RNA, 21 nt, Staphylococcus aureus subsp. aureus MW2
uuggcggggccccaacauaga

SEQ ID NO: 4007332 - RNA, 23 nt, Staphylococcus aureus subsp. aureus MW2
uuggcggggccccaacauagaag

SEQ ID NO: 4007333 - RNA, 19 nt, Staphylococcus aureus subsp. aureus MW2
uuggcuccccaauuucucu

SEQ ID NO: 4007334 - RNA, 19 nt, Staphylococcus aureus subsp. aureus MW2
uuggcucuuuuuauuuaua

SEQ ID NO: 4007335 - RNA, 16 nt, Staphylococcus aureus subsp. aureus MW2
uuggcuugaaguuguu

SEQ ID NO: 4007336 - RNA, 15 nt, Staphylococcus aureus subsp. aureus MW2
uugggaauugaccac

SEQ ID NO: 4007337 - RNA, 21 nt, Staphylococcus aureus subsp. aureus MW2
uugggcgcuuuuuaauuugua

SEQ ID NO: 4007338 - RNA, 14 nt, Staphylococcus aureus subsp. aureus MW2
uugggguauagaaa

SEQ ID NO: 4007339 - RNA, 18 nt, Staphylococcus aureus subsp. aureus MW2
uuggggugugggccccaa

SEQ ID NO: 4007340 - RNA, 20 nt, Staphylococcus aureus subsp. aureus MW2
uugguaagcuaauuucuaau

SEQ ID NO: 4007341 - RNA, 18 nt, Staphylococcus aureus subsp. aureus MW2
uugguagcauuuuagauu

SEQ ID NO: 4007342 - RNA, 20 nt, Staphylococcus aureus subsp. aureus MW2
uugguauuuauccugaccaa

SEQ ID NO: 4007343 - RNA, 16 nt, Staphylococcus aureus subsp. aureus MW2
uugguguuuagucuuu

SEQ ID NO: 4007344 - RNA, 21 nt, Staphylococcus aureus subsp. aureus MW2
uugguuacgugaccuuuguaa

SEQ ID NO: 4007345 - RNA, 15 nt, Staphylococcus aureus subsp. aureus MW2
uugguugaacuguuu

SEQ ID NO: 4007346 - RNA, 19 nt, Staphylococcus aureus subsp. aureus MW2
uugguugaaugaacaugua

SEQ ID NO: 4007347 - RNA, 15 nt, Staphylococcus aureus subsp. aureus MW2
uugguuuuuaaaagu

SEQ ID NO: 4007348 - RNA, 14 nt, Staphylococcus aureus subsp. aureus MW2
uuguaaaagugaau

SEQ ID NO: 4007349 - RNA, 23 nt, Staphylococcus aureus subsp. aureus MW2
uuguaaaagugaauaauugagaa

SEQ ID NO: 4007350 - RNA, 15 nt, Staphylococcus aureus subsp. aureus MW2
uuguaaauaaaacua

SEQ ID NO: 4007351 - RNA, 21 nt, Staphylococcus aureus subsp. aureus MW2
uuguaaauauuuuuuaaaaug

SEQ ID NO: 4007352 - RNA, 23 nt, Staphylococcus aureus subsp. aureus MW2
uuguaaaucacgauuuucaagua

SEQ ID NO: 4007353 - RNA, 15 nt, Staphylococcus aureus subsp. aureus MW2
uuguaaauccuccau

SEQ ID NO: 4007354 - RNA, 20 nt, Staphylococcus aureus subsp. aureus MW2
uuguaaauuuauuuuuaauu

SEQ ID NO: 4007355 - RNA, 15 nt, Staphylococcus aureus subsp. aureus MW2
uuguaacacacuuau

SEQ ID NO: 4007356 - RNA, 23 nt, Staphylococcus aureus subsp. aureus MW2
uuguaacucuauccaaagacaua

SEQ ID NO: 4007357 - RNA, 22 nt, Staphylococcus aureus subsp. aureus MW2
uuguaagucgcucuagacauua

SEQ ID NO: 4007358 - RNA, 22 nt, Staphylococcus aureus subsp. aureus MW2
uuguaauacaucuaauaaauau

SEQ ID NO: 4007359 - RNA, 20 nt, Staphylococcus aureus subsp. aureus MW2
uuguaauacugaaugcucau

SEQ ID NO: 4007360 - RNA, 14 nt, Staphylococcus aureus subsp. aureus MW2
uuguaaucauacca

SEQ ID NO: 4007361 - RNA, 13 nt, Staphylococcus aureus subsp. aureus MW2
uuguaauuuaaau

SEQ ID NO: 4007362 - RNA, 21 nt, Staphylococcus aureus subsp. aureus MW2
uuguacaaaaaauuguaaguc

SEQ ID NO: 4007363 - RNA, 14 nt, Staphylococcus aureus subsp. aureus MW2
uuguacaaucaaag

SEQ ID NO: 4007364 - RNA, 17 nt, Staphylococcus aureus subsp. aureus MW2
uuguacaguaauauuca

SEQ ID NO: 4007365 - RNA, 23 nt, Staphylococcus aureus subsp. aureus MW2
uuguacaguaauauucaacuugu

SEQ ID NO: 4007366 - RNA, 16 nt, Staphylococcus aureus subsp. aureus MW2
uuguacauauguguau

SEQ ID NO: 4007367 - RNA, 14 nt, Staphylococcus aureus subsp. aureus MW2
uuguaccaaugaau

SEQ ID NO: 4007368 - RNA, 14 nt, Staphylococcus aureus subsp. aureus MW2
uuguacgauaacua

SEQ ID NO: 4007369 - RNA, 14 nt, Staphylococcus aureus subsp. aureus MW2
uuguauaacuaaga

SEQ ID NO: 4007370 - RNA, 17 nt, Staphylococcus aureus subsp. aureus MW2
uuguauagaauguguau

SEQ ID NO: 4007371 - RNA, 20 nt, Staphylococcus aureus subsp. aureus MW2
uuguauagauuguauuuaau

SEQ ID NO: 4007372 - RNA, 16 nt, Staphylococcus aureus subsp. aureus MW2
uuguauaucuguauaa

SEQ ID NO: 4007373 - RNA, 18 nt, Staphylococcus aureus subsp. aureus MW2
uuguauaucuguauaaaa

SEQ ID NO: 4007374 - RNA, 16 nt, Staphylococcus aureus subsp. aureus MW2
uuguaucaacauuaau

SEQ ID NO: 4007375 - RNA, 16 nt, Staphylococcus aureus subsp. aureus MW2
uuguaugauaaccauu

SEQ ID NO: 4007376 - RNA, 15 nt, Staphylococcus aureus subsp. aureus MW2
uuguauuaaucaaau

SEQ ID NO: 4007377 - RNA, 22 nt, Staphylococcus aureus subsp. aureus MW2
uuguauuaaucaaauauuuuau

SEQ ID NO: 4007378 - RNA, 19 nt, Staphylococcus aureus subsp. aureus MW2
uuguauugacaucuucgua

SEQ ID NO: 4007379 - RNA, 14 nt, Staphylococcus aureus subsp. aureus MW2
uuguauuuaaaauc

SEQ ID NO: 4007380 - RNA, 15 nt, Staphylococcus aureus subsp. aureus MW2
uuguauuuaaaauca

SEQ ID NO: 4007381 - RNA, 18 nt, Staphylococcus aureus subsp. aureus MW2
uuguauuuaauaaguuaa

SEQ ID NO: 4007382 - RNA, 17 nt, Staphylococcus aureus subsp. aureus MW2
uuguauuuuauuuauuu

SEQ ID NO: 4007383 - RNA, 14 nt, Staphylococcus aureus subsp. aureus MW2
uuguauuuuucaaa

SEQ ID NO: 4007384 - RNA, 22 nt, Staphylococcus aureus subsp. aureus MW2
uuuaaauaaaugacuucacauu

SEQ ID NO: 4007385 - RNA, 16 nt, Staphylococcus aureus subsp. aureus MW2
uuuaaauacuugcucu

SEQ ID NO: 4007386 - RNA, 17 nt, Staphylococcus aureus subsp. aureus MW2
uuuaaauauacuucuau

SEQ ID NO: 4007387 - RNA, 13 nt, Staphylococcus aureus subsp. aureus MW2
uuuaaauauuguc

SEQ ID NO: 4007388 - RNA, 18 nt, Staphylococcus aureus subsp. aureus MW2
uuuaaaucuuguucuaau

SEQ ID NO: 4007389 - RNA, 12 nt, Staphylococcus aureus subsp. aureus MW2
uuuaaaugauau

SEQ ID NO: 4007390 - RNA, 20 nt, Staphylococcus aureus subsp. aureus MW2
uuuaaaugauuucacuucau

SEQ ID NO: 4007391 - RNA, 23 nt, Staphylococcus aureus subsp. aureus MW2
uuuaaaugauuucacuucauaaa

SEQ ID NO: 4007392 - RNA, 17 nt, Staphylococcus aureus subsp. aureus MW2
uuuaaaugcuuucaaau

SEQ ID NO: 4007393 - RNA, 22 nt, Staphylococcus aureus subsp. aureus MW2
uuuaaauuaaaauaauuaaacu

SEQ ID NO: 4007394 - RNA, 20 nt, Staphylococcus aureus subsp. aureus MW2
uuuaaauuuucaucauaauc

SEQ ID NO: 4007395 - RNA, 15 nt, Staphylococcus aureus subsp. aureus MW2
uuuaacaaaauauac

SEQ ID NO: 4007396 - RNA, 23 nt, Staphylococcus aureus subsp. aureus MW2
uuuaacaucauuuuuggaugaua

SEQ ID NO: 4007397 - RNA, 13 nt, Staphylococcus aureus subsp. aureus MW2
uuuaacaucugaa

SEQ ID NO: 4007398 - RNA, 22 nt, Staphylococcus aureus subsp. aureus MW2
uuuaacauuuacacgucuaauu

SEQ ID NO: 4007399 - RNA, 14 nt, Staphylococcus aureus subsp. aureus MW2
uuuaacauuucuga

SEQ ID NO: 4007400 - RNA, 17 nt, Staphylococcus aureus subsp. aureus MW2
uuuaacauuuuuuucaa

SEQ ID NO: 4007401 - RNA, 13 nt, Staphylococcus aureus subsp. aureus MW2
uuuaaccaaaauu

SEQ ID NO: 4007402 - RNA, 17 nt, Staphylococcus aureus subsp. aureus MW2
uuuaaccuacacgacca

SEQ ID NO: 4007403 - RNA, 16 nt, Staphylococcus aureus subsp. aureus MW2
uuuaacguaucauccc

SEQ ID NO: 4007404 - RNA, 13 nt, Staphylococcus aureus subsp. aureus MW2
uuuaacuaaacca

SEQ ID NO: 4007405 - RNA, 23 nt, Staphylococcus aureus subsp. aureus MW2
uuuaacucuugaaacacaaaaag

SEQ ID NO: 4007406 - RNA, 18 nt, Staphylococcus aureus subsp. aureus MW2
uuuaacugguugauaaau

SEQ ID NO: 4007407 - RNA, 22 nt, Staphylococcus aureus subsp. aureus MW2
uuuaacuuauauacguugauua

SEQ ID NO: 4007408 - RNA, 17 nt, Staphylococcus aureus subsp. aureus MW2
uuuaacuugauuuucua

SEQ ID NO: 4007409 - RNA, 13 nt, Staphylococcus aureus subsp. aureus MW2
uuuaagaaugcga

SEQ ID NO: 4007410 - RNA, 15 nt, Staphylococcus aureus subsp. aureus MW2
uuuaagaucaauauc

SEQ ID NO: 4007411 - RNA, 12 nt, Staphylococcus aureus subsp. aureus MW2
uuuaagcugcuc

SEQ ID NO: 4007412 - RNA, 19 nt, Staphylococcus aureus subsp. aureus MW2
uuuaagcuuacgacauacu

SEQ ID NO: 4007413 - RNA, 19 nt, Staphylococcus aureus subsp. aureus MW2
uuuaaguuaucaaauugac

SEQ ID NO: 4007414 - RNA, 17 nt, Staphylococcus aureus subsp. aureus MW2
uuuaaguuuauaaucag

SEQ ID NO: 4007415 - RNA, 17 nt, Staphylococcus aureus subsp. aureus MW2
uuuaaguuuuucagggu

SEQ ID NO: 4007416 - RNA, 14 nt, Staphylococcus aureus subsp. aureus MW2
uuuaauaacaaaau

SEQ ID NO: 4007417 - RNA, 14 nt, Staphylococcus aureus subsp. aureus MW2
uuuaauaauuaaau

SEQ ID NO: 4007418 - RNA, 18 nt, Staphylococcus aureus subsp. aureus MW2
uuuaauaauuaaauauaa

SEQ ID NO: 4007419 - RNA, 16 nt, Staphylococcus aureus subsp. aureus MW2
uuuaauacuaauaacu

SEQ ID NO: 4007420 - RNA, 21 nt, Staphylococcus aureus subsp. aureus MW2
uuuaauacuauaguaagaaaa

SEQ ID NO: 4007421 - RNA, 22 nt, Staphylococcus aureus subsp. aureus MW2
uuuaauagcgauaagcaugaua

SEQ ID NO: 4007422 - RNA, 15 nt, Staphylococcus aureus subsp. aureus MW2
uuuaauagcuuguuu

SEQ ID NO: 4007423 - RNA, 19 nt, Staphylococcus aureus subsp. aureus MW2
uuuaauagcuuguuuauuu

SEQ ID NO: 4007424 - RNA, 17 nt, Staphylococcus aureus subsp. aureus MW2
uuuaauagguucuucuu

SEQ ID NO: 4007425 - RNA, 13 nt, Staphylococcus aureus subsp. aureus MW2
uuuaauauaaauu

SEQ ID NO: 4007426 - RNA, 18 nt, Staphylococcus aureus subsp. aureus MW2
uuuaauaucacgaucuuu

SEQ ID NO: 4007427 - RNA, 14 nt, Staphylococcus aureus subsp. aureus MW2
uuuaauaucuaauu

SEQ ID NO: 4007428 - RNA, 20 nt, Staphylococcus aureus subsp. aureus MW2
uuuaauaucuaauucuguuu

SEQ ID NO: 4007429 - RNA, 18 nt, Staphylococcus aureus subsp. aureus MW2
uuuaauauugaauaaaaa

SEQ ID NO: 4007430 - RNA, 19 nt, Staphylococcus aureus subsp. aureus MW2
uuuaauauugaauaaaaaa

SEQ ID NO: 4007431 - RNA, 21 nt, Staphylococcus aureus subsp. aureus MW2
uuuaauauuguuauacauaua

SEQ ID NO: 4007432 - RNA, 19 nt, Staphylococcus aureus subsp. aureus MW2
uuuaauauuugauaacaaa

SEQ ID NO: 4007433 - RNA, 19 nt, Staphylococcus aureus subsp. aureus MW2
uuuaaucguaacauaucag

SEQ ID NO: 4007434 - RNA, 13 nt, Staphylococcus aureus subsp. aureus MW2
uuuaaucuauaua

SEQ ID NO: 4007435 - RNA, 16 nt, Staphylococcus aureus subsp. aureus MW2
uuuaaucuguauguaa

SEQ ID NO: 4007436 - RNA, 13 nt, Staphylococcus aureus subsp. aureus MW2
uuuaaugaaguaa

SEQ ID NO: 4007437 - RNA, 14 nt, Staphylococcus aureus subsp. aureus MW2
uuuaaugcuuuaaa

SEQ ID NO: 4007438 - RNA, 21 nt, Staphylococcus aureus subsp. aureus MW2
uuuaaugggcgauaaaaguug

SEQ ID NO: 4007439 - RNA, 22 nt, Staphylococcus aureus subsp. aureus MW2
uuuaaugggcgugccauuaaaa

SEQ ID NO: 4007440 - RNA, 16 nt, Staphylococcus aureus subsp. aureus MW2
uuuaaugucuaaaaau

SEQ ID NO: 4007441 - RNA, 12 nt, Staphylococcus aureus subsp. aureus MW2
uuuaauguguaa

SEQ ID NO: 4007442 - RNA, 16 nt, Staphylococcus aureus subsp. aureus MW2
uuuaauguuaaacaau

SEQ ID NO: 4007443 - RNA, 19 nt, Staphylococcus aureus subsp. aureus MW2
uuuaauguugcaaaauuaa

SEQ ID NO: 4007444 - RNA, 16 nt, Staphylococcus aureus subsp. aureus MW2
uuuaauguuuaauaau

SEQ ID NO: 4007445 - RNA, 16 nt, Staphylococcus aureus subsp. aureus MW2
uuuaauuaauuaucau

SEQ ID NO: 4007446 - RNA, 22 nt, Staphylococcus aureus subsp. aureus MW2
uuuaauucugguuuaaugagcu

SEQ ID NO: 4007447 - RNA, 18 nt, Staphylococcus aureus subsp. aureus MW2
uuuaauugcaaaugcucu

SEQ ID NO: 4007448 - RNA, 14 nt, Staphylococcus aureus subsp. aureus MW2
uuuaauugcuguaa

SEQ ID NO: 4007449 - RNA, 21 nt, Staphylococcus aureus subsp. aureus MW2
uuuaauuguuuaauaacaaaa

SEQ ID NO: 4007450 - RNA, 19 nt, Staphylococcus aureus subsp. aureus MW2
uuuaauuucugguaaaaaa

SEQ ID NO: 4007451 - RNA, 23 nt, Staphylococcus aureus subsp. aureus MW2
uuuaauuucugguaaaaaaauaa

SEQ ID NO: 4007452 - RNA, 20 nt, Staphylococcus aureus subsp. aureus MW2
uuuaauuugauuaaauucuu

SEQ ID NO: 4007453 - RNA, 14 nt, Staphylococcus aureus subsp. aureus MW2
uuuaauuuucuaaa

SEQ ID NO: 4007454 - RNA, 15 nt, Staphylococcus aureus subsp. aureus MW2
uuuaauuuucuaaag

SEQ ID NO: 4007455 - RNA, 17 nt, Staphylococcus aureus subsp. aureus MW2
uuuaauuuuucauuaau

SEQ ID NO: 4007456 - RNA, 21 nt, Staphylococcus aureus subsp. aureus MW2
uuuacaaaaugaugaaaauca

SEQ ID NO: 4007457 - RNA, 22 nt, Staphylococcus aureus subsp. aureus MW2
uuuacaagaacaugauacugaa

SEQ ID NO: 4007458 - RNA, 20 nt, Staphylococcus aureus subsp. aureus MW2
uuuacaagucuuauuuguuu

SEQ ID NO: 4007459 - RNA, 20 nt, Staphylococcus aureus subsp. aureus MW2
uuuacaauaugauuaauaaa

SEQ ID NO: 4007460 - RNA, 17 nt, Staphylococcus aureus subsp. aureus MW2
uuuacaucuauccuugu

SEQ ID NO: 4007461 - RNA, 20 nt, Staphylococcus aureus subsp. aureus MW2
uuuacauuuaacauuucaau

SEQ ID NO: 4007462 - RNA, 21 nt, Staphylococcus aureus subsp. aureus MW2
uuuacauuuaacauuucaauu

SEQ ID NO: 4007463 - RNA, 14 nt, Staphylococcus aureus subsp. aureus MW2
uuuaccacuuauaa

SEQ ID NO: 4007464 - RNA, 20 nt, Staphylococcus aureus subsp. aureus MW2
uuuaccauguuuuacaaguu

SEQ ID NO: 4007465 - RNA, 13 nt, Staphylococcus aureus subsp. aureus MW2
uuuaccuucaucu

SEQ ID NO: 4007466 - RNA, 14 nt, Staphylococcus aureus subsp. aureus MW2
uuuaccuucaucuu

SEQ ID NO: 4007467 - RNA, 22 nt, Staphylococcus aureus subsp. aureus MW2
uuuaccuucgcauacuuuuuca

SEQ ID NO: 4007468 - RNA, 13 nt, Staphylococcus aureus subsp. aureus MW2
uuuacgauaaaua

SEQ ID NO: 4007469 - RNA, 15 nt, Staphylococcus aureus subsp. aureus MW2
uuuacggauuuuucu

SEQ ID NO: 4007470 - RNA, 15 nt, Staphylococcus aureus subsp. aureus MW2
uuuacgugcauugua

SEQ ID NO: 4007471 - RNA, 14 nt, Staphylococcus aureus subsp. aureus MW2
uuuacguucugauu

SEQ ID NO: 4007472 - RNA, 14 nt, Staphylococcus aureus subsp. aureus MW2
uuuacuacaaagca

SEQ ID NO: 4007473 - RNA, 17 nt, Staphylococcus aureus subsp. aureus MW2
uuuauucagauauuaau

SEQ ID NO: 4007474 - RNA, 22 nt, Staphylococcus aureus subsp. aureus MW2
uuuauucccaccggacaaugua

SEQ ID NO: 4007475 - RNA, 21 nt, Staphylococcus aureus subsp. aureus MW2
uuuauugagcuuuguuugaaa

SEQ ID NO: 4007476 - RNA, 16 nt, Staphylococcus aureus subsp. aureus MW2
uuuauuggguaauauu

SEQ ID NO: 4007477 - RNA, 13 nt, Staphylococcus aureus subsp. aureus MW2
uuuauuuaacacu

SEQ ID NO: 4007478 - RNA, 20 nt, Staphylococcus aureus subsp. aureus MW2
uuuauuuaacacuucaguua

SEQ ID NO: 4007479 - RNA, 19 nt, Staphylococcus aureus subsp. aureus MW2
uuuauuuagaauaaacuuu

SEQ ID NO: 4007480 - RNA, 22 nt, Staphylococcus aureus subsp. aureus MW2
uuuauuuauaaaauaaaaugca

SEQ ID NO: 4007481 - RNA, 14 nt, Staphylococcus aureus subsp. aureus MW2
uuuauuuauucuaa

SEQ ID NO: 4007482 - RNA, 14 nt, Staphylococcus aureus subsp. aureus MW2
uuuauuugaaauaa

SEQ ID NO: 4007483 - RNA, 16 nt, Staphylococcus aureus subsp. aureus MW2
uuuauuugucuuugaa

SEQ ID NO: 4007484 - RNA, 12 nt, Staphylococcus aureus subsp. aureus MW2
uuuauuuuaaau

SEQ ID NO: 4007485 - RNA, 14 nt, Staphylococcus aureus subsp. aureus MW2
uuuauuuuauaaga

SEQ ID NO: 4007486 - RNA, 19 nt, Staphylococcus aureus subsp. aureus MW2
uuuauuuucaauaaauaaa

SEQ ID NO: 4007487 - RNA, 22 nt, Staphylococcus aureus subsp. aureus MW2
uuuauuuuuggauucaccaauu

SEQ ID NO: 4007488 - RNA, 11 nt, Staphylococcus aureus subsp. aureus MW2
uuuauuuuuuu

SEQ ID NO: 4007489 - RNA, 11 nt, Staphylococcus aureus subsp. aureus MW2
uuucaaaaaua

SEQ ID NO: 4007490 - RNA, 14 nt, Staphylococcus aureus subsp. aureus MW2
uuucaaaacuagca

SEQ ID NO: 4007491 - RNA, 20 nt, Staphylococcus aureus subsp. aureus MW2
uuucaaaaucaauugaaaaa

SEQ ID NO: 4007492 - RNA, 13 nt, Staphylococcus aureus subsp. aureus MW2
uuucaaacauauu

SEQ ID NO: 4007493 - RNA, 19 nt, Staphylococcus aureus subsp. aureus MW2
uuucaaacgauuuucaaaa

SEQ ID NO: 4007494 - RNA, 23 nt, Staphylococcus aureus subsp. aureus MW2
uuucaaagcugucaacuugucua

SEQ ID NO: 4007495 - RNA, 14 nt, Staphylococcus aureus subsp. aureus MW2
uuucaaauaagaau

SEQ ID NO: 4007496 - RNA, 15 nt, Staphylococcus aureus subsp. aureus MW2
uuucaaauaauauaa

SEQ ID NO: 4007497 - RNA, 22 nt, Staphylococcus aureus subsp. aureus MW2
uuucaaauaauauaaaacgaua

SEQ ID NO: 4007498 - RNA, 14 nt, Staphylococcus aureus subsp. aureus MW2
uuucaaauauaaaa

SEQ ID NO: 4007499 - RNA, 18 nt, Staphylococcus aureus subsp. aureus MW2
uuucaaaugugaaaguca

SEQ ID NO: 4007500 - RNA, 23 nt, Staphylococcus aureus subsp. aureus MW2
uuucaaaugugaaagucauccua

SEQ ID NO: 4007501 - RNA, 19 nt, Staphylococcus aureus subsp. aureus MW2
uuucaaauguguaaacuag

SEQ ID NO: 4007502 - RNA, 23 nt, Staphylococcus aureus subsp. aureus MW2
uuucaaauuaauuaaaccaauac

SEQ ID NO: 4007503 - RNA, 15 nt, Staphylococcus aureus subsp. aureus MW2
uuucaacaaaaugcg

SEQ ID NO: 4007504 - RNA, 16 nt, Staphylococcus aureus subsp. aureus MW2
uuucaacauaauauuu

SEQ ID NO: 4007505 - RNA, 11 nt, Staphylococcus aureus subsp. aureus MW2
uuucaacauuu

SEQ ID NO: 4007506 - RNA, 14 nt, Staphylococcus aureus subsp. aureus MW2
uuucaagaccaaau

SEQ ID NO: 4007507 - RNA, 17 nt, Staphylococcus aureus subsp. aureus MW2
uuucaagaccaaauauu

SEQ ID NO: 4007508 - RNA, 13 nt, Staphylococcus aureus subsp. aureus MW2
uuucaauaaauaa

SEQ ID NO: 4007509 - RNA, 15 nt, Staphylococcus aureus subsp. aureus MW2
uuucaauaaauuuua

SEQ ID NO: 4007510 - RNA, 12 nt, Staphylococcus aureus subsp. aureus MW2
uuucaauauuag

SEQ ID NO: 4007511 - RNA, 16 nt, Staphylococcus aureus subsp. aureus MW2
uuucaauccuuuguuu

SEQ ID NO: 4007512 - RNA, 21 nt, Staphylococcus aureus subsp. aureus MW2
uuucaauguuugcaucacuug

SEQ ID NO: 4007513 - RNA, 14 nt, Staphylococcus aureus subsp. aureus MW2
uuucaauuagaaaa

SEQ ID NO: 4007514 - RNA, 20 nt, Staphylococcus aureus subsp. aureus MW2
uuucaauuagaaaauuucuc

SEQ ID NO: 4007515 - RNA, 16 nt, Staphylococcus aureus subsp. aureus MW2
uuucaauuucuacuga

SEQ ID NO: 4007516 - RNA, 21 nt, Staphylococcus aureus subsp. aureus MW2
uuucacgauuuuuaaaaugcu

SEQ ID NO: 4007517 - RNA, 22 nt, Staphylococcus aureus subsp. aureus MW2
uuucacuacgucaagcuuugcu

SEQ ID NO: 4007518 - RNA, 17 nt, Staphylococcus aureus subsp. aureus MW2
uuucacucauauuacuu

SEQ ID NO: 4007519 - RNA, 19 nt, Staphylococcus aureus subsp. aureus MW2
uuucacuguuuuaucuaca

SEQ ID NO: 4007520 - RNA, 14 nt, Staphylococcus aureus subsp. aureus MW2
uuucacuucauaaa

SEQ ID NO: 4007521 - RNA, 13 nt, Staphylococcus aureus subsp. aureus MW2
uuucagaaugaac

SEQ ID NO: 4007522 - RNA, 14 nt, Staphylococcus aureus subsp. aureus MW2
uuucagagauauuu

SEQ ID NO: 4007523 - RNA, 18 nt, Staphylococcus aureus subsp. aureus MW2
uuucagcaucuacuaaau

SEQ ID NO: 4007524 - RNA, 18 nt, Staphylococcus aureus subsp. aureus MW2
uuucagccacugucaugu

SEQ ID NO: 4007525 - RNA, 19 nt, Staphylococcus aureus subsp. aureus MW2
uuucaggaauuguuaaaug

SEQ ID NO: 4007526 - RNA, 14 nt, Staphylococcus aureus subsp. aureus MW2
uuucaguagaugcu

SEQ ID NO: 4007527 - RNA, 17 nt, Staphylococcus aureus subsp. aureus MW2
uuucagucguuaaaaua

SEQ ID NO: 4007528 - RNA, 20 nt, Staphylococcus aureus subsp. aureus MW2
uuucauaaacugaaucgauu

SEQ ID NO: 4007529 - RNA, 16 nt, Staphylococcus aureus subsp. aureus MW2
uuucauaaaguuuauu

SEQ ID NO: 4007530 - RNA, 21 nt, Staphylococcus aureus subsp. aureus MW2
uuucauaaauauuuaaaauau

SEQ ID NO: 4007531 - RNA, 23 nt, Staphylococcus aureus subsp. aureus MW2
uuucauaaauauuuaaaauauua

SEQ ID NO: 4007532 - RNA, 13 nt, Staphylococcus aureus subsp. aureus MW2
uuucauaaucucu

SEQ ID NO: 4007533 - RNA, 13 nt, Staphylococcus aureus subsp. aureus MW2
uuucauaauguua

SEQ ID NO: 4007534 - RNA, 18 nt, Staphylococcus aureus subsp. aureus MW2
uuucauaauuaauaacau

SEQ ID NO: 4007535 - RNA, 19 nt, Staphylococcus aureus subsp. aureus MW2
uuucauaauuaauaacauc

SEQ ID NO: 4007536 - RNA, 23 nt, Staphylococcus aureus subsp. aureus MW2
uuucauauaaauagcuucuuaaa

SEQ ID NO: 4007537 - RNA, 20 nt, Staphylococcus aureus subsp. aureus MW2
uuucauaugcaucaacagau

SEQ ID NO: 4007538 - RNA, 14 nt, Staphylococcus aureus subsp. aureus MW2
uuucaucaaaucca

SEQ ID NO: 4007539 - RNA, 18 nt, Staphylococcus aureus subsp. aureus MW2
uuucaucaaauucaaauu

SEQ ID NO: 4007540 - RNA, 18 nt, Staphylococcus aureus subsp. aureus MW2
uuucaucaaauucucauu

SEQ ID NO: 4007541 - RNA, 14 nt, Staphylococcus aureus subsp. aureus MW2
uuucaucaauauca

SEQ ID NO: 4007542 - RNA, 22 nt, Staphylococcus aureus subsp. aureus MW2
uuucaucuucaacuuucucuaa

SEQ ID NO: 4007543 - RNA, 23 nt, Staphylococcus aureus subsp. aureus MW2
uuucaucuucaacuuucucuaaa

SEQ ID NO: 4007544 - RNA, 13 nt, Staphylococcus aureus subsp. aureus MW2
uuucaugaccaac

SEQ ID NO: 4007545 - RNA, 22 nt, Staphylococcus aureus subsp. aureus MW2
uuucaugugucacaaugaccau

SEQ ID NO: 4007546 - RNA, 20 nt, Staphylococcus aureus subsp. aureus MW2
uuucauguuugauucuaaau

SEQ ID NO: 4007547 - RNA, 22 nt, Staphylococcus aureus subsp. aureus MW2
uuucauguuugauucuaaauaa

SEQ ID NO: 4007548 - RNA, 19 nt, Staphylococcus aureus subsp. aureus MW2
uuucauuaauuuuuucguu

SEQ ID NO: 4007549 - RNA, 15 nt, Staphylococcus aureus subsp. aureus MW2
uuucauugaucgauu

SEQ ID NO: 4007550 - RNA, 15 nt, Staphylococcus aureus subsp. aureus MW2
uuucauuuuuauccc

SEQ ID NO: 4007551 - RNA, 18 nt, Staphylococcus aureus subsp. aureus MW2
uuucauuuuuucaauguc

SEQ ID NO: 4007552 - RNA, 14 nt, Staphylococcus aureus subsp. aureus MW2
uuuccaauccauua

SEQ ID NO: 4007553 - RNA, 20 nt, Staphylococcus aureus subsp. aureus MW2
uuuccauaaauaaaaugcua

SEQ ID NO: 4007554 - RNA, 14 nt, Staphylococcus aureus subsp. aureus MW2
uuucccuacugcuu

SEQ ID NO: 4007555 - RNA, 22 nt, Staphylococcus aureus subsp. aureus MW2
uuuccuauuaggauccaauuua

SEQ ID NO: 4007556 - RNA, 22 nt, Staphylococcus aureus subsp. aureus MW2
uuuccucaacgggaacaucaua

SEQ ID NO: 4007557 - RNA, 16 nt, Staphylococcus aureus subsp. aureus MW2
uuuccucacuagauag

SEQ ID NO: 4007558 - RNA, 19 nt, Staphylococcus aureus subsp. aureus MW2
uuuccucgguuuuauuuuu

SEQ ID NO: 4007559 - RNA, 22 nt, Staphylococcus aureus subsp. aureus MW2
uuuccucuuuaaagcuaaaugu

SEQ ID NO: 4007560 - RNA, 16 nt, Staphylococcus aureus subsp. aureus MW2
uuuccugcagucauuu

SEQ ID NO: 4007561 - RNA, 18 nt, Staphylococcus aureus subsp. aureus MW2
uuuccuguuacuuucaca

SEQ ID NO: 4007562 - RNA, 16 nt, Staphylococcus aureus subsp. aureus MW2
uuugauucuaaauaau

SEQ ID NO: 4007563 - RNA, 14 nt, Staphylococcus aureus subsp. aureus MW2
uuugauuguaauaa

SEQ ID NO: 4007564 - RNA, 13 nt, Staphylococcus aureus subsp. aureus MW2
uuugauuguuuaa

SEQ ID NO: 4007565 - RNA, 17 nt, Staphylococcus aureus subsp. aureus MW2
uuugauuuauauuuuuu

SEQ ID NO: 4007566 - RNA, 20 nt, Staphylococcus aureus subsp. aureus MW2
uuugauuuggguaauguuuu

SEQ ID NO: 4007567 - RNA, 12 nt, Staphylococcus aureus subsp. aureus MW2
uuugauuuuaau

SEQ ID NO: 4007568 - RNA, 17 nt, Staphylococcus aureus subsp. aureus MW2
uuugauuuugaauauaa

SEQ ID NO: 4007569 - RNA, 19 nt, Staphylococcus aureus subsp. aureus MW2
uuugcaaauuggaaaaaua

SEQ ID NO: 4007570 - RNA, 16 nt, Staphylococcus aureus subsp. aureus MW2
uuugcauacauaucuu

SEQ ID NO: 4007571 - RNA, 13 nt, Staphylococcus aureus subsp. aureus MW2
uuugcaugaaaau

SEQ ID NO: 4007572 - RNA, 21 nt, Staphylococcus aureus subsp. aureus MW2
uuugccagucauuguauaaaa

SEQ ID NO: 4007573 - RNA, 22 nt, Staphylococcus aureus subsp. aureus MW2
uuugcgaaaauaucauuucugu

SEQ ID NO: 4007574 - RNA, 14 nt, Staphylococcus aureus subsp. aureus MW2
uuugcgguguggcg

SEQ ID NO: 4007575 - RNA, 17 nt, Staphylococcus aureus subsp. aureus MW2
uuugcuaugauguguua

SEQ ID NO: 4007576 - RNA, 22 nt, Staphylococcus aureus subsp. aureus MW2
uuugcucuaaacuucuauuaau

SEQ ID NO: 4007577 - RNA, 17 nt, Staphylococcus aureus subsp. aureus MW2
uuugcuuaaaccuuaau

SEQ ID NO: 4007578 - RNA, 23 nt, Staphylococcus aureus subsp. aureus MW2
uuugcuuuagcucuuuuuugauu

SEQ ID NO: 4007579 - RNA, 18 nt, Staphylococcus aureus subsp. aureus MW2
uuugcuuuauuuucuugu

SEQ ID NO: 4007580 - RNA, 16 nt, Staphylococcus aureus subsp. aureus MW2
uuugcuuuuuguaaug

SEQ ID NO: 4007581 - RNA, 14 nt, Staphylococcus aureus subsp. aureus MW2
uuuggaaauaucuu

SEQ ID NO: 4007582 - RNA, 15 nt, Staphylococcus aureus subsp. aureus MW2
uuuggaacauauuca

SEQ ID NO: 4007583 - RNA, 16 nt, Staphylococcus aureus subsp. aureus MW2
uuuggaauacuuuucu

SEQ ID NO: 4007584 - RNA, 19 nt, Staphylococcus aureus subsp. aureus MW2
uuuggaugaacaaaauaac

SEQ ID NO: 4007585 - RNA, 14 nt, Staphylococcus aureus subsp. aureus MW2
uuuggauuccaucu

SEQ ID NO: 4007586 - RNA, 19 nt, Staphylococcus aureus subsp. aureus MW2
uuuggauuucuuuuuaaaa

SEQ ID NO: 4007587 - RNA, 21 nt, Staphylococcus aureus subsp. aureus MW2
uuuggauuucuuuuuaaaauc

SEQ ID NO: 4007588 - RNA, 22 nt, Staphylococcus aureus subsp. aureus MW2
uuugggaauuguauuaaucaaa

SEQ ID NO: 4007589 - RNA, 15 nt, Staphylococcus aureus subsp. aureus MW2
uuugggcuuuuucac

SEQ ID NO: 4007590 - RNA, 17 nt, Staphylococcus aureus subsp. aureus MW2
uuugguaggcauuuuau

SEQ ID NO: 4007591 - RNA, 12 nt, Staphylococcus aureus subsp. aureus MW2
uuuggucaaguu

SEQ ID NO: 4007592 - RNA, 18 nt, Staphylococcus aureus subsp. aureus MW2
uuuggucaaguuuugguc

SEQ ID NO: 4007593 - RNA, 15 nt, Staphylococcus aureus subsp. aureus MW2
uuugguuugcuuuaa

SEQ ID NO: 4007594 - RNA, 22 nt, Staphylococcus aureus subsp. aureus MW2
uuuguaaagcuuuaguuaaaua

SEQ ID NO: 4007595 - RNA, 20 nt, Staphylococcus aureus subsp. aureus MW2
uuuguaaauauuuuuuaaaa

SEQ ID NO: 4007596 - RNA, 14 nt, Staphylococcus aureus subsp. aureus MW2
uuuguaaauuuuua

SEQ ID NO: 4007597 - RNA, 23 nt, Staphylococcus aureus subsp. aureus MW2
uuuguaaccccauuuuaaaguca

SEQ ID NO: 4007598 - RNA, 17 nt, Staphylococcus aureus subsp. aureus MW2
uuuguaacguucuuaua

SEQ ID NO: 4007599 - RNA, 19 nt, Staphylococcus aureus subsp. aureus MW2
uuuguaauacaagcaauac

SEQ ID NO: 4007600 - RNA, 13 nt, Staphylococcus aureus subsp. aureus MW2
uuuguaauacauc

SEQ ID NO: 4007601 - RNA, 18 nt, Staphylococcus aureus subsp. aureus MW2
uuuguaauucuuguaaau

SEQ ID NO: 4007602 - RNA, 16 nt, Staphylococcus aureus subsp. aureus MW2
uuuguacauaaaaaua

SEQ ID NO: 4007603 - RNA, 15 nt, Staphylococcus aureus subsp. aureus MW2
uuuguauuguuugaa

SEQ ID NO: 4007604 - RNA, 14 nt, Staphylococcus aureus subsp. aureus MW2
uuuguauuuaaaau

SEQ ID NO: 4007605 - RNA, 12 nt, Staphylococcus aureus subsp. aureus MW2
uuuguauuuaug

SEQ ID NO: 4007606 - RNA, 20 nt, Staphylococcus aureus subsp. aureus MW2
uuuguccgauuuauuugaga

SEQ ID NO: 4007607 - RNA, 13 nt, Staphylococcus aureus subsp. aureus MW2
uuugucguuacua

SEQ ID NO: 4007608 - RNA, 17 nt, Staphylococcus aureus subsp. aureus MW2
uuugugcuuuuuuguuu

SEQ ID NO: 4007609 - RNA, 22 nt, Staphylococcus aureus subsp. aureus MW2
uuuguggcgcaguuugcaaagc

SEQ ID NO: 4007610 - RNA, 11 nt, Staphylococcus aureus subsp. aureus MW2
uuugugguaau

SEQ ID NO: 4007611 - RNA, 16 nt, Staphylococcus aureus subsp. aureus MW2
uuuguuaaaaaauuaa

SEQ ID NO: 4007612 - RNA, 17 nt, Staphylococcus aureus subsp. aureus MW2
uuuguuaaaaaauuaaa

SEQ ID NO: 4007613 - RNA, 16 nt, Staphylococcus aureus subsp. aureus MW2
uuuguuauaucuaauu

SEQ ID NO: 4007614 - RNA, 14 nt, Staphylococcus aureus subsp. aureus MW2
uuuguucaaucacu

SEQ ID NO: 4007615 - RNA, 17 nt, Staphylococcus aureus subsp. aureus MW2
uuuguucaaucacuaua

SEQ ID NO: 4007616 - RNA, 14 nt, Staphylococcus aureus subsp. aureus MW2
uuuguuguuauaua

SEQ ID NO: 4007617 - RNA, 13 nt, Staphylococcus aureus subsp. aureus MW2
uuuguuucuaaau

SEQ ID NO: 4007618 - RNA, 16 nt, Staphylococcus aureus subsp. aureus MW2
uuuguuuuaaauacuu

SEQ ID NO: 4007619 - RNA, 13 nt, Staphylococcus aureus subsp. aureus MW2
uuuguuuuuauau

SEQ ID NO: 4007620 - RNA, 15 nt, Staphylococcus aureus subsp. aureus MW2
uuuuaaaaaacauac

SEQ ID NO: 4007621 - RNA, 22 nt, Staphylococcus aureus subsp. aureus MW2
uuuuaaaaaacauaccugcaua

SEQ ID NO: 4007622 - RNA, 12 nt, Staphylococcus aureus subsp. aureus MW2
uuuuaaaaaccu

SEQ ID NO: 4007623 - RNA, 17 nt, Staphylococcus aureus subsp. aureus MW2
uuuuaaaagauaaauaa

SEQ ID NO: 4007624 - RNA, 20 nt, Staphylococcus aureus subsp. aureus MW2
uuuuaaaauauuaaucaauu

SEQ ID NO: 4007625 - RNA, 14 nt, Staphylococcus aureus subsp. aureus MW2
uuuuaaaaugauag

SEQ ID NO: 4007626 - RNA, 21 nt, Staphylococcus aureus subsp. aureus MW2
uuuuaaaauuaugauuauuuu

SEQ ID NO: 4007627 - RNA, 16 nt, Staphylococcus aureus subsp. aureus MW2
uuuuaaacaaaaauaa

SEQ ID NO: 4007628 - RNA, 14 nt, Staphylococcus aureus subsp. aureus MW2
uuuuaaacaaauaa

SEQ ID NO: 4007629 - RNA, 22 nt, Staphylococcus aureus subsp. aureus MW2
uuuuaaacaugaacaaucagau

SEQ ID NO: 4007630 - RNA, 23 nt, Staphylococcus aureus subsp. aureus MW2
uuuuaaacucauccauugaucuu

SEQ ID NO: 4007631 - RNA, 18 nt, Staphylococcus aureus subsp. aureus MW2
uuuuaaagaaaaguuuag

SEQ ID NO: 4007632 - RNA, 11 nt, Staphylococcus aureus subsp. aureus MW2
uuuuaaaggac

SEQ ID NO: 4007633 - RNA, 16 nt, Staphylococcus aureus subsp. aureus MW2
uuuuaaauaaaaugca

SEQ ID NO: 4007634 - RNA, 18 nt, Staphylococcus aureus subsp. aureus MW2
uuuuaaaucuacaauauu

SEQ ID NO: 4007635 - RNA, 13 nt, Staphylococcus aureus subsp. aureus MW2
uuuuaaaucuuuu

SEQ ID NO: 4007636 - RNA, 15 nt, Staphylococcus aureus subsp. aureus MW2
uuuuaaauucuuaua

SEQ ID NO: 4007637 - RNA, 21 nt, Staphylococcus aureus subsp. aureus MW2
uuuuaaauucuuauaaaauaa

SEQ ID NO: 4007638 - RNA, 13 nt, Staphylococcus aureus subsp. aureus MW2
uuuuaaauuuaag

SEQ ID NO: 4007639 - RNA, 12 nt, Staphylococcus aureus subsp. aureus MW2
uuuuaaauuuag

SEQ ID NO: 4007640 - RNA, 21 nt, Staphylococcus aureus subsp. aureus MW2
uuuuaaauuuaguaucucauu

SEQ ID NO: 4007641 - RNA, 17 nt, Staphylococcus aureus subsp. aureus MW2
uuuuaaauuuuuuaaua

SEQ ID NO: 4007642 - RNA, 15 nt, Staphylococcus aureus subsp. aureus MW2
uuuuaacaaaauaua

SEQ ID NO: 4007643 - RNA, 17 nt, Staphylococcus aureus subsp. aureus MW2
uuuuaacaaaauauacu

SEQ ID NO: 4007644 - RNA, 21 nt, Staphylococcus aureus subsp. aureus MW2
uuuuaacaaaauauacuaaau

SEQ ID NO: 4007645 - RNA, 23 nt, Staphylococcus aureus subsp. aureus MW2
uuuuaacaagugaugaaaaagag

SEQ ID NO: 4007646 - RNA, 21 nt, Staphylococcus aureus subsp. aureus MW2
uuuuaacauagcuuaauaauu

SEQ ID NO: 4007647 - RNA, 13 nt, Staphylococcus aureus subsp. aureus MW2
uuuuaacaucauu

SEQ ID NO: 4007648 - RNA, 17 nt, Staphylococcus aureus subsp. aureus MW2
uuuuaagaucaauauca

SEQ ID NO: 4007649 - RNA, 24 nt, Staphylococcus aureus subsp. aureus MW2
uuuuaaggcagcuaaaaaguauac

SEQ ID NO: 4007650 - RNA, 12 nt, Staphylococcus aureus subsp. aureus MW2
uuuuaagugaug

SEQ ID NO: 4007651 - RNA, 15 nt, Staphylococcus aureus subsp. aureus MW2
uuuucaauauuugau

SEQ ID NO: 4007652 - RNA, 13 nt, Staphylococcus aureus subsp. aureus MW2
uuuucaauuucua

SEQ ID NO: 4007653 - RNA, 16 nt, Staphylococcus aureus subsp. aureus MW2
uuuucacgaauaucuu

SEQ ID NO: 4007654 - RNA, 22 nt, Staphylococcus aureus subsp. aureus MW2
uuuucacgaauaucuuaaagaa

SEQ ID NO: 4007655 - RNA, 22 nt, Staphylococcus aureus subsp. aureus MW2
uuuucagcuaauugucguucuu

SEQ ID NO: 4007656 - RNA, 18 nt, Staphylococcus aureus subsp. aureus MW2
uuuucauaaauauuuaaa

SEQ ID NO: 4007657 - RNA, 21 nt, Staphylococcus aureus subsp. aureus MW2
uuuucauaaauauuuaaaaua

SEQ ID NO: 4007658 - RNA, 20 nt, Staphylococcus aureus subsp. aureus MW2
uuuucauagaacaaaaugua

SEQ ID NO: 4007659 - RNA, 18 nt, Staphylococcus aureus subsp. aureus MW2
uuuucauauaauuuuaau

SEQ ID NO: 4007660 - RNA, 18 nt, Staphylococcus aureus subsp. aureus MW2
uuuucaucauuaaaauca

SEQ ID NO: 4007661 - RNA, 21 nt, Staphylococcus aureus subsp. aureus MW2
uuuucaugugucauaauccau

SEQ ID NO: 4007662 - RNA, 13 nt, Staphylococcus aureus subsp. aureus MW2
uuuuccaacuucu

SEQ ID NO: 4007663 - RNA, 19 nt, Staphylococcus aureus subsp. aureus MW2
uuuuccaacuucuuuugua

SEQ ID NO: 4007664 - RNA, 19 nt, Staphylococcus aureus subsp. aureus MW2
uuuuccuaaaccucuaaau

SEQ ID NO: 4007665 - RNA, 22 nt, Staphylococcus aureus subsp. aureus MW2
uuuuccuuuugaauaauaaacu

SEQ ID NO: 4007666 - RNA, 15 nt, Staphylococcus aureus subsp. aureus MW2
uuuucgccaaaaacu

SEQ ID NO: 4007667 - RNA, 20 nt, Staphylococcus aureus subsp. aureus MW2
uuuucguuaacucuaucuau

SEQ ID NO: 4007668 - RNA, 14 nt, Staphylococcus aureus subsp. aureus MW2
uuuucuaaacaacu

SEQ ID NO: 4007669 - RNA, 22 nt, Staphylococcus aureus subsp. aureus MW2
uuuucuaaagcuugaucaaauu

SEQ ID NO: 4007670 - RNA, 14 nt, Staphylococcus aureus subsp. aureus MW2
uuuucuaauuguuu

SEQ ID NO: 4007671 - RNA, 22 nt, Staphylococcus aureus subsp. aureus MW2
uuuucuagguaauacgaaugca

SEQ ID NO: 4007672 - RNA, 23 nt, Staphylococcus aureus subsp. aureus MW2
uuuucucaacaguuucuuggucu

SEQ ID NO: 4007673 - RNA, 19 nt, Staphylococcus aureus subsp. aureus MW2
uuuucuggucacuaaugca

SEQ ID NO: 4007674 - RNA, 19 nt, Staphylococcus aureus subsp. aureus MW2
uuuucuguccaaaaagguu

SEQ ID NO: 4007675 - RNA, 21 nt, Staphylococcus aureus subsp. aureus MW2
uuuucugugaccaauagaauu

SEQ ID NO: 4007676 - RNA, 23 nt, Staphylococcus aureus subsp. aureus MW2
uuuucuuaaacgcucuucuucuu

SEQ ID NO: 4007677 - RNA, 17 nt, Staphylococcus aureus subsp. aureus MW2
uuuucuuccacacaaau

SEQ ID NO: 4007678 - RNA, 17 nt, Staphylococcus aureus subsp. aureus MW2
uuuucuugaaauaaaca

SEQ ID NO: 4007679 - RNA, 22 nt, Staphylococcus aureus subsp. aureus MW2
uuuucuugcauacgaauuaaaa

SEQ ID NO: 4007680 - RNA, 16 nt, Staphylococcus aureus subsp. aureus MW2
uuuucuugguuugaga

SEQ ID NO: 4007681 - RNA, 22 nt, Staphylococcus aureus subsp. aureus MW2
uuuucuuuauuuuaaacaugaa

SEQ ID NO: 4007682 - RNA, 12 nt, Staphylococcus aureus subsp. aureus MW2
uuuucuuuuguu

SEQ ID NO: 4007683 - RNA, 16 nt, Staphylococcus aureus subsp. aureus MW2
uuuugaaacaucuaaa

SEQ ID NO: 4007684 - RNA, 22 nt, Staphylococcus aureus subsp. aureus MW2
uuuugaaacaucuaaauaguuu

SEQ ID NO: 4007685 - RNA, 13 nt, Staphylococcus aureus subsp. aureus MW2
uuuugaaauggua

SEQ ID NO: 4007686 - RNA, 19 nt, Staphylococcus aureus subsp. aureus MW2
uuuugaagggacaaugaag

SEQ ID NO: 4007687 - RNA, 21 nt, Staphylococcus aureus subsp. aureus MW2
uuuugaaucacauuaacaagg

SEQ ID NO: 4007688 - RNA, 19 nt, Staphylococcus aureus subsp. aureus MW2
uuuugaaucauacgaauuu

SEQ ID NO: 4007689 - RNA, 18 nt, Staphylococcus aureus subsp. aureus MW2
uuuugaauguuucuccua

SEQ ID NO: 4007690 - RNA, 13 nt, Staphylococcus aureus subsp. aureus MW2
uuuugaauuacag

SEQ ID NO: 4007691 - RNA, 19 nt, Staphylococcus aureus subsp. aureus MW2
uuuugaauuacagauuucu

SEQ ID NO: 4007692 - RNA, 19 nt, Staphylococcus aureus subsp. aureus MW2
uuuugagagauuauuuaaa

SEQ ID NO: 4007693 - RNA, 20 nt, Staphylococcus aureus subsp. aureus MW2
uuuugagagauuauuuaaaa

SEQ ID NO: 4007694 - RNA, 12 nt, Staphylococcus aureus subsp. aureus MW2
uuuugagauauu

SEQ ID NO: 4007695 - RNA, 21 nt, Staphylococcus aureus subsp. aureus MW2
uuuugagcacuuaauaaguca

SEQ ID NO: 4007696 - RNA, 13 nt, Staphylococcus aureus subsp. aureus MW2
uuuugauauaaaa

SEQ ID NO: 4007697 - RNA, 19 nt, Staphylococcus aureus subsp. aureus MW2
uuuugauuaguaaauauag

SEQ ID NO: 4007698 - RNA, 18 nt, Staphylococcus aureus subsp. aureus MW2
uuuugauuuacgugcauu

SEQ ID NO: 4007699 - RNA, 14 nt, Staphylococcus aureus subsp. aureus MW2
uuuugauuuuaaua

SEQ ID NO: 4007700 - RNA, 14 nt, Staphylococcus aureus subsp. aureus MW2
uuuugcaaaauuuu

SEQ ID NO: 4007701 - RNA, 21 nt, Staphylococcus aureus subsp. aureus MW2
uuuugcaucacagauaaugca

SEQ ID NO: 4007702 - RNA, 15 nt, Staphylococcus aureus subsp. aureus MW2
uuuugcgaaaauauc

SEQ ID NO: 4007703 - RNA, 21 nt, Staphylococcus aureus subsp. aureus MW2
uuuugcgaccggauguuucuu

SEQ ID NO: 4007704 - RNA, 16 nt, Staphylococcus aureus subsp. aureus MW2
uuuugcgcuucuagua

SEQ ID NO: 4007705 - RNA, 15 nt, Staphylococcus aureus subsp. aureus MW2
uuuugcuaaccauca

SEQ ID NO: 4007706 - RNA, 14 nt, Staphylococcus aureus subsp. aureus MW2
uuuugcuguauaua

SEQ ID NO: 4007707 - RNA, 13 nt, Staphylococcus aureus subsp. aureus MW2
uuuuggaaacaug

SEQ ID NO: 4007708 - RNA, 17 nt, Staphylococcus aureus subsp. aureus MW2
uuuuggucaaguaaaug

SEQ ID NO: 4007709 - RNA, 18 nt, Staphylococcus aureus subsp. aureus MW2
uuuuguaacguucuuaua

SEQ ID NO: 4007710 - RNA, 12 nt, Staphylococcus aureus subsp. aureus MW2
uuuuguauaucu

SEQ ID NO: 4007711 - RNA, 16 nt, Staphylococcus aureus subsp. aureus MW2
uuuugugauuuuuaau

SEQ ID NO: 4007712 - RNA, 17 nt, Staphylococcus aureus subsp. aureus MW2
uuuuguguucggaauuu

SEQ ID NO: 4007713 - RNA, 14 nt, Staphylococcus aureus subsp. aureus MW2
uuuuguuaauuuuu

SEQ ID NO: 4007714 - RNA, 22 nt, Staphylococcus aureus subsp. aureus MW2
uuuuguugcucagugcauuuuu

SEQ ID NO: 4007715 - RNA, 17 nt, Staphylococcus aureus subsp. aureus MW2
uuuuuaaaaaauuuaaa

SEQ ID NO: 4007716 - RNA, 22 nt, Staphylococcus aureus subsp. aureus MW2
uuuuuaaaaaauuuaaauaaua

SEQ ID NO: 4007717 - RNA, 14 nt, Staphylococcus aureus subsp. aureus MW2
uuuuuaaaaauaca

SEQ ID NO: 4007718 - RNA, 19 nt, Staphylococcus aureus subsp. aureus MW2
uuuuuaaaauuaucaauug

SEQ ID NO: 4007719 - RNA, 16 nt, Staphylococcus aureus subsp. aureus MW2
uuuuuaaagcugggga

SEQ ID NO: 4007720 - RNA, 11 nt, Staphylococcus aureus subsp. aureus MW2
uuuuuaaauac

SEQ ID NO: 4007721 - RNA, 17 nt, Staphylococcus aureus subsp. aureus MW2
uuuuuaaaugcuuuaaa

SEQ ID NO: 4007722 - RNA, 13 nt, Staphylococcus aureus subsp. aureus MW2
uuuuuaaauuuaa

SEQ ID NO: 4007723 - RNA, 18 nt, Staphylococcus aureus subsp. aureus MW2
uuuuuaacaaaauauacu

SEQ ID NO: 4007724 - RNA, 19 nt, Staphylococcus aureus subsp. aureus MW2
uuuuuaacaaaauauacua

SEQ ID NO: 4007725 - RNA, 23 nt, Staphylococcus aureus subsp. aureus MW2
uuuuuaacauagcuuaauaauua

SEQ ID NO: 4007726 - RNA, 13 nt, Staphylococcus aureus subsp. aureus MW2
uuuuuaacuaaua

SEQ ID NO: 4007727 - RNA, 16 nt, Staphylococcus aureus subsp. aureus MW2
uuuuuaacugccauau

SEQ ID NO: 4007728 - RNA, 18 nt, Staphylococcus aureus subsp. aureus MW2
uuuuuaacuuuaacaucu

SEQ ID NO: 4007729 - RNA, 23 nt, Staphylococcus aureus subsp. aureus MW2
uuuuuaacuuuaacaucugaauc

SEQ ID NO: 4007730 - RNA, 16 nt, Staphylococcus aureus subsp. aureus MW2
uuuuuaauauauuuau

SEQ ID NO: 4007731 - RNA, 19 nt, Staphylococcus aureus subsp. aureus MW2
uuuuuaauuuguauuuaaa

SEQ ID NO: 4007732 - RNA, 22 nt, Staphylococcus aureus subsp. aureus MW2
uuuuuacaauaugauuaauaaa

SEQ ID NO: 4007733 - RNA, 19 nt, Staphylococcus aureus subsp. aureus MW2
uuuuuacuaggaauauaaa

SEQ ID NO: 4007734 - RNA, 20 nt, Staphylococcus aureus subsp. aureus MW2
uuuuuagacauuaaaaaauc

SEQ ID NO: 4007735 - RNA, 18 nt, Staphylococcus aureus subsp. aureus MW2
uuuuuagccccagcaaau

SEQ ID NO: 4007736 - RNA, 15 nt, Staphylococcus aureus subsp. aureus MW2
uuuuuaguaauaaca

SEQ ID NO: 4007737 - RNA, 18 nt, Staphylococcus aureus subsp. aureus MW2
uuuuuauaaguauucaua

SEQ ID NO: 4007738 - RNA, 23 nt, Staphylococcus aureus subsp. aureus MW2
uuuuuauauuauuucaauacccu

SEQ ID NO: 4007739 - RNA, 13 nt, Staphylococcus aureus subsp. aureus MW2
aaaaaaauagcuc

SEQ ID NO: 4007740 - RNA, 17 nt, Staphylococcus aureus subsp. aureus MW2
aaaacaauaaaauuacu

SEQ ID NO: 4007741 - RNA, 15 nt, Staphylococcus aureus subsp. aureus MW2
aaaacaauaauaaua

SEQ ID NO: 4007742 - RNA, 17 nt, Staphylococcus aureus subsp. aureus MW2
aaaacaaugauuaaaau

SEQ ID NO: 4007743 - RNA, 22 nt, Staphylococcus aureus subsp. aureus MW2
aaaacacccugcuuaucauuac

SEQ ID NO: 4007744 - RNA, 22 nt, Staphylococcus aureus subsp. aureus MW2
aaaacagaggucuucgcaauca

SEQ ID NO: 4007745 - RNA, 15 nt, Staphylococcus aureus subsp. aureus MW2
aaaacagcaaauaaa

SEQ ID NO: 4007746 - RNA, 21 nt, Staphylococcus aureus subsp. aureus MW2
aaaacagcaguaagauauuuc

SEQ ID NO: 4007747 - RNA, 18 nt, Staphylococcus aureus subsp. aureus MW2
aaaacagguggaaguguu

SEQ ID NO: 4007748 - RNA, 19 nt, Staphylococcus aureus subsp. aureus MW2
aaaacaguguagcacaaga

SEQ ID NO: 4007749 - RNA, 17 nt, Staphylococcus aureus subsp. aureus MW2
aaaacauaaauacaaaa

SEQ ID NO: 4007750 - RNA, 14 nt, Staphylococcus aureus subsp. aureus MW2
aaaacauaaucauu

SEQ ID NO: 4007751 - RNA, 15 nt, Staphylococcus aureus subsp. aureus MW2
aaaacaucuacauca

SEQ ID NO: 4007752 - RNA, 19 nt, Staphylococcus aureus subsp. aureus MW2
aaaacauucccuuaauaau

SEQ ID NO: 4007753 - RNA, 20 nt, Staphylococcus aureus subsp. aureus MW2
aaaacauucccuuaauaaua

SEQ ID NO: 4007754 - RNA, 21 nt, Staphylococcus aureus subsp. aureus MW2
aaaacauuggcgaggccccaa

SEQ ID NO: 4007755 - RNA, 13 nt, Staphylococcus aureus subsp. aureus MW2
aaaacauuuugug

SEQ ID NO: 4007756 - RNA, 16 nt, Staphylococcus aureus subsp. aureus MW2
aaaaccaaaauacuga

SEQ ID NO: 4007757 - RNA, 21 nt, Staphylococcus aureus subsp. aureus MW2
aaaaccccuguugaacuuuag

SEQ ID NO: 4007758 - RNA, 15 nt, Staphylococcus aureus subsp. aureus MW2
aaaaccgaaaauacc

SEQ ID NO: 4007759 - RNA, 17 nt, Staphylococcus aureus subsp. aureus MW2
aaaaccgaacaucugaa

SEQ ID NO: 4007760 - RNA, 21 nt, Staphylococcus aureus subsp. aureus MW2
aaaaccgaacaucugaaaaaa

SEQ ID NO: 4007761 - RNA, 15 nt, Staphylococcus aureus subsp. aureus MW2
aaaaccgagaaucuc

SEQ ID NO: 4007762 - RNA, 20 nt, Staphylococcus aureus subsp. aureus MW2
aaaaccgaggaaauccuuaa

SEQ ID NO: 4007763 - RNA, 21 nt, Staphylococcus aureus subsp. aureus MW2
aaaaccgcuauaaaauuuuga

SEQ ID NO: 4007764 - RNA, 20 nt, Staphylococcus aureus subsp. aureus MW2
aaaaccuauuccuaauaaau

SEQ ID NO: 4007765 - RNA, 13 nt, Staphylococcus aureus subsp. aureus MW2
aaaaccucuuuuu

SEQ ID NO: 4007766 - RNA, 20 nt, Staphylococcus aureus subsp. aureus MW2
aaaacgagcuggugagaaau

SEQ ID NO: 4007767 - RNA, 18 nt, Staphylococcus aureus subsp. aureus MW2
aaaacgauuaauaguuuu

SEQ ID NO: 4007768 - RNA, 19 nt, Staphylococcus aureus subsp. aureus MW2
aaaacgcaauaacacauca

SEQ ID NO: 4007769 - RNA, 14 nt, Staphylococcus aureus subsp. aureus MW2
aaaacuaaagggac

SEQ ID NO: 4007770 - RNA, 14 nt, Staphylococcus aureus subsp. aureus MW2
aaaacuauuuuuua

SEQ ID NO: 4007771 - RNA, 18 nt, Staphylococcus aureus subsp. aureus MW2
aaaacugaaguaaaaagc

SEQ ID NO: 4007772 - RNA, 17 nt, Staphylococcus aureus subsp. aureus MW2
aaaacuguaaaucauca

SEQ ID NO: 4007773 - RNA, 21 nt, Staphylococcus aureus subsp. aureus MW2
aaaacuuagaacaguuagaaa

SEQ ID NO: 4007774 - RNA, 13 nt, Staphylococcus aureus subsp. aureus MW2
aaaacuuguaaau

SEQ ID NO: 4007775 - RNA, 18 nt, Staphylococcus aureus subsp. aureus MW2
aaaacuuguuguuauuua

SEQ ID NO: 4007776 - RNA, 18 nt, Staphylococcus aureus subsp. aureus MW2
aaaagaacauucuaacua

SEQ ID NO: 4007777 - RNA, 20 nt, Staphylococcus aureus subsp. aureus MW2
aaaagaauuauucaaguaaa

SEQ ID NO: 4007778 - RNA, 12 nt, Staphylococcus aureus subsp. aureus MW2
aaaagacagaaa

SEQ ID NO: 4007779 - RNA, 22 nt, Staphylococcus aureus subsp. aureus MW2
aaaagacggugaccuuauauuu

SEQ ID NO: 4007780 - RNA, 16 nt, Staphylococcus aureus subsp. aureus MW2
aaaagacuacaaguua

SEQ ID NO: 4007781 - RNA, 22 nt, Staphylococcus aureus subsp. aureus MW2
aaaagagaaacaaaacaaaaaa

SEQ ID NO: 4007782 - RNA, 17 nt, Staphylococcus aureus subsp. aureus MW2
aaaagagaauauaaaau

SEQ ID NO: 4007783 - RNA, 22 nt, Staphylococcus aureus subsp. aureus MW2
aaaagagauuuuuuugaaaagu

SEQ ID NO: 4007784 - RNA, 18 nt, Staphylococcus aureus subsp. aureus MW2
aaaagagguuuucauuaa

SEQ ID NO: 4007785 - RNA, 13 nt, Staphylococcus aureus subsp. aureus MW2
aaaagaguacauu

SEQ ID NO: 4007786 - RNA, 17 nt, Staphylococcus aureus subsp. aureus MW2
aaaagaguuaauaaaau

SEQ ID NO: 4007787 - RNA, 16 nt, Staphylococcus aureus subsp. aureus MW2
aaaagauaaauaaaag

SEQ ID NO: 4007788 - RNA, 18 nt, Staphylococcus aureus subsp. aureus MW2
aaaagaugaaaaucuuua

SEQ ID NO: 4007789 - RNA, 21 nt, Staphylococcus aureus subsp. aureus MW2
aaaagaugguuuuguuuugcu

SEQ ID NO: 4007790 - RNA, 19 nt, Staphylococcus aureus subsp. aureus MW2
aaaagcagucgaacaauga

SEQ ID NO: 4007791 - RNA, 13 nt, Staphylococcus aureus subsp. aureus MW2
aaaagcaucuuua

SEQ ID NO: 4007792 - RNA, 23 nt, Staphylococcus aureus subsp. aureus MW2
aaaagcaugauacucaauaaaau

SEQ ID NO: 4007793 - RNA, 13 nt, Staphylococcus aureus subsp. aureus MW2
aaaagccaccuau

SEQ ID NO: 4007794 - RNA, 19 nt, Staphylococcus aureus subsp. aureus MW2
aaaagccaucuuaccuuua

SEQ ID NO: 4007795 - RNA, 22 nt, Staphylococcus aureus subsp. aureus MW2
aaaagccuacuuugucugcaau

SEQ ID NO: 4007796 - RNA, 14 nt, Staphylococcus aureus subsp. aureus MW2
aaaagcuagaaguu

SEQ ID NO: 4007797 - RNA, 15 nt, Staphylococcus aureus subsp. aureus MW2
aaaagcuagaaguuc

SEQ ID NO: 4007798 - RNA, 21 nt, Staphylococcus aureus subsp. aureus MW2
aaaagcuagaaguucuuaugc

SEQ ID NO: 4007799 - RNA, 23 nt, Staphylococcus aureus subsp. aureus MW2
aaaagcugaugugacaaaguuua

SEQ ID NO: 4007800 - RNA, 18 nt, Staphylococcus aureus subsp. aureus MW2
aaaagcugauuucuauca

SEQ ID NO: 4007801 - RNA, 18 nt, Staphylococcus aureus subsp. aureus MW2
aaaagcuguaguuucaac

SEQ ID NO: 4007802 - RNA, 19 nt, Staphylococcus aureus subsp. aureus MW2
aaaaggcgaaacauuaaaa

SEQ ID NO: 4007803 - RNA, 16 nt, Staphylococcus aureus subsp. aureus MW2
aaaagguuaauauuaa

SEQ ID NO: 4007804 - RNA, 22 nt, Staphylococcus aureus subsp. aureus MW2
aaaagguuaauauuaaauuuug

SEQ ID NO: 4007805 - RNA, 22 nt, Staphylococcus aureus subsp. aureus MW2
aaaaguaaaaucuuuaacauuu

SEQ ID NO: 4007806 - RNA, 14 nt, Staphylococcus aureus subsp. aureus MW2
aaaaguaguugaaa

SEQ ID NO: 4007807 - RNA, 13 nt, Staphylococcus aureus subsp. aureus MW2
aaaagucaaagag

SEQ ID NO: 4007808 - RNA, 14 nt, Staphylococcus aureus subsp. aureus MW2
aaaagucaaagagg

SEQ ID NO: 4007809 - RNA, 15 nt, Staphylococcus aureus subsp. aureus MW2
aaaagucaaagagga

SEQ ID NO: 4007810 - RNA, 19 nt, Staphylococcus aureus subsp. aureus MW2
aaaagucccgcuuaaaaug

SEQ ID NO: 4007811 - RNA, 22 nt, Staphylococcus aureus subsp. aureus MW2
aaaagucccgcuuaaaaugauu

SEQ ID NO: 4007812 - RNA, 23 nt, Staphylococcus aureus subsp. aureus MW2
aaaagugaaaguauuagauauau

SEQ ID NO: 4007813 - RNA, 23 nt, Staphylococcus aureus subsp. aureus MW2
aaaagugcaaguccaaauaauau

SEQ ID NO: 4007814 - RNA, 19 nt, Staphylococcus aureus subsp. aureus MW2
aaaagugccagguucaaua

SEQ ID NO: 4007815 - RNA, 17 nt, Staphylococcus aureus subsp. aureus MW2
aaaagugcgauuaucag

SEQ ID NO: 4007816 - RNA, 17 nt, Staphylococcus aureus subsp. aureus MW2
aaaaguggccuuuuaaa

SEQ ID NO: 4007817 - RNA, 15 nt, Staphylococcus aureus subsp. aureus MW2
aaaaguguaauguuc

SEQ ID NO: 4007818 - RNA, 20 nt, Staphylococcus aureus subsp. aureus MW2
aaaaguguuaaugucuucau

SEQ ID NO: 4007819 - RNA, 21 nt, Staphylococcus aureus subsp. aureus MW2
aaaaguguuaugaauuagagg

SEQ ID NO: 4007820 - RNA, 22 nt, Staphylococcus aureus subsp. aureus MW2
aaaaguguugacuuuaucaauu

SEQ ID NO: 4007821 - RNA, 17 nt, Staphylococcus aureus subsp. aureus MW2
aaaaguguuuaaaugcu

SEQ ID NO: 4007822 - RNA, 17 nt, Staphylococcus aureus subsp. aureus MW2
aaaaguugauuaaaagu

SEQ ID NO: 4007823 - RNA, 21 nt, Staphylococcus aureus subsp. aureus MW2
aaaaguugauuaaaaguguug

SEQ ID NO: 4007824 - RNA, 15 nt, Staphylococcus aureus subsp. aureus MW2
aaaauaaaaaaccaa

SEQ ID NO: 4007825 - RNA, 12 nt, Staphylococcus aureus subsp. aureus MW2
aaaauaaaaaau

SEQ ID NO: 4007826 - RNA, 17 nt, Staphylococcus aureus subsp. aureus MW2
aaaauaaaaaaugcacu

SEQ ID NO: 4007827 - RNA, 13 nt, Staphylococcus aureus subsp. aureus MW2
aaaauaaaaacca

SEQ ID NO: 4007828 - RNA, 22 nt, Staphylococcus aureus subsp. aureus MW2
aaaaugauuguuuuaaguggga

SEQ ID NO: 4007829 - RNA, 19 nt, Staphylococcus aureus subsp. aureus MW2
aaaaugccgagauuauuau

SEQ ID NO: 4007830 - RNA, 21 nt, Staphylococcus aureus subsp. aureus MW2
aaaaugcgcuuccaauuuaaa

SEQ ID NO: 4007831 - RNA, 23 nt, Staphylococcus aureus subsp. aureus MW2
aaaaugcgcuuccaauuuaaaau

SEQ ID NO: 4007832 - RNA, 17 nt, Staphylococcus aureus subsp. aureus MW2
aaaaugcuuuuuugaaa

SEQ ID NO: 4007833 - RNA, 17 nt, Staphylococcus aureus subsp. aureus MW2
aaaauggcaucuggcaa

SEQ ID NO: 4007834 - RNA, 18 nt, Staphylococcus aureus subsp. aureus MW2
aaaauggcgaaaaagcua

SEQ ID NO: 4007835 - RNA, 13 nt, Staphylococcus aureus subsp. aureus MW2
aaaauguaaucac

SEQ ID NO: 4007836 - RNA, 22 nt, Staphylococcus aureus subsp. aureus MW2
aaaauguaggcgccauaaucau

SEQ ID NO: 4007837 - RNA, 20 nt, Staphylococcus aureus subsp. aureus MW2
aaaauguauuaaauaugcac

SEQ ID NO: 4007838 - RNA, 20 nt, Staphylococcus aureus subsp. aureus MW2
aaaaugucauuugaauccaa

SEQ ID NO: 4007839 - RNA, 16 nt, Staphylococcus aureus subsp. aureus MW2
aaaaugucuaaaaaaa

SEQ ID NO: 4007840 - RNA, 17 nt, Staphylococcus aureus subsp. aureus MW2
aaaaugucuaaaaaaau

SEQ ID NO: 4007841 - RNA, 17 nt, Staphylococcus aureus subsp. aureus MW2
aaaaugucuuugaaaaa

SEQ ID NO: 4007842 - RNA, 21 nt, Staphylococcus aureus subsp. aureus MW2
aaaauguguuaaaauauauuu

SEQ ID NO: 4007843 - RNA, 20 nt, Staphylococcus aureus subsp. aureus MW2
aaaauguuaucuaguacauc

SEQ ID NO: 4007844 - RNA, 16 nt, Staphylococcus aureus subsp. aureus MW2
aaaauguuuaacaaua

SEQ ID NO: 4007845 - RNA, 13 nt, Staphylococcus aureus subsp. aureus MW2
aaaauuaaaaucu

SEQ ID NO: 4007846 - RNA, 15 nt, Staphylococcus aureus subsp. aureus MW2
aaaauuaaauaauga

SEQ ID NO: 4007847 - RNA, 15 nt, Staphylococcus aureus subsp. aureus MW2
aaaauuaacuuaaaa

SEQ ID NO: 4007848 - RNA, 15 nt, Staphylococcus aureus subsp. aureus MW2
aaaauuaagaugaaa

SEQ ID NO: 4007849 - RNA, 12 nt, Staphylococcus aureus subsp. aureus MW2
aaaauuaauaau

SEQ ID NO: 4007850 - RNA, 17 nt, Staphylococcus aureus subsp. aureus MW2
aaaauuaauguuuucag

SEQ ID NO: 4007851 - RNA, 22 nt, Staphylococcus aureus subsp. aureus MW2
aaaauuacgcaaagaaaaacau

SEQ ID NO: 4007852 - RNA, 14 nt, Staphylococcus aureus subsp. aureus MW2
aaaauuagaauucg

SEQ ID NO: 4007853 - RNA, 18 nt, Staphylococcus aureus subsp. aureus MW2
aaaauuagacguguaaau

SEQ ID NO: 4007854 - RNA, 23 nt, Staphylococcus aureus subsp. aureus MW2
aaaauuagggguggaaauaugaa

SEQ ID NO: 4007855 - RNA, 12 nt, Staphylococcus aureus subsp. aureus MW2
aaaauuaucaau

SEQ ID NO: 4007856 - RNA, 19 nt, Staphylococcus aureus subsp. aureus MW2
aaaauuaucuuucaucaaa

SEQ ID NO: 4007857 - RNA, 16 nt, Staphylococcus aureus subsp. aureus MW2
aaaauuauguaaaaaa

SEQ ID NO: 4007858 - RNA, 14 nt, Staphylococcus aureus subsp. aureus MW2
aaaauucaccaacu

SEQ ID NO: 4007859 - RNA, 15 nt, Staphylococcus aureus subsp. aureus MW2
aaaauucuggauuaa

SEQ ID NO: 4007860 - RNA, 23 nt, Staphylococcus aureus subsp. aureus MW2
aaaauucuuucuuuuuuacauuu

SEQ ID NO: 4007861 - RNA, 13 nt, Staphylococcus aureus subsp. aureus MW2
aaaauugaacuuu

SEQ ID NO: 4007862 - RNA, 21 nt, Staphylococcus aureus subsp. aureus MW2
aaaauugauauugcaaaacuu

SEQ ID NO: 4007863 - RNA, 17 nt, Staphylococcus aureus subsp. aureus MW2
aaaauugcuaaaaaaau

SEQ ID NO: 4007864 - RNA, 15 nt, Staphylococcus aureus subsp. aureus MW2
aaaauugcuauauua

SEQ ID NO: 4007865 - RNA, 20 nt, Staphylococcus aureus subsp. aureus MW2
aaaauugguuuggauaaaau

SEQ ID NO: 4007866 - RNA, 12 nt, Staphylococcus aureus subsp. aureus MW2
aaaauuguaagu

SEQ ID NO: 4007867 - RNA, 13 nt, Staphylococcus aureus subsp. aureus MW2
aaaauuguaauac

SEQ ID NO: 4007868 - RNA, 16 nt, Staphylococcus aureus subsp. aureus MW2
aaaauuguauagaaug

SEQ ID NO: 4007869 - RNA, 16 nt, Staphylococcus aureus subsp. aureus MW2
aaaauuguauuauuau

SEQ ID NO: 4007870 - RNA, 16 nt, Staphylococcus aureus subsp. aureus MW2
aaaauuguuaauacau

SEQ ID NO: 4007871 - RNA, 18 nt, Staphylococcus aureus subsp. aureus MW2
aaaauuuauucaaaucau

SEQ ID NO: 4007872 - RNA, 22 nt, Staphylococcus aureus subsp. aureus MW2
aaaauuugaaauauaccaacca

SEQ ID NO: 4007873 - RNA, 22 nt, Staphylococcus aureus subsp. aureus MW2
aaaauuugcucgugaaaagcag

SEQ ID NO: 4007874 - RNA, 13 nt, Staphylococcus aureus subsp. aureus MW2
aaaauuuguaaca

SEQ ID NO: 4007875 - RNA, 17 nt, Staphylococcus aureus subsp. aureus MW2
aaacaaaaaauaucuuu

SEQ ID NO: 4007876 - RNA, 21 nt, Staphylococcus aureus subsp. aureus MW2
aaacaaaaaauaucuuuuugu

SEQ ID NO: 4007877 - RNA, 14 nt, Staphylococcus aureus subsp. aureus MW2
aaacaaaaauaagu

SEQ ID NO: 4007878 - RNA, 16 nt, Staphylococcus aureus subsp. aureus MW2
aaacaaaaccaaaaua

SEQ ID NO: 4007879 - RNA, 15 nt, Staphylococcus aureus subsp. aureus MW2
aaacaaaacuuaaaa

SEQ ID NO: 4007880 - RNA, 19 nt, Staphylococcus aureus subsp. aureus MW2
aaacaaaacuuaaaauauu

SEQ ID NO: 4007881 - RNA, 21 nt, Staphylococcus aureus subsp. aureus MW2
aaacaaagcucaauaaauuau

SEQ ID NO: 4007882 - RNA, 19 nt, Staphylococcus aureus subsp. aureus MW2
aaacaaagguuuguaagac

SEQ ID NO: 4007883 - RNA, 16 nt, Staphylococcus aureus subsp. aureus MW2
aaacaaaucuuuuaaa

SEQ ID NO: 4007884 - RNA, 12 nt, Staphylococcus aureus subsp. aureus MW2
aaacaacaucac

SEQ ID NO: 4007885 - RNA, 14 nt, Staphylococcus aureus subsp. aureus MW2
aaacaacaucgauu

SEQ ID NO: 4007886 - RNA, 20 nt, Staphylococcus aureus subsp. aureus MW2
aaacaacaucgauuuaucau

SEQ ID NO: 4007887 - RNA, 20 nt, Staphylococcus aureus subsp. aureus MW2
aaacaaccugugauaaaaau

SEQ ID NO: 4007888 - RNA, 16 nt, Staphylococcus aureus subsp. aureus MW2
aaacaacuucugaaac

SEQ ID NO: 4007889 - RNA, 12 nt, Staphylococcus aureus subsp. aureus MW2
aaacaagaaaac

SEQ ID NO: 4007890 - RNA, 15 nt, Staphylococcus aureus subsp. aureus MW2
aaacaagaauaaauc

SEQ ID NO: 4007891 - RNA, 21 nt, Staphylococcus aureus subsp. aureus MW2
aaacaagauuccuaaagaaua

SEQ ID NO: 4007892 - RNA, 13 nt, Staphylococcus aureus subsp. aureus MW2
aaacaauaaaaaa

SEQ ID NO: 4007893 - RNA, 12 nt, Staphylococcus aureus subsp. aureus MW2
aaacaauaauaa

SEQ ID NO: 4007894 - RNA, 23 nt, Staphylococcus aureus subsp. aureus MW2
aaacaauacguuuucggauugaa

SEQ ID NO: 4007895 - RNA, 17 nt, Staphylococcus aureus subsp. aureus MW2
aaacaaugauuaaaauu

SEQ ID NO: 4007896 - RNA, 17 nt, Staphylococcus aureus subsp. aureus MW2
aaacaauuacaaaauca

SEQ ID NO: 4007897 - RNA, 17 nt, Staphylococcus aureus subsp. aureus MW2
aaacaauuuaaaaagca

SEQ ID NO: 4007898 - RNA, 13 nt, Staphylococcus aureus subsp. aureus MW2
aaacacaaaaagg

SEQ ID NO: 4007899 - RNA, 18 nt, Staphylococcus aureus subsp. aureus MW2
aaacacacuguugaaaau

SEQ ID NO: 4007900 - RNA, 20 nt, Staphylococcus aureus subsp. aureus MW2
aaacacagacguuuuugaau

SEQ ID NO: 4007901 - RNA, 18 nt, Staphylococcus aureus subsp. aureus MW2
aaacacccugcuuaucau

SEQ ID NO: 4007902 - RNA, 22 nt, Staphylococcus aureus subsp. aureus MW2
aaacaccuuucgcgacuucauu

SEQ ID NO: 4007903 - RNA, 20 nt, Staphylococcus aureus subsp. aureus MW2
aaacacgcggugggcgaaau

SEQ ID NO: 4007904 - RNA, 19 nt, Staphylococcus aureus subsp. aureus MW2
aaacacuuuuaguuguaac

SEQ ID NO: 4007905 - RNA, 13 nt, Staphylococcus aureus subsp. aureus MW2
aaacagaauuauu

SEQ ID NO: 4007906 - RNA, 14 nt, Staphylococcus aureus subsp. aureus MW2
aaacagcaaauaaa

SEQ ID NO: 4007907 - RNA, 19 nt, Staphylococcus aureus subsp. aureus MW2
aaacagcaguaagaugauu

SEQ ID NO: 4007908 - RNA, 21 nt, Staphylococcus aureus subsp. aureus MW2
aaacagguuaucacaacagua

SEQ ID NO: 4007909 - RNA, 13 nt, Staphylococcus aureus subsp. aureus MW2
aaacauaaaaaua

SEQ ID NO: 4007910 - RNA, 14 nt, Staphylococcus aureus subsp. aureus MW2
aaacauaaaaauau

SEQ ID NO: 4007911 - RNA, 21 nt, Staphylococcus aureus subsp. aureus MW2
aaacauaauuaccuuuccauu

SEQ ID NO: 4007912 - RNA, 15 nt, Staphylococcus aureus subsp. aureus MW2
aaacauagagaaauu

SEQ ID NO: 4007913 - RNA, 18 nt, Staphylococcus aureus subsp. aureus MW2
aaacauagagaaauuuga

SEQ ID NO: 4007914 - RNA, 19 nt, Staphylococcus aureus subsp. aureus MW2
aaacauagagaauuucaaa

SEQ ID NO: 4007915 - RNA, 19 nt, Staphylococcus aureus subsp. aureus MW2
aaacaucacuugcuguugc

SEQ ID NO: 4007916 - RNA, 15 nt, Staphylococcus aureus subsp. aureus MW2
aaacauccaauuaug

SEQ ID NO: 4007917 - RNA, 12 nt, Staphylococcus aureus subsp. aureus MW2
aaagacagaaau

SEQ ID NO: 4007918 - RNA, 23 nt, Staphylococcus aureus subsp. aureus MW2
aaagaccguauuuuuuuauaauu

SEQ ID NO: 4007919 - RNA, 16 nt, Staphylococcus aureus subsp. aureus MW2
aaagacgcuuucuauu

SEQ ID NO: 4007920 - RNA, 19 nt, Staphylococcus aureus subsp. aureus MW2
aaagacuagccauaccuua

SEQ ID NO: 4007921 - RNA, 22 nt, Staphylococcus aureus subsp. aureus MW2
aaagacucaauuucauuugaaa

SEQ ID NO: 4007922 - RNA, 19 nt, Staphylococcus aureus subsp. aureus MW2
aaagacugacuaauaaaac

SEQ ID NO: 4007923 - RNA, 21 nt, Staphylococcus aureus subsp. aureus MW2
aaagagaaaagcuagaaguuc

SEQ ID NO: 4007924 - RNA, 22 nt, Staphylococcus aureus subsp. aureus MW2
aaagagaaacaaaacaaaaaau

SEQ ID NO: 4007925 - RNA, 22 nt, Staphylococcus aureus subsp. aureus MW2
aaagagaugggcuaagguuguu

SEQ ID NO: 4007926 - RNA, 20 nt, Staphylococcus aureus subsp. aureus MW2
aaagaggcgccacaacaugu

SEQ ID NO: 4007927 - RNA, 22 nt, Staphylococcus aureus subsp. aureus MW2
aaagaggcgccacaacauguuu

SEQ ID NO: 4007928 - RNA, 15 nt, Staphylococcus aureus subsp. aureus MW2
aaagaggcuuuaaaa

SEQ ID NO: 4007929 - RNA, 16 nt, Staphylococcus aureus subsp. aureus MW2
aaagagguacuagaau

SEQ ID NO: 4007930 - RNA, 14 nt, Staphylococcus aureus subsp. aureus MW2
aaagaguaaaguua

SEQ ID NO: 4007931 - RNA, 14 nt, Staphylococcus aureus subsp. aureus MW2
aaagaguuaauaaa

SEQ ID NO: 4007932 - RNA, 16 nt, Staphylococcus aureus subsp. aureus MW2
aaagaguuaauaaaau

SEQ ID NO: 4007933 - RNA, 12 nt, Staphylococcus aureus subsp. aureus MW2
aaagauauaaac

SEQ ID NO: 4007934 - RNA, 14 nt, Staphylococcus aureus subsp. aureus MW2
aaagauauaaacau

SEQ ID NO: 4007935 - RNA, 16 nt, Staphylococcus aureus subsp. aureus MW2
aaagauauaaacauuu

SEQ ID NO: 4007936 - RNA, 22 nt, Staphylococcus aureus subsp. aureus MW2
aaagauauaaggcgcucucuuu

SEQ ID NO: 4007937 - RNA, 21 nt, Staphylococcus aureus subsp. aureus MW2
aaagauauguuuauauugcaa

SEQ ID NO: 4007938 - RNA, 17 nt, Staphylococcus aureus subsp. aureus MW2
aaagaugaaaaucuuua

SEQ ID NO: 4007939 - RNA, 16 nt, Staphylococcus aureus subsp. aureus MW2
aaagauguugaaaagu

SEQ ID NO: 4007940 - RNA, 12 nt, Staphylococcus aureus subsp. aureus MW2
aaagauuaaaau

SEQ ID NO: 4007941 - RNA, 11 nt, Staphylococcus aureus subsp. aureus MW2
aaagauuucag

SEQ ID NO: 4007942 - RNA, 19 nt, Staphylococcus aureus subsp. aureus MW2
aaagauuucaguucaucau

SEQ ID NO: 4007943 - RNA, 20 nt, Staphylococcus aureus subsp. aureus MW2
aaagcaaugucuugauugaa

SEQ ID NO: 4007944 - RNA, 21 nt, Staphylococcus aureus subsp. aureus MW2
aaagcaaugucuugauugaau

SEQ ID NO: 4007945 - RNA, 17 nt, Staphylococcus aureus subsp. aureus MW2
aaagcaccuaaaauaga

SEQ ID NO: 4007946 - RNA, 21 nt, Staphylococcus aureus subsp. aureus MW2
aaagcaccuaaaauagaaaaa

SEQ ID NO: 4007947 - RNA, 22 nt, Staphylococcus aureus subsp. aureus MW2
aaagcaccuaaaauagaaaaau

SEQ ID NO: 4007948 - RNA, 17 nt, Staphylococcus aureus subsp. aureus MW2
aaagcaggcaagcuauc

SEQ ID NO: 4007949 - RNA, 17 nt, Staphylococcus aureus subsp. aureus MW2
aaagcagucgaacaaug

SEQ ID NO: 4007950 - RNA, 17 nt, Staphylococcus aureus subsp. aureus MW2
aaagcaguuaaugaauc

SEQ ID NO: 4007951 - RNA, 21 nt, Staphylococcus aureus subsp. aureus MW2
aaagcaucuucaauauuuaaa

SEQ ID NO: 4007952 - RNA, 22 nt, Staphylococcus aureus subsp. aureus MW2
aaagcaugauacucaauaaaau

SEQ ID NO: 4007953 - RNA, 14 nt, Staphylococcus aureus subsp. aureus MW2
aaagcauuuaaaua

SEQ ID NO: 4007954 - RNA, 15 nt, Staphylococcus aureus subsp. aureus MW2
aaagccaauuaauaa

SEQ ID NO: 4007955 - RNA, 18 nt, Staphylococcus aureus subsp. aureus MW2
aaagcccuauuauuuuuu

SEQ ID NO: 4007956 - RNA, 16 nt, Staphylococcus aureus subsp. aureus MW2
aaagccuucuaucucu

SEQ ID NO: 4007957 - RNA, 23 nt, Staphylococcus aureus subsp. aureus MW2
aaagcguaaggaauuacacuuua

SEQ ID NO: 4007958 - RNA, 17 nt, Staphylococcus aureus subsp. aureus MW2
aaagcuaacauaccuaa

SEQ ID NO: 4007959 - RNA, 13 nt, Staphylococcus aureus subsp. aureus MW2
aaagcuaauuuuu

SEQ ID NO: 4007960 - RNA, 13 nt, Staphylococcus aureus subsp. aureus MW2
aaagcuagaaguu

SEQ ID NO: 4007961 - RNA, 17 nt, Staphylococcus aureus subsp. aureus MW2
aaagcuagaaguucuua

SEQ ID NO: 4007962 - RNA, 20 nt, Staphylococcus aureus subsp. aureus MW2
aaagcuauaaaaaaucuuuu

SEQ ID NO: 4007963 - RNA, 22 nt, Staphylococcus aureus subsp. aureus MW2
aaagcucggcacucaauuuaag

SEQ ID NO: 4007964 - RNA, 14 nt, Staphylococcus aureus subsp. aureus MW2
aaagcugucaacuu

SEQ ID NO: 4007965 - RNA, 14 nt, Staphylococcus aureus subsp. aureus MW2
aaagcuugauuuaa

SEQ ID NO: 4007966 - RNA, 18 nt, Staphylococcus aureus subsp. aureus MW2
aaagcuugauuuaacaac

SEQ ID NO: 4007967 - RNA, 18 nt, Staphylococcus aureus subsp. aureus MW2
aaagcuuuucuugaaaua

SEQ ID NO: 4007968 - RNA, 21 nt, Staphylococcus aureus subsp. aureus MW2
aaagcuuuuuugcuuuuauaa

SEQ ID NO: 4007969 - RNA, 19 nt, Staphylococcus aureus subsp. aureus MW2
aaaggaauguuuaaaaaac

SEQ ID NO: 4007970 - RNA, 23 nt, Staphylococcus aureus subsp. aureus MW2
aaaggacgucuuuuuagauugua

SEQ ID NO: 4007971 - RNA, 19 nt, Staphylococcus aureus subsp. aureus MW2
aaaggauauugaaaacacg

SEQ ID NO: 4007972 - RNA, 17 nt, Staphylococcus aureus subsp. aureus MW2
aaaggcgaaacauuaaa

SEQ ID NO: 4007973 - RNA, 15 nt, Staphylococcus aureus subsp. aureus MW2
aaaggcucauuuguu

SEQ ID NO: 4007974 - RNA, 15 nt, Staphylococcus aureus subsp. aureus MW2
aaagggaauggauua

SEQ ID NO: 4007975 - RNA, 14 nt, Staphylococcus aureus subsp. aureus MW2
aaagggcaaaaaag

SEQ ID NO: 4007976 - RNA, 18 nt, Staphylococcus aureus subsp. aureus MW2
aaagguaccacuguauuu

SEQ ID NO: 4007977 - RNA, 21 nt, Staphylococcus aureus subsp. aureus MW2
aaaggucaaaaaauuaaucaa

SEQ ID NO: 4007978 - RNA, 12 nt, Staphylococcus aureus subsp. aureus MW2
aaaggucaucug

SEQ ID NO: 4007979 - RNA, 23 nt, Staphylococcus aureus subsp. aureus MW2
aaaggugugggcuuuauuaucau

SEQ ID NO: 4007980 - RNA, 20 nt, Staphylococcus aureus subsp. aureus MW2
aaagguuaauauuaaauuuu

SEQ ID NO: 4007981 - RNA, 20 nt, Staphylococcus aureus subsp. aureus MW2
aaagguuguuuuucaucauu

SEQ ID NO: 4007982 - RNA, 17 nt, Staphylococcus aureus subsp. aureus MW2
aaagguuuacuauuaaa

SEQ ID NO: 4007983 - RNA, 21 nt, Staphylococcus aureus subsp. aureus MW2
aaagguuuacuauuaaaggaa

SEQ ID NO: 4007984 - RNA, 14 nt, Staphylococcus aureus subsp. aureus MW2
aaaguaaguaaaau

SEQ ID NO: 4007985 - RNA, 13 nt, Staphylococcus aureus subsp. aureus MW2
aaaguaauaugag

SEQ ID NO: 4007986 - RNA, 15 nt, Staphylococcus aureus subsp. aureus MW2
aaaguacuuacaaau

SEQ ID NO: 4007987 - RNA, 12 nt, Staphylococcus aureus subsp. aureus MW2
aaaguauaaggu

SEQ ID NO: 4007988 - RNA, 14 nt, Staphylococcus aureus subsp. aureus MW2
aaaguauaugaauc

SEQ ID NO: 4007989 - RNA, 22 nt, Staphylococcus aureus subsp. aureus MW2
aaaguaucgccaaucuauugca

SEQ ID NO: 4007990 - RNA, 22 nt, Staphylococcus aureus subsp. aureus MW2
aaaguaucuaugaaauuuuuua

SEQ ID NO: 4007991 - RNA, 21 nt, Staphylococcus aureus subsp. aureus MW2
aaaguauuagauauauuugaa

SEQ ID NO: 4007992 - RNA, 15 nt, Staphylococcus aureus subsp. aureus MW2
aaagucaaagaggaa

SEQ ID NO: 4007993 - RNA, 14 nt, Staphylococcus aureus subsp. aureus MW2
aaagucaauuuaaa

SEQ ID NO: 4007994 - RNA, 16 nt, Staphylococcus aureus subsp. aureus MW2
aaagucaauuuaaaua

SEQ ID NO: 4007995 - RNA, 18 nt, Staphylococcus aureus subsp. aureus MW2
aaagucagcauacaauaa

SEQ ID NO: 4007996 - RNA, 20 nt, Staphylococcus aureus subsp. aureus MW2
aaagucagcauacaauaaug

SEQ ID NO: 4007997 - RNA, 15 nt, Staphylococcus aureus subsp. aureus MW2
aaagucagcuuacaa

SEQ ID NO: 4007998 - RNA, 18 nt, Staphylococcus aureus subsp. aureus MW2
aaagucagguuacaauaa

SEQ ID NO: 4007999 - RNA, 21 nt, Staphylococcus aureus subsp. aureus MW2
aaagucagguuacaauaaugu

SEQ ID NO: 4008000 - RNA, 20 nt, Staphylococcus aureus subsp. aureus MW2
aaagucauacuuaugagcaa

SEQ ID NO: 4008001 - RNA, 15 nt, Staphylococcus aureus subsp. aureus MW2
aaagucauuuagaua

SEQ ID NO: 4008002 - RNA, 20 nt, Staphylococcus aureus subsp. aureus MW2
aaagucguuguugaaauuaa

SEQ ID NO: 4008003 - RNA, 21 nt, Staphylococcus aureus subsp. aureus MW2
aaagucguuguugaaauuaaa

SEQ ID NO: 4008004 - RNA, 16 nt, Staphylococcus aureus subsp. aureus MW2
aaagucuucaucuuua

SEQ ID NO: 4008005 - RNA, 22 nt, Staphylococcus aureus subsp. aureus MW2
aaaucacucaacugaugaaaag

SEQ ID NO: 4008006 - RNA, 22 nt, Staphylococcus aureus subsp. aureus MW2
aaaucagcaccgccugaaauag

SEQ ID NO: 4008007 - RNA, 12 nt, Staphylococcus aureus subsp. aureus MW2
aaaucagcuuuu

SEQ ID NO: 4008008 - RNA, 15 nt, Staphylococcus aureus subsp. aureus MW2
aaaucagcuuuucuu

SEQ ID NO: 4008009 - RNA, 13 nt, Staphylococcus aureus subsp. aureus MW2
aaaucaguaauau

SEQ ID NO: 4008010 - RNA, 16 nt, Staphylococcus aureus subsp. aureus MW2
aaaucaguaauaucaa

SEQ ID NO: 4008011 - RNA, 18 nt, Staphylococcus aureus subsp. aureus MW2
aaaucagucauucacaua

SEQ ID NO: 4008012 - RNA, 14 nt, Staphylococcus aureus subsp. aureus MW2
aaaucauaaauaac

SEQ ID NO: 4008013 - RNA, 17 nt, Staphylococcus aureus subsp. aureus MW2
aaaucauacgagaaauu

SEQ ID NO: 4008014 - RNA, 21 nt, Staphylococcus aureus subsp. aureus MW2
aaaucauagucgguuauuaca

SEQ ID NO: 4008015 - RNA, 20 nt, Staphylococcus aureus subsp. aureus MW2
aaaucaucguauuucauaua

SEQ ID NO: 4008016 - RNA, 20 nt, Staphylococcus aureus subsp. aureus MW2
aaaucaucuuaacaauuuua

SEQ ID NO: 4008017 - RNA, 20 nt, Staphylococcus aureus subsp. aureus MW2
aaaucaucuucaguuaguuu

SEQ ID NO: 4008018 - RNA, 20 nt, Staphylococcus aureus subsp. aureus MW2
aaaucaugaaauuaaaaaca

SEQ ID NO: 4008019 - RNA, 19 nt, Staphylococcus aureus subsp. aureus MW2
aaaucauuaagaaaaggcu

SEQ ID NO: 4008020 - RNA, 13 nt, Staphylococcus aureus subsp. aureus MW2
aaaucauuaauaa

SEQ ID NO: 4008021 - RNA, 14 nt, Staphylococcus aureus subsp. aureus MW2
aaaucauuaauaau

SEQ ID NO: 4008022 - RNA, 19 nt, Staphylococcus aureus subsp. aureus MW2
aaaucauuaauaauuaaac

SEQ ID NO: 4008023 - RNA, 18 nt, Staphylococcus aureus subsp. aureus MW2
aaaucauucauuugcaaa

SEQ ID NO: 4008024 - RNA, 19 nt, Staphylococcus aureus subsp. aureus MW2
aaaucauucauuugcaaag

SEQ ID NO: 4008025 - RNA, 23 nt, Staphylococcus aureus subsp. aureus MW2
aaaucauugcgugcuucacuaaa

SEQ ID NO: 4008026 - RNA, 16 nt, Staphylococcus aureus subsp. aureus MW2
aaauccacacauuaag

SEQ ID NO: 4008027 - RNA, 22 nt, Staphylococcus aureus subsp. aureus MW2
aaauccuaagcaucguaaaaaa

SEQ ID NO: 4008028 - RNA, 14 nt, Staphylococcus aureus subsp. aureus MW2
aaaucgaaauuucc

SEQ ID NO: 4008029 - RNA, 14 nt, Staphylococcus aureus subsp. aureus MW2
aaaucgaacaaaug

SEQ ID NO: 4008030 - RNA, 23 nt, Staphylococcus aureus subsp. aureus MW2
aaaucgaauugguaaaaaucuca

SEQ ID NO: 4008031 - RNA, 15 nt, Staphylococcus aureus subsp. aureus MW2
aaaucgauaacaguu

SEQ ID NO: 4008032 - RNA, 22 nt, Staphylococcus aureus subsp. aureus MW2
aaaucgauacuaauaucuucuu

SEQ ID NO: 4008033 - RNA, 15 nt, Staphylococcus aureus subsp. aureus MW2
aaaucgauuaauuau

SEQ ID NO: 4008034 - RNA, 15 nt, Staphylococcus aureus subsp. aureus MW2
aaaucggaauaaaau

SEQ ID NO: 4008035 - RNA, 15 nt, Staphylococcus aureus subsp. aureus MW2
aaaucggacagcuga

SEQ ID NO: 4008036 - RNA, 15 nt, Staphylococcus aureus subsp. aureus MW2
aaaucggauuaacau

SEQ ID NO: 4008037 - RNA, 18 nt, Staphylococcus aureus subsp. aureus MW2
aaaucgugcccauaugau

SEQ ID NO: 4008038 - RNA, 15 nt, Staphylococcus aureus subsp. aureus MW2
aaaucguuauaagua

SEQ ID NO: 4008039 - RNA, 12 nt, Staphylococcus aureus subsp. aureus MW2
aaaucguuucau

SEQ ID NO: 4008040 - RNA, 20 nt, Staphylococcus aureus subsp. aureus MW2
aaaucuaaaucuauacuuua

SEQ ID NO: 4008041 - RNA, 13 nt, Staphylococcus aureus subsp. aureus MW2
aaaucuacaauau

SEQ ID NO: 4008042 - RNA, 18 nt, Staphylococcus aureus subsp. aureus MW2
aaaucuacaauauuaaaa

SEQ ID NO: 4008043 - RNA, 12 nt, Staphylococcus aureus subsp. aureus MW2
aaaucuacaauu

SEQ ID NO: 4008044 - RNA, 21 nt, Staphylococcus aureus subsp. aureus MW2
aaaucuauaccauuccaaaaa

SEQ ID NO: 4008045 - RNA, 13 nt, Staphylococcus aureus subsp. aureus MW2
aaaucuauauaaa

SEQ ID NO: 4008046 - RNA, 15 nt, Staphylococcus aureus subsp. aureus MW2
aaaucuauauaaagu

SEQ ID NO: 4008047 - RNA, 14 nt, Staphylococcus aureus subsp. aureus MW2
aaaucucauaauaa

SEQ ID NO: 4008048 - RNA, 15 nt, Staphylococcus aureus subsp. aureus MW2
aaaucugauucauua

SEQ ID NO: 4008049 - RNA, 20 nt, Staphylococcus aureus subsp. aureus MW2
aaaucugcuugugugucauu

SEQ ID NO: 4008050 - RNA, 19 nt, Staphylococcus aureus subsp. aureus MW2
aaaucugggacgucaauca

SEQ ID NO: 4008051 - RNA, 22 nt, Staphylococcus aureus subsp. aureus MW2
aaaucuguacuucuaauuugca

SEQ ID NO: 4008052 - RNA, 20 nt, Staphylococcus aureus subsp. aureus MW2
aaaucuguuuaaauuuaaaa

SEQ ID NO: 4008053 - RNA, 23 nt, Staphylococcus aureus subsp. aureus MW2
aaaucuuacauugauaaaauaau

SEQ ID NO: 4008054 - RNA, 19 nt, Staphylococcus aureus subsp. aureus MW2
aaaucuuauagauuuuuca

SEQ ID NO: 4008055 - RNA, 21 nt, Staphylococcus aureus subsp. aureus MW2
aaaucuuaugaugucauguau

SEQ ID NO: 4008056 - RNA, 22 nt, Staphylococcus aureus subsp. aureus MW2
aaaucuucaagugccauuuuua

SEQ ID NO: 4008057 - RNA, 12 nt, Staphylococcus aureus subsp. aureus MW2
aaaucuuguucu

SEQ ID NO: 4008058 - RNA, 13 nt, Staphylococcus aureus subsp. aureus MW2
aaaucuuguucua

SEQ ID NO: 4008059 - RNA, 14 nt, Staphylococcus aureus subsp. aureus MW2
aaaucuuuaaaugu

SEQ ID NO: 4008060 - RNA, 21 nt, Staphylococcus aureus subsp. aureus MW2
aaaucuuuaaauguaucacuu

SEQ ID NO: 4008061 - RNA, 14 nt, Staphylococcus aureus subsp. aureus MW2
aaaucuuuuaaauu

SEQ ID NO: 4008062 - RNA, 22 nt, Staphylococcus aureus subsp. aureus MW2
aaaucuuuuaaauuuaguaucu

SEQ ID NO: 4008063 - RNA, 16 nt, Staphylococcus aureus subsp. aureus MW2
aaaucuuuuagcuuuu

SEQ ID NO: 4008064 - RNA, 20 nt, Staphylococcus aureus subsp. aureus MW2
aaaucuuuuagcuuuuguaa

SEQ ID NO: 4008065 - RNA, 14 nt, Staphylococcus aureus subsp. aureus MW2
aaaugaaaaaguaa

SEQ ID NO: 4008066 - RNA, 16 nt, Staphylococcus aureus subsp. aureus MW2
aaaugaaauucuuuug

SEQ ID NO: 4008067 - RNA, 10 nt, Staphylococcus aureus subsp. aureus MW2
aaaugaacca

SEQ ID NO: 4008068 - RNA, 23 nt, Staphylococcus aureus subsp. aureus MW2
aaaugaagucuuucaacaaaaug

SEQ ID NO: 4008069 - RNA, 20 nt, Staphylococcus aureus subsp. aureus MW2
aaaugaauguuaagacauau

SEQ ID NO: 4008070 - RNA, 15 nt, Staphylococcus aureus subsp. aureus MW2
aaaugacauuuuaaa

SEQ ID NO: 4008071 - RNA, 18 nt, Staphylococcus aureus subsp. aureus MW2
aaaugacgcucgagcucu

SEQ ID NO: 4008072 - RNA, 14 nt, Staphylococcus aureus subsp. aureus MW2
aaaugacugaauua

SEQ ID NO: 4008073 - RNA, 18 nt, Staphylococcus aureus subsp. aureus MW2
aaaugacugaauuaauau

SEQ ID NO: 4008074 - RNA, 23 nt, Staphylococcus aureus subsp. aureus MW2
aaaugacugaauuaauauccaaa

SEQ ID NO: 4008075 - RNA, 18 nt, Staphylococcus aureus subsp. aureus MW2
aaaugacuucacauuuau

SEQ ID NO: 4008076 - RNA, 16 nt, Staphylococcus aureus subsp. aureus MW2
aaaugagcguuccauu

SEQ ID NO: 4008077 - RNA, 16 nt, Staphylococcus aureus subsp. aureus MW2
aaaugauaauuuaaua

SEQ ID NO: 4008078 - RNA, 20 nt, Staphylococcus aureus subsp. aureus MW2
aaaugauacauuauuaaaua

SEQ ID NO: 4008079 - RNA, 19 nt, Staphylococcus aureus subsp. aureus MW2
aaaugauagauucaaaauu

SEQ ID NO: 4008080 - RNA, 23 nt, Staphylococcus aureus subsp. aureus MW2
aaaugauagcuaaacauuuuaua

SEQ ID NO: 4008081 - RNA, 16 nt, Staphylococcus aureus subsp. aureus MW2
aaaugaucaucguaua

SEQ ID NO: 4008082 - RNA, 14 nt, Staphylococcus aureus subsp. aureus MW2
aaaugaugauuuaa

SEQ ID NO: 4008083 - RNA, 14 nt, Staphylococcus aureus subsp. aureus MW2
aaaugauggguagu

SEQ ID NO: 4008084 - RNA, 23 nt, Staphylococcus aureus subsp. aureus MW2
aaaugauggguaguuaauauaau

SEQ ID NO: 4008085 - RNA, 23 nt, Staphylococcus aureus subsp. aureus MW2
aaaugauuaaaguguuucaacau

SEQ ID NO: 4008086 - RNA, 16 nt, Staphylococcus aureus subsp. aureus MW2
aaaugauuaauaacau

SEQ ID NO: 4008087 - RNA, 19 nt, Staphylococcus aureus subsp. aureus MW2
aaaugauugguaaacauaa

SEQ ID NO: 4008088 - RNA, 13 nt, Staphylococcus aureus subsp. aureus MW2
aaaugcaauacau

SEQ ID NO: 4008089 - RNA, 21 nt, Staphylococcus aureus subsp. aureus MW2
aaaugcacuagcaacaucuuu

SEQ ID NO: 4008090 - RNA, 19 nt, Staphylococcus aureus subsp. aureus MW2
aaaugcacugagcaacaaa

SEQ ID NO: 4008091 - RNA, 21 nt, Staphylococcus aureus subsp. aureus MW2
aaaugcauaauauauuaaaaa

SEQ ID NO: 4008092 - RNA, 15 nt, Staphylococcus aureus subsp. aureus MW2
aaaugcauuacuacu

SEQ ID NO: 4008093 - RNA, 19 nt, Staphylococcus aureus subsp. aureus MW2
aaauugauaguagcuuaau

SEQ ID NO: 4008094 - RNA, 14 nt, Staphylococcus aureus subsp. aureus MW2
aaauugauuaaaua

SEQ ID NO: 4008095 - RNA, 17 nt, Staphylococcus aureus subsp. aureus MW2
aaauugauuaaauaaau

SEQ ID NO: 4008096 - RNA, 19 nt, Staphylococcus aureus subsp. aureus MW2
aaauugcaauggcaaccuu

SEQ ID NO: 4008097 - RNA, 17 nt, Staphylococcus aureus subsp. aureus MW2
aaauugcguuguuucau

SEQ ID NO: 4008098 - RNA, 21 nt, Staphylococcus aureus subsp. aureus MW2
aaauugcuaaaaaaauuaaaa

SEQ ID NO: 4008099 - RNA, 17 nt, Staphylococcus aureus subsp. aureus MW2
aaauugcuauauuagua

SEQ ID NO: 4008100 - RNA, 19 nt, Staphylococcus aureus subsp. aureus MW2
aaauugcuauauuaguaua

SEQ ID NO: 4008101 - RNA, 18 nt, Staphylococcus aureus subsp. aureus MW2
aaauugcuugaaauuauu

SEQ ID NO: 4008102 - RNA, 16 nt, Staphylococcus aureus subsp. aureus MW2
aaauuggaaucccaau

SEQ ID NO: 4008103 - RNA, 18 nt, Staphylococcus aureus subsp. aureus MW2
aaauuguacugauauaua

SEQ ID NO: 4008104 - RNA, 14 nt, Staphylococcus aureus subsp. aureus MW2
aaauuguaugaaua

SEQ ID NO: 4008105 - RNA, 16 nt, Staphylococcus aureus subsp. aureus MW2
aaauugucucacuugu

SEQ ID NO: 4008106 - RNA, 14 nt, Staphylococcus aureus subsp. aureus MW2
aaauugugaacuaa

SEQ ID NO: 4008107 - RNA, 20 nt, Staphylococcus aureus subsp. aureus MW2
aaauugugaacuaaauugaa

SEQ ID NO: 4008108 - RNA, 20 nt, Staphylococcus aureus subsp. aureus MW2
aaauuguggcguaguuugaa

SEQ ID NO: 4008109 - RNA, 23 nt, Staphylococcus aureus subsp. aureus MW2
aaauuguguugaaucaacaguuu

SEQ ID NO: 4008110 - RNA, 15 nt, Staphylococcus aureus subsp. aureus MW2
aaauuguguuucuuu

SEQ ID NO: 4008111 - RNA, 22 nt, Staphylococcus aureus subsp. aureus MW2
aaauuguguuucuuuuauuuuc

SEQ ID NO: 4008112 - RNA, 15 nt, Staphylococcus aureus subsp. aureus MW2
aaauuguuaauacau

SEQ ID NO: 4008113 - RNA, 17 nt, Staphylococcus aureus subsp. aureus MW2
aaauuuaaaacaaugau

SEQ ID NO: 4008114 - RNA, 15 nt, Staphylococcus aureus subsp. aureus MW2
aaauuuaaaagaaaa

SEQ ID NO: 4008115 - RNA, 12 nt, Staphylococcus aureus subsp. aureus MW2
aaauuuaaaaua

SEQ ID NO: 4008116 - RNA, 14 nt, Staphylococcus aureus subsp. aureus MW2
aaauuuaaaauaau

SEQ ID NO: 4008117 - RNA, 22 nt, Staphylococcus aureus subsp. aureus MW2
aaauuuauauagucuaugaaua

SEQ ID NO: 4008118 - RNA, 14 nt, Staphylococcus aureus subsp. aureus MW2
aaauuuauuauaaa

SEQ ID NO: 4008119 - RNA, 17 nt, Staphylococcus aureus subsp. aureus MW2
aaauuuauuauaaaaua

SEQ ID NO: 4008120 - RNA, 18 nt, Staphylococcus aureus subsp. aureus MW2
aaauuuauuauaaaauag

SEQ ID NO: 4008121 - RNA, 22 nt, Staphylococcus aureus subsp. aureus MW2
aaauuuauuauaaaauagaagu

SEQ ID NO: 4008122 - RNA, 21 nt, Staphylococcus aureus subsp. aureus MW2
aaauuuauuauucguuucuuu

SEQ ID NO: 4008123 - RNA, 13 nt, Staphylococcus aureus subsp. aureus MW2
aaauuuauuuuua

SEQ ID NO: 4008124 - RNA, 17 nt, Staphylococcus aureus subsp. aureus MW2
aaauuuauuuuuaauuu

SEQ ID NO: 4008125 - RNA, 21 nt, Staphylococcus aureus subsp. aureus MW2
aaauuucaagguauacacaaa

SEQ ID NO: 4008126 - RNA, 20 nt, Staphylococcus aureus subsp. aureus MW2
aaauuucucccauccccuuu

SEQ ID NO: 4008127 - RNA, 21 nt, Staphylococcus aureus subsp. aureus MW2
aaauuucugaacauaaaaaaa

SEQ ID NO: 4008128 - RNA, 19 nt, Staphylococcus aureus subsp. aureus MW2
aaauuugauuuucaauuuc

SEQ ID NO: 4008129 - RNA, 15 nt, Staphylococcus aureus subsp. aureus MW2
aaauuugcaugaaaa

SEQ ID NO: 4008130 - RNA, 14 nt, Staphylococcus aureus subsp. aureus MW2
aaauuuuaugaauc

SEQ ID NO: 4008131 - RNA, 17 nt, Staphylococcus aureus subsp. aureus MW2
aaauuuucauuuuggua

SEQ ID NO: 4008132 - RNA, 19 nt, Staphylococcus aureus subsp. aureus MW2
aaauuuucuaaauguguua

SEQ ID NO: 4008133 - RNA, 12 nt, Staphylococcus aureus subsp. aureus MW2
aaauuuugaaga

SEQ ID NO: 4008134 - RNA, 15 nt, Staphylococcus aureus subsp. aureus MW2
aaauuuugaagaagu

SEQ ID NO: 4008135 - RNA, 13 nt, Staphylococcus aureus subsp. aureus MW2
aaauuuugauuua

SEQ ID NO: 4008136 - RNA, 21 nt, Staphylococcus aureus subsp. aureus MW2
aaauuuugauuuaccuucauc

SEQ ID NO: 4008137 - RNA, 20 nt, Staphylococcus aureus subsp. aureus MW2
aaauuuuggaccucuugaaa

SEQ ID NO: 4008138 - RNA, 21 nt, Staphylococcus aureus subsp. aureus MW2
aaauuuuggcgucaucauuag

SEQ ID NO: 4008139 - RNA, 12 nt, Staphylococcus aureus subsp. aureus MW2
aacaaaaaauaa

SEQ ID NO: 4008140 - RNA, 13 nt, Staphylococcus aureus subsp. aureus MW2
aacaaaaauugcu

SEQ ID NO: 4008141 - RNA, 18 nt, Staphylococcus aureus subsp. aureus MW2
aacaaaacuuaaaauauu

SEQ ID NO: 4008142 - RNA, 13 nt, Staphylococcus aureus subsp. aureus MW2
aacaaaaggcugg

SEQ ID NO: 4008143 - RNA, 18 nt, Staphylococcus aureus subsp. aureus MW2
aacaaaagugaauguuuu

SEQ ID NO: 4008144 - RNA, 18 nt, Staphylococcus aureus subsp. aureus MW2
aacaaaaugcguaucaau

SEQ ID NO: 4008145 - RNA, 13 nt, Staphylococcus aureus subsp. aureus MW2
aacaaaauuaaau

SEQ ID NO: 4008146 - RNA, 14 nt, Staphylococcus aureus subsp. aureus MW2
aacaaaauuaaaua

SEQ ID NO: 4008147 - RNA, 16 nt, Staphylococcus aureus subsp. aureus MW2
aacaaacauaccccuu

SEQ ID NO: 4008148 - RNA, 22 nt, Staphylococcus aureus subsp. aureus MW2
aacaaacauuaaucuauauaaa

SEQ ID NO: 4008149 - RNA, 11 nt, Staphylococcus aureus subsp. aureus MW2
aacaaagaagc

SEQ ID NO: 4008150 - RNA, 22 nt, Staphylococcus aureus subsp. aureus MW2
aacaaagauuauugaaauuugg

SEQ ID NO: 4008151 - RNA, 12 nt, Staphylococcus aureus subsp. aureus MW2
aacaaauaaaaa

SEQ ID NO: 4008152 - RNA, 14 nt, Staphylococcus aureus subsp. aureus MW2
aacaaauauaauac

SEQ ID NO: 4008153 - RNA, 21 nt, Staphylococcus aureus subsp. aureus MW2
aacaaauauaauguauaaaac

SEQ ID NO: 4008154 - RNA, 22 nt, Staphylococcus aureus subsp. aureus MW2
aacaaauauaauguauaaaaca

SEQ ID NO: 4008155 - RNA, 19 nt, Staphylococcus aureus subsp. aureus MW2
aacaaaugaaaaaguaaaa

SEQ ID NO: 4008156 - RNA, 12 nt, Staphylococcus aureus subsp. aureus MW2
aacaaauuaaaa

SEQ ID NO: 4008157 - RNA, 17 nt, Staphylococcus aureus subsp. aureus MW2
aacaaauucauauuaac

SEQ ID NO: 4008158 - RNA, 22 nt, Staphylococcus aureus subsp. aureus MW2
aacaacaaauauaauguauaaa

SEQ ID NO: 4008159 - RNA, 23 nt, Staphylococcus aureus subsp. aureus MW2
aacaaccguuuuaaguacagcau

SEQ ID NO: 4008160 - RNA, 19 nt, Staphylococcus aureus subsp. aureus MW2
aacaaccuauuaauugaaa

SEQ ID NO: 4008161 - RNA, 23 nt, Staphylococcus aureus subsp. aureus MW2
aacaaccucugauacuucaccau

SEQ ID NO: 4008162 - RNA, 18 nt, Staphylococcus aureus subsp. aureus MW2
aacaaccugugauaaaaa

SEQ ID NO: 4008163 - RNA, 16 nt, Staphylococcus aureus subsp. aureus MW2
aacaacuaagauauau

SEQ ID NO: 4008164 - RNA, 16 nt, Staphylococcus aureus subsp. aureus MW2
aacaacuuuauuauac

SEQ ID NO: 4008165 - RNA, 14 nt, Staphylococcus aureus subsp. aureus MW2
aacaagaaaacuaa

SEQ ID NO: 4008166 - RNA, 12 nt, Staphylococcus aureus subsp. aureus MW2
aacaagaauaaa

SEQ ID NO: 4008167 - RNA, 19 nt, Staphylococcus aureus subsp. aureus MW2
aacaagauuccuaaagaau

SEQ ID NO: 4008168 - RNA, 20 nt, Staphylococcus aureus subsp. aureus MW2
aacaagauuccuaaagaaua

SEQ ID NO: 4008169 - RNA, 19 nt, Staphylococcus aureus subsp. aureus MW2
aacaagguacacuagucuu

SEQ ID NO: 4008170 - RNA, 12 nt, Staphylococcus aureus subsp. aureus MW2
aacaaguacaau

SEQ ID NO: 4008171 - RNA, 20 nt, Staphylococcus aureus subsp. aureus MW2
aacaaguauaaaugcagcug

SEQ ID NO: 4008172 - RNA, 14 nt, Staphylococcus aureus subsp. aureus MW2
aacaaguucauuuc

SEQ ID NO: 4008173 - RNA, 17 nt, Staphylococcus aureus subsp. aureus MW2
aacaaguucauuucaau

SEQ ID NO: 4008174 - RNA, 14 nt, Staphylococcus aureus subsp. aureus MW2
aacaauaauaauaa

SEQ ID NO: 4008175 - RNA, 13 nt, Staphylococcus aureus subsp. aureus MW2
aacaauaauugau

SEQ ID NO: 4008176 - RNA, 17 nt, Staphylococcus aureus subsp. aureus MW2
aacaauacauaaugguu

SEQ ID NO: 4008177 - RNA, 15 nt, Staphylococcus aureus subsp. aureus MW2
aacaauauaaaagca

SEQ ID NO: 4008178 - RNA, 13 nt, Staphylococcus aureus subsp. aureus MW2
aacaauauaauau

SEQ ID NO: 4008179 - RNA, 21 nt, Staphylococcus aureus subsp. aureus MW2
aacaauauaauauauacaaau

SEQ ID NO: 4008180 - RNA, 20 nt, Staphylococcus aureus subsp. aureus MW2
aacaauaucaucuaaauggu

SEQ ID NO: 4008181 - RNA, 20 nt, Staphylococcus aureus subsp. aureus MW2
aacaauauuaaauuucugaa

SEQ ID NO: 4008182 - RNA, 21 nt, Staphylococcus aureus subsp. aureus MW2
aacauauuuaucucuuucuuc

SEQ ID NO: 4008183 - RNA, 12 nt, Staphylococcus aureus subsp. aureus MW2
aacauauuuuaa

SEQ ID NO: 4008184 - RNA, 21 nt, Staphylococcus aureus subsp. aureus MW2
aacauauuuuaacuaugaaug

SEQ ID NO: 4008185 - RNA, 17 nt, Staphylococcus aureus subsp. aureus MW2
aacauauuuuuugauau

SEQ ID NO: 4008186 - RNA, 18 nt, Staphylococcus aureus subsp. aureus MW2
aacaucacagaaaauaca

SEQ ID NO: 4008187 - RNA, 19 nt, Staphylococcus aureus subsp. aureus MW2
aacaucacagaaaauacau

SEQ ID NO: 4008188 - RNA, 21 nt, Staphylococcus aureus subsp. aureus MW2
aacaucacuuuaggguucauu

SEQ ID NO: 4008189 - RNA, 16 nt, Staphylococcus aureus subsp. aureus MW2
aacaucauaaucgcca

SEQ ID NO: 4008190 - RNA, 14 nt, Staphylococcus aureus subsp. aureus MW2
aacaucaucuaugc

SEQ ID NO: 4008191 - RNA, 15 nt, Staphylococcus aureus subsp. aureus MW2
aacaucauuaacuuu

SEQ ID NO: 4008192 - RNA, 13 nt, Staphylococcus aureus subsp. aureus MW2
aacaucauucaca

SEQ ID NO: 4008193 - RNA, 20 nt, Staphylococcus aureus subsp. aureus MW2
aacaucgauugauaauguaa

SEQ ID NO: 4008194 - RNA, 22 nt, Staphylococcus aureus subsp. aureus MW2
aacaucgauuuaucauuauuug

SEQ ID NO: 4008195 - RNA, 17 nt, Staphylococcus aureus subsp. aureus MW2
aacaucugaaaaaauua

SEQ ID NO: 4008196 - RNA, 16 nt, Staphylococcus aureus subsp. aureus MW2
aacaucugaaucugaa

SEQ ID NO: 4008197 - RNA, 13 nt, Staphylococcus aureus subsp. aureus MW2
aacaucuucaaca

SEQ ID NO: 4008198 - RNA, 15 nt, Staphylococcus aureus subsp. aureus MW2
aacaucuucuucauc

SEQ ID NO: 4008199 - RNA, 18 nt, Staphylococcus aureus subsp. aureus MW2
aacaucuucuucaucaua

SEQ ID NO: 4008200 - RNA, 21 nt, Staphylococcus aureus subsp. aureus MW2
aacaucuuuuguuguuuuuga

SEQ ID NO: 4008201 - RNA, 17 nt, Staphylococcus aureus subsp. aureus MW2
aacaugaacaaucagau

SEQ ID NO: 4008202 - RNA, 23 nt, Staphylococcus aureus subsp. aureus MW2
aacaugaacaaucagauaaguua

SEQ ID NO: 4008203 - RNA, 16 nt, Staphylococcus aureus subsp. aureus MW2
aacaugacagcaucac

SEQ ID NO: 4008204 - RNA, 23 nt, Staphylococcus aureus subsp. aureus MW2
aacaugaccuaauauauuacuaa

SEQ ID NO: 4008205 - RNA, 20 nt, Staphylococcus aureus subsp. aureus MW2
aacaugauucaugauauguu

SEQ ID NO: 4008206 - RNA, 20 nt, Staphylococcus aureus subsp. aureus MW2
aacaugggguuuuauuuuug

SEQ ID NO: 4008207 - RNA, 17 nt, Staphylococcus aureus subsp. aureus MW2
aacauguacaauuuuua

SEQ ID NO: 4008208 - RNA, 20 nt, Staphylococcus aureus subsp. aureus MW2
aacauguuccgcuacaaaac

SEQ ID NO: 4008209 - RNA, 12 nt, Staphylococcus aureus subsp. aureus MW2
aacauuaaaaau

SEQ ID NO: 4008210 - RNA, 13 nt, Staphylococcus aureus subsp. aureus MW2
aacauuaaaauaa

SEQ ID NO: 4008211 - RNA, 18 nt, Staphylococcus aureus subsp. aureus MW2
aacauuaaaauaauuaaa

SEQ ID NO: 4008212 - RNA, 15 nt, Staphylococcus aureus subsp. aureus MW2
aacauuaaaaugaua

SEQ ID NO: 4008213 - RNA, 14 nt, Staphylococcus aureus subsp. aureus MW2
aacauuaaguucuu

SEQ ID NO: 4008214 - RNA, 17 nt, Staphylococcus aureus subsp. aureus MW2
aacauuaauaaauaaua

SEQ ID NO: 4008215 - RNA, 20 nt, Staphylococcus aureus subsp. aureus MW2
aacauuaaucuauauaaaaa

SEQ ID NO: 4008216 - RNA, 22 nt, Staphylococcus aureus subsp. aureus MW2
aacauuacccuuuaaucucaug

SEQ ID NO: 4008217 - RNA, 14 nt, Staphylococcus aureus subsp. aureus MW2
aacauuacguucua

SEQ ID NO: 4008218 - RNA, 20 nt, Staphylococcus aureus subsp. aureus MW2
aacauuacuaauugaucagc

SEQ ID NO: 4008219 - RNA, 19 nt, Staphylococcus aureus subsp. aureus MW2
aacauuagcaugauaaagu

SEQ ID NO: 4008220 - RNA, 19 nt, Staphylococcus aureus subsp. aureus MW2
aacauucccuuaauaauaa

SEQ ID NO: 4008221 - RNA, 17 nt, Staphylococcus aureus subsp. aureus MW2
aacauucuucaaaaaau

SEQ ID NO: 4008222 - RNA, 19 nt, Staphylococcus aureus subsp. aureus MW2
aacauucuucaaaaaauaa

SEQ ID NO: 4008223 - RNA, 15 nt, Staphylococcus aureus subsp. aureus MW2
aacauugagauuauc

SEQ ID NO: 4008224 - RNA, 20 nt, Staphylococcus aureus subsp. aureus MW2
aacauugagauuaucuuuag

SEQ ID NO: 4008225 - RNA, 19 nt, Staphylococcus aureus subsp. aureus MW2
aacauuggcgaggccccaa

SEQ ID NO: 4008226 - RNA, 20 nt, Staphylococcus aureus subsp. aureus MW2
aacauuuaaaaaaugcgcuu

SEQ ID NO: 4008227 - RNA, 16 nt, Staphylococcus aureus subsp. aureus MW2
aacauuuaagaaacgu

SEQ ID NO: 4008228 - RNA, 18 nt, Staphylococcus aureus subsp. aureus MW2
aacauuuacacgucuaau

SEQ ID NO: 4008229 - RNA, 16 nt, Staphylococcus aureus subsp. aureus MW2
aacauuucaauugcau

SEQ ID NO: 4008230 - RNA, 11 nt, Staphylococcus aureus subsp. aureus MW2
aacauuuuuag

SEQ ID NO: 4008231 - RNA, 18 nt, Staphylococcus aureus subsp. aureus MW2
aacauuuuugauuuuaau

SEQ ID NO: 4008232 - RNA, 20 nt, Staphylococcus aureus subsp. aureus MW2
aacauuuuuuauagcaaauu

SEQ ID NO: 4008233 - RNA, 22 nt, Staphylococcus aureus subsp. aureus MW2
aacauuuuuuucaaugcuuuca

SEQ ID NO: 4008234 - RNA, 15 nt, Staphylococcus aureus subsp. aureus MW2
aaccaaaccauuaau

SEQ ID NO: 4008235 - RNA, 20 nt, Staphylococcus aureus subsp. aureus MW2
aaccaaaucggaauaaaaua

SEQ ID NO: 4008236 - RNA, 15 nt, Staphylococcus aureus subsp. aureus MW2
aaccaacaauugguu

SEQ ID NO: 4008237 - RNA, 19 nt, Staphylococcus aureus subsp. aureus MW2
aaccaaugauuguuaauac

SEQ ID NO: 4008238 - RNA, 20 nt, Staphylococcus aureus subsp. aureus MW2
aaccacaacaaugaauccaa

SEQ ID NO: 4008239 - RNA, 16 nt, Staphylococcus aureus subsp. aureus MW2
aaccacgcaucaugua

SEQ ID NO: 4008240 - RNA, 23 nt, Staphylococcus aureus subsp. aureus MW2
aaccacuccuuaaacaaauaaau

SEQ ID NO: 4008241 - RNA, 19 nt, Staphylococcus aureus subsp. aureus MW2
aaccagcuaaaccaucugu

SEQ ID NO: 4008242 - RNA, 16 nt, Staphylococcus aureus subsp. aureus MW2
aaccagcuaaccaaau

SEQ ID NO: 4008243 - RNA, 18 nt, Staphylococcus aureus subsp. aureus MW2
aaccagcuaaccaaauaa

SEQ ID NO: 4008244 - RNA, 20 nt, Staphylococcus aureus subsp. aureus MW2
aaccagcuaaccaaauaauu

SEQ ID NO: 4008245 - RNA, 14 nt, Staphylococcus aureus subsp. aureus MW2
aaccagugcaacua

SEQ ID NO: 4008246 - RNA, 14 nt, Staphylococcus aureus subsp. aureus MW2
aaccaguuuaguau

SEQ ID NO: 4008247 - RNA, 21 nt, Staphylococcus aureus subsp. aureus MW2
aaccauacucuaacuuaccau

SEQ ID NO: 4008248 - RNA, 21 nt, Staphylococcus aureus subsp. aureus MW2
aaccauagauaauugcuauaa

SEQ ID NO: 4008249 - RNA, 15 nt, Staphylococcus aureus subsp. aureus MW2
aaccaucauaaaugu

SEQ ID NO: 4008250 - RNA, 15 nt, Staphylococcus aureus subsp. aureus MW2
aaccaucauuuauau

SEQ ID NO: 4008251 - RNA, 12 nt, Staphylococcus aureus subsp. aureus MW2
aaccaucugugu

SEQ ID NO: 4008252 - RNA, 21 nt, Staphylococcus aureus subsp. aureus MW2
aaccaucugugucagcauuca

SEQ ID NO: 4008253 - RNA, 23 nt, Staphylococcus aureus subsp. aureus MW2
aaccaucugugucagcauucaua

SEQ ID NO: 4008254 - RNA, 21 nt, Staphylococcus aureus subsp. aureus MW2
aaccauguguaggcaauugag

SEQ ID NO: 4008255 - RNA, 14 nt, Staphylococcus aureus subsp. aureus MW2
aaccauuuaaaaau

SEQ ID NO: 4008256 - RNA, 16 nt, Staphylococcus aureus subsp. aureus MW2
aaccauuuaaaaauug

SEQ ID NO: 4008257 - RNA, 17 nt, Staphylococcus aureus subsp. aureus MW2
aaccauuucauuucagu

SEQ ID NO: 4008258 - RNA, 20 nt, Staphylococcus aureus subsp. aureus MW2
aaccauuuccgaauaaaggu

SEQ ID NO: 4008259 - RNA, 22 nt, Staphylococcus aureus subsp. aureus MW2
aaccauuuuuuuaucuguagaa

SEQ ID NO: 4008260 - RNA, 18 nt, Staphylococcus aureus subsp. aureus MW2
aacccaggugcaucuuuu

SEQ ID NO: 4008261 - RNA, 18 nt, Staphylococcus aureus subsp. aureus MW2
aacccauuuucaaaacua

SEQ ID NO: 4008262 - RNA, 20 nt, Staphylococcus aureus subsp. aureus MW2
aaccccuucaaaauuuugac

SEQ ID NO: 4008263 - RNA, 12 nt, Staphylococcus aureus subsp. aureus MW2
aaccgaaaauac

SEQ ID NO: 4008264 - RNA, 16 nt, Staphylococcus aureus subsp. aureus MW2
aaccgaaauaucaaca

SEQ ID NO: 4008265 - RNA, 16 nt, Staphylococcus aureus subsp. aureus MW2
aaccgauuaauauaau

SEQ ID NO: 4008266 - RNA, 18 nt, Staphylococcus aureus subsp. aureus MW2
aaccgauuaauauaauac

SEQ ID NO: 4008267 - RNA, 21 nt, Staphylococcus aureus subsp. aureus MW2
aaccgccaacuaauguuaaaa

SEQ ID NO: 4008268 - RNA, 22 nt, Staphylococcus aureus subsp. aureus MW2
aaccgcuacaauuauaaaugau

SEQ ID NO: 4008269 - RNA, 19 nt, Staphylococcus aureus subsp. aureus MW2
aaccgcuugggcugacauu

SEQ ID NO: 4008270 - RNA, 22 nt, Staphylococcus aureus subsp. aureus MW2
aacuacugcuaaaauaaaauua

SEQ ID NO: 4008271 - RNA, 20 nt, Staphylococcus aureus subsp. aureus MW2
aacuacuucaucacucgcaa

SEQ ID NO: 4008272 - RNA, 18 nt, Staphylococcus aureus subsp. aureus MW2
aacuagaaaacauaaaua

SEQ ID NO: 4008273 - RNA, 17 nt, Staphylococcus aureus subsp. aureus MW2
aacuagaacaagaauua

SEQ ID NO: 4008274 - RNA, 18 nt, Staphylococcus aureus subsp. aureus MW2
aacuaguacgaaaugcau

SEQ ID NO: 4008275 - RNA, 22 nt, Staphylococcus aureus subsp. aureus MW2
aacuaguguaaugucucuuuuc

SEQ ID NO: 4008276 - RNA, 13 nt, Staphylococcus aureus subsp. aureus MW2
aacuauaacaaua

SEQ ID NO: 4008277 - RNA, 19 nt, Staphylococcus aureus subsp. aureus MW2
aacuauaaccuauuaaauc

SEQ ID NO: 4008278 - RNA, 18 nt, Staphylococcus aureus subsp. aureus MW2
aacuauaauaaagauuau

SEQ ID NO: 4008279 - RNA, 15 nt, Staphylococcus aureus subsp. aureus MW2
aacuaucgauacuaa

SEQ ID NO: 4008280 - RNA, 22 nt, Staphylococcus aureus subsp. aureus MW2
aacuaucgauacuaaacgauaa

SEQ ID NO: 4008281 - RNA, 14 nt, Staphylococcus aureus subsp. aureus MW2
aacuaucugauuaa

SEQ ID NO: 4008282 - RNA, 15 nt, Staphylococcus aureus subsp. aureus MW2
aacucaaaccuguuu

SEQ ID NO: 4008283 - RNA, 18 nt, Staphylococcus aureus subsp. aureus MW2
aacucaguaaauuuauua

SEQ ID NO: 4008284 - RNA, 17 nt, Staphylococcus aureus subsp. aureus MW2
aacucauccauugaucu

SEQ ID NO: 4008285 - RNA, 22 nt, Staphylococcus aureus subsp. aureus MW2
aacucuaaaagccaucuuaccu

SEQ ID NO: 4008286 - RNA, 12 nt, Staphylococcus aureus subsp. aureus MW2
aacucuaucuau

SEQ ID NO: 4008287 - RNA, 15 nt, Staphylococcus aureus subsp. aureus MW2
aacucucuaaaaagc

SEQ ID NO: 4008288 - RNA, 17 nt, Staphylococcus aureus subsp. aureus MW2
aacucugauauugaucu

SEQ ID NO: 4008289 - RNA, 16 nt, Staphylococcus aureus subsp. aureus MW2
aacugaauuaaagcau

SEQ ID NO: 4008290 - RNA, 13 nt, Staphylococcus aureus subsp. aureus MW2
aacugaauuucgu

SEQ ID NO: 4008291 - RNA, 21 nt, Staphylococcus aureus subsp. aureus MW2
aacugaguucaauuaaauuau

SEQ ID NO: 4008292 - RNA, 15 nt, Staphylococcus aureus subsp. aureus MW2
aacugauaauugaug

SEQ ID NO: 4008293 - RNA, 20 nt, Staphylococcus aureus subsp. aureus MW2
aacugcauguacaucuuuag

SEQ ID NO: 4008294 - RNA, 14 nt, Staphylococcus aureus subsp. aureus MW2
aacugcuaauuuuu

SEQ ID NO: 4008295 - RNA, 17 nt, Staphylococcus aureus subsp. aureus MW2
aacugcuuuuuauuaug

SEQ ID NO: 4008296 - RNA, 14 nt, Staphylococcus aureus subsp. aureus MW2
aacuggaacuuaca

SEQ ID NO: 4008297 - RNA, 18 nt, Staphylococcus aureus subsp. aureus MW2
aacuggaacuuacaaguc

SEQ ID NO: 4008298 - RNA, 14 nt, Staphylococcus aureus subsp. aureus MW2
aacugggauauaga

SEQ ID NO: 4008299 - RNA, 13 nt, Staphylococcus aureus subsp. aureus MW2
aacuguaaaacau

SEQ ID NO: 4008300 - RNA, 23 nt, Staphylococcus aureus subsp. aureus MW2
aacuguaugccgccuaauaauaa

SEQ ID NO: 4008301 - RNA, 20 nt, Staphylococcus aureus subsp. aureus MW2
aacugugauauuaauugaaa

SEQ ID NO: 4008302 - RNA, 23 nt, Staphylococcus aureus subsp. aureus MW2
aacugugauauuaauugaaaaac

SEQ ID NO: 4008303 - RNA, 17 nt, Staphylococcus aureus subsp. aureus MW2
aacuguuaaacucauac

SEQ ID NO: 4008304 - RNA, 14 nt, Staphylococcus aureus subsp. aureus MW2
aacuguucuaaaau

SEQ ID NO: 4008305 - RNA, 23 nt, Staphylococcus aureus subsp. aureus MW2
aacuguucuaaaauuaaccauuu

SEQ ID NO: 4008306 - RNA, 15 nt, Staphylococcus aureus subsp. aureus MW2
aacuguuuaucauga

SEQ ID NO: 4008307 - RNA, 23 nt, Staphylococcus aureus subsp. aureus MW2
aacuuaaaaaugaaaugaaguau

SEQ ID NO: 4008308 - RNA, 13 nt, Staphylococcus aureus subsp. aureus MW2
aacuuaaaacuau

SEQ ID NO: 4008309 - RNA, 19 nt, Staphylococcus aureus subsp. aureus MW2
aacuuaaaagagaauauaa

SEQ ID NO: 4008310 - RNA, 23 nt, Staphylococcus aureus subsp. aureus MW2
aacuuaaaagagaauauaaaaua

SEQ ID NO: 4008311 - RNA, 15 nt, Staphylococcus aureus subsp. aureus MW2
aacuuaaaauauuua

SEQ ID NO: 4008312 - RNA, 12 nt, Staphylococcus aureus subsp. aureus MW2
aacuuaaauauc

SEQ ID NO: 4008313 - RNA, 20 nt, Staphylococcus aureus subsp. aureus MW2
aacuuaaauaucgacaaauu

SEQ ID NO: 4008314 - RNA, 15 nt, Staphylococcus aureus subsp. aureus MW2
aacuuaacucuauca

SEQ ID NO: 4008315 - RNA, 23 nt, Staphylococcus aureus subsp. aureus MW2
aacuuaacucuaucaaauuacuu

SEQ ID NO: 4008316 - RNA, 21 nt, Staphylococcus aureus subsp. aureus MW2
aacuuaauaaccauguaaaau

SEQ ID NO: 4008317 - RNA, 21 nt, Staphylococcus aureus subsp. aureus MW2
aacuuaauacgauaauaacua

SEQ ID NO: 4008318 - RNA, 13 nt, Staphylococcus aureus subsp. aureus MW2
aacuuacauuaca

SEQ ID NO: 4008319 - RNA, 15 nt, Staphylococcus aureus subsp. aureus MW2
aacuuaccaugauga

SEQ ID NO: 4008320 - RNA, 15 nt, Staphylococcus aureus subsp. aureus MW2
aacuuacuuuuguaa

SEQ ID NO: 4008321 - RNA, 12 nt, Staphylococcus aureus subsp. aureus MW2
aacuuauaauau

SEQ ID NO: 4008322 - RNA, 16 nt, Staphylococcus aureus subsp. aureus MW2
aacuuaucugauuguu

SEQ ID NO: 4008323 - RNA, 15 nt, Staphylococcus aureus subsp. aureus MW2
aacuuauuauuuauc

SEQ ID NO: 4008324 - RNA, 13 nt, Staphylococcus aureus subsp. aureus MW2
aacuuauucuuca

SEQ ID NO: 4008325 - RNA, 14 nt, Staphylococcus aureus subsp. aureus MW2
aacuucaauaaugu

SEQ ID NO: 4008326 - RNA, 14 nt, Staphylococcus aureus subsp. aureus MW2
aacuucauaauaua

SEQ ID NO: 4008327 - RNA, 16 nt, Staphylococcus aureus subsp. aureus MW2
aacuucauaauauauc

SEQ ID NO: 4008328 - RNA, 13 nt, Staphylococcus aureus subsp. aureus MW2
aacuucaucuaaa

SEQ ID NO: 4008329 - RNA, 12 nt, Staphylococcus aureus subsp. aureus MW2
aacuucuacagu

SEQ ID NO: 4008330 - RNA, 13 nt, Staphylococcus aureus subsp. aureus MW2
aacuucucuuagu

SEQ ID NO: 4008331 - RNA, 22 nt, Staphylococcus aureus subsp. aureus MW2
aacuucugaaacgccucaacac

SEQ ID NO: 4008332 - RNA, 18 nt, Staphylococcus aureus subsp. aureus MW2
aacuucugguucuucacu

SEQ ID NO: 4008333 - RNA, 22 nt, Staphylococcus aureus subsp. aureus MW2
aacuucuucuccguauuuaccu

SEQ ID NO: 4008334 - RNA, 13 nt, Staphylococcus aureus subsp. aureus MW2
aacuucuuuucuu

SEQ ID NO: 4008335 - RNA, 13 nt, Staphylococcus aureus subsp. aureus MW2
aacuugaacagau

SEQ ID NO: 4008336 - RNA, 18 nt, Staphylococcus aureus subsp. aureus MW2
aacuugaacuaaaacaau

SEQ ID NO: 4008337 - RNA, 21 nt, Staphylococcus aureus subsp. aureus MW2
aacuugauauuauauaaaagu

SEQ ID NO: 4008338 - RNA, 20 nt, Staphylococcus aureus subsp. aureus MW2
aacuugaucauuauaaaaug

SEQ ID NO: 4008339 - RNA, 17 nt, Staphylococcus aureus subsp. aureus MW2
aacuugcacauuauugu

SEQ ID NO: 4008340 - RNA, 21 nt, Staphylococcus aureus subsp. aureus MW2
aacuugcauugucuguagaaa

SEQ ID NO: 4008341 - RNA, 18 nt, Staphylococcus aureus subsp. aureus MW2
aacuugccugguaacguu

SEQ ID NO: 4008342 - RNA, 22 nt, Staphylococcus aureus subsp. aureus MW2
aacuugucuaccgaaugaguuu

SEQ ID NO: 4008343 - RNA, 20 nt, Staphylococcus aureus subsp. aureus MW2
aacuugugauauauaaccau

SEQ ID NO: 4008344 - RNA, 20 nt, Staphylococcus aureus subsp. aureus MW2
aacuuguuguuauuuauuug

SEQ ID NO: 4008345 - RNA, 23 nt, Staphylococcus aureus subsp. aureus MW2
aacuuguuguuauuuauuugauu

SEQ ID NO: 4008346 - RNA, 15 nt, Staphylococcus aureus subsp. aureus MW2
aacuuuaaauguuuu

SEQ ID NO: 4008347 - RNA, 12 nt, Staphylococcus aureus subsp. aureus MW2
aacuuuaacauc

SEQ ID NO: 4008348 - RNA, 16 nt, Staphylococcus aureus subsp. aureus MW2
aacuuuaacaucugaa

SEQ ID NO: 4008349 - RNA, 20 nt, Staphylococcus aureus subsp. aureus MW2
aacuuuaacaucugaaucug

SEQ ID NO: 4008350 - RNA, 17 nt, Staphylococcus aureus subsp. aureus MW2
aacuuuaagcugucaua

SEQ ID NO: 4008351 - RNA, 20 nt, Staphylococcus aureus subsp. aureus MW2
aacuuuaauauaaguauaau

SEQ ID NO: 4008352 - RNA, 16 nt, Staphylococcus aureus subsp. aureus MW2
aacuuuacgauaaaua

SEQ ID NO: 4008353 - RNA, 17 nt, Staphylococcus aureus subsp. aureus MW2
aacuuuaguauauucaa

SEQ ID NO: 4008354 - RNA, 20 nt, Staphylococcus aureus subsp. aureus MW2
aacuuucacucauauuacuu

SEQ ID NO: 4008355 - RNA, 23 nt, Staphylococcus aureus subsp. aureus MW2
aacuuucagcaccagaacaauuc

SEQ ID NO: 4008356 - RNA, 11 nt, Staphylococcus aureus subsp. aureus MW2
aacuuucucua

SEQ ID NO: 4008357 - RNA, 19 nt, Staphylococcus aureus subsp. aureus MW2
aacuuuguaugaagauuua

SEQ ID NO: 4008358 - RNA, 22 nt, Staphylococcus aureus subsp. aureus MW2
aacuuuguaugaagauuuaagg

SEQ ID NO: 4008359 - RNA, 21 nt, Staphylococcus aureus subsp. aureus MW2
aagauuaugaaaacauuauua

SEQ ID NO: 4008360 - RNA, 14 nt, Staphylococcus aureus subsp. aureus MW2
aagauuauuauuac

SEQ ID NO: 4008361 - RNA, 20 nt, Staphylococcus aureus subsp. aureus MW2
aagauuauugaaauuuggua

SEQ ID NO: 4008362 - RNA, 19 nt, Staphylococcus aureus subsp. aureus MW2
aagauuauuugcgauauca

SEQ ID NO: 4008363 - RNA, 20 nt, Staphylococcus aureus subsp. aureus MW2
aagauuuguagcuugaauaa

SEQ ID NO: 4008364 - RNA, 23 nt, Staphylococcus aureus subsp. aureus MW2
aagauuuguagcuugaauaauau

SEQ ID NO: 4008365 - RNA, 19 nt, Staphylococcus aureus subsp. aureus MW2
aagcaaagaugauacccaa

SEQ ID NO: 4008366 - RNA, 19 nt, Staphylococcus aureus subsp. aureus MW2
aagcaacuguaaaugaaau

SEQ ID NO: 4008367 - RNA, 14 nt, Staphylococcus aureus subsp. aureus MW2
aagcaauacgauug

SEQ ID NO: 4008368 - RNA, 18 nt, Staphylococcus aureus subsp. aureus MW2
aagcaaucuuaguacaaa

SEQ ID NO: 4008369 - RNA, 17 nt, Staphylococcus aureus subsp. aureus MW2
aagcacagaaaauuaua

SEQ ID NO: 4008370 - RNA, 19 nt, Staphylococcus aureus subsp. aureus MW2
aagcacagaaaauuauacu

SEQ ID NO: 4008371 - RNA, 14 nt, Staphylococcus aureus subsp. aureus MW2
aagcaccuaaaaua

SEQ ID NO: 4008372 - RNA, 19 nt, Staphylococcus aureus subsp. aureus MW2
aagcaccuaaaauagaaaa

SEQ ID NO: 4008373 - RNA, 21 nt, Staphylococcus aureus subsp. aureus MW2
aagcaccuaaaauagaaaaau

SEQ ID NO: 4008374 - RNA, 23 nt, Staphylococcus aureus subsp. aureus MW2
aagcacgugguugguuaccaucu

SEQ ID NO: 4008375 - RNA, 14 nt, Staphylococcus aureus subsp. aureus MW2
aagcagcuugccua

SEQ ID NO: 4008376 - RNA, 18 nt, Staphylococcus aureus subsp. aureus MW2
aagcagucugcucuuuuu

SEQ ID NO: 4008377 - RNA, 17 nt, Staphylococcus aureus subsp. aureus MW2
aagcauaccuacagaau

SEQ ID NO: 4008378 - RNA, 18 nt, Staphylococcus aureus subsp. aureus MW2
aagcauaccuacagaaug

SEQ ID NO: 4008379 - RNA, 18 nt, Staphylococcus aureus subsp. aureus MW2
aagcauaucuuuaucauu

SEQ ID NO: 4008380 - RNA, 14 nt, Staphylococcus aureus subsp. aureus MW2
aagcaucauauaca

SEQ ID NO: 4008381 - RNA, 14 nt, Staphylococcus aureus subsp. aureus MW2
aagcaucgaacaau

SEQ ID NO: 4008382 - RNA, 18 nt, Staphylococcus aureus subsp. aureus MW2
aagcaucguaaaaaacaa

SEQ ID NO: 4008383 - RNA, 16 nt, Staphylococcus aureus subsp. aureus MW2
aagcauuaaguucauc

SEQ ID NO: 4008384 - RNA, 19 nt, Staphylococcus aureus subsp. aureus MW2
aagcauuaaguucaucaug

SEQ ID NO: 4008385 - RNA, 16 nt, Staphylococcus aureus subsp. aureus MW2
aagccaacacauaaau

SEQ ID NO: 4008386 - RNA, 22 nt, Staphylococcus aureus subsp. aureus MW2
aagccaguugaaguugaagcgg

SEQ ID NO: 4008387 - RNA, 14 nt, Staphylococcus aureus subsp. aureus MW2
aagccauuuuucuu

SEQ ID NO: 4008388 - RNA, 14 nt, Staphylococcus aureus subsp. aureus MW2
aagccccuuacaac

SEQ ID NO: 4008389 - RNA, 14 nt, Staphylococcus aureus subsp. aureus MW2
aagccccuuuuaaa

SEQ ID NO: 4008390 - RNA, 22 nt, Staphylococcus aureus subsp. aureus MW2
aagccccuuuuaaauucuuaua

SEQ ID NO: 4008391 - RNA, 17 nt, Staphylococcus aureus subsp. aureus MW2
aagccuucaauaguuuc

SEQ ID NO: 4008392 - RNA, 14 nt, Staphylococcus aureus subsp. aureus MW2
aagccuucuauaua

SEQ ID NO: 4008393 - RNA, 20 nt, Staphylococcus aureus subsp. aureus MW2
aagcgacgauuggaaaguuu

SEQ ID NO: 4008394 - RNA, 13 nt, Staphylococcus aureus subsp. aureus MW2
aagcgauuuccau

SEQ ID NO: 4008395 - RNA, 23 nt, Staphylococcus aureus subsp. aureus MW2
aagcgcaugcuugaacuuuuauu

SEQ ID NO: 4008396 - RNA, 19 nt, Staphylococcus aureus subsp. aureus MW2
aagcgccugucucauuagc

SEQ ID NO: 4008397 - RNA, 17 nt, Staphylococcus aureus subsp. aureus MW2
aagcgcuuggauuuuuu

SEQ ID NO: 4008398 - RNA, 17 nt, Staphylococcus aureus subsp. aureus MW2
aagcgggacucaucgag

SEQ ID NO: 4008399 - RNA, 18 nt, Staphylococcus aureus subsp. aureus MW2
aagcggguugaagcaauu

SEQ ID NO: 4008400 - RNA, 14 nt, Staphylococcus aureus subsp. aureus MW2
aagcguaauauuua

SEQ ID NO: 4008401 - RNA, 15 nt, Staphylococcus aureus subsp. aureus MW2
aagcguaugauguug

SEQ ID NO: 4008402 - RNA, 21 nt, Staphylococcus aureus subsp. aureus MW2
aagcguucgugauagaaguuu

SEQ ID NO: 4008403 - RNA, 15 nt, Staphylococcus aureus subsp. aureus MW2
aagcuaaagaguuau

SEQ ID NO: 4008404 - RNA, 15 nt, Staphylococcus aureus subsp. aureus MW2
aagcuaaauguuaau

SEQ ID NO: 4008405 - RNA, 14 nt, Staphylococcus aureus subsp. aureus MW2
aagcuaaguuugaa

SEQ ID NO: 4008406 - RNA, 13 nt, Staphylococcus aureus subsp. aureus MW2
aagcuaauaucaa

SEQ ID NO: 4008407 - RNA, 13 nt, Staphylococcus aureus subsp. aureus MW2
aagcuaauauuua

SEQ ID NO: 4008408 - RNA, 23 nt, Staphylococcus aureus subsp. aureus MW2
aagcuaauucauauucaaauuua

SEQ ID NO: 4008409 - RNA, 13 nt, Staphylococcus aureus subsp. aureus MW2
aagcuacccguuu

SEQ ID NO: 4008410 - RNA, 18 nt, Staphylococcus aureus subsp. aureus MW2
aagcuagaaguucuuaug

SEQ ID NO: 4008411 - RNA, 21 nt, Staphylococcus aureus subsp. aureus MW2
aagcuagaaguucuuaugcag

SEQ ID NO: 4008412 - RNA, 13 nt, Staphylococcus aureus subsp. aureus MW2
aagcuagcuacaa

SEQ ID NO: 4008413 - RNA, 14 nt, Staphylococcus aureus subsp. aureus MW2
aagcuauaaaaaau

SEQ ID NO: 4008414 - RNA, 21 nt, Staphylococcus aureus subsp. aureus MW2
aagcuauaaaaaaucuuuuga

SEQ ID NO: 4008415 - RNA, 18 nt, Staphylococcus aureus subsp. aureus MW2
aagcucaauaaauuauga

SEQ ID NO: 4008416 - RNA, 14 nt, Staphylococcus aureus subsp. aureus MW2
aagcucaugaauca

SEQ ID NO: 4008417 - RNA, 15 nt, Staphylococcus aureus subsp. aureus MW2
aagcucaugaaucag

SEQ ID NO: 4008418 - RNA, 20 nt, Staphylococcus aureus subsp. aureus MW2
aagcucaugaaucagaugau

SEQ ID NO: 4008419 - RNA, 20 nt, Staphylococcus aureus subsp. aureus MW2
aagcucauuucaauauuaaa

SEQ ID NO: 4008420 - RNA, 13 nt, Staphylococcus aureus subsp. aureus MW2
aagcucccauuaa

SEQ ID NO: 4008421 - RNA, 21 nt, Staphylococcus aureus subsp. aureus MW2
aagcucuuuuuuguuauaucu

SEQ ID NO: 4008422 - RNA, 20 nt, Staphylococcus aureus subsp. aureus MW2
aagcugacaaaccaauuuua

SEQ ID NO: 4008423 - RNA, 23 nt, Staphylococcus aureus subsp. aureus MW2
aagcugacaaaccaauuuuaaua

SEQ ID NO: 4008424 - RNA, 14 nt, Staphylococcus aureus subsp. aureus MW2
aagcugauuucuau

SEQ ID NO: 4008425 - RNA, 18 nt, Staphylococcus aureus subsp. aureus MW2
aagcugauuuuucauuga

SEQ ID NO: 4008426 - RNA, 17 nt, Staphylococcus aureus subsp. aureus MW2
aagcugcaauuaugcca

SEQ ID NO: 4008427 - RNA, 20 nt, Staphylococcus aureus subsp. aureus MW2
aagcugcgauauaacuaaaa

SEQ ID NO: 4008428 - RNA, 16 nt, Staphylococcus aureus subsp. aureus MW2
aagcuggcggaaaguc

SEQ ID NO: 4008429 - RNA, 19 nt, Staphylococcus aureus subsp. aureus MW2
aagcuggcggaaagucagc

SEQ ID NO: 4008430 - RNA, 20 nt, Staphylococcus aureus subsp. aureus MW2
aagcuggcggaaagucaggu

SEQ ID NO: 4008431 - RNA, 14 nt, Staphylococcus aureus subsp. aureus MW2
aagcugucauaccu

SEQ ID NO: 4008432 - RNA, 17 nt, Staphylococcus aureus subsp. aureus MW2
aagcugucuuacugcug

SEQ ID NO: 4008433 - RNA, 15 nt, Staphylococcus aureus subsp. aureus MW2
aagcuuaucaacgau

SEQ ID NO: 4008434 - RNA, 13 nt, Staphylococcus aureus subsp. aureus MW2
aagcuuauuaaau

SEQ ID NO: 4008435 - RNA, 16 nt, Staphylococcus aureus subsp. aureus MW2
aagcuugcgauaaguu

SEQ ID NO: 4008436 - RNA, 18 nt, Staphylococcus aureus subsp. aureus MW2
aagcuugcgauaaguuca

SEQ ID NO: 4008437 - RNA, 15 nt, Staphylococcus aureus subsp. aureus MW2
aagcuuuaacuugau

SEQ ID NO: 4008438 - RNA, 15 nt, Staphylococcus aureus subsp. aureus MW2
aagcuuuaguuaaau

SEQ ID NO: 4008439 - RNA, 17 nt, Staphylococcus aureus subsp. aureus MW2
aagcuuuaguuaaauag

SEQ ID NO: 4008440 - RNA, 18 nt, Staphylococcus aureus subsp. aureus MW2
aagcuuuauaaaacgcuu

SEQ ID NO: 4008441 - RNA, 13 nt, Staphylococcus aureus subsp. aureus MW2
aagcuuugacaua

SEQ ID NO: 4008442 - RNA, 14 nt, Staphylococcus aureus subsp. aureus MW2
aagcuuugacauau

SEQ ID NO: 4008443 - RNA, 21 nt, Staphylococcus aureus subsp. aureus MW2
aagcuuugcugcuuuuccauu

SEQ ID NO: 4008444 - RNA, 19 nt, Staphylococcus aureus subsp. aureus MW2
aagcuuuuacgccuucuuu

SEQ ID NO: 4008445 - RNA, 15 nt, Staphylococcus aureus subsp. aureus MW2
aagcuuuuuugcuuu

SEQ ID NO: 4008446 - RNA, 21 nt, Staphylococcus aureus subsp. aureus MW2
aagcuuuuuugcuuuuauaau

SEQ ID NO: 4008447 - RNA, 23 nt, Staphylococcus aureus subsp. aureus MW2
aagcuuuuuugcuuuuauaauaa

SEQ ID NO: 4008448 - RNA, 13 nt, Staphylococcus aureus subsp. aureus MW2
aaggaaagcuuca

SEQ ID NO: 4008449 - RNA, 12 nt, Staphylococcus aureus subsp. aureus MW2
aaggaaccuguc

SEQ ID NO: 4008450 - RNA, 20 nt, Staphylococcus aureus subsp. aureus MW2
aaggaauagcuacaauuaaa

SEQ ID NO: 4008451 - RNA, 13 nt, Staphylococcus aureus subsp. aureus MW2
aaggaauuucaaa

SEQ ID NO: 4008452 - RNA, 17 nt, Staphylococcus aureus subsp. aureus MW2
aaggacgucuuuuuaga

SEQ ID NO: 4008453 - RNA, 19 nt, Staphylococcus aureus subsp. aureus MW2
aaggaucauguuccccauu

SEQ ID NO: 4008454 - RNA, 15 nt, Staphylococcus aureus subsp. aureus MW2
aaggaugaguuuaaa

SEQ ID NO: 4008455 - RNA, 20 nt, Staphylococcus aureus subsp. aureus MW2
aaggaugaugugaauguuuu

SEQ ID NO: 4008456 - RNA, 16 nt, Staphylococcus aureus subsp. aureus MW2
aaggauguuauaaaau

SEQ ID NO: 4008457 - RNA, 14 nt, Staphylococcus aureus subsp. aureus MW2
aaggccauuuuuau

SEQ ID NO: 4008458 - RNA, 16 nt, Staphylococcus aureus subsp. aureus MW2
aaggcgaaacauuaaa

SEQ ID NO: 4008459 - RNA, 16 nt, Staphylococcus aureus subsp. aureus MW2
aaggcgcucucuuuuu

SEQ ID NO: 4008460 - RNA, 20 nt, Staphylococcus aureus subsp. aureus MW2
aaggcuagcuaaaauuugcu

SEQ ID NO: 4008461 - RNA, 14 nt, Staphylococcus aureus subsp. aureus MW2
aaggcucauuuguu

SEQ ID NO: 4008462 - RNA, 21 nt, Staphylococcus aureus subsp. aureus MW2
aagggaucggucuugaaaacc

SEQ ID NO: 4008463 - RNA, 12 nt, Staphylococcus aureus subsp. aureus MW2
aagggcaaaaaa

SEQ ID NO: 4008464 - RNA, 22 nt, Staphylococcus aureus subsp. aureus MW2
aaggguguuuagauagcucuau

SEQ ID NO: 4008465 - RNA, 14 nt, Staphylococcus aureus subsp. aureus MW2
aagguaauuuaaca

SEQ ID NO: 4008466 - RNA, 16 nt, Staphylococcus aureus subsp. aureus MW2
aagguaauuuaacauu

SEQ ID NO: 4008467 - RNA, 21 nt, Staphylococcus aureus subsp. aureus MW2
aagguacguuguaauaguaag

SEQ ID NO: 4008468 - RNA, 23 nt, Staphylococcus aureus subsp. aureus MW2
aagguagcguagcauuauuuaaa

SEQ ID NO: 4008469 - RNA, 15 nt, Staphylococcus aureus subsp. aureus MW2
aagguauucuauuuu

SEQ ID NO: 4008470 - RNA, 14 nt, Staphylococcus aureus subsp. aureus MW2
aaggucuauauaua

SEQ ID NO: 4008471 - RNA, 19 nt, Staphylococcus aureus subsp. aureus MW2
aaggucuauauauauuuaa

SEQ ID NO: 4008472 - RNA, 16 nt, Staphylococcus aureus subsp. aureus MW2
aaggugauugaacaau

SEQ ID NO: 4008473 - RNA, 19 nt, Staphylococcus aureus subsp. aureus MW2
aagguguucgggaauuuuu

SEQ ID NO: 4008474 - RNA, 19 nt, Staphylococcus aureus subsp. aureus MW2
aagguuauuuuuuaugguc

SEQ ID NO: 4008475 - RNA, 22 nt, Staphylococcus aureus subsp. aureus MW2
aagguuguuuuucaucauuaaa

SEQ ID NO: 4008476 - RNA, 14 nt, Staphylococcus aureus subsp. aureus MW2
aaguaaaaguuuug

SEQ ID NO: 4008477 - RNA, 14 nt, Staphylococcus aureus subsp. aureus MW2
aaguaaaauaaaaa

SEQ ID NO: 4008478 - RNA, 21 nt, Staphylococcus aureus subsp. aureus MW2
aaguaaacgagacaucaucua

SEQ ID NO: 4008479 - RNA, 21 nt, Staphylococcus aureus subsp. aureus MW2
aaguaaagggaggaauuaaua

SEQ ID NO: 4008480 - RNA, 17 nt, Staphylococcus aureus subsp. aureus MW2
aaguaacauaugcaagu

SEQ ID NO: 4008481 - RNA, 14 nt, Staphylococcus aureus subsp. aureus MW2
aaguaaccacaaca

SEQ ID NO: 4008482 - RNA, 19 nt, Staphylococcus aureus subsp. aureus MW2
aaguaagcguaauauuuaa

SEQ ID NO: 4008483 - RNA, 21 nt, Staphylococcus aureus subsp. aureus MW2
aaguaagcguaauauuuaaga

SEQ ID NO: 4008484 - RNA, 12 nt, Staphylococcus aureus subsp. aureus MW2
aaguaauaacuc

SEQ ID NO: 4008485 - RNA, 20 nt, Staphylococcus aureus subsp. aureus MW2
aaguaauaauauaaauaaaa

SEQ ID NO: 4008486 - RNA, 15 nt, Staphylococcus aureus subsp. aureus MW2
aaguaauaauggcaa

SEQ ID NO: 4008487 - RNA, 20 nt, Staphylococcus aureus subsp. aureus MW2
aaguaauaauuuauugauaa

SEQ ID NO: 4008488 - RNA, 22 nt, Staphylococcus aureus subsp. aureus MW2
aaguaauccccgaagcacagaa

SEQ ID NO: 4008489 - RNA, 24 nt, Staphylococcus aureus subsp. aureus MW2
aaguaaugcuuuacuauauucaau

SEQ ID NO: 4008490 - RNA, 15 nt, Staphylococcus aureus subsp. aureus MW2
aaguaaugugcauug

SEQ ID NO: 4008491 - RNA, 18 nt, Staphylococcus aureus subsp. aureus MW2
aaguaaugugcauugcuu

SEQ ID NO: 4008492 - RNA, 13 nt, Staphylococcus aureus subsp. aureus MW2
aaguaauuaaaua

SEQ ID NO: 4008493 - RNA, 15 nt, Staphylococcus aureus subsp. aureus MW2
aaguaauuaaauacu

SEQ ID NO: 4008494 - RNA, 13 nt, Staphylococcus aureus subsp. aureus MW2
aaguaauuucucu

SEQ ID NO: 4008495 - RNA, 14 nt, Staphylococcus aureus subsp. aureus MW2
aaguacaaauaaua

SEQ ID NO: 4008496 - RNA, 14 nt, Staphylococcus aureus subsp. aureus MW2
aaguacauaaaugc

SEQ ID NO: 4008497 - RNA, 14 nt, Staphylococcus aureus subsp. aureus MW2
aaguacgcaauuua

SEQ ID NO: 4008498 - RNA, 22 nt, Staphylococcus aureus subsp. aureus MW2
aaguacgcaauuuaauauuaua

SEQ ID NO: 4008499 - RNA, 17 nt, Staphylococcus aureus subsp. aureus MW2
aaguacuuacaaauaua

SEQ ID NO: 4008500 - RNA, 22 nt, Staphylococcus aureus subsp. aureus MW2
aaguacuuaccuuucaaauaua

SEQ ID NO: 4008501 - RNA, 13 nt, Staphylococcus aureus subsp. aureus MW2
aaguacuuuacca

SEQ ID NO: 4008502 - RNA, 14 nt, Staphylococcus aureus subsp. aureus MW2
aaguacuuuaccac

SEQ ID NO: 4008503 - RNA, 14 nt, Staphylococcus aureus subsp. aureus MW2
aaguacuuuuacaa

SEQ ID NO: 4008504 - RNA, 16 nt, Staphylococcus aureus subsp. aureus MW2
aaguagacauugaaag

SEQ ID NO: 4008505 - RNA, 17 nt, Staphylococcus aureus subsp. aureus MW2
aaguagcucaaaacaau

SEQ ID NO: 4008506 - RNA, 20 nt, Staphylococcus aureus subsp. aureus MW2
aaguaggcugaaguugaagc

SEQ ID NO: 4008507 - RNA, 21 nt, Staphylococcus aureus subsp. aureus MW2
aaguagucgaagaagauuaug

SEQ ID NO: 4008508 - RNA, 18 nt, Staphylococcus aureus subsp. aureus MW2
aaguauaagguugaagaa

SEQ ID NO: 4008509 - RNA, 15 nt, Staphylococcus aureus subsp. aureus MW2
aaguauaauuaaacu

SEQ ID NO: 4008510 - RNA, 14 nt, Staphylococcus aureus subsp. aureus MW2
aaguauagaccauc

SEQ ID NO: 4008511 - RNA, 18 nt, Staphylococcus aureus subsp. aureus MW2
aaguauauaagcaaagac

SEQ ID NO: 4008512 - RNA, 13 nt, Staphylococcus aureus subsp. aureus MW2
aaguauaugaauc

SEQ ID NO: 4008513 - RNA, 21 nt, Staphylococcus aureus subsp. aureus MW2
aaguauaugaaucgauauaau

SEQ ID NO: 4008514 - RNA, 23 nt, Staphylococcus aureus subsp. aureus MW2
aaguaucgccaaucuauugcaau

SEQ ID NO: 4008515 - RNA, 21 nt, Staphylococcus aureus subsp. aureus MW2
aaguaugagacgcauugcaag

SEQ ID NO: 4008516 - RNA, 17 nt, Staphylococcus aureus subsp. aureus MW2
aaguaugagagauagaa

SEQ ID NO: 4008517 - RNA, 18 nt, Staphylococcus aureus subsp. aureus MW2
aaguaugaguuauuaagc

SEQ ID NO: 4008518 - RNA, 20 nt, Staphylococcus aureus subsp. aureus MW2
aaguaugcgccauacauaug

SEQ ID NO: 4008519 - RNA, 14 nt, Staphylococcus aureus subsp. aureus MW2
aaguauggcaguuu

SEQ ID NO: 4008520 - RNA, 22 nt, Staphylococcus aureus subsp. aureus MW2
aaguauggcgaaauguuuugga

SEQ ID NO: 4008521 - RNA, 20 nt, Staphylococcus aureus subsp. aureus MW2
aaguaugucaucuucaauuc

SEQ ID NO: 4008522 - RNA, 15 nt, Staphylococcus aureus subsp. aureus MW2
aaguauguugucaua

SEQ ID NO: 4008523 - RNA, 14 nt, Staphylococcus aureus subsp. aureus MW2
aaguauuaugauug

SEQ ID NO: 4008524 - RNA, 16 nt, Staphylococcus aureus subsp. aureus MW2
aaguauuaugauugcu

SEQ ID NO: 4008525 - RNA, 21 nt, Staphylococcus aureus subsp. aureus MW2
aaguauuuaaaccuaaugaua

SEQ ID NO: 4008526 - RNA, 16 nt, Staphylococcus aureus subsp. aureus MW2
aaguauuugaaguauu

SEQ ID NO: 4008527 - RNA, 13 nt, Staphylococcus aureus subsp. aureus MW2
aaguauuuuccuu

SEQ ID NO: 4008528 - RNA, 15 nt, Staphylococcus aureus subsp. aureus MW2
aaguauuuuccuuca

SEQ ID NO: 4008529 - RNA, 13 nt, Staphylococcus aureus subsp. aureus MW2
aagucaauuuaaa

SEQ ID NO: 4008530 - RNA, 13 nt, Staphylococcus aureus subsp. aureus MW2
aagucaccuucag

SEQ ID NO: 4008531 - RNA, 16 nt, Staphylococcus aureus subsp. aureus MW2
aagucagcauacaaua

SEQ ID NO: 4008532 - RNA, 17 nt, Staphylococcus aureus subsp. aureus MW2
aagucagcauacaauaa

SEQ ID NO: 4008533 - RNA, 18 nt, Staphylococcus aureus subsp. aureus MW2
aagucagcgauaauuguu

SEQ ID NO: 4008534 - RNA, 17 nt, Staphylococcus aureus subsp. aureus MW2
aagucagcuuacaauaa

SEQ ID NO: 4008535 - RNA, 23 nt, Staphylococcus aureus subsp. aureus MW2
aagucauacacaaugauuauaaa

SEQ ID NO: 4008536 - RNA, 15 nt, Staphylococcus aureus subsp. aureus MW2
aagucauuaaaugua

SEQ ID NO: 4008537 - RNA, 15 nt, Staphylococcus aureus subsp. aureus MW2
aaguuuguuuucuuu

SEQ ID NO: 4008538 - RNA, 13 nt, Staphylococcus aureus subsp. aureus MW2
aaguuuucauuua

SEQ ID NO: 4008539 - RNA, 13 nt, Staphylococcus aureus subsp. aureus MW2
aaguuuucauuuu

SEQ ID NO: 4008540 - RNA, 13 nt, Staphylococcus aureus subsp. aureus MW2
aauaaaaaaugca

SEQ ID NO: 4008541 - RNA, 15 nt, Staphylococcus aureus subsp. aureus MW2
aauaaaaaaugcacu

SEQ ID NO: 4008542 - RNA, 16 nt, Staphylococcus aureus subsp. aureus MW2
aauaaaaaggagcgac

SEQ ID NO: 4008543 - RNA, 15 nt, Staphylococcus aureus subsp. aureus MW2
aauaaaaauacauaa

SEQ ID NO: 4008544 - RNA, 17 nt, Staphylococcus aureus subsp. aureus MW2
aauaaaaauacauaauu

SEQ ID NO: 4008545 - RNA, 15 nt, Staphylococcus aureus subsp. aureus MW2
aauaaaaauugaauu

SEQ ID NO: 4008546 - RNA, 20 nt, Staphylococcus aureus subsp. aureus MW2
aauaaaacgcuucauauaaa

SEQ ID NO: 4008547 - RNA, 18 nt, Staphylococcus aureus subsp. aureus MW2
aauaaaacugcaauaauu

SEQ ID NO: 4008548 - RNA, 14 nt, Staphylococcus aureus subsp. aureus MW2
aauaaaacuuauaa

SEQ ID NO: 4008549 - RNA, 18 nt, Staphylococcus aureus subsp. aureus MW2
aauaaaagucgauaaaua

SEQ ID NO: 4008550 - RNA, 16 nt, Staphylococcus aureus subsp. aureus MW2
aauaaaauauaucuua

SEQ ID NO: 4008551 - RNA, 14 nt, Staphylococcus aureus subsp. aureus MW2
aauaaaaucaaagc

SEQ ID NO: 4008552 - RNA, 13 nt, Staphylococcus aureus subsp. aureus MW2
aauaaaauuaaaa

SEQ ID NO: 4008553 - RNA, 15 nt, Staphylococcus aureus subsp. aureus MW2
aauaaaauucuauaa

SEQ ID NO: 4008554 - RNA, 16 nt, Staphylococcus aureus subsp. aureus MW2
aauaaacaacugcaau

SEQ ID NO: 4008555 - RNA, 22 nt, Staphylococcus aureus subsp. aureus MW2
aauaaacaacugcaauagcuau

SEQ ID NO: 4008556 - RNA, 12 nt, Staphylococcus aureus subsp. aureus MW2
aauaaaccagug

SEQ ID NO: 4008557 - RNA, 21 nt, Staphylococcus aureus subsp. aureus MW2
aauaaagagguacuagaauua

SEQ ID NO: 4008558 - RNA, 17 nt, Staphylococcus aureus subsp. aureus MW2
aauaaagauuauaucuu

SEQ ID NO: 4008559 - RNA, 11 nt, Staphylococcus aureus subsp. aureus MW2
aauaaaggucu

SEQ ID NO: 4008560 - RNA, 19 nt, Staphylococcus aureus subsp. aureus MW2
aauaaaggucuauauauau

SEQ ID NO: 4008561 - RNA, 24 nt, Staphylococcus aureus subsp. aureus MW2
aauaaaggucuauauauauuuaaa

SEQ ID NO: 4008562 - RNA, 17 nt, Staphylococcus aureus subsp. aureus MW2
aauaaaguccaauacaa

SEQ ID NO: 4008563 - RNA, 20 nt, Staphylococcus aureus subsp. aureus MW2
aauaaaguccaauacaauuu

SEQ ID NO: 4008564 - RNA, 12 nt, Staphylococcus aureus subsp. aureus MW2
aauaaauaacuu

SEQ ID NO: 4008565 - RNA, 19 nt, Staphylococcus aureus subsp. aureus MW2
aauaaauaagcaaucauaa

SEQ ID NO: 4008566 - RNA, 13 nt, Staphylococcus aureus subsp. aureus MW2
aauaaauacaaua

SEQ ID NO: 4008567 - RNA, 14 nt, Staphylococcus aureus subsp. aureus MW2
aauaaauacaaugu

SEQ ID NO: 4008568 - RNA, 16 nt, Staphylococcus aureus subsp. aureus MW2
aauaaauacaauguua

SEQ ID NO: 4008569 - RNA, 21 nt, Staphylococcus aureus subsp. aureus MW2
aauaaauaggaugaaaaagau

SEQ ID NO: 4008570 - RNA, 20 nt, Staphylococcus aureus subsp. aureus MW2
aauaaaucauacgagaaauu

SEQ ID NO: 4008571 - RNA, 19 nt, Staphylococcus aureus subsp. aureus MW2
aauaaaucggacugauaga

SEQ ID NO: 4008572 - RNA, 16 nt, Staphylococcus aureus subsp. aureus MW2
aauaaaucuaucuauu

SEQ ID NO: 4008573 - RNA, 17 nt, Staphylococcus aureus subsp. aureus MW2
aauaaaucuaucuauuc

SEQ ID NO: 4008574 - RNA, 19 nt, Staphylococcus aureus subsp. aureus MW2
aauaaaucuaucuauucaa

SEQ ID NO: 4008575 - RNA, 13 nt, Staphylococcus aureus subsp. aureus MW2
aauaaaucuuucc

SEQ ID NO: 4008576 - RNA, 21 nt, Staphylococcus aureus subsp. aureus MW2
aauaaaugacuucacauuuau

SEQ ID NO: 4008577 - RNA, 12 nt, Staphylococcus aureus subsp. aureus MW2
aauaaaugguuu

SEQ ID NO: 4008578 - RNA, 14 nt, Staphylococcus aureus subsp. aureus MW2
aauaaauguccgau

SEQ ID NO: 4008579 - RNA, 19 nt, Staphylococcus aureus subsp. aureus MW2
aauaaauuagccauuucaa

SEQ ID NO: 4008580 - RNA, 24 nt, Staphylococcus aureus subsp. aureus MW2
aauaaauuguaauauauuaauauu

SEQ ID NO: 4008581 - RNA, 18 nt, Staphylococcus aureus subsp. aureus MW2
aauaaauuguaugaauaa

SEQ ID NO: 4008582 - RNA, 17 nt, Staphylococcus aureus subsp. aureus MW2
aauaaauuuagauauaa

SEQ ID NO: 4008583 - RNA, 21 nt, Staphylococcus aureus subsp. aureus MW2
aauaaauuuagauauaauaaa

SEQ ID NO: 4008584 - RNA, 13 nt, Staphylococcus aureus subsp. aureus MW2
aauaaauuuauaa

SEQ ID NO: 4008585 - RNA, 19 nt, Staphylococcus aureus subsp. aureus MW2
aauaaauuuugagaaaaua

SEQ ID NO: 4008586 - RNA, 18 nt, Staphylococcus aureus subsp. aureus MW2
aauaacaaaauuaaauau

SEQ ID NO: 4008587 - RNA, 18 nt, Staphylococcus aureus subsp. aureus MW2
aauaacaccuuucauuug

SEQ ID NO: 4008588 - RNA, 17 nt, Staphylococcus aureus subsp. aureus MW2
aauaacacgauuugguu

SEQ ID NO: 4008589 - RNA, 19 nt, Staphylococcus aureus subsp. aureus MW2
aauaacagcuacaaauaau

SEQ ID NO: 4008590 - RNA, 19 nt, Staphylococcus aureus subsp. aureus MW2
aauaacauccccaaaaaua

SEQ ID NO: 4008591 - RNA, 12 nt, Staphylococcus aureus subsp. aureus MW2
aauaacaucuaa

SEQ ID NO: 4008592 - RNA, 15 nt, Staphylococcus aureus subsp. aureus MW2
aauaacaucuaaauu

SEQ ID NO: 4008593 - RNA, 12 nt, Staphylococcus aureus subsp. aureus MW2
aauaacauguuu

SEQ ID NO: 4008594 - RNA, 17 nt, Staphylococcus aureus subsp. aureus MW2
aauaacauguuuguggc

SEQ ID NO: 4008595 - RNA, 13 nt, Staphylococcus aureus subsp. aureus MW2
aauaacauugaac

SEQ ID NO: 4008596 - RNA, 21 nt, Staphylococcus aureus subsp. aureus MW2
aauaaccaccaucccauuaaa

SEQ ID NO: 4008597 - RNA, 16 nt, Staphylococcus aureus subsp. aureus MW2
aauaacccauuuucaa

SEQ ID NO: 4008598 - RNA, 18 nt, Staphylococcus aureus subsp. aureus MW2
aauaaccgcacuuucuau

SEQ ID NO: 4008599 - RNA, 16 nt, Staphylococcus aureus subsp. aureus MW2
aauaaccuacauuaau

SEQ ID NO: 4008600 - RNA, 19 nt, Staphylococcus aureus subsp. aureus MW2
aauaaccuagguuaaagau

SEQ ID NO: 4008601 - RNA, 23 nt, Staphylococcus aureus subsp. aureus MW2
aauaaccuuuaaaacaucauuca

SEQ ID NO: 4008602 - RNA, 14 nt, Staphylococcus aureus subsp. aureus MW2
aauaacgcauauaa

SEQ ID NO: 4008603 - RNA, 18 nt, Staphylococcus aureus subsp. aureus MW2
aauaacgucacaacggca

SEQ ID NO: 4008604 - RNA, 22 nt, Staphylococcus aureus subsp. aureus MW2
aauaacuagauguucacauucu

SEQ ID NO: 4008605 - RNA, 13 nt, Staphylococcus aureus subsp. aureus MW2
aauaacucaguaa

SEQ ID NO: 4008606 - RNA, 23 nt, Staphylococcus aureus subsp. aureus MW2
aauaacucuucuaaguuauuaca

SEQ ID NO: 4008607 - RNA, 15 nt, Staphylococcus aureus subsp. aureus MW2
aauaacugaguuaaa

SEQ ID NO: 4008608 - RNA, 16 nt, Staphylococcus aureus subsp. aureus MW2
aauaacuggcaaauca

SEQ ID NO: 4008609 - RNA, 20 nt, Staphylococcus aureus subsp. aureus MW2
aauaacuggcaaaucaaaca

SEQ ID NO: 4008610 - RNA, 19 nt, Staphylococcus aureus subsp. aureus MW2
aauaagaauguguuaauca

SEQ ID NO: 4008611 - RNA, 20 nt, Staphylococcus aureus subsp. aureus MW2
aauaagacuucccuauaugu

SEQ ID NO: 4008612 - RNA, 18 nt, Staphylococcus aureus subsp. aureus MW2
aauaagagggaagugaag

SEQ ID NO: 4008613 - RNA, 15 nt, Staphylococcus aureus subsp. aureus MW2
aauaagauuuugcuu

SEQ ID NO: 4008614 - RNA, 22 nt, Staphylococcus aureus subsp. aureus MW2
aauaagauuuugcuuuaaacau

SEQ ID NO: 4008615 - RNA, 17 nt, Staphylococcus aureus subsp. aureus MW2
aauaagcguaaaaucau

SEQ ID NO: 4008616 - RNA, 11 nt, Staphylococcus aureus subsp. aureus MW2
aauaaguaugg

SEQ ID NO: 4008617 - RNA, 20 nt, Staphylococcus aureus subsp. aureus MW2
aauaagugauaaauaaugca

SEQ ID NO: 4008618 - RNA, 13 nt, Staphylococcus aureus subsp. aureus MW2
aauaaguuaccuu

SEQ ID NO: 4008619 - RNA, 19 nt, Staphylococcus aureus subsp. aureus MW2
aauaaguugucaucuaauu

SEQ ID NO: 4008620 - RNA, 11 nt, Staphylococcus aureus subsp. aureus MW2
aauaauaaaau

SEQ ID NO: 4008621 - RNA, 12 nt, Staphylococcus aureus subsp. aureus MW2
aauaauaaaaua

SEQ ID NO: 4008622 - RNA, 16 nt, Staphylococcus aureus subsp. aureus MW2
aauaauaaacuuaaaa

SEQ ID NO: 4008623 - RNA, 16 nt, Staphylococcus aureus subsp. aureus MW2
aauaauacauucauua

SEQ ID NO: 4008624 - RNA, 17 nt, Staphylococcus aureus subsp. aureus MW2
aauaauacauucauuaa

SEQ ID NO: 4008625 - RNA, 17 nt, Staphylococcus aureus subsp. aureus MW2
aauaauaccuucaauug

SEQ ID NO: 4008626 - RNA, 20 nt, Staphylococcus aureus subsp. aureus MW2
aauacuaucugacauuuaaa

SEQ ID NO: 4008627 - RNA, 15 nt, Staphylococcus aureus subsp. aureus MW2
aauacuguauuuuag

SEQ ID NO: 4008628 - RNA, 21 nt, Staphylococcus aureus subsp. aureus MW2
aauacuguauuuuagcgucau

SEQ ID NO: 4008629 - RNA, 19 nt, Staphylococcus aureus subsp. aureus MW2
aauacuguuuaaauaaaau

SEQ ID NO: 4008630 - RNA, 14 nt, Staphylococcus aureus subsp. aureus MW2
aauacuguuuucau

SEQ ID NO: 4008631 - RNA, 20 nt, Staphylococcus aureus subsp. aureus MW2
aauacuucuaacgcaacuga

SEQ ID NO: 4008632 - RNA, 19 nt, Staphylococcus aureus subsp. aureus MW2
aauacuucuuguucgauaa

SEQ ID NO: 4008633 - RNA, 13 nt, Staphylococcus aureus subsp. aureus MW2
aauacuugaaaga

SEQ ID NO: 4008634 - RNA, 20 nt, Staphylococcus aureus subsp. aureus MW2
aauacuugaaagauuuguag

SEQ ID NO: 4008635 - RNA, 21 nt, Staphylococcus aureus subsp. aureus MW2
aauacuugaauguaagaaguc

SEQ ID NO: 4008636 - RNA, 16 nt, Staphylococcus aureus subsp. aureus MW2
aauacuuuauuugaua

SEQ ID NO: 4008637 - RNA, 20 nt, Staphylococcus aureus subsp. aureus MW2
aauacuuucaaacaaaucuu

SEQ ID NO: 4008638 - RNA, 17 nt, Staphylococcus aureus subsp. aureus MW2
aauacuuucacuuuuua

SEQ ID NO: 4008639 - RNA, 14 nt, Staphylococcus aureus subsp. aureus MW2
aauacuuuuuaacu

SEQ ID NO: 4008640 - RNA, 15 nt, Staphylococcus aureus subsp. aureus MW2
aauacuuuuuaacug

SEQ ID NO: 4008641 - RNA, 15 nt, Staphylococcus aureus subsp. aureus MW2
aauacuuuuuauaua

SEQ ID NO: 4008642 - RNA, 19 nt, Staphylococcus aureus subsp. aureus MW2
aauagaaaaauuucaaaaa

SEQ ID NO: 4008643 - RNA, 21 nt, Staphylococcus aureus subsp. aureus MW2
aauagaaaaauuucaaaaaua

SEQ ID NO: 4008644 - RNA, 12 nt, Staphylococcus aureus subsp. aureus MW2
aauagaaauaau

SEQ ID NO: 4008645 - RNA, 21 nt, Staphylococcus aureus subsp. aureus MW2
aauagaacgaaauaguucaaa

SEQ ID NO: 4008646 - RNA, 22 nt, Staphylococcus aureus subsp. aureus MW2
aauagaagguuauuuuuuaugg

SEQ ID NO: 4008647 - RNA, 17 nt, Staphylococcus aureus subsp. aureus MW2
aauagacaccaaaaaca

SEQ ID NO: 4008648 - RNA, 23 nt, Staphylococcus aureus subsp. aureus MW2
aauagacauuguuaaacuaagag

SEQ ID NO: 4008649 - RNA, 22 nt, Staphylococcus aureus subsp. aureus MW2
aauagacugacacaguaauucu

SEQ ID NO: 4008650 - RNA, 15 nt, Staphylococcus aureus subsp. aureus MW2
aauagagaaaaaaua

SEQ ID NO: 4008651 - RNA, 18 nt, Staphylococcus aureus subsp. aureus MW2
aauagagaaacguaagac

SEQ ID NO: 4008652 - RNA, 18 nt, Staphylococcus aureus subsp. aureus MW2
aauagagguauaauuaaa

SEQ ID NO: 4008653 - RNA, 19 nt, Staphylococcus aureus subsp. aureus MW2
aauagagguauaauuaaau

SEQ ID NO: 4008654 - RNA, 17 nt, Staphylococcus aureus subsp. aureus MW2
aauagauaaugcaccug

SEQ ID NO: 4008655 - RNA, 16 nt, Staphylococcus aureus subsp. aureus MW2
aauagauugaaaaaau

SEQ ID NO: 4008656 - RNA, 13 nt, Staphylococcus aureus subsp. aureus MW2
aauagcauuugua

SEQ ID NO: 4008657 - RNA, 20 nt, Staphylococcus aureus subsp. aureus MW2
aauagcauuuguaaacagua

SEQ ID NO: 4008658 - RNA, 15 nt, Staphylococcus aureus subsp. aureus MW2
aauagccauaucaua

SEQ ID NO: 4008659 - RNA, 18 nt, Staphylococcus aureus subsp. aureus MW2
aauagccauaucauauua

SEQ ID NO: 4008660 - RNA, 22 nt, Staphylococcus aureus subsp. aureus MW2
aauagcccuuuauacaauuuuu

SEQ ID NO: 4008661 - RNA, 14 nt, Staphylococcus aureus subsp. aureus MW2
aauagcuauauuuu

SEQ ID NO: 4008662 - RNA, 23 nt, Staphylococcus aureus subsp. aureus MW2
aauagcuauauuuuuguauuuau

SEQ ID NO: 4008663 - RNA, 17 nt, Staphylococcus aureus subsp. aureus MW2
aauagcuauuaaaauag

SEQ ID NO: 4008664 - RNA, 18 nt, Staphylococcus aureus subsp. aureus MW2
aauaggauaugcuaaaca

SEQ ID NO: 4008665 - RNA, 21 nt, Staphylococcus aureus subsp. aureus MW2
aauaggugcuuguaaaauuuu

SEQ ID NO: 4008666 - RNA, 19 nt, Staphylococcus aureus subsp. aureus MW2
aauagguuaguaauauauu

SEQ ID NO: 4008667 - RNA, 18 nt, Staphylococcus aureus subsp. aureus MW2
aauaguaacgucugguuu

SEQ ID NO: 4008668 - RNA, 12 nt, Staphylococcus aureus subsp. aureus MW2
aauaguaaugau

SEQ ID NO: 4008669 - RNA, 19 nt, Staphylococcus aureus subsp. aureus MW2
aauaguaccaugcucuuuu

SEQ ID NO: 4008670 - RNA, 23 nt, Staphylococcus aureus subsp. aureus MW2
aauagucggggccccaacacaga

SEQ ID NO: 4008671 - RNA, 17 nt, Staphylococcus aureus subsp. aureus MW2
aauaguuaccaaaauuu

SEQ ID NO: 4008672 - RNA, 23 nt, Staphylococcus aureus subsp. aureus MW2
aauaguuaccaaaauuugaaaua

SEQ ID NO: 4008673 - RNA, 18 nt, Staphylococcus aureus subsp. aureus MW2
aauaguucuuuaaauuau

SEQ ID NO: 4008674 - RNA, 21 nt, Staphylococcus aureus subsp. aureus MW2
aauaguucuuuaaauuauaua

SEQ ID NO: 4008675 - RNA, 19 nt, Staphylococcus aureus subsp. aureus MW2
aauaguuguuuauuauaga

SEQ ID NO: 4008676 - RNA, 15 nt, Staphylococcus aureus subsp. aureus MW2
aauaguuuauaauuu

SEQ ID NO: 4008677 - RNA, 17 nt, Staphylococcus aureus subsp. aureus MW2
aauaguuuuauaagaag

SEQ ID NO: 4008678 - RNA, 14 nt, Staphylococcus aureus subsp. aureus MW2
aauaguuuuucaua

SEQ ID NO: 4008679 - RNA, 21 nt, Staphylococcus aureus subsp. aureus MW2
aauaguuuuucauauucacau

SEQ ID NO: 4008680 - RNA, 14 nt, Staphylococcus aureus subsp. aureus MW2
aauauaaaacgaua

SEQ ID NO: 4008681 - RNA, 14 nt, Staphylococcus aureus subsp. aureus MW2
aauauaaaagcacu

SEQ ID NO: 4008682 - RNA, 15 nt, Staphylococcus aureus subsp. aureus MW2
aauauaaaagcacua

SEQ ID NO: 4008683 - RNA, 15 nt, Staphylococcus aureus subsp. aureus MW2
aauauaaaauaaagu

SEQ ID NO: 4008684 - RNA, 15 nt, Staphylococcus aureus subsp. aureus MW2
aauauaaacaucuuc

SEQ ID NO: 4008685 - RNA, 13 nt, Staphylococcus aureus subsp. aureus MW2
aauauaaauaaaa

SEQ ID NO: 4008686 - RNA, 22 nt, Staphylococcus aureus subsp. aureus MW2
aauauaaauuucuucauaguuc

SEQ ID NO: 4008687 - RNA, 14 nt, Staphylococcus aureus subsp. aureus MW2
aauauaaauuuuga

SEQ ID NO: 4008688 - RNA, 18 nt, Staphylococcus aureus subsp. aureus MW2
aauauaacaaguauaaau

SEQ ID NO: 4008689 - RNA, 14 nt, Staphylococcus aureus subsp. aureus MW2
aauauaacaucaaa

SEQ ID NO: 4008690 - RNA, 16 nt, Staphylococcus aureus subsp. aureus MW2
aauauaacaucaaaua

SEQ ID NO: 4008691 - RNA, 18 nt, Staphylococcus aureus subsp. aureus MW2
aauauaacaucaaauaga

SEQ ID NO: 4008692 - RNA, 16 nt, Staphylococcus aureus subsp. aureus MW2
aauauaaguaaucaua

SEQ ID NO: 4008693 - RNA, 19 nt, Staphylococcus aureus subsp. aureus MW2
aauauaagucuauuaugua

SEQ ID NO: 4008694 - RNA, 15 nt, Staphylococcus aureus subsp. aureus MW2
aauauaauagaaaua

SEQ ID NO: 4008695 - RNA, 15 nt, Staphylococcus aureus subsp. aureus MW2
aauauaauauauaca

SEQ ID NO: 4008696 - RNA, 17 nt, Staphylococcus aureus subsp. aureus MW2
aauauaauauauacaaa

SEQ ID NO: 4008697 - RNA, 14 nt, Staphylococcus aureus subsp. aureus MW2
aauauaauguauaa

SEQ ID NO: 4008698 - RNA, 20 nt, Staphylococcus aureus subsp. aureus MW2
aauauaauguauaaaacaga

SEQ ID NO: 4008699 - RNA, 23 nt, Staphylococcus aureus subsp. aureus MW2
aauauaauuaaacauuuagauuu

SEQ ID NO: 4008700 - RNA, 13 nt, Staphylococcus aureus subsp. aureus MW2
aauauaauuuuuu

SEQ ID NO: 4008701 - RNA, 18 nt, Staphylococcus aureus subsp. aureus MW2
aauauacauuuacauauu

SEQ ID NO: 4008702 - RNA, 15 nt, Staphylococcus aureus subsp. aureus MW2
aauauaccaaccaaa

SEQ ID NO: 4008703 - RNA, 20 nt, Staphylococcus aureus subsp. aureus MW2
aauauaccaaccaaaaccaa

SEQ ID NO: 4008704 - RNA, 17 nt, Staphylococcus aureus subsp. aureus MW2
aauauacgagacauuuc

SEQ ID NO: 4008705 - RNA, 15 nt, Staphylococcus aureus subsp. aureus MW2
aauauacuaaaguuc

SEQ ID NO: 4008706 - RNA, 17 nt, Staphylococcus aureus subsp. aureus MW2
aauauacuuaauuuaaa

SEQ ID NO: 4008707 - RNA, 20 nt, Staphylococcus aureus subsp. aureus MW2
aauauacuuaauuuaaaucu

SEQ ID NO: 4008708 - RNA, 22 nt, Staphylococcus aureus subsp. aureus MW2
aauauacuuuuauagaaaauua

SEQ ID NO: 4008709 - RNA, 21 nt, Staphylococcus aureus subsp. aureus MW2
aauauagaagugcgguuuaau

SEQ ID NO: 4008710 - RNA, 15 nt, Staphylococcus aureus subsp. aureus MW2
aauauagauuuugua

SEQ ID NO: 4008711 - RNA, 21 nt, Staphylococcus aureus subsp. aureus MW2
aauauaguaauaaaagucgau

SEQ ID NO: 4008712 - RNA, 15 nt, Staphylococcus aureus subsp. aureus MW2
aauauauacaaauaa

SEQ ID NO: 4008713 - RNA, 16 nt, Staphylococcus aureus subsp. aureus MW2
aauauauacaaauaaa

SEQ ID NO: 4008714 - RNA, 15 nt, Staphylococcus aureus subsp. aureus MW2
aauauuuauauuaaa

SEQ ID NO: 4008715 - RNA, 17 nt, Staphylococcus aureus subsp. aureus MW2
aauauuuauauuaaaua

SEQ ID NO: 4008716 - RNA, 22 nt, Staphylococcus aureus subsp. aureus MW2
aauauuuauauuaaauacuaua

SEQ ID NO: 4008717 - RNA, 19 nt, Staphylococcus aureus subsp. aureus MW2
aauauuuauuguuuuuaaa

SEQ ID NO: 4008718 - RNA, 21 nt, Staphylococcus aureus subsp. aureus MW2
aauauuuauuguuuuuaaaau

SEQ ID NO: 4008719 - RNA, 14 nt, Staphylococcus aureus subsp. aureus MW2
aauauuuauuuuaa

SEQ ID NO: 4008720 - RNA, 19 nt, Staphylococcus aureus subsp. aureus MW2
aauauuucccuaugaaaua

SEQ ID NO: 4008721 - RNA, 12 nt, Staphylococcus aureus subsp. aureus MW2
aauauuugauaa

SEQ ID NO: 4008722 - RNA, 21 nt, Staphylococcus aureus subsp. aureus MW2
aauauuugauaaguagaaaau

SEQ ID NO: 4008723 - RNA, 20 nt, Staphylococcus aureus subsp. aureus MW2
aauauuugcuaaugcuagua

SEQ ID NO: 4008724 - RNA, 15 nt, Staphylococcus aureus subsp. aureus MW2
aauauuuuauuacau

SEQ ID NO: 4008725 - RNA, 22 nt, Staphylococcus aureus subsp. aureus MW2
aauauuuucauguccaucuuuu

SEQ ID NO: 4008726 - RNA, 17 nt, Staphylococcus aureus subsp. aureus MW2
aauauuuuuuaaaauga

SEQ ID NO: 4008727 - RNA, 16 nt, Staphylococcus aureus subsp. aureus MW2
aauauuuuuuaaugaa

SEQ ID NO: 4008728 - RNA, 15 nt, Staphylococcus aureus subsp. aureus MW2
aauauuuuuugauau

SEQ ID NO: 4008729 - RNA, 16 nt, Staphylococcus aureus subsp. aureus MW2
aauauuuuuugauauu

SEQ ID NO: 4008730 - RNA, 18 nt, Staphylococcus aureus subsp. aureus MW2
aauauuuuuuucaagaua

SEQ ID NO: 4008731 - RNA, 15 nt, Staphylococcus aureus subsp. aureus MW2
aaucaaaaaagacau

SEQ ID NO: 4008732 - RNA, 21 nt, Staphylococcus aureus subsp. aureus MW2
aaucaaagaggcuuuaaaauu

SEQ ID NO: 4008733 - RNA, 21 nt, Staphylococcus aureus subsp. aureus MW2
aaucaaagaguaaaguuaaaa

SEQ ID NO: 4008734 - RNA, 23 nt, Staphylococcus aureus subsp. aureus MW2
aaucaaagggcuucgauucauaa

SEQ ID NO: 4008735 - RNA, 14 nt, Staphylococcus aureus subsp. aureus MW2
aaucaaauauuuua

SEQ ID NO: 4008736 - RNA, 20 nt, Staphylococcus aureus subsp. aureus MW2
aaucaaauauuuuauuacau

SEQ ID NO: 4008737 - RNA, 13 nt, Staphylococcus aureus subsp. aureus MW2
aaucaaaucaaua

SEQ ID NO: 4008738 - RNA, 20 nt, Staphylococcus aureus subsp. aureus MW2
aaucaaauuagucauccaaa

SEQ ID NO: 4008739 - RNA, 17 nt, Staphylococcus aureus subsp. aureus MW2
aaucaacaguuuuauua

SEQ ID NO: 4008740 - RNA, 21 nt, Staphylococcus aureus subsp. aureus MW2
aaucaacaucaucuuuaauuu

SEQ ID NO: 4008741 - RNA, 16 nt, Staphylococcus aureus subsp. aureus MW2
aaucaaccuuugcuaa

SEQ ID NO: 4008742 - RNA, 22 nt, Staphylococcus aureus subsp. aureus MW2
aaucaacguauauaaguuaaaa

SEQ ID NO: 4008743 - RNA, 15 nt, Staphylococcus aureus subsp. aureus MW2
aaucaacuuuaauca

SEQ ID NO: 4008744 - RNA, 16 nt, Staphylococcus aureus subsp. aureus MW2
aaucaagcuagcauca

SEQ ID NO: 4008745 - RNA, 13 nt, Staphylococcus aureus subsp. aureus MW2
aaucacaauauaa

SEQ ID NO: 4008746 - RNA, 14 nt, Staphylococcus aureus subsp. aureus MW2
aaucacauaugaua

SEQ ID NO: 4008747 - RNA, 18 nt, Staphylococcus aureus subsp. aureus MW2
aaucaccuuuuuuaacuu

SEQ ID NO: 4008748 - RNA, 17 nt, Staphylococcus aureus subsp. aureus MW2
aaucacgauuuucaagu

SEQ ID NO: 4008749 - RNA, 19 nt, Staphylococcus aureus subsp. aureus MW2
aaucacgauuuucaaguaa

SEQ ID NO: 4008750 - RNA, 20 nt, Staphylococcus aureus subsp. aureus MW2
aaucacuauuuguuguuaua

SEQ ID NO: 4008751 - RNA, 21 nt, Staphylococcus aureus subsp. aureus MW2
aaucacuccucuauuuuauga

SEQ ID NO: 4008752 - RNA, 16 nt, Staphylococcus aureus subsp. aureus MW2
aaucacuucugaaaau

SEQ ID NO: 4008753 - RNA, 21 nt, Staphylococcus aureus subsp. aureus MW2
aaucacuuggcgacauuugua

SEQ ID NO: 4008754 - RNA, 16 nt, Staphylococcus aureus subsp. aureus MW2
aaucagcuauaaaagu

SEQ ID NO: 4008755 - RNA, 14 nt, Staphylococcus aureus subsp. aureus MW2
aaucaggaauguuu

SEQ ID NO: 4008756 - RNA, 16 nt, Staphylococcus aureus subsp. aureus MW2
aaucaggaauguuugu

SEQ ID NO: 4008757 - RNA, 18 nt, Staphylococcus aureus subsp. aureus MW2
aaucaggaauguuuguau

SEQ ID NO: 4008758 - RNA, 17 nt, Staphylococcus aureus subsp. aureus MW2
aaucagggacaaaaauu

SEQ ID NO: 4008759 - RNA, 19 nt, Staphylococcus aureus subsp. aureus MW2
aaucagguuuaaacaguuu

SEQ ID NO: 4008760 - RNA, 14 nt, Staphylococcus aureus subsp. aureus MW2
aaucaguaauaaug

SEQ ID NO: 4008761 - RNA, 16 nt, Staphylococcus aureus subsp. aureus MW2
aaucagucauucacau

SEQ ID NO: 4008762 - RNA, 24 nt, Staphylococcus aureus subsp. aureus MW2
aaucaguuacucuauagucaucug

SEQ ID NO: 4008763 - RNA, 15 nt, Staphylococcus aureus subsp. aureus MW2
aaucaguuuuugaau

SEQ ID NO: 4008764 - RNA, 12 nt, Staphylococcus aureus subsp. aureus MW2
aaucauagauau

SEQ ID NO: 4008765 - RNA, 22 nt, Staphylococcus aureus subsp. aureus MW2
aaucauagauauaagaaaucca

SEQ ID NO: 4008766 - RNA, 16 nt, Staphylococcus aureus subsp. aureus MW2
aaucauagcaacaucg

SEQ ID NO: 4008767 - RNA, 20 nt, Staphylococcus aureus subsp. aureus MW2
aaucauagcaacaucggcac

SEQ ID NO: 4008768 - RNA, 14 nt, Staphylococcus aureus subsp. aureus MW2
aaucaucacacaua

SEQ ID NO: 4008769 - RNA, 21 nt, Staphylococcus aureus subsp. aureus MW2
aaucaucgaacaugaaugaua

SEQ ID NO: 4008770 - RNA, 17 nt, Staphylococcus aureus subsp. aureus MW2
aaucaucuaaaugcacu

SEQ ID NO: 4008771 - RNA, 21 nt, Staphylococcus aureus subsp. aureus MW2
aaucaucuuaacaauuuuaau

SEQ ID NO: 4008772 - RNA, 20 nt, Staphylococcus aureus subsp. aureus MW2
aaucaucuuaaugcuaugau

SEQ ID NO: 4008773 - RNA, 20 nt, Staphylococcus aureus subsp. aureus MW2
aaucaugaaauuaaaaacac

SEQ ID NO: 4008774 - RNA, 13 nt, Staphylococcus aureus subsp. aureus MW2
aaucaugacauaa

SEQ ID NO: 4008775 - RNA, 22 nt, Staphylococcus aureus subsp. aureus MW2
aaucauguaaugcuuaaaaaca

SEQ ID NO: 4008776 - RNA, 23 nt, Staphylococcus aureus subsp. aureus MW2
aaucauguaaugcuuaaaaacaa

SEQ ID NO: 4008777 - RNA, 17 nt, Staphylococcus aureus subsp. aureus MW2
aaucauuaauaauuaaa

SEQ ID NO: 4008778 - RNA, 18 nt, Staphylococcus aureus subsp. aureus MW2
aaucauuagcgaaaaccu

SEQ ID NO: 4008779 - RNA, 18 nt, Staphylococcus aureus subsp. aureus MW2
aaucauuaguuaugugcu

SEQ ID NO: 4008780 - RNA, 23 nt, Staphylococcus aureus subsp. aureus MW2
aaucauuaguuaugugcuaaucu

SEQ ID NO: 4008781 - RNA, 13 nt, Staphylococcus aureus subsp. aureus MW2
aaucauuauagca

SEQ ID NO: 4008782 - RNA, 14 nt, Staphylococcus aureus subsp. aureus MW2
aaucauucacuuca

SEQ ID NO: 4008783 - RNA, 13 nt, Staphylococcus aureus subsp. aureus MW2
aaucauugcguaa

SEQ ID NO: 4008784 - RNA, 19 nt, Staphylococcus aureus subsp. aureus MW2
aaucauuguaaaugaucau

SEQ ID NO: 4008785 - RNA, 21 nt, Staphylococcus aureus subsp. aureus MW2
aauccaaaaucuuuacuugua

SEQ ID NO: 4008786 - RNA, 19 nt, Staphylococcus aureus subsp. aureus MW2
aauccaaagcugaauuuua

SEQ ID NO: 4008787 - RNA, 18 nt, Staphylococcus aureus subsp. aureus MW2
aauccaagauauauaacu

SEQ ID NO: 4008788 - RNA, 16 nt, Staphylococcus aureus subsp. aureus MW2
aauccaagcaaucuua

SEQ ID NO: 4008789 - RNA, 17 nt, Staphylococcus aureus subsp. aureus MW2
aauccaagcaaucuuag

SEQ ID NO: 4008790 - RNA, 18 nt, Staphylococcus aureus subsp. aureus MW2
aauccaagugacaacauu

SEQ ID NO: 4008791 - RNA, 18 nt, Staphylococcus aureus subsp. aureus MW2
aauccaauuaaauauuua

SEQ ID NO: 4008792 - RNA, 13 nt, Staphylococcus aureus subsp. aureus MW2
aauccaguaauca

SEQ ID NO: 4008793 - RNA, 18 nt, Staphylococcus aureus subsp. aureus MW2
aauccauucuucuuguuu

SEQ ID NO: 4008794 - RNA, 19 nt, Staphylococcus aureus subsp. aureus MW2
aaucccauaaugacuauaa

SEQ ID NO: 4008795 - RNA, 21 nt, Staphylococcus aureus subsp. aureus MW2
aauccgauucacucuguaaua

SEQ ID NO: 4008796 - RNA, 20 nt, Staphylococcus aureus subsp. aureus MW2
aauccgauuuugauauaaaa

SEQ ID NO: 4008797 - RNA, 21 nt, Staphylococcus aureus subsp. aureus MW2
aauccgcuuuauuuuaucauc

SEQ ID NO: 4008798 - RNA, 16 nt, Staphylococcus aureus subsp. aureus MW2
aauccggaacauuaaa

SEQ ID NO: 4008799 - RNA, 23 nt, Staphylococcus aureus subsp. aureus MW2
aauccgucuuuuuuuaugaaaag

SEQ ID NO: 4008800 - RNA, 18 nt, Staphylococcus aureus subsp. aureus MW2
aauccuugagcucacgau

SEQ ID NO: 4008801 - RNA, 15 nt, Staphylococcus aureus subsp. aureus MW2
aauccuuuauauuua

SEQ ID NO: 4008802 - RNA, 20 nt, Staphylococcus aureus subsp. aureus MW2
aaugaaguaggcugaaguug

SEQ ID NO: 4008803 - RNA, 21 nt, Staphylococcus aureus subsp. aureus MW2
aaugaagucuuucaacaaaau

SEQ ID NO: 4008804 - RNA, 14 nt, Staphylococcus aureus subsp. aureus MW2
aaugaauaaagcua

SEQ ID NO: 4008805 - RNA, 18 nt, Staphylococcus aureus subsp. aureus MW2
aaugaauaaugacaaauu

SEQ ID NO: 4008806 - RNA, 23 nt, Staphylococcus aureus subsp. aureus MW2
aaugaauaaugacaaauuaucac

SEQ ID NO: 4008807 - RNA, 14 nt, Staphylococcus aureus subsp. aureus MW2
aaugaauaauucca

SEQ ID NO: 4008808 - RNA, 16 nt, Staphylococcus aureus subsp. aureus MW2
aaugaaugaagacgaa

SEQ ID NO: 4008809 - RNA, 21 nt, Staphylococcus aureus subsp. aureus MW2
aaugaauuagcuaagccuguu

SEQ ID NO: 4008810 - RNA, 18 nt, Staphylococcus aureus subsp. aureus MW2
aaugacauggaaaauaua

SEQ ID NO: 4008811 - RNA, 23 nt, Staphylococcus aureus subsp. aureus MW2
aaugaccaucuggcguuaaccau

SEQ ID NO: 4008812 - RNA, 20 nt, Staphylococcus aureus subsp. aureus MW2
aaugaccauugucaugccuu

SEQ ID NO: 4008813 - RNA, 14 nt, Staphylococcus aureus subsp. aureus MW2
aaugacgagaauua

SEQ ID NO: 4008814 - RNA, 14 nt, Staphylococcus aureus subsp. aureus MW2
aaugacgauacgua

SEQ ID NO: 4008815 - RNA, 15 nt, Staphylococcus aureus subsp. aureus MW2
aaugacuaacuuucu

SEQ ID NO: 4008816 - RNA, 14 nt, Staphylococcus aureus subsp. aureus MW2
aaugacuaccuguu

SEQ ID NO: 4008817 - RNA, 17 nt, Staphylococcus aureus subsp. aureus MW2
aaugacuauaacaccaa

SEQ ID NO: 4008818 - RNA, 23 nt, Staphylococcus aureus subsp. aureus MW2
aaugacuauaacaccaauuaaau

SEQ ID NO: 4008819 - RNA, 18 nt, Staphylococcus aureus subsp. aureus MW2
aaugacuaugcaaaugaa

SEQ ID NO: 4008820 - RNA, 21 nt, Staphylococcus aureus subsp. aureus MW2
aaugacugaauuaauauccaa

SEQ ID NO: 4008821 - RNA, 13 nt, Staphylococcus aureus subsp. aureus MW2
aaugacuucacau

SEQ ID NO: 4008822 - RNA, 17 nt, Staphylococcus aureus subsp. aureus MW2
aaugacuucacauuuau

SEQ ID NO: 4008823 - RNA, 13 nt, Staphylococcus aureus subsp. aureus MW2
aaugauaauccac

SEQ ID NO: 4008824 - RNA, 16 nt, Staphylococcus aureus subsp. aureus MW2
aaugauaauccaccaa

SEQ ID NO: 4008825 - RNA, 19 nt, Staphylococcus aureus subsp. aureus MW2
aaugauacgccuaaauauu

SEQ ID NO: 4008826 - RNA, 15 nt, Staphylococcus aureus subsp. aureus MW2
aaugauagugaauaa

SEQ ID NO: 4008827 - RNA, 20 nt, Staphylococcus aureus subsp. aureus MW2
aaugaucaucguauagaugu

SEQ ID NO: 4008828 - RNA, 18 nt, Staphylococcus aureus subsp. aureus MW2
aaugaucaucuauauuua

SEQ ID NO: 4008829 - RNA, 23 nt, Staphylococcus aureus subsp. aureus MW2
aaugaugaaaaucaguugcuuca

SEQ ID NO: 4008830 - RNA, 16 nt, Staphylococcus aureus subsp. aureus MW2
aaugaugaauuguaaa

SEQ ID NO: 4008831 - RNA, 14 nt, Staphylococcus aureus subsp. aureus MW2
aaugaugacaucaa

SEQ ID NO: 4008832 - RNA, 17 nt, Staphylococcus aureus subsp. aureus MW2
aaugaugauuuaaagca

SEQ ID NO: 4008833 - RNA, 14 nt, Staphylococcus aureus subsp. aureus MW2
aaugaugcugccau

SEQ ID NO: 4008834 - RNA, 13 nt, Staphylococcus aureus subsp. aureus MW2
aaugauuaaaaau

SEQ ID NO: 4008835 - RNA, 19 nt, Staphylococcus aureus subsp. aureus MW2
aaugauuaaaaaucaaaga

SEQ ID NO: 4008836 - RNA, 17 nt, Staphylococcus aureus subsp. aureus MW2
aaugauuauaaauacau

SEQ ID NO: 4008837 - RNA, 21 nt, Staphylococcus aureus subsp. aureus MW2
aaugauucuuaucuuuaauca

SEQ ID NO: 4008838 - RNA, 23 nt, Staphylococcus aureus subsp. aureus MW2
aaugauucuuaucuuuaaucaaa

SEQ ID NO: 4008839 - RNA, 11 nt, Staphylococcus aureus subsp. aureus MW2
aaugauuggua

SEQ ID NO: 4008840 - RNA, 23 nt, Staphylococcus aureus subsp. aureus MW2
aaugauuuaauaaacaccaauau

SEQ ID NO: 4008841 - RNA, 20 nt, Staphylococcus aureus subsp. aureus MW2
aaugauuucuucauuaucaa

SEQ ID NO: 4008842 - RNA, 13 nt, Staphylococcus aureus subsp. aureus MW2
aaugauuugauaa

SEQ ID NO: 4008843 - RNA, 19 nt, Staphylococcus aureus subsp. aureus MW2
aaugauuugauaauauuau

SEQ ID NO: 4008844 - RNA, 15 nt, Staphylococcus aureus subsp. aureus MW2
aaugauuugugguaa

SEQ ID NO: 4008845 - RNA, 14 nt, Staphylococcus aureus subsp. aureus MW2
aaugauuuugcuuu

SEQ ID NO: 4008846 - RNA, 22 nt, Staphylococcus aureus subsp. aureus MW2
aaugauuuuuauuauugucauc

SEQ ID NO: 4008847 - RNA, 15 nt, Staphylococcus aureus subsp. aureus MW2
aaugcaacuugauca

SEQ ID NO: 4008848 - RNA, 23 nt, Staphylococcus aureus subsp. aureus MW2
aaugcaaguuggcggggcccaaa

SEQ ID NO: 4008849 - RNA, 21 nt, Staphylococcus aureus subsp. aureus MW2
aaugcaauacauuaauauaaa

SEQ ID NO: 4008850 - RNA, 20 nt, Staphylococcus aureus subsp. aureus MW2
aaugcacuagcaacaucuuu

SEQ ID NO: 4008851 - RNA, 21 nt, Staphylococcus aureus subsp. aureus MW2
aaugcacuagcaacaucuuuu

SEQ ID NO: 4008852 - RNA, 19 nt, Staphylococcus aureus subsp. aureus MW2
aaugcagauucuucaccaa

SEQ ID NO: 4008853 - RNA, 17 nt, Staphylococcus aureus subsp. aureus MW2
aaugcauuacuacuuua

SEQ ID NO: 4008854 - RNA, 20 nt, Staphylococcus aureus subsp. aureus MW2
aaugccauuguuauccaaaa

SEQ ID NO: 4008855 - RNA, 18 nt, Staphylococcus aureus subsp. aureus MW2
aaugccgagauuauuaug

SEQ ID NO: 4008856 - RNA, 19 nt, Staphylococcus aureus subsp. aureus MW2
aaugccuaauuuguaaccc

SEQ ID NO: 4008857 - RNA, 16 nt, Staphylococcus aureus subsp. aureus MW2
aaugccucugcaacgc

SEQ ID NO: 4008858 - RNA, 20 nt, Staphylococcus aureus subsp. aureus MW2
aaugccugccccuuagucau

SEQ ID NO: 4008859 - RNA, 16 nt, Staphylococcus aureus subsp. aureus MW2
aaugcgacaucgccaa

SEQ ID NO: 4008860 - RNA, 20 nt, Staphylococcus aureus subsp. aureus MW2
aaugcguaucgagagauuau

SEQ ID NO: 4008861 - RNA, 17 nt, Staphylococcus aureus subsp. aureus MW2
aaugcuaaaaguauaaa

SEQ ID NO: 4008862 - RNA, 16 nt, Staphylococcus aureus subsp. aureus MW2
aaugcuaauuuaacug

SEQ ID NO: 4008863 - RNA, 15 nt, Staphylococcus aureus subsp. aureus MW2
aaugcuacaauuucc

SEQ ID NO: 4008864 - RNA, 15 nt, Staphylococcus aureus subsp. aureus MW2
aaugcuacuauuaaa

SEQ ID NO: 4008865 - RNA, 12 nt, Staphylococcus aureus subsp. aureus MW2
aaugcuaugauu

SEQ ID NO: 4008866 - RNA, 15 nt, Staphylococcus aureus subsp. aureus MW2
aaugcuaugauuaaa

SEQ ID NO: 4008867 - RNA, 15 nt, Staphylococcus aureus subsp. aureus MW2
aaugcucaucuucua

SEQ ID NO: 4008868 - RNA, 19 nt, Staphylococcus aureus subsp. aureus MW2
aaugcucuauauauccauu

SEQ ID NO: 4008869 - RNA, 16 nt, Staphylococcus aureus subsp. aureus MW2
aaugcuuaaaaacaau

SEQ ID NO: 4008870 - RNA, 16 nt, Staphylococcus aureus subsp. aureus MW2
aaugcuucaaauguaa

SEQ ID NO: 4008871 - RNA, 22 nt, Staphylococcus aureus subsp. aureus MW2
aaugcuucuucuacagauuuau

SEQ ID NO: 4008872 - RNA, 14 nt, Staphylococcus aureus subsp. aureus MW2
aaugcuugaauuuu

SEQ ID NO: 4008873 - RNA, 15 nt, Staphylococcus aureus subsp. aureus MW2
aaugcuuuaaauauu

SEQ ID NO: 4008874 - RNA, 21 nt, Staphylococcus aureus subsp. aureus MW2
aaugcuuuaucgaauucuucu

SEQ ID NO: 4008875 - RNA, 13 nt, Staphylococcus aureus subsp. aureus MW2
aaugcuuucaaau

SEQ ID NO: 4008876 - RNA, 13 nt, Staphylococcus aureus subsp. aureus MW2
aaugcuuuuuuga

SEQ ID NO: 4008877 - RNA, 19 nt, Staphylococcus aureus subsp. aureus MW2
aauggaacgccgaauaauc

SEQ ID NO: 4008878 - RNA, 22 nt, Staphylococcus aureus subsp. aureus MW2
aauggaacgccgaauaauccag

SEQ ID NO: 4008879 - RNA, 15 nt, Staphylococcus aureus subsp. aureus MW2
aauggaugaauauau

SEQ ID NO: 4008880 - RNA, 16 nt, Staphylococcus aureus subsp. aureus MW2
aauggcaaucuauaua

SEQ ID NO: 4008881 - RNA, 21 nt, Staphylococcus aureus subsp. aureus MW2
aauggcaaucuauauaaaugu

SEQ ID NO: 4008882 - RNA, 20 nt, Staphylococcus aureus subsp. aureus MW2
aauggcaauuaaaacuauaa

SEQ ID NO: 4008883 - RNA, 16 nt, Staphylococcus aureus subsp. aureus MW2
aauggcacuuaauaua

SEQ ID NO: 4008884 - RNA, 22 nt, Staphylococcus aureus subsp. aureus MW2
aauggcacuuaauauaaggaag

SEQ ID NO: 4008885 - RNA, 22 nt, Staphylococcus aureus subsp. aureus MW2
aaugggaauuguauuagcaauu

SEQ ID NO: 4008886 - RNA, 18 nt, Staphylococcus aureus subsp. aureus MW2
aaugggcgauaaaaguug

SEQ ID NO: 4008887 - RNA, 21 nt, Staphylococcus aureus subsp. aureus MW2
aaugguauugauuauucuuua

SEQ ID NO: 4008888 - RNA, 14 nt, Staphylococcus aureus subsp. aureus MW2
aaugguuaaagguc

SEQ ID NO: 4008889 - RNA, 16 nt, Staphylococcus aureus subsp. aureus MW2
aaugguucuaaaauag

SEQ ID NO: 4008890 - RNA, 12 nt, Staphylococcus aureus subsp. aureus MW2
aauuaagaaaag

SEQ ID NO: 4008891 - RNA, 13 nt, Staphylococcus aureus subsp. aureus MW2
aauuaagaugaaa

SEQ ID NO: 4008892 - RNA, 15 nt, Staphylococcus aureus subsp. aureus MW2
aauuaaguguauaua

SEQ ID NO: 4008893 - RNA, 15 nt, Staphylococcus aureus subsp. aureus MW2
aauuaauacaucaau

SEQ ID NO: 4008894 - RNA, 17 nt, Staphylococcus aureus subsp. aureus MW2
aauuaauacaucaauau

SEQ ID NO: 4008895 - RNA, 16 nt, Staphylococcus aureus subsp. aureus MW2
aauuaauauccaaaau

SEQ ID NO: 4008896 - RNA, 14 nt, Staphylococcus aureus subsp. aureus MW2
aauuaauuacuuuc

SEQ ID NO: 4008897 - RNA, 20 nt, Staphylococcus aureus subsp. aureus MW2
aauuaauuacuuucauugua

SEQ ID NO: 4008898 - RNA, 18 nt, Staphylococcus aureus subsp. aureus MW2
aauuaauuaucauaaaua

SEQ ID NO: 4008899 - RNA, 14 nt, Staphylococcus aureus subsp. aureus MW2
aauuaauuaucuua

SEQ ID NO: 4008900 - RNA, 21 nt, Staphylococcus aureus subsp. aureus MW2
aauuaauuccuggugcaauaa

SEQ ID NO: 4008901 - RNA, 22 nt, Staphylococcus aureus subsp. aureus MW2
aauuaauucgccuaaaugguuu

SEQ ID NO: 4008902 - RNA, 16 nt, Staphylococcus aureus subsp. aureus MW2
aauuacaaaaguauga

SEQ ID NO: 4008903 - RNA, 21 nt, Staphylococcus aureus subsp. aureus MW2
aauuacacccuuuaaauuuaa

SEQ ID NO: 4008904 - RNA, 16 nt, Staphylococcus aureus subsp. aureus MW2
aauuacacuuuaaaua

SEQ ID NO: 4008905 - RNA, 21 nt, Staphylococcus aureus subsp. aureus MW2
aauuacagcgugauucaucua

SEQ ID NO: 4008906 - RNA, 18 nt, Staphylococcus aureus subsp. aureus MW2
aauuacgcaaagaaaaac

SEQ ID NO: 4008907 - RNA, 20 nt, Staphylococcus aureus subsp. aureus MW2
aauuacuaaaauaucaaaau

SEQ ID NO: 4008908 - RNA, 19 nt, Staphylococcus aureus subsp. aureus MW2
aauuacuaaccuaaagaua

SEQ ID NO: 4008909 - RNA, 21 nt, Staphylococcus aureus subsp. aureus MW2
aauuacuaaccuaaagauaau

SEQ ID NO: 4008910 - RNA, 13 nt, Staphylococcus aureus subsp. aureus MW2
aauuacuauauuu

SEQ ID NO: 4008911 - RNA, 18 nt, Staphylococcus aureus subsp. aureus MW2
aauuacuuucauuguaaa

SEQ ID NO: 4008912 - RNA, 19 nt, Staphylococcus aureus subsp. aureus MW2
aauuacuuucauuguaaau

SEQ ID NO: 4008913 - RNA, 16 nt, Staphylococcus aureus subsp. aureus MW2
aauuagaagcaauuaa

SEQ ID NO: 4008914 - RNA, 22 nt, Staphylococcus aureus subsp. aureus MW2
aauuagaagcaauuaaguauag

SEQ ID NO: 4008915 - RNA, 23 nt, Staphylococcus aureus subsp. aureus MW2
aauuagagggcacgagaaauguc

SEQ ID NO: 4008916 - RNA, 18 nt, Staphylococcus aureus subsp. aureus MW2
aauuagauaaaacaaaac

SEQ ID NO: 4008917 - RNA, 17 nt, Staphylococcus aureus subsp. aureus MW2
aauuagaugaaauggaa

SEQ ID NO: 4008918 - RNA, 14 nt, Staphylococcus aureus subsp. aureus MW2
aauuagauuuaaaa

SEQ ID NO: 4008919 - RNA, 19 nt, Staphylococcus aureus subsp. aureus MW2
aauuagcaugacuguaagu

SEQ ID NO: 4008920 - RNA, 19 nt, Staphylococcus aureus subsp. aureus MW2
aauuagccccaguauagaa

SEQ ID NO: 4008921 - RNA, 16 nt, Staphylococcus aureus subsp. aureus MW2
aauuaggauuaacaua

SEQ ID NO: 4008922 - RNA, 16 nt, Staphylococcus aureus subsp. aureus MW2
aauuagucauugaaaa

SEQ ID NO: 4008923 - RNA, 18 nt, Staphylococcus aureus subsp. aureus MW2
aauuaguucguguuugaa

SEQ ID NO: 4008924 - RNA, 21 nt, Staphylococcus aureus subsp. aureus MW2
aauuaguuuuuguuuacagau

SEQ ID NO: 4008925 - RNA, 22 nt, Staphylococcus aureus subsp. aureus MW2
aauuauaaguagugauuuuuua

SEQ ID NO: 4008926 - RNA, 17 nt, Staphylococcus aureus subsp. aureus MW2
aauuauaauuguaaugc

SEQ ID NO: 4008927 - RNA, 23 nt, Staphylococcus aureus subsp. aureus MW2
aauuauacgagaauaugaucuaa

SEQ ID NO: 4008928 - RNA, 15 nt, Staphylococcus aureus subsp. aureus MW2
aauuauagccuucau

SEQ ID NO: 4008929 - RNA, 17 nt, Staphylococcus aureus subsp. aureus MW2
aauuauaggaauuuuuu

SEQ ID NO: 4008930 - RNA, 23 nt, Staphylococcus aureus subsp. aureus MW2
aauuaucauaaauauaagauagu

SEQ ID NO: 4008931 - RNA, 20 nt, Staphylococcus aureus subsp. aureus MW2
aauuaucauaugugauuuaa

SEQ ID NO: 4008932 - RNA, 19 nt, Staphylococcus aureus subsp. aureus MW2
aauuaucauuaaauugcuu

SEQ ID NO: 4008933 - RNA, 12 nt, Staphylococcus aureus subsp. aureus MW2
aauuaucauuac

SEQ ID NO: 4008934 - RNA, 13 nt, Staphylococcus aureus subsp. aureus MW2
aauuaucuauaua

SEQ ID NO: 4008935 - RNA, 17 nt, Staphylococcus aureus subsp. aureus MW2
aauuaucuauauaugaa

SEQ ID NO: 4008936 - RNA, 15 nt, Staphylococcus aureus subsp. aureus MW2
aauuaucuuaaguca

SEQ ID NO: 4008937 - RNA, 20 nt, Staphylococcus aureus subsp. aureus MW2
aauuaucuuaagucaucaau

SEQ ID NO: 4008938 - RNA, 14 nt, Staphylococcus aureus subsp. aureus MW2
aauuaucuucauca

SEQ ID NO: 4008939 - RNA, 19 nt, Staphylococcus aureus subsp. aureus MW2
aauuaugaucaauaagauu

SEQ ID NO: 4008940 - RNA, 22 nt, Staphylococcus aureus subsp. aureus MW2
aauuaugauuauuuuucucaua

SEQ ID NO: 4008941 - RNA, 17 nt, Staphylococcus aureus subsp. aureus MW2
aauuauggauaaaauuu

SEQ ID NO: 4008942 - RNA, 19 nt, Staphylococcus aureus subsp. aureus MW2
aauuauggcagauccauaa

SEQ ID NO: 4008943 - RNA, 22 nt, Staphylococcus aureus subsp. aureus MW2
aauuauuaaagcuaucuucaga

SEQ ID NO: 4008944 - RNA, 12 nt, Staphylococcus aureus subsp. aureus MW2
aauuauuauaau

SEQ ID NO: 4008945 - RNA, 16 nt, Staphylococcus aureus subsp. aureus MW2
aauuauuauucuaacu

SEQ ID NO: 4008946 - RNA, 20 nt, Staphylococcus aureus subsp. aureus MW2
aauuauuauugcugugauug

SEQ ID NO: 4008947 - RNA, 22 nt, Staphylococcus aureus subsp. aureus MW2
aauuauuauugcugugauuguc

SEQ ID NO: 4008948 - RNA, 23 nt, Staphylococcus aureus subsp. aureus MW2
aauuauuccuucauugaagaaua

SEQ ID NO: 4008949 - RNA, 13 nt, Staphylococcus aureus subsp. aureus MW2
aauuauugacauu

SEQ ID NO: 4008950 - RNA, 17 nt, Staphylococcus aureus subsp. aureus MW2
aauuauugcaucauaau

SEQ ID NO: 4008951 - RNA, 16 nt, Staphylococcus aureus subsp. aureus MW2
aauuauuuaaaaugcu

SEQ ID NO: 4008952 - RNA, 11 nt, Staphylococcus aureus subsp. aureus MW2
aauuauuuaau

SEQ ID NO: 4008953 - RNA, 19 nt, Staphylococcus aureus subsp. aureus MW2
aauuauuuauucauuauag

SEQ ID NO: 4008954 - RNA, 24 nt, Staphylococcus aureus subsp. aureus MW2
aauuauuuauucauuauagucuua

SEQ ID NO: 4008955 - RNA, 11 nt, Staphylococcus aureus subsp. aureus MW2
aauuauuucau

SEQ ID NO: 4008956 - RNA, 21 nt, Staphylococcus aureus subsp. aureus MW2
aauuauuuuucucaacaguuu

SEQ ID NO: 4008957 - RNA, 22 nt, Staphylococcus aureus subsp. aureus MW2
aauuauuuuugauggucagcaa

SEQ ID NO: 4008958 - RNA, 13 nt, Staphylococcus aureus subsp. aureus MW2
aauucaaauuaua

SEQ ID NO: 4008959 - RNA, 19 nt, Staphylococcus aureus subsp. aureus MW2
aauucaaccaauuauuaaa

SEQ ID NO: 4008960 - RNA, 13 nt, Staphylococcus aureus subsp. aureus MW2
aauucaacgucau

SEQ ID NO: 4008961 - RNA, 15 nt, Staphylococcus aureus subsp. aureus MW2
aauucaauaaucuua

SEQ ID NO: 4008962 - RNA, 16 nt, Staphylococcus aureus subsp. aureus MW2
aauucaauaaucuuag

SEQ ID NO: 4008963 - RNA, 15 nt, Staphylococcus aureus subsp. aureus MW2
aauucaaugauuuuu

SEQ ID NO: 4008964 - RNA, 20 nt, Staphylococcus aureus subsp. aureus MW2
aauucaaugauuuuuaaaaa

SEQ ID NO: 4008965 - RNA, 15 nt, Staphylococcus aureus subsp. aureus MW2
aauucacgagcugcu

SEQ ID NO: 4008966 - RNA, 19 nt, Staphylococcus aureus subsp. aureus MW2
aauucacuuauacauguaa

SEQ ID NO: 4008967 - RNA, 23 nt, Staphylococcus aureus subsp. aureus MW2
aauucaguaaucuuguuuucauu

SEQ ID NO: 4008968 - RNA, 14 nt, Staphylococcus aureus subsp. aureus MW2
aauucauaaaugcu

SEQ ID NO: 4008969 - RNA, 16 nt, Staphylococcus aureus subsp. aureus MW2
aauucauaagaaaaau

SEQ ID NO: 4008970 - RNA, 17 nt, Staphylococcus aureus subsp. aureus MW2
aauucauaagaaaaaug

SEQ ID NO: 4008971 - RNA, 20 nt, Staphylococcus aureus subsp. aureus MW2
aauucaucuuaucaagaaua

SEQ ID NO: 4008972 - RNA, 21 nt, Staphylococcus aureus subsp. aureus MW2
aauucaucuuaucaagaauau

SEQ ID NO: 4008973 - RNA, 21 nt, Staphylococcus aureus subsp. aureus MW2
aauucauuccaaacacacugu

SEQ ID NO: 4008974 - RNA, 17 nt, Staphylococcus aureus subsp. aureus MW2
aauuccaaagaaagcua

SEQ ID NO: 4008975 - RNA, 14 nt, Staphylococcus aureus subsp. aureus MW2
aauuccaucaucuc

SEQ ID NO: 4008976 - RNA, 17 nt, Staphylococcus aureus subsp. aureus MW2
aauuccauguauucuua

SEQ ID NO: 4008977 - RNA, 21 nt, Staphylococcus aureus subsp. aureus MW2
aauuccucuggaacuuuaaua

SEQ ID NO: 4008978 - RNA, 15 nt, Staphylococcus aureus subsp. aureus MW2
aauuguugcauuacu

SEQ ID NO: 4008979 - RNA, 18 nt, Staphylococcus aureus subsp. aureus MW2
aauuguugcauuacuuuc

SEQ ID NO: 4008980 - RNA, 17 nt, Staphylococcus aureus subsp. aureus MW2
aauuguuguacauguau

SEQ ID NO: 4008981 - RNA, 18 nt, Staphylococcus aureus subsp. aureus MW2
aauuguuguacauguauu

SEQ ID NO: 4008982 - RNA, 19 nt, Staphylococcus aureus subsp. aureus MW2
aauuguuuaauaacaaaau

SEQ ID NO: 4008983 - RNA, 14 nt, Staphylococcus aureus subsp. aureus MW2
aauuguuuacuaua

SEQ ID NO: 4008984 - RNA, 16 nt, Staphylococcus aureus subsp. aureus MW2
aauuuaaaaagcagua

SEQ ID NO: 4008985 - RNA, 12 nt, Staphylococcus aureus subsp. aureus MW2
aauuuaaaacaa

SEQ ID NO: 4008986 - RNA, 19 nt, Staphylococcus aureus subsp. aureus MW2
aauuuaaaacaaugauuaa

SEQ ID NO: 4008987 - RNA, 20 nt, Staphylococcus aureus subsp. aureus MW2
aauuuaaaacaaugauuaaa

SEQ ID NO: 4008988 - RNA, 14 nt, Staphylococcus aureus subsp. aureus MW2
aauuuaaaagaaaa

SEQ ID NO: 4008989 - RNA, 15 nt, Staphylococcus aureus subsp. aureus MW2
aauuuaaagcaucau

SEQ ID NO: 4008990 - RNA, 22 nt, Staphylococcus aureus subsp. aureus MW2
aauuuaaagcaucauauacaua

SEQ ID NO: 4008991 - RNA, 20 nt, Staphylococcus aureus subsp. aureus MW2
aauuuaaagucuucaucuuu

SEQ ID NO: 4008992 - RNA, 11 nt, Staphylococcus aureus subsp. aureus MW2
aauuuaaauaa

SEQ ID NO: 4008993 - RNA, 12 nt, Staphylococcus aureus subsp. aureus MW2
aauuuaaauauu

SEQ ID NO: 4008994 - RNA, 15 nt, Staphylococcus aureus subsp. aureus MW2
aauuuaaaugcuuaa

SEQ ID NO: 4008995 - RNA, 18 nt, Staphylococcus aureus subsp. aureus MW2
aauuuaaauuaaguacua

SEQ ID NO: 4008996 - RNA, 17 nt, Staphylococcus aureus subsp. aureus MW2
aauuuaacguguaauga

SEQ ID NO: 4008997 - RNA, 17 nt, Staphylococcus aureus subsp. aureus MW2
aauuuaacguuuugaug

SEQ ID NO: 4008998 - RNA, 18 nt, Staphylococcus aureus subsp. aureus MW2
aauuuaauagguucuucu

SEQ ID NO: 4008999 - RNA, 20 nt, Staphylococcus aureus subsp. aureus MW2
aauuuaauaugcuauguaaa

SEQ ID NO: 4009000 - RNA, 16 nt, Staphylococcus aureus subsp. aureus MW2
aauuuaauauuauaag

SEQ ID NO: 4009001 - RNA, 16 nt, Staphylococcus aureus subsp. aureus MW2
aauuuaauuaagaaaa

SEQ ID NO: 4009002 - RNA, 19 nt, Staphylococcus aureus subsp. aureus MW2
aauuuaauugcuguaaaua

SEQ ID NO: 4009003 - RNA, 17 nt, Staphylococcus aureus subsp. aureus MW2
aauuuaauuucaacaac

SEQ ID NO: 4009004 - RNA, 15 nt, Staphylococcus aureus subsp. aureus MW2
aauuuaauuuuauuu

SEQ ID NO: 4009005 - RNA, 22 nt, Staphylococcus aureus subsp. aureus MW2
aauuuacaaaaacuauuuuuua

SEQ ID NO: 4009006 - RNA, 16 nt, Staphylococcus aureus subsp. aureus MW2
aauuuaccaguuugau

SEQ ID NO: 4009007 - RNA, 17 nt, Staphylococcus aureus subsp. aureus MW2
aauuuagauauaauaaa

SEQ ID NO: 4009008 - RNA, 12 nt, Staphylococcus aureus subsp. aureus MW2
aauuuagaugca

SEQ ID NO: 4009009 - RNA, 15 nt, Staphylococcus aureus subsp. aureus MW2
aauuuagaugcauaa

SEQ ID NO: 4009010 - RNA, 19 nt, Staphylococcus aureus subsp. aureus MW2
aauuuagcaucaaaaauaa

SEQ ID NO: 4009011 - RNA, 21 nt, Staphylococcus aureus subsp. aureus MW2
aauuuagguggagauuuaaca

SEQ ID NO: 4009012 - RNA, 18 nt, Staphylococcus aureus subsp. aureus MW2
aauuuaguacucaauguu

SEQ ID NO: 4009013 - RNA, 21 nt, Staphylococcus aureus subsp. aureus MW2
aauuuaguauaaauaaaaaua

SEQ ID NO: 4009014 - RNA, 17 nt, Staphylococcus aureus subsp. aureus MW2
aauuuaguuuuaauaua

SEQ ID NO: 4009015 - RNA, 17 nt, Staphylococcus aureus subsp. aureus MW2
aauuuauaaaaagagau

SEQ ID NO: 4009016 - RNA, 16 nt, Staphylococcus aureus subsp. aureus MW2
aauuuauaaugauuaa

SEQ ID NO: 4009017 - RNA, 15 nt, Staphylococcus aureus subsp. aureus MW2
aauuuauaauuucua

SEQ ID NO: 4009018 - RNA, 17 nt, Staphylococcus aureus subsp. aureus MW2
aauuuauaauuucuaaa

SEQ ID NO: 4009019 - RNA, 20 nt, Staphylococcus aureus subsp. aureus MW2
aauuuauaauuucuaaaucu

SEQ ID NO: 4009020 - RNA, 16 nt, Staphylococcus aureus subsp. aureus MW2
aauuuauauagucuau

SEQ ID NO: 4009021 - RNA, 13 nt, Staphylococcus aureus subsp. aureus MW2
aauuuauauuaaa

SEQ ID NO: 4009022 - RNA, 15 nt, Staphylococcus aureus subsp. aureus MW2
aauuuauauuaaaua

SEQ ID NO: 4009023 - RNA, 15 nt, Staphylococcus aureus subsp. aureus MW2
aauuuaucaauuucu

SEQ ID NO: 4009024 - RNA, 16 nt, Staphylococcus aureus subsp. aureus MW2
aauuuaucauuauuua

SEQ ID NO: 4009025 - RNA, 22 nt, Staphylococcus aureus subsp. aureus MW2
aauuuaucgagaacaucaucau

SEQ ID NO: 4009026 - RNA, 22 nt, Staphylococcus aureus subsp. aureus MW2
aauuuauguguugugauauaua

SEQ ID NO: 4009027 - RNA, 12 nt, Staphylococcus aureus subsp. aureus MW2
aauuuauuauaa

SEQ ID NO: 4009028 - RNA, 16 nt, Staphylococcus aureus subsp. aureus MW2
aauuuauuuauuuuga

SEQ ID NO: 4009029 - RNA, 23 nt, Staphylococcus aureus subsp. aureus MW2
aauuuauuuauuuugauuugauu

SEQ ID NO: 4009030 - RNA, 13 nt, Staphylococcus aureus subsp. aureus MW2
aauuuauuuugua

SEQ ID NO: 4009031 - RNA, 15 nt, Staphylococcus aureus subsp. aureus MW2
aauuucaaaaaggaa

SEQ ID NO: 4009032 - RNA, 12 nt, Staphylococcus aureus subsp. aureus MW2
aauuucaaaaau

SEQ ID NO: 4009033 - RNA, 18 nt, Staphylococcus aureus subsp. aureus MW2
aauuucaaugucugcauc

SEQ ID NO: 4009034 - RNA, 23 nt, Staphylococcus aureus subsp. aureus MW2
aauuucaauuuggaaauaucuua

SEQ ID NO: 4009035 - RNA, 21 nt, Staphylococcus aureus subsp. aureus MW2
aauuucacuuuaacuucuuuu

SEQ ID NO: 4009036 - RNA, 18 nt, Staphylococcus aureus subsp. aureus MW2
aauuucauaguuaucgau

SEQ ID NO: 4009037 - RNA, 20 nt, Staphylococcus aureus subsp. aureus MW2
aauuucauaguuaucgauuu

SEQ ID NO: 4009038 - RNA, 14 nt, Staphylococcus aureus subsp. aureus MW2
aauuucaugugcaa

SEQ ID NO: 4009039 - RNA, 19 nt, Staphylococcus aureus subsp. aureus MW2
aauuucauuugaaauaguu

SEQ ID NO: 4009040 - RNA, 17 nt, Staphylococcus aureus subsp. aureus MW2
aauuucauuuuugauaa

SEQ ID NO: 4009041 - RNA, 16 nt, Staphylococcus aureus subsp. aureus MW2
aauuuccaaaguaaua

SEQ ID NO: 4009042 - RNA, 16 nt, Staphylococcus aureus subsp. aureus MW2
aauuuccaauaucuuc

SEQ ID NO: 4009043 - RNA, 18 nt, Staphylococcus aureus subsp. aureus MW2
aauuuccaauaucuucuu

SEQ ID NO: 4009044 - RNA, 21 nt, Staphylococcus aureus subsp. aureus MW2
aauuuccugcagucauuugau

SEQ ID NO: 4009045 - RNA, 16 nt, Staphylococcus aureus subsp. aureus MW2
aauuucgacaucuaga

SEQ ID NO: 4009046 - RNA, 18 nt, Staphylococcus aureus subsp. aureus MW2
aauuucgauuuucaccaa

SEQ ID NO: 4009047 - RNA, 19 nt, Staphylococcus aureus subsp. aureus MW2
aauuucuaauuuaguaucu

SEQ ID NO: 4009048 - RNA, 20 nt, Staphylococcus aureus subsp. aureus MW2
aauuucuacagacaaugcaa

SEQ ID NO: 4009049 - RNA, 22 nt, Staphylococcus aureus subsp. aureus MW2
aauuucuacagacaaugcaagu

SEQ ID NO: 4009050 - RNA, 17 nt, Staphylococcus aureus subsp. aureus MW2
aauuucuaugaaaaaaa

SEQ ID NO: 4009051 - RNA, 14 nt, Staphylococcus aureus subsp. aureus MW2
aauuucuauuuaaa

SEQ ID NO: 4009052 - RNA, 20 nt, Staphylococcus aureus subsp. aureus MW2
aauuucucacugcuguucuu

SEQ ID NO: 4009053 - RNA, 15 nt, Staphylococcus aureus subsp. aureus MW2
aauuucugaacauaa

SEQ ID NO: 4009054 - RNA, 17 nt, Staphylococcus aureus subsp. aureus MW2
aauuucugcuucuuuua

SEQ ID NO: 4009055 - RNA, 18 nt, Staphylococcus aureus subsp. aureus MW2
aauuucugguaaaaaaau

SEQ ID NO: 4009056 - RNA, 19 nt, Staphylococcus aureus subsp. aureus MW2
aauuucugguaaaaaaaua

SEQ ID NO: 4009057 - RNA, 23 nt, Staphylococcus aureus subsp. aureus MW2
aauuucuguuuacgccauaagaa

SEQ ID NO: 4009058 - RNA, 14 nt, Staphylococcus aureus subsp. aureus MW2
aauuucuuuaaagu

SEQ ID NO: 4009059 - RNA, 16 nt, Staphylococcus aureus subsp. aureus MW2
aauuugaaauauacca

SEQ ID NO: 4009060 - RNA, 21 nt, Staphylococcus aureus subsp. aureus MW2
aauuugaauauacuuaauuua

SEQ ID NO: 4009061 - RNA, 21 nt, Staphylococcus aureus subsp. aureus MW2
aauuugagccauuguuauuau

SEQ ID NO: 4009062 - RNA, 17 nt, Staphylococcus aureus subsp. aureus MW2
aauuugaggauacauaa

SEQ ID NO: 4009063 - RNA, 23 nt, Staphylococcus aureus subsp. aureus MW2
aauuugauguucuugaaaacaau

SEQ ID NO: 4009064 - RNA, 16 nt, Staphylococcus aureus subsp. aureus MW2
aauuugauuaaauucu

SEQ ID NO: 4009065 - RNA, 16 nt, Staphylococcus aureus subsp. aureus MW2
aauuugcacaaagaua

SEQ ID NO: 4009066 - RNA, 18 nt, Staphylococcus aureus subsp. aureus MW2
aauuuggucauuuaaaca

SEQ ID NO: 4009067 - RNA, 23 nt, Staphylococcus aureus subsp. aureus MW2
acaaauguauaccuauuggcauu

SEQ ID NO: 4009068 - RNA, 17 nt, Staphylococcus aureus subsp. aureus MW2
acaaauguucuauagaa

SEQ ID NO: 4009069 - RNA, 13 nt, Staphylococcus aureus subsp. aureus MW2
acaaauguuuuaa

SEQ ID NO: 4009070 - RNA, 19 nt, Staphylococcus aureus subsp. aureus MW2
acaaauguuuuaaguuguu

SEQ ID NO: 4009071 - RNA, 22 nt, Staphylococcus aureus subsp. aureus MW2
acaaauuaaaaaacaauaaaau

SEQ ID NO: 4009072 - RNA, 13 nt, Staphylococcus aureus subsp. aureus MW2
acaaauuaaaaag

SEQ ID NO: 4009073 - RNA, 18 nt, Staphylococcus aureus subsp. aureus MW2
acaaauuaaaaagguacu

SEQ ID NO: 4009074 - RNA, 16 nt, Staphylococcus aureus subsp. aureus MW2
acaaauuaucacucau

SEQ ID NO: 4009075 - RNA, 11 nt, Staphylococcus aureus subsp. aureus MW2
acaaauuauua

SEQ ID NO: 4009076 - RNA, 12 nt, Staphylococcus aureus subsp. aureus MW2
acaaauuauuaa

SEQ ID NO: 4009077 - RNA, 16 nt, Staphylococcus aureus subsp. aureus MW2
acaaauucuaugagaa

SEQ ID NO: 4009078 - RNA, 18 nt, Staphylococcus aureus subsp. aureus MW2
acaaauucuaugagaaua

SEQ ID NO: 4009079 - RNA, 21 nt, Staphylococcus aureus subsp. aureus MW2
acaaauucuaugagaauagac

SEQ ID NO: 4009080 - RNA, 22 nt, Staphylococcus aureus subsp. aureus MW2
acaaauugcaauggcaaccuuu

SEQ ID NO: 4009081 - RNA, 21 nt, Staphylococcus aureus subsp. aureus MW2
acaaauuugaauauacuuaau

SEQ ID NO: 4009082 - RNA, 23 nt, Staphylococcus aureus subsp. aureus MW2
acaaauuugaauauacuuaauuu

SEQ ID NO: 4009083 - RNA, 16 nt, Staphylococcus aureus subsp. aureus MW2
acaaauuuuaaaauaa

SEQ ID NO: 4009084 - RNA, 14 nt, Staphylococcus aureus subsp. aureus MW2
acaacaaauuuuga

SEQ ID NO: 4009085 - RNA, 15 nt, Staphylococcus aureus subsp. aureus MW2
acaacaaucaaauua

SEQ ID NO: 4009086 - RNA, 14 nt, Staphylococcus aureus subsp. aureus MW2
acaacaaucacgau

SEQ ID NO: 4009087 - RNA, 13 nt, Staphylococcus aureus subsp. aureus MW2
acaacaaugaauc

SEQ ID NO: 4009088 - RNA, 17 nt, Staphylococcus aureus subsp. aureus MW2
acaacacgaugacaugg

SEQ ID NO: 4009089 - RNA, 22 nt, Staphylococcus aureus subsp. aureus MW2
acaacagugcucuaugcuuuua

SEQ ID NO: 4009090 - RNA, 21 nt, Staphylococcus aureus subsp. aureus MW2
acaacaugauuucuucuccuu

SEQ ID NO: 4009091 - RNA, 11 nt, Staphylococcus aureus subsp. aureus MW2
acaacauguuu

SEQ ID NO: 4009092 - RNA, 21 nt, Staphylococcus aureus subsp. aureus MW2
acaacauuauuuauauuuaga

SEQ ID NO: 4009093 - RNA, 13 nt, Staphylococcus aureus subsp. aureus MW2
acaaccaucagca

SEQ ID NO: 4009094 - RNA, 19 nt, Staphylococcus aureus subsp. aureus MW2
acaaccugugauaaaaauc

SEQ ID NO: 4009095 - RNA, 15 nt, Staphylococcus aureus subsp. aureus MW2
acaacgacuuucacu

SEQ ID NO: 4009096 - RNA, 18 nt, Staphylococcus aureus subsp. aureus MW2
acaacggcauaauacaca

SEQ ID NO: 4009097 - RNA, 19 nt, Staphylococcus aureus subsp. aureus MW2
acaacggcauaauacacau

SEQ ID NO: 4009098 - RNA, 19 nt, Staphylococcus aureus subsp. aureus MW2
acaacguccacagaugcau

SEQ ID NO: 4009099 - RNA, 17 nt, Staphylococcus aureus subsp. aureus MW2
acaacuaauaacaaaua

SEQ ID NO: 4009100 - RNA, 15 nt, Staphylococcus aureus subsp. aureus MW2
acaacuguucuaaaa

SEQ ID NO: 4009101 - RNA, 19 nt, Staphylococcus aureus subsp. aureus MW2
acaacuguucuaaaauuaa

SEQ ID NO: 4009102 - RNA, 13 nt, Staphylococcus aureus subsp. aureus MW2
acaacuucuucuc

SEQ ID NO: 4009103 - RNA, 19 nt, Staphylococcus aureus subsp. aureus MW2
acaacuugaacuaaaacaa

SEQ ID NO: 4009104 - RNA, 15 nt, Staphylococcus aureus subsp. aureus MW2
acaacuuuauuauac

SEQ ID NO: 4009105 - RNA, 18 nt, Staphylococcus aureus subsp. aureus MW2
acaagaacaugauacuga

SEQ ID NO: 4009106 - RNA, 19 nt, Staphylococcus aureus subsp. aureus MW2
acaagauucauacacugca

SEQ ID NO: 4009107 - RNA, 15 nt, Staphylococcus aureus subsp. aureus MW2
acaagcaucaugaaa

SEQ ID NO: 4009108 - RNA, 20 nt, Staphylococcus aureus subsp. aureus MW2
acaagcaucaugaaauuaga

SEQ ID NO: 4009109 - RNA, 16 nt, Staphylococcus aureus subsp. aureus MW2
acaagccaagauaaau

SEQ ID NO: 4009110 - RNA, 21 nt, Staphylococcus aureus subsp. aureus MW2
acaagccaagauaaaucauca

SEQ ID NO: 4009111 - RNA, 22 nt, Staphylococcus aureus subsp. aureus MW2
acaagccuuaaaauauuuaacu

SEQ ID NO: 4009112 - RNA, 10 nt, Staphylococcus aureus subsp. aureus MW2
acaagcuuua

SEQ ID NO: 4009113 - RNA, 20 nt, Staphylococcus aureus subsp. aureus MW2
acaagguaugaaauaacaau

SEQ ID NO: 4009114 - RNA, 15 nt, Staphylococcus aureus subsp. aureus MW2
acaagguuucaagag

SEQ ID NO: 4009115 - RNA, 15 nt, Staphylococcus aureus subsp. aureus MW2
acaaguacaauaaua

SEQ ID NO: 4009116 - RNA, 18 nt, Staphylococcus aureus subsp. aureus MW2
acaaguacaauaauaccu

SEQ ID NO: 4009117 - RNA, 15 nt, Staphylococcus aureus subsp. aureus MW2
acaaguauaaaugca

SEQ ID NO: 4009118 - RNA, 20 nt, Staphylococcus aureus subsp. aureus MW2
acaaguauaaaugcagcugu

SEQ ID NO: 4009119 - RNA, 23 nt, Staphylococcus aureus subsp. aureus MW2
acaagucuaguucgaacacacac

SEQ ID NO: 4009120 - RNA, 18 nt, Staphylococcus aureus subsp. aureus MW2
acaagucuuuacucuaca

SEQ ID NO: 4009121 - RNA, 16 nt, Staphylococcus aureus subsp. aureus MW2
acaaguuauuauccaa

SEQ ID NO: 4009122 - RNA, 17 nt, Staphylococcus aureus subsp. aureus MW2
acaaguugcacauuaua

SEQ ID NO: 4009123 - RNA, 20 nt, Staphylococcus aureus subsp. aureus MW2
acaaguugcugaauaaaaua

SEQ ID NO: 4009124 - RNA, 11 nt, Staphylococcus aureus subsp. aureus MW2
acaauaaaauu

SEQ ID NO: 4009125 - RNA, 14 nt, Staphylococcus aureus subsp. aureus MW2
acaauaaaauuacu

SEQ ID NO: 4009126 - RNA, 15 nt, Staphylococcus aureus subsp. aureus MW2
acaauaacuguucuu

SEQ ID NO: 4009127 - RNA, 22 nt, Staphylococcus aureus subsp. aureus MW2
acaauaauaugccaaaguaaua

SEQ ID NO: 4009128 - RNA, 14 nt, Staphylococcus aureus subsp. aureus MW2
acaauaaugugcaa

SEQ ID NO: 4009129 - RNA, 16 nt, Staphylococcus aureus subsp. aureus MW2
acaauaaugugcaagu

SEQ ID NO: 4009130 - RNA, 20 nt, Staphylococcus aureus subsp. aureus MW2
acaauaaugugcaaguuggg

SEQ ID NO: 4009131 - RNA, 15 nt, Staphylococcus aureus subsp. aureus MW2
acaauacaaaucgau

SEQ ID NO: 4009132 - RNA, 15 nt, Staphylococcus aureus subsp. aureus MW2
acaauacauaauggu

SEQ ID NO: 4009133 - RNA, 16 nt, Staphylococcus aureus subsp. aureus MW2
acaauacauaaugguu

SEQ ID NO: 4009134 - RNA, 16 nt, Staphylococcus aureus subsp. aureus MW2
acaauagguacaacua

SEQ ID NO: 4009135 - RNA, 22 nt, Staphylococcus aureus subsp. aureus MW2
acaauaguauuaacuauaaaua

SEQ ID NO: 4009136 - RNA, 14 nt, Staphylococcus aureus subsp. aureus MW2
acaauauaaaagca

SEQ ID NO: 4009137 - RNA, 15 nt, Staphylococcus aureus subsp. aureus MW2
acaauauaaaagcac

SEQ ID NO: 4009138 - RNA, 23 nt, Staphylococcus aureus subsp. aureus MW2
acaauauaauauauacaaauaaa

SEQ ID NO: 4009139 - RNA, 14 nt, Staphylococcus aureus subsp. aureus MW2
acaauaucacuuaa

SEQ ID NO: 4009140 - RNA, 14 nt, Staphylococcus aureus subsp. aureus MW2
acaauaucaucuaa

SEQ ID NO: 4009141 - RNA, 15 nt, Staphylococcus aureus subsp. aureus MW2
acaauauuaaaauua

SEQ ID NO: 4009142 - RNA, 23 nt, Staphylococcus aureus subsp. aureus MW2
acaauauuuuuacauauuuauac

SEQ ID NO: 4009143 - RNA, 19 nt, Staphylococcus aureus subsp. aureus MW2
acaaucaacuuagaauuua

SEQ ID NO: 4009144 - RNA, 21 nt, Staphylococcus aureus subsp. aureus MW2
acaaucaacuuagaauuuaca

SEQ ID NO: 4009145 - RNA, 13 nt, Staphylococcus aureus subsp. aureus MW2
acaaucacagcaa

SEQ ID NO: 4009146 - RNA, 15 nt, Staphylococcus aureus subsp. aureus MW2
acaaucagauaaguu

SEQ ID NO: 4009147 - RNA, 24 nt, Staphylococcus aureus subsp. aureus MW2
acaaucagauaaguuacuagcauu

SEQ ID NO: 4009148 - RNA, 19 nt, Staphylococcus aureus subsp. aureus MW2
acaauccugaagagaaaau

SEQ ID NO: 4009149 - RNA, 23 nt, Staphylococcus aureus subsp. aureus MW2
acaauccugaagagaaaauuugu

SEQ ID NO: 4009150 - RNA, 19 nt, Staphylococcus aureus subsp. aureus MW2
acaaucggaagcauauuuc

SEQ ID NO: 4009151 - RNA, 22 nt, Staphylococcus aureus subsp. aureus MW2
acaaucuaaauguaaaaucauu

SEQ ID NO: 4009152 - RNA, 20 nt, Staphylococcus aureus subsp. aureus MW2
acaaugaagcuaaguauaua

SEQ ID NO: 4009153 - RNA, 20 nt, Staphylococcus aureus subsp. aureus MW2
acaaugaauccaaauauuaa

SEQ ID NO: 4009154 - RNA, 14 nt, Staphylococcus aureus subsp. aureus MW2
acaaugauuaaaau

SEQ ID NO: 4009155 - RNA, 15 nt, Staphylococcus aureus subsp. aureus MW2
acaaugcaaguuggc

SEQ ID NO: 4009156 - RNA, 17 nt, Staphylococcus aureus subsp. aureus MW2
acagcugcuucucuuug

SEQ ID NO: 4009157 - RNA, 20 nt, Staphylococcus aureus subsp. aureus MW2
acagcugcuucucuuugaac

SEQ ID NO: 4009158 - RNA, 23 nt, Staphylococcus aureus subsp. aureus MW2
acagcuuaauuuuauuauuaauc

SEQ ID NO: 4009159 - RNA, 13 nt, Staphylococcus aureus subsp. aureus MW2
acagcuucaaaau

SEQ ID NO: 4009160 - RNA, 19 nt, Staphylococcus aureus subsp. aureus MW2
acagcuucucauugaaauc

SEQ ID NO: 4009161 - RNA, 14 nt, Staphylococcus aureus subsp. aureus MW2
acagcuuuuucuac

SEQ ID NO: 4009162 - RNA, 18 nt, Staphylococcus aureus subsp. aureus MW2
acagguuacuuuuuuaau

SEQ ID NO: 4009163 - RNA, 18 nt, Staphylococcus aureus subsp. aureus MW2
acaguaauuuuuaaacaa

SEQ ID NO: 4009164 - RNA, 19 nt, Staphylococcus aureus subsp. aureus MW2
acaguaauuuuuaaacaaa

SEQ ID NO: 4009165 - RNA, 21 nt, Staphylococcus aureus subsp. aureus MW2
acaguacgguuauuuggauaa

SEQ ID NO: 4009166 - RNA, 14 nt, Staphylococcus aureus subsp. aureus MW2
acaguaucuucagu

SEQ ID NO: 4009167 - RNA, 20 nt, Staphylococcus aureus subsp. aureus MW2
acagucaaugacuuaacauc

SEQ ID NO: 4009168 - RNA, 18 nt, Staphylococcus aureus subsp. aureus MW2
acagucauaaauugauuu

SEQ ID NO: 4009169 - RNA, 20 nt, Staphylococcus aureus subsp. aureus MW2
acagucccaaccccuuuauu

SEQ ID NO: 4009170 - RNA, 16 nt, Staphylococcus aureus subsp. aureus MW2
acagugaacaccccuu

SEQ ID NO: 4009171 - RNA, 15 nt, Staphylococcus aureus subsp. aureus MW2
acagugaaucuaaac

SEQ ID NO: 4009172 - RNA, 15 nt, Staphylococcus aureus subsp. aureus MW2
acagugacugauuca

SEQ ID NO: 4009173 - RNA, 17 nt, Staphylococcus aureus subsp. aureus MW2
acagugacugauucacc

SEQ ID NO: 4009174 - RNA, 19 nt, Staphylococcus aureus subsp. aureus MW2
acagugcaugaugaacuua

SEQ ID NO: 4009175 - RNA, 14 nt, Staphylococcus aureus subsp. aureus MW2
acaguguggucuug

SEQ ID NO: 4009176 - RNA, 22 nt, Staphylococcus aureus subsp. aureus MW2
acaguuacuuucgcuugcaaag

SEQ ID NO: 4009177 - RNA, 20 nt, Staphylococcus aureus subsp. aureus MW2
acaguuaugccugaagcgcu

SEQ ID NO: 4009178 - RNA, 21 nt, Staphylococcus aureus subsp. aureus MW2
acaguuucaucuucaacuuuc

SEQ ID NO: 4009179 - RNA, 14 nt, Staphylococcus aureus subsp. aureus MW2
acaguuucuauauu

SEQ ID NO: 4009180 - RNA, 20 nt, Staphylococcus aureus subsp. aureus MW2
acaguuucuuggucugcugu

SEQ ID NO: 4009181 - RNA, 23 nt, Staphylococcus aureus subsp. aureus MW2
acaguuuuauuaucuuuguaaau

SEQ ID NO: 4009182 - RNA, 19 nt, Staphylococcus aureus subsp. aureus MW2
acauaaaaaaagagaccuu

SEQ ID NO: 4009183 - RNA, 13 nt, Staphylococcus aureus subsp. aureus MW2
acauaaaaaaaua

SEQ ID NO: 4009184 - RNA, 14 nt, Staphylococcus aureus subsp. aureus MW2
acauaaaacuuaca

SEQ ID NO: 4009185 - RNA, 16 nt, Staphylococcus aureus subsp. aureus MW2
acauaaaacuuacauu

SEQ ID NO: 4009186 - RNA, 15 nt, Staphylococcus aureus subsp. aureus MW2
acauaaacaauaacu

SEQ ID NO: 4009187 - RNA, 13 nt, Staphylococcus aureus subsp. aureus MW2
acauaaagaauuu

SEQ ID NO: 4009188 - RNA, 12 nt, Staphylococcus aureus subsp. aureus MW2
acauaaaucaau

SEQ ID NO: 4009189 - RNA, 13 nt, Staphylococcus aureus subsp. aureus MW2
acauaaaucaaua

SEQ ID NO: 4009190 - RNA, 23 nt, Staphylococcus aureus subsp. aureus MW2
acauaaaucuaauacuuucaaac

SEQ ID NO: 4009191 - RNA, 18 nt, Staphylococcus aureus subsp. aureus MW2
acauaaaugcuaaaagua

SEQ ID NO: 4009192 - RNA, 17 nt, Staphylococcus aureus subsp. aureus MW2
acauaacagcuaaaaau

SEQ ID NO: 4009193 - RNA, 15 nt, Staphylococcus aureus subsp. aureus MW2
acauaaccuugcuuu

SEQ ID NO: 4009194 - RNA, 17 nt, Staphylococcus aureus subsp. aureus MW2
acauaacucaaauaucu

SEQ ID NO: 4009195 - RNA, 14 nt, Staphylococcus aureus subsp. aureus MW2
acauaagaaaaagc

SEQ ID NO: 4009196 - RNA, 16 nt, Staphylococcus aureus subsp. aureus MW2
acauaagcaaagauga

SEQ ID NO: 4009197 - RNA, 21 nt, Staphylococcus aureus subsp. aureus MW2
acauaaggucuuggacuaaua

SEQ ID NO: 4009198 - RNA, 13 nt, Staphylococcus aureus subsp. aureus MW2
acauaaucauaau

SEQ ID NO: 4009199 - RNA, 20 nt, Staphylococcus aureus subsp. aureus MW2
acauaauuaacuuucuuuug

SEQ ID NO: 4009200 - RNA, 18 nt, Staphylococcus aureus subsp. aureus MW2
acauaauuuaucaauuuc

SEQ ID NO: 4009201 - RNA, 20 nt, Staphylococcus aureus subsp. aureus MW2
acauaauuuaucaauuucua

SEQ ID NO: 4009202 - RNA, 16 nt, Staphylococcus aureus subsp. aureus MW2
acauaauuuaucugcg

SEQ ID NO: 4009203 - RNA, 15 nt, Staphylococcus aureus subsp. aureus MW2
acauacauuuugaaa

SEQ ID NO: 4009204 - RNA, 14 nt, Staphylococcus aureus subsp. aureus MW2
acauacugauuaaa

SEQ ID NO: 4009205 - RNA, 15 nt, Staphylococcus aureus subsp. aureus MW2
acauacugauuaaac

SEQ ID NO: 4009206 - RNA, 14 nt, Staphylococcus aureus subsp. aureus MW2
acauagaaagguga

SEQ ID NO: 4009207 - RNA, 22 nt, Staphylococcus aureus subsp. aureus MW2
acauagaauaacgucauauguu

SEQ ID NO: 4009208 - RNA, 17 nt, Staphylococcus aureus subsp. aureus MW2
acauagacacuuaacuu

SEQ ID NO: 4009209 - RNA, 16 nt, Staphylococcus aureus subsp. aureus MW2
acauaggauaucuacg

SEQ ID NO: 4009210 - RNA, 22 nt, Staphylococcus aureus subsp. aureus MW2
acauagguauaaucauuuaaac

SEQ ID NO: 4009211 - RNA, 22 nt, Staphylococcus aureus subsp. aureus MW2
acauaguuucuucuauuauauu

SEQ ID NO: 4009212 - RNA, 16 nt, Staphylococcus aureus subsp. aureus MW2
acauauaaaucauuuc

SEQ ID NO: 4009213 - RNA, 13 nt, Staphylococcus aureus subsp. aureus MW2
acauauaagaauu

SEQ ID NO: 4009214 - RNA, 13 nt, Staphylococcus aureus subsp. aureus MW2
acauauacaaauu

SEQ ID NO: 4009215 - RNA, 17 nt, Staphylococcus aureus subsp. aureus MW2
acauauacaaauuuaua

SEQ ID NO: 4009216 - RNA, 18 nt, Staphylococcus aureus subsp. aureus MW2
acauauacaaauuuauau

SEQ ID NO: 4009217 - RNA, 15 nt, Staphylococcus aureus subsp. aureus MW2
acauaugacuuuauu

SEQ ID NO: 4009218 - RNA, 16 nt, Staphylococcus aureus subsp. aureus MW2
acauaugcuauaucca

SEQ ID NO: 4009219 - RNA, 19 nt, Staphylococcus aureus subsp. aureus MW2
acauauguacuauuaucua

SEQ ID NO: 4009220 - RNA, 23 nt, Staphylococcus aureus subsp. aureus MW2
acauaugucuuucuaaguuugaa

SEQ ID NO: 4009221 - RNA, 19 nt, Staphylococcus aureus subsp. aureus MW2
acauauguguaugauagaa

SEQ ID NO: 4009222 - RNA, 14 nt, Staphylococcus aureus subsp. aureus MW2
acauauuauauaua

SEQ ID NO: 4009223 - RNA, 18 nt, Staphylococcus aureus subsp. aureus MW2
acauauuaugauacgcuu

SEQ ID NO: 4009224 - RNA, 13 nt, Staphylococcus aureus subsp. aureus MW2
acauauuggcuug

SEQ ID NO: 4009225 - RNA, 21 nt, Staphylococcus aureus subsp. aureus MW2
acauauuggcuugcuucauua

SEQ ID NO: 4009226 - RNA, 18 nt, Staphylococcus aureus subsp. aureus MW2
acauauuuauauuuugua

SEQ ID NO: 4009227 - RNA, 19 nt, Staphylococcus aureus subsp. aureus MW2
acauauuuuaacuaugaau

SEQ ID NO: 4009228 - RNA, 15 nt, Staphylococcus aureus subsp. aureus MW2
acauauuuuuuaaau

SEQ ID NO: 4009229 - RNA, 14 nt, Staphylococcus aureus subsp. aureus MW2
acauauuuuuugau

SEQ ID NO: 4009230 - RNA, 16 nt, Staphylococcus aureus subsp. aureus MW2
acauauuuuuugauau

SEQ ID NO: 4009231 - RNA, 18 nt, Staphylococcus aureus subsp. aureus MW2
acaucaaauagacaccaa

SEQ ID NO: 4009232 - RNA, 19 nt, Staphylococcus aureus subsp. aureus MW2
acaucaaauagacaccaaa

SEQ ID NO: 4009233 - RNA, 22 nt, Staphylococcus aureus subsp. aureus MW2
acaucaaauagacaccaaaaac

SEQ ID NO: 4009234 - RNA, 14 nt, Staphylococcus aureus subsp. aureus MW2
acaucaaauuuuuc

SEQ ID NO: 4009235 - RNA, 12 nt, Staphylococcus aureus subsp. aureus MW2
acaucaauaucu

SEQ ID NO: 4009236 - RNA, 14 nt, Staphylococcus aureus subsp. aureus MW2
acaucaauaucuuc

SEQ ID NO: 4009237 - RNA, 21 nt, Staphylococcus aureus subsp. aureus MW2
acaucauaauaaaucuaucua

SEQ ID NO: 4009238 - RNA, 22 nt, Staphylococcus aureus subsp. aureus MW2
acaucauagcacuacaucaagu

SEQ ID NO: 4009239 - RNA, 13 nt, Staphylococcus aureus subsp. aureus MW2
acaucaucaaguu

SEQ ID NO: 4009240 - RNA, 17 nt, Staphylococcus aureus subsp. aureus MW2
acaucaucuuuaauuuu

SEQ ID NO: 4009241 - RNA, 20 nt, Staphylococcus aureus subsp. aureus MW2
acaucauuguuauagcguuu

SEQ ID NO: 4009242 - RNA, 15 nt, Staphylococcus aureus subsp. aureus MW2
acaucauuuuuggau

SEQ ID NO: 4009243 - RNA, 22 nt, Staphylococcus aureus subsp. aureus MW2
acauccaauuauguuuaucuac

SEQ ID NO: 4009244 - RNA, 15 nt, Staphylococcus aureus subsp. aureus MW2
acauccccaaaaaua

SEQ ID NO: 4009245 - RNA, 17 nt, Staphylococcus aureus subsp. aureus MW2
acauuucagcauuugcu

SEQ ID NO: 4009246 - RNA, 22 nt, Staphylococcus aureus subsp. aureus MW2
acauuucgguaugauauuucua

SEQ ID NO: 4009247 - RNA, 13 nt, Staphylococcus aureus subsp. aureus MW2
acauuucuucaau

SEQ ID NO: 4009248 - RNA, 20 nt, Staphylococcus aureus subsp. aureus MW2
acauuugaagcauuaaguuc

SEQ ID NO: 4009249 - RNA, 20 nt, Staphylococcus aureus subsp. aureus MW2
acauuugaccaaguaugaga

SEQ ID NO: 4009250 - RNA, 15 nt, Staphylococcus aureus subsp. aureus MW2
acauuugguucuucu

SEQ ID NO: 4009251 - RNA, 20 nt, Staphylococcus aureus subsp. aureus MW2
acauuuguaaauauuuuuua

SEQ ID NO: 4009252 - RNA, 17 nt, Staphylococcus aureus subsp. aureus MW2
acauuugucacucuuua

SEQ ID NO: 4009253 - RNA, 15 nt, Staphylococcus aureus subsp. aureus MW2
acauuuuaauaaaau

SEQ ID NO: 4009254 - RNA, 22 nt, Staphylococcus aureus subsp. aureus MW2
acauuuuaauaaaaucaucuua

SEQ ID NO: 4009255 - RNA, 17 nt, Staphylococcus aureus subsp. aureus MW2
acauuuuaucugaaaau

SEQ ID NO: 4009256 - RNA, 18 nt, Staphylococcus aureus subsp. aureus MW2
acauuuuaucugaaaaua

SEQ ID NO: 4009257 - RNA, 23 nt, Staphylococcus aureus subsp. aureus MW2
acauuuugauacguaaacacuuu

SEQ ID NO: 4009258 - RNA, 19 nt, Staphylococcus aureus subsp. aureus MW2
acauuuuuagcuuuaguua

SEQ ID NO: 4009259 - RNA, 14 nt, Staphylococcus aureus subsp. aureus MW2
acauuuuuggcuug

SEQ ID NO: 4009260 - RNA, 17 nt, Staphylococcus aureus subsp. aureus MW2
accaaaaacagaggucu

SEQ ID NO: 4009261 - RNA, 22 nt, Staphylococcus aureus subsp. aureus MW2
accaaaaauaauuaugaaaagu

SEQ ID NO: 4009262 - RNA, 22 nt, Staphylococcus aureus subsp. aureus MW2
accaaauaaauaagugauaaau

SEQ ID NO: 4009263 - RNA, 19 nt, Staphylococcus aureus subsp. aureus MW2
accaaaucggaauaaaaua

SEQ ID NO: 4009264 - RNA, 13 nt, Staphylococcus aureus subsp. aureus MW2
accaaauuuauaa

SEQ ID NO: 4009265 - RNA, 21 nt, Staphylococcus aureus subsp. aureus MW2
accaaauuugugauuaugcau

SEQ ID NO: 4009266 - RNA, 21 nt, Staphylococcus aureus subsp. aureus MW2
accaacaauagguacaacuaa

SEQ ID NO: 4009267 - RNA, 22 nt, Staphylococcus aureus subsp. aureus MW2
accaacaauugcacuuggugau

SEQ ID NO: 4009268 - RNA, 20 nt, Staphylococcus aureus subsp. aureus MW2
accaaccaaaaccaaaugaa

SEQ ID NO: 4009269 - RNA, 18 nt, Staphylococcus aureus subsp. aureus MW2
accaacuugcacauuauu

SEQ ID NO: 4009270 - RNA, 13 nt, Staphylococcus aureus subsp. aureus MW2
accaagaauauaa

SEQ ID NO: 4009271 - RNA, 20 nt, Staphylococcus aureus subsp. aureus MW2
accaaguaauucuuuaccau

SEQ ID NO: 4009272 - RNA, 24 nt, Staphylococcus aureus subsp. aureus MW2
accaagugcuuuuuuaccagcaug

SEQ ID NO: 4009273 - RNA, 11 nt, Staphylococcus aureus subsp. aureus MW2
accaauaauua

SEQ ID NO: 4009274 - RNA, 21 nt, Staphylococcus aureus subsp. aureus MW2
accaauacguuuccaauccau

SEQ ID NO: 4009275 - RNA, 20 nt, Staphylococcus aureus subsp. aureus MW2
accaauauaaacaucuucuu

SEQ ID NO: 4009276 - RNA, 11 nt, Staphylococcus aureus subsp. aureus MW2
accaaucgaag

SEQ ID NO: 4009277 - RNA, 20 nt, Staphylococcus aureus subsp. aureus MW2
accaaugauagugaauaaug

SEQ ID NO: 4009278 - RNA, 12 nt, Staphylococcus aureus subsp. aureus MW2
accaauuagcau

SEQ ID NO: 4009279 - RNA, 13 nt, Staphylococcus aureus subsp. aureus MW2
accaauuagcaug

SEQ ID NO: 4009280 - RNA, 15 nt, Staphylococcus aureus subsp. aureus MW2
accaauuagcaugac

SEQ ID NO: 4009281 - RNA, 13 nt, Staphylococcus aureus subsp. aureus MW2
accaauuaggauu

SEQ ID NO: 4009282 - RNA, 16 nt, Staphylococcus aureus subsp. aureus MW2
accaauugaaauuaac

SEQ ID NO: 4009283 - RNA, 12 nt, Staphylococcus aureus subsp. aureus MW2
accaauuuuuag

SEQ ID NO: 4009284 - RNA, 14 nt, Staphylococcus aureus subsp. aureus MW2
accacaacaaugaa

SEQ ID NO: 4009285 - RNA, 23 nt, Staphylococcus aureus subsp. aureus MW2
accacacuuuaaacaagcaucau

SEQ ID NO: 4009286 - RNA, 15 nt, Staphylococcus aureus subsp. aureus MW2
accaccauaugcuaa

SEQ ID NO: 4009287 - RNA, 19 nt, Staphylococcus aureus subsp. aureus MW2
accaccugauaaugcaugu

SEQ ID NO: 4009288 - RNA, 15 nt, Staphylococcus aureus subsp. aureus MW2
accacgguucaccau

SEQ ID NO: 4009289 - RNA, 20 nt, Staphylococcus aureus subsp. aureus MW2
accacucaauucucuaacuu

SEQ ID NO: 4009290 - RNA, 19 nt, Staphylococcus aureus subsp. aureus MW2
accacuggccuuuaaugau

SEQ ID NO: 4009291 - RNA, 17 nt, Staphylococcus aureus subsp. aureus MW2
accacuucuucaccugc

SEQ ID NO: 4009292 - RNA, 16 nt, Staphylococcus aureus subsp. aureus MW2
accacuugaauacuuu

SEQ ID NO: 4009293 - RNA, 23 nt, Staphylococcus aureus subsp. aureus MW2
accacuugaauacuuuuuaacug

SEQ ID NO: 4009294 - RNA, 14 nt, Staphylococcus aureus subsp. aureus MW2
accagcacaucaaa

SEQ ID NO: 4009295 - RNA, 14 nt, Staphylococcus aureus subsp. aureus MW2
accagcuaaccaaa

SEQ ID NO: 4009296 - RNA, 18 nt, Staphylococcus aureus subsp. aureus MW2
accagcuaaccaaauaau

SEQ ID NO: 4009297 - RNA, 16 nt, Staphylococcus aureus subsp. aureus MW2
accagcucguuuuuug

SEQ ID NO: 4009298 - RNA, 21 nt, Staphylococcus aureus subsp. aureus MW2
accagcuuucguaccugcucu

SEQ ID NO: 4009299 - RNA, 15 nt, Staphylococcus aureus subsp. aureus MW2
accaguaacagcuaa

SEQ ID NO: 4009300 - RNA, 20 nt, Staphylococcus aureus subsp. aureus MW2
accagugggcuccaaacaua

SEQ ID NO: 4009301 - RNA, 14 nt, Staphylococcus aureus subsp. aureus MW2
accaguuucuggua

SEQ ID NO: 4009302 - RNA, 13 nt, Staphylococcus aureus subsp. aureus MW2
accauaaaaauag

SEQ ID NO: 4009303 - RNA, 23 nt, Staphylococcus aureus subsp. aureus MW2
accauagauuauauuaucauuga

SEQ ID NO: 4009304 - RNA, 18 nt, Staphylococcus aureus subsp. aureus MW2
accauaguaacaaaauga

SEQ ID NO: 4009305 - RNA, 23 nt, Staphylococcus aureus subsp. aureus MW2
accauauuuuuuaguaauaacau

SEQ ID NO: 4009306 - RNA, 19 nt, Staphylococcus aureus subsp. aureus MW2
accaucaacgccauauuua

SEQ ID NO: 4009307 - RNA, 21 nt, Staphylococcus aureus subsp. aureus MW2
accaucaacgccauauuuauu

SEQ ID NO: 4009308 - RNA, 16 nt, Staphylococcus aureus subsp. aureus MW2
accaucaguauuugua

SEQ ID NO: 4009309 - RNA, 20 nt, Staphylococcus aureus subsp. aureus MW2
accaucucaacuaaucgugu

SEQ ID NO: 4009310 - RNA, 14 nt, Staphylococcus aureus subsp. aureus MW2
accaucucuauuuu

SEQ ID NO: 4009311 - RNA, 18 nt, Staphylococcus aureus subsp. aureus MW2
accaugacgauuccaauc

SEQ ID NO: 4009312 - RNA, 22 nt, Staphylococcus aureus subsp. aureus MW2
accaugaugagauaaaaucaua

SEQ ID NO: 4009313 - RNA, 14 nt, Staphylococcus aureus subsp. aureus MW2
accaugcucuuuuu

SEQ ID NO: 4009314 - RNA, 20 nt, Staphylococcus aureus subsp. aureus MW2
accauuauaauuauuuuuau

SEQ ID NO: 4009315 - RNA, 19 nt, Staphylococcus aureus subsp. aureus MW2
accauuauagacauaagca

SEQ ID NO: 4009316 - RNA, 20 nt, Staphylococcus aureus subsp. aureus MW2
accauuauagacauaagcaa

SEQ ID NO: 4009317 - RNA, 20 nt, Staphylococcus aureus subsp. aureus MW2
accauuaucaagaacuuuaa

SEQ ID NO: 4009318 - RNA, 22 nt, Staphylococcus aureus subsp. aureus MW2
accauucaucgucucacuuaau

SEQ ID NO: 4009319 - RNA, 14 nt, Staphylococcus aureus subsp. aureus MW2
accauuccaaaaau

SEQ ID NO: 4009320 - RNA, 22 nt, Staphylococcus aureus subsp. aureus MW2
accauucgaaagccaauuaaua

SEQ ID NO: 4009321 - RNA, 14 nt, Staphylococcus aureus subsp. aureus MW2
accauugaaugaau

SEQ ID NO: 4009322 - RNA, 19 nt, Staphylococcus aureus subsp. aureus MW2
accauugcacaguuucauc

SEQ ID NO: 4009323 - RNA, 19 nt, Staphylococcus aureus subsp. aureus MW2
accauugugaugauaauua

SEQ ID NO: 4009324 - RNA, 14 nt, Staphylococcus aureus subsp. aureus MW2
accauuuaaaaauu

SEQ ID NO: 4009325 - RNA, 17 nt, Staphylococcus aureus subsp. aureus MW2
accauuuaacucaccuu

SEQ ID NO: 4009326 - RNA, 16 nt, Staphylococcus aureus subsp. aureus MW2
accauuuacuucauaa

SEQ ID NO: 4009327 - RNA, 16 nt, Staphylococcus aureus subsp. aureus MW2
accauuucuuuuuuca

SEQ ID NO: 4009328 - RNA, 18 nt, Staphylococcus aureus subsp. aureus MW2
accauuucuuuuuucaau

SEQ ID NO: 4009329 - RNA, 14 nt, Staphylococcus aureus subsp. aureus MW2
accauuuucaauaa

SEQ ID NO: 4009330 - RNA, 13 nt, Staphylococcus aureus subsp. aureus MW2
acccaaaaaauug

SEQ ID NO: 4009331 - RNA, 20 nt, Staphylococcus aureus subsp. aureus MW2
acccaaguccggcugaaggg

SEQ ID NO: 4009332 - RNA, 13 nt, Staphylococcus aureus subsp. aureus MW2
acccauauaauuu

SEQ ID NO: 4009333 - RNA, 18 nt, Staphylococcus aureus subsp. aureus MW2
acgaacaaggcgacuucu

SEQ ID NO: 4009334 - RNA, 23 nt, Staphylococcus aureus subsp. aureus MW2
acgaacaagucuugcaauaccuc

SEQ ID NO: 4009335 - RNA, 19 nt, Staphylococcus aureus subsp. aureus MW2
acgaaggucuacuaaauaa

SEQ ID NO: 4009336 - RNA, 19 nt, Staphylococcus aureus subsp. aureus MW2
acgaagugcaacaaaagug

SEQ ID NO: 4009337 - RNA, 16 nt, Staphylococcus aureus subsp. aureus MW2
acgaauagaaaauaau

SEQ ID NO: 4009338 - RNA, 22 nt, Staphylococcus aureus subsp. aureus MW2
acgacaacuugaacuaaaacaa

SEQ ID NO: 4009339 - RNA, 13 nt, Staphylococcus aureus subsp. aureus MW2
acgacgaaauaaa

SEQ ID NO: 4009340 - RNA, 13 nt, Staphylococcus aureus subsp. aureus MW2
acgacgaaauaau

SEQ ID NO: 4009341 - RNA, 18 nt, Staphylococcus aureus subsp. aureus MW2
acgacguccagcuaauaa

SEQ ID NO: 4009342 - RNA, 19 nt, Staphylococcus aureus subsp. aureus MW2
acgacucuccaaauauugu

SEQ ID NO: 4009343 - RNA, 19 nt, Staphylococcus aureus subsp. aureus MW2
acgacuuucuaaagcaauu

SEQ ID NO: 4009344 - RNA, 14 nt, Staphylococcus aureus subsp. aureus MW2
acgagagagaaaag

SEQ ID NO: 4009345 - RNA, 18 nt, Staphylococcus aureus subsp. aureus MW2
acgagcuggugagaaauu

SEQ ID NO: 4009346 - RNA, 19 nt, Staphylococcus aureus subsp. aureus MW2
acgagcuugggacagaaaa

SEQ ID NO: 4009347 - RNA, 20 nt, Staphylococcus aureus subsp. aureus MW2
acgagucauaaauauaaaau

SEQ ID NO: 4009348 - RNA, 14 nt, Staphylococcus aureus subsp. aureus MW2
acgaguguuaucac

SEQ ID NO: 4009349 - RNA, 20 nt, Staphylococcus aureus subsp. aureus MW2
acgauaacaauuuauuaaaa

SEQ ID NO: 4009350 - RNA, 14 nt, Staphylococcus aureus subsp. aureus MW2
acgauaagaauuaa

SEQ ID NO: 4009351 - RNA, 16 nt, Staphylococcus aureus subsp. aureus MW2
acgauaagaauuaaca

SEQ ID NO: 4009352 - RNA, 18 nt, Staphylococcus aureus subsp. aureus MW2
acgauaagaauuaacaac

SEQ ID NO: 4009353 - RNA, 18 nt, Staphylococcus aureus subsp. aureus MW2
acgauaccuuuaauaaua

SEQ ID NO: 4009354 - RNA, 14 nt, Staphylococcus aureus subsp. aureus MW2
acgauagauuuauc

SEQ ID NO: 4009355 - RNA, 22 nt, Staphylococcus aureus subsp. aureus MW2
acgauagauuuuuucauagcuu

SEQ ID NO: 4009356 - RNA, 17 nt, Staphylococcus aureus subsp. aureus MW2
acgauauaacauuaaaa

SEQ ID NO: 4009357 - RNA, 20 nt, Staphylococcus aureus subsp. aureus MW2
acgaucaguugagucaauuu

SEQ ID NO: 4009358 - RNA, 13 nt, Staphylococcus aureus subsp. aureus MW2
acgaugguugcuu

SEQ ID NO: 4009359 - RNA, 15 nt, Staphylococcus aureus subsp. aureus MW2
acgauugaacaucuc

SEQ ID NO: 4009360 - RNA, 16 nt, Staphylococcus aureus subsp. aureus MW2
acgauugaacaucucu

SEQ ID NO: 4009361 - RNA, 18 nt, Staphylococcus aureus subsp. aureus MW2
acgauugaguugaaaaua

SEQ ID NO: 4009362 - RNA, 17 nt, Staphylococcus aureus subsp. aureus MW2
acgauugggcaacuuuu

SEQ ID NO: 4009363 - RNA, 17 nt, Staphylococcus aureus subsp. aureus MW2
acgauuguugcaaugau

SEQ ID NO: 4009364 - RNA, 17 nt, Staphylococcus aureus subsp. aureus MW2
acgauuuguucaaugau

SEQ ID NO: 4009365 - RNA, 14 nt, Staphylococcus aureus subsp. aureus MW2
acgauuuucaaaac

SEQ ID NO: 4009366 - RNA, 15 nt, Staphylococcus aureus subsp. aureus MW2
acgauuuugucuuuu

SEQ ID NO: 4009367 - RNA, 17 nt, Staphylococcus aureus subsp. aureus MW2
acgcaaaaauacuccuu

SEQ ID NO: 4009368 - RNA, 15 nt, Staphylococcus aureus subsp. aureus MW2
acgcaaagaaaaaca

SEQ ID NO: 4009369 - RNA, 16 nt, Staphylococcus aureus subsp. aureus MW2
acgcaaagaaaaacau

SEQ ID NO: 4009370 - RNA, 17 nt, Staphylococcus aureus subsp. aureus MW2
acgcaauacgaauaucu

SEQ ID NO: 4009371 - RNA, 22 nt, Staphylococcus aureus subsp. aureus MW2
acgcaauuaaccuugauuuaau

SEQ ID NO: 4009372 - RNA, 17 nt, Staphylococcus aureus subsp. aureus MW2
acgcaauuuaauauuau

SEQ ID NO: 4009373 - RNA, 23 nt, Staphylococcus aureus subsp. aureus MW2
acgcaauuuaauauuauaaguug

SEQ ID NO: 4009374 - RNA, 19 nt, Staphylococcus aureus subsp. aureus MW2
acgcaccuggcacaaaugc

SEQ ID NO: 4009375 - RNA, 23 nt, Staphylococcus aureus subsp. aureus MW2
acgcauacaggaaauugaagcgu

SEQ ID NO: 4009376 - RNA, 23 nt, Staphylococcus aureus subsp. aureus MW2
acgcauuacuuuagaaagugauu

SEQ ID NO: 4009377 - RNA, 15 nt, Staphylococcus aureus subsp. aureus MW2
acgccauaagaaaau

SEQ ID NO: 4009378 - RNA, 21 nt, Staphylococcus aureus subsp. aureus MW2
acgccucaacacuuucuacuc

SEQ ID NO: 4009379 - RNA, 23 nt, Staphylococcus aureus subsp. aureus MW2
acgccuggaaucgcguuuaacaa

SEQ ID NO: 4009380 - RNA, 21 nt, Staphylococcus aureus subsp. aureus MW2
acgccuuggccuacuuuuuca

SEQ ID NO: 4009381 - RNA, 13 nt, Staphylococcus aureus subsp. aureus MW2
acgccuuuccauu

SEQ ID NO: 4009382 - RNA, 23 nt, Staphylococcus aureus subsp. aureus MW2
acgcgaaaaaaucggacagcuga

SEQ ID NO: 4009383 - RNA, 15 nt, Staphylococcus aureus subsp. aureus MW2
acgcggguaauauuu

SEQ ID NO: 4009384 - RNA, 13 nt, Staphylococcus aureus subsp. aureus MW2
acgcucuucuucu

SEQ ID NO: 4009385 - RNA, 21 nt, Staphylococcus aureus subsp. aureus MW2
acgcuguuuuuaaaugcuuua

SEQ ID NO: 4009386 - RNA, 16 nt, Staphylococcus aureus subsp. aureus MW2
acgcuuauacuauaua

SEQ ID NO: 4009387 - RNA, 14 nt, Staphylococcus aureus subsp. aureus MW2
acgcuuuaaaucau

SEQ ID NO: 4009388 - RNA, 15 nt, Staphylococcus aureus subsp. aureus MW2
acgcuuuuuaaaaaa

SEQ ID NO: 4009389 - RNA, 14 nt, Staphylococcus aureus subsp. aureus MW2
acggaaauaaccac

SEQ ID NO: 4009390 - RNA, 16 nt, Staphylococcus aureus subsp. aureus MW2
acggaacuacuacauu

SEQ ID NO: 4009391 - RNA, 17 nt, Staphylococcus aureus subsp. aureus MW2
acggcacauucauaccg

SEQ ID NO: 4009392 - RNA, 16 nt, Staphylococcus aureus subsp. aureus MW2
acggcacuaauauuua

SEQ ID NO: 4009393 - RNA, 20 nt, Staphylococcus aureus subsp. aureus MW2
acggcacuaauauuuaaaaa

SEQ ID NO: 4009394 - RNA, 14 nt, Staphylococcus aureus subsp. aureus MW2
acggcugcuuuaac

SEQ ID NO: 4009395 - RNA, 16 nt, Staphylococcus aureus subsp. aureus MW2
acggggcuuuuugugu

SEQ ID NO: 4009396 - RNA, 20 nt, Staphylococcus aureus subsp. aureus MW2
acggggugcuuuuuauguua

SEQ ID NO: 4009397 - RNA, 12 nt, Staphylococcus aureus subsp. aureus MW2
acgguacagaua

SEQ ID NO: 4009398 - RNA, 13 nt, Staphylococcus aureus subsp. aureus MW2
acgguauuuucaa

SEQ ID NO: 4009399 - RNA, 17 nt, Staphylococcus aureus subsp. aureus MW2
acgguuauuuggauaau

SEQ ID NO: 4009400 - RNA, 14 nt, Staphylococcus aureus subsp. aureus MW2
acguaaaauaugau

SEQ ID NO: 4009401 - RNA, 18 nt, Staphylococcus aureus subsp. aureus MW2
acguaacuguuuuaaauu

SEQ ID NO: 4009402 - RNA, 19 nt, Staphylococcus aureus subsp. aureus MW2
acguaaguguaaaugaaag

SEQ ID NO: 4009403 - RNA, 19 nt, Staphylococcus aureus subsp. aureus MW2
acguaauccuuggaaacga

SEQ ID NO: 4009404 - RNA, 14 nt, Staphylococcus aureus subsp. aureus MW2
acguaaugaaucaa

SEQ ID NO: 4009405 - RNA, 16 nt, Staphylococcus aureus subsp. aureus MW2
acguaaugaaucaauu

SEQ ID NO: 4009406 - RNA, 17 nt, Staphylococcus aureus subsp. aureus MW2
acguaauuaauagguua

SEQ ID NO: 4009407 - RNA, 20 nt, Staphylococcus aureus subsp. aureus MW2
acguauagaugcuaauguaa

SEQ ID NO: 4009408 - RNA, 18 nt, Staphylococcus aureus subsp. aureus MW2
acguauauaaguuaaaau

SEQ ID NO: 4009409 - RNA, 15 nt, Staphylococcus aureus subsp. aureus MW2
acguaucaucaaaau

SEQ ID NO: 4009410 - RNA, 17 nt, Staphylococcus aureus subsp. aureus MW2
acguaugcccucauaaa

SEQ ID NO: 4009411 - RNA, 14 nt, Staphylococcus aureus subsp. aureus MW2
acgucaacagcaua

SEQ ID NO: 4009412 - RNA, 10 nt, Staphylococcus aureus subsp. aureus MW2
acgucuaccu

SEQ ID NO: 4009413 - RNA, 22 nt, Staphylococcus aureus subsp. aureus MW2
acgucuuguaucaacauuaaua

SEQ ID NO: 4009414 - RNA, 15 nt, Staphylococcus aureus subsp. aureus MW2
acgucuuuuuagauu

SEQ ID NO: 4009415 - RNA, 13 nt, Staphylococcus aureus subsp. aureus MW2
acgugaacaacau

SEQ ID NO: 4009416 - RNA, 19 nt, Staphylococcus aureus subsp. aureus MW2
acgugcugccuuuuugcuu

SEQ ID NO: 4009417 - RNA, 14 nt, Staphylococcus aureus subsp. aureus MW2
acguggcucuaaaa

SEQ ID NO: 4009418 - RNA, 18 nt, Staphylococcus aureus subsp. aureus MW2
acgugguugguuaccauc

SEQ ID NO: 4009419 - RNA, 16 nt, Staphylococcus aureus subsp. aureus MW2
acguguaaauguuaaa

SEQ ID NO: 4009420 - RNA, 20 nt, Staphylococcus aureus subsp. aureus MW2
acguuauucguuaacaauca

SEQ ID NO: 4009421 - RNA, 13 nt, Staphylococcus aureus subsp. aureus MW2
acguuauuuucaa

SEQ ID NO: 4009422 - RNA, 23 nt, Staphylococcus aureus subsp. aureus MW2
acuauguuguuuaaauuucaaaa

SEQ ID NO: 4009423 - RNA, 13 nt, Staphylococcus aureus subsp. aureus MW2
acuauuaaaggaa

SEQ ID NO: 4009424 - RNA, 15 nt, Staphylococcus aureus subsp. aureus MW2
acuauuaaaggaaau

SEQ ID NO: 4009425 - RNA, 17 nt, Staphylococcus aureus subsp. aureus MW2
acuauuaucuauccauu

SEQ ID NO: 4009426 - RNA, 21 nt, Staphylococcus aureus subsp. aureus MW2
acuauugauauucuaaaaaau

SEQ ID NO: 4009427 - RNA, 22 nt, Staphylococcus aureus subsp. aureus MW2
acuauuuaaucuuaauauuuau

SEQ ID NO: 4009428 - RNA, 19 nt, Staphylococcus aureus subsp. aureus MW2
acuauuuuagcucuuguuc

SEQ ID NO: 4009429 - RNA, 14 nt, Staphylococcus aureus subsp. aureus MW2
acuauuuuuuagac

SEQ ID NO: 4009430 - RNA, 20 nt, Staphylococcus aureus subsp. aureus MW2
acuauuuuuuagacuuuauu

SEQ ID NO: 4009431 - RNA, 20 nt, Staphylococcus aureus subsp. aureus MW2
acucaaaaagccaacacauu

SEQ ID NO: 4009432 - RNA, 20 nt, Staphylococcus aureus subsp. aureus MW2
acucaaaauguuuaacaaua

SEQ ID NO: 4009433 - RNA, 19 nt, Staphylococcus aureus subsp. aureus MW2
acucaaacaauaaagccau

SEQ ID NO: 4009434 - RNA, 21 nt, Staphylococcus aureus subsp. aureus MW2
acucaaacaauaaagccaucu

SEQ ID NO: 4009435 - RNA, 19 nt, Staphylococcus aureus subsp. aureus MW2
acucaaaccuguuuggaaa

SEQ ID NO: 4009436 - RNA, 17 nt, Staphylococcus aureus subsp. aureus MW2
acucaaagauauacuua

SEQ ID NO: 4009437 - RNA, 14 nt, Staphylococcus aureus subsp. aureus MW2
acucaaauaucuaa

SEQ ID NO: 4009438 - RNA, 22 nt, Staphylococcus aureus subsp. aureus MW2
acucaauaugaaaccuuugguu

SEQ ID NO: 4009439 - RNA, 22 nt, Staphylococcus aureus subsp. aureus MW2
acucaaugauuguaauaucuaa

SEQ ID NO: 4009440 - RNA, 15 nt, Staphylococcus aureus subsp. aureus MW2
acucaauucucuaac

SEQ ID NO: 4009441 - RNA, 18 nt, Staphylococcus aureus subsp. aureus MW2
acucaauuucauuugaaa

SEQ ID NO: 4009442 - RNA, 13 nt, Staphylococcus aureus subsp. aureus MW2
acucagauuuuau

SEQ ID NO: 4009443 - RNA, 17 nt, Staphylococcus aureus subsp. aureus MW2
acucaggcuuaauuaau

SEQ ID NO: 4009444 - RNA, 15 nt, Staphylococcus aureus subsp. aureus MW2
acucaguaaauuuau

SEQ ID NO: 4009445 - RNA, 14 nt, Staphylococcus aureus subsp. aureus MW2
acucauaaucaagu

SEQ ID NO: 4009446 - RNA, 17 nt, Staphylococcus aureus subsp. aureus MW2
acucauccauugaucuu

SEQ ID NO: 4009447 - RNA, 21 nt, Staphylococcus aureus subsp. aureus MW2
acucauccauugaucuuuuau

SEQ ID NO: 4009448 - RNA, 21 nt, Staphylococcus aureus subsp. aureus MW2
acucaucuguccgauaucuuu

SEQ ID NO: 4009449 - RNA, 16 nt, Staphylococcus aureus subsp. aureus MW2
acucaugcacuuuauu

SEQ ID NO: 4009450 - RNA, 20 nt, Staphylococcus aureus subsp. aureus MW2
acucauguaacguaaaaaug

SEQ ID NO: 4009451 - RNA, 12 nt, Staphylococcus aureus subsp. aureus MW2
acucauuuuuug

SEQ ID NO: 4009452 - RNA, 17 nt, Staphylococcus aureus subsp. aureus MW2
acuccaauuaccaauga

SEQ ID NO: 4009453 - RNA, 17 nt, Staphylococcus aureus subsp. aureus MW2
acuccaguuuauaacug

SEQ ID NO: 4009454 - RNA, 15 nt, Staphylococcus aureus subsp. aureus MW2
acucccuuuauuuuc

SEQ ID NO: 4009455 - RNA, 20 nt, Staphylococcus aureus subsp. aureus MW2
acuccuuacaauaaagacau

SEQ ID NO: 4009456 - RNA, 15 nt, Staphylococcus aureus subsp. aureus MW2
acuccuuauuuuucg

SEQ ID NO: 4009457 - RNA, 22 nt, Staphylococcus aureus subsp. aureus MW2
acucgacuugguauuuauccug

SEQ ID NO: 4009458 - RNA, 16 nt, Staphylococcus aureus subsp. aureus MW2
acucggggaauuuuua

SEQ ID NO: 4009459 - RNA, 17 nt, Staphylococcus aureus subsp. aureus MW2
acucggggaauuuuuau

SEQ ID NO: 4009460 - RNA, 19 nt, Staphylococcus aureus subsp. aureus MW2
acucguaaauuuuaucuaa

SEQ ID NO: 4009461 - RNA, 24 nt, Staphylococcus aureus subsp. aureus MW2
acucguaaauuuuaucuaaacauu

SEQ ID NO: 4009462 - RNA, 16 nt, Staphylococcus aureus subsp. aureus MW2
acucguugcgcucuuu

SEQ ID NO: 4009463 - RNA, 23 nt, Staphylococcus aureus subsp. aureus MW2
acucguugcgcucuuuucuuguu

SEQ ID NO: 4009464 - RNA, 12 nt, Staphylococcus aureus subsp. aureus MW2
acucuaaaggaa

SEQ ID NO: 4009465 - RNA, 13 nt, Staphylococcus aureus subsp. aureus MW2
acucuacuagaau

SEQ ID NO: 4009466 - RNA, 20 nt, Staphylococcus aureus subsp. aureus MW2
acucuagcggaacguaaguu

SEQ ID NO: 4009467 - RNA, 19 nt, Staphylococcus aureus subsp. aureus MW2
acucugagcacuuagcaau

SEQ ID NO: 4009468 - RNA, 19 nt, Staphylococcus aureus subsp. aureus MW2
acucugaucuaaaaccaua

SEQ ID NO: 4009469 - RNA, 22 nt, Staphylococcus aureus subsp. aureus MW2
acucugcgauuucuaaagcgau

SEQ ID NO: 4009470 - RNA, 22 nt, Staphylococcus aureus subsp. aureus MW2
acugacacuuuaaccacuccuu

SEQ ID NO: 4009471 - RNA, 17 nt, Staphylococcus aureus subsp. aureus MW2
acugacuaauaaaacuu

SEQ ID NO: 4009472 - RNA, 13 nt, Staphylococcus aureus subsp. aureus MW2
acugauaauacug

SEQ ID NO: 4009473 - RNA, 18 nt, Staphylococcus aureus subsp. aureus MW2
acugauauauacuagcaa

SEQ ID NO: 4009474 - RNA, 22 nt, Staphylococcus aureus subsp. aureus MW2
acugauggaaaaguuuuuuacu

SEQ ID NO: 4009475 - RNA, 16 nt, Staphylococcus aureus subsp. aureus MW2
acugcaaauacaccag

SEQ ID NO: 4009476 - RNA, 22 nt, Staphylococcus aureus subsp. aureus MW2
acugcaaauacgaguguuuuaa

SEQ ID NO: 4009477 - RNA, 18 nt, Staphylococcus aureus subsp. aureus MW2
acugcaacaccacacagc

SEQ ID NO: 4009478 - RNA, 23 nt, Staphylococcus aureus subsp. aureus MW2
acugcaauaauuacuaaccuaaa

SEQ ID NO: 4009479 - RNA, 19 nt, Staphylococcus aureus subsp. aureus MW2
acugcacaucauaauaaau

SEQ ID NO: 4009480 - RNA, 20 nt, Staphylococcus aureus subsp. aureus MW2
acugcaccgauaucauauaa

SEQ ID NO: 4009481 - RNA, 21 nt, Staphylococcus aureus subsp. aureus MW2
acugcauagguaaccuuaaau

SEQ ID NO: 4009482 - RNA, 16 nt, Staphylococcus aureus subsp. aureus MW2
acugcauauaaaguca

SEQ ID NO: 4009483 - RNA, 17 nt, Staphylococcus aureus subsp. aureus MW2
acugcauguacaucuuu

SEQ ID NO: 4009484 - RNA, 16 nt, Staphylococcus aureus subsp. aureus MW2
acugccaauaaaaugc

SEQ ID NO: 4009485 - RNA, 19 nt, Staphylococcus aureus subsp. aureus MW2
acugccaauaaaaugcaau

SEQ ID NO: 4009486 - RNA, 17 nt, Staphylococcus aureus subsp. aureus MW2
acugccauauagauauu

SEQ ID NO: 4009487 - RNA, 17 nt, Staphylococcus aureus subsp. aureus MW2
acugccauauguuuuag

SEQ ID NO: 4009488 - RNA, 20 nt, Staphylococcus aureus subsp. aureus MW2
acugccauucuuuuucucaa

SEQ ID NO: 4009489 - RNA, 22 nt, Staphylococcus aureus subsp. aureus MW2
acugccugacauucaucacaaa

SEQ ID NO: 4009490 - RNA, 16 nt, Staphylococcus aureus subsp. aureus MW2
acugccuuuuuguaau

SEQ ID NO: 4009491 - RNA, 22 nt, Staphylococcus aureus subsp. aureus MW2
acugcgaacagcugcuucucuu

SEQ ID NO: 4009492 - RNA, 16 nt, Staphylococcus aureus subsp. aureus MW2
acugcgacauguccau

SEQ ID NO: 4009493 - RNA, 16 nt, Staphylococcus aureus subsp. aureus MW2
acugcuaaaauuguau

SEQ ID NO: 4009494 - RNA, 20 nt, Staphylococcus aureus subsp. aureus MW2
acugcuaauauuagauaucu

SEQ ID NO: 4009495 - RNA, 16 nt, Staphylococcus aureus subsp. aureus MW2
acugcuaauuuuuuca

SEQ ID NO: 4009496 - RNA, 20 nt, Staphylococcus aureus subsp. aureus MW2
acugcucuuuauauauaaaa

SEQ ID NO: 4009497 - RNA, 20 nt, Staphylococcus aureus subsp. aureus MW2
acugcugcuucggcaccuuu

SEQ ID NO: 4009498 - RNA, 23 nt, Staphylococcus aureus subsp. aureus MW2
acugcuuuuuuauucuaauacaa

SEQ ID NO: 4009499 - RNA, 17 nt, Staphylococcus aureus subsp. aureus MW2
acuggauaaauaaagau

SEQ ID NO: 4009500 - RNA, 22 nt, Staphylococcus aureus subsp. aureus MW2
acuggcguuaaagcuuuucuug

SEQ ID NO: 4009501 - RNA, 13 nt, Staphylococcus aureus subsp. aureus MW2
acugggcaacuuu

SEQ ID NO: 4009502 - RNA, 18 nt, Staphylococcus aureus subsp. aureus MW2
acugggcaacuuuuuuag

SEQ ID NO: 4009503 - RNA, 19 nt, Staphylococcus aureus subsp. aureus MW2
acugguugauaaauaaacu

SEQ ID NO: 4009504 - RNA, 13 nt, Staphylococcus aureus subsp. aureus MW2
acuguaaaacaau

SEQ ID NO: 4009505 - RNA, 12 nt, Staphylococcus aureus subsp. aureus MW2
acuguaaaucau

SEQ ID NO: 4009506 - RNA, 17 nt, Staphylococcus aureus subsp. aureus MW2
acuguagaaacacaagg

SEQ ID NO: 4009507 - RNA, 18 nt, Staphylococcus aureus subsp. aureus MW2
acuguaguggaagacaau

SEQ ID NO: 4009508 - RNA, 22 nt, Staphylococcus aureus subsp. aureus MW2
acuguauagcuggcuuuuuaau

SEQ ID NO: 4009509 - RNA, 20 nt, Staphylococcus aureus subsp. aureus MW2
acuguaugccgccuaauaau

SEQ ID NO: 4009510 - RNA, 20 nt, Staphylococcus aureus subsp. aureus MW2
acuugauauuauauaaaagu

SEQ ID NO: 4009511 - RNA, 18 nt, Staphylococcus aureus subsp. aureus MW2
acuugaucauuauaaaau

SEQ ID NO: 4009512 - RNA, 15 nt, Staphylococcus aureus subsp. aureus MW2
acuugaugaaacuga

SEQ ID NO: 4009513 - RNA, 19 nt, Staphylococcus aureus subsp. aureus MW2
acuugcacauuauuguaac

SEQ ID NO: 4009514 - RNA, 15 nt, Staphylococcus aureus subsp. aureus MW2
acuugccuauuuuuu

SEQ ID NO: 4009515 - RNA, 20 nt, Staphylococcus aureus subsp. aureus MW2
acuugccuauuuuuuuaugu

SEQ ID NO: 4009516 - RNA, 14 nt, Staphylococcus aureus subsp. aureus MW2
acuugcgcaugcuu

SEQ ID NO: 4009517 - RNA, 16 nt, Staphylococcus aureus subsp. aureus MW2
acuugcuaaaacuaau

SEQ ID NO: 4009518 - RNA, 20 nt, Staphylococcus aureus subsp. aureus MW2
acuugcuguugcaauaaaau

SEQ ID NO: 4009519 - RNA, 18 nt, Staphylococcus aureus subsp. aureus MW2
acuuggauucaaaugaca

SEQ ID NO: 4009520 - RNA, 21 nt, Staphylococcus aureus subsp. aureus MW2
acuuggcgacauuuguaaaua

SEQ ID NO: 4009521 - RNA, 15 nt, Staphylococcus aureus subsp. aureus MW2
acuuguaaauuuauu

SEQ ID NO: 4009522 - RNA, 15 nt, Staphylococcus aureus subsp. aureus MW2
acuuguaauauaaca

SEQ ID NO: 4009523 - RNA, 18 nt, Staphylococcus aureus subsp. aureus MW2
acuuguaauauaacaagu

SEQ ID NO: 4009524 - RNA, 21 nt, Staphylococcus aureus subsp. aureus MW2
acuuguccguuuuauauuuau

SEQ ID NO: 4009525 - RNA, 16 nt, Staphylococcus aureus subsp. aureus MW2
acuugucuuuuuuaaa

SEQ ID NO: 4009526 - RNA, 18 nt, Staphylococcus aureus subsp. aureus MW2
acuuguuaagguauccuu

SEQ ID NO: 4009527 - RNA, 19 nt, Staphylococcus aureus subsp. aureus MW2
acuuguucaacaacugcga

SEQ ID NO: 4009528 - RNA, 13 nt, Staphylococcus aureus subsp. aureus MW2
acuuguuuccuac

SEQ ID NO: 4009529 - RNA, 16 nt, Staphylococcus aureus subsp. aureus MW2
acuuguuuguuuuugu

SEQ ID NO: 4009530 - RNA, 16 nt, Staphylococcus aureus subsp. aureus MW2
acuuuaaaauuguaua

SEQ ID NO: 4009531 - RNA, 16 nt, Staphylococcus aureus subsp. aureus MW2
acuuuaacaauuuuau

SEQ ID NO: 4009532 - RNA, 16 nt, Staphylococcus aureus subsp. aureus MW2
acuuuaacaucugaau

SEQ ID NO: 4009533 - RNA, 23 nt, Staphylococcus aureus subsp. aureus MW2
acuuuaaccacuccuuaaacaaa

SEQ ID NO: 4009534 - RNA, 22 nt, Staphylococcus aureus subsp. aureus MW2
acuuuaauacuaccguuuuuau

SEQ ID NO: 4009535 - RNA, 20 nt, Staphylococcus aureus subsp. aureus MW2
acuuuaauugcucuuuaaca

SEQ ID NO: 4009536 - RNA, 20 nt, Staphylococcus aureus subsp. aureus MW2
acuuuaccaauaucaugcaa

SEQ ID NO: 4009537 - RNA, 13 nt, Staphylococcus aureus subsp. aureus MW2
acuuuaccaucuu

SEQ ID NO: 4009538 - RNA, 18 nt, Staphylococcus aureus subsp. aureus MW2
acuuuacgauaaauagug

SEQ ID NO: 4009539 - RNA, 15 nt, Staphylococcus aureus subsp. aureus MW2
acuuuagaaagugau

SEQ ID NO: 4009540 - RNA, 14 nt, Staphylococcus aureus subsp. aureus MW2
acuuuaguauuaua

SEQ ID NO: 4009541 - RNA, 19 nt, Staphylococcus aureus subsp. aureus MW2
acuuuauagggcgcacauu

SEQ ID NO: 4009542 - RNA, 16 nt, Staphylococcus aureus subsp. aureus MW2
acuuuaucuauuucua

SEQ ID NO: 4009543 - RNA, 20 nt, Staphylococcus aureus subsp. aureus MW2
acuuuaucuauuucuauaua

SEQ ID NO: 4009544 - RNA, 22 nt, Staphylococcus aureus subsp. aureus MW2
acuuuauuucuauaucuauuua

SEQ ID NO: 4009545 - RNA, 13 nt, Staphylococcus aureus subsp. aureus MW2
acuuuauuuuucc

SEQ ID NO: 4009546 - RNA, 20 nt, Staphylococcus aureus subsp. aureus MW2
acuuucaaacaaaucuuuua

SEQ ID NO: 4009547 - RNA, 23 nt, Staphylococcus aureus subsp. aureus MW2
acuuucaaacaaaucuuuuaaau

SEQ ID NO: 4009548 - RNA, 15 nt, Staphylococcus aureus subsp. aureus MW2
acuuucacuuuuuau

SEQ ID NO: 4009549 - RNA, 16 nt, Staphylococcus aureus subsp. aureus MW2
acuuucacuuuuuaua

SEQ ID NO: 4009550 - RNA, 16 nt, Staphylococcus aureus subsp. aureus MW2
acuuucagucguuaaa

SEQ ID NO: 4009551 - RNA, 15 nt, Staphylococcus aureus subsp. aureus MW2
acuuucccuacugcu

SEQ ID NO: 4009552 - RNA, 17 nt, Staphylococcus aureus subsp. aureus MW2
acuuuccgccuucaauc

SEQ ID NO: 4009553 - RNA, 18 nt, Staphylococcus aureus subsp. aureus MW2
acuuuccgccuucaaucc

SEQ ID NO: 4009554 - RNA, 16 nt, Staphylococcus aureus subsp. aureus MW2
acuuucgcuugcaaag

SEQ ID NO: 4009555 - RNA, 16 nt, Staphylococcus aureus subsp. aureus MW2
acuuucucuaaaggua

SEQ ID NO: 4009556 - RNA, 18 nt, Staphylococcus aureus subsp. aureus MW2
acuuucuugaugaauuaa

SEQ ID NO: 4009557 - RNA, 12 nt, Staphylococcus aureus subsp. aureus MW2
acuuucuuuauu

SEQ ID NO: 4009558 - RNA, 20 nt, Staphylococcus aureus subsp. aureus MW2
acuuucuuuauuaugcugaa

SEQ ID NO: 4009559 - RNA, 18 nt, Staphylococcus aureus subsp. aureus MW2
acuuucuuuuguuuuuau

SEQ ID NO: 4009560 - RNA, 23 nt, Staphylococcus aureus subsp. aureus MW2
acuuugaauugguugaucaauua

SEQ ID NO: 4009561 - RNA, 14 nt, Staphylococcus aureus subsp. aureus MW2
acuuugauauguuu

SEQ ID NO: 4009562 - RNA, 17 nt, Staphylococcus aureus subsp. aureus MW2
acuuugauauguuuccu

SEQ ID NO: 4009563 - RNA, 19 nt, Staphylococcus aureus subsp. aureus MW2
acuuuggaaauuuauuaua

SEQ ID NO: 4009564 - RNA, 15 nt, Staphylococcus aureus subsp. aureus MW2
acuuuggcaaaguca

SEQ ID NO: 4009565 - RNA, 19 nt, Staphylococcus aureus subsp. aureus MW2
acuuuggcaucauaauuaa

SEQ ID NO: 4009566 - RNA, 22 nt, Staphylococcus aureus subsp. aureus MW2
acuuuggcaucauaauuaaaua

SEQ ID NO: 4009567 - RNA, 17 nt, Staphylococcus aureus subsp. aureus MW2
acuuuggucaacuuuuu

SEQ ID NO: 4009568 - RNA, 19 nt, Staphylococcus aureus subsp. aureus MW2
acuuugucuuuaaugaaag

SEQ ID NO: 4009569 - RNA, 21 nt, Staphylococcus aureus subsp. aureus MW2
acuuuguucugcuuuuucuuu

SEQ ID NO: 4009570 - RNA, 22 nt, Staphylococcus aureus subsp. aureus MW2
acuuuguucugcuuuuucuuua

SEQ ID NO: 4009571 - RNA, 18 nt, Staphylococcus aureus subsp. aureus MW2
acuuuuaaucuguaugua

SEQ ID NO: 4009572 - RNA, 23 nt, Staphylococcus aureus subsp. aureus MW2
acuuuuacuuucucaucuauuua

SEQ ID NO: 4009573 - RNA, 14 nt, Staphylococcus aureus subsp. aureus MW2
acuuuuauuacuua

SEQ ID NO: 4009574 - RNA, 15 nt, Staphylococcus aureus subsp. aureus MW2
acuuuucaauauuag

SEQ ID NO: 4009575 - RNA, 14 nt, Staphylococcus aureus subsp. aureus MW2
acuuuucuaaacaa

SEQ ID NO: 4009576 - RNA, 16 nt, Staphylococcus aureus subsp. aureus MW2
acuuuucuaucaaaaa

SEQ ID NO: 4009577 - RNA, 12 nt, Staphylococcus aureus subsp. aureus MW2
acuuuucuuauc

SEQ ID NO: 4009578 - RNA, 12 nt, Staphylococcus aureus subsp. aureus MW2
acuuuucuucca

SEQ ID NO: 4009579 - RNA, 14 nt, Staphylococcus aureus subsp. aureus MW2
acuuuugcaucaca

SEQ ID NO: 4009580 - RNA, 12 nt, Staphylococcus aureus subsp. aureus MW2
acuuuuuaaagg

SEQ ID NO: 4009581 - RNA, 14 nt, Staphylococcus aureus subsp. aureus MW2
acuuuuuaaaggac

SEQ ID NO: 4009582 - RNA, 18 nt, Staphylococcus aureus subsp. aureus MW2
acuuuuuauaucaaaauc

SEQ ID NO: 4009583 - RNA, 21 nt, Staphylococcus aureus subsp. aureus MW2
acuuuuuauuaguauucaaaa

SEQ ID NO: 4009584 - RNA, 15 nt, Staphylococcus aureus subsp. aureus MW2
acuuuuucaauaugu

SEQ ID NO: 4009585 - RNA, 18 nt, Staphylococcus aureus subsp. aureus MW2
acuuuuucagaaugaacu

SEQ ID NO: 4009586 - RNA, 17 nt, Staphylococcus aureus subsp. aureus MW2
acuuuuucaucuuucac

SEQ ID NO: 4009587 - RNA, 23 nt, Staphylococcus aureus subsp. aureus MW2
acuuuuucgauuaauucuucuuc

SEQ ID NO: 4009588 - RNA, 13 nt, Staphylococcus aureus subsp. aureus MW2
acuuuuuguuaau

SEQ ID NO: 4009589 - RNA, 16 nt, Staphylococcus aureus subsp. aureus MW2
acuuuuuuaacuuuaa

SEQ ID NO: 4009590 - RNA, 18 nt, Staphylococcus aureus subsp. aureus MW2
acuuuuuuaacuuuaaca

SEQ ID NO: 4009591 - RNA, 19 nt, Staphylococcus aureus subsp. aureus MW2
acuuuuuuagguguaaaau

SEQ ID NO: 4009592 - RNA, 14 nt, Staphylococcus aureus subsp. aureus MW2
agaaaaaauaaaug

SEQ ID NO: 4009593 - RNA, 20 nt, Staphylococcus aureus subsp. aureus MW2
agaaaaagguuaauauuaaa

SEQ ID NO: 4009594 - RNA, 19 nt, Staphylococcus aureus subsp. aureus MW2
agaaaaagugauaauuaaa

SEQ ID NO: 4009595 - RNA, 13 nt, Staphylococcus aureus subsp. aureus MW2
agaaaaauaugau

SEQ ID NO: 4009596 - RNA, 14 nt, Staphylococcus aureus subsp. aureus MW2
agaaaaauaugauu

SEQ ID NO: 4009597 - RNA, 17 nt, Staphylococcus aureus subsp. aureus MW2
agaaaacauaaauacaa

SEQ ID NO: 4009598 - RNA, 21 nt, Staphylococcus aureus subsp. aureus MW2
agaaaagcagucgaacaauga

SEQ ID NO: 4009599 - RNA, 15 nt, Staphylococcus aureus subsp. aureus MW2
agaaugauacuguau

SEQ ID NO: 4009600 - RNA, 12 nt, Staphylococcus aureus subsp. aureus MW2
agaaugauauaa

SEQ ID NO: 4009601 - RNA, 18 nt, Staphylococcus aureus subsp. aureus MW2
agaaugcaccaacaauag

SEQ ID NO: 4009602 - RNA, 16 nt, Staphylococcus aureus subsp. aureus MW2
agaaugccauaccugc

SEQ ID NO: 4009603 - RNA, 22 nt, Staphylococcus aureus subsp. aureus MW2
agaaugcgauuuccuuuagcaa

SEQ ID NO: 4009604 - RNA, 17 nt, Staphylococcus aureus subsp. aureus MW2
agaaugucgauauuucu

SEQ ID NO: 4009605 - RNA, 13 nt, Staphylococcus aureus subsp. aureus MW2
agaauuaaagucu

SEQ ID NO: 4009606 - RNA, 12 nt, Staphylococcus aureus subsp. aureus MW2
agaauuaacaac

SEQ ID NO: 4009607 - RNA, 20 nt, Staphylococcus aureus subsp. aureus MW2
agaauuaacaacaaauauaa

SEQ ID NO: 4009608 - RNA, 20 nt, Staphylococcus aureus subsp. aureus MW2
agaauuaguacuugaaacau

SEQ ID NO: 4009609 - RNA, 16 nt, Staphylococcus aureus subsp. aureus MW2
agaauucaauuucuca

SEQ ID NO: 4009610 - RNA, 13 nt, Staphylococcus aureus subsp. aureus MW2
agaauucauuaau

SEQ ID NO: 4009611 - RNA, 14 nt, Staphylococcus aureus subsp. aureus MW2
agaauuucaucaaa

SEQ ID NO: 4009612 - RNA, 17 nt, Staphylococcus aureus subsp. aureus MW2
agaauuucaucaaaucc

SEQ ID NO: 4009613 - RNA, 17 nt, Staphylococcus aureus subsp. aureus MW2
agaauuucguuauuaaa

SEQ ID NO: 4009614 - RNA, 14 nt, Staphylococcus aureus subsp. aureus MW2
agacaaaaaaugaa

SEQ ID NO: 4009615 - RNA, 14 nt, Staphylococcus aureus subsp. aureus MW2
agacaauaaaucuu

SEQ ID NO: 4009616 - RNA, 12 nt, Staphylococcus aureus subsp. aureus MW2
agacaauauuuu

SEQ ID NO: 4009617 - RNA, 13 nt, Staphylococcus aureus subsp. aureus MW2
agacaaugcaagu

SEQ ID NO: 4009618 - RNA, 17 nt, Staphylococcus aureus subsp. aureus MW2
agacaaugcaaguuggg

SEQ ID NO: 4009619 - RNA, 20 nt, Staphylococcus aureus subsp. aureus MW2
agacaauguucuuuucaaca

SEQ ID NO: 4009620 - RNA, 14 nt, Staphylococcus aureus subsp. aureus MW2
agacaccaaaaaca

SEQ ID NO: 4009621 - RNA, 17 nt, Staphylococcus aureus subsp. aureus MW2
agacacggccugcaagu

SEQ ID NO: 4009622 - RNA, 14 nt, Staphylococcus aureus subsp. aureus MW2
agacacuuaacuug

SEQ ID NO: 4009623 - RNA, 10 nt, Staphylococcus aureus subsp. aureus MW2
agacagaaau

SEQ ID NO: 4009624 - RNA, 19 nt, Staphylococcus aureus subsp. aureus MW2
agacagguuacuuuuuuaa

SEQ ID NO: 4009625 - RNA, 13 nt, Staphylococcus aureus subsp. aureus MW2
agacauaaaaaaa

SEQ ID NO: 4009626 - RNA, 16 nt, Staphylococcus aureus subsp. aureus MW2
agacauaaaaaaagag

SEQ ID NO: 4009627 - RNA, 17 nt, Staphylococcus aureus subsp. aureus MW2
agacauaaauauggauu

SEQ ID NO: 4009628 - RNA, 22 nt, Staphylococcus aureus subsp. aureus MW2
agacauaaauuuuuauccaagu

SEQ ID NO: 4009629 - RNA, 14 nt, Staphylococcus aureus subsp. aureus MW2
agacauaagcaaag

SEQ ID NO: 4009630 - RNA, 15 nt, Staphylococcus aureus subsp. aureus MW2
agacauaagcaaaga

SEQ ID NO: 4009631 - RNA, 22 nt, Staphylococcus aureus subsp. aureus MW2
agacauauagcggugucaauau

SEQ ID NO: 4009632 - RNA, 21 nt, Staphylococcus aureus subsp. aureus MW2
agacauugaaaggaacauuuc

SEQ ID NO: 4009633 - RNA, 23 nt, Staphylococcus aureus subsp. aureus MW2
agacauuguuaaacuaagagggu

SEQ ID NO: 4009634 - RNA, 16 nt, Staphylococcus aureus subsp. aureus MW2
agacauuucuucaauu

SEQ ID NO: 4009635 - RNA, 12 nt, Staphylococcus aureus subsp. aureus MW2
agaccaaauauu

SEQ ID NO: 4009636 - RNA, 19 nt, Staphylococcus aureus subsp. aureus MW2
agaccauuuuauauuuuag

SEQ ID NO: 4009637 - RNA, 13 nt, Staphylococcus aureus subsp. aureus MW2
agaccuaugaauu

SEQ ID NO: 4009638 - RNA, 13 nt, Staphylococcus aureus subsp. aureus MW2
agaccucguuaca

SEQ ID NO: 4009639 - RNA, 14 nt, Staphylococcus aureus subsp. aureus MW2
agaccuuucuugac

SEQ ID NO: 4009640 - RNA, 12 nt, Staphylococcus aureus subsp. aureus MW2
agacgaacauca

SEQ ID NO: 4009641 - RNA, 14 nt, Staphylococcus aureus subsp. aureus MW2
agacgccgaaaaga

SEQ ID NO: 4009642 - RNA, 16 nt, Staphylococcus aureus subsp. aureus MW2
agacgcuguuuuaaau

SEQ ID NO: 4009643 - RNA, 19 nt, Staphylococcus aureus subsp. aureus MW2
agacguaaguguaaaugaa

SEQ ID NO: 4009644 - RNA, 17 nt, Staphylococcus aureus subsp. aureus MW2
agacguuuuugaaucag

SEQ ID NO: 4009645 - RNA, 18 nt, Staphylococcus aureus subsp. aureus MW2
agacuaaaaugaaugaag

SEQ ID NO: 4009646 - RNA, 23 nt, Staphylococcus aureus subsp. aureus MW2
agacuauaaugaauaaauaauuu

SEQ ID NO: 4009647 - RNA, 14 nt, Staphylococcus aureus subsp. aureus MW2
agacuauuauaauu

SEQ ID NO: 4009648 - RNA, 13 nt, Staphylococcus aureus subsp. aureus MW2
agacucacuucuu

SEQ ID NO: 4009649 - RNA, 14 nt, Staphylococcus aureus subsp. aureus MW2
agacucacuucuua

SEQ ID NO: 4009650 - RNA, 13 nt, Staphylococcus aureus subsp. aureus MW2
agacuccuaaauu

SEQ ID NO: 4009651 - RNA, 17 nt, Staphylococcus aureus subsp. aureus MW2
agacuccuaaauuauug

SEQ ID NO: 4009652 - RNA, 20 nt, Staphylococcus aureus subsp. aureus MW2
agacucuccaccauaugugg

SEQ ID NO: 4009653 - RNA, 20 nt, Staphylococcus aureus subsp. aureus MW2
agacugccaauaaaaugcaa

SEQ ID NO: 4009654 - RNA, 17 nt, Staphylococcus aureus subsp. aureus MW2
agacuuauucaacguau

SEQ ID NO: 4009655 - RNA, 19 nt, Staphylococcus aureus subsp. aureus MW2
agacuuauuugaaugcaaa

SEQ ID NO: 4009656 - RNA, 16 nt, Staphylococcus aureus subsp. aureus MW2
agacuucuuucaauua

SEQ ID NO: 4009657 - RNA, 23 nt, Staphylococcus aureus subsp. aureus MW2
agacuuucuuaauugaauuaaau

SEQ ID NO: 4009658 - RNA, 11 nt, Staphylococcus aureus subsp. aureus MW2
agacuuucuug

SEQ ID NO: 4009659 - RNA, 23 nt, Staphylococcus aureus subsp. aureus MW2
agagaaaaaauaaauguuaaaga

SEQ ID NO: 4009660 - RNA, 13 nt, Staphylococcus aureus subsp. aureus MW2
agagaaaauuugu

SEQ ID NO: 4009661 - RNA, 16 nt, Staphylococcus aureus subsp. aureus MW2
agagaaacaaaacaaa

SEQ ID NO: 4009662 - RNA, 21 nt, Staphylococcus aureus subsp. aureus MW2
agagaaacaaaacaaaaaaua

SEQ ID NO: 4009663 - RNA, 12 nt, Staphylococcus aureus subsp. aureus MW2
agagaacagcag

SEQ ID NO: 4009664 - RNA, 13 nt, Staphylococcus aureus subsp. aureus MW2
agagaaucaauua

SEQ ID NO: 4009665 - RNA, 13 nt, Staphylococcus aureus subsp. aureus MW2
agagaauuucaaa

SEQ ID NO: 4009666 - RNA, 19 nt, Staphylococcus aureus subsp. aureus MW2
agagaauuucaaaaaggaa

SEQ ID NO: 4009667 - RNA, 17 nt, Staphylococcus aureus subsp. aureus MW2
agagaauuucgaaaaga

SEQ ID NO: 4009668 - RNA, 21 nt, Staphylococcus aureus subsp. aureus MW2
agagaauuucgaaaagaaauu

SEQ ID NO: 4009669 - RNA, 12 nt, Staphylococcus aureus subsp. aureus MW2
agagacauuuua

SEQ ID NO: 4009670 - RNA, 20 nt, Staphylococcus aureus subsp. aureus MW2
agagacugaagagcuuuuag

SEQ ID NO: 4009671 - RNA, 13 nt, Staphylococcus aureus subsp. aureus MW2
agagagaaaagcu

SEQ ID NO: 4009672 - RNA, 17 nt, Staphylococcus aureus subsp. aureus MW2
agagagaaaagcuagaa

SEQ ID NO: 4009673 - RNA, 23 nt, Staphylococcus aureus subsp. aureus MW2
agagaugggcuaagguuguucua

SEQ ID NO: 4009674 - RNA, 16 nt, Staphylococcus aureus subsp. aureus MW2
agagcauaguuuucau

SEQ ID NO: 4009675 - RNA, 19 nt, Staphylococcus aureus subsp. aureus MW2
agagccccuuacaacuuua

SEQ ID NO: 4009676 - RNA, 16 nt, Staphylococcus aureus subsp. aureus MW2
agagccgugaaagaaa

SEQ ID NO: 4009677 - RNA, 22 nt, Staphylococcus aureus subsp. aureus MW2
agagccgugaaagaaaaaacuu

SEQ ID NO: 4009678 - RNA, 20 nt, Staphylococcus aureus subsp. aureus MW2
agagcucaaccucuuaguuc

SEQ ID NO: 4009679 - RNA, 22 nt, Staphylococcus aureus subsp. aureus MW2
agagcuuuuaguaaauaauuua

SEQ ID NO: 4009680 - RNA, 15 nt, Staphylococcus aureus subsp. aureus MW2
agaggggaacaaugg

SEQ ID NO: 4009681 - RNA, 17 nt, Staphylococcus aureus subsp. aureus MW2
agagguaaaucuguuua

SEQ ID NO: 4009682 - RNA, 18 nt, Staphylococcus aureus subsp. aureus MW2
agaguaaaguuaaaagcu

SEQ ID NO: 4009683 - RNA, 17 nt, Staphylococcus aureus subsp. aureus MW2
agaguaguucggaugag

SEQ ID NO: 4009684 - RNA, 13 nt, Staphylococcus aureus subsp. aureus MW2
agaguuaauaaaa

SEQ ID NO: 4009685 - RNA, 15 nt, Staphylococcus aureus subsp. aureus MW2
agauaaaacaaaacc

SEQ ID NO: 4009686 - RNA, 15 nt, Staphylococcus aureus subsp. aureus MW2
agauaaacaagccaa

SEQ ID NO: 4009687 - RNA, 18 nt, Staphylococcus aureus subsp. aureus MW2
agauaaagcuucgucaau

SEQ ID NO: 4009688 - RNA, 13 nt, Staphylococcus aureus subsp. aureus MW2
agcaaaagaugaa

SEQ ID NO: 4009689 - RNA, 18 nt, Staphylococcus aureus subsp. aureus MW2
agcaaaagaugaaaaucu

SEQ ID NO: 4009690 - RNA, 21 nt, Staphylococcus aureus subsp. aureus MW2
agcaaaauuauguaaaaaaua

SEQ ID NO: 4009691 - RNA, 16 nt, Staphylococcus aureus subsp. aureus MW2
agcaaagacaaaagca

SEQ ID NO: 4009692 - RNA, 16 nt, Staphylococcus aureus subsp. aureus MW2
agcaaagcaaauuagu

SEQ ID NO: 4009693 - RNA, 15 nt, Staphylococcus aureus subsp. aureus MW2
agcaaauaaaaucau

SEQ ID NO: 4009694 - RNA, 17 nt, Staphylococcus aureus subsp. aureus MW2
agcaaauacuucaagag

SEQ ID NO: 4009695 - RNA, 16 nt, Staphylococcus aureus subsp. aureus MW2
agcaaauauuauuaaa

SEQ ID NO: 4009696 - RNA, 15 nt, Staphylococcus aureus subsp. aureus MW2
agcaaaugcacugua

SEQ ID NO: 4009697 - RNA, 12 nt, Staphylococcus aureus subsp. aureus MW2
agcaacaaauau

SEQ ID NO: 4009698 - RNA, 19 nt, Staphylococcus aureus subsp. aureus MW2
agcaacgauaccaaauaua

SEQ ID NO: 4009699 - RNA, 19 nt, Staphylococcus aureus subsp. aureus MW2
agcaacucaggaauagaug

SEQ ID NO: 4009700 - RNA, 21 nt, Staphylococcus aureus subsp. aureus MW2
agcaagcagugcuaauuuuga

SEQ ID NO: 4009701 - RNA, 17 nt, Staphylococcus aureus subsp. aureus MW2
agcaaguccaaauaaug

SEQ ID NO: 4009702 - RNA, 19 nt, Staphylococcus aureus subsp. aureus MW2
agcaagucuucuaaaaaau

SEQ ID NO: 4009703 - RNA, 15 nt, Staphylococcus aureus subsp. aureus MW2
agcaaguuauaucau

SEQ ID NO: 4009704 - RNA, 18 nt, Staphylococcus aureus subsp. aureus MW2
agcaauacgauugcaaug

SEQ ID NO: 4009705 - RNA, 20 nt, Staphylococcus aureus subsp. aureus MW2
agcaauuaaagucaauuuaa

SEQ ID NO: 4009706 - RNA, 22 nt, Staphylococcus aureus subsp. aureus MW2
agcaauuaaagucaauuuaaau

SEQ ID NO: 4009707 - RNA, 17 nt, Staphylococcus aureus subsp. aureus MW2
agcaauugaaucaaaua

SEQ ID NO: 4009708 - RNA, 17 nt, Staphylococcus aureus subsp. aureus MW2
agcacagcgauuaaaug

SEQ ID NO: 4009709 - RNA, 20 nt, Staphylococcus aureus subsp. aureus MW2
agcacagcgauuaaaugaug

SEQ ID NO: 4009710 - RNA, 20 nt, Staphylococcus aureus subsp. aureus MW2
agcacauuuuuaguuagaaa

SEQ ID NO: 4009711 - RNA, 14 nt, Staphylococcus aureus subsp. aureus MW2
agcaccagcacauc

SEQ ID NO: 4009712 - RNA, 16 nt, Staphylococcus aureus subsp. aureus MW2
agcaccgcgaauuacg

SEQ ID NO: 4009713 - RNA, 23 nt, Staphylococcus aureus subsp. aureus MW2
agcaccggcaccuuuaggaaucg

SEQ ID NO: 4009714 - RNA, 23 nt, Staphylococcus aureus subsp. aureus MW2
agcaccguaacauauguacuauu

SEQ ID NO: 4009715 - RNA, 13 nt, Staphylococcus aureus subsp. aureus MW2
agcaccuaaaaua

SEQ ID NO: 4009716 - RNA, 16 nt, Staphylococcus aureus subsp. aureus MW2
agcacgagacaauaau

SEQ ID NO: 4009717 - RNA, 18 nt, Staphylococcus aureus subsp. aureus MW2
agcacuagccguuauuuu

SEQ ID NO: 4009718 - RNA, 16 nt, Staphylococcus aureus subsp. aureus MW2
agcacuaucuuuugcu

SEQ ID NO: 4009719 - RNA, 13 nt, Staphylococcus aureus subsp. aureus MW2
agcacuauuuuua

SEQ ID NO: 4009720 - RNA, 17 nt, Staphylococcus aureus subsp. aureus MW2
agcacugaaaucuagac

SEQ ID NO: 4009721 - RNA, 12 nt, Staphylococcus aureus subsp. aureus MW2
agcaguaagaua

SEQ ID NO: 4009722 - RNA, 22 nt, Staphylococcus aureus subsp. aureus MW2
agcaguaagaugauuucaaaug

SEQ ID NO: 4009723 - RNA, 21 nt, Staphylococcus aureus subsp. aureus MW2
agcaguaagauuauuuucaau

SEQ ID NO: 4009724 - RNA, 18 nt, Staphylococcus aureus subsp. aureus MW2
agcaguauauaucaaaua

SEQ ID NO: 4009725 - RNA, 21 nt, Staphylococcus aureus subsp. aureus MW2
agcauaccuuuauuauuuaau

SEQ ID NO: 4009726 - RNA, 17 nt, Staphylococcus aureus subsp. aureus MW2
agcauaguuuucauacu

SEQ ID NO: 4009727 - RNA, 17 nt, Staphylococcus aureus subsp. aureus MW2
agcauauugauguucuc

SEQ ID NO: 4009728 - RNA, 13 nt, Staphylococcus aureus subsp. aureus MW2
agcauauuucuaa

SEQ ID NO: 4009729 - RNA, 14 nt, Staphylococcus aureus subsp. aureus MW2
agcaucgaacaauc

SEQ ID NO: 4009730 - RNA, 20 nt, Staphylococcus aureus subsp. aureus MW2
agcaucgggaucuaauuuuu

SEQ ID NO: 4009731 - RNA, 22 nt, Staphylococcus aureus subsp. aureus MW2
agcaucgggaucuaauuuuucc

SEQ ID NO: 4009732 - RNA, 19 nt, Staphylococcus aureus subsp. aureus MW2
agcaucguaaaaaacaaaa

SEQ ID NO: 4009733 - RNA, 18 nt, Staphylococcus aureus subsp. aureus MW2
agcaucuacuaaaucaaa

SEQ ID NO: 4009734 - RNA, 16 nt, Staphylococcus aureus subsp. aureus MW2
agcaucuauaauauuc

SEQ ID NO: 4009735 - RNA, 20 nt, Staphylococcus aureus subsp. aureus MW2
agcaugaaucgcauuuaaau

SEQ ID NO: 4009736 - RNA, 18 nt, Staphylococcus aureus subsp. aureus MW2
agcaugcuuugagcaaua

SEQ ID NO: 4009737 - RNA, 20 nt, Staphylococcus aureus subsp. aureus MW2
agcaugcuuugagcaauaau

SEQ ID NO: 4009738 - RNA, 20 nt, Staphylococcus aureus subsp. aureus MW2
agcauuaaguucaucaugca

SEQ ID NO: 4009739 - RNA, 22 nt, Staphylococcus aureus subsp. aureus MW2
agcauuagcaaauauuauuaaa

SEQ ID NO: 4009740 - RNA, 23 nt, Staphylococcus aureus subsp. aureus MW2
agcauucccguauaauaguuuac

SEQ ID NO: 4009741 - RNA, 22 nt, Staphylococcus aureus subsp. aureus MW2
agcauugagauggucuuuuaau

SEQ ID NO: 4009742 - RNA, 19 nt, Staphylococcus aureus subsp. aureus MW2
agcauugggacauaaaauu

SEQ ID NO: 4009743 - RNA, 16 nt, Staphylococcus aureus subsp. aureus MW2
agcauuucuuuauuag

SEQ ID NO: 4009744 - RNA, 16 nt, Staphylococcus aureus subsp. aureus MW2
agcauuugcuguuaau

SEQ ID NO: 4009745 - RNA, 15 nt, Staphylococcus aureus subsp. aureus MW2
agccaaauaaauuuu

SEQ ID NO: 4009746 - RNA, 22 nt, Staphylococcus aureus subsp. aureus MW2
agccaaaucuuuaauaaccuuu

SEQ ID NO: 4009747 - RNA, 23 nt, Staphylococcus aureus subsp. aureus MW2
agccaaaucuuuaauaaccuuua

SEQ ID NO: 4009748 - RNA, 16 nt, Staphylococcus aureus subsp. aureus MW2
agccaacacauaaaug

SEQ ID NO: 4009749 - RNA, 14 nt, Staphylococcus aureus subsp. aureus MW2
agccacagccaccu

SEQ ID NO: 4009750 - RNA, 19 nt, Staphylococcus aureus subsp. aureus MW2
agccauaccuuauuucagc

SEQ ID NO: 4009751 - RNA, 13 nt, Staphylococcus aureus subsp. aureus MW2
agccaucaauauu

SEQ ID NO: 4009752 - RNA, 22 nt, Staphylococcus aureus subsp. aureus MW2
agccauuauuauuuuuuucuuu

SEQ ID NO: 4009753 - RNA, 17 nt, Staphylococcus aureus subsp. aureus MW2
agccauuuguuguaaac

SEQ ID NO: 4009754 - RNA, 23 nt, Staphylococcus aureus subsp. aureus MW2
agccauuuguuguaaaccagcua

SEQ ID NO: 4009755 - RNA, 18 nt, Staphylococcus aureus subsp. aureus MW2
agccccagcaaauacuuc

SEQ ID NO: 4009756 - RNA, 14 nt, Staphylococcus aureus subsp. aureus MW2
agccccuuuuaaau

SEQ ID NO: 4009757 - RNA, 14 nt, Staphylococcus aureus subsp. aureus MW2
agcccuauuauuuu

SEQ ID NO: 4009758 - RNA, 14 nt, Staphylococcus aureus subsp. aureus MW2
agcccuauuuuuaa

SEQ ID NO: 4009759 - RNA, 20 nt, Staphylococcus aureus subsp. aureus MW2
agcccuuuauacaauuuuuu

SEQ ID NO: 4009760 - RNA, 15 nt, Staphylococcus aureus subsp. aureus MW2
agccgugaaagaaaa

SEQ ID NO: 4009761 - RNA, 16 nt, Staphylococcus aureus subsp. aureus MW2
agccguuuuugaaaug

SEQ ID NO: 4009762 - RNA, 17 nt, Staphylococcus aureus subsp. aureus MW2
agccguuuuugaaaugu

SEQ ID NO: 4009763 - RNA, 21 nt, Staphylococcus aureus subsp. aureus MW2
agccuagaacauugauuauug

SEQ ID NO: 4009764 - RNA, 15 nt, Staphylococcus aureus subsp. aureus MW2
agccuauccauucaa

SEQ ID NO: 4009765 - RNA, 22 nt, Staphylococcus aureus subsp. aureus MW2
agccuauuuaaaagacaaucuc

SEQ ID NO: 4009766 - RNA, 19 nt, Staphylococcus aureus subsp. aureus MW2
agccucuugccuugaaauc

SEQ ID NO: 4009767 - RNA, 21 nt, Staphylococcus aureus subsp. aureus MW2
agccugagcgugucauuaaca

SEQ ID NO: 4009768 - RNA, 21 nt, Staphylococcus aureus subsp. aureus MW2
agccuguuugacacauuauug

SEQ ID NO: 4009769 - RNA, 21 nt, Staphylococcus aureus subsp. aureus MW2
agcgaaaguaucuaugaaauu

SEQ ID NO: 4009770 - RNA, 17 nt, Staphylococcus aureus subsp. aureus MW2
agcgaaauuuguaaaga

SEQ ID NO: 4009771 - RNA, 18 nt, Staphylococcus aureus subsp. aureus MW2
agcgaccgugguucaaaa

SEQ ID NO: 4009772 - RNA, 17 nt, Staphylococcus aureus subsp. aureus MW2
agcgauaauuguugcau

SEQ ID NO: 4009773 - RNA, 17 nt, Staphylococcus aureus subsp. aureus MW2
agcgaugaaaguugcuu

SEQ ID NO: 4009774 - RNA, 22 nt, Staphylococcus aureus subsp. aureus MW2
agcgauuuuaaagaaaaguuua

SEQ ID NO: 4009775 - RNA, 17 nt, Staphylococcus aureus subsp. aureus MW2
agcgcaggcgcuccuac

SEQ ID NO: 4009776 - RNA, 12 nt, Staphylococcus aureus subsp. aureus MW2
aggauaagaacg

SEQ ID NO: 4009777 - RNA, 16 nt, Staphylococcus aureus subsp. aureus MW2
aggauaagaacgagaa

SEQ ID NO: 4009778 - RNA, 23 nt, Staphylococcus aureus subsp. aureus MW2
aggauauuuauucuaaguuaaaa

SEQ ID NO: 4009779 - RNA, 18 nt, Staphylococcus aureus subsp. aureus MW2
aggaucaagugcagaugu

SEQ ID NO: 4009780 - RNA, 23 nt, Staphylococcus aureus subsp. aureus MW2
aggauccaauuuauaaugauuaa

SEQ ID NO: 4009781 - RNA, 14 nt, Staphylococcus aureus subsp. aureus MW2
aggaugaguuuaaa

SEQ ID NO: 4009782 - RNA, 15 nt, Staphylococcus aureus subsp. aureus MW2
aggaugaguuuaaaa

SEQ ID NO: 4009783 - RNA, 19 nt, Staphylococcus aureus subsp. aureus MW2
aggauggaaugauacgccu

SEQ ID NO: 4009784 - RNA, 18 nt, Staphylococcus aureus subsp. aureus MW2
aggauguuauaaaaugaa

SEQ ID NO: 4009785 - RNA, 14 nt, Staphylococcus aureus subsp. aureus MW2
aggauuauuaucaa

SEQ ID NO: 4009786 - RNA, 21 nt, Staphylococcus aureus subsp. aureus MW2
aggauucgauugguuuaaaaa

SEQ ID NO: 4009787 - RNA, 23 nt, Staphylococcus aureus subsp. aureus MW2
aggauucgauugguuuaaaaagu

SEQ ID NO: 4009788 - RNA, 20 nt, Staphylococcus aureus subsp. aureus MW2
aggauuuccucgguuuuauu

SEQ ID NO: 4009789 - RNA, 14 nt, Staphylococcus aureus subsp. aureus MW2
aggcaauauuaaaa

SEQ ID NO: 4009790 - RNA, 16 nt, Staphylococcus aureus subsp. aureus MW2
aggcaaucuugaacaa

SEQ ID NO: 4009791 - RNA, 17 nt, Staphylococcus aureus subsp. aureus MW2
aggcaaucuugaacaau

SEQ ID NO: 4009792 - RNA, 12 nt, Staphylococcus aureus subsp. aureus MW2
aggcaaugcaag

SEQ ID NO: 4009793 - RNA, 13 nt, Staphylococcus aureus subsp. aureus MW2
aggcaaugcaagu

SEQ ID NO: 4009794 - RNA, 17 nt, Staphylococcus aureus subsp. aureus MW2
aggcaaugcaaguuggc

SEQ ID NO: 4009795 - RNA, 16 nt, Staphylococcus aureus subsp. aureus MW2
aggcauuguguaugag

SEQ ID NO: 4009796 - RNA, 19 nt, Staphylococcus aureus subsp. aureus MW2
aggccauuuuuauuuaaca

SEQ ID NO: 4009797 - RNA, 16 nt, Staphylococcus aureus subsp. aureus MW2
aggcccauaaauuacu

SEQ ID NO: 4009798 - RNA, 18 nt, Staphylococcus aureus subsp. aureus MW2
aggcccauaaauuacuug

SEQ ID NO: 4009799 - RNA, 12 nt, Staphylococcus aureus subsp. aureus MW2
aggcuaauuuuu

SEQ ID NO: 4009800 - RNA, 12 nt, Staphylococcus aureus subsp. aureus MW2
aggcuagauaau

SEQ ID NO: 4009801 - RNA, 18 nt, Staphylococcus aureus subsp. aureus MW2
aggcuagauaauaaucca

SEQ ID NO: 4009802 - RNA, 17 nt, Staphylococcus aureus subsp. aureus MW2
aggcuagcuaaaauuug

SEQ ID NO: 4009803 - RNA, 20 nt, Staphylococcus aureus subsp. aureus MW2
aggcugggacauaaaucaau

SEQ ID NO: 4009804 - RNA, 19 nt, Staphylococcus aureus subsp. aureus MW2
aggcuuaaauauaaugauc

SEQ ID NO: 4009805 - RNA, 15 nt, Staphylococcus aureus subsp. aureus MW2
aggcuuauuaacuuu

SEQ ID NO: 4009806 - RNA, 13 nt, Staphylococcus aureus subsp. aureus MW2
aggcuuuaaaauu

SEQ ID NO: 4009807 - RNA, 19 nt, Staphylococcus aureus subsp. aureus MW2
aggcuuuaaaauuuuuugg

SEQ ID NO: 4009808 - RNA, 15 nt, Staphylococcus aureus subsp. aureus MW2
agggacgucaucaug

SEQ ID NO: 4009809 - RNA, 22 nt, Staphylococcus aureus subsp. aureus MW2
agggcauugagauuggaagggc

SEQ ID NO: 4009810 - RNA, 14 nt, Staphylococcus aureus subsp. aureus MW2
agggcauugauuca

SEQ ID NO: 4009811 - RNA, 15 nt, Staphylococcus aureus subsp. aureus MW2
agggccccaacacag

SEQ ID NO: 4009812 - RNA, 21 nt, Staphylococcus aureus subsp. aureus MW2
agggcuguuuuuuaaugcuuu

SEQ ID NO: 4009813 - RNA, 17 nt, Staphylococcus aureus subsp. aureus MW2
aggggccccaacacaga

SEQ ID NO: 4009814 - RNA, 21 nt, Staphylococcus aureus subsp. aureus MW2
aggggccccaacacagagaau

SEQ ID NO: 4009815 - RNA, 20 nt, Staphylococcus aureus subsp. aureus MW2
aggggcuucuuucuaaaaua

SEQ ID NO: 4009816 - RNA, 16 nt, Staphylococcus aureus subsp. aureus MW2
agggggcuucuuuguu

SEQ ID NO: 4009817 - RNA, 21 nt, Staphylococcus aureus subsp. aureus MW2
aggguauugaaauaauauaaa

SEQ ID NO: 4009818 - RNA, 23 nt, Staphylococcus aureus subsp. aureus MW2
aggguuugccagucauuguauaa

SEQ ID NO: 4009819 - RNA, 19 nt, Staphylococcus aureus subsp. aureus MW2
agguaaaucuguuuaaauu

SEQ ID NO: 4009820 - RNA, 12 nt, Staphylococcus aureus subsp. aureus MW2
agguaaauuuaa

SEQ ID NO: 4009821 - RNA, 15 nt, Staphylococcus aureus subsp. aureus MW2
agguaacuaaaaugu

SEQ ID NO: 4009822 - RNA, 13 nt, Staphylococcus aureus subsp. aureus MW2
agguaacugcuuu

SEQ ID NO: 4009823 - RNA, 18 nt, Staphylococcus aureus subsp. aureus MW2
agguaacugcuuuggagu

SEQ ID NO: 4009824 - RNA, 15 nt, Staphylococcus aureus subsp. aureus MW2
agguaagugcucaaa

SEQ ID NO: 4009825 - RNA, 13 nt, Staphylococcus aureus subsp. aureus MW2
agguaauacuuuu

SEQ ID NO: 4009826 - RNA, 15 nt, Staphylococcus aureus subsp. aureus MW2
agguaauuuaacauu

SEQ ID NO: 4009827 - RNA, 17 nt, Staphylococcus aureus subsp. aureus MW2
agguaauuuaacauuuu

SEQ ID NO: 4009828 - RNA, 14 nt, Staphylococcus aureus subsp. aureus MW2
agguauaaucauuu

SEQ ID NO: 4009829 - RNA, 15 nt, Staphylococcus aureus subsp. aureus MW2
agguauacacaaauu

SEQ ID NO: 4009830 - RNA, 22 nt, Staphylococcus aureus subsp. aureus MW2
agguauagcaaguuuauaaauu

SEQ ID NO: 4009831 - RNA, 21 nt, Staphylococcus aureus subsp. aureus MW2
agguauaggugcaguuaaauu

SEQ ID NO: 4009832 - RNA, 22 nt, Staphylococcus aureus subsp. aureus MW2
aggucaucugaugaggcaauau

SEQ ID NO: 4009833 - RNA, 17 nt, Staphylococcus aureus subsp. aureus MW2
aggucuauguacaauca

SEQ ID NO: 4009834 - RNA, 15 nt, Staphylococcus aureus subsp. aureus MW2
aggugauuauauaua

SEQ ID NO: 4009835 - RNA, 17 nt, Staphylococcus aureus subsp. aureus MW2
aggugauugaacaauaa

SEQ ID NO: 4009836 - RNA, 18 nt, Staphylococcus aureus subsp. aureus MW2
aggugcuuguaaaauuuu

SEQ ID NO: 4009837 - RNA, 14 nt, Staphylococcus aureus subsp. aureus MW2
agguguaaaaugug

SEQ ID NO: 4009838 - RNA, 17 nt, Staphylococcus aureus subsp. aureus MW2
aggugucguaauuuacc

SEQ ID NO: 4009839 - RNA, 19 nt, Staphylococcus aureus subsp. aureus MW2
aggugugguguaaagauca

SEQ ID NO: 4009840 - RNA, 17 nt, Staphylococcus aureus subsp. aureus MW2
agguuagaauuauguug

SEQ ID NO: 4009841 - RNA, 14 nt, Staphylococcus aureus subsp. aureus MW2
agguuauauuuaaa

SEQ ID NO: 4009842 - RNA, 16 nt, Staphylococcus aureus subsp. aureus MW2
agguuauuuuuuaugg

SEQ ID NO: 4009843 - RNA, 16 nt, Staphylococcus aureus subsp. aureus MW2
agguucaucuuuaugc

SEQ ID NO: 4009844 - RNA, 14 nt, Staphylococcus aureus subsp. aureus MW2
agguugaagaagga

SEQ ID NO: 4009845 - RNA, 19 nt, Staphylococcus aureus subsp. aureus MW2
agguuguucuauacauucc

SEQ ID NO: 4009846 - RNA, 21 nt, Staphylococcus aureus subsp. aureus MW2
agguuguuuuucaucauuaaa

SEQ ID NO: 4009847 - RNA, 23 nt, Staphylococcus aureus subsp. aureus MW2
agguuguuuuucaucauuaaaau

SEQ ID NO: 4009848 - RNA, 16 nt, Staphylococcus aureus subsp. aureus MW2
agguuuguaagacaac

SEQ ID NO: 4009849 - RNA, 17 nt, Staphylococcus aureus subsp. aureus MW2
agguuuuacaauuuuug

SEQ ID NO: 4009850 - RNA, 14 nt, Staphylococcus aureus subsp. aureus MW2
aguaaaaauacauu

SEQ ID NO: 4009851 - RNA, 15 nt, Staphylococcus aureus subsp. aureus MW2
aguaaaauaaaaaau

SEQ ID NO: 4009852 - RNA, 20 nt, Staphylococcus aureus subsp. aureus MW2
aguaaaaucuuuaacauuug

SEQ ID NO: 4009853 - RNA, 22 nt, Staphylococcus aureus subsp. aureus MW2
aguaaaccgaggugucaauaaa

SEQ ID NO: 4009854 - RNA, 14 nt, Staphylococcus aureus subsp. aureus MW2
aguaaauaauuuaa

SEQ ID NO: 4009855 - RNA, 17 nt, Staphylococcus aureus subsp. aureus MW2
aguaaauaauuuaaauu

SEQ ID NO: 4009856 - RNA, 19 nt, Staphylococcus aureus subsp. aureus MW2
aguaaauaauuuaaauuaa

SEQ ID NO: 4009857 - RNA, 21 nt, Staphylococcus aureus subsp. aureus MW2
aguaaauaauuuaaauuaaaa

SEQ ID NO: 4009858 - RNA, 11 nt, Staphylococcus aureus subsp. aureus MW2
aguaaaucaaa

SEQ ID NO: 4009859 - RNA, 17 nt, Staphylococcus aureus subsp. aureus MW2
aguaagaugauuucaaa

SEQ ID NO: 4009860 - RNA, 23 nt, Staphylococcus aureus subsp. aureus MW2
aguaagaugauuucaaaugugaa

SEQ ID NO: 4009861 - RNA, 19 nt, Staphylococcus aureus subsp. aureus MW2
aguaagauuaccuacaaua

SEQ ID NO: 4009862 - RNA, 17 nt, Staphylococcus aureus subsp. aureus MW2
aguaagauuauuuucaa

SEQ ID NO: 4009863 - RNA, 19 nt, Staphylococcus aureus subsp. aureus MW2
aguaagauuauuuucaauu

SEQ ID NO: 4009864 - RNA, 17 nt, Staphylococcus aureus subsp. aureus MW2
aguaaguacgaggacca

SEQ ID NO: 4009865 - RNA, 15 nt, Staphylococcus aureus subsp. aureus MW2
agucaugucccauaa

SEQ ID NO: 4009866 - RNA, 17 nt, Staphylococcus aureus subsp. aureus MW2
agucauucaaucaucaa

SEQ ID NO: 4009867 - RNA, 21 nt, Staphylococcus aureus subsp. aureus MW2
agucauucaaucaucaagaca

SEQ ID NO: 4009868 - RNA, 23 nt, Staphylococcus aureus subsp. aureus MW2
agucauuugaugguuuaauugca

SEQ ID NO: 4009869 - RNA, 14 nt, Staphylococcus aureus subsp. aureus MW2
agucauuugauuua

SEQ ID NO: 4009870 - RNA, 12 nt, Staphylococcus aureus subsp. aureus MW2
aguccauuuucu

SEQ ID NO: 4009871 - RNA, 14 nt, Staphylococcus aureus subsp. aureus MW2
aguccauuuucuuu

SEQ ID NO: 4009872 - RNA, 14 nt, Staphylococcus aureus subsp. aureus MW2
agucccgcuuaaaa

SEQ ID NO: 4009873 - RNA, 14 nt, Staphylococcus aureus subsp. aureus MW2
agucgaacaaugau

SEQ ID NO: 4009874 - RNA, 18 nt, Staphylococcus aureus subsp. aureus MW2
agucgauaaauaugaugu

SEQ ID NO: 4009875 - RNA, 17 nt, Staphylococcus aureus subsp. aureus MW2
agucggggccccaacac

SEQ ID NO: 4009876 - RNA, 16 nt, Staphylococcus aureus subsp. aureus MW2
agucgguguuuucuua

SEQ ID NO: 4009877 - RNA, 19 nt, Staphylococcus aureus subsp. aureus MW2
agucguucucuuaaauaug

SEQ ID NO: 4009878 - RNA, 19 nt, Staphylococcus aureus subsp. aureus MW2
agucguuguugaaauuaaa

SEQ ID NO: 4009879 - RNA, 23 nt, Staphylococcus aureus subsp. aureus MW2
agucuaaaugcaauauguaacaa

SEQ ID NO: 4009880 - RNA, 15 nt, Staphylococcus aureus subsp. aureus MW2
agucuaugaauaaug

SEQ ID NO: 4009881 - RNA, 15 nt, Staphylococcus aureus subsp. aureus MW2
agucucguaauaaug

SEQ ID NO: 4009882 - RNA, 19 nt, Staphylococcus aureus subsp. aureus MW2
agucucuuuacggauugcu

SEQ ID NO: 4009883 - RNA, 21 nt, Staphylococcus aureus subsp. aureus MW2
agucucuuuacggauugcugc

SEQ ID NO: 4009884 - RNA, 16 nt, Staphylococcus aureus subsp. aureus MW2
agucucuuuugauaaa

SEQ ID NO: 4009885 - RNA, 18 nt, Staphylococcus aureus subsp. aureus MW2
agucuggaacaauaauca

SEQ ID NO: 4009886 - RNA, 23 nt, Staphylococcus aureus subsp. aureus MW2
agucuggaacaauaaucaauguu

SEQ ID NO: 4009887 - RNA, 21 nt, Staphylococcus aureus subsp. aureus MW2
agucuguauauggcgauaaca

SEQ ID NO: 4009888 - RNA, 13 nt, Staphylococcus aureus subsp. aureus MW2
agucuguugguuu

SEQ ID NO: 4009889 - RNA, 14 nt, Staphylococcus aureus subsp. aureus MW2
agucuuauuuuuau

SEQ ID NO: 4009890 - RNA, 22 nt, Staphylococcus aureus subsp. aureus MW2
agucuuggacauuguaaaaugc

SEQ ID NO: 4009891 - RNA, 20 nt, Staphylococcus aureus subsp. aureus MW2
agucuugugauaauucuuca

SEQ ID NO: 4009892 - RNA, 13 nt, Staphylococcus aureus subsp. aureus MW2
agucuuuaacuuu

SEQ ID NO: 4009893 - RNA, 22 nt, Staphylococcus aureus subsp. aureus MW2
agucuuuuuauuuuaauauuuu

SEQ ID NO: 4009894 - RNA, 16 nt, Staphylococcus aureus subsp. aureus MW2
agucuuuuugauuaaa

SEQ ID NO: 4009895 - RNA, 13 nt, Staphylococcus aureus subsp. aureus MW2
agucuuuuuuaag

SEQ ID NO: 4009896 - RNA, 19 nt, Staphylococcus aureus subsp. aureus MW2
agugaaagucguuguugaa

SEQ ID NO: 4009897 - RNA, 14 nt, Staphylococcus aureus subsp. aureus MW2
agugaaauaccucc

SEQ ID NO: 4009898 - RNA, 16 nt, Staphylococcus aureus subsp. aureus MW2
agugaaaucauuuaaa

SEQ ID NO: 4009899 - RNA, 21 nt, Staphylococcus aureus subsp. aureus MW2
agugaacaccccuucucuaaa

SEQ ID NO: 4009900 - RNA, 17 nt, Staphylococcus aureus subsp. aureus MW2
agugaauaauugagaaa

SEQ ID NO: 4009901 - RNA, 19 nt, Staphylococcus aureus subsp. aureus MW2
agugaauaauugagaaaaa

SEQ ID NO: 4009902 - RNA, 22 nt, Staphylococcus aureus subsp. aureus MW2
agugaaucuaaacuauaauaau

SEQ ID NO: 4009903 - RNA, 21 nt, Staphylococcus aureus subsp. aureus MW2
agugaaucuucuaauuaagaa

SEQ ID NO: 4009904 - RNA, 15 nt, Staphylococcus aureus subsp. aureus MW2
agugacacuguaacg

SEQ ID NO: 4009905 - RNA, 18 nt, Staphylococcus aureus subsp. aureus MW2
agugacauuccaaaaccg

SEQ ID NO: 4009906 - RNA, 18 nt, Staphylococcus aureus subsp. aureus MW2
agugacgggguuuuauca

SEQ ID NO: 4009907 - RNA, 16 nt, Staphylococcus aureus subsp. aureus MW2
agugagcguauuauua

SEQ ID NO: 4009908 - RNA, 13 nt, Staphylococcus aureus subsp. aureus MW2
agugaguauaagu

SEQ ID NO: 4009909 - RNA, 14 nt, Staphylococcus aureus subsp. aureus MW2
agugaugaaaaaga

SEQ ID NO: 4009910 - RNA, 21 nt, Staphylococcus aureus subsp. aureus MW2
agugaugaaaaagaguuaaua

SEQ ID NO: 4009911 - RNA, 15 nt, Staphylococcus aureus subsp. aureus MW2
agugaugaccaauau

SEQ ID NO: 4009912 - RNA, 12 nt, Staphylococcus aureus subsp. aureus MW2
agugauuuaaaa

SEQ ID NO: 4009913 - RNA, 16 nt, Staphylococcus aureus subsp. aureus MW2
agugauuuaaaaaaau

SEQ ID NO: 4009914 - RNA, 20 nt, Staphylococcus aureus subsp. aureus MW2
agugauuuaaaaaaauuaau

SEQ ID NO: 4009915 - RNA, 13 nt, Staphylococcus aureus subsp. aureus MW2
agugcuaagaggu

SEQ ID NO: 4009916 - RNA, 18 nt, Staphylococcus aureus subsp. aureus MW2
agugcucuugcaauagca

SEQ ID NO: 4009917 - RNA, 23 nt, Staphylococcus aureus subsp. aureus MW2
agugcuuaugaaugaaaucagca

SEQ ID NO: 4009918 - RNA, 19 nt, Staphylococcus aureus subsp. aureus MW2
agugcuugauuaacauuuu

SEQ ID NO: 4009919 - RNA, 21 nt, Staphylococcus aureus subsp. aureus MW2
agugcuuuuuauuuuuauuca

SEQ ID NO: 4009920 - RNA, 14 nt, Staphylococcus aureus subsp. aureus MW2
aguggaaauuaugu

SEQ ID NO: 4009921 - RNA, 18 nt, Staphylococcus aureus subsp. aureus MW2
aguggaucacgauaaugu

SEQ ID NO: 4009922 - RNA, 16 nt, Staphylococcus aureus subsp. aureus MW2
aguggcauuuaaaaau

SEQ ID NO: 4009923 - RNA, 18 nt, Staphylococcus aureus subsp. aureus MW2
agugggacagaaaugaua

SEQ ID NO: 4009924 - RNA, 17 nt, Staphylococcus aureus subsp. aureus MW2
agugguaaaaaguuuaa

SEQ ID NO: 4009925 - RNA, 14 nt, Staphylococcus aureus subsp. aureus MW2
agugguaaaaauga

SEQ ID NO: 4009926 - RNA, 18 nt, Staphylococcus aureus subsp. aureus MW2
agugguuuucuuuauuuu

SEQ ID NO: 4009927 - RNA, 14 nt, Staphylococcus aureus subsp. aureus MW2
aguguaaaugaaag

SEQ ID NO: 4009928 - RNA, 22 nt, Staphylococcus aureus subsp. aureus MW2
aguguaauguuccccugaaaag

SEQ ID NO: 4009929 - RNA, 16 nt, Staphylococcus aureus subsp. aureus MW2
aguguagcacaagauu

SEQ ID NO: 4009930 - RNA, 17 nt, Staphylococcus aureus subsp. aureus MW2
aguguagccaaauaaau

SEQ ID NO: 4009931 - RNA, 13 nt, Staphylococcus aureus subsp. aureus MW2
aguguauacaagg

SEQ ID NO: 4009932 - RNA, 12 nt, Staphylococcus aureus subsp. aureus MW2
aguguauauagu

SEQ ID NO: 4009933 - RNA, 14 nt, Staphylococcus aureus subsp. aureus MW2
aguguauauaguag

SEQ ID NO: 4009934 - RNA, 19 nt, Staphylococcus aureus subsp. aureus MW2
aguguaugcauauaagaua

SEQ ID NO: 4009935 - RNA, 17 nt, Staphylococcus aureus subsp. aureus MW2
aguguauucauuuuaaa

SEQ ID NO: 4009936 - RNA, 19 nt, Staphylococcus aureus subsp. aureus MW2
aguguauucauuuuaaauu

SEQ ID NO: 4009937 - RNA, 23 nt, Staphylococcus aureus subsp. aureus MW2
agugugcaggauaacguucacuu

SEQ ID NO: 4009938 - RNA, 15 nt, Staphylococcus aureus subsp. aureus MW2
aguguggucuuguga

SEQ ID NO: 4009939 - RNA, 22 nt, Staphylococcus aureus subsp. aureus MW2
aguguuauauuggcgggcccca

SEQ ID NO: 4009940 - RNA, 13 nt, Staphylococcus aureus subsp. aureus MW2
aguguuauauugu

SEQ ID NO: 4009941 - RNA, 22 nt, Staphylococcus aureus subsp. aureus MW2
aguguucucauuauaaugauuu

SEQ ID NO: 4009942 - RNA, 17 nt, Staphylococcus aureus subsp. aureus MW2
aguguuuaugaaagucu

SEQ ID NO: 4009943 - RNA, 11 nt, Staphylococcus aureus subsp. aureus MW2
aguguuucaua

SEQ ID NO: 4009944 - RNA, 14 nt, Staphylococcus aureus subsp. aureus MW2
aguguuuuauucga

SEQ ID NO: 4009945 - RNA, 18 nt, Staphylococcus aureus subsp. aureus MW2
aguuaaaaccuuuucaaa

SEQ ID NO: 4009946 - RNA, 19 nt, Staphylococcus aureus subsp. aureus MW2
aguuaaaauugguuuggau

SEQ ID NO: 4009947 - RNA, 16 nt, Staphylococcus aureus subsp. aureus MW2
aguuaaaguacuuaca

SEQ ID NO: 4009948 - RNA, 14 nt, Staphylococcus aureus subsp. aureus MW2
aguuaaauaguaag

SEQ ID NO: 4009949 - RNA, 20 nt, Staphylococcus aureus subsp. aureus MW2
aguuaacggcguauucaauu

SEQ ID NO: 4009950 - RNA, 16 nt, Staphylococcus aureus subsp. aureus MW2
aguuaauaaaauuacg

SEQ ID NO: 4009951 - RNA, 17 nt, Staphylococcus aureus subsp. aureus MW2
aguuaauauaauuaaac

SEQ ID NO: 4009952 - RNA, 15 nt, Staphylococcus aureus subsp. aureus MW2
aguuaauguaaaguu

SEQ ID NO: 4009953 - RNA, 12 nt, Staphylococcus aureus subsp. aureus MW2
aguuaauuaugu

SEQ ID NO: 4009954 - RNA, 14 nt, Staphylococcus aureus subsp. aureus MW2
auaaaaagaauaug

SEQ ID NO: 4009955 - RNA, 19 nt, Staphylococcus aureus subsp. aureus MW2
auaaaaagaauaugauauu

SEQ ID NO: 4009956 - RNA, 21 nt, Staphylococcus aureus subsp. aureus MW2
auaaaaagauauaagaaaaag

SEQ ID NO: 4009957 - RNA, 18 nt, Staphylococcus aureus subsp. aureus MW2
auaaaaaggagcgacaau

SEQ ID NO: 4009958 - RNA, 18 nt, Staphylococcus aureus subsp. aureus MW2
auaaaaagugaaaguauu

SEQ ID NO: 4009959 - RNA, 15 nt, Staphylococcus aureus subsp. aureus MW2
auaaaaauauucaaa

SEQ ID NO: 4009960 - RNA, 20 nt, Staphylococcus aureus subsp. aureus MW2
auaaaaauguauuaaauaug

SEQ ID NO: 4009961 - RNA, 13 nt, Staphylococcus aureus subsp. aureus MW2
auaaaacagaauu

SEQ ID NO: 4009962 - RNA, 15 nt, Staphylococcus aureus subsp. aureus MW2
auaaaacgauaagaa

SEQ ID NO: 4009963 - RNA, 17 nt, Staphylococcus aureus subsp. aureus MW2
auaaaacgcuucauaua

SEQ ID NO: 4009964 - RNA, 17 nt, Staphylococcus aureus subsp. aureus MW2
auaaaacuaauuaggua

SEQ ID NO: 4009965 - RNA, 15 nt, Staphylococcus aureus subsp. aureus MW2
auaaaacuaucuaca

SEQ ID NO: 4009966 - RNA, 16 nt, Staphylococcus aureus subsp. aureus MW2
auaaaacuauguguau

SEQ ID NO: 4009967 - RNA, 22 nt, Staphylococcus aureus subsp. aureus MW2
auaaaacuauguguauaugugg

SEQ ID NO: 4009968 - RNA, 13 nt, Staphylococcus aureus subsp. aureus MW2
auaaaacuuacau

SEQ ID NO: 4009969 - RNA, 23 nt, Staphylococcus aureus subsp. aureus MW2
auaaaacuuacauuacauauauc

SEQ ID NO: 4009970 - RNA, 19 nt, Staphylococcus aureus subsp. aureus MW2
auaaaacuuauaacugaua

SEQ ID NO: 4009971 - RNA, 20 nt, Staphylococcus aureus subsp. aureus MW2
auaaaagccaugauacgaug

SEQ ID NO: 4009972 - RNA, 22 nt, Staphylococcus aureus subsp. aureus MW2
auaaaaggcuuuguuaaacaca

SEQ ID NO: 4009973 - RNA, 23 nt, Staphylococcus aureus subsp. aureus MW2
auaaaaguacuuuaaaauuguau

SEQ ID NO: 4009974 - RNA, 16 nt, Staphylococcus aureus subsp. aureus MW2
auaaaagucgauaaau

SEQ ID NO: 4009975 - RNA, 19 nt, Staphylococcus aureus subsp. aureus MW2
auaaaagucgauaaauaug

SEQ ID NO: 4009976 - RNA, 20 nt, Staphylococcus aureus subsp. aureus MW2
auaaaagucgauaaauauga

SEQ ID NO: 4009977 - RNA, 22 nt, Staphylococcus aureus subsp. aureus MW2
auaaaagucgauaaauaugaug

SEQ ID NO: 4009978 - RNA, 12 nt, Staphylococcus aureus subsp. aureus MW2
auaaaauaaaau

SEQ ID NO: 4009979 - RNA, 12 nt, Staphylococcus aureus subsp. aureus MW2
auaaaauaaaua

SEQ ID NO: 4009980 - RNA, 13 nt, Staphylococcus aureus subsp. aureus MW2
auaaaauaaauaa

SEQ ID NO: 4009981 - RNA, 22 nt, Staphylococcus aureus subsp. aureus MW2
auaaaauaaucgguaauuacuu

SEQ ID NO: 4009982 - RNA, 20 nt, Staphylococcus aureus subsp. aureus MW2
auaaaauauaucuuaugaua

SEQ ID NO: 4009983 - RNA, 13 nt, Staphylococcus aureus subsp. aureus MW2
auaaaaucauaug

SEQ ID NO: 4009984 - RNA, 20 nt, Staphylococcus aureus subsp. aureus MW2
auaaaaucaucguauuucau

SEQ ID NO: 4009985 - RNA, 15 nt, Staphylococcus aureus subsp. aureus MW2
auaaaaugaauaauu

SEQ ID NO: 4009986 - RNA, 22 nt, Staphylococcus aureus subsp. aureus MW2
auaaaaugcauagcucuucuuu

SEQ ID NO: 4009987 - RNA, 18 nt, Staphylococcus aureus subsp. aureus MW2
auaaaaugcuacaauuuc

SEQ ID NO: 4009988 - RNA, 20 nt, Staphylococcus aureus subsp. aureus MW2
auaaaauggugcgaauaaua

SEQ ID NO: 4009989 - RNA, 14 nt, Staphylococcus aureus subsp. aureus MW2
auaaaauuaaaaca

SEQ ID NO: 4009990 - RNA, 16 nt, Staphylococcus aureus subsp. aureus MW2
auaaaauuaaaacagc

SEQ ID NO: 4009991 - RNA, 21 nt, Staphylococcus aureus subsp. aureus MW2
auaaaauuacuugaauauuau

SEQ ID NO: 4009992 - RNA, 13 nt, Staphylococcus aureus subsp. aureus MW2
auaaaauuuaaaa

SEQ ID NO: 4009993 - RNA, 15 nt, Staphylococcus aureus subsp. aureus MW2
auaaaauuuaaaaca

SEQ ID NO: 4009994 - RNA, 14 nt, Staphylococcus aureus subsp. aureus MW2
auaaaauuucugcu

SEQ ID NO: 4009995 - RNA, 13 nt, Staphylococcus aureus subsp. aureus MW2
auaaaauuuugaa

SEQ ID NO: 4009996 - RNA, 15 nt, Staphylococcus aureus subsp. aureus MW2
auaaaauuuuuuuca

SEQ ID NO: 4009997 - RNA, 16 nt, Staphylococcus aureus subsp. aureus MW2
auaaaauuuuuuucau

SEQ ID NO: 4009998 - RNA, 20 nt, Staphylococcus aureus subsp. aureus MW2
auaaacaacugcaauagcua

SEQ ID NO: 4009999 - RNA, 15 nt, Staphylococcus aureus subsp. aureus MW2
auaaacaauaaaaaa

SEQ ID NO: 4010000 - RNA, 13 nt, Staphylococcus aureus subsp. aureus MW2
auaaacaauaacu

SEQ ID NO: 4010001 - RNA, 12 nt, Staphylococcus aureus subsp. aureus MW2
auaaacauauca

SEQ ID NO: 4010002 - RNA, 23 nt, Staphylococcus aureus subsp. aureus MW2
auaaaccaaaucggaauaaaaua

SEQ ID NO: 4010003 - RNA, 14 nt, Staphylococcus aureus subsp. aureus MW2
auaaaccacgcaca

SEQ ID NO: 4010004 - RNA, 21 nt, Staphylococcus aureus subsp. aureus MW2
auaaaccgauuguuucaccag

SEQ ID NO: 4010005 - RNA, 23 nt, Staphylococcus aureus subsp. aureus MW2
auaaaccgauuguuucaccagcu

SEQ ID NO: 4010006 - RNA, 17 nt, Staphylococcus aureus subsp. aureus MW2
auaaacgcaaauuaaau

SEQ ID NO: 4010007 - RNA, 17 nt, Staphylococcus aureus subsp. aureus MW2
auaaacgcacugcugca

SEQ ID NO: 4010008 - RNA, 18 nt, Staphylococcus aureus subsp. aureus MW2
auaaacguccaaacacaa

SEQ ID NO: 4010009 - RNA, 12 nt, Staphylococcus aureus subsp. aureus MW2
auaaacuacaca

SEQ ID NO: 4010010 - RNA, 23 nt, Staphylococcus aureus subsp. aureus MW2
auaaacuacuaaaaggacucaua

SEQ ID NO: 4010011 - RNA, 14 nt, Staphylococcus aureus subsp. aureus MW2
auaaacuauuaaau

SEQ ID NO: 4010012 - RNA, 12 nt, Staphylococcus aureus subsp. aureus MW2
auaaacuuaaaa

SEQ ID NO: 4010013 - RNA, 23 nt, Staphylococcus aureus subsp. aureus MW2
auaaacuuuugcaauuuuugaaa

SEQ ID NO: 4010014 - RNA, 20 nt, Staphylococcus aureus subsp. aureus MW2
auaaagaauuucgaaaagaa

SEQ ID NO: 4010015 - RNA, 15 nt, Staphylococcus aureus subsp. aureus MW2
auaaagacaccuuca

SEQ ID NO: 4010016 - RNA, 21 nt, Staphylococcus aureus subsp. aureus MW2
auaaagacaccuucaauaucu

SEQ ID NO: 4010017 - RNA, 13 nt, Staphylococcus aureus subsp. aureus MW2
auaaagauuauau

SEQ ID NO: 4010018 - RNA, 15 nt, Staphylococcus aureus subsp. aureus MW2
auaaagauuauaucu

SEQ ID NO: 4010019 - RNA, 20 nt, Staphylococcus aureus subsp. aureus MW2
auaaagcugcgauauaacua

SEQ ID NO: 4010020 - RNA, 17 nt, Staphylococcus aureus subsp. aureus MW2
auaaagcuuugacauau

SEQ ID NO: 4010021 - RNA, 19 nt, Staphylococcus aureus subsp. aureus MW2
auaaaggucuauauauauu

SEQ ID NO: 4010022 - RNA, 21 nt, Staphylococcus aureus subsp. aureus MW2
auaaaguaugagagauagaaa

SEQ ID NO: 4010023 - RNA, 16 nt, Staphylococcus aureus subsp. aureus MW2
auaaagucauacuuau

SEQ ID NO: 4010024 - RNA, 18 nt, Staphylococcus aureus subsp. aureus MW2
auaaaguccaauacaauu

SEQ ID NO: 4010025 - RNA, 20 nt, Staphylococcus aureus subsp. aureus MW2
auaaaguccaauacaauuua

SEQ ID NO: 4010026 - RNA, 20 nt, Staphylococcus aureus subsp. aureus MW2
auaaagugaguauaaguuug

SEQ ID NO: 4010027 - RNA, 16 nt, Staphylococcus aureus subsp. aureus MW2
auaaaguguaaauuug

SEQ ID NO: 4010028 - RNA, 19 nt, Staphylococcus aureus subsp. aureus MW2
auaaaguugacaauacaaa

SEQ ID NO: 4010029 - RNA, 13 nt, Staphylococcus aureus subsp. aureus MW2
auaaaguuuauuu

SEQ ID NO: 4010030 - RNA, 16 nt, Staphylococcus aureus subsp. aureus MW2
auaaaguuuauuuaug

SEQ ID NO: 4010031 - RNA, 13 nt, Staphylococcus aureus subsp. aureus MW2
auaaauaaaaaua

SEQ ID NO: 4010032 - RNA, 14 nt, Staphylococcus aureus subsp. aureus MW2
auaaauaaaaauau

SEQ ID NO: 4010033 - RNA, 14 nt, Staphylococcus aureus subsp. aureus MW2
auaaauaaaagcca

SEQ ID NO: 4010034 - RNA, 23 nt, Staphylococcus aureus subsp. aureus MW2
auaaauaaaagcccccuuuucac

SEQ ID NO: 4010035 - RNA, 23 nt, Staphylococcus aureus subsp. aureus MW2
auaaauaaaaggcauucuuccaa

SEQ ID NO: 4010036 - RNA, 13 nt, Staphylococcus aureus subsp. aureus MW2
auaaauaaaaugc

SEQ ID NO: 4010037 - RNA, 12 nt, Staphylococcus aureus subsp. aureus MW2
auaaauaaaauu

SEQ ID NO: 4010038 - RNA, 13 nt, Staphylococcus aureus subsp. aureus MW2
auaaauaaaauuu

SEQ ID NO: 4010039 - RNA, 12 nt, Staphylococcus aureus subsp. aureus MW2
auaaauaaacaa

SEQ ID NO: 4010040 - RNA, 17 nt, Staphylococcus aureus subsp. aureus MW2
auaaauaaacucaccaa

SEQ ID NO: 4010041 - RNA, 20 nt, Staphylococcus aureus subsp. aureus MW2
auaaauaaagauucaauuaa

SEQ ID NO: 4010042 - RNA, 22 nt, Staphylococcus aureus subsp. aureus MW2
auaaauaagcaaucauaauacu

SEQ ID NO: 4010043 - RNA, 17 nt, Staphylococcus aureus subsp. aureus MW2
auaacauucuucaaaaa

SEQ ID NO: 4010044 - RNA, 18 nt, Staphylococcus aureus subsp. aureus MW2
auaacauucuucaaaaaa

SEQ ID NO: 4010045 - RNA, 19 nt, Staphylococcus aureus subsp. aureus MW2
auaacauucuucaaaaaau

SEQ ID NO: 4010046 - RNA, 22 nt, Staphylococcus aureus subsp. aureus MW2
auaacauucuucaaaaaauaau

SEQ ID NO: 4010047 - RNA, 23 nt, Staphylococcus aureus subsp. aureus MW2
auaacauucuucaaaaaauaaua

SEQ ID NO: 4010048 - RNA, 20 nt, Staphylococcus aureus subsp. aureus MW2
auaacauuggcaaacgaaua

SEQ ID NO: 4010049 - RNA, 15 nt, Staphylococcus aureus subsp. aureus MW2
auaaccaaguaauuc

SEQ ID NO: 4010050 - RNA, 21 nt, Staphylococcus aureus subsp. aureus MW2
auaaccauaguaacaaaauga

SEQ ID NO: 4010051 - RNA, 17 nt, Staphylococcus aureus subsp. aureus MW2
auaaccauguaaaauua

SEQ ID NO: 4010052 - RNA, 16 nt, Staphylococcus aureus subsp. aureus MW2
auaacccauuuucaaa

SEQ ID NO: 4010053 - RNA, 18 nt, Staphylococcus aureus subsp. aureus MW2
auaacccauuuucaaaac

SEQ ID NO: 4010054 - RNA, 16 nt, Staphylococcus aureus subsp. aureus MW2
auaaccgaugugauuu

SEQ ID NO: 4010055 - RNA, 20 nt, Staphylococcus aureus subsp. aureus MW2
auaaccgcacuuucuauuaa

SEQ ID NO: 4010056 - RNA, 14 nt, Staphylococcus aureus subsp. aureus MW2
auaaccuacauuaa

SEQ ID NO: 4010057 - RNA, 17 nt, Staphylococcus aureus subsp. aureus MW2
auaaccuguaauugaug

SEQ ID NO: 4010058 - RNA, 19 nt, Staphylococcus aureus subsp. aureus MW2
auaaccuuuaaaacaucau

SEQ ID NO: 4010059 - RNA, 20 nt, Staphylococcus aureus subsp. aureus MW2
auaaccuuuaaaacaucauu

SEQ ID NO: 4010060 - RNA, 22 nt, Staphylococcus aureus subsp. aureus MW2
auaaccuuuaaaacaucauuca

SEQ ID NO: 4010061 - RNA, 20 nt, Staphylococcus aureus subsp. aureus MW2
auaacgauagauuuuuucau

SEQ ID NO: 4010062 - RNA, 15 nt, Staphylococcus aureus subsp. aureus MW2
auaacgugcuuuuuu

SEQ ID NO: 4010063 - RNA, 19 nt, Staphylococcus aureus subsp. aureus MW2
auaacgugcuuuuuuagaa

SEQ ID NO: 4010064 - RNA, 22 nt, Staphylococcus aureus subsp. aureus MW2
auaacguguuugcucaaaaugg

SEQ ID NO: 4010065 - RNA, 23 nt, Staphylococcus aureus subsp. aureus MW2
auaacguguuugcucaaaauggu

SEQ ID NO: 4010066 - RNA, 14 nt, Staphylococcus aureus subsp. aureus MW2
auaacguucacuug

SEQ ID NO: 4010067 - RNA, 21 nt, Staphylococcus aureus subsp. aureus MW2
auaacguucgccaacuaaauc

SEQ ID NO: 4010068 - RNA, 16 nt, Staphylococcus aureus subsp. aureus MW2
auaacguucuguuuug

SEQ ID NO: 4010069 - RNA, 20 nt, Staphylococcus aureus subsp. aureus MW2
auaacuagaacaagaauuau

SEQ ID NO: 4010070 - RNA, 14 nt, Staphylococcus aureus subsp. aureus MW2
auaacuagaaugau

SEQ ID NO: 4010071 - RNA, 21 nt, Staphylococcus aureus subsp. aureus MW2
auaacuaguauccuuuauaaa

SEQ ID NO: 4010072 - RNA, 23 nt, Staphylococcus aureus subsp. aureus MW2
auaacucgacuugguauuuaucc

SEQ ID NO: 4010073 - RNA, 21 nt, Staphylococcus aureus subsp. aureus MW2
auaacucgcuucguucuaaaa

SEQ ID NO: 4010074 - RNA, 15 nt, Staphylococcus aureus subsp. aureus MW2
auaacugauaauacu

SEQ ID NO: 4010075 - RNA, 20 nt, Staphylococcus aureus subsp. aureus MW2
auaacugcauguacaucuuu

SEQ ID NO: 4010076 - RNA, 13 nt, Staphylococcus aureus subsp. aureus MW2
auaacuguaaaac

SEQ ID NO: 4010077 - RNA, 19 nt, Staphylococcus aureus subsp. aureus MW2
auaacuguagcuccuaaag

SEQ ID NO: 4010078 - RNA, 23 nt, Staphylococcus aureus subsp. aureus MW2
auaacuguucuuucgucuuguaa

SEQ ID NO: 4010079 - RNA, 18 nt, Staphylococcus aureus subsp. aureus MW2
auaacuugauauuauaua

SEQ ID NO: 4010080 - RNA, 12 nt, Staphylococcus aureus subsp. aureus MW2
auaacuuuaaaa

SEQ ID NO: 4010081 - RNA, 13 nt, Staphylococcus aureus subsp. aureus MW2
auaacuuuaaaaa

SEQ ID NO: 4010082 - RNA, 15 nt, Staphylococcus aureus subsp. aureus MW2
auaacuuuaaaaauu

SEQ ID NO: 4010083 - RNA, 16 nt, Staphylococcus aureus subsp. aureus MW2
auaagaagugcuuaug

SEQ ID NO: 4010084 - RNA, 15 nt, Staphylococcus aureus subsp. aureus MW2
auaagaaucagcuaa

SEQ ID NO: 4010085 - RNA, 15 nt, Staphylococcus aureus subsp. aureus MW2
auaagaaucaucuaa

SEQ ID NO: 4010086 - RNA, 12 nt, Staphylococcus aureus subsp. aureus MW2
auaagaauguga

SEQ ID NO: 4010087 - RNA, 10 nt, Staphylococcus aureus subsp. aureus MW2
auaagaauuu

SEQ ID NO: 4010088 - RNA, 13 nt, Staphylococcus aureus subsp. aureus MW2
auaagacaauagu

SEQ ID NO: 4010089 - RNA, 15 nt, Staphylococcus aureus subsp. aureus MW2
auaagacaauaguau

SEQ ID NO: 4010090 - RNA, 19 nt, Staphylococcus aureus subsp. aureus MW2
auaagacuucccuauaugu

SEQ ID NO: 4010091 - RNA, 21 nt, Staphylococcus aureus subsp. aureus MW2
auaagauaauuuuuaacauca

SEQ ID NO: 4010092 - RNA, 21 nt, Staphylococcus aureus subsp. aureus MW2
auaagauaguuugagaaaauu

SEQ ID NO: 4010093 - RNA, 16 nt, Staphylococcus aureus subsp. aureus MW2
auaagaugcaugccaa

SEQ ID NO: 4010094 - RNA, 20 nt, Staphylococcus aureus subsp. aureus MW2
auaagaugcaugccaauuaa

SEQ ID NO: 4010095 - RNA, 21 nt, Staphylococcus aureus subsp. aureus MW2
auaagaugcaugccaauuaau

SEQ ID NO: 4010096 - RNA, 15 nt, Staphylococcus aureus subsp. aureus MW2
auaagauugcuuuuu

SEQ ID NO: 4010097 - RNA, 14 nt, Staphylococcus aureus subsp. aureus MW2
auaagauuucucag

SEQ ID NO: 4010098 - RNA, 15 nt, Staphylococcus aureus subsp. aureus MW2
auaagauuuugcuuu

SEQ ID NO: 4010099 - RNA, 22 nt, Staphylococcus aureus subsp. aureus MW2
auaagauuuugcuuuaaacauu

SEQ ID NO: 4010100 - RNA, 18 nt, Staphylococcus aureus subsp. aureus MW2
auaagcaaucauaauacu

SEQ ID NO: 4010101 - RNA, 18 nt, Staphylococcus aureus subsp. aureus MW2
auaagccuuuucaaacau

SEQ ID NO: 4010102 - RNA, 13 nt, Staphylococcus aureus subsp. aureus MW2
auaagcuaauauu

SEQ ID NO: 4010103 - RNA, 16 nt, Staphylococcus aureus subsp. aureus MW2
auaagcuaauauuuau

SEQ ID NO: 4010104 - RNA, 14 nt, Staphylococcus aureus subsp. aureus MW2
auaaggacucuguu

SEQ ID NO: 4010105 - RNA, 15 nt, Staphylococcus aureus subsp. aureus MW2
auaaggauaucugaa

SEQ ID NO: 4010106 - RNA, 15 nt, Staphylococcus aureus subsp. aureus MW2
auaaggcuauuccua

SEQ ID NO: 4010107 - RNA, 20 nt, Staphylococcus aureus subsp. aureus MW2
auaagguagcguagcauuau

SEQ ID NO: 4010108 - RNA, 19 nt, Staphylococcus aureus subsp. aureus MW2
auaaguaaucauaauaauc

SEQ ID NO: 4010109 - RNA, 15 nt, Staphylococcus aureus subsp. aureus MW2
auaaguacaaauaau

SEQ ID NO: 4010110 - RNA, 18 nt, Staphylococcus aureus subsp. aureus MW2
auaaguacaaauaauaca

SEQ ID NO: 4010111 - RNA, 20 nt, Staphylococcus aureus subsp. aureus MW2
auaaguacaaauaauacagg

SEQ ID NO: 4010112 - RNA, 22 nt, Staphylococcus aureus subsp. aureus MW2
auaaguagcucaaaacaauuua

SEQ ID NO: 4010113 - RNA, 18 nt, Staphylococcus aureus subsp. aureus MW2
auaaguaguucaauaaau

SEQ ID NO: 4010114 - RNA, 15 nt, Staphylococcus aureus subsp. aureus MW2
auaagucuauuaugu

SEQ ID NO: 4010115 - RNA, 19 nt, Staphylococcus aureus subsp. aureus MW2
auaagucuuaacaaauuaa

SEQ ID NO: 4010116 - RNA, 16 nt, Staphylococcus aureus subsp. aureus MW2
auaaguguuguuuuau

SEQ ID NO: 4010117 - RNA, 13 nt, Staphylococcus aureus subsp. aureus MW2
auaaguuaaaaau

SEQ ID NO: 4010118 - RNA, 15 nt, Staphylococcus aureus subsp. aureus MW2
auaaguuaauguaau

SEQ ID NO: 4010119 - RNA, 18 nt, Staphylococcus aureus subsp. aureus MW2
auaaguuugguucaguag

SEQ ID NO: 4010120 - RNA, 18 nt, Staphylococcus aureus subsp. aureus MW2
auaaguuuguuuguaaaa

SEQ ID NO: 4010121 - RNA, 14 nt, Staphylococcus aureus subsp. aureus MW2
auaauaaaaaggag

SEQ ID NO: 4010122 - RNA, 12 nt, Staphylococcus aureus subsp. aureus MW2
auaauaaagauu

SEQ ID NO: 4010123 - RNA, 14 nt, Staphylococcus aureus subsp. aureus MW2
auaauaaauaggau

SEQ ID NO: 4010124 - RNA, 13 nt, Staphylococcus aureus subsp. aureus MW2
auaauaaaucacg

SEQ ID NO: 4010125 - RNA, 16 nt, Staphylococcus aureus subsp. aureus MW2
auaauaaccuacauua

SEQ ID NO: 4010126 - RNA, 14 nt, Staphylococcus aureus subsp. aureus MW2
auaauaauacaauu

SEQ ID NO: 4010127 - RNA, 13 nt, Staphylococcus aureus subsp. aureus MW2
auaauaauauuga

SEQ ID NO: 4010128 - RNA, 18 nt, Staphylococcus aureus subsp. aureus MW2
auaauaauccaccuaaaa

SEQ ID NO: 4010129 - RNA, 20 nt, Staphylococcus aureus subsp. aureus MW2
auaauaauucauaaaugcuu

SEQ ID NO: 4010130 - RNA, 14 nt, Staphylococcus aureus subsp. aureus MW2
auaauacaauuuua

SEQ ID NO: 4010131 - RNA, 12 nt, Staphylococcus aureus subsp. aureus MW2
auaauacaugau

SEQ ID NO: 4010132 - RNA, 21 nt, Staphylococcus aureus subsp. aureus MW2
auaauuacuaaccuaaagaua

SEQ ID NO: 4010133 - RNA, 22 nt, Staphylococcus aureus subsp. aureus MW2
auaauuacuaaccuaaagauaa

SEQ ID NO: 4010134 - RNA, 16 nt, Staphylococcus aureus subsp. aureus MW2
auaauuagauuuaaaa

SEQ ID NO: 4010135 - RNA, 22 nt, Staphylococcus aureus subsp. aureus MW2
auaauuagucauugaaaauauu

SEQ ID NO: 4010136 - RNA, 13 nt, Staphylococcus aureus subsp. aureus MW2
auaauuaugaaaa

SEQ ID NO: 4010137 - RNA, 16 nt, Staphylococcus aureus subsp. aureus MW2
auaauuaugaaaagug

SEQ ID NO: 4010138 - RNA, 17 nt, Staphylococcus aureus subsp. aureus MW2
auaauuaugaaaaguga

SEQ ID NO: 4010139 - RNA, 17 nt, Staphylococcus aureus subsp. aureus MW2
auaauuauuaaacuuug

SEQ ID NO: 4010140 - RNA, 17 nt, Staphylococcus aureus subsp. aureus MW2
auaauucagaugaauaa

SEQ ID NO: 4010141 - RNA, 17 nt, Staphylococcus aureus subsp. aureus MW2
auaauucaguguuacua

SEQ ID NO: 4010142 - RNA, 12 nt, Staphylococcus aureus subsp. aureus MW2
auaauucaucuu

SEQ ID NO: 4010143 - RNA, 13 nt, Staphylococcus aureus subsp. aureus MW2
auaauucaucuug

SEQ ID NO: 4010144 - RNA, 16 nt, Staphylococcus aureus subsp. aureus MW2
auaauuccugaaacaa

SEQ ID NO: 4010145 - RNA, 20 nt, Staphylococcus aureus subsp. aureus MW2
auaauuccugaaacaaugau

SEQ ID NO: 4010146 - RNA, 20 nt, Staphylococcus aureus subsp. aureus MW2
auaauucgugauuacauucu

SEQ ID NO: 4010147 - RNA, 18 nt, Staphylococcus aureus subsp. aureus MW2
auaauucuuuuagaauuc

SEQ ID NO: 4010148 - RNA, 20 nt, Staphylococcus aureus subsp. aureus MW2
auaauugcauagcuaaauaa

SEQ ID NO: 4010149 - RNA, 22 nt, Staphylococcus aureus subsp. aureus MW2
auaauugcauagcuaaauaaau

SEQ ID NO: 4010150 - RNA, 15 nt, Staphylococcus aureus subsp. aureus MW2
auaauugcauuacua

SEQ ID NO: 4010151 - RNA, 13 nt, Staphylococcus aureus subsp. aureus MW2
auaauuggaauaa

SEQ ID NO: 4010152 - RNA, 17 nt, Staphylococcus aureus subsp. aureus MW2
auaauuggcagauagaa

SEQ ID NO: 4010153 - RNA, 23 nt, Staphylococcus aureus subsp. aureus MW2
auaauuuaaaggcauaauaacca

SEQ ID NO: 4010154 - RNA, 18 nt, Staphylococcus aureus subsp. aureus MW2
auaauuuaaauuaaaaua

SEQ ID NO: 4010155 - RNA, 19 nt, Staphylococcus aureus subsp. aureus MW2
auaauuuaaauuaaaauaa

SEQ ID NO: 4010156 - RNA, 20 nt, Staphylococcus aureus subsp. aureus MW2
auaauuuaaauuaaaauaau

SEQ ID NO: 4010157 - RNA, 23 nt, Staphylococcus aureus subsp. aureus MW2
auaauuuaauguugcaaaauuaa

SEQ ID NO: 4010158 - RNA, 16 nt, Staphylococcus aureus subsp. aureus MW2
auaauuuaauugguuu

SEQ ID NO: 4010159 - RNA, 17 nt, Staphylococcus aureus subsp. aureus MW2
auaauuucuaaaucuaa

SEQ ID NO: 4010160 - RNA, 16 nt, Staphylococcus aureus subsp. aureus MW2
auaauuucuucuucug

SEQ ID NO: 4010161 - RNA, 19 nt, Staphylococcus aureus subsp. aureus MW2
auaauuugguuaauacguu

SEQ ID NO: 4010162 - RNA, 16 nt, Staphylococcus aureus subsp. aureus MW2
auaauuuguaauuccu

SEQ ID NO: 4010163 - RNA, 16 nt, Staphylococcus aureus subsp. aureus MW2
auaauuugugugcgau

SEQ ID NO: 4010164 - RNA, 12 nt, Staphylococcus aureus subsp. aureus MW2
auaauuuuaaaa

SEQ ID NO: 4010165 - RNA, 14 nt, Staphylococcus aureus subsp. aureus MW2
auaauuuuaaaaau

SEQ ID NO: 4010166 - RNA, 18 nt, Staphylococcus aureus subsp. aureus MW2
auaauuuuaaaaauaaaa

SEQ ID NO: 4010167 - RNA, 18 nt, Staphylococcus aureus subsp. aureus MW2
auaauuuuaauauuaugu

SEQ ID NO: 4010168 - RNA, 17 nt, Staphylococcus aureus subsp. aureus MW2
auaauuuuguuucacua

SEQ ID NO: 4010169 - RNA, 22 nt, Staphylococcus aureus subsp. aureus MW2
auaauuuuuaacagcgugaaua

SEQ ID NO: 4010170 - RNA, 18 nt, Staphylococcus aureus subsp. aureus MW2
auaauuuuuaacaucauu

SEQ ID NO: 4010171 - RNA, 13 nt, Staphylococcus aureus subsp. aureus MW2
auacaaauugauu

SEQ ID NO: 4010172 - RNA, 17 nt, Staphylococcus aureus subsp. aureus MW2
auacaauaguauaaaua

SEQ ID NO: 4010173 - RNA, 18 nt, Staphylococcus aureus subsp. aureus MW2
auacaaugaauuucuaau

SEQ ID NO: 4010174 - RNA, 21 nt, Staphylococcus aureus subsp. aureus MW2
auacaaugaauuucuaauuua

SEQ ID NO: 4010175 - RNA, 14 nt, Staphylococcus aureus subsp. aureus MW2
auacaauguauuuu

SEQ ID NO: 4010176 - RNA, 15 nt, Staphylococcus aureus subsp. aureus MW2
auacaauguauuuug

SEQ ID NO: 4010177 - RNA, 17 nt, Staphylococcus aureus subsp. aureus MW2
auacaauguauuuugau

SEQ ID NO: 4010178 - RNA, 20 nt, Staphylococcus aureus subsp. aureus MW2
auacaauuauggauaaaauu

SEQ ID NO: 4010179 - RNA, 13 nt, Staphylococcus aureus subsp. aureus MW2
auacaauuuaggu

SEQ ID NO: 4010180 - RNA, 21 nt, Staphylococcus aureus subsp. aureus MW2
auacaauuuagguuaauuaaa

SEQ ID NO: 4010181 - RNA, 13 nt, Staphylococcus aureus subsp. aureus MW2
auacaauuuuuug

SEQ ID NO: 4010182 - RNA, 18 nt, Staphylococcus aureus subsp. aureus MW2
auacacacugcuaaaauu

SEQ ID NO: 4010183 - RNA, 17 nt, Staphylococcus aureus subsp. aureus MW2
auacacagauuacucug

SEQ ID NO: 4010184 - RNA, 14 nt, Staphylococcus aureus subsp. aureus MW2
auacaccaauauuu

SEQ ID NO: 4010185 - RNA, 18 nt, Staphylococcus aureus subsp. aureus MW2
auacaccaauauuuuucg

SEQ ID NO: 4010186 - RNA, 15 nt, Staphylococcus aureus subsp. aureus MW2
auacaccuauuacac

SEQ ID NO: 4010187 - RNA, 13 nt, Staphylococcus aureus subsp. aureus MW2
auacacguacaaa

SEQ ID NO: 4010188 - RNA, 17 nt, Staphylococcus aureus subsp. aureus MW2
auacacugcacaucaua

SEQ ID NO: 4010189 - RNA, 19 nt, Staphylococcus aureus subsp. aureus MW2
auacacuugcuaaaacuaa

SEQ ID NO: 4010190 - RNA, 20 nt, Staphylococcus aureus subsp. aureus MW2
auacacuugguuaucauuau

SEQ ID NO: 4010191 - RNA, 22 nt, Staphylococcus aureus subsp. aureus MW2
auacacuugguuaucauuauuc

SEQ ID NO: 4010192 - RNA, 23 nt, Staphylococcus aureus subsp. aureus MW2
auacacuugguuaucauuauuca

SEQ ID NO: 4010193 - RNA, 23 nt, Staphylococcus aureus subsp. aureus MW2
auacacuuuuugacauauuuuuu

SEQ ID NO: 4010194 - RNA, 19 nt, Staphylococcus aureus subsp. aureus MW2
auacagaaccaacaauaaa

SEQ ID NO: 4010195 - RNA, 20 nt, Staphylococcus aureus subsp. aureus MW2
auacagaacuuuaauaauga

SEQ ID NO: 4010196 - RNA, 20 nt, Staphylococcus aureus subsp. aureus MW2
auacaggaaauugaagcguu

SEQ ID NO: 4010197 - RNA, 20 nt, Staphylococcus aureus subsp. aureus MW2
auacagucaauacaaaacau

SEQ ID NO: 4010198 - RNA, 14 nt, Staphylococcus aureus subsp. aureus MW2
auacaguuguacca

SEQ ID NO: 4010199 - RNA, 19 nt, Staphylococcus aureus subsp. aureus MW2
auacauaauucaaugccau

SEQ ID NO: 4010200 - RNA, 19 nt, Staphylococcus aureus subsp. aureus MW2
auacauaccacacuuuaaa

SEQ ID NO: 4010201 - RNA, 12 nt, Staphylococcus aureus subsp. aureus MW2
auacauacugau

SEQ ID NO: 4010202 - RNA, 13 nt, Staphylococcus aureus subsp. aureus MW2
auacauacugauu

SEQ ID NO: 4010203 - RNA, 12 nt, Staphylococcus aureus subsp. aureus MW2
auacauaucuuu

SEQ ID NO: 4010204 - RNA, 14 nt, Staphylococcus aureus subsp. aureus MW2
auacauaucuuuug

SEQ ID NO: 4010205 - RNA, 15 nt, Staphylococcus aureus subsp. aureus MW2
auacauaucuuuugc

SEQ ID NO: 4010206 - RNA, 18 nt, Staphylococcus aureus subsp. aureus MW2
auacauauuuauauuuug

SEQ ID NO: 4010207 - RNA, 23 nt, Staphylococcus aureus subsp. aureus MW2
auacaucaucaaguucaccguaa

SEQ ID NO: 4010208 - RNA, 16 nt, Staphylococcus aureus subsp. aureus MW2
auacaucaucgccagc

SEQ ID NO: 4010209 - RNA, 20 nt, Staphylococcus aureus subsp. aureus MW2
auacauccauacuucuauuu

SEQ ID NO: 4010210 - RNA, 15 nt, Staphylococcus aureus subsp. aureus MW2
auacaugauauaaau

SEQ ID NO: 4010211 - RNA, 19 nt, Staphylococcus aureus subsp. aureus MW2
auacaugauauaaauaggu

SEQ ID NO: 4010212 - RNA, 17 nt, Staphylococcus aureus subsp. aureus MW2
auacauguaacagugug

SEQ ID NO: 4010213 - RNA, 23 nt, Staphylococcus aureus subsp. aureus MW2
auacauguaacagugugaaauaa

SEQ ID NO: 4010214 - RNA, 19 nt, Staphylococcus aureus subsp. aureus MW2
auacaugugggauaucuuc

SEQ ID NO: 4010215 - RNA, 16 nt, Staphylococcus aureus subsp. aureus MW2
auacauuagaacaauc

SEQ ID NO: 4010216 - RNA, 15 nt, Staphylococcus aureus subsp. aureus MW2
auacauuauuaaaua

SEQ ID NO: 4010217 - RNA, 21 nt, Staphylococcus aureus subsp. aureus MW2
auacauuccaaaguaccaucu

SEQ ID NO: 4010218 - RNA, 16 nt, Staphylococcus aureus subsp. aureus MW2
auaccaaccaaaacca

SEQ ID NO: 4010219 - RNA, 21 nt, Staphylococcus aureus subsp. aureus MW2
auaccaaccaaaaccaaauga

SEQ ID NO: 4010220 - RNA, 16 nt, Staphylococcus aureus subsp. aureus MW2
auacuuucaaacaaau

SEQ ID NO: 4010221 - RNA, 21 nt, Staphylococcus aureus subsp. aureus MW2
auacuuucacuuuuuauauca

SEQ ID NO: 4010222 - RNA, 14 nt, Staphylococcus aureus subsp. aureus MW2
auacuuugaaagaa

SEQ ID NO: 4010223 - RNA, 11 nt, Staphylococcus aureus subsp. aureus MW2
auacuuuucuu

SEQ ID NO: 4010224 - RNA, 17 nt, Staphylococcus aureus subsp. aureus MW2
auacuuuugcaucacag

SEQ ID NO: 4010225 - RNA, 13 nt, Staphylococcus aureus subsp. aureus MW2
auacuuuuuaaau

SEQ ID NO: 4010226 - RNA, 21 nt, Staphylococcus aureus subsp. aureus MW2
auacuuuuucagaaugaacuu

SEQ ID NO: 4010227 - RNA, 14 nt, Staphylococcus aureus subsp. aureus MW2
auagaaaaaacaag

SEQ ID NO: 4010228 - RNA, 17 nt, Staphylococcus aureus subsp. aureus MW2
auagaaaaagggcaaaa

SEQ ID NO: 4010229 - RNA, 16 nt, Staphylococcus aureus subsp. aureus MW2
auagaaaaauuucaaa

SEQ ID NO: 4010230 - RNA, 21 nt, Staphylococcus aureus subsp. aureus MW2
auagaaaaugaguacaacaua

SEQ ID NO: 4010231 - RNA, 14 nt, Staphylococcus aureus subsp. aureus MW2
auagaaauaacgau

SEQ ID NO: 4010232 - RNA, 18 nt, Staphylococcus aureus subsp. aureus MW2
auagaaauaacgauaccu

SEQ ID NO: 4010233 - RNA, 19 nt, Staphylococcus aureus subsp. aureus MW2
auagaaauaacgauaccuu

SEQ ID NO: 4010234 - RNA, 15 nt, Staphylococcus aureus subsp. aureus MW2
auagaaauaaucaca

SEQ ID NO: 4010235 - RNA, 19 nt, Staphylococcus aureus subsp. aureus MW2
auagaaaucagcuuuucuu

SEQ ID NO: 4010236 - RNA, 12 nt, Staphylococcus aureus subsp. aureus MW2
auagaaaugaua

SEQ ID NO: 4010237 - RNA, 19 nt, Staphylococcus aureus subsp. aureus MW2
auagaaauuguaguauuuu

SEQ ID NO: 4010238 - RNA, 21 nt, Staphylococcus aureus subsp. aureus MW2
auagaaauuguaguauuuuuu

SEQ ID NO: 4010239 - RNA, 20 nt, Staphylococcus aureus subsp. aureus MW2
auagaagaacgaagaaugau

SEQ ID NO: 4010240 - RNA, 15 nt, Staphylococcus aureus subsp. aureus MW2
auagaaguauggaug

SEQ ID NO: 4010241 - RNA, 15 nt, Staphylococcus aureus subsp. aureus MW2
auagaaugucgauau

SEQ ID NO: 4010242 - RNA, 15 nt, Staphylococcus aureus subsp. aureus MW2
auagacaccaaaaac

SEQ ID NO: 4010243 - RNA, 17 nt, Staphylococcus aureus subsp. aureus MW2
auagacauaagcaaaga

SEQ ID NO: 4010244 - RNA, 18 nt, Staphylococcus aureus subsp. aureus MW2
auagacauuguuaaacua

SEQ ID NO: 4010245 - RNA, 16 nt, Staphylococcus aureus subsp. aureus MW2
auagacugccaauaaa

SEQ ID NO: 4010246 - RNA, 14 nt, Staphylococcus aureus subsp. aureus MW2
auagagaaaaaaua

SEQ ID NO: 4010247 - RNA, 19 nt, Staphylococcus aureus subsp. aureus MW2
auagagaaaaaauaaaugu

SEQ ID NO: 4010248 - RNA, 20 nt, Staphylococcus aureus subsp. aureus MW2
auagagaaaaaauaaauguu

SEQ ID NO: 4010249 - RNA, 22 nt, Staphylococcus aureus subsp. aureus MW2
auagaguaguucggaugagaaa

SEQ ID NO: 4010250 - RNA, 13 nt, Staphylococcus aureus subsp. aureus MW2
auagauaaggcua

SEQ ID NO: 4010251 - RNA, 14 nt, Staphylococcus aureus subsp. aureus MW2
auagauaaugcacc

SEQ ID NO: 4010252 - RNA, 15 nt, Staphylococcus aureus subsp. aureus MW2
auagauagaaauugu

SEQ ID NO: 4010253 - RNA, 15 nt, Staphylococcus aureus subsp. aureus MW2
auagauaucauuuua

SEQ ID NO: 4010254 - RNA, 13 nt, Staphylococcus aureus subsp. aureus MW2
auagaucuuugua

SEQ ID NO: 4010255 - RNA, 16 nt, Staphylococcus aureus subsp. aureus MW2
auagaugaaaauuuaa

SEQ ID NO: 4010256 - RNA, 15 nt, Staphylococcus aureus subsp. aureus MW2
auagaugugucuuuu

SEQ ID NO: 4010257 - RNA, 18 nt, Staphylococcus aureus subsp. aureus MW2
auagaugugucuuuuguu

SEQ ID NO: 4010258 - RNA, 15 nt, Staphylococcus aureus subsp. aureus MW2
auagauugaaaaaau

SEQ ID NO: 4010259 - RNA, 23 nt, Staphylococcus aureus subsp. aureus MW2
auagauuuaucaccuuuaggcaa

SEQ ID NO: 4010260 - RNA, 16 nt, Staphylococcus aureus subsp. aureus MW2
auagauuuuucagcug

SEQ ID NO: 4010261 - RNA, 19 nt, Staphylococcus aureus subsp. aureus MW2
auagcaaaauuauguaaaa

SEQ ID NO: 4010262 - RNA, 21 nt, Staphylococcus aureus subsp. aureus MW2
auagcaaccauauuuuuagaa

SEQ ID NO: 4010263 - RNA, 15 nt, Staphylococcus aureus subsp. aureus MW2
auagcacuacaucaa

SEQ ID NO: 4010264 - RNA, 19 nt, Staphylococcus aureus subsp. aureus MW2
auagcacugaaaucuagac

SEQ ID NO: 4010265 - RNA, 20 nt, Staphylococcus aureus subsp. aureus MW2
auagcagguggcauccauau

SEQ ID NO: 4010266 - RNA, 21 nt, Staphylococcus aureus subsp. aureus MW2
auagcauaaaaagagguuuuc

SEQ ID NO: 4010267 - RNA, 22 nt, Staphylococcus aureus subsp. aureus MW2
auagcauaaaauuucugcuucu

SEQ ID NO: 4010268 - RNA, 18 nt, Staphylococcus aureus subsp. aureus MW2
auagccaauauaacaagc

SEQ ID NO: 4010269 - RNA, 17 nt, Staphylococcus aureus subsp. aureus MW2
auagccuauuuaaaaga

SEQ ID NO: 4010270 - RNA, 14 nt, Staphylococcus aureus subsp. aureus MW2
auagccuucaaaau

SEQ ID NO: 4010271 - RNA, 20 nt, Staphylococcus aureus subsp. aureus MW2
auagcgcucuggauuuuucu

SEQ ID NO: 4010272 - RNA, 21 nt, Staphylococcus aureus subsp. aureus MW2
auagcgcucuggauuuuucuu

SEQ ID NO: 4010273 - RNA, 14 nt, Staphylococcus aureus subsp. aureus MW2
auagcgguguuuug

SEQ ID NO: 4010274 - RNA, 17 nt, Staphylococcus aureus subsp. aureus MW2
auagcgguguuuugaga

SEQ ID NO: 4010275 - RNA, 16 nt, Staphylococcus aureus subsp. aureus MW2
auagcuaaugcauuau

SEQ ID NO: 4010276 - RNA, 18 nt, Staphylococcus aureus subsp. aureus MW2
auagcuaaugcauuauua

SEQ ID NO: 4010277 - RNA, 18 nt, Staphylococcus aureus subsp. aureus MW2
auagcuaugauuugauau

SEQ ID NO: 4010278 - RNA, 22 nt, Staphylococcus aureus subsp. aureus MW2
auagcuaugauuugauauuuca

SEQ ID NO: 4010279 - RNA, 17 nt, Staphylococcus aureus subsp. aureus MW2
auagcuccuccaaagcu

SEQ ID NO: 4010280 - RNA, 22 nt, Staphylococcus aureus subsp. aureus MW2
auagcucuucuuuuucuugcau

SEQ ID NO: 4010281 - RNA, 15 nt, Staphylococcus aureus subsp. aureus MW2
auagcuuuacuucuc

SEQ ID NO: 4010282 - RNA, 16 nt, Staphylococcus aureus subsp. aureus MW2
auaggaaacuuaaaua

SEQ ID NO: 4010283 - RNA, 17 nt, Staphylococcus aureus subsp. aureus MW2
auaggauuauuaucaaa

SEQ ID NO: 4010284 - RNA, 20 nt, Staphylococcus aureus subsp. aureus MW2
auaggauuuccuauuaggau

SEQ ID NO: 4010285 - RNA, 21 nt, Staphylococcus aureus subsp. aureus MW2
auaggauuuccuauuaggauc

SEQ ID NO: 4010286 - RNA, 16 nt, Staphylococcus aureus subsp. aureus MW2
auagggcgcacauuau

SEQ ID NO: 4010287 - RNA, 14 nt, Staphylococcus aureus subsp. aureus MW2
auagguaacuaaaa

SEQ ID NO: 4010288 - RNA, 22 nt, Staphylococcus aureus subsp. aureus MW2
auaggugauuauauauauuaaa

SEQ ID NO: 4010289 - RNA, 18 nt, Staphylococcus aureus subsp. aureus MW2
auaguaacagacuuuguu

SEQ ID NO: 4010290 - RNA, 21 nt, Staphylococcus aureus subsp. aureus MW2
auaguaacagacuuuguuaaa

SEQ ID NO: 4010291 - RNA, 13 nt, Staphylococcus aureus subsp. aureus MW2
auaguaaucgauu

SEQ ID NO: 4010292 - RNA, 21 nt, Staphylococcus aureus subsp. aureus MW2
auaguaccaugcucuuuuucc

SEQ ID NO: 4010293 - RNA, 12 nt, Staphylococcus aureus subsp. aureus MW2
auaguaggagug

SEQ ID NO: 4010294 - RNA, 15 nt, Staphylococcus aureus subsp. aureus MW2
auaguauguaucuuu

SEQ ID NO: 4010295 - RNA, 19 nt, Staphylococcus aureus subsp. aureus MW2
auaguauuaacuauaaaua

SEQ ID NO: 4010296 - RNA, 23 nt, Staphylococcus aureus subsp. aureus MW2
auaguauuaacuauaaauagaag

SEQ ID NO: 4010297 - RNA, 14 nt, Staphylococcus aureus subsp. aureus MW2
auagucaucuguua

SEQ ID NO: 4010298 - RNA, 12 nt, Staphylococcus aureus subsp. aureus MW2
auagucaucuua

SEQ ID NO: 4010299 - RNA, 22 nt, Staphylococcus aureus subsp. aureus MW2
auagucauucauaauuuguuga

SEQ ID NO: 4010300 - RNA, 22 nt, Staphylococcus aureus subsp. aureus MW2
auagucugcuauuuuuuuaaua

SEQ ID NO: 4010301 - RNA, 19 nt, Staphylococcus aureus subsp. aureus MW2
auagucuucggcuuuguaa

SEQ ID NO: 4010302 - RNA, 12 nt, Staphylococcus aureus subsp. aureus MW2
auagugaaauua

SEQ ID NO: 4010303 - RNA, 19 nt, Staphylococcus aureus subsp. aureus MW2
auagugcuuguuuauuaca

SEQ ID NO: 4010304 - RNA, 19 nt, Staphylococcus aureus subsp. aureus MW2
auaguggaugcucguauag

SEQ ID NO: 4010305 - RNA, 23 nt, Staphylococcus aureus subsp. aureus MW2
auagugguaaaaaguuuaaagua

SEQ ID NO: 4010306 - RNA, 16 nt, Staphylococcus aureus subsp. aureus MW2
auaguuaagauuuuaa

SEQ ID NO: 4010307 - RNA, 14 nt, Staphylococcus aureus subsp. aureus MW2
auaguuaccaaaau

SEQ ID NO: 4010308 - RNA, 14 nt, Staphylococcus aureus subsp. aureus MW2
auaguucuauauaa

SEQ ID NO: 4010309 - RNA, 18 nt, Staphylococcus aureus subsp. aureus MW2
auauauccugccaauaua

SEQ ID NO: 4010310 - RNA, 21 nt, Staphylococcus aureus subsp. aureus MW2
auauauccugccaauauauuc

SEQ ID NO: 4010311 - RNA, 19 nt, Staphylococcus aureus subsp. aureus MW2
auauaucuagccugaaaua

SEQ ID NO: 4010312 - RNA, 15 nt, Staphylococcus aureus subsp. aureus MW2
auauaugaaauauuu

SEQ ID NO: 4010313 - RNA, 17 nt, Staphylococcus aureus subsp. aureus MW2
auauaugaaauauuuau

SEQ ID NO: 4010314 - RNA, 12 nt, Staphylococcus aureus subsp. aureus MW2
auauaugauaaa

SEQ ID NO: 4010315 - RNA, 14 nt, Staphylococcus aureus subsp. aureus MW2
auauaugauaaaua

SEQ ID NO: 4010316 - RNA, 16 nt, Staphylococcus aureus subsp. aureus MW2
auauauguaacaaaug

SEQ ID NO: 4010317 - RNA, 15 nt, Staphylococcus aureus subsp. aureus MW2
auauauguaacauaa

SEQ ID NO: 4010318 - RNA, 16 nt, Staphylococcus aureus subsp. aureus MW2
auauauguaacauaaa

SEQ ID NO: 4010319 - RNA, 19 nt, Staphylococcus aureus subsp. aureus MW2
auauauguaacauaaagcu

SEQ ID NO: 4010320 - RNA, 12 nt, Staphylococcus aureus subsp. aureus MW2
auauauuaaaaa

SEQ ID NO: 4010321 - RNA, 14 nt, Staphylococcus aureus subsp. aureus MW2
auauauuaaaaauc

SEQ ID NO: 4010322 - RNA, 12 nt, Staphylococcus aureus subsp. aureus MW2
auauauuaauau

SEQ ID NO: 4010323 - RNA, 12 nt, Staphylococcus aureus subsp. aureus MW2
auauauuauaaa

SEQ ID NO: 4010324 - RNA, 15 nt, Staphylococcus aureus subsp. aureus MW2
auauauuauaaaaau

SEQ ID NO: 4010325 - RNA, 17 nt, Staphylococcus aureus subsp. aureus MW2
auauauuauaaaaauag

SEQ ID NO: 4010326 - RNA, 15 nt, Staphylococcus aureus subsp. aureus MW2
auauauucaucucuu

SEQ ID NO: 4010327 - RNA, 13 nt, Staphylococcus aureus subsp. aureus MW2
auauauucguuac

SEQ ID NO: 4010328 - RNA, 18 nt, Staphylococcus aureus subsp. aureus MW2
auauauucuaauugcaca

SEQ ID NO: 4010329 - RNA, 16 nt, Staphylococcus aureus subsp. aureus MW2
auauauuuauuuuuga

SEQ ID NO: 4010330 - RNA, 19 nt, Staphylococcus aureus subsp. aureus MW2
auauauuuauuuuugauag

SEQ ID NO: 4010331 - RNA, 12 nt, Staphylococcus aureus subsp. aureus MW2
auauauuugaaa

SEQ ID NO: 4010332 - RNA, 17 nt, Staphylococcus aureus subsp. aureus MW2
auauauuugaaagguaa

SEQ ID NO: 4010333 - RNA, 21 nt, Staphylococcus aureus subsp. aureus MW2
auauauuuggaggugaugaga

SEQ ID NO: 4010334 - RNA, 21 nt, Staphylococcus aureus subsp. aureus MW2
auaucaaaaaauauguuuaau

SEQ ID NO: 4010335 - RNA, 17 nt, Staphylococcus aureus subsp. aureus MW2
auaucaaaauauaaaau

SEQ ID NO: 4010336 - RNA, 14 nt, Staphylococcus aureus subsp. aureus MW2
auaucaaauacauu

SEQ ID NO: 4010337 - RNA, 17 nt, Staphylococcus aureus subsp. aureus MW2
auaucaaauacauuuca

SEQ ID NO: 4010338 - RNA, 22 nt, Staphylococcus aureus subsp. aureus MW2
auaucaacauguuccgcuacaa

SEQ ID NO: 4010339 - RNA, 14 nt, Staphylococcus aureus subsp. aureus MW2
auaucaagauguuu

SEQ ID NO: 4010340 - RNA, 12 nt, Staphylococcus aureus subsp. aureus MW2
auaucaaguaug

SEQ ID NO: 4010341 - RNA, 18 nt, Staphylococcus aureus subsp. aureus MW2
auaucaauaauucguuga

SEQ ID NO: 4010342 - RNA, 20 nt, Staphylococcus aureus subsp. aureus MW2
auaucaauuguugcaaaaua

SEQ ID NO: 4010343 - RNA, 21 nt, Staphylococcus aureus subsp. aureus MW2
auaucaauuuauuauuaacug

SEQ ID NO: 4010344 - RNA, 21 nt, Staphylococcus aureus subsp. aureus MW2
auaucacaacacauaaauuaa

SEQ ID NO: 4010345 - RNA, 21 nt, Staphylococcus aureus subsp. aureus MW2
auaucagcuuuuucauucacu

SEQ ID NO: 4010346 - RNA, 15 nt, Staphylococcus aureus subsp. aureus MW2
auaucauauucaaaa

SEQ ID NO: 4010347 - RNA, 14 nt, Staphylococcus aureus subsp. aureus MW2
auaucaucucuaug

SEQ ID NO: 4010348 - RNA, 17 nt, Staphylococcus aureus subsp. aureus MW2
auaucaugcaaaacuaa

SEQ ID NO: 4010349 - RNA, 22 nt, Staphylococcus aureus subsp. aureus MW2
auaucaugcgcaauauucguag

SEQ ID NO: 4010350 - RNA, 22 nt, Staphylococcus aureus subsp. aureus MW2
auaucauuauuaccuuugcuaa

SEQ ID NO: 4010351 - RNA, 15 nt, Staphylococcus aureus subsp. aureus MW2
auaucauucauguuc

SEQ ID NO: 4010352 - RNA, 21 nt, Staphylococcus aureus subsp. aureus MW2
auauccacgguuuaccacuua

SEQ ID NO: 4010353 - RNA, 20 nt, Staphylococcus aureus subsp. aureus MW2
auauccauucaauguuuaau

SEQ ID NO: 4010354 - RNA, 21 nt, Staphylococcus aureus subsp. aureus MW2
auauccauucuuuuucaaaau

SEQ ID NO: 4010355 - RNA, 17 nt, Staphylococcus aureus subsp. aureus MW2
auaucccggaauauuaa

SEQ ID NO: 4010356 - RNA, 18 nt, Staphylococcus aureus subsp. aureus MW2
auaucccggaauauuaac

SEQ ID NO: 4010357 - RNA, 22 nt, Staphylococcus aureus subsp. aureus MW2
auauccgaaaauugcuaaaaaa

SEQ ID NO: 4010358 - RNA, 21 nt, Staphylococcus aureus subsp. aureus MW2
auaucgaugacuuugucuuua

SEQ ID NO: 4010359 - RNA, 17 nt, Staphylococcus aureus subsp. aureus MW2
auaucgcgcaucaaaaa

SEQ ID NO: 4010360 - RNA, 17 nt, Staphylococcus aureus subsp. aureus MW2
auaucgcuuuugaaguu

SEQ ID NO: 4010361 - RNA, 17 nt, Staphylococcus aureus subsp. aureus MW2
auaucuacagagaauca

SEQ ID NO: 4010362 - RNA, 14 nt, Staphylococcus aureus subsp. aureus MW2
auaucucaaagauu

SEQ ID NO: 4010363 - RNA, 12 nt, Staphylococcus aureus subsp. aureus MW2
auaucucaagau

SEQ ID NO: 4010364 - RNA, 17 nt, Staphylococcus aureus subsp. aureus MW2
auaucuguauauccauu

SEQ ID NO: 4010365 - RNA, 17 nt, Staphylococcus aureus subsp. aureus MW2
auaucuuaaagaauuaa

SEQ ID NO: 4010366 - RNA, 19 nt, Staphylococcus aureus subsp. aureus MW2
auaucuuaaguacauaaau

SEQ ID NO: 4010367 - RNA, 17 nt, Staphylococcus aureus subsp. aureus MW2
auaucuuauaacaaaaa

SEQ ID NO: 4010368 - RNA, 17 nt, Staphylococcus aureus subsp. aureus MW2
auaucuugcuuggauaa

SEQ ID NO: 4010369 - RNA, 17 nt, Staphylococcus aureus subsp. aureus MW2
auaucuuuuaauguuuu

SEQ ID NO: 4010370 - RNA, 11 nt, Staphylococcus aureus subsp. aureus MW2
auaugaaaugu

SEQ ID NO: 4010371 - RNA, 13 nt, Staphylococcus aureus subsp. aureus MW2
auaugaacaaaaa

SEQ ID NO: 4010372 - RNA, 14 nt, Staphylococcus aureus subsp. aureus MW2
auaugaauaaccau

SEQ ID NO: 4010373 - RNA, 16 nt, Staphylococcus aureus subsp. aureus MW2
auaugaauaaugcaau

SEQ ID NO: 4010374 - RNA, 21 nt, Staphylococcus aureus subsp. aureus MW2
auaugaauggcauuuaauacu

SEQ ID NO: 4010375 - RNA, 20 nt, Staphylococcus aureus subsp. aureus MW2
auaugaauuuagaugcauaa

SEQ ID NO: 4010376 - RNA, 13 nt, Staphylococcus aureus subsp. aureus MW2
auaugaauuuuau

SEQ ID NO: 4010377 - RNA, 23 nt, Staphylococcus aureus subsp. aureus MW2
auaugaccuuuaugugcaucauu

SEQ ID NO: 4010378 - RNA, 21 nt, Staphylococcus aureus subsp. aureus MW2
auaugacgcgugaauuaaaaa

SEQ ID NO: 4010379 - RNA, 20 nt, Staphylococcus aureus subsp. aureus MW2
auaugacuuuuuauuaguau

SEQ ID NO: 4010380 - RNA, 17 nt, Staphylococcus aureus subsp. aureus MW2
auaugaguuacaugguu

SEQ ID NO: 4010381 - RNA, 13 nt, Staphylococcus aureus subsp. aureus MW2
auaugauaaauau

SEQ ID NO: 4010382 - RNA, 12 nt, Staphylococcus aureus subsp. aureus MW2
auaugauaacca

SEQ ID NO: 4010383 - RNA, 15 nt, Staphylococcus aureus subsp. aureus MW2
auaugauaaccaaac

SEQ ID NO: 4010384 - RNA, 17 nt, Staphylococcus aureus subsp. aureus MW2
auaugauguuaaaaaau

SEQ ID NO: 4010385 - RNA, 20 nt, Staphylococcus aureus subsp. aureus MW2
auaugauuacaacuuauucu

SEQ ID NO: 4010386 - RNA, 18 nt, Staphylococcus aureus subsp. aureus MW2
auaugauugcaaauuauc

SEQ ID NO: 4010387 - RNA, 12 nt, Staphylococcus aureus subsp. aureus MW2
auaugauuuaaa

SEQ ID NO: 4010388 - RNA, 23 nt, Staphylococcus aureus subsp. aureus MW2
auaugcacuuuuuauacauuaac

SEQ ID NO: 4010389 - RNA, 12 nt, Staphylococcus aureus subsp. aureus MW2
auaugcauauau

SEQ ID NO: 4010390 - RNA, 16 nt, Staphylococcus aureus subsp. aureus MW2
auaugcaucaacagau

SEQ ID NO: 4010391 - RNA, 18 nt, Staphylococcus aureus subsp. aureus MW2
auaugcuauguaaaucgu

SEQ ID NO: 4010392 - RNA, 21 nt, Staphylococcus aureus subsp. aureus MW2
auaugcuugcugugaauaaaa

SEQ ID NO: 4010393 - RNA, 23 nt, Staphylococcus aureus subsp. aureus MW2
auaugcuugcugugaauaaaauu

SEQ ID NO: 4010394 - RNA, 15 nt, Staphylococcus aureus subsp. aureus MW2
auauggaaaauguau

SEQ ID NO: 4010395 - RNA, 14 nt, Staphylococcus aureus subsp. aureus MW2
auauggauuuugaa

SEQ ID NO: 4010396 - RNA, 23 nt, Staphylococcus aureus subsp. aureus MW2
auauggcaucaucaccauacuaa

SEQ ID NO: 4010397 - RNA, 15 nt, Staphylococcus aureus subsp. aureus MW2
auaugguuagaaaaa

SEQ ID NO: 4010398 - RNA, 12 nt, Staphylococcus aureus subsp. aureus MW2
auauuuaaacua

SEQ ID NO: 4010399 - RNA, 22 nt, Staphylococcus aureus subsp. aureus MW2
auauuuaaacucauaauuuucu

SEQ ID NO: 4010400 - RNA, 12 nt, Staphylococcus aureus subsp. aureus MW2
auauuuaaauag

SEQ ID NO: 4010401 - RNA, 13 nt, Staphylococcus aureus subsp. aureus MW2
auauuuacacaga

SEQ ID NO: 4010402 - RNA, 17 nt, Staphylococcus aureus subsp. aureus MW2
auauuuacacagaauga

SEQ ID NO: 4010403 - RNA, 21 nt, Staphylococcus aureus subsp. aureus MW2
auauuuacacagaaugauaua

SEQ ID NO: 4010404 - RNA, 19 nt, Staphylococcus aureus subsp. aureus MW2
auauuuagauuuauaacga

SEQ ID NO: 4010405 - RNA, 21 nt, Staphylococcus aureus subsp. aureus MW2
auauuuagguaauacaucauc

SEQ ID NO: 4010406 - RNA, 14 nt, Staphylococcus aureus subsp. aureus MW2
auauuuauuuuaaa

SEQ ID NO: 4010407 - RNA, 18 nt, Staphylococcus aureus subsp. aureus MW2
auauuuauuuuaaauuuu

SEQ ID NO: 4010408 - RNA, 14 nt, Staphylococcus aureus subsp. aureus MW2
auauuuauuuuaua

SEQ ID NO: 4010409 - RNA, 14 nt, Staphylococcus aureus subsp. aureus MW2
auauuuauuuuuga

SEQ ID NO: 4010410 - RNA, 16 nt, Staphylococcus aureus subsp. aureus MW2
auauuucauuugacug

SEQ ID NO: 4010411 - RNA, 19 nt, Staphylococcus aureus subsp. aureus MW2
auauuucccuaugaaauaa

SEQ ID NO: 4010412 - RNA, 22 nt, Staphylococcus aureus subsp. aureus MW2
auauuucgguuagucuuaaucc

SEQ ID NO: 4010413 - RNA, 14 nt, Staphylococcus aureus subsp. aureus MW2
auauuucuaaauua

SEQ ID NO: 4010414 - RNA, 21 nt, Staphylococcus aureus subsp. aureus MW2
auauuucugggcuuucuuuuu

SEQ ID NO: 4010415 - RNA, 23 nt, Staphylococcus aureus subsp. aureus MW2
auauuucuguuuuccuuuugaau

SEQ ID NO: 4010416 - RNA, 15 nt, Staphylococcus aureus subsp. aureus MW2
auauuucuuaccauu

SEQ ID NO: 4010417 - RNA, 21 nt, Staphylococcus aureus subsp. aureus MW2
auauuugaaagguaaguacuu

SEQ ID NO: 4010418 - RNA, 16 nt, Staphylococcus aureus subsp. aureus MW2
auauuugauaacaaaa

SEQ ID NO: 4010419 - RNA, 20 nt, Staphylococcus aureus subsp. aureus MW2
auauuugauaacaaaaugau

SEQ ID NO: 4010420 - RNA, 20 nt, Staphylococcus aureus subsp. aureus MW2
auauuugcuagucauaauuu

SEQ ID NO: 4010421 - RNA, 18 nt, Staphylococcus aureus subsp. aureus MW2
auauuuuauuuaaaaaua

SEQ ID NO: 4010422 - RNA, 22 nt, Staphylococcus aureus subsp. aureus MW2
auauuuuauuuaaaaauagccu

SEQ ID NO: 4010423 - RNA, 11 nt, Staphylococcus aureus subsp. aureus MW2
auauuuucuua

SEQ ID NO: 4010424 - RNA, 12 nt, Staphylococcus aureus subsp. aureus MW2
auauuuugauuu

SEQ ID NO: 4010425 - RNA, 16 nt, Staphylococcus aureus subsp. aureus MW2
auauuuuuacauauuu

SEQ ID NO: 4010426 - RNA, 18 nt, Staphylococcus aureus subsp. aureus MW2
auauuuuuacauauuuau

SEQ ID NO: 4010427 - RNA, 12 nt, Staphylococcus aureus subsp. aureus MW2
auauuuuucuuc

SEQ ID NO: 4010428 - RNA, 19 nt, Staphylococcus aureus subsp. aureus MW2
auauuuuucuucaguuaaa

SEQ ID NO: 4010429 - RNA, 12 nt, Staphylococcus aureus subsp. aureus MW2
auauuuuuuaau

SEQ ID NO: 4010430 - RNA, 19 nt, Staphylococcus aureus subsp. aureus MW2
auauuuuuuacaagcuuua

SEQ ID NO: 4010431 - RNA, 23 nt, Staphylococcus aureus subsp. aureus MW2
auauuuuuuacaagcuuuauaaa

SEQ ID NO: 4010432 - RNA, 14 nt, Staphylococcus aureus subsp. aureus MW2
auauuuuuucugug

SEQ ID NO: 4010433 - RNA, 17 nt, Staphylococcus aureus subsp. aureus MW2
auauuuuuugauauaaa

SEQ ID NO: 4010434 - RNA, 22 nt, Staphylococcus aureus subsp. aureus MW2
aucaaaaaaacaaaaaauaauu

SEQ ID NO: 4010435 - RNA, 13 nt, Staphylococcus aureus subsp. aureus MW2
aucaaaaauaaaa

SEQ ID NO: 4010436 - RNA, 14 nt, Staphylococcus aureus subsp. aureus MW2
aucaaaaauaaaaa

SEQ ID NO: 4010437 - RNA, 20 nt, Staphylococcus aureus subsp. aureus MW2
aucaaaaccgcuauaaaauu

SEQ ID NO: 4010438 - RNA, 23 nt, Staphylococcus aureus subsp. aureus MW2
aucaaaauauaaaauccuaagca

SEQ ID NO: 4010439 - RNA, 22 nt, Staphylococcus aureus subsp. aureus MW2
aucaaagaaaaagugauaauua

SEQ ID NO: 4010440 - RNA, 23 nt, Staphylococcus aureus subsp. aureus MW2
aucaaagaaaaagugauaauuaa

SEQ ID NO: 4010441 - RNA, 20 nt, Staphylococcus aureus subsp. aureus MW2
aucaaagaggcuuuaaaauu

SEQ ID NO: 4010442 - RNA, 20 nt, Staphylococcus aureus subsp. aureus MW2
aucaaagaguaaaguuaaaa

SEQ ID NO: 4010443 - RNA, 14 nt, Staphylococcus aureus subsp. aureus MW2
aucaaaguaucagu

SEQ ID NO: 4010444 - RNA, 16 nt, Staphylococcus aureus subsp. aureus MW2
aucaaaguaucuuuug

SEQ ID NO: 4010445 - RNA, 17 nt, Staphylococcus aureus subsp. aureus MW2
aucaaaguaucuuuugc

SEQ ID NO: 4010446 - RNA, 21 nt, Staphylococcus aureus subsp. aureus MW2
aucaaagucuucuucaacaau

SEQ ID NO: 4010447 - RNA, 17 nt, Staphylococcus aureus subsp. aureus MW2
aucaaauacauuucaaa

SEQ ID NO: 4010448 - RNA, 18 nt, Staphylococcus aureus subsp. aureus MW2
aucaaauacauuucaaaa

SEQ ID NO: 4010449 - RNA, 19 nt, Staphylococcus aureus subsp. aureus MW2
aucaaauagacaccaaaaa

SEQ ID NO: 4010450 - RNA, 13 nt, Staphylococcus aureus subsp. aureus MW2
aucaaaucaauau

SEQ ID NO: 4010451 - RNA, 22 nt, Staphylococcus aureus subsp. aureus MW2
aucaaaugguacaguuaauucu

SEQ ID NO: 4010452 - RNA, 20 nt, Staphylococcus aureus subsp. aureus MW2
aucaaauuacaaauuaucua

SEQ ID NO: 4010453 - RNA, 11 nt, Staphylococcus aureus subsp. aureus MW2
aucaaauuacc

SEQ ID NO: 4010454 - RNA, 13 nt, Staphylococcus aureus subsp. aureus MW2
aucaaauuaccau

SEQ ID NO: 4010455 - RNA, 13 nt, Staphylococcus aureus subsp. aureus MW2
aucaaauucaaau

SEQ ID NO: 4010456 - RNA, 18 nt, Staphylococcus aureus subsp. aureus MW2
aucaaauucaaauuauaa

SEQ ID NO: 4010457 - RNA, 14 nt, Staphylococcus aureus subsp. aureus MW2
aucaacaaauuuaa

SEQ ID NO: 4010458 - RNA, 13 nt, Staphylococcus aureus subsp. aureus MW2
aucaacaauauaa

SEQ ID NO: 4010459 - RNA, 15 nt, Staphylococcus aureus subsp. aureus MW2
aucaacaauauaaaa

SEQ ID NO: 4010460 - RNA, 14 nt, Staphylococcus aureus subsp. aureus MW2
aucaacacacacag

SEQ ID NO: 4010461 - RNA, 23 nt, Staphylococcus aureus subsp. aureus MW2
aucaacacacacaguuuauaaua

SEQ ID NO: 4010462 - RNA, 17 nt, Staphylococcus aureus subsp. aureus MW2
aucaacccaucauguac

SEQ ID NO: 4010463 - RNA, 14 nt, Staphylococcus aureus subsp. aureus MW2
aucaaccuguucuu

SEQ ID NO: 4010464 - RNA, 18 nt, Staphylococcus aureus subsp. aureus MW2
aucaaccuguucuuuauu

SEQ ID NO: 4010465 - RNA, 20 nt, Staphylococcus aureus subsp. aureus MW2
aucaaccuuugcuaaaucaa

SEQ ID NO: 4010466 - RNA, 16 nt, Staphylococcus aureus subsp. aureus MW2
aucaacgagucauaaa

SEQ ID NO: 4010467 - RNA, 19 nt, Staphylococcus aureus subsp. aureus MW2
aucaacgagucauaaauau

SEQ ID NO: 4010468 - RNA, 18 nt, Staphylococcus aureus subsp. aureus MW2
aucaacgccauauuuauu

SEQ ID NO: 4010469 - RNA, 17 nt, Staphylococcus aureus subsp. aureus MW2
aucaacugcuucacgau

SEQ ID NO: 4010470 - RNA, 14 nt, Staphylococcus aureus subsp. aureus MW2
aucaacuucauaua

SEQ ID NO: 4010471 - RNA, 17 nt, Staphylococcus aureus subsp. aureus MW2
aucaacuugaauguaug

SEQ ID NO: 4010472 - RNA, 18 nt, Staphylococcus aureus subsp. aureus MW2
aucaacuuuaaucaaaaa

SEQ ID NO: 4010473 - RNA, 19 nt, Staphylococcus aureus subsp. aureus MW2
aucaacuuuuuguuaauuu

SEQ ID NO: 4010474 - RNA, 13 nt, Staphylococcus aureus subsp. aureus MW2
aucaagaaauguu

SEQ ID NO: 4010475 - RNA, 19 nt, Staphylococcus aureus subsp. aureus MW2
aucaagaaauguuaaauua

SEQ ID NO: 4010476 - RNA, 13 nt, Staphylococcus aureus subsp. aureus MW2
aucaagaauauaa

SEQ ID NO: 4010477 - RNA, 22 nt, Staphylococcus aureus subsp. aureus MW2
aucaagacauuuuaacaaguga

SEQ ID NO: 4010478 - RNA, 22 nt, Staphylococcus aureus subsp. aureus MW2
aucaagacucccuuuuuaaaau

SEQ ID NO: 4010479 - RNA, 16 nt, Staphylococcus aureus subsp. aureus MW2
aucaagagguaaaucu

SEQ ID NO: 4010480 - RNA, 22 nt, Staphylococcus aureus subsp. aureus MW2
aucaagguguccuuuuuauuuu

SEQ ID NO: 4010481 - RNA, 17 nt, Staphylococcus aureus subsp. aureus MW2
aucaaguaguuaucuaa

SEQ ID NO: 4010482 - RNA, 22 nt, Staphylococcus aureus subsp. aureus MW2
aucaaguaugcgccauacauau

SEQ ID NO: 4010483 - RNA, 16 nt, Staphylococcus aureus subsp. aureus MW2
aucaauaacuauaauc

SEQ ID NO: 4010484 - RNA, 14 nt, Staphylococcus aureus subsp. aureus MW2
aucaauaguuuaua

SEQ ID NO: 4010485 - RNA, 16 nt, Staphylococcus aureus subsp. aureus MW2
aucaauaguuuauaau

SEQ ID NO: 4010486 - RNA, 15 nt, Staphylococcus aureus subsp. aureus MW2
aucaauauaauuugg

SEQ ID NO: 4010487 - RNA, 16 nt, Staphylococcus aureus subsp. aureus MW2
aucaucuauauuuaau

SEQ ID NO: 4010488 - RNA, 11 nt, Staphylococcus aureus subsp. aureus MW2
aucaucuauuc

SEQ ID NO: 4010489 - RNA, 14 nt, Staphylococcus aureus subsp. aureus MW2
aucaucuauucaaa

SEQ ID NO: 4010490 - RNA, 23 nt, Staphylococcus aureus subsp. aureus MW2
aucaucuccuugguuauuaaaau

SEQ ID NO: 4010491 - RNA, 15 nt, Staphylococcus aureus subsp. aureus MW2
aucaucuuaacaauu

SEQ ID NO: 4010492 - RNA, 19 nt, Staphylococcus aureus subsp. aureus MW2
aucaucuuaacaauuuuaa

SEQ ID NO: 4010493 - RNA, 18 nt, Staphylococcus aureus subsp. aureus MW2
aucaugaaauuaaaaaca

SEQ ID NO: 4010494 - RNA, 14 nt, Staphylococcus aureus subsp. aureus MW2
aucaugauuacuaa

SEQ ID NO: 4010495 - RNA, 12 nt, Staphylococcus aureus subsp. aureus MW2
aucaugauuauu

SEQ ID NO: 4010496 - RNA, 15 nt, Staphylococcus aureus subsp. aureus MW2
aucaugcaaaacuaa

SEQ ID NO: 4010497 - RNA, 16 nt, Staphylococcus aureus subsp. aureus MW2
aucaugccuucaugaa

SEQ ID NO: 4010498 - RNA, 14 nt, Staphylococcus aureus subsp. aureus MW2
aucaugcgcaauau

SEQ ID NO: 4010499 - RNA, 15 nt, Staphylococcus aureus subsp. aureus MW2
aucaugcgcaauauu

SEQ ID NO: 4010500 - RNA, 17 nt, Staphylococcus aureus subsp. aureus MW2
aucaugcucguuuuuau

SEQ ID NO: 4010501 - RNA, 18 nt, Staphylococcus aureus subsp. aureus MW2
aucauggcacaucagaua

SEQ ID NO: 4010502 - RNA, 22 nt, Staphylococcus aureus subsp. aureus MW2
aucauggcuuauacacuuacaa

SEQ ID NO: 4010503 - RNA, 21 nt, Staphylococcus aureus subsp. aureus MW2
aucauggucaacuuuuuuaac

SEQ ID NO: 4010504 - RNA, 19 nt, Staphylococcus aureus subsp. aureus MW2
aucauguacaguuacuuuc

SEQ ID NO: 4010505 - RNA, 18 nt, Staphylococcus aureus subsp. aureus MW2
aucaugucgaaucaaagu

SEQ ID NO: 4010506 - RNA, 23 nt, Staphylococcus aureus subsp. aureus MW2
aucauguuccccauuaauuaaca

SEQ ID NO: 4010507 - RNA, 20 nt, Staphylococcus aureus subsp. aureus MW2
aucauguucuaaugcugcuu

SEQ ID NO: 4010508 - RNA, 11 nt, Staphylococcus aureus subsp. aureus MW2
aucauuaaaau

SEQ ID NO: 4010509 - RNA, 12 nt, Staphylococcus aureus subsp. aureus MW2
aucauuaaaauc

SEQ ID NO: 4010510 - RNA, 22 nt, Staphylococcus aureus subsp. aureus MW2
aucauuaaauugcuugaaauua

SEQ ID NO: 4010511 - RNA, 15 nt, Staphylococcus aureus subsp. aureus MW2
aucauuaauaauuaa

SEQ ID NO: 4010512 - RNA, 14 nt, Staphylococcus aureus subsp. aureus MW2
aucauuagauaaua

SEQ ID NO: 4010513 - RNA, 20 nt, Staphylococcus aureus subsp. aureus MW2
aucauuaguguagaaaauag

SEQ ID NO: 4010514 - RNA, 16 nt, Staphylococcus aureus subsp. aureus MW2
aucauuaguuuuuaaa

SEQ ID NO: 4010515 - RNA, 21 nt, Staphylococcus aureus subsp. aureus MW2
aucauuaguuuuuaaaauuau

SEQ ID NO: 4010516 - RNA, 14 nt, Staphylococcus aureus subsp. aureus MW2
aucauuaucaaaua

SEQ ID NO: 4010517 - RNA, 19 nt, Staphylococcus aureus subsp. aureus MW2
aucauuauuugauaaauaa

SEQ ID NO: 4010518 - RNA, 20 nt, Staphylococcus aureus subsp. aureus MW2
aucauucccugcagcaauca

SEQ ID NO: 4010519 - RNA, 21 nt, Staphylococcus aureus subsp. aureus MW2
aucauucccugcagcaaucac

SEQ ID NO: 4010520 - RNA, 18 nt, Staphylococcus aureus subsp. aureus MW2
aucauugaauguuggauc

SEQ ID NO: 4010521 - RNA, 22 nt, Staphylococcus aureus subsp. aureus MW2
aucauugauauagucaaugaau

SEQ ID NO: 4010522 - RNA, 13 nt, Staphylococcus aureus subsp. aureus MW2
aucauuguaaaug

SEQ ID NO: 4010523 - RNA, 20 nt, Staphylococcus aureus subsp. aureus MW2
aucauuguggcuuuuuuuau

SEQ ID NO: 4010524 - RNA, 23 nt, Staphylococcus aureus subsp. aureus MW2
aucauuguguccauaaauauuaa

SEQ ID NO: 4010525 - RNA, 19 nt, Staphylococcus aureus subsp. aureus MW2
aucauuuaaaauauuuuuu

SEQ ID NO: 4010526 - RNA, 18 nt, Staphylococcus aureus subsp. aureus MW2
aucauuuacuuuagaaac

SEQ ID NO: 4010527 - RNA, 14 nt, Staphylococcus aureus subsp. aureus MW2
aucauuucaaauaa

SEQ ID NO: 4010528 - RNA, 15 nt, Staphylococcus aureus subsp. aureus MW2
aucauuucaaauaag

SEQ ID NO: 4010529 - RNA, 12 nt, Staphylococcus aureus subsp. aureus MW2
aucauuucuguc

SEQ ID NO: 4010530 - RNA, 18 nt, Staphylococcus aureus subsp. aureus MW2
aucauuuggcguucaaca

SEQ ID NO: 4010531 - RNA, 18 nt, Staphylococcus aureus subsp. aureus MW2
aucauuuguguuuuuaau

SEQ ID NO: 4010532 - RNA, 22 nt, Staphylococcus aureus subsp. aureus MW2
aucauuuguguuuuuaauguuu

SEQ ID NO: 4010533 - RNA, 15 nt, Staphylococcus aureus subsp. aureus MW2
aucauuuucaauacu

SEQ ID NO: 4010534 - RNA, 17 nt, Staphylococcus aureus subsp. aureus MW2
aucauuuucuugauuuu

SEQ ID NO: 4010535 - RNA, 19 nt, Staphylococcus aureus subsp. aureus MW2
aucauuuucuugauuuuag

SEQ ID NO: 4010536 - RNA, 14 nt, Staphylococcus aureus subsp. aureus MW2
aucauuuuuucaau

SEQ ID NO: 4010537 - RNA, 15 nt, Staphylococcus aureus subsp. aureus MW2
aucauuuuuucaaua

SEQ ID NO: 4010538 - RNA, 14 nt, Staphylococcus aureus subsp. aureus MW2
auccaaaacauuuu

SEQ ID NO: 4010539 - RNA, 18 nt, Staphylococcus aureus subsp. aureus MW2
auccaaaauccugaaauu

SEQ ID NO: 4010540 - RNA, 11 nt, Staphylococcus aureus subsp. aureus MW2
auccaaaccaa

SEQ ID NO: 4010541 - RNA, 20 nt, Staphylococcus aureus subsp. aureus MW2
auccaaagaaacggaaauga

SEQ ID NO: 4010542 - RNA, 16 nt, Staphylococcus aureus subsp. aureus MW2
auccaaagacauacag

SEQ ID NO: 4010543 - RNA, 13 nt, Staphylococcus aureus subsp. aureus MW2
auccaaauauuaa

SEQ ID NO: 4010544 - RNA, 23 nt, Staphylococcus aureus subsp. aureus MW2
auccaaggauguuauaaaaugaa

SEQ ID NO: 4010545 - RNA, 20 nt, Staphylococcus aureus subsp. aureus MW2
auccaagucuaaaugcaaua

SEQ ID NO: 4010546 - RNA, 21 nt, Staphylococcus aureus subsp. aureus MW2
auccaagucuaaaugcaauau

SEQ ID NO: 4010547 - RNA, 20 nt, Staphylococcus aureus subsp. aureus MW2
auccaagugacaacauuauu

SEQ ID NO: 4010548 - RNA, 13 nt, Staphylococcus aureus subsp. aureus MW2
auccaaugaugaa

SEQ ID NO: 4010549 - RNA, 17 nt, Staphylococcus aureus subsp. aureus MW2
auccaauuuauaaugau

SEQ ID NO: 4010550 - RNA, 15 nt, Staphylococcus aureus subsp. aureus MW2
auccacgguuuacca

SEQ ID NO: 4010551 - RNA, 17 nt, Staphylococcus aureus subsp. aureus MW2
auccaguaaucaaagau

SEQ ID NO: 4010552 - RNA, 22 nt, Staphylococcus aureus subsp. aureus MW2
auccaguccuuuuuuuauguuu

SEQ ID NO: 4010553 - RNA, 15 nt, Staphylococcus aureus subsp. aureus MW2
auccaguuaauuauu

SEQ ID NO: 4010554 - RNA, 19 nt, Staphylococcus aureus subsp. aureus MW2
auccaguuaauuauuuaga

SEQ ID NO: 4010555 - RNA, 21 nt, Staphylococcus aureus subsp. aureus MW2
auccauauauguaacaaaugc

SEQ ID NO: 4010556 - RNA, 15 nt, Staphylococcus aureus subsp. aureus MW2
auccaucaauaccau

SEQ ID NO: 4010557 - RNA, 13 nt, Staphylococcus aureus subsp. aureus MW2
auccaucuaauuc

SEQ ID NO: 4010558 - RNA, 12 nt, Staphylococcus aureus subsp. aureus MW2
auccaucuacac

SEQ ID NO: 4010559 - RNA, 15 nt, Staphylococcus aureus subsp. aureus MW2
auccauucaauguuu

SEQ ID NO: 4010560 - RNA, 23 nt, Staphylococcus aureus subsp. aureus MW2
auccauucccuuuucaucaaauu

SEQ ID NO: 4010561 - RNA, 12 nt, Staphylococcus aureus subsp. aureus MW2
auccauucuuuu

SEQ ID NO: 4010562 - RNA, 15 nt, Staphylococcus aureus subsp. aureus MW2
auccauucuuuuuca

SEQ ID NO: 4010563 - RNA, 17 nt, Staphylococcus aureus subsp. aureus MW2
auccauucuuuuucaaa

SEQ ID NO: 4010564 - RNA, 15 nt, Staphylococcus aureus subsp. aureus MW2
auccauuuuuugccu

SEQ ID NO: 4010565 - RNA, 18 nt, Staphylococcus aureus subsp. aureus MW2
aucccaaccaugcuuuuu

SEQ ID NO: 4010566 - RNA, 20 nt, Staphylococcus aureus subsp. aureus MW2
aucccaaguuacgauaucau

SEQ ID NO: 4010567 - RNA, 19 nt, Staphylococcus aureus subsp. aureus MW2
aucccauuggcaucacaua

SEQ ID NO: 4010568 - RNA, 16 nt, Staphylococcus aureus subsp. aureus MW2
aucccucuaucaaauu

SEQ ID NO: 4010569 - RNA, 15 nt, Staphylococcus aureus subsp. aureus MW2
aucccuguaaaacca

SEQ ID NO: 4010570 - RNA, 17 nt, Staphylococcus aureus subsp. aureus MW2
auccuaaauuauaaaua

SEQ ID NO: 4010571 - RNA, 19 nt, Staphylococcus aureus subsp. aureus MW2
auccuaagcauaaaucaac

SEQ ID NO: 4010572 - RNA, 22 nt, Staphylococcus aureus subsp. aureus MW2
auccuacgacacguguaaaaau

SEQ ID NO: 4010573 - RNA, 23 nt, Staphylococcus aureus subsp. aureus MW2
auccuacgacacguguaaaaaug

SEQ ID NO: 4010574 - RNA, 20 nt, Staphylococcus aureus subsp. aureus MW2
auccuauggcgcaauuuuua

SEQ ID NO: 4010575 - RNA, 16 nt, Staphylococcus aureus subsp. aureus MW2
auccucaguuauacca

SEQ ID NO: 4010576 - RNA, 13 nt, Staphylococcus aureus subsp. aureus MW2
aucuauaaauacu

SEQ ID NO: 4010577 - RNA, 19 nt, Staphylococcus aureus subsp. aureus MW2
aucuauaaauuauuuuuga

SEQ ID NO: 4010578 - RNA, 13 nt, Staphylococcus aureus subsp. aureus MW2
aucuauaagauuu

SEQ ID NO: 4010579 - RNA, 14 nt, Staphylococcus aureus subsp. aureus MW2
aucuauaauauuca

SEQ ID NO: 4010580 - RNA, 19 nt, Staphylococcus aureus subsp. aureus MW2
aucuauacaauuauggaua

SEQ ID NO: 4010581 - RNA, 14 nt, Staphylococcus aureus subsp. aureus MW2
aucuauacuuuauc

SEQ ID NO: 4010582 - RNA, 19 nt, Staphylococcus aureus subsp. aureus MW2
aucuauaggucuacaaaug

SEQ ID NO: 4010583 - RNA, 16 nt, Staphylococcus aureus subsp. aureus MW2
aucuauauaaauguuu

SEQ ID NO: 4010584 - RNA, 14 nt, Staphylococcus aureus subsp. aureus MW2
aucuauauuuaauu

SEQ ID NO: 4010585 - RNA, 18 nt, Staphylococcus aureus subsp. aureus MW2
aucuaucgguaauuuuug

SEQ ID NO: 4010586 - RNA, 23 nt, Staphylococcus aureus subsp. aureus MW2
aucuaugauaugugaaaaagcua

SEQ ID NO: 4010587 - RNA, 22 nt, Staphylococcus aureus subsp. aureus MW2
aucuaugguuaugguguguugg

SEQ ID NO: 4010588 - RNA, 20 nt, Staphylococcus aureus subsp. aureus MW2
aucuauguauaguaacgcau

SEQ ID NO: 4010589 - RNA, 16 nt, Staphylococcus aureus subsp. aureus MW2
aucuauucaaauauaa

SEQ ID NO: 4010590 - RNA, 15 nt, Staphylococcus aureus subsp. aureus MW2
aucuauucaaaugau

SEQ ID NO: 4010591 - RNA, 20 nt, Staphylococcus aureus subsp. aureus MW2
aucuauuuaucauacuucaa

SEQ ID NO: 4010592 - RNA, 19 nt, Staphylococcus aureus subsp. aureus MW2
aucuauuuuaaacucaucc

SEQ ID NO: 4010593 - RNA, 15 nt, Staphylococcus aureus subsp. aureus MW2
aucuauuuuuaacua

SEQ ID NO: 4010594 - RNA, 20 nt, Staphylococcus aureus subsp. aureus MW2
aucucaauccaauuaaauau

SEQ ID NO: 4010595 - RNA, 20 nt, Staphylococcus aureus subsp. aureus MW2
aucucauacuauacaaugua

SEQ ID NO: 4010596 - RNA, 17 nt, Staphylococcus aureus subsp. aureus MW2
aucucaugccaaaaaca

SEQ ID NO: 4010597 - RNA, 13 nt, Staphylococcus aureus subsp. aureus MW2
aucucauucuuua

SEQ ID NO: 4010598 - RNA, 20 nt, Staphylococcus aureus subsp. aureus MW2
aucucauucuuuaauauaaa

SEQ ID NO: 4010599 - RNA, 19 nt, Staphylococcus aureus subsp. aureus MW2
aucuccgcuacaauuauau

SEQ ID NO: 4010600 - RNA, 16 nt, Staphylococcus aureus subsp. aureus MW2
aucucggcauuuuuau

SEQ ID NO: 4010601 - RNA, 14 nt, Staphylococcus aureus subsp. aureus MW2
aucucuaaauccuu

SEQ ID NO: 4010602 - RNA, 14 nt, Staphylococcus aureus subsp. aureus MW2
aucucuauuuuuua

SEQ ID NO: 4010603 - RNA, 13 nt, Staphylococcus aureus subsp. aureus MW2
aucucuuauaagu

SEQ ID NO: 4010604 - RNA, 19 nt, Staphylococcus aureus subsp. aureus MW2
aucugaaaauaucacugaa

SEQ ID NO: 4010605 - RNA, 18 nt, Staphylococcus aureus subsp. aureus MW2
aucugaagguaauuuaac

SEQ ID NO: 4010606 - RNA, 12 nt, Staphylococcus aureus subsp. aureus MW2
aucugaaucugc

SEQ ID NO: 4010607 - RNA, 14 nt, Staphylococcus aureus subsp. aureus MW2
aucugacauuuaaa

SEQ ID NO: 4010608 - RNA, 12 nt, Staphylococcus aureus subsp. aureus MW2
aucugacauuuc

SEQ ID NO: 4010609 - RNA, 21 nt, Staphylococcus aureus subsp. aureus MW2
aucugauuguucauguuuaaa

SEQ ID NO: 4010610 - RNA, 13 nt, Staphylococcus aureus subsp. aureus MW2
aucugauuucacu

SEQ ID NO: 4010611 - RNA, 19 nt, Staphylococcus aureus subsp. aureus MW2
aucugcaaaugccucuuuu

SEQ ID NO: 4010612 - RNA, 17 nt, Staphylococcus aureus subsp. aureus MW2
aucugcaacgauuuuaa

SEQ ID NO: 4010613 - RNA, 13 nt, Staphylococcus aureus subsp. aureus MW2
aucugcaacuaau

SEQ ID NO: 4010614 - RNA, 17 nt, Staphylococcus aureus subsp. aureus MW2
aucugcaugguuugcug

SEQ ID NO: 4010615 - RNA, 13 nt, Staphylococcus aureus subsp. aureus MW2
aucugcauuuaau

SEQ ID NO: 4010616 - RNA, 16 nt, Staphylococcus aureus subsp. aureus MW2
aucuggcaaauugccu

SEQ ID NO: 4010617 - RNA, 18 nt, Staphylococcus aureus subsp. aureus MW2
aucuggcguuaaccauuu

SEQ ID NO: 4010618 - RNA, 19 nt, Staphylococcus aureus subsp. aureus MW2
aucuguaccguauuuuaau

SEQ ID NO: 4010619 - RNA, 15 nt, Staphylococcus aureus subsp. aureus MW2
aucuguagguuuaau

SEQ ID NO: 4010620 - RNA, 15 nt, Staphylococcus aureus subsp. aureus MW2
aucuguauauccauu

SEQ ID NO: 4010621 - RNA, 17 nt, Staphylococcus aureus subsp. aureus MW2
aucuguauauccauucu

SEQ ID NO: 4010622 - RNA, 12 nt, Staphylococcus aureus subsp. aureus MW2
aucuguaucaaa

SEQ ID NO: 4010623 - RNA, 22 nt, Staphylococcus aureus subsp. aureus MW2
aucuguaucaaagucucuagua

SEQ ID NO: 4010624 - RNA, 16 nt, Staphylococcus aureus subsp. aureus MW2
aucuguccgauuuaau

SEQ ID NO: 4010625 - RNA, 15 nt, Staphylococcus aureus subsp. aureus MW2
aucuguccgauuuuu

SEQ ID NO: 4010626 - RNA, 18 nt, Staphylococcus aureus subsp. aureus MW2
aucuguuacagguuuuaa

SEQ ID NO: 4010627 - RNA, 23 nt, Staphylococcus aureus subsp. aureus MW2
aucuguuacagguuuuaaaauua

SEQ ID NO: 4010628 - RNA, 16 nt, Staphylococcus aureus subsp. aureus MW2
aucuguugucaucaug

SEQ ID NO: 4010629 - RNA, 14 nt, Staphylococcus aureus subsp. aureus MW2
aucuguuucuuguu

SEQ ID NO: 4010630 - RNA, 22 nt, Staphylococcus aureus subsp. aureus MW2
aucuguuuuagguuuguugcuu

SEQ ID NO: 4010631 - RNA, 22 nt, Staphylococcus aureus subsp. aureus MW2
aucuuaaagcauaucucaagau

SEQ ID NO: 4010632 - RNA, 22 nt, Staphylococcus aureus subsp. aureus MW2
aucuuaacaauuuuaauuuuuc

SEQ ID NO: 4010633 - RNA, 21 nt, Staphylococcus aureus subsp. aureus MW2
aucuuaaguacauaaaugcua

SEQ ID NO: 4010634 - RNA, 22 nt, Staphylococcus aureus subsp. aureus MW2
aucuuaaguacauaaaugcuaa

SEQ ID NO: 4010635 - RNA, 16 nt, Staphylococcus aureus subsp. aureus MW2
aucuuaccuuuauguu

SEQ ID NO: 4010636 - RNA, 16 nt, Staphylococcus aureus subsp. aureus MW2
aucuuacuacuuaauu

SEQ ID NO: 4010637 - RNA, 15 nt, Staphylococcus aureus subsp. aureus MW2
aucuuacugcuuuuu

SEQ ID NO: 4010638 - RNA, 19 nt, Staphylococcus aureus subsp. aureus MW2
aucuuagacgcuguuuuaa

SEQ ID NO: 4010639 - RNA, 21 nt, Staphylococcus aureus subsp. aureus MW2
aucuuagacgcuguuuuaaau

SEQ ID NO: 4010640 - RNA, 13 nt, Staphylococcus aureus subsp. aureus MW2
aucuuaucaagaa

SEQ ID NO: 4010641 - RNA, 20 nt, Staphylococcus aureus subsp. aureus MW2
aucuuaugacugcuuuuuau

SEQ ID NO: 4010642 - RNA, 15 nt, Staphylococcus aureus subsp. aureus MW2
aucuucaguuauuug

SEQ ID NO: 4010643 - RNA, 15 nt, Staphylococcus aureus subsp. aureus MW2
aucuucaucauugua

SEQ ID NO: 4010644 - RNA, 16 nt, Staphylococcus aureus subsp. aureus MW2
aucuucgacuacaagu

SEQ ID NO: 4010645 - RNA, 23 nt, Staphylococcus aureus subsp. aureus MW2
aucuucgacuacaaguuuauaau

SEQ ID NO: 4010646 - RNA, 23 nt, Staphylococcus aureus subsp. aureus MW2
aucuucguauaguacuaaaagua

SEQ ID NO: 4010647 - RNA, 14 nt, Staphylococcus aureus subsp. aureus MW2
aucuucuaauucca

SEQ ID NO: 4010648 - RNA, 14 nt, Staphylococcus aureus subsp. aureus MW2
aucuucuaauuguu

SEQ ID NO: 4010649 - RNA, 17 nt, Staphylococcus aureus subsp. aureus MW2
aucuucuaguaauucuu

SEQ ID NO: 4010650 - RNA, 19 nt, Staphylococcus aureus subsp. aureus MW2
aucuucuaguaauucuuca

SEQ ID NO: 4010651 - RNA, 20 nt, Staphylococcus aureus subsp. aureus MW2
aucuucuaguaauucuucau

SEQ ID NO: 4010652 - RNA, 14 nt, Staphylococcus aureus subsp. aureus MW2
aucuucucauaaaa

SEQ ID NO: 4010653 - RNA, 21 nt, Staphylococcus aureus subsp. aureus MW2
aucuucuggauagguaucacu

SEQ ID NO: 4010654 - RNA, 13 nt, Staphylococcus aureus subsp. aureus MW2
aucuucuguuuau

SEQ ID NO: 4010655 - RNA, 16 nt, Staphylococcus aureus subsp. aureus MW2
aucuucuguuuauaua

SEQ ID NO: 4010656 - RNA, 16 nt, Staphylococcus aureus subsp. aureus MW2
aucuucuucaucauau

SEQ ID NO: 4010657 - RNA, 15 nt, Staphylococcus aureus subsp. aureus MW2
aucuucuuuuucuac

SEQ ID NO: 4010658 - RNA, 16 nt, Staphylococcus aureus subsp. aureus MW2
aucuugauuauauuuu

SEQ ID NO: 4010659 - RNA, 19 nt, Staphylococcus aureus subsp. aureus MW2
aucuugauuauauuuuucu

SEQ ID NO: 4010660 - RNA, 16 nt, Staphylococcus aureus subsp. aureus MW2
aucuugcuuggauaau

SEQ ID NO: 4010661 - RNA, 22 nt, Staphylococcus aureus subsp. aureus MW2
aucuugcuuggauaauugcauu

SEQ ID NO: 4010662 - RNA, 21 nt, Staphylococcus aureus subsp. aureus MW2
aucuuggccaauuaacuugau

SEQ ID NO: 4010663 - RNA, 17 nt, Staphylococcus aureus subsp. aureus MW2
aucuuguucuaauuguu

SEQ ID NO: 4010664 - RNA, 23 nt, Staphylococcus aureus subsp. aureus MW2
aucuuguucuucgucaaauucaa

SEQ ID NO: 4010665 - RNA, 19 nt, Staphylococcus aureus subsp. aureus MW2
augacauggaaaauauauu

SEQ ID NO: 4010666 - RNA, 23 nt, Staphylococcus aureus subsp. aureus MW2
augacauuuuaaaucuaauuauu

SEQ ID NO: 4010667 - RNA, 13 nt, Staphylococcus aureus subsp. aureus MW2
augaccaauauuc

SEQ ID NO: 4010668 - RNA, 19 nt, Staphylococcus aureus subsp. aureus MW2
augaccaugauauauaaca

SEQ ID NO: 4010669 - RNA, 15 nt, Staphylococcus aureus subsp. aureus MW2
augaccauugucaug

SEQ ID NO: 4010670 - RNA, 22 nt, Staphylococcus aureus subsp. aureus MW2
augaccauugucaugccuucau

SEQ ID NO: 4010671 - RNA, 16 nt, Staphylococcus aureus subsp. aureus MW2
augaccuaauauauua

SEQ ID NO: 4010672 - RNA, 16 nt, Staphylococcus aureus subsp. aureus MW2
augaccuggaauauug

SEQ ID NO: 4010673 - RNA, 16 nt, Staphylococcus aureus subsp. aureus MW2
augacgaacgauagau

SEQ ID NO: 4010674 - RNA, 20 nt, Staphylococcus aureus subsp. aureus MW2
augacgagaauuaaagucug

SEQ ID NO: 4010675 - RNA, 13 nt, Staphylococcus aureus subsp. aureus MW2
augacuaacgaaa

SEQ ID NO: 4010676 - RNA, 14 nt, Staphylococcus aureus subsp. aureus MW2
augacuaacgaaaa

SEQ ID NO: 4010677 - RNA, 17 nt, Staphylococcus aureus subsp. aureus MW2
augacuaagauaucugg

SEQ ID NO: 4010678 - RNA, 14 nt, Staphylococcus aureus subsp. aureus MW2
augacuauuuucca

SEQ ID NO: 4010679 - RNA, 16 nt, Staphylococcus aureus subsp. aureus MW2
augacugacacuuuaa

SEQ ID NO: 4010680 - RNA, 20 nt, Staphylococcus aureus subsp. aureus MW2
augacugagaaaaauauuuc

SEQ ID NO: 4010681 - RNA, 14 nt, Staphylococcus aureus subsp. aureus MW2
augacugcaaauac

SEQ ID NO: 4010682 - RNA, 16 nt, Staphylococcus aureus subsp. aureus MW2
augacuuaacaucuuu

SEQ ID NO: 4010683 - RNA, 20 nt, Staphylococcus aureus subsp. aureus MW2
augacuuaacaucuuuuuca

SEQ ID NO: 4010684 - RNA, 20 nt, Staphylococcus aureus subsp. aureus MW2
augacuucgauucuccuuuu

SEQ ID NO: 4010685 - RNA, 16 nt, Staphylococcus aureus subsp. aureus MW2
augacuuuuuauuagu

SEQ ID NO: 4010686 - RNA, 22 nt, Staphylococcus aureus subsp. aureus MW2
augagaagcugucuuacugcug

SEQ ID NO: 4010687 - RNA, 20 nt, Staphylococcus aureus subsp. aureus MW2
augagauuauuuuuuuaaau

SEQ ID NO: 4010688 - RNA, 17 nt, Staphylococcus aureus subsp. aureus MW2
augagcaaagcaaauua

SEQ ID NO: 4010689 - RNA, 16 nt, Staphylococcus aureus subsp. aureus MW2
augagcccguuaaaaa

SEQ ID NO: 4010690 - RNA, 14 nt, Staphylococcus aureus subsp. aureus MW2
augagucuuuuuga

SEQ ID NO: 4010691 - RNA, 17 nt, Staphylococcus aureus subsp. aureus MW2
augaguugaagcuaauu

SEQ ID NO: 4010692 - RNA, 15 nt, Staphylococcus aureus subsp. aureus MW2
augaguuuaaaaaua

SEQ ID NO: 4010693 - RNA, 15 nt, Staphylococcus aureus subsp. aureus MW2
augauaaauuaaagc

SEQ ID NO: 4010694 - RNA, 16 nt, Staphylococcus aureus subsp. aureus MW2
augauaaccaaucauc

SEQ ID NO: 4010695 - RNA, 12 nt, Staphylococcus aureus subsp. aureus MW2
augauaaccauu

SEQ ID NO: 4010696 - RNA, 14 nt, Staphylococcus aureus subsp. aureus MW2
augauaauaagaau

SEQ ID NO: 4010697 - RNA, 15 nt, Staphylococcus aureus subsp. aureus MW2
augauaauuaaugcc

SEQ ID NO: 4010698 - RNA, 18 nt, Staphylococcus aureus subsp. aureus MW2
augauaauuaaugccauu

SEQ ID NO: 4010699 - RNA, 21 nt, Staphylococcus aureus subsp. aureus MW2
augauaauuaauuaaaagccc

SEQ ID NO: 4010700 - RNA, 20 nt, Staphylococcus aureus subsp. aureus MW2
augauacauuauuaaauaga

SEQ ID NO: 4010701 - RNA, 22 nt, Staphylococcus aureus subsp. aureus MW2
augauacccaauauuaauccac

SEQ ID NO: 4010702 - RNA, 19 nt, Staphylococcus aureus subsp. aureus MW2
augauacgcuuuuuaaaaa

SEQ ID NO: 4010703 - RNA, 21 nt, Staphylococcus aureus subsp. aureus MW2
augauacgcuuuuuaaaaaau

SEQ ID NO: 4010704 - RNA, 22 nt, Staphylococcus aureus subsp. aureus MW2
augauacgcuuuuuaaaaaauu

SEQ ID NO: 4010705 - RNA, 18 nt, Staphylococcus aureus subsp. aureus MW2
augauacgugguuuuauu

SEQ ID NO: 4010706 - RNA, 21 nt, Staphylococcus aureus subsp. aureus MW2
augauacugaaauuucauaaa

SEQ ID NO: 4010707 - RNA, 16 nt, Staphylococcus aureus subsp. aureus MW2
augauagaauacuaaa

SEQ ID NO: 4010708 - RNA, 15 nt, Staphylococcus aureus subsp. aureus MW2
augauagauuuagga

SEQ ID NO: 4010709 - RNA, 19 nt, Staphylococcus aureus subsp. aureus MW2
augauagcgugauuuuuca

SEQ ID NO: 4010710 - RNA, 16 nt, Staphylococcus aureus subsp. aureus MW2
augauagcuaaacauu

SEQ ID NO: 4010711 - RNA, 15 nt, Staphylococcus aureus subsp. aureus MW2
augauagugcuuuuu

SEQ ID NO: 4010712 - RNA, 22 nt, Staphylococcus aureus subsp. aureus MW2
augauaguguaugaauggcaau

SEQ ID NO: 4010713 - RNA, 14 nt, Staphylococcus aureus subsp. aureus MW2
augauauauuacau

SEQ ID NO: 4010714 - RNA, 15 nt, Staphylococcus aureus subsp. aureus MW2
augauauguucgcuu

SEQ ID NO: 4010715 - RNA, 18 nt, Staphylococcus aureus subsp. aureus MW2
augauauuaccuucaagu

SEQ ID NO: 4010716 - RNA, 20 nt, Staphylococcus aureus subsp. aureus MW2
augauauugauuugauucau

SEQ ID NO: 4010717 - RNA, 23 nt, Staphylococcus aureus subsp. aureus MW2
augauauugauuugauucauuac

SEQ ID NO: 4010718 - RNA, 16 nt, Staphylococcus aureus subsp. aureus MW2
augauauuuaacgaaa

SEQ ID NO: 4010719 - RNA, 18 nt, Staphylococcus aureus subsp. aureus MW2
augauauuuaacgaaaau

SEQ ID NO: 4010720 - RNA, 15 nt, Staphylococcus aureus subsp. aureus MW2
augauauuuucgcaa

SEQ ID NO: 4010721 - RNA, 22 nt, Staphylococcus aureus subsp. aureus MW2
augauauuuucgcaaaauuauu

SEQ ID NO: 4010722 - RNA, 21 nt, Staphylococcus aureus subsp. aureus MW2
augauauuuucgcaaaauuua

SEQ ID NO: 4010723 - RNA, 23 nt, Staphylococcus aureus subsp. aureus MW2
augauauuuucgcaaaauuuauu

SEQ ID NO: 4010724 - RNA, 22 nt, Staphylococcus aureus subsp. aureus MW2
augaucuuuguagccuucaacu

SEQ ID NO: 4010725 - RNA, 17 nt, Staphylococcus aureus subsp. aureus MW2
augaugaacuuaaugcu

SEQ ID NO: 4010726 - RNA, 14 nt, Staphylococcus aureus subsp. aureus MW2
augaugaauuguug

SEQ ID NO: 4010727 - RNA, 23 nt, Staphylococcus aureus subsp. aureus MW2
augaugaauuguuguacauguau

SEQ ID NO: 4010728 - RNA, 20 nt, Staphylococcus aureus subsp. aureus MW2
augaugacaaaaauaaaacc

SEQ ID NO: 4010729 - RNA, 15 nt, Staphylococcus aureus subsp. aureus MW2
augaugacaucaaua

SEQ ID NO: 4010730 - RNA, 15 nt, Staphylococcus aureus subsp. aureus MW2
augaugagauaaaau

SEQ ID NO: 4010731 - RNA, 19 nt, Staphylococcus aureus subsp. aureus MW2
augaugagauaaaaucaua

SEQ ID NO: 4010732 - RNA, 22 nt, Staphylococcus aureus subsp. aureus MW2
augaugcuucgcacaacugcau

SEQ ID NO: 4010733 - RNA, 22 nt, Staphylococcus aureus subsp. aureus MW2
augauuaaaaaucaaagaggcu

SEQ ID NO: 4010734 - RNA, 23 nt, Staphylococcus aureus subsp. aureus MW2
augauuaaaaaucaaagaggcuu

SEQ ID NO: 4010735 - RNA, 14 nt, Staphylococcus aureus subsp. aureus MW2
augauuaaaauuaa

SEQ ID NO: 4010736 - RNA, 19 nt, Staphylococcus aureus subsp. aureus MW2
augauuaaagcuuaagugc

SEQ ID NO: 4010737 - RNA, 21 nt, Staphylococcus aureus subsp. aureus MW2
augauuaaaguguuucaacau

SEQ ID NO: 4010738 - RNA, 14 nt, Staphylococcus aureus subsp. aureus MW2
augauuaauuaaag

SEQ ID NO: 4010739 - RNA, 23 nt, Staphylococcus aureus subsp. aureus MW2
augauuacguugguuuaaaaauu

SEQ ID NO: 4010740 - RNA, 20 nt, Staphylococcus aureus subsp. aureus MW2
augauuacuuuaagauuauu

SEQ ID NO: 4010741 - RNA, 23 nt, Staphylococcus aureus subsp. aureus MW2
augauuagcgcaccaauuaucaa

SEQ ID NO: 4010742 - RNA, 18 nt, Staphylococcus aureus subsp. aureus MW2
augauuauucucuuuauu

SEQ ID NO: 4010743 - RNA, 14 nt, Staphylococcus aureus subsp. aureus MW2
augauuauuuuucu

SEQ ID NO: 4010744 - RNA, 19 nt, Staphylococcus aureus subsp. aureus MW2
augauuccaaguauuuucu

SEQ ID NO: 4010745 - RNA, 17 nt, Staphylococcus aureus subsp. aureus MW2
augauugcaaauuauca

SEQ ID NO: 4010746 - RNA, 20 nt, Staphylococcus aureus subsp. aureus MW2
augauuggcuugaaguuguu

SEQ ID NO: 4010747 - RNA, 15 nt, Staphylococcus aureus subsp. aureus MW2
augauuguaauaucu

SEQ ID NO: 4010748 - RNA, 22 nt, Staphylococcus aureus subsp. aureus MW2
augauuguaauaucuaaagauu

SEQ ID NO: 4010749 - RNA, 16 nt, Staphylococcus aureus subsp. aureus MW2
augauuguuaauacaa

SEQ ID NO: 4010750 - RNA, 14 nt, Staphylococcus aureus subsp. aureus MW2
augauuuaaagcaa

SEQ ID NO: 4010751 - RNA, 18 nt, Staphylococcus aureus subsp. aureus MW2
augauuuaaguuuauaau

SEQ ID NO: 4010752 - RNA, 17 nt, Staphylococcus aureus subsp. aureus MW2
augauuuauuaacucau

SEQ ID NO: 4010753 - RNA, 16 nt, Staphylococcus aureus subsp. aureus MW2
augucgaaaauagcua

SEQ ID NO: 4010754 - RNA, 17 nt, Staphylococcus aureus subsp. aureus MW2
augucgaucuaacaauu

SEQ ID NO: 4010755 - RNA, 14 nt, Staphylococcus aureus subsp. aureus MW2
augucguuuucuua

SEQ ID NO: 4010756 - RNA, 18 nt, Staphylococcus aureus subsp. aureus MW2
augucucucuuucuuauu

SEQ ID NO: 4010757 - RNA, 15 nt, Staphylococcus aureus subsp. aureus MW2
augucuuaaauucuu

SEQ ID NO: 4010758 - RNA, 14 nt, Staphylococcus aureus subsp. aureus MW2
augucuuugaaaaa

SEQ ID NO: 4010759 - RNA, 21 nt, Staphylococcus aureus subsp. aureus MW2
augucuuuuuuuguaaauguu

SEQ ID NO: 4010760 - RNA, 22 nt, Staphylococcus aureus subsp. aureus MW2
augugaaauaaucccaaccauu

SEQ ID NO: 4010761 - RNA, 19 nt, Staphylococcus aureus subsp. aureus MW2
augugaacaucuaguuauu

SEQ ID NO: 4010762 - RNA, 17 nt, Staphylococcus aureus subsp. aureus MW2
augugaugcuugaaugu

SEQ ID NO: 4010763 - RNA, 20 nt, Staphylococcus aureus subsp. aureus MW2
augugaugcuugaauguuug

SEQ ID NO: 4010764 - RNA, 20 nt, Staphylococcus aureus subsp. aureus MW2
augugauuuucuuucauaaa

SEQ ID NO: 4010765 - RNA, 20 nt, Staphylococcus aureus subsp. aureus MW2
augugcaagugguaaaaaug

SEQ ID NO: 4010766 - RNA, 14 nt, Staphylococcus aureus subsp. aureus MW2
augugcaaguuggc

SEQ ID NO: 4010767 - RNA, 23 nt, Staphylococcus aureus subsp. aureus MW2
augugcaaguuggcggggcccca

SEQ ID NO: 4010768 - RNA, 21 nt, Staphylococcus aureus subsp. aureus MW2
augugcaucauuuauaugaug

SEQ ID NO: 4010769 - RNA, 13 nt, Staphylococcus aureus subsp. aureus MW2
augugcgugguuu

SEQ ID NO: 4010770 - RNA, 14 nt, Staphylococcus aureus subsp. aureus MW2
augugcuuuaucaa

SEQ ID NO: 4010771 - RNA, 15 nt, Staphylococcus aureus subsp. aureus MW2
augugcuuuaucaac

SEQ ID NO: 4010772 - RNA, 17 nt, Staphylococcus aureus subsp. aureus MW2
auguggaacaugauuca

SEQ ID NO: 4010773 - RNA, 17 nt, Staphylococcus aureus subsp. aureus MW2
auguguaugauagaaua

SEQ ID NO: 4010774 - RNA, 17 nt, Staphylococcus aureus subsp. aureus MW2
augugucauaauccauu

SEQ ID NO: 4010775 - RNA, 18 nt, Staphylococcus aureus subsp. aureus MW2
augugucauaauccauuc

SEQ ID NO: 4010776 - RNA, 14 nt, Staphylococcus aureus subsp. aureus MW2
auguguguugcuuu

SEQ ID NO: 4010777 - RNA, 22 nt, Staphylococcus aureus subsp. aureus MW2
auguguuaaucaacguauauaa

SEQ ID NO: 4010778 - RNA, 24 nt, Staphylococcus aureus subsp. aureus MW2
auguguuaaucaacguauauaagu

SEQ ID NO: 4010779 - RNA, 13 nt, Staphylococcus aureus subsp. aureus MW2
auguguugcauua

SEQ ID NO: 4010780 - RNA, 22 nt, Staphylococcus aureus subsp. aureus MW2
auguguugcauuacuaucuuca

SEQ ID NO: 4010781 - RNA, 14 nt, Staphylococcus aureus subsp. aureus MW2
auguguugugauau

SEQ ID NO: 4010782 - RNA, 16 nt, Staphylococcus aureus subsp. aureus MW2
auguguugugauauau

SEQ ID NO: 4010783 - RNA, 21 nt, Staphylococcus aureus subsp. aureus MW2
auguguuuucaacaguuuuaa

SEQ ID NO: 4010784 - RNA, 14 nt, Staphylococcus aureus subsp. aureus MW2
auguuaaacaauac

SEQ ID NO: 4010785 - RNA, 23 nt, Staphylococcus aureus subsp. aureus MW2
auguuaaacuagaaaacauaaau

SEQ ID NO: 4010786 - RNA, 17 nt, Staphylococcus aureus subsp. aureus MW2
auguuaaagauuauuau

SEQ ID NO: 4010787 - RNA, 17 nt, Staphylococcus aureus subsp. aureus MW2
auguuaacugcaaacuu

SEQ ID NO: 4010788 - RNA, 19 nt, Staphylococcus aureus subsp. aureus MW2
auguuacacaaauuaaaac

SEQ ID NO: 4010789 - RNA, 15 nt, Staphylococcus aureus subsp. aureus MW2
auguuacccuaauga

SEQ ID NO: 4010790 - RNA, 21 nt, Staphylococcus aureus subsp. aureus MW2
auguuacucuuagguauacgu

SEQ ID NO: 4010791 - RNA, 14 nt, Staphylococcus aureus subsp. aureus MW2
auguuacugaugaa

SEQ ID NO: 4010792 - RNA, 18 nt, Staphylococcus aureus subsp. aureus MW2
auguuagugacaagguau

SEQ ID NO: 4010793 - RNA, 15 nt, Staphylococcus aureus subsp. aureus MW2
auguuauaaaaugaa

SEQ ID NO: 4010794 - RNA, 18 nt, Staphylococcus aureus subsp. aureus MW2
auguuauaaaaugaauaa

SEQ ID NO: 4010795 - RNA, 14 nt, Staphylococcus aureus subsp. aureus MW2
auguuauauuauga

SEQ ID NO: 4010796 - RNA, 13 nt, Staphylococcus aureus subsp. aureus MW2
auguuaucgauau

SEQ ID NO: 4010797 - RNA, 22 nt, Staphylococcus aureus subsp. aureus MW2
auguuaucgauauagcauaaaa

SEQ ID NO: 4010798 - RNA, 15 nt, Staphylococcus aureus subsp. aureus MW2
auguuauuagauacu

SEQ ID NO: 4010799 - RNA, 16 nt, Staphylococcus aureus subsp. aureus MW2
auguucagaacuacaa

SEQ ID NO: 4010800 - RNA, 18 nt, Staphylococcus aureus subsp. aureus MW2
auguucagaacuacaauu

SEQ ID NO: 4010801 - RNA, 16 nt, Staphylococcus aureus subsp. aureus MW2
auguuccauauaaccu

SEQ ID NO: 4010802 - RNA, 18 nt, Staphylococcus aureus subsp. aureus MW2
auguuccccauuaauuaa

SEQ ID NO: 4010803 - RNA, 20 nt, Staphylococcus aureus subsp. aureus MW2
auguuccuuguuuuaaacuu

SEQ ID NO: 4010804 - RNA, 23 nt, Staphylococcus aureus subsp. aureus MW2
auguucuuaacaauaucaucuaa

SEQ ID NO: 4010805 - RNA, 19 nt, Staphylococcus aureus subsp. aureus MW2
auguugacucguuauucaa

SEQ ID NO: 4010806 - RNA, 14 nt, Staphylococcus aureus subsp. aureus MW2
auguugcaaaauua

SEQ ID NO: 4010807 - RNA, 13 nt, Staphylococcus aureus subsp. aureus MW2
auguuggggcccc

SEQ ID NO: 4010808 - RNA, 21 nt, Staphylococcus aureus subsp. aureus MW2
auguuguuuaaauuucaaaau

SEQ ID NO: 4010809 - RNA, 14 nt, Staphylococcus aureus subsp. aureus MW2
auguuuaaaaaacu

SEQ ID NO: 4010810 - RNA, 13 nt, Staphylococcus aureus subsp. aureus MW2
auguuuaaacauu

SEQ ID NO: 4010811 - RNA, 15 nt, Staphylococcus aureus subsp. aureus MW2
auguuuaaacauuuu

SEQ ID NO: 4010812 - RNA, 16 nt, Staphylococcus aureus subsp. aureus MW2
auguuuaagacuauaa

SEQ ID NO: 4010813 - RNA, 20 nt, Staphylococcus aureus subsp. aureus MW2
auguuuaagacuauaaugaa

SEQ ID NO: 4010814 - RNA, 12 nt, Staphylococcus aureus subsp. aureus MW2
auguuuaauaau

SEQ ID NO: 4010815 - RNA, 20 nt, Staphylococcus aureus subsp. aureus MW2
auguuuaauuugauuaaauu

SEQ ID NO: 4010816 - RNA, 14 nt, Staphylococcus aureus subsp. aureus MW2
auguuuaauuuucu

SEQ ID NO: 4010817 - RNA, 17 nt, Staphylococcus aureus subsp. aureus MW2
auguuucagaacugcca

SEQ ID NO: 4010818 - RNA, 13 nt, Staphylococcus aureus subsp. aureus MW2
auguuuccauuua

SEQ ID NO: 4010819 - RNA, 14 nt, Staphylococcus aureus subsp. aureus MW2
auguuucuagauau

SEQ ID NO: 4010820 - RNA, 17 nt, Staphylococcus aureus subsp. aureus MW2
auguuugaagaccuucu

SEQ ID NO: 4010821 - RNA, 21 nt, Staphylococcus aureus subsp. aureus MW2
auguuugaagaccuucuaaaa

SEQ ID NO: 4010822 - RNA, 15 nt, Staphylococcus aureus subsp. aureus MW2
auguuugauucuaaa

SEQ ID NO: 4010823 - RNA, 14 nt, Staphylococcus aureus subsp. aureus MW2
auguuugcaacaua

SEQ ID NO: 4010824 - RNA, 18 nt, Staphylococcus aureus subsp. aureus MW2
auguuugcaacauauuuu

SEQ ID NO: 4010825 - RNA, 20 nt, Staphylococcus aureus subsp. aureus MW2
auguuugcaacauauuuuca

SEQ ID NO: 4010826 - RNA, 15 nt, Staphylococcus aureus subsp. aureus MW2
auguuugcaucacuu

SEQ ID NO: 4010827 - RNA, 17 nt, Staphylococcus aureus subsp. aureus MW2
auguuuggaugaacaaa

SEQ ID NO: 4010828 - RNA, 17 nt, Staphylococcus aureus subsp. aureus MW2
auguuuggcauaauaau

SEQ ID NO: 4010829 - RNA, 18 nt, Staphylococcus aureus subsp. aureus MW2
auguuuguaaaucaagug

SEQ ID NO: 4010830 - RNA, 17 nt, Staphylococcus aureus subsp. aureus MW2
auguuuugguacauaaa

SEQ ID NO: 4010831 - RNA, 21 nt, Staphylococcus aureus subsp. aureus MW2
auguuuuuaacagcuuuuucu

SEQ ID NO: 4010832 - RNA, 15 nt, Staphylococcus aureus subsp. aureus MW2
auguuuuuuaaguac

SEQ ID NO: 4010833 - RNA, 21 nt, Staphylococcus aureus subsp. aureus MW2
auguuuuuuaaguacaacagu

SEQ ID NO: 4010834 - RNA, 14 nt, Staphylococcus aureus subsp. aureus MW2
auuaaaaaacaaaa

SEQ ID NO: 4010835 - RNA, 15 nt, Staphylococcus aureus subsp. aureus MW2
auuaaaaaacaaaac

SEQ ID NO: 4010836 - RNA, 16 nt, Staphylococcus aureus subsp. aureus MW2
auuaaaaaacaauaaa

SEQ ID NO: 4010837 - RNA, 13 nt, Staphylococcus aureus subsp. aureus MW2
auuaaaaaucaaa

SEQ ID NO: 4010838 - RNA, 15 nt, Staphylococcus aureus subsp. aureus MW2
auuaaaaaucaaaga

SEQ ID NO: 4010839 - RNA, 14 nt, Staphylococcus aureus subsp. aureus MW2
auuaaaaauccuca

SEQ ID NO: 4010840 - RNA, 18 nt, Staphylococcus aureus subsp. aureus MW2
auuaaaacagcaaauaaa

SEQ ID NO: 4010841 - RNA, 18 nt, Staphylococcus aureus subsp. aureus MW2
auuaaaagaguacauuua

SEQ ID NO: 4010842 - RNA, 14 nt, Staphylococcus aureus subsp. aureus MW2
auuaauuugauaaa

SEQ ID NO: 4010843 - RNA, 14 nt, Staphylococcus aureus subsp. aureus MW2
auuaauuuucucaa

SEQ ID NO: 4010844 - RNA, 19 nt, Staphylococcus aureus subsp. aureus MW2
auuaauuuuguaauuagga

SEQ ID NO: 4010845 - RNA, 17 nt, Staphylococcus aureus subsp. aureus MW2
auuaauuuuucaaaugu

SEQ ID NO: 4010846 - RNA, 12 nt, Staphylococcus aureus subsp. aureus MW2
auuacaaacaua

SEQ ID NO: 4010847 - RNA, 14 nt, Staphylococcus aureus subsp. aureus MW2
auuacaaacauaau

SEQ ID NO: 4010848 - RNA, 15 nt, Staphylococcus aureus subsp. aureus MW2
auuacaaacauaauc

SEQ ID NO: 4010849 - RNA, 20 nt, Staphylococcus aureus subsp. aureus MW2
auuacaaccaacaauugguu

SEQ ID NO: 4010850 - RNA, 15 nt, Staphylococcus aureus subsp. aureus MW2
auuacaaguuacauu

SEQ ID NO: 4010851 - RNA, 15 nt, Staphylococcus aureus subsp. aureus MW2
auuacaaucaaaaaa

SEQ ID NO: 4010852 - RNA, 20 nt, Staphylococcus aureus subsp. aureus MW2
auuacacccuuuaaauuuaa

SEQ ID NO: 4010853 - RNA, 19 nt, Staphylococcus aureus subsp. aureus MW2
auuacacgcauuacuuuag

SEQ ID NO: 4010854 - RNA, 22 nt, Staphylococcus aureus subsp. aureus MW2
auuacacuacgcugaugaauga

SEQ ID NO: 4010855 - RNA, 13 nt, Staphylococcus aureus subsp. aureus MW2
auuacacuuuaaa

SEQ ID NO: 4010856 - RNA, 17 nt, Staphylococcus aureus subsp. aureus MW2
auuacacuuuaaauaca

SEQ ID NO: 4010857 - RNA, 22 nt, Staphylococcus aureus subsp. aureus MW2
auuacagcgugauucaucuauu

SEQ ID NO: 4010858 - RNA, 24 nt, Staphylococcus aureus subsp. aureus MW2
auuacaggaaauccgcauaaauua

SEQ ID NO: 4010859 - RNA, 16 nt, Staphylococcus aureus subsp. aureus MW2
auuacaguauuugacg

SEQ ID NO: 4010860 - RNA, 21 nt, Staphylococcus aureus subsp. aureus MW2
auuacaguuucuauauuuuau

SEQ ID NO: 4010861 - RNA, 14 nt, Staphylococcus aureus subsp. aureus MW2
auuacauaauuuau

SEQ ID NO: 4010862 - RNA, 16 nt, Staphylococcus aureus subsp. aureus MW2
auuacauaauuuaucu

SEQ ID NO: 4010863 - RNA, 18 nt, Staphylococcus aureus subsp. aureus MW2
auuacaucgacaauuuuc

SEQ ID NO: 4010864 - RNA, 23 nt, Staphylococcus aureus subsp. aureus MW2
auuacaugcaccuuuacaacaua

SEQ ID NO: 4010865 - RNA, 21 nt, Staphylococcus aureus subsp. aureus MW2
auuacauguuggcauaaccug

SEQ ID NO: 4010866 - RNA, 14 nt, Staphylococcus aureus subsp. aureus MW2
auuacauuuuaugu

SEQ ID NO: 4010867 - RNA, 13 nt, Staphylococcus aureus subsp. aureus MW2
auuaccagcaauu

SEQ ID NO: 4010868 - RNA, 15 nt, Staphylococcus aureus subsp. aureus MW2
auuaccauauaaagc

SEQ ID NO: 4010869 - RNA, 19 nt, Staphylococcus aureus subsp. aureus MW2
auuacccacaucuuuuuaa

SEQ ID NO: 4010870 - RNA, 21 nt, Staphylococcus aureus subsp. aureus MW2
auuacccacaucuuuuuaaaa

SEQ ID NO: 4010871 - RNA, 14 nt, Staphylococcus aureus subsp. aureus MW2
auuaccuacaauaa

SEQ ID NO: 4010872 - RNA, 15 nt, Staphylococcus aureus subsp. aureus MW2
auuaccuuuccauuc

SEQ ID NO: 4010873 - RNA, 24 nt, Staphylococcus aureus subsp. aureus MW2
auuacgcaaagaaaaacaucgauu

SEQ ID NO: 4010874 - RNA, 21 nt, Staphylococcus aureus subsp. aureus MW2
auuacgcugucucauuaaugu

SEQ ID NO: 4010875 - RNA, 20 nt, Staphylococcus aureus subsp. aureus MW2
auuacguaucuuuacaacag

SEQ ID NO: 4010876 - RNA, 20 nt, Staphylococcus aureus subsp. aureus MW2
auuacguucuaauaauuuaa

SEQ ID NO: 4010877 - RNA, 23 nt, Staphylococcus aureus subsp. aureus MW2
auuacguucuaauaauuuaaugu

SEQ ID NO: 4010878 - RNA, 16 nt, Staphylococcus aureus subsp. aureus MW2
auuacguuuacuacaa

SEQ ID NO: 4010879 - RNA, 17 nt, Staphylococcus aureus subsp. aureus MW2
auuacguuuacuacaaa

SEQ ID NO: 4010880 - RNA, 13 nt, Staphylococcus aureus subsp. aureus MW2
auuacuaaccuau

SEQ ID NO: 4010881 - RNA, 19 nt, Staphylococcus aureus subsp. aureus MW2
auuacuaaccuauuaaaau

SEQ ID NO: 4010882 - RNA, 19 nt, Staphylococcus aureus subsp. aureus MW2
auuacuacauaauuuauca

SEQ ID NO: 4010883 - RNA, 20 nt, Staphylococcus aureus subsp. aureus MW2
auuacuacuuuauaaauauc

SEQ ID NO: 4010884 - RNA, 23 nt, Staphylococcus aureus subsp. aureus MW2
auuacuacuuuauaaauaucuuu

SEQ ID NO: 4010885 - RNA, 14 nt, Staphylococcus aureus subsp. aureus MW2
auuacuauaaaaaa

SEQ ID NO: 4010886 - RNA, 13 nt, Staphylococcus aureus subsp. aureus MW2
auuacuauauuua

SEQ ID NO: 4010887 - RNA, 17 nt, Staphylococcus aureus subsp. aureus MW2
auuacuauauuuaaauu

SEQ ID NO: 4010888 - RNA, 17 nt, Staphylococcus aureus subsp. aureus MW2
auuacuaucuucaucau

SEQ ID NO: 4010889 - RNA, 17 nt, Staphylococcus aureus subsp. aureus MW2
auuacuguaaauaugaa

SEQ ID NO: 4010890 - RNA, 13 nt, Staphylococcus aureus subsp. aureus MW2
auuacuuaucugu

SEQ ID NO: 4010891 - RNA, 17 nt, Staphylococcus aureus subsp. aureus MW2
auuacuuauucaaaugu

SEQ ID NO: 4010892 - RNA, 22 nt, Staphylococcus aureus subsp. aureus MW2
auuacuuauuucuuuucauuau

SEQ ID NO: 4010893 - RNA, 13 nt, Staphylococcus aureus subsp. aureus MW2
auuacuugaauau

SEQ ID NO: 4010894 - RNA, 18 nt, Staphylococcus aureus subsp. aureus MW2
auuacuugaauauuauuc

SEQ ID NO: 4010895 - RNA, 19 nt, Staphylococcus aureus subsp. aureus MW2
auuacuugaauauuauuca

SEQ ID NO: 4010896 - RNA, 13 nt, Staphylococcus aureus subsp. aureus MW2
auuacuuuagaaa

SEQ ID NO: 4010897 - RNA, 17 nt, Staphylococcus aureus subsp. aureus MW2
auuacuuucauuguaaa

SEQ ID NO: 4010898 - RNA, 17 nt, Staphylococcus aureus subsp. aureus MW2
auuacuuuggaaauuua

SEQ ID NO: 4010899 - RNA, 21 nt, Staphylococcus aureus subsp. aureus MW2
auuagaaaaggcucauuuguu

SEQ ID NO: 4010900 - RNA, 14 nt, Staphylococcus aureus subsp. aureus MW2
auuagaauauaugu

SEQ ID NO: 4010901 - RNA, 14 nt, Staphylococcus aureus subsp. aureus MW2
auuagaauuuaguu

SEQ ID NO: 4010902 - RNA, 19 nt, Staphylococcus aureus subsp. aureus MW2
auuagacguguaaauguua

SEQ ID NO: 4010903 - RNA, 22 nt, Staphylococcus aureus subsp. aureus MW2
auuagacuuucuuaauugaauu

SEQ ID NO: 4010904 - RNA, 23 nt, Staphylococcus aureus subsp. aureus MW2
auuagagggcacgagaaauguca

SEQ ID NO: 4010905 - RNA, 14 nt, Staphylococcus aureus subsp. aureus MW2
auuagauaaaacaa

SEQ ID NO: 4010906 - RNA, 17 nt, Staphylococcus aureus subsp. aureus MW2
auuagauauauuugaaa

SEQ ID NO: 4010907 - RNA, 15 nt, Staphylococcus aureus subsp. aureus MW2
auuagauaucuuaau

SEQ ID NO: 4010908 - RNA, 22 nt, Staphylococcus aureus subsp. aureus MW2
auuagauaucuuaaucuaaaaa

SEQ ID NO: 4010909 - RNA, 18 nt, Staphylococcus aureus subsp. aureus MW2
auuagaugaaauggaaag

SEQ ID NO: 4010910 - RNA, 16 nt, Staphylococcus aureus subsp. aureus MW2
auuagaugauauuuaa

SEQ ID NO: 4010911 - RNA, 13 nt, Staphylococcus aureus subsp. aureus MW2
auuagauuuuaug

SEQ ID NO: 4010912 - RNA, 14 nt, Staphylococcus aureus subsp. aureus MW2
auuagauuuuaugc

SEQ ID NO: 4010913 - RNA, 22 nt, Staphylococcus aureus subsp. aureus MW2
auuagauuuuaugcuuuacuug

SEQ ID NO: 4010914 - RNA, 15 nt, Staphylococcus aureus subsp. aureus MW2
auuagcaaauauuau

SEQ ID NO: 4010915 - RNA, 21 nt, Staphylococcus aureus subsp. aureus MW2
auuagcaaauauuauuaaauc

SEQ ID NO: 4010916 - RNA, 15 nt, Staphylococcus aureus subsp. aureus MW2
auuagcgaaaaccuc

SEQ ID NO: 4010917 - RNA, 22 nt, Staphylococcus aureus subsp. aureus MW2
auuagcgaaaaccucuguuuug

SEQ ID NO: 4010918 - RNA, 14 nt, Staphylococcus aureus subsp. aureus MW2
auuagcgaaaacua

SEQ ID NO: 4010919 - RNA, 21 nt, Staphylococcus aureus subsp. aureus MW2
auuagcgcaccaauuaucaac

SEQ ID NO: 4010920 - RNA, 21 nt, Staphylococcus aureus subsp. aureus MW2
auuagcuagcaugagcgcaua

SEQ ID NO: 4010921 - RNA, 22 nt, Staphylococcus aureus subsp. aureus MW2
auuagcuaugaacgaaucuaua

SEQ ID NO: 4010922 - RNA, 19 nt, Staphylococcus aureus subsp. aureus MW2
auuagcuuuuucaacuaau

SEQ ID NO: 4010923 - RNA, 14 nt, Staphylococcus aureus subsp. aureus MW2
auuaggauguucag

SEQ ID NO: 4010924 - RNA, 15 nt, Staphylococcus aureus subsp. aureus MW2
auuaggauguucagc

SEQ ID NO: 4010925 - RNA, 23 nt, Staphylococcus aureus subsp. aureus MW2
auuaggauuaacauaacuagcaa

SEQ ID NO: 4010926 - RNA, 13 nt, Staphylococcus aureus subsp. aureus MW2
auuaggcauucau

SEQ ID NO: 4010927 - RNA, 17 nt, Staphylococcus aureus subsp. aureus MW2
auuagggggcauauuaa

SEQ ID NO: 4010928 - RNA, 15 nt, Staphylococcus aureus subsp. aureus MW2
auuaguaaauauagu

SEQ ID NO: 4010929 - RNA, 13 nt, Staphylococcus aureus subsp. aureus MW2
auuaguaaugacu

SEQ ID NO: 4010930 - RNA, 19 nt, Staphylococcus aureus subsp. aureus MW2
auuauuucgccuuuuuuau

SEQ ID NO: 4010931 - RNA, 19 nt, Staphylococcus aureus subsp. aureus MW2
auuauuucgucgucccacc

SEQ ID NO: 4010932 - RNA, 16 nt, Staphylococcus aureus subsp. aureus MW2
auuauuugauaaauaa

SEQ ID NO: 4010933 - RNA, 20 nt, Staphylococcus aureus subsp. aureus MW2
auuauuugugacguauuaca

SEQ ID NO: 4010934 - RNA, 15 nt, Staphylococcus aureus subsp. aureus MW2
auuauuuuacuuugu

SEQ ID NO: 4010935 - RNA, 18 nt, Staphylococcus aureus subsp. aureus MW2
auuauuuuacuuuguaau

SEQ ID NO: 4010936 - RNA, 20 nt, Staphylococcus aureus subsp. aureus MW2
auuauuuuucucauagucau

SEQ ID NO: 4010937 - RNA, 23 nt, Staphylococcus aureus subsp. aureus MW2
auuauuuuugauggucagcaaau

SEQ ID NO: 4010938 - RNA, 21 nt, Staphylococcus aureus subsp. aureus MW2
auucaaaaauuguuaauacau

SEQ ID NO: 4010939 - RNA, 14 nt, Staphylococcus aureus subsp. aureus MW2
auucaaaauaacuu

SEQ ID NO: 4010940 - RNA, 16 nt, Staphylococcus aureus subsp. aureus MW2
auucaaaauaacuuau

SEQ ID NO: 4010941 - RNA, 12 nt, Staphylococcus aureus subsp. aureus MW2
auucaaaauuau

SEQ ID NO: 4010942 - RNA, 19 nt, Staphylococcus aureus subsp. aureus MW2
auucaaaggacgucuuuuu

SEQ ID NO: 4010943 - RNA, 20 nt, Staphylococcus aureus subsp. aureus MW2
auucaaaguuuucauuuaac

SEQ ID NO: 4010944 - RNA, 17 nt, Staphylococcus aureus subsp. aureus MW2
auucaaauauaaauaaa

SEQ ID NO: 4010945 - RNA, 18 nt, Staphylococcus aureus subsp. aureus MW2
auucaaauauaaauaaaa

SEQ ID NO: 4010946 - RNA, 24 nt, Staphylococcus aureus subsp. aureus MW2
auucaaauguuuacugucaucuuu

SEQ ID NO: 4010947 - RNA, 12 nt, Staphylococcus aureus subsp. aureus MW2
auucaaccaauu

SEQ ID NO: 4010948 - RNA, 17 nt, Staphylococcus aureus subsp. aureus MW2
auucaaccaauuauuaa

SEQ ID NO: 4010949 - RNA, 22 nt, Staphylococcus aureus subsp. aureus MW2
auucaacguauaagugauauca

SEQ ID NO: 4010950 - RNA, 19 nt, Staphylococcus aureus subsp. aureus MW2
auucaagcaucauuuuucg

SEQ ID NO: 4010951 - RNA, 15 nt, Staphylococcus aureus subsp. aureus MW2
auucaaugauuuuua

SEQ ID NO: 4010952 - RNA, 16 nt, Staphylococcus aureus subsp. aureus MW2
auucaaugauuuuuaa

SEQ ID NO: 4010953 - RNA, 17 nt, Staphylococcus aureus subsp. aureus MW2
auucaauguaauuuuca

SEQ ID NO: 4010954 - RNA, 14 nt, Staphylococcus aureus subsp. aureus MW2
auucaauguuuaau

SEQ ID NO: 4010955 - RNA, 23 nt, Staphylococcus aureus subsp. aureus MW2
auucaauguuuaauuuucuaaag

SEQ ID NO: 4010956 - RNA, 18 nt, Staphylococcus aureus subsp. aureus MW2
auucaauugauuacacca

SEQ ID NO: 4010957 - RNA, 14 nt, Staphylococcus aureus subsp. aureus MW2
auucaauugcuaaa

SEQ ID NO: 4010958 - RNA, 13 nt, Staphylococcus aureus subsp. aureus MW2
auucaauuuaguu

SEQ ID NO: 4010959 - RNA, 20 nt, Staphylococcus aureus subsp. aureus MW2
auucaauuucucaccagcuc

SEQ ID NO: 4010960 - RNA, 15 nt, Staphylococcus aureus subsp. aureus MW2
auucacauacauuuu

SEQ ID NO: 4010961 - RNA, 21 nt, Staphylococcus aureus subsp. aureus MW2
auucacauagccucuuaaaau

SEQ ID NO: 4010962 - RNA, 16 nt, Staphylococcus aureus subsp. aureus MW2
auucacauuauuuaaa

SEQ ID NO: 4010963 - RNA, 16 nt, Staphylococcus aureus subsp. aureus MW2
auucagaugaauaaug

SEQ ID NO: 4010964 - RNA, 19 nt, Staphylococcus aureus subsp. aureus MW2
auucagucaguaaaaauac

SEQ ID NO: 4010965 - RNA, 21 nt, Staphylococcus aureus subsp. aureus MW2
auucagucaguaaaaauacau

SEQ ID NO: 4010966 - RNA, 15 nt, Staphylococcus aureus subsp. aureus MW2
auucauaaaauuuaa

SEQ ID NO: 4010967 - RNA, 14 nt, Staphylococcus aureus subsp. aureus MW2
auucauaaaugcuu

SEQ ID NO: 4010968 - RNA, 17 nt, Staphylococcus aureus subsp. aureus MW2
auucauaagaaaaaugu

SEQ ID NO: 4010969 - RNA, 14 nt, Staphylococcus aureus subsp. aureus MW2
auucauaucuuuca

SEQ ID NO: 4010970 - RNA, 12 nt, Staphylococcus aureus subsp. aureus MW2
auucauauuaac

SEQ ID NO: 4010971 - RNA, 19 nt, Staphylococcus aureus subsp. aureus MW2
auucaucgucucacuuaau

SEQ ID NO: 4010972 - RNA, 14 nt, Staphylococcus aureus subsp. aureus MW2
auucaucuuaucaa

SEQ ID NO: 4010973 - RNA, 23 nt, Staphylococcus aureus subsp. aureus MW2
auucaucuugcaaguauuuucuu

SEQ ID NO: 4010974 - RNA, 14 nt, Staphylococcus aureus subsp. aureus MW2
auucaugaauaauu

SEQ ID NO: 4010975 - RNA, 21 nt, Staphylococcus aureus subsp. aureus MW2
auucauguccgagacuauauu

SEQ ID NO: 4010976 - RNA, 21 nt, Staphylococcus aureus subsp. aureus MW2
auucauguucgaugauuucuu

SEQ ID NO: 4010977 - RNA, 14 nt, Staphylococcus aureus subsp. aureus MW2
auucauuacauguu

SEQ ID NO: 4010978 - RNA, 19 nt, Staphylococcus aureus subsp. aureus MW2
auucauuacauguuacuga

SEQ ID NO: 4010979 - RNA, 21 nt, Staphylococcus aureus subsp. aureus MW2
auucauuauagucuuaaacau

SEQ ID NO: 4010980 - RNA, 13 nt, Staphylococcus aureus subsp. aureus MW2
auucauuuuaaau

SEQ ID NO: 4010981 - RNA, 14 nt, Staphylococcus aureus subsp. aureus MW2
auuccaaaaauugu

SEQ ID NO: 4010982 - RNA, 20 nt, Staphylococcus aureus subsp. aureus MW2
auuccaaaaccgaaaauacc

SEQ ID NO: 4010983 - RNA, 18 nt, Staphylococcus aureus subsp. aureus MW2
auuccaaacacacuguug

SEQ ID NO: 4010984 - RNA, 15 nt, Staphylococcus aureus subsp. aureus MW2
auuccaaguauuuuc

SEQ ID NO: 4010985 - RNA, 16 nt, Staphylococcus aureus subsp. aureus MW2
auuccacuacaaucau

SEQ ID NO: 4010986 - RNA, 17 nt, Staphylococcus aureus subsp. aureus MW2
auuccaugucaauuuuu

SEQ ID NO: 4010987 - RNA, 16 nt, Staphylococcus aureus subsp. aureus MW2
auuccauuucaaaugc

SEQ ID NO: 4010988 - RNA, 17 nt, Staphylococcus aureus subsp. aureus MW2
auuccccauuuaucuaa

SEQ ID NO: 4010989 - RNA, 17 nt, Staphylococcus aureus subsp. aureus MW2
auucccuuuucaucaaa

SEQ ID NO: 4010990 - RNA, 17 nt, Staphylococcus aureus subsp. aureus MW2
auuccuagcuuuuaugu

SEQ ID NO: 4010991 - RNA, 23 nt, Staphylococcus aureus subsp. aureus MW2
auuccucuggaacuuuaauacca

SEQ ID NO: 4010992 - RNA, 14 nt, Staphylococcus aureus subsp. aureus MW2
auuccugaaacaau

SEQ ID NO: 4010993 - RNA, 20 nt, Staphylococcus aureus subsp. aureus MW2
auucgaaaaagguauucaaa

SEQ ID NO: 4010994 - RNA, 18 nt, Staphylococcus aureus subsp. aureus MW2
auucgaacuaucaauaua

SEQ ID NO: 4010995 - RNA, 20 nt, Staphylococcus aureus subsp. aureus MW2
auucgaacuaucaauauaau

SEQ ID NO: 4010996 - RNA, 22 nt, Staphylococcus aureus subsp. aureus MW2
auucgauugguuuaaaaaguca

SEQ ID NO: 4010997 - RNA, 15 nt, Staphylococcus aureus subsp. aureus MW2
auucguaauuuauga

SEQ ID NO: 4010998 - RNA, 23 nt, Staphylococcus aureus subsp. aureus MW2
auucguaccaacucgcuauaugu

SEQ ID NO: 4010999 - RNA, 17 nt, Staphylococcus aureus subsp. aureus MW2
auucgugauuacauucu

SEQ ID NO: 4011000 - RNA, 13 nt, Staphylococcus aureus subsp. aureus MW2
auucguuaacaau

SEQ ID NO: 4011001 - RNA, 17 nt, Staphylococcus aureus subsp. aureus MW2
auucguugauuuagcau

SEQ ID NO: 4011002 - RNA, 23 nt, Staphylococcus aureus subsp. aureus MW2
auucguugauuuagcauacauua

SEQ ID NO: 4011003 - RNA, 17 nt, Staphylococcus aureus subsp. aureus MW2
auucguuugaauuauuu

SEQ ID NO: 4011004 - RNA, 21 nt, Staphylococcus aureus subsp. aureus MW2
auucuaaaaaauuaaaaauuu

SEQ ID NO: 4011005 - RNA, 22 nt, Staphylococcus aureus subsp. aureus MW2
auucuaaaacggaaauaaccac

SEQ ID NO: 4011006 - RNA, 15 nt, Staphylococcus aureus subsp. aureus MW2
auucuaaaagaauua

SEQ ID NO: 4011007 - RNA, 14 nt, Staphylococcus aureus subsp. aureus MW2
auucuaacuuugua

SEQ ID NO: 4011008 - RNA, 14 nt, Staphylococcus aureus subsp. aureus MW2
auucuaaguuaaaa

SEQ ID NO: 4011009 - RNA, 17 nt, Staphylococcus aureus subsp. aureus MW2
auucuaaguuaaaaccu

SEQ ID NO: 4011010 - RNA, 18 nt, Staphylococcus aureus subsp. aureus MW2
auucuaauacaaaccuau

SEQ ID NO: 4011011 - RNA, 18 nt, Staphylococcus aureus subsp. aureus MW2
auucuaauugcacauuua

SEQ ID NO: 4011012 - RNA, 18 nt, Staphylococcus aureus subsp. aureus MW2
auucuacaggcaaugcaa

SEQ ID NO: 4011013 - RNA, 19 nt, Staphylococcus aureus subsp. aureus MW2
auucuagagauaacuagaa

SEQ ID NO: 4011014 - RNA, 19 nt, Staphylococcus aureus subsp. aureus MW2
auucuagcaucgauguuau

SEQ ID NO: 4011015 - RNA, 16 nt, Staphylococcus aureus subsp. aureus MW2
auucuagugaaauacc

SEQ ID NO: 4011016 - RNA, 19 nt, Staphylococcus aureus subsp. aureus MW2
auucuauccuaagcauaaa

SEQ ID NO: 4011017 - RNA, 18 nt, Staphylococcus aureus subsp. aureus MW2
auucuaugagaauagaca

SEQ ID NO: 4011018 - RNA, 16 nt, Staphylococcus aureus subsp. aureus MW2
auugccuguagaauuu

SEQ ID NO: 4011019 - RNA, 19 nt, Staphylococcus aureus subsp. aureus MW2
auugcgguaauugaaucgu

SEQ ID NO: 4011020 - RNA, 21 nt, Staphylococcus aureus subsp. aureus MW2
auugcguaacaucacagaaaa

SEQ ID NO: 4011021 - RNA, 13 nt, Staphylococcus aureus subsp. aureus MW2
auugcuaaaaaaa

SEQ ID NO: 4011022 - RNA, 21 nt, Staphylococcus aureus subsp. aureus MW2
auugcuacccaccuuucuuua

SEQ ID NO: 4011023 - RNA, 20 nt, Staphylococcus aureus subsp. aureus MW2
auugcuaguuuuuuauuuuu

SEQ ID NO: 4011024 - RNA, 22 nt, Staphylococcus aureus subsp. aureus MW2
auugcuauaagaacuaaugguu

SEQ ID NO: 4011025 - RNA, 17 nt, Staphylococcus aureus subsp. aureus MW2
auugcucuaagcauuca

SEQ ID NO: 4011026 - RNA, 16 nt, Staphylococcus aureus subsp. aureus MW2
auugcucuuuaacaau

SEQ ID NO: 4011027 - RNA, 20 nt, Staphylococcus aureus subsp. aureus MW2
auugcugggcuaccgauugu

SEQ ID NO: 4011028 - RNA, 18 nt, Staphylococcus aureus subsp. aureus MW2
auugcuguaaccccuugu

SEQ ID NO: 4011029 - RNA, 21 nt, Staphylococcus aureus subsp. aureus MW2
auugcuugaaauuauuauuua

SEQ ID NO: 4011030 - RNA, 18 nt, Staphylococcus aureus subsp. aureus MW2
auugcuuuacuaauuccg

SEQ ID NO: 4011031 - RNA, 22 nt, Staphylococcus aureus subsp. aureus MW2
auuggaauacucuuuaaucuac

SEQ ID NO: 4011032 - RNA, 18 nt, Staphylococcus aureus subsp. aureus MW2
auuggauaauuucuucuu

SEQ ID NO: 4011033 - RNA, 16 nt, Staphylococcus aureus subsp. aureus MW2
auuggcaguaguugac

SEQ ID NO: 4011034 - RNA, 20 nt, Staphylococcus aureus subsp. aureus MW2
auuggcaguucugaaacauu

SEQ ID NO: 4011035 - RNA, 16 nt, Staphylococcus aureus subsp. aureus MW2
auuggcgggccccaac

SEQ ID NO: 4011036 - RNA, 14 nt, Staphylococcus aureus subsp. aureus MW2
auuggcuugcuuca

SEQ ID NO: 4011037 - RNA, 13 nt, Staphylococcus aureus subsp. aureus MW2
auugggacuuauu

SEQ ID NO: 4011038 - RNA, 17 nt, Staphylococcus aureus subsp. aureus MW2
auuggguaauauuaguc

SEQ ID NO: 4011039 - RNA, 13 nt, Staphylococcus aureus subsp. aureus MW2
auugggucuuuau

SEQ ID NO: 4011040 - RNA, 15 nt, Staphylococcus aureus subsp. aureus MW2
auugggucuuuauca

SEQ ID NO: 4011041 - RNA, 14 nt, Staphylococcus aureus subsp. aureus MW2
auugguauaacaau

SEQ ID NO: 4011042 - RNA, 18 nt, Staphylococcus aureus subsp. aureus MW2
auugguucuauaauaaau

SEQ ID NO: 4011043 - RNA, 16 nt, Staphylococcus aureus subsp. aureus MW2
auugguugauuaguuu

SEQ ID NO: 4011044 - RNA, 18 nt, Staphylococcus aureus subsp. aureus MW2
auugguuuucauguguca

SEQ ID NO: 4011045 - RNA, 21 nt, Staphylococcus aureus subsp. aureus MW2
auugguuuuuacuauaauaau

SEQ ID NO: 4011046 - RNA, 21 nt, Staphylococcus aureus subsp. aureus MW2
auuguaaaaacguucaaucgu

SEQ ID NO: 4011047 - RNA, 16 nt, Staphylococcus aureus subsp. aureus MW2
auuguaaaacaaauua

SEQ ID NO: 4011048 - RNA, 13 nt, Staphylococcus aureus subsp. aureus MW2
auuguaaaaugua

SEQ ID NO: 4011049 - RNA, 13 nt, Staphylococcus aureus subsp. aureus MW2
auuguaaauaaaa

SEQ ID NO: 4011050 - RNA, 14 nt, Staphylococcus aureus subsp. aureus MW2
auuguaaauauagu

SEQ ID NO: 4011051 - RNA, 18 nt, Staphylococcus aureus subsp. aureus MW2
auuguaaauauaguaaua

SEQ ID NO: 4011052 - RNA, 18 nt, Staphylococcus aureus subsp. aureus MW2
auuguaaaucuuguugga

SEQ ID NO: 4011053 - RNA, 22 nt, Staphylococcus aureus subsp. aureus MW2
auuguaagucgaaaguacccag

SEQ ID NO: 4011054 - RNA, 22 nt, Staphylococcus aureus subsp. aureus MW2
auuguaauaauaaucuuuaaca

SEQ ID NO: 4011055 - RNA, 13 nt, Staphylococcus aureus subsp. aureus MW2
auuguaaucuauu

SEQ ID NO: 4011056 - RNA, 22 nt, Staphylococcus aureus subsp. aureus MW2
auuguacgcuucaauuauuuca

SEQ ID NO: 4011057 - RNA, 22 nt, Staphylococcus aureus subsp. aureus MW2
auuguagcgccuaagacauaaa

SEQ ID NO: 4011058 - RNA, 21 nt, Staphylococcus aureus subsp. aureus MW2
auuguaguauuuuuugccauc

SEQ ID NO: 4011059 - RNA, 18 nt, Staphylococcus aureus subsp. aureus MW2
auuguauagaauguguau

SEQ ID NO: 4011060 - RNA, 15 nt, Staphylococcus aureus subsp. aureus MW2
auuguaugaauaaua

SEQ ID NO: 4011061 - RNA, 18 nt, Staphylococcus aureus subsp. aureus MW2
auuguauguugaaaguga

SEQ ID NO: 4011062 - RNA, 18 nt, Staphylococcus aureus subsp. aureus MW2
auuguauuaaucaaauau

SEQ ID NO: 4011063 - RNA, 19 nt, Staphylococcus aureus subsp. aureus MW2
auuguauuaaucaaauauu

SEQ ID NO: 4011064 - RNA, 12 nt, Staphylococcus aureus subsp. aureus MW2
auugucaucaug

SEQ ID NO: 4011065 - RNA, 15 nt, Staphylococcus aureus subsp. aureus MW2
auugucaucauguuc

SEQ ID NO: 4011066 - RNA, 21 nt, Staphylococcus aureus subsp. aureus MW2
auugucguuguacaucauuaa

SEQ ID NO: 4011067 - RNA, 20 nt, Staphylococcus aureus subsp. aureus MW2
auugucuagguuagaauuau

SEQ ID NO: 4011068 - RNA, 14 nt, Staphylococcus aureus subsp. aureus MW2
auugucuuauaaga

SEQ ID NO: 4011069 - RNA, 14 nt, Staphylococcus aureus subsp. aureus MW2
auugucuucauuaa

SEQ ID NO: 4011070 - RNA, 19 nt, Staphylococcus aureus subsp. aureus MW2
auugucuuuucauuuuuua

SEQ ID NO: 4011071 - RNA, 18 nt, Staphylococcus aureus subsp. aureus MW2
auugugacaauuuaaauu

SEQ ID NO: 4011072 - RNA, 17 nt, Staphylococcus aureus subsp. aureus MW2
auuguguaugagucuuu

SEQ ID NO: 4011073 - RNA, 17 nt, Staphylococcus aureus subsp. aureus MW2
auuguguugaaucaaca

SEQ ID NO: 4011074 - RNA, 18 nt, Staphylococcus aureus subsp. aureus MW2
auuguuaauuucaacauu

SEQ ID NO: 4011075 - RNA, 16 nt, Staphylococcus aureus subsp. aureus MW2
auuguuacuuuaacuu

SEQ ID NO: 4011076 - RNA, 21 nt, Staphylococcus aureus subsp. aureus MW2
auuguuagauaaucucauucu

SEQ ID NO: 4011077 - RNA, 18 nt, Staphylococcus aureus subsp. aureus MW2
auuguuauccaaaacauu

SEQ ID NO: 4011078 - RNA, 19 nt, Staphylococcus aureus subsp. aureus MW2
auuguugagaaacuuuuuc

SEQ ID NO: 4011079 - RNA, 21 nt, Staphylococcus aureus subsp. aureus MW2
auuguugcuaaucucagauuu

SEQ ID NO: 4011080 - RNA, 20 nt, Staphylococcus aureus subsp. aureus MW2
auuguuuaauaacaaaauua

SEQ ID NO: 4011081 - RNA, 19 nt, Staphylococcus aureus subsp. aureus MW2
auuguuuuggcuuugagug

SEQ ID NO: 4011082 - RNA, 16 nt, Staphylococcus aureus subsp. aureus MW2
auuguuuuuaaaaucu

SEQ ID NO: 4011083 - RNA, 22 nt, Staphylococcus aureus subsp. aureus MW2
auuuaaaaaacaaauguuuuaa

SEQ ID NO: 4011084 - RNA, 13 nt, Staphylococcus aureus subsp. aureus MW2
auuuaaaaaaugc

SEQ ID NO: 4011085 - RNA, 15 nt, Staphylococcus aureus subsp. aureus MW2
auuuaaaaauaguaa

SEQ ID NO: 4011086 - RNA, 20 nt, Staphylococcus aureus subsp. aureus MW2
auuuaaaaaucuacauauga

SEQ ID NO: 4011087 - RNA, 21 nt, Staphylococcus aureus subsp. aureus MW2
auuuaaaacaaugauuaaaau

SEQ ID NO: 4011088 - RNA, 12 nt, Staphylococcus aureus subsp. aureus MW2
auuuaaaagaaa

SEQ ID NO: 4011089 - RNA, 14 nt, Staphylococcus aureus subsp. aureus MW2
auuuaaaauauaaa

SEQ ID NO: 4011090 - RNA, 16 nt, Staphylococcus aureus subsp. aureus MW2
auuuaaaauauaaauu

SEQ ID NO: 4011091 - RNA, 15 nt, Staphylococcus aureus subsp. aureus MW2
auuuaaaauauuaau

SEQ ID NO: 4011092 - RNA, 17 nt, Staphylococcus aureus subsp. aureus MW2
auuuaaaauauuauuuu

SEQ ID NO: 4011093 - RNA, 19 nt, Staphylococcus aureus subsp. aureus MW2
auuuaaaauauuauuuuua

SEQ ID NO: 4011094 - RNA, 13 nt, Staphylococcus aureus subsp. aureus MW2
auuuaaaaugauu

SEQ ID NO: 4011095 - RNA, 19 nt, Staphylococcus aureus subsp. aureus MW2
auuuaaaaugcuuguucaa

SEQ ID NO: 4011096 - RNA, 13 nt, Staphylococcus aureus subsp. aureus MW2
auuuaaaauuauu

SEQ ID NO: 4011097 - RNA, 16 nt, Staphylococcus aureus subsp. aureus MW2
auuuaaacucauaauu

SEQ ID NO: 4011098 - RNA, 17 nt, Staphylococcus aureus subsp. aureus MW2
auuuaaacuucguaaau

SEQ ID NO: 4011099 - RNA, 14 nt, Staphylococcus aureus subsp. aureus MW2
auuuaaagcaucau

SEQ ID NO: 4011100 - RNA, 17 nt, Staphylococcus aureus subsp. aureus MW2
auuuaaagucuucaucu

SEQ ID NO: 4011101 - RNA, 16 nt, Staphylococcus aureus subsp. aureus MW2
auuuaaaucaauauuc

SEQ ID NO: 4011102 - RNA, 17 nt, Staphylococcus aureus subsp. aureus MW2
auuuaaaugcuuucaaa

SEQ ID NO: 4011103 - RNA, 20 nt, Staphylococcus aureus subsp. aureus MW2
auuuaaaugcuuucaaauac

SEQ ID NO: 4011104 - RNA, 15 nt, Staphylococcus aureus subsp. aureus MW2
auuuaaauuaaaaua

SEQ ID NO: 4011105 - RNA, 18 nt, Staphylococcus aureus subsp. aureus MW2
auuuaaauuaaaauaauu

SEQ ID NO: 4011106 - RNA, 14 nt, Staphylococcus aureus subsp. aureus MW2
auuuaaauuacagu

SEQ ID NO: 4011107 - RNA, 17 nt, Staphylococcus aureus subsp. aureus MW2
auuuauuuuugauagug

SEQ ID NO: 4011108 - RNA, 15 nt, Staphylococcus aureus subsp. aureus MW2
auuucaaaaaggaau

SEQ ID NO: 4011109 - RNA, 17 nt, Staphylococcus aureus subsp. aureus MW2
auuucaaacgauuuuca

SEQ ID NO: 4011110 - RNA, 14 nt, Staphylococcus aureus subsp. aureus MW2
auuucaaauauaaa

SEQ ID NO: 4011111 - RNA, 19 nt, Staphylococcus aureus subsp. aureus MW2
auuucaaaucaauaccaac

SEQ ID NO: 4011112 - RNA, 15 nt, Staphylococcus aureus subsp. aureus MW2
auuucaaaugugaaa

SEQ ID NO: 4011113 - RNA, 18 nt, Staphylococcus aureus subsp. aureus MW2
auuucaauugcacuuacu

SEQ ID NO: 4011114 - RNA, 13 nt, Staphylococcus aureus subsp. aureus MW2
auuucaauuugga

SEQ ID NO: 4011115 - RNA, 16 nt, Staphylococcus aureus subsp. aureus MW2
auuucacucuacaauc

SEQ ID NO: 4011116 - RNA, 16 nt, Staphylococcus aureus subsp. aureus MW2
auuucacuuuaacuuc

SEQ ID NO: 4011117 - RNA, 14 nt, Staphylococcus aureus subsp. aureus MW2
auuucagaaauaca

SEQ ID NO: 4011118 - RNA, 19 nt, Staphylococcus aureus subsp. aureus MW2
auuucagaaauacauccau

SEQ ID NO: 4011119 - RNA, 23 nt, Staphylococcus aureus subsp. aureus MW2
auuucagcaccgacaauuauaau

SEQ ID NO: 4011120 - RNA, 15 nt, Staphylococcus aureus subsp. aureus MW2
auuucagcgauaacg

SEQ ID NO: 4011121 - RNA, 19 nt, Staphylococcus aureus subsp. aureus MW2
auuucaguaccauguuuuu

SEQ ID NO: 4011122 - RNA, 18 nt, Staphylococcus aureus subsp. aureus MW2
auuucaguauauuuuaac

SEQ ID NO: 4011123 - RNA, 15 nt, Staphylococcus aureus subsp. aureus MW2
auuucaguucaucau

SEQ ID NO: 4011124 - RNA, 15 nt, Staphylococcus aureus subsp. aureus MW2
auuucauaauguuaa

SEQ ID NO: 4011125 - RNA, 18 nt, Staphylococcus aureus subsp. aureus MW2
auuucauagggaaauauu

SEQ ID NO: 4011126 - RNA, 13 nt, Staphylococcus aureus subsp. aureus MW2
auuucaucaaauc

SEQ ID NO: 4011127 - RNA, 21 nt, Staphylococcus aureus subsp. aureus MW2
auuucaucaaauccaaaaucu

SEQ ID NO: 4011128 - RNA, 17 nt, Staphylococcus aureus subsp. aureus MW2
auuucauuaauuuuuuc

SEQ ID NO: 4011129 - RNA, 14 nt, Staphylococcus aureus subsp. aureus MW2
auuuccacagcaau

SEQ ID NO: 4011130 - RNA, 14 nt, Staphylococcus aureus subsp. aureus MW2
auuucccuggaaaa

SEQ ID NO: 4011131 - RNA, 17 nt, Staphylococcus aureus subsp. aureus MW2
auuucccuggaaaauga

SEQ ID NO: 4011132 - RNA, 16 nt, Staphylococcus aureus subsp. aureus MW2
auuuccguuuuagaau

SEQ ID NO: 4011133 - RNA, 21 nt, Staphylococcus aureus subsp. aureus MW2
auuuccuauuaggauccaauu

SEQ ID NO: 4011134 - RNA, 21 nt, Staphylococcus aureus subsp. aureus MW2
auuuccucaccuucauuuuca

SEQ ID NO: 4011135 - RNA, 17 nt, Staphylococcus aureus subsp. aureus MW2
auuucgaaaagaaauuc

SEQ ID NO: 4011136 - RNA, 20 nt, Staphylococcus aureus subsp. aureus MW2
auuucgacaucuagaugaaa

SEQ ID NO: 4011137 - RNA, 18 nt, Staphylococcus aureus subsp. aureus MW2
auuucgagauucaauauu

SEQ ID NO: 4011138 - RNA, 20 nt, Staphylococcus aureus subsp. aureus MW2
auuucgauaccuaaaauacc

SEQ ID NO: 4011139 - RNA, 13 nt, Staphylococcus aureus subsp. aureus MW2
auuucgauuuuca

SEQ ID NO: 4011140 - RNA, 18 nt, Staphylococcus aureus subsp. aureus MW2
auuucgccucaucuaauu

SEQ ID NO: 4011141 - RNA, 20 nt, Staphylococcus aureus subsp. aureus MW2
auuucggggacguucaugga

SEQ ID NO: 4011142 - RNA, 18 nt, Staphylococcus aureus subsp. aureus MW2
auuucuaaaccauuuuca

SEQ ID NO: 4011143 - RNA, 17 nt, Staphylococcus aureus subsp. aureus MW2
auuucuaauacauacug

SEQ ID NO: 4011144 - RNA, 20 nt, Staphylococcus aureus subsp. aureus MW2
auuucuaauuuaguaucuau

SEQ ID NO: 4011145 - RNA, 17 nt, Staphylococcus aureus subsp. aureus MW2
auuucuacagacaaugc

SEQ ID NO: 4011146 - RNA, 19 nt, Staphylococcus aureus subsp. aureus MW2
auuucuacagacaaugcaa

SEQ ID NO: 4011147 - RNA, 15 nt, Staphylococcus aureus subsp. aureus MW2
auuucuacucgaaac

SEQ ID NO: 4011148 - RNA, 15 nt, Staphylococcus aureus subsp. aureus MW2
auuucuauaucuauu

SEQ ID NO: 4011149 - RNA, 20 nt, Staphylococcus aureus subsp. aureus MW2
auuucuauaucuauuuauca

SEQ ID NO: 4011150 - RNA, 23 nt, Staphylococcus aureus subsp. aureus MW2
auuucuauaucuauuuaucauac

SEQ ID NO: 4011151 - RNA, 15 nt, Staphylococcus aureus subsp. aureus MW2
auuucuaucaaauaa

SEQ ID NO: 4011152 - RNA, 20 nt, Staphylococcus aureus subsp. aureus MW2
auuucuaucaaauaaugaau

SEQ ID NO: 4011153 - RNA, 13 nt, Staphylococcus aureus subsp. aureus MW2
auuucuauuuaaa

SEQ ID NO: 4011154 - RNA, 20 nt, Staphylococcus aureus subsp. aureus MW2
auuucuauuuaaacaagaaa

SEQ ID NO: 4011155 - RNA, 14 nt, Staphylococcus aureus subsp. aureus MW2
auuucugaaaacuu

SEQ ID NO: 4011156 - RNA, 22 nt, Staphylococcus aureus subsp. aureus MW2
auuucugaaaugauacauuauu

SEQ ID NO: 4011157 - RNA, 19 nt, Staphylococcus aureus subsp. aureus MW2
auuucuggcguacauauaa

SEQ ID NO: 4011158 - RNA, 14 nt, Staphylococcus aureus subsp. aureus MW2
auuucuguaccaaa

SEQ ID NO: 4011159 - RNA, 18 nt, Staphylococcus aureus subsp. aureus MW2
auuucuguaccaaauuug

SEQ ID NO: 4011160 - RNA, 14 nt, Staphylococcus aureus subsp. aureus MW2
auuucuuaccauuu

SEQ ID NO: 4011161 - RNA, 18 nt, Staphylococcus aureus subsp. aureus MW2
auuucuucauuaucaaua

SEQ ID NO: 4011162 - RNA, 13 nt, Staphylococcus aureus subsp. aureus MW2
auuucuucugcua

SEQ ID NO: 4011163 - RNA, 22 nt, Staphylococcus aureus subsp. aureus MW2
auuucuugugcgguaaccauuu

SEQ ID NO: 4011164 - RNA, 13 nt, Staphylococcus aureus subsp. aureus MW2
auuucuuuucauu

SEQ ID NO: 4011165 - RNA, 21 nt, Staphylococcus aureus subsp. aureus MW2
auuucuuuucauuaucauuaa

SEQ ID NO: 4011166 - RNA, 22 nt, Staphylococcus aureus subsp. aureus MW2
auuugaaaauauuacuaacaac

SEQ ID NO: 4011167 - RNA, 12 nt, Staphylococcus aureus subsp. aureus MW2
auuugaaauaau

SEQ ID NO: 4011168 - RNA, 14 nt, Staphylococcus aureus subsp. aureus MW2
auuugaagcauuaa

SEQ ID NO: 4011169 - RNA, 19 nt, Staphylococcus aureus subsp. aureus MW2
auuugaaguauuuuccuuc

SEQ ID NO: 4011170 - RNA, 18 nt, Staphylococcus aureus subsp. aureus MW2
auuugaauaccuacagau

SEQ ID NO: 4011171 - RNA, 22 nt, Staphylococcus aureus subsp. aureus MW2
auuugaauaccuacagauuuua

SEQ ID NO: 4011172 - RNA, 20 nt, Staphylococcus aureus subsp. aureus MW2
auuugaaugcaaaucaaaua

SEQ ID NO: 4011173 - RNA, 22 nt, Staphylococcus aureus subsp. aureus MW2
auuugaauugacuuacauuuua

SEQ ID NO: 4011174 - RNA, 14 nt, Staphylococcus aureus subsp. aureus MW2
auuugaauuuaauu

SEQ ID NO: 4011175 - RNA, 18 nt, Staphylococcus aureus subsp. aureus MW2
auuugaggauacauaaau

SEQ ID NO: 4011176 - RNA, 21 nt, Staphylococcus aureus subsp. aureus MW2
auuugaggauacauaaaucua

SEQ ID NO: 4011177 - RNA, 16 nt, Staphylococcus aureus subsp. aureus MW2
auuugauaaaaaauga

SEQ ID NO: 4011178 - RNA, 15 nt, Staphylococcus aureus subsp. aureus MW2
auuugauaauauuau

SEQ ID NO: 4011179 - RNA, 13 nt, Staphylococcus aureus subsp. aureus MW2
auuugauacaacu

SEQ ID NO: 4011180 - RNA, 12 nt, Staphylococcus aureus subsp. aureus MW2
auuugaucaacc

SEQ ID NO: 4011181 - RNA, 21 nt, Staphylococcus aureus subsp. aureus MW2
auuugaucaaccuguucuuua

SEQ ID NO: 4011182 - RNA, 14 nt, Staphylococcus aureus subsp. aureus MW2
auuugauccauaua

SEQ ID NO: 4011183 - RNA, 16 nt, Staphylococcus aureus subsp. aureus MW2
auuugauguucuugaa

SEQ ID NO: 4011184 - RNA, 16 nt, Staphylococcus aureus subsp. aureus MW2
auuugauuauucuuca

SEQ ID NO: 4011185 - RNA, 14 nt, Staphylococcus aureus subsp. aureus MW2
auuugauuuaaaaa

SEQ ID NO: 4011186 - RNA, 14 nt, Staphylococcus aureus subsp. aureus MW2
auuugauuuauauu

SEQ ID NO: 4011187 - RNA, 17 nt, Staphylococcus aureus subsp. aureus MW2
auuugauuuucaauuuc

SEQ ID NO: 4011188 - RNA, 16 nt, Staphylococcus aureus subsp. aureus MW2
auuugcaugaaaauua

SEQ ID NO: 4011189 - RNA, 23 nt, Staphylococcus aureus subsp. aureus MW2
auuugccccgccauucauaaaug

SEQ ID NO: 4011190 - RNA, 16 nt, Staphylococcus aureus subsp. aureus MW2
auuugcgauuucuucu

SEQ ID NO: 4011191 - RNA, 16 nt, Staphylococcus aureus subsp. aureus MW2
auuugcugaaugaagc

SEQ ID NO: 4011192 - RNA, 20 nt, Staphylococcus aureus subsp. aureus MW2
auuugcugaaugaagcauuu

SEQ ID NO: 4011193 - RNA, 21 nt, Staphylococcus aureus subsp. aureus MW2
auuugcugaaugaagcauuuu

SEQ ID NO: 4011194 - RNA, 21 nt, Staphylococcus aureus subsp. aureus MW2
auuugcuguuaauaaaucauu

SEQ ID NO: 4011195 - RNA, 13 nt, Staphylococcus aureus subsp. aureus MW2
auuuggaauacuu

SEQ ID NO: 4011196 - RNA, 13 nt, Staphylococcus aureus subsp. aureus MW2
auuuucaauacuu

SEQ ID NO: 4011197 - RNA, 22 nt, Staphylococcus aureus subsp. aureus MW2
auuuucaauacuugaaagauuu

SEQ ID NO: 4011198 - RNA, 22 nt, Staphylococcus aureus subsp. aureus MW2
auuuucaaugauuaaaucuucu

SEQ ID NO: 4011199 - RNA, 13 nt, Staphylococcus aureus subsp. aureus MW2
auuuucaauuaga

SEQ ID NO: 4011200 - RNA, 16 nt, Staphylococcus aureus subsp. aureus MW2
auuuucaauuagaaaa

SEQ ID NO: 4011201 - RNA, 21 nt, Staphylococcus aureus subsp. aureus MW2
auuuucacaaucauagauaua

SEQ ID NO: 4011202 - RNA, 23 nt, Staphylococcus aureus subsp. aureus MW2
auuuucacaaucauagauauaag

SEQ ID NO: 4011203 - RNA, 15 nt, Staphylococcus aureus subsp. aureus MW2
auuuucauaaacucu

SEQ ID NO: 4011204 - RNA, 18 nt, Staphylococcus aureus subsp. aureus MW2
auuuucaucauaaucuac

SEQ ID NO: 4011205 - RNA, 19 nt, Staphylococcus aureus subsp. aureus MW2
auuuucauuguauguugaa

SEQ ID NO: 4011206 - RNA, 11 nt, Staphylococcus aureus subsp. aureus MW2
auuuucauuuu

SEQ ID NO: 4011207 - RNA, 15 nt, Staphylococcus aureus subsp. aureus MW2
auuuucgcaaaauuu

SEQ ID NO: 4011208 - RNA, 20 nt, Staphylococcus aureus subsp. aureus MW2
auuuucgggaauuuuacguu

SEQ ID NO: 4011209 - RNA, 21 nt, Staphylococcus aureus subsp. aureus MW2
auuuucuacgaauacuaaaau

SEQ ID NO: 4011210 - RNA, 17 nt, Staphylococcus aureus subsp. aureus MW2
auuuucuauuauuuuac

SEQ ID NO: 4011211 - RNA, 20 nt, Staphylococcus aureus subsp. aureus MW2
auuuucucaaacuaucuuau

SEQ ID NO: 4011212 - RNA, 14 nt, Staphylococcus aureus subsp. aureus MW2
auuuucuguccaaa

SEQ ID NO: 4011213 - RNA, 21 nt, Staphylococcus aureus subsp. aureus MW2
auuuucuuagaaaaucaaguu

SEQ ID NO: 4011214 - RNA, 20 nt, Staphylococcus aureus subsp. aureus MW2
auuuucuugccaucaauuuc

SEQ ID NO: 4011215 - RNA, 21 nt, Staphylococcus aureus subsp. aureus MW2
auuuucuuuuucuaaauaaac

SEQ ID NO: 4011216 - RNA, 15 nt, Staphylococcus aureus subsp. aureus MW2
auuuugaagaagugc

SEQ ID NO: 4011217 - RNA, 20 nt, Staphylococcus aureus subsp. aureus MW2
auuuugaauaugauauuaag

SEQ ID NO: 4011218 - RNA, 20 nt, Staphylococcus aureus subsp. aureus MW2
auuuugaaucacauuaacaa

SEQ ID NO: 4011219 - RNA, 15 nt, Staphylococcus aureus subsp. aureus MW2
auuuugacuauucuc

SEQ ID NO: 4011220 - RNA, 23 nt, Staphylococcus aureus subsp. aureus MW2
auuuugacuauucucagucucuu

SEQ ID NO: 4011221 - RNA, 21 nt, Staphylococcus aureus subsp. aureus MW2
auuuugagaaaauaucauuuc

SEQ ID NO: 4011222 - RNA, 22 nt, Staphylococcus aureus subsp. aureus MW2
auuuugagcuaaccacaucauu

SEQ ID NO: 4011223 - RNA, 13 nt, Staphylococcus aureus subsp. aureus MW2
auuuugaguauuu

SEQ ID NO: 4011224 - RNA, 14 nt, Staphylococcus aureus subsp. aureus MW2
auuuugaguauuug

SEQ ID NO: 4011225 - RNA, 19 nt, Staphylococcus aureus subsp. aureus MW2
auuuugagucguagauacu

SEQ ID NO: 4011226 - RNA, 11 nt, Staphylococcus aureus subsp. aureus MW2
auuuugauuua

SEQ ID NO: 4011227 - RNA, 15 nt, Staphylococcus aureus subsp. aureus MW2
auuuugauuuaccuu

SEQ ID NO: 4011228 - RNA, 21 nt, Staphylococcus aureus subsp. aureus MW2
auuuugauuuaccuucaucuu

SEQ ID NO: 4011229 - RNA, 14 nt, Staphylococcus aureus subsp. aureus MW2
auuuugccauaugu

SEQ ID NO: 4011230 - RNA, 19 nt, Staphylococcus aureus subsp. aureus MW2
auuuugcccaugucaugaa

SEQ ID NO: 4011231 - RNA, 21 nt, Staphylococcus aureus subsp. aureus MW2
auuuugcgaaaauaucauuuc

SEQ ID NO: 4011232 - RNA, 19 nt, Staphylococcus aureus subsp. aureus MW2
auuuugcuugcuuacaaua

SEQ ID NO: 4011233 - RNA, 21 nt, Staphylococcus aureus subsp. aureus MW2
auuuugcuuuaaacauugacu

SEQ ID NO: 4011234 - RNA, 15 nt, Staphylococcus aureus subsp. aureus MW2
auuuuggaacauauu

SEQ ID NO: 4011235 - RNA, 13 nt, Staphylococcus aureus subsp. aureus MW2
auuuuggauuuuu

SEQ ID NO: 4011236 - RNA, 17 nt, Staphylococcus aureus subsp. aureus MW2
auuuuggcacauaaauc

SEQ ID NO: 4011237 - RNA, 16 nt, Staphylococcus aureus subsp. aureus MW2
auuuugggaauuguau

SEQ ID NO: 4011238 - RNA, 15 nt, Staphylococcus aureus subsp. aureus MW2
auuuuguacauaaaa

SEQ ID NO: 4011239 - RNA, 16 nt, Staphylococcus aureus subsp. aureus MW2
auuuuguacauaaaaa

SEQ ID NO: 4011240 - RNA, 16 nt, Staphylococcus aureus subsp. aureus MW2
auuuuguaugaauggu

SEQ ID NO: 4011241 - RNA, 14 nt, Staphylococcus aureus subsp. aureus MW2
auuuuguauuuuuc

SEQ ID NO: 4011242 - RNA, 19 nt, Staphylococcus aureus subsp. aureus MW2
auuuugucuuuuauauuuu

SEQ ID NO: 4011243 - RNA, 14 nt, Staphylococcus aureus subsp. aureus MW2
auuuugugaauuua

SEQ ID NO: 4011244 - RNA, 14 nt, Staphylococcus aureus subsp. aureus MW2
auuuugugcuuuuu

SEQ ID NO: 4011245 - RNA, 24 nt, Staphylococcus aureus subsp. aureus MW2
auuuuguuaggagagauguauaaa

SEQ ID NO: 4011246 - RNA, 18 nt, Staphylococcus aureus subsp. aureus MW2
auuuuguugaaacuguau

SEQ ID NO: 4011247 - RNA, 23 nt, Staphylococcus aureus subsp. aureus MW2
auuuuguugaaacuguaucaaca

SEQ ID NO: 4011248 - RNA, 14 nt, Staphylococcus aureus subsp. aureus MW2
auuuuguuucacua

SEQ ID NO: 4011249 - RNA, 14 nt, Staphylococcus aureus subsp. aureus MW2
auuuuguuuuaaaa

SEQ ID NO: 4011250 - RNA, 14 nt, Staphylococcus aureus subsp. aureus MW2
auuuuguuuucuuu

SEQ ID NO: 4011251 - RNA, 12 nt, Staphylococcus aureus subsp. aureus MW2
auuuuuaaaauu

SEQ ID NO: 4011252 - RNA, 15 nt, Staphylococcus aureus subsp. aureus MW2
auuuuuaaaauuaug

SEQ ID NO: 4011253 - RNA, 23 nt, Staphylococcus aureus subsp. aureus MW2
auuuuuaaaauuaugauuauuuu

SEQ ID NO: 4011254 - RNA, 21 nt, Staphylococcus aureus subsp. aureus MW2
auuuuuaaauaugauagccaa

SEQ ID NO: 4011255 - RNA, 17 nt, Staphylococcus aureus subsp. aureus MW2
auuuuuaaauuacuaua

SEQ ID NO: 4011256 - RNA, 23 nt, Staphylococcus aureus subsp. aureus MW2
auuuuuaacagcgugaauauaag

SEQ ID NO: 4011257 - RNA, 15 nt, Staphylococcus aureus subsp. aureus MW2
auuuuuaacaucauu

SEQ ID NO: 4011258 - RNA, 15 nt, Staphylococcus aureus subsp. aureus MW2
auuuuuaauaaugca

SEQ ID NO: 4011259 - RNA, 15 nt, Staphylococcus aureus subsp. aureus MW2
auuuuuaauguuaca

SEQ ID NO: 4011260 - RNA, 17 nt, Staphylococcus aureus subsp. aureus MW2
auuuuuaauuucuggua

SEQ ID NO: 4011261 - RNA, 22 nt, Staphylococcus aureus subsp. aureus MW2
auuuuuacaaagugauuuaaaa

SEQ ID NO: 4011262 - RNA, 15 nt, Staphylococcus aureus subsp. aureus MW2
auuuuuagacauuaa

SEQ ID NO: 4011263 - RNA, 13 nt, Staphylococcus aureus subsp. aureus MW2
auuuuuaguuaaa

SEQ ID NO: 4011264 - RNA, 18 nt, Staphylococcus aureus subsp. aureus MW2
auuuuuaguuagaaagua

SEQ ID NO: 4011265 - RNA, 13 nt, Staphylococcus aureus subsp. aureus MW2
auuuuuauagaua

SEQ ID NO: 4011266 - RNA, 16 nt, Staphylococcus aureus subsp. aureus MW2
auuuuuauagauaagg

SEQ ID NO: 4011267 - RNA, 13 nt, Staphylococcus aureus subsp. aureus MW2
auuuuuaucaucu

SEQ ID NO: 4011268 - RNA, 20 nt, Staphylococcus aureus subsp. aureus MW2
auuuuuaucccacuccuuau

SEQ ID NO: 4011269 - RNA, 13 nt, Staphylococcus aureus subsp. aureus MW2
auuuuuauuuaua

SEQ ID NO: 4011270 - RNA, 14 nt, Staphylococcus aureus subsp. aureus MW2
auuuuucaaauguu

SEQ ID NO: 4011271 - RNA, 16 nt, Staphylococcus aureus subsp. aureus MW2
auuuuucaauuaaaug

SEQ ID NO: 4011272 - RNA, 16 nt, Staphylococcus aureus subsp. aureus MW2
auuuuuccaguccauu

SEQ ID NO: 4011273 - RNA, 17 nt, Staphylococcus aureus subsp. aureus MW2
auuuuuccaguccauuu

SEQ ID NO: 4011274 - RNA, 18 nt, Staphylococcus aureus subsp. aureus MW2
auuuuuccaguccauuuu

SEQ ID NO: 4011275 - RNA, 22 nt, Staphylococcus aureus subsp. aureus MW2
auuuuuccauaguggaauacuu

SEQ ID NO: 4011276 - RNA, 20 nt, Staphylococcus aureus subsp. aureus MW2
auuuuucuuauaaaaaucuu

SEQ ID NO: 4011277 - RNA, 12 nt, Staphylococcus aureus subsp. aureus MW2
auuuuucuucuu

SEQ ID NO: 4011278 - RNA, 15 nt, Staphylococcus aureus subsp. aureus MW2
auuuuucuuuguguu

SEQ ID NO: 4011279 - RNA, 16 nt, Staphylococcus aureus subsp. aureus MW2
auuuuugacuguuaaa

SEQ ID NO: 4011280 - RNA, 20 nt, Staphylococcus aureus subsp. aureus MW2
auuuuuggauucaccaauua

SEQ ID NO: 4011281 - RNA, 23 nt, Staphylococcus aureus subsp. aureus MW2
auuuuuuaaaugcgaaguauaaa

SEQ ID NO: 4011282 - RNA, 13 nt, Staphylococcus aureus subsp. aureus MW2
auuuuuuaauaua

SEQ ID NO: 4011283 - RNA, 14 nt, Staphylococcus aureus subsp. aureus MW2
auuuuuuacaacgu

SEQ ID NO: 4011284 - RNA, 16 nt, Staphylococcus aureus subsp. aureus MW2
auuuuuuagacuuuau

SEQ ID NO: 4011285 - RNA, 15 nt, Staphylococcus aureus subsp. aureus MW2
caaaaaauaauuuaa

SEQ ID NO: 4011286 - RNA, 11 nt, Staphylococcus aureus subsp. aureus MW2
caaaaaauauc

SEQ ID NO: 4011287 - RNA, 20 nt, Staphylococcus aureus subsp. aureus MW2
caaaaaaucgaacaaaugaa

SEQ ID NO: 4011288 - RNA, 15 nt, Staphylococcus aureus subsp. aureus MW2
caaaaaauuguauaa

SEQ ID NO: 4011289 - RNA, 21 nt, Staphylococcus aureus subsp. aureus MW2
caaaaacauaaucauugugua

SEQ ID NO: 4011290 - RNA, 17 nt, Staphylococcus aureus subsp. aureus MW2
caaaaacuauuuuuuag

SEQ ID NO: 4011291 - RNA, 22 nt, Staphylococcus aureus subsp. aureus MW2
caaaaacuauuuuuuagacuuu

SEQ ID NO: 4011292 - RNA, 18 nt, Staphylococcus aureus subsp. aureus MW2
caaaaagcccuauuauuu

SEQ ID NO: 4011293 - RNA, 21 nt, Staphylococcus aureus subsp. aureus MW2
caaaaagguuguuuuucauca

SEQ ID NO: 4011294 - RNA, 21 nt, Staphylococcus aureus subsp. aureus MW2
caaaaagucucauuaucacca

SEQ ID NO: 4011295 - RNA, 18 nt, Staphylococcus aureus subsp. aureus MW2
caaaaauaaaaacuucua

SEQ ID NO: 4011296 - RNA, 14 nt, Staphylococcus aureus subsp. aureus MW2
caaaaauaaaaaug

SEQ ID NO: 4011297 - RNA, 14 nt, Staphylococcus aureus subsp. aureus MW2
caaaaauaaaaccg

SEQ ID NO: 4011298 - RNA, 22 nt, Staphylococcus aureus subsp. aureus MW2
caaaaauaauuaugaaaaguga

SEQ ID NO: 4011299 - RNA, 20 nt, Staphylococcus aureus subsp. aureus MW2
caaaaauacuccuuucauac

SEQ ID NO: 4011300 - RNA, 22 nt, Staphylococcus aureus subsp. aureus MW2
caaaaauagucggggccccaac

SEQ ID NO: 4011301 - RNA, 14 nt, Staphylococcus aureus subsp. aureus MW2
caaaaaugaagaau

SEQ ID NO: 4011302 - RNA, 20 nt, Staphylococcus aureus subsp. aureus MW2
caaaaauugcuauauuagua

SEQ ID NO: 4011303 - RNA, 13 nt, Staphylococcus aureus subsp. aureus MW2
caaaaauuguaaa

SEQ ID NO: 4011304 - RNA, 17 nt, Staphylococcus aureus subsp. aureus MW2
caaaaauuguaaaaccu

SEQ ID NO: 4011305 - RNA, 14 nt, Staphylococcus aureus subsp. aureus MW2
caaaacaaaaaaua

SEQ ID NO: 4011306 - RNA, 15 nt, Staphylococcus aureus subsp. aureus MW2
caaaacaaaaaauau

SEQ ID NO: 4011307 - RNA, 19 nt, Staphylococcus aureus subsp. aureus MW2
caaaacaaaaaauaucuuu

SEQ ID NO: 4011308 - RNA, 23 nt, Staphylococcus aureus subsp. aureus MW2
caaaacaaaaaauaucuuuuugu

SEQ ID NO: 4011309 - RNA, 19 nt, Staphylococcus aureus subsp. aureus MW2
caaaacaauuuaaaaagca

SEQ ID NO: 4011310 - RNA, 18 nt, Staphylococcus aureus subsp. aureus MW2
caaaacauuuugugacuu

SEQ ID NO: 4011311 - RNA, 14 nt, Staphylococcus aureus subsp. aureus MW2
caaaaccaaaugaa

SEQ ID NO: 4011312 - RNA, 15 nt, Staphylococcus aureus subsp. aureus MW2
caaaaccaaaugaac

SEQ ID NO: 4011313 - RNA, 17 nt, Staphylococcus aureus subsp. aureus MW2
caaaacgcauuucaugu

SEQ ID NO: 4011314 - RNA, 19 nt, Staphylococcus aureus subsp. aureus MW2
caaaacuuuuacuuucuca

SEQ ID NO: 4011315 - RNA, 20 nt, Staphylococcus aureus subsp. aureus MW2
caaaagaaaguuaauuaugu

SEQ ID NO: 4011316 - RNA, 15 nt, Staphylococcus aureus subsp. aureus MW2
caaaagaugaaaauc

SEQ ID NO: 4011317 - RNA, 20 nt, Staphylococcus aureus subsp. aureus MW2
caaaagauguuucaaaauaa

SEQ ID NO: 4011318 - RNA, 21 nt, Staphylococcus aureus subsp. aureus MW2
caaaagauguuucaaaauaau

SEQ ID NO: 4011319 - RNA, 20 nt, Staphylococcus aureus subsp. aureus MW2
caaaaggcugggacauaaau

SEQ ID NO: 4011320 - RNA, 13 nt, Staphylococcus aureus subsp. aureus MW2
caaaaguaugauu

SEQ ID NO: 4011321 - RNA, 14 nt, Staphylococcus aureus subsp. aureus MW2
caaaaguaugauuu

SEQ ID NO: 4011322 - RNA, 13 nt, Staphylococcus aureus subsp. aureus MW2
caaaagugaaugu

SEQ ID NO: 4011323 - RNA, 20 nt, Staphylococcus aureus subsp. aureus MW2
caaaagugaauguuuuucgg

SEQ ID NO: 4011324 - RNA, 22 nt, Staphylococcus aureus subsp. aureus MW2
caaaagugccagguucaauagu

SEQ ID NO: 4011325 - RNA, 18 nt, Staphylococcus aureus subsp. aureus MW2
caaaagugguuguuccca

SEQ ID NO: 4011326 - RNA, 15 nt, Staphylococcus aureus subsp. aureus MW2
caaaauaacauguuu

SEQ ID NO: 4011327 - RNA, 20 nt, Staphylococcus aureus subsp. aureus MW2
caaaauaacauguuuguggc

SEQ ID NO: 4011328 - RNA, 18 nt, Staphylococcus aureus subsp. aureus MW2
caaaauaaugauacuaau

SEQ ID NO: 4011329 - RNA, 21 nt, Staphylococcus aureus subsp. aureus MW2
caaaauaguuguuuauuauag

SEQ ID NO: 4011330 - RNA, 12 nt, Staphylococcus aureus subsp. aureus MW2
caaaauauaaaa

SEQ ID NO: 4011331 - RNA, 16 nt, Staphylococcus aureus subsp. aureus MW2
caaaauauaaaauccu

SEQ ID NO: 4011332 - RNA, 16 nt, Staphylococcus aureus subsp. aureus MW2
caaaauauacuaaauu

SEQ ID NO: 4011333 - RNA, 19 nt, Staphylococcus aureus subsp. aureus MW2
caaaaucaacccaucaugu

SEQ ID NO: 4011334 - RNA, 21 nt, Staphylococcus aureus subsp. aureus MW2
caaaaucaccuuuuuuaacuu

SEQ ID NO: 4011335 - RNA, 16 nt, Staphylococcus aureus subsp. aureus MW2
caaaaugaugaaaauc

SEQ ID NO: 4011336 - RNA, 16 nt, Staphylococcus aureus subsp. aureus MW2
caaaaugguuaaaauc

SEQ ID NO: 4011337 - RNA, 18 nt, Staphylococcus aureus subsp. aureus MW2
caaaauguuuaacaauaa

SEQ ID NO: 4011338 - RNA, 18 nt, Staphylococcus aureus subsp. aureus MW2
caaaauuauguaaaaaau

SEQ ID NO: 4011339 - RNA, 19 nt, Staphylococcus aureus subsp. aureus MW2
caaaauuauguaaaaaaua

SEQ ID NO: 4011340 - RNA, 17 nt, Staphylococcus aureus subsp. aureus MW2
caaaauuugaaauauac

SEQ ID NO: 4011341 - RNA, 23 nt, Staphylococcus aureus subsp. aureus MW2
caaaauuugaaauauaccaacca

SEQ ID NO: 4011342 - RNA, 18 nt, Staphylococcus aureus subsp. aureus MW2
caaaauuuugacuauucu

SEQ ID NO: 4011343 - RNA, 21 nt, Staphylococcus aureus subsp. aureus MW2
caaaauuuugacuauucucag

SEQ ID NO: 4011344 - RNA, 15 nt, Staphylococcus aureus subsp. aureus MW2
caaaauuuugcaaaa

SEQ ID NO: 4011345 - RNA, 19 nt, Staphylococcus aureus subsp. aureus MW2
caaaauuuugcaaaaaaau

SEQ ID NO: 4011346 - RNA, 15 nt, Staphylococcus aureus subsp. aureus MW2
caaacaauacauaau

SEQ ID NO: 4011347 - RNA, 11 nt, Staphylococcus aureus subsp. aureus MW2
caaacacacug

SEQ ID NO: 4011348 - RNA, 13 nt, Staphylococcus aureus subsp. aureus MW2
caaacacaguaca

SEQ ID NO: 4011349 - RNA, 24 nt, Staphylococcus aureus subsp. aureus MW2
caaacacaguacaaauaacaaaca

SEQ ID NO: 4011350 - RNA, 14 nt, Staphylococcus aureus subsp. aureus MW2
caaacauagagaaa

SEQ ID NO: 4011351 - RNA, 17 nt, Staphylococcus aureus subsp. aureus MW2
caaacauagagaauuuc

SEQ ID NO: 4011352 - RNA, 21 nt, Staphylococcus aureus subsp. aureus MW2
caaacauuaaucuauauaaaa

SEQ ID NO: 4011353 - RNA, 18 nt, Staphylococcus aureus subsp. aureus MW2
caaaccaauuuuaauagu

SEQ ID NO: 4011354 - RNA, 17 nt, Staphylococcus aureus subsp. aureus MW2
caaaccggucuauaaca

SEQ ID NO: 4011355 - RNA, 17 nt, Staphylococcus aureus subsp. aureus MW2
caaacgcguuauagaua

SEQ ID NO: 4011356 - RNA, 22 nt, Staphylococcus aureus subsp. aureus MW2
caaacggcacuaauauuuaaaa

SEQ ID NO: 4011357 - RNA, 15 nt, Staphylococcus aureus subsp. aureus MW2
caaacguuauguaca

SEQ ID NO: 4011358 - RNA, 13 nt, Staphylococcus aureus subsp. aureus MW2
caaauuuccacag

SEQ ID NO: 4011359 - RNA, 20 nt, Staphylococcus aureus subsp. aureus MW2
caaauuugaauauacuuaau

SEQ ID NO: 4011360 - RNA, 13 nt, Staphylococcus aureus subsp. aureus MW2
caacaaaagaugu

SEQ ID NO: 4011361 - RNA, 22 nt, Staphylococcus aureus subsp. aureus MW2
caacaaaagugccagguucaau

SEQ ID NO: 4011362 - RNA, 14 nt, Staphylococcus aureus subsp. aureus MW2
caacaaagaagcug

SEQ ID NO: 4011363 - RNA, 16 nt, Staphylococcus aureus subsp. aureus MW2
caacaaagagaauuuc

SEQ ID NO: 4011364 - RNA, 12 nt, Staphylococcus aureus subsp. aureus MW2
caacaaauuuaa

SEQ ID NO: 4011365 - RNA, 15 nt, Staphylococcus aureus subsp. aureus MW2
caacaacaaguucuu

SEQ ID NO: 4011366 - RNA, 14 nt, Staphylococcus aureus subsp. aureus MW2
caacaacauaucau

SEQ ID NO: 4011367 - RNA, 18 nt, Staphylococcus aureus subsp. aureus MW2
caacaacgacuuucacua

SEQ ID NO: 4011368 - RNA, 15 nt, Staphylococcus aureus subsp. aureus MW2
caacaacuaagauau

SEQ ID NO: 4011369 - RNA, 19 nt, Staphylococcus aureus subsp. aureus MW2
caacaacuaagauauauug

SEQ ID NO: 4011370 - RNA, 14 nt, Staphylococcus aureus subsp. aureus MW2
caacaagguuucaa

SEQ ID NO: 4011371 - RNA, 12 nt, Staphylococcus aureus subsp. aureus MW2
caacaauuugca

SEQ ID NO: 4011372 - RNA, 13 nt, Staphylococcus aureus subsp. aureus MW2
caacacagaagcu

SEQ ID NO: 4011373 - RNA, 10 nt, Staphylococcus aureus subsp. aureus MW2
caacacagag

SEQ ID NO: 4011374 - RNA, 16 nt, Staphylococcus aureus subsp. aureus MW2
caacacagagaauuuc

SEQ ID NO: 4011375 - RNA, 19 nt, Staphylococcus aureus subsp. aureus MW2
caacacagagaauuucgaa

SEQ ID NO: 4011376 - RNA, 13 nt, Staphylococcus aureus subsp. aureus MW2
caacacauucugg

SEQ ID NO: 4011377 - RNA, 15 nt, Staphylococcus aureus subsp. aureus MW2
caacacccauauaau

SEQ ID NO: 4011378 - RNA, 16 nt, Staphylococcus aureus subsp. aureus MW2
caacacccauauaauu

SEQ ID NO: 4011379 - RNA, 19 nt, Staphylococcus aureus subsp. aureus MW2
caacacccauauaauuugg

SEQ ID NO: 4011380 - RNA, 15 nt, Staphylococcus aureus subsp. aureus MW2
caacaccuaauauuu

SEQ ID NO: 4011381 - RNA, 17 nt, Staphylococcus aureus subsp. aureus MW2
caacacguuuuaagcca

SEQ ID NO: 4011382 - RNA, 22 nt, Staphylococcus aureus subsp. aureus MW2
caacacuacccacacagguaaa

SEQ ID NO: 4011383 - RNA, 16 nt, Staphylococcus aureus subsp. aureus MW2
caacagggguaaaacu

SEQ ID NO: 4011384 - RNA, 16 nt, Staphylococcus aureus subsp. aureus MW2
caacagggguuuuuau

SEQ ID NO: 4011385 - RNA, 18 nt, Staphylococcus aureus subsp. aureus MW2
caacagggguuuuuauau

SEQ ID NO: 4011386 - RNA, 13 nt, Staphylococcus aureus subsp. aureus MW2
caacaguauuaau

SEQ ID NO: 4011387 - RNA, 15 nt, Staphylococcus aureus subsp. aureus MW2
caacaguauuaauua

SEQ ID NO: 4011388 - RNA, 21 nt, Staphylococcus aureus subsp. aureus MW2
caacaguuucuuggucugcug

SEQ ID NO: 4011389 - RNA, 23 nt, Staphylococcus aureus subsp. aureus MW2
caacaguuucuuggucugcugua

SEQ ID NO: 4011390 - RNA, 15 nt, Staphylococcus aureus subsp. aureus MW2
caacaguuuuaaaga

SEQ ID NO: 4011391 - RNA, 13 nt, Staphylococcus aureus subsp. aureus MW2
caacauacaugcc

SEQ ID NO: 4011392 - RNA, 15 nt, Staphylococcus aureus subsp. aureus MW2
caacauagaagcugg

SEQ ID NO: 4011393 - RNA, 17 nt, Staphylococcus aureus subsp. aureus MW2
caacauauuauauauau

SEQ ID NO: 4011394 - RNA, 14 nt, Staphylococcus aureus subsp. aureus MW2
caacaucaaaaccc

SEQ ID NO: 4011395 - RNA, 22 nt, Staphylococcus aureus subsp. aureus MW2
caacaucgauuuaucauuauuu

SEQ ID NO: 4011396 - RNA, 18 nt, Staphylococcus aureus subsp. aureus MW2
caacaucuuuuguuguuu

SEQ ID NO: 4011397 - RNA, 12 nt, Staphylococcus aureus subsp. aureus MW2
caacaugacagc

SEQ ID NO: 4011398 - RNA, 12 nt, Staphylococcus aureus subsp. aureus MW2
caacauguuugg

SEQ ID NO: 4011399 - RNA, 21 nt, Staphylococcus aureus subsp. aureus MW2
caacauguuuggaugaacaaa

SEQ ID NO: 4011400 - RNA, 16 nt, Staphylococcus aureus subsp. aureus MW2
caacauuaauaaauaa

SEQ ID NO: 4011401 - RNA, 19 nt, Staphylococcus aureus subsp. aureus MW2
caacauuaauaaauaauaa

SEQ ID NO: 4011402 - RNA, 15 nt, Staphylococcus aureus subsp. aureus MW2
caacauuauuuauau

SEQ ID NO: 4011403 - RNA, 20 nt, Staphylococcus aureus subsp. aureus MW2
caacauugagauuaucuuua

SEQ ID NO: 4011404 - RNA, 23 nt, Staphylococcus aureus subsp. aureus MW2
caacauuuugauacguaaacacu

SEQ ID NO: 4011405 - RNA, 13 nt, Staphylococcus aureus subsp. aureus MW2
caacauuuuuuau

SEQ ID NO: 4011406 - RNA, 22 nt, Staphylococcus aureus subsp. aureus MW2
caaccaugcuuuuuagcauauu

SEQ ID NO: 4011407 - RNA, 18 nt, Staphylococcus aureus subsp. aureus MW2
caaccuaccuauuugauu

SEQ ID NO: 4011408 - RNA, 17 nt, Staphylococcus aureus subsp. aureus MW2
caaccugugauaaaaau

SEQ ID NO: 4011409 - RNA, 16 nt, Staphylococcus aureus subsp. aureus MW2
caaccuuugcuaaauc

SEQ ID NO: 4011410 - RNA, 17 nt, Staphylococcus aureus subsp. aureus MW2
caaccuuugcuaaauca

SEQ ID NO: 4011411 - RNA, 17 nt, Staphylococcus aureus subsp. aureus MW2
caacgagucauaaauau

SEQ ID NO: 4011412 - RNA, 14 nt, Staphylococcus aureus subsp. aureus MW2
caacgauaccaaau

SEQ ID NO: 4011413 - RNA, 18 nt, Staphylococcus aureus subsp. aureus MW2
caacguauaagugauauc

SEQ ID NO: 4011414 - RNA, 21 nt, Staphylococcus aureus subsp. aureus MW2
caacguauauaaguuaaaauu

SEQ ID NO: 4011415 - RNA, 17 nt, Staphylococcus aureus subsp. aureus MW2
caacgucccaacaacau

SEQ ID NO: 4011416 - RNA, 21 nt, Staphylococcus aureus subsp. aureus MW2
caacgucccaacaacauauca

SEQ ID NO: 4011417 - RNA, 20 nt, Staphylococcus aureus subsp. aureus MW2
caacguuauucguuaacaau

SEQ ID NO: 4011418 - RNA, 12 nt, Staphylococcus aureus subsp. aureus MW2
caacuaagauau

SEQ ID NO: 4011419 - RNA, 16 nt, Staphylococcus aureus subsp. aureus MW2
caacuaagaugacuga

SEQ ID NO: 4011420 - RNA, 21 nt, Staphylococcus aureus subsp. aureus MW2
caacuaaguugacuauauaau

SEQ ID NO: 4011421 - RNA, 22 nt, Staphylococcus aureus subsp. aureus MW2
caacuaaguugacuauauaaug

SEQ ID NO: 4011422 - RNA, 16 nt, Staphylococcus aureus subsp. aureus MW2
caacuaauaacaaaua

SEQ ID NO: 4011423 - RNA, 17 nt, Staphylococcus aureus subsp. aureus MW2
caacuaauaacaaauag

SEQ ID NO: 4011424 - RNA, 15 nt, Staphylococcus aureus subsp. aureus MW2
caacuaauaacucag

SEQ ID NO: 4011425 - RNA, 14 nt, Staphylococcus aureus subsp. aureus MW2
caacuaauaugauu

SEQ ID NO: 4011426 - RNA, 17 nt, Staphylococcus aureus subsp. aureus MW2
caacuaauuuaaagcau

SEQ ID NO: 4011427 - RNA, 20 nt, Staphylococcus aureus subsp. aureus MW2
caacuaauuuaaagcaucau

SEQ ID NO: 4011428 - RNA, 22 nt, Staphylococcus aureus subsp. aureus MW2
caacuaauuuaaagcaucauau

SEQ ID NO: 4011429 - RNA, 18 nt, Staphylococcus aureus subsp. aureus MW2
caacuacugcuaaaauaa

SEQ ID NO: 4011430 - RNA, 22 nt, Staphylococcus aureus subsp. aureus MW2
caacuacugucaauauaacauu

SEQ ID NO: 4011431 - RNA, 15 nt, Staphylococcus aureus subsp. aureus MW2
caacuauaugugucg

SEQ ID NO: 4011432 - RNA, 14 nt, Staphylococcus aureus subsp. aureus MW2
caacucuaacagcu

SEQ ID NO: 4011433 - RNA, 14 nt, Staphylococcus aureus subsp. aureus MW2
caacugcauauaaa

SEQ ID NO: 4011434 - RNA, 20 nt, Staphylococcus aureus subsp. aureus MW2
caacuguaaaugaaauggua

SEQ ID NO: 4011435 - RNA, 20 nt, Staphylococcus aureus subsp. aureus MW2
caacugucgguucaucuaaa

SEQ ID NO: 4011436 - RNA, 23 nt, Staphylococcus aureus subsp. aureus MW2
caacuguucuaaaauuaaccauu

SEQ ID NO: 4011437 - RNA, 21 nt, Staphylococcus aureus subsp. aureus MW2
caacuuaaauaucgacaaauu

SEQ ID NO: 4011438 - RNA, 13 nt, Staphylococcus aureus subsp. aureus MW2
caacuuaauaacc

SEQ ID NO: 4011439 - RNA, 13 nt, Staphylococcus aureus subsp. aureus MW2
caacuuagaauuu

SEQ ID NO: 4011440 - RNA, 15 nt, Staphylococcus aureus subsp. aureus MW2
caacuuauucuucac

SEQ ID NO: 4011441 - RNA, 15 nt, Staphylococcus aureus subsp. aureus MW2
caacuucaucuaaau

SEQ ID NO: 4011442 - RNA, 19 nt, Staphylococcus aureus subsp. aureus MW2
caacuucaucuaaaugaug

SEQ ID NO: 4011443 - RNA, 23 nt, Staphylococcus aureus subsp. aureus MW2
caacuucuucuccguauuuaccu

SEQ ID NO: 4011444 - RNA, 19 nt, Staphylococcus aureus subsp. aureus MW2
caacuugaucauuauaaaa

SEQ ID NO: 4011445 - RNA, 14 nt, Staphylococcus aureus subsp. aureus MW2
caacuugcacauua

SEQ ID NO: 4011446 - RNA, 19 nt, Staphylococcus aureus subsp. aureus MW2
caacuugcacauuauugua

SEQ ID NO: 4011447 - RNA, 22 nt, Staphylococcus aureus subsp. aureus MW2
caacuuuaaucaaaaagacuca

SEQ ID NO: 4011448 - RNA, 15 nt, Staphylococcus aureus subsp. aureus MW2
caacuuuacgauaaa

SEQ ID NO: 4011449 - RNA, 17 nt, Staphylococcus aureus subsp. aureus MW2
caacuuuacgauaaaua

SEQ ID NO: 4011450 - RNA, 21 nt, Staphylococcus aureus subsp. aureus MW2
caacuuuagcauauucgcuua

SEQ ID NO: 4011451 - RNA, 21 nt, Staphylococcus aureus subsp. aureus MW2
caacuuuauaaccuaaagcug

SEQ ID NO: 4011452 - RNA, 12 nt, Staphylococcus aureus subsp. aureus MW2
caacuuucucua

SEQ ID NO: 4011453 - RNA, 16 nt, Staphylococcus aureus subsp. aureus MW2
caacuuuuuaauaaua

SEQ ID NO: 4011454 - RNA, 22 nt, Staphylococcus aureus subsp. aureus MW2
caacuuuuuaauaauacuucua

SEQ ID NO: 4011455 - RNA, 12 nt, Staphylococcus aureus subsp. aureus MW2
caagaaaacuaa

SEQ ID NO: 4011456 - RNA, 19 nt, Staphylococcus aureus subsp. aureus MW2
caagaaacaauucauuaau

SEQ ID NO: 4011457 - RNA, 17 nt, Staphylococcus aureus subsp. aureus MW2
caagaaauguuaaauua

SEQ ID NO: 4011458 - RNA, 14 nt, Staphylococcus aureus subsp. aureus MW2
caagaacuuuaaaa

SEQ ID NO: 4011459 - RNA, 17 nt, Staphylococcus aureus subsp. aureus MW2
caagaaguaauguuaaa

SEQ ID NO: 4011460 - RNA, 21 nt, Staphylococcus aureus subsp. aureus MW2
caagaauauaacguucgccaa

SEQ ID NO: 4011461 - RNA, 16 nt, Staphylococcus aureus subsp. aureus MW2
caagaauuaaugaaau

SEQ ID NO: 4011462 - RNA, 22 nt, Staphylococcus aureus subsp. aureus MW2
caagaauuauggcagauccaua

SEQ ID NO: 4011463 - RNA, 22 nt, Staphylococcus aureus subsp. aureus MW2
caagacauuacaucuuuaagcu

SEQ ID NO: 4011464 - RNA, 17 nt, Staphylococcus aureus subsp. aureus MW2
caagacucccuuuuuaa

SEQ ID NO: 4011465 - RNA, 22 nt, Staphylococcus aureus subsp. aureus MW2
caagacucccuuuuuaaaauac

SEQ ID NO: 4011466 - RNA, 16 nt, Staphylococcus aureus subsp. aureus MW2
caagagauaagaaaau

SEQ ID NO: 4011467 - RNA, 23 nt, Staphylococcus aureus subsp. aureus MW2
caagagauaagaaaauaccuaau

SEQ ID NO: 4011468 - RNA, 15 nt, Staphylococcus aureus subsp. aureus MW2
caagagguuuuauuu

SEQ ID NO: 4011469 - RNA, 13 nt, Staphylococcus aureus subsp. aureus MW2
caagauaaaucau

SEQ ID NO: 4011470 - RNA, 20 nt, Staphylococcus aureus subsp. aureus MW2
caagaugcucaaugcauuuc

SEQ ID NO: 4011471 - RNA, 18 nt, Staphylococcus aureus subsp. aureus MW2
caagaugguauugcuuua

SEQ ID NO: 4011472 - RNA, 23 nt, Staphylococcus aureus subsp. aureus MW2
caagauuaugacaacauaacaaa

SEQ ID NO: 4011473 - RNA, 14 nt, Staphylococcus aureus subsp. aureus MW2
caagcauaucuuua

SEQ ID NO: 4011474 - RNA, 14 nt, Staphylococcus aureus subsp. aureus MW2
caagcaucaugaaa

SEQ ID NO: 4011475 - RNA, 14 nt, Staphylococcus aureus subsp. aureus MW2
caagcaugucacug

SEQ ID NO: 4011476 - RNA, 15 nt, Staphylococcus aureus subsp. aureus MW2
caagccaagauaaau

SEQ ID NO: 4011477 - RNA, 18 nt, Staphylococcus aureus subsp. aureus MW2
caagcguuucuugaucua

SEQ ID NO: 4011478 - RNA, 16 nt, Staphylococcus aureus subsp. aureus MW2
caagcuagaaacacau

SEQ ID NO: 4011479 - RNA, 19 nt, Staphylococcus aureus subsp. aureus MW2
caagcucuuuuuuguuaua

SEQ ID NO: 4011480 - RNA, 22 nt, Staphylococcus aureus subsp. aureus MW2
caagcuuaauaagcugaaauaa

SEQ ID NO: 4011481 - RNA, 18 nt, Staphylococcus aureus subsp. aureus MW2
caagcuuuucauuuuuau

SEQ ID NO: 4011482 - RNA, 16 nt, Staphylococcus aureus subsp. aureus MW2
caaggauguuauaaaa

SEQ ID NO: 4011483 - RNA, 20 nt, Staphylococcus aureus subsp. aureus MW2
caaggauguuauaaaaugaa

SEQ ID NO: 4011484 - RNA, 22 nt, Staphylococcus aureus subsp. aureus MW2
caaggauguuauaaaaugaaua

SEQ ID NO: 4011485 - RNA, 19 nt, Staphylococcus aureus subsp. aureus MW2
caagguaguuggcugauag

SEQ ID NO: 4011486 - RNA, 21 nt, Staphylococcus aureus subsp. aureus MW2
caagguguucgggaauuuuuu

SEQ ID NO: 4011487 - RNA, 11 nt, Staphylococcus aureus subsp. aureus MW2
caaguaaugau

SEQ ID NO: 4011488 - RNA, 14 nt, Staphylococcus aureus subsp. aureus MW2
caaguaauucuuua

SEQ ID NO: 4011489 - RNA, 16 nt, Staphylococcus aureus subsp. aureus MW2
caaguaauucuuuacc

SEQ ID NO: 4011490 - RNA, 21 nt, Staphylococcus aureus subsp. aureus MW2
caaguaauucuuuaccauuca

SEQ ID NO: 4011491 - RNA, 15 nt, Staphylococcus aureus subsp. aureus MW2
caaguauagaccauc

SEQ ID NO: 4011492 - RNA, 13 nt, Staphylococcus aureus subsp. aureus MW2
caaguccaaauaa

SEQ ID NO: 4011493 - RNA, 20 nt, Staphylococcus aureus subsp. aureus MW2
caagucguucucuuaaauau

SEQ ID NO: 4011494 - RNA, 22 nt, Staphylococcus aureus subsp. aureus MW2
caagucguucucuuaaauauga

SEQ ID NO: 4011495 - RNA, 15 nt, Staphylococcus aureus subsp. aureus MW2
caagucuaacaguua

SEQ ID NO: 4011496 - RNA, 23 nt, Staphylococcus aureus subsp. aureus MW2
caagucuaguucgaacacacacu

SEQ ID NO: 4011497 - RNA, 14 nt, Staphylococcus aureus subsp. aureus MW2
caagugaugaaaaa

SEQ ID NO: 4011498 - RNA, 15 nt, Staphylococcus aureus subsp. aureus MW2
caagugguaaaaaug

SEQ ID NO: 4011499 - RNA, 22 nt, Staphylococcus aureus subsp. aureus MW2
caaguugcugaauaaaauauau

SEQ ID NO: 4011500 - RNA, 17 nt, Staphylococcus aureus subsp. aureus MW2
caaguuggcggggcccc

SEQ ID NO: 4011501 - RNA, 23 nt, Staphylococcus aureus subsp. aureus MW2
caaguuggcggggccccaacaca

SEQ ID NO: 4011502 - RNA, 22 nt, Staphylococcus aureus subsp. aureus MW2
caaguuggggaugggccccaac

SEQ ID NO: 4011503 - RNA, 24 nt, Staphylococcus aureus subsp. aureus MW2
caaguuuaguaucuccaucaaagu

SEQ ID NO: 4011504 - RNA, 19 nt, Staphylococcus aureus subsp. aureus MW2
caaguuuauaaauuucgau

SEQ ID NO: 4011505 - RNA, 19 nt, Staphylococcus aureus subsp. aureus MW2
caaguuuauaaucuuuuuu

SEQ ID NO: 4011506 - RNA, 22 nt, Staphylococcus aureus subsp. aureus MW2
caaguuucauggggcuuaugca

SEQ ID NO: 4011507 - RNA, 19 nt, Staphylococcus aureus subsp. aureus MW2
caaguuuucggcuagauuu

SEQ ID NO: 4011508 - RNA, 21 nt, Staphylococcus aureus subsp. aureus MW2
caauaaaaaugguauucgcau

SEQ ID NO: 4011509 - RNA, 13 nt, Staphylococcus aureus subsp. aureus MW2
caauaaaaauuga

SEQ ID NO: 4011510 - RNA, 22 nt, Staphylococcus aureus subsp. aureus MW2
caauaaaacuauguguauaugu

SEQ ID NO: 4011511 - RNA, 21 nt, Staphylococcus aureus subsp. aureus MW2
caauaaaauuggaacacgaaa

SEQ ID NO: 4011512 - RNA, 15 nt, Staphylococcus aureus subsp. aureus MW2
caauaaauuaugaaa

SEQ ID NO: 4011513 - RNA, 22 nt, Staphylococcus aureus subsp. aureus MW2
caauaaauuguuuacuauacuu

SEQ ID NO: 4011514 - RNA, 23 nt, Staphylococcus aureus subsp. aureus MW2
caauaaauuucaagguauacaca

SEQ ID NO: 4011515 - RNA, 15 nt, Staphylococcus aureus subsp. aureus MW2
caauaaauuuuauau

SEQ ID NO: 4011516 - RNA, 14 nt, Staphylococcus aureus subsp. aureus MW2
caauaaauuuuuaa

SEQ ID NO: 4011517 - RNA, 16 nt, Staphylococcus aureus subsp. aureus MW2
caauaacaccaauuga

SEQ ID NO: 4011518 - RNA, 19 nt, Staphylococcus aureus subsp. aureus MW2
caauaacagcuacaaauaa

SEQ ID NO: 4011519 - RNA, 19 nt, Staphylococcus aureus subsp. aureus MW2
caauaauccgagucauacu

SEQ ID NO: 4011520 - RNA, 20 nt, Staphylococcus aureus subsp. aureus MW2
caauaaugugcaaguuggcg

SEQ ID NO: 4011521 - RNA, 22 nt, Staphylococcus aureus subsp. aureus MW2
caauaaugugcaaguuggcggg

SEQ ID NO: 4011522 - RNA, 19 nt, Staphylococcus aureus subsp. aureus MW2
caauaaugugcaaguuggg

SEQ ID NO: 4011523 - RNA, 11 nt, Staphylococcus aureus subsp. aureus MW2
caauaauguua

SEQ ID NO: 4011524 - RNA, 15 nt, Staphylococcus aureus subsp. aureus MW2
caauaauugaugaaa

SEQ ID NO: 4011525 - RNA, 14 nt, Staphylococcus aureus subsp. aureus MW2
caauaauuuuaucu

SEQ ID NO: 4011526 - RNA, 14 nt, Staphylococcus aureus subsp. aureus MW2
caauacaaaucgau

SEQ ID NO: 4011527 - RNA, 17 nt, Staphylococcus aureus subsp. aureus MW2
caauacagaacuuuaau

SEQ ID NO: 4011528 - RNA, 19 nt, Staphylococcus aureus subsp. aureus MW2
caauacagaacuuuaauaa

SEQ ID NO: 4011529 - RNA, 18 nt, Staphylococcus aureus subsp. aureus MW2
caauacauuaauauaaau

SEQ ID NO: 4011530 - RNA, 17 nt, Staphylococcus aureus subsp. aureus MW2
caauaccauaauuaaau

SEQ ID NO: 4011531 - RNA, 19 nt, Staphylococcus aureus subsp. aureus MW2
caauacgaaaccaaaaaua

SEQ ID NO: 4011532 - RNA, 21 nt, Staphylococcus aureus subsp. aureus MW2
caauacgaaaccaaaaauaau

SEQ ID NO: 4011533 - RNA, 18 nt, Staphylococcus aureus subsp. aureus MW2
caauacgaaguuucaugu

SEQ ID NO: 4011534 - RNA, 15 nt, Staphylococcus aureus subsp. aureus MW2
caauacgaauaucug

SEQ ID NO: 4011535 - RNA, 21 nt, Staphylococcus aureus subsp. aureus MW2
caauacuacuguugacauuug

SEQ ID NO: 4011536 - RNA, 15 nt, Staphylococcus aureus subsp. aureus MW2
caauacuuuuuauau

SEQ ID NO: 4011537 - RNA, 14 nt, Staphylococcus aureus subsp. aureus MW2
caauagaugaaaau

SEQ ID NO: 4011538 - RNA, 17 nt, Staphylococcus aureus subsp. aureus MW2
caauagguacaacuaaa

SEQ ID NO: 4011539 - RNA, 14 nt, Staphylococcus aureus subsp. aureus MW2
caauagguucauua

SEQ ID NO: 4011540 - RNA, 12 nt, Staphylococcus aureus subsp. aureus MW2
caauaguaccau

SEQ ID NO: 4011541 - RNA, 21 nt, Staphylococcus aureus subsp. aureus MW2
caauaguaguauuaucuuuca

SEQ ID NO: 4011542 - RNA, 16 nt, Staphylococcus aureus subsp. aureus MW2
caauaguauaaauauc

SEQ ID NO: 4011543 - RNA, 16 nt, Staphylococcus aureus subsp. aureus MW2
caauaguuuauaauuu

SEQ ID NO: 4011544 - RNA, 14 nt, Staphylococcus aureus subsp. aureus MW2
caauauaaaagcac

SEQ ID NO: 4011545 - RNA, 15 nt, Staphylococcus aureus subsp. aureus MW2
caauauaaaagcacu

SEQ ID NO: 4011546 - RNA, 17 nt, Staphylococcus aureus subsp. aureus MW2
caauauaaaagcacuau

SEQ ID NO: 4011547 - RNA, 15 nt, Staphylococcus aureus subsp. aureus MW2
caauauaaacaucuu

SEQ ID NO: 4011548 - RNA, 15 nt, Staphylococcus aureus subsp. aureus MW2
caauauaacauugca

SEQ ID NO: 4011549 - RNA, 21 nt, Staphylococcus aureus subsp. aureus MW2
caauauaauauauacaaauaa

SEQ ID NO: 4011550 - RNA, 16 nt, Staphylococcus aureus subsp. aureus MW2
caauauacaaugcuga

SEQ ID NO: 4011551 - RNA, 20 nt, Staphylococcus aureus subsp. aureus MW2
caauauacauuuacauauug

SEQ ID NO: 4011552 - RNA, 14 nt, Staphylococcus aureus subsp. aureus MW2
caauauacuuuuua

SEQ ID NO: 4011553 - RNA, 17 nt, Staphylococcus aureus subsp. aureus MW2
caauauacuuuuuaaau

SEQ ID NO: 4011554 - RNA, 20 nt, Staphylococcus aureus subsp. aureus MW2
caauauagaaaaugaguaca

SEQ ID NO: 4011555 - RNA, 21 nt, Staphylococcus aureus subsp. aureus MW2
caauauagaaaaugaguacaa

SEQ ID NO: 4011556 - RNA, 20 nt, Staphylococcus aureus subsp. aureus MW2
caauauauucaccuacaaca

SEQ ID NO: 4011557 - RNA, 19 nt, Staphylococcus aureus subsp. aureus MW2
caauaucacuuaaacgcuu

SEQ ID NO: 4011558 - RNA, 21 nt, Staphylococcus aureus subsp. aureus MW2
caauauguggcgcucuuauaa

SEQ ID NO: 4011559 - RNA, 12 nt, Staphylococcus aureus subsp. aureus MW2
caauauuacuuu

SEQ ID NO: 4011560 - RNA, 18 nt, Staphylococcus aureus subsp. aureus MW2
caauauuaggccaacguu

SEQ ID NO: 4011561 - RNA, 13 nt, Staphylococcus aureus subsp. aureus MW2
caauauucucuuu

SEQ ID NO: 4011562 - RNA, 14 nt, Staphylococcus aureus subsp. aureus MW2
caauauucucuuua

SEQ ID NO: 4011563 - RNA, 21 nt, Staphylococcus aureus subsp. aureus MW2
caauauugucuucauuaacau

SEQ ID NO: 4011564 - RNA, 22 nt, Staphylococcus aureus subsp. aureus MW2
caauauuugauaaguagaaaau

SEQ ID NO: 4011565 - RNA, 12 nt, Staphylococcus aureus subsp. aureus MW2
caaucaaaggcu

SEQ ID NO: 4011566 - RNA, 23 nt, Staphylococcus aureus subsp. aureus MW2
caaucaacgagucauaaauauaa

SEQ ID NO: 4011567 - RNA, 19 nt, Staphylococcus aureus subsp. aureus MW2
caaucaacuuagaauuuac

SEQ ID NO: 4011568 - RNA, 15 nt, Staphylococcus aureus subsp. aureus MW2
caaucaacuucauau

SEQ ID NO: 4011569 - RNA, 13 nt, Staphylococcus aureus subsp. aureus MW2
caaucacaauaua

SEQ ID NO: 4011570 - RNA, 14 nt, Staphylococcus aureus subsp. aureus MW2
caaucacagcaaua

SEQ ID NO: 4011571 - RNA, 12 nt, Staphylococcus aureus subsp. aureus MW2
caaucauaauac

SEQ ID NO: 4011572 - RNA, 23 nt, Staphylococcus aureus subsp. aureus MW2
caaucauaccggcaaauaacaau

SEQ ID NO: 4011573 - RNA, 20 nt, Staphylococcus aureus subsp. aureus MW2
caaucaucgcaaaaacauaa

SEQ ID NO: 4011574 - RNA, 18 nt, Staphylococcus aureus subsp. aureus MW2
caaucauuguaaaugauc

SEQ ID NO: 4011575 - RNA, 15 nt, Staphylococcus aureus subsp. aureus MW2
caaucgcaucuguua

SEQ ID NO: 4011576 - RNA, 13 nt, Staphylococcus aureus subsp. aureus MW2
caaucguuaauuu

SEQ ID NO: 4011577 - RNA, 23 nt, Staphylococcus aureus subsp. aureus MW2
caaucguuucuuccgcacugccu

SEQ ID NO: 4011578 - RNA, 17 nt, Staphylococcus aureus subsp. aureus MW2
caaucuaaauguaaaau

SEQ ID NO: 4011579 - RNA, 14 nt, Staphylococcus aureus subsp. aureus MW2
caaucuauauaaau

SEQ ID NO: 4011580 - RNA, 16 nt, Staphylococcus aureus subsp. aureus MW2
caaugaauaaauugau

SEQ ID NO: 4011581 - RNA, 19 nt, Staphylococcus aureus subsp. aureus MW2
caaugaauaaugacaaauu

SEQ ID NO: 4011582 - RNA, 22 nt, Staphylococcus aureus subsp. aureus MW2
caaugaauuucuaauuuaguau

SEQ ID NO: 4011583 - RNA, 20 nt, Staphylococcus aureus subsp. aureus MW2
caaugagcaagucuucuaaa

SEQ ID NO: 4011584 - RNA, 14 nt, Staphylococcus aureus subsp. aureus MW2
caaugauaccuuua

SEQ ID NO: 4011585 - RNA, 20 nt, Staphylococcus aureus subsp. aureus MW2
caaugaugaauuguaaaagu

SEQ ID NO: 4011586 - RNA, 22 nt, Staphylococcus aureus subsp. aureus MW2
caaugaugggaaaucaguaaua

SEQ ID NO: 4011587 - RNA, 21 nt, Staphylococcus aureus subsp. aureus MW2
caaugauguuacaaucgccau

SEQ ID NO: 4011588 - RNA, 18 nt, Staphylococcus aureus subsp. aureus MW2
caaugauuaaaucuucua

SEQ ID NO: 4011589 - RNA, 14 nt, Staphylococcus aureus subsp. aureus MW2
caaugauucaucag

SEQ ID NO: 4011590 - RNA, 14 nt, Staphylococcus aureus subsp. aureus MW2
caaugauuugauaa

SEQ ID NO: 4011591 - RNA, 15 nt, Staphylococcus aureus subsp. aureus MW2
caaugauuuuuaaaa

SEQ ID NO: 4011592 - RNA, 14 nt, Staphylococcus aureus subsp. aureus MW2
caaugcaaguuggc

SEQ ID NO: 4011593 - RNA, 15 nt, Staphylococcus aureus subsp. aureus MW2
caaugcaaguuggcg

SEQ ID NO: 4011594 - RNA, 19 nt, Staphylococcus aureus subsp. aureus MW2
caaugcaaguuggcggggc

SEQ ID NO: 4011595 - RNA, 20 nt, Staphylococcus aureus subsp. aureus MW2
caaugcauaaaaccuucaau

SEQ ID NO: 4011596 - RNA, 17 nt, Staphylococcus aureus subsp. aureus MW2
caaugccacaucauagc

SEQ ID NO: 4011597 - RNA, 20 nt, Staphylococcus aureus subsp. aureus MW2
caaugccacaucauagcacu

SEQ ID NO: 4011598 - RNA, 15 nt, Staphylococcus aureus subsp. aureus MW2
caaugccuuuaaagc

SEQ ID NO: 4011599 - RNA, 19 nt, Staphylococcus aureus subsp. aureus MW2
caaugcuuccaucacauca

SEQ ID NO: 4011600 - RNA, 15 nt, Staphylococcus aureus subsp. aureus MW2
caauggaucuguuac

SEQ ID NO: 4011601 - RNA, 16 nt, Staphylococcus aureus subsp. aureus MW2
caauggaucuguuaca

SEQ ID NO: 4011602 - RNA, 14 nt, Staphylococcus aureus subsp. aureus MW2
caauggccauuuga

SEQ ID NO: 4011603 - RNA, 13 nt, Staphylococcus aureus subsp. aureus MW2
caauggcuuuacc

SEQ ID NO: 4011604 - RNA, 13 nt, Staphylococcus aureus subsp. aureus MW2
caauguaaaaaag

SEQ ID NO: 4011605 - RNA, 12 nt, Staphylococcus aureus subsp. aureus MW2
caauguauuuug

SEQ ID NO: 4011606 - RNA, 20 nt, Staphylococcus aureus subsp. aureus MW2
caauguauuuugaucugugc

SEQ ID NO: 4011607 - RNA, 18 nt, Staphylococcus aureus subsp. aureus MW2
caaugucugcaucagauc

SEQ ID NO: 4011608 - RNA, 17 nt, Staphylococcus aureus subsp. aureus MW2
caaugugagauauaaag

SEQ ID NO: 4011609 - RNA, 21 nt, Staphylococcus aureus subsp. aureus MW2
caauguuaggugcuugguuaa

SEQ ID NO: 4011610 - RNA, 17 nt, Staphylococcus aureus subsp. aureus MW2
caauguuuaauuuucua

SEQ ID NO: 4011611 - RNA, 18 nt, Staphylococcus aureus subsp. aureus MW2
caauguuugccagguaaa

SEQ ID NO: 4011612 - RNA, 13 nt, Staphylococcus aureus subsp. aureus MW2
caauuaaaucgau

SEQ ID NO: 4011613 - RNA, 19 nt, Staphylococcus aureus subsp. aureus MW2
caauuaaguacuucaaagc

SEQ ID NO: 4011614 - RNA, 20 nt, Staphylococcus aureus subsp. aureus MW2
caauuaaguacuucaaagca

SEQ ID NO: 4011615 - RNA, 13 nt, Staphylococcus aureus subsp. aureus MW2
caauuaauaaaca

SEQ ID NO: 4011616 - RNA, 23 nt, Staphylococcus aureus subsp. aureus MW2
caauuaauuuagucauuacaaau

SEQ ID NO: 4011617 - RNA, 15 nt, Staphylococcus aureus subsp. aureus MW2
caauuauaauaaaac

SEQ ID NO: 4011618 - RNA, 17 nt, Staphylococcus aureus subsp. aureus MW2
caauuaucaacauaaua

SEQ ID NO: 4011619 - RNA, 18 nt, Staphylococcus aureus subsp. aureus MW2
caauuaucaacauaauau

SEQ ID NO: 4011620 - RNA, 14 nt, Staphylococcus aureus subsp. aureus MW2
caauuauggauaaa

SEQ ID NO: 4011621 - RNA, 19 nt, Staphylococcus aureus subsp. aureus MW2
caauuauuauugcugugau

SEQ ID NO: 4011622 - RNA, 19 nt, Staphylococcus aureus subsp. aureus MW2
caauuauugaaaacaaaaa

SEQ ID NO: 4011623 - RNA, 12 nt, Staphylococcus aureus subsp. aureus MW2
caauucaaugua

SEQ ID NO: 4011624 - RNA, 13 nt, Staphylococcus aureus subsp. aureus MW2
caauucauaagaa

SEQ ID NO: 4011625 - RNA, 15 nt, Staphylococcus aureus subsp. aureus MW2
caauucauaagaaaa

SEQ ID NO: 4011626 - RNA, 22 nt, Staphylococcus aureus subsp. aureus MW2
caauucauuaauaggauuauua

SEQ ID NO: 4011627 - RNA, 14 nt, Staphylococcus aureus subsp. aureus MW2
caauucucuaacuu

SEQ ID NO: 4011628 - RNA, 21 nt, Staphylococcus aureus subsp. aureus MW2
caauucugugagguaaaacua

SEQ ID NO: 4011629 - RNA, 17 nt, Staphylococcus aureus subsp. aureus MW2
caauucuuacaccugca

SEQ ID NO: 4011630 - RNA, 12 nt, Staphylococcus aureus subsp. aureus MW2
caauucuucaau

SEQ ID NO: 4011631 - RNA, 15 nt, Staphylococcus aureus subsp. aureus MW2
caauugaagugaaau

SEQ ID NO: 4011632 - RNA, 22 nt, Staphylococcus aureus subsp. aureus MW2
caauugaagugaaauugcgugc

SEQ ID NO: 4011633 - RNA, 22 nt, Staphylococcus aureus subsp. aureus MW2
caauugaaugaaguaauauaua

SEQ ID NO: 4011634 - RNA, 15 nt, Staphylococcus aureus subsp. aureus MW2
caauugcuaaaucau

SEQ ID NO: 4011635 - RNA, 17 nt, Staphylococcus aureus subsp. aureus MW2
caauuggaaguauuuau

SEQ ID NO: 4011636 - RNA, 16 nt, Staphylococcus aureus subsp. aureus MW2
caauugguuguuucaa

SEQ ID NO: 4011637 - RNA, 16 nt, Staphylococcus aureus subsp. aureus MW2
caauuguuacuuuaac

SEQ ID NO: 4011638 - RNA, 20 nt, Staphylococcus aureus subsp. aureus MW2
caauuguugcaaaauacgau

SEQ ID NO: 4011639 - RNA, 13 nt, Staphylococcus aureus subsp. aureus MW2
caauuuaaauaag

SEQ ID NO: 4011640 - RNA, 19 nt, Staphylococcus aureus subsp. aureus MW2
caauuuaaauaaguuacuc

SEQ ID NO: 4011641 - RNA, 15 nt, Staphylococcus aureus subsp. aureus MW2
caauuuaauagacau

SEQ ID NO: 4011642 - RNA, 18 nt, Staphylococcus aureus subsp. aureus MW2
caauuuaauagacauuaa

SEQ ID NO: 4011643 - RNA, 19 nt, Staphylococcus aureus subsp. aureus MW2
caauuuaguauaaauaaaa

SEQ ID NO: 4011644 - RNA, 16 nt, Staphylococcus aureus subsp. aureus MW2
caauuuaguucacaau

SEQ ID NO: 4011645 - RNA, 18 nt, Staphylococcus aureus subsp. aureus MW2
caauuuaucgagaacauc

SEQ ID NO: 4011646 - RNA, 22 nt, Staphylococcus aureus subsp. aureus MW2
caauuuauuauuaacuguaccu

SEQ ID NO: 4011647 - RNA, 16 nt, Staphylococcus aureus subsp. aureus MW2
caauuuauuuuuauau

SEQ ID NO: 4011648 - RNA, 13 nt, Staphylococcus aureus subsp. aureus MW2
caauuucuacaga

SEQ ID NO: 4011649 - RNA, 16 nt, Staphylococcus aureus subsp. aureus MW2
caauuucuacagacaa

SEQ ID NO: 4011650 - RNA, 12 nt, Staphylococcus aureus subsp. aureus MW2
caauuucucuau

SEQ ID NO: 4011651 - RNA, 14 nt, Staphylococcus aureus subsp. aureus MW2
caauuucucugugu

SEQ ID NO: 4011652 - RNA, 13 nt, Staphylococcus aureus subsp. aureus MW2
caauuucuguaau

SEQ ID NO: 4011653 - RNA, 15 nt, Staphylococcus aureus subsp. aureus MW2
caauuugcauaacau

SEQ ID NO: 4011654 - RNA, 23 nt, Staphylococcus aureus subsp. aureus MW2
caauuugcuguccacuauauccu

SEQ ID NO: 4011655 - RNA, 15 nt, Staphylococcus aureus subsp. aureus MW2
caauuuggaaauauc

SEQ ID NO: 4011656 - RNA, 22 nt, Staphylococcus aureus subsp. aureus MW2
caauuuguccuucgcuaugacc

SEQ ID NO: 4011657 - RNA, 17 nt, Staphylococcus aureus subsp. aureus MW2
caauuuuaaaucuuuua

SEQ ID NO: 4011658 - RNA, 13 nt, Staphylococcus aureus subsp. aureus MW2
caauuuuaccaug

SEQ ID NO: 4011659 - RNA, 15 nt, Staphylococcus aureus subsp. aureus MW2
caauuuuaucugaau

SEQ ID NO: 4011660 - RNA, 19 nt, Staphylococcus aureus subsp. aureus MW2
caauuuucucauuaaccuu

SEQ ID NO: 4011661 - RNA, 14 nt, Staphylococcus aureus subsp. aureus MW2
caauuuuuaacaaa

SEQ ID NO: 4011662 - RNA, 19 nt, Staphylococcus aureus subsp. aureus MW2
caauuuuucacuuauaaca

SEQ ID NO: 4011663 - RNA, 23 nt, Staphylococcus aureus subsp. aureus MW2
caauuuuugaaagugauaaaucu

SEQ ID NO: 4011664 - RNA, 15 nt, Staphylococcus aureus subsp. aureus MW2
caauuuuuucaucuu

SEQ ID NO: 4011665 - RNA, 14 nt, Staphylococcus aureus subsp. aureus MW2
cacaaaaaugaaga

SEQ ID NO: 4011666 - RNA, 22 nt, Staphylococcus aureus subsp. aureus MW2
cacaaaauuaggcauucaucua

SEQ ID NO: 4011667 - RNA, 23 nt, Staphylococcus aureus subsp. aureus MW2
cacaaacaagaauaaaucccaua

SEQ ID NO: 4011668 - RNA, 22 nt, Staphylococcus aureus subsp. aureus MW2
cacaaaugaauggagcaugauu

SEQ ID NO: 4011669 - RNA, 18 nt, Staphylococcus aureus subsp. aureus MW2
cacaaaugcuacaucaau

SEQ ID NO: 4011670 - RNA, 21 nt, Staphylococcus aureus subsp. aureus MW2
cacaacaaucacgauuaaugu

SEQ ID NO: 4011671 - RNA, 23 nt, Staphylococcus aureus subsp. aureus MW2
cacaacauguuuggaugaacaaa

SEQ ID NO: 4011672 - RNA, 16 nt, Staphylococcus aureus subsp. aureus MW2
cacaaccagucagaaa

SEQ ID NO: 4011673 - RNA, 14 nt, Staphylococcus aureus subsp. aureus MW2
cacaagcaucuaua

SEQ ID NO: 4011674 - RNA, 15 nt, Staphylococcus aureus subsp. aureus MW2
cacaauaagauugac

SEQ ID NO: 4011675 - RNA, 16 nt, Staphylococcus aureus subsp. aureus MW2
cacaauaucacuuaaa

SEQ ID NO: 4011676 - RNA, 15 nt, Staphylococcus aureus subsp. aureus MW2
cacacagcuucauua

SEQ ID NO: 4011677 - RNA, 20 nt, Staphylococcus aureus subsp. aureus MW2
cacacagguaaauuuaaaau

SEQ ID NO: 4011678 - RNA, 22 nt, Staphylococcus aureus subsp. aureus MW2
cacacagguaaauuuaaaauaa

SEQ ID NO: 4011679 - RNA, 15 nt, Staphylococcus aureus subsp. aureus MW2
cacacaguuuauaau

SEQ ID NO: 4011680 - RNA, 14 nt, Staphylococcus aureus subsp. aureus MW2
cacacuuuaaacaa

SEQ ID NO: 4011681 - RNA, 22 nt, Staphylococcus aureus subsp. aureus MW2
cacagaagcuggcggaaaguca

SEQ ID NO: 4011682 - RNA, 21 nt, Staphylococcus aureus subsp. aureus MW2
cacagcaauucacuuauacau

SEQ ID NO: 4011683 - RNA, 18 nt, Staphylococcus aureus subsp. aureus MW2
cacaguuauauauuacuu

SEQ ID NO: 4011684 - RNA, 19 nt, Staphylococcus aureus subsp. aureus MW2
cacaguuucaucuucaacu

SEQ ID NO: 4011685 - RNA, 12 nt, Staphylococcus aureus subsp. aureus MW2
cacauaaaucaa

SEQ ID NO: 4011686 - RNA, 15 nt, Staphylococcus aureus subsp. aureus MW2
cacauaugauaauua

SEQ ID NO: 4011687 - RNA, 13 nt, Staphylococcus aureus subsp. aureus MW2
cacaucacuauac

SEQ ID NO: 4011688 - RNA, 23 nt, Staphylococcus aureus subsp. aureus MW2
cacaucauaauaaaucuaucuau

SEQ ID NO: 4011689 - RNA, 15 nt, Staphylococcus aureus subsp. aureus MW2
cacaucauagcacua

SEQ ID NO: 4011690 - RNA, 23 nt, Staphylococcus aureus subsp. aureus MW2
cacaucauagcacuacaucaagu

SEQ ID NO: 4011691 - RNA, 16 nt, Staphylococcus aureus subsp. aureus MW2
cacaucaugacauuaa

SEQ ID NO: 4011692 - RNA, 20 nt, Staphylococcus aureus subsp. aureus MW2
cacaucaugacauuaaucau

SEQ ID NO: 4011693 - RNA, 15 nt, Staphylococcus aureus subsp. aureus MW2
cacaucgcauaauau

SEQ ID NO: 4011694 - RNA, 13 nt, Staphylococcus aureus subsp. aureus MW2
cacaucuaugugg

SEQ ID NO: 4011695 - RNA, 22 nt, Staphylococcus aureus subsp. aureus MW2
cacaucuuuagcuauuuaaaau

SEQ ID NO: 4011696 - RNA, 16 nt, Staphylococcus aureus subsp. aureus MW2
cacaucuuuuugauaa

SEQ ID NO: 4011697 - RNA, 13 nt, Staphylococcus aureus subsp. aureus MW2
cacaugaauuuua

SEQ ID NO: 4011698 - RNA, 18 nt, Staphylococcus aureus subsp. aureus MW2
cacauguaccacauuuuc

SEQ ID NO: 4011699 - RNA, 12 nt, Staphylococcus aureus subsp. aureus MW2
cacaugugaaau

SEQ ID NO: 4011700 - RNA, 14 nt, Staphylococcus aureus subsp. aureus MW2
cacauuaacaaggc

SEQ ID NO: 4011701 - RNA, 18 nt, Staphylococcus aureus subsp. aureus MW2
cacauuauuguaaccuga

SEQ ID NO: 4011702 - RNA, 15 nt, Staphylococcus aureus subsp. aureus MW2
cacauugucuacaaa

SEQ ID NO: 4011703 - RNA, 23 nt, Staphylococcus aureus subsp. aureus MW2
cacauuuuuaguuagaaaguauu

SEQ ID NO: 4011704 - RNA, 23 nt, Staphylococcus aureus subsp. aureus MW2
caccaacaauagguacaacuaaa

SEQ ID NO: 4011705 - RNA, 21 nt, Staphylococcus aureus subsp. aureus MW2
caccaaugauagugaauaaug

SEQ ID NO: 4011706 - RNA, 19 nt, Staphylococcus aureus subsp. aureus MW2
caccaauuaggauucgauu

SEQ ID NO: 4011707 - RNA, 16 nt, Staphylococcus aureus subsp. aureus MW2
caccaauuaucaacau

SEQ ID NO: 4011708 - RNA, 16 nt, Staphylococcus aureus subsp. aureus MW2
caccagaacaauucaa

SEQ ID NO: 4011709 - RNA, 18 nt, Staphylococcus aureus subsp. aureus MW2
caccagauaucauaauau

SEQ ID NO: 4011710 - RNA, 13 nt, Staphylococcus aureus subsp. aureus MW2
caccagcacauca

SEQ ID NO: 4011711 - RNA, 14 nt, Staphylococcus aureus subsp. aureus MW2
caccagcacaucaa

SEQ ID NO: 4011712 - RNA, 22 nt, Staphylococcus aureus subsp. aureus MW2
caccagccaauggaacgccgaa

SEQ ID NO: 4011713 - RNA, 17 nt, Staphylococcus aureus subsp. aureus MW2
caccagccccaauuagc

SEQ ID NO: 4011714 - RNA, 21 nt, Staphylococcus aureus subsp. aureus MW2
caccaguuugugguaaugauu

SEQ ID NO: 4011715 - RNA, 13 nt, Staphylococcus aureus subsp. aureus MW2
caccauaaaaaua

SEQ ID NO: 4011716 - RNA, 12 nt, Staphylococcus aureus subsp. aureus MW2
caccauaugugg

SEQ ID NO: 4011717 - RNA, 22 nt, Staphylococcus aureus subsp. aureus MW2
caccaucugcaacuaauaugau

SEQ ID NO: 4011718 - RNA, 15 nt, Staphylococcus aureus subsp. aureus MW2
caccauugcacaguu

SEQ ID NO: 4011719 - RNA, 21 nt, Staphylococcus aureus subsp. aureus MW2
cacccaauaauugcugucacu

SEQ ID NO: 4011720 - RNA, 14 nt, Staphylococcus aureus subsp. aureus MW2
caccccuucucuaa

SEQ ID NO: 4011721 - RNA, 18 nt, Staphylococcus aureus subsp. aureus MW2
caccguaaucuuuuaacu

SEQ ID NO: 4011722 - RNA, 20 nt, Staphylococcus aureus subsp. aureus MW2
caccguggaauuuaccauuu

SEQ ID NO: 4011723 - RNA, 14 nt, Staphylococcus aureus subsp. aureus MW2
caccuaaaauagaa

SEQ ID NO: 4011724 - RNA, 13 nt, Staphylococcus aureus subsp. aureus MW2
caccuaaaugauu

SEQ ID NO: 4011725 - RNA, 22 nt, Staphylococcus aureus subsp. aureus MW2
caccuaauaaugcgauuacagu

SEQ ID NO: 4011726 - RNA, 13 nt, Staphylococcus aureus subsp. aureus MW2
caccuacaaauau

SEQ ID NO: 4011727 - RNA, 19 nt, Staphylococcus aureus subsp. aureus MW2
caccuacaaauauuucuaa

SEQ ID NO: 4011728 - RNA, 18 nt, Staphylococcus aureus subsp. aureus MW2
caccucuaaguucaccua

SEQ ID NO: 4011729 - RNA, 19 nt, Staphylococcus aureus subsp. aureus MW2
caccucuaaguucaccuaa

SEQ ID NO: 4011730 - RNA, 14 nt, Staphylococcus aureus subsp. aureus MW2
caccugcaacacua

SEQ ID NO: 4011731 - RNA, 16 nt, Staphylococcus aureus subsp. aureus MW2
caccugcaauuuguaa

SEQ ID NO: 4011732 - RNA, 15 nt, Staphylococcus aureus subsp. aureus MW2
caccugcagcauccu

SEQ ID NO: 4011733 - RNA, 21 nt, Staphylococcus aureus subsp. aureus MW2
caccuggucguacuuucaaau

SEQ ID NO: 4011734 - RNA, 16 nt, Staphylococcus aureus subsp. aureus MW2
caccuucaauaucugu

SEQ ID NO: 4011735 - RNA, 17 nt, Staphylococcus aureus subsp. aureus MW2
caccuucaauaucugua

SEQ ID NO: 4011736 - RNA, 16 nt, Staphylococcus aureus subsp. aureus MW2
caccuuuacaacauac

SEQ ID NO: 4011737 - RNA, 21 nt, Staphylococcus aureus subsp. aureus MW2
caccuuuaucuguaucaaagu

SEQ ID NO: 4011738 - RNA, 18 nt, Staphylococcus aureus subsp. aureus MW2
caccuuuauuaccagcuu

SEQ ID NO: 4011739 - RNA, 18 nt, Staphylococcus aureus subsp. aureus MW2
caccuuucgcgacuucau

SEQ ID NO: 4011740 - RNA, 19 nt, Staphylococcus aureus subsp. aureus MW2
caccuuuuuuaacuuuaac

SEQ ID NO: 4011741 - RNA, 22 nt, Staphylococcus aureus subsp. aureus MW2
caccuuuuuuaacuuuaacauc

SEQ ID NO: 4011742 - RNA, 15 nt, Staphylococcus aureus subsp. aureus MW2
cacgaacaacauuag

SEQ ID NO: 4011743 - RNA, 14 nt, Staphylococcus aureus subsp. aureus MW2
cacgacauguaggu

SEQ ID NO: 4011744 - RNA, 15 nt, Staphylococcus aureus subsp. aureus MW2
cacgacguucuucaa

SEQ ID NO: 4011745 - RNA, 12 nt, Staphylococcus aureus subsp. aureus MW2
cacgacuuucua

SEQ ID NO: 4011746 - RNA, 11 nt, Staphylococcus aureus subsp. aureus MW2
cacgagaaaug

SEQ ID NO: 4011747 - RNA, 17 nt, Staphylococcus aureus subsp. aureus MW2
cacgagcugcuucaacu

SEQ ID NO: 4011748 - RNA, 18 nt, Staphylococcus aureus subsp. aureus MW2
cacgauagucauaacgau

SEQ ID NO: 4011749 - RNA, 23 nt, Staphylococcus aureus subsp. aureus MW2
cacgaucaguugagucaauuucu

SEQ ID NO: 4011750 - RNA, 19 nt, Staphylococcus aureus subsp. aureus MW2
cacgauuaaugucacaugu

SEQ ID NO: 4011751 - RNA, 23 nt, Staphylococcus aureus subsp. aureus MW2
cacgauuacgcucauaugucugu

SEQ ID NO: 4011752 - RNA, 12 nt, Staphylococcus aureus subsp. aureus MW2
cacgauuuuuaa

SEQ ID NO: 4011753 - RNA, 19 nt, Staphylococcus aureus subsp. aureus MW2
cacgcggugggcgaaauca

SEQ ID NO: 4011754 - RNA, 23 nt, Staphylococcus aureus subsp. aureus MW2
cacgcuaacauucagugcaauga

SEQ ID NO: 4011755 - RNA, 21 nt, Staphylococcus aureus subsp. aureus MW2
cacgcucauuuucuguugcag

SEQ ID NO: 4011756 - RNA, 13 nt, Staphylococcus aureus subsp. aureus MW2
cacggucccaaga

SEQ ID NO: 4011757 - RNA, 20 nt, Staphylococcus aureus subsp. aureus MW2
cacguaauugaguuguugca

SEQ ID NO: 4011758 - RNA, 17 nt, Staphylococcus aureus subsp. aureus MW2
cacgugguuucuuuaau

SEQ ID NO: 4011759 - RNA, 14 nt, Staphylococcus aureus subsp. aureus MW2
cacuaaauucaaua

SEQ ID NO: 4011760 - RNA, 19 nt, Staphylococcus aureus subsp. aureus MW2
cacuaauauuuaaaaaaca

SEQ ID NO: 4011761 - RNA, 16 nt, Staphylococcus aureus subsp. aureus MW2
cacuaaugcauaauua

SEQ ID NO: 4011762 - RNA, 17 nt, Staphylococcus aureus subsp. aureus MW2
cacuaauggcacuuaau

SEQ ID NO: 4011763 - RNA, 24 nt, Staphylococcus aureus subsp. aureus MW2
cacuacgcugaugaaugauugcau

SEQ ID NO: 4011764 - RNA, 18 nt, Staphylococcus aureus subsp. aureus MW2
cacuagcaacaucuuuug

SEQ ID NO: 4011765 - RNA, 15 nt, Staphylococcus aureus subsp. aureus MW2
cacuagcgucagcaa

SEQ ID NO: 4011766 - RNA, 14 nt, Staphylococcus aureus subsp. aureus MW2
cacuagcuaaugca

SEQ ID NO: 4011767 - RNA, 21 nt, Staphylococcus aureus subsp. aureus MW2
cacuaggauguucaucaacau

SEQ ID NO: 4011768 - RNA, 20 nt, Staphylococcus aureus subsp. aureus MW2
cacuauaaaagccaugauac

SEQ ID NO: 4011769 - RNA, 16 nt, Staphylococcus aureus subsp. aureus MW2
cacuauauccuuuuug

SEQ ID NO: 4011770 - RNA, 13 nt, Staphylococcus aureus subsp. aureus MW2
cacuaucauuauc

SEQ ID NO: 4011771 - RNA, 19 nt, Staphylococcus aureus subsp. aureus MW2
cacuaucauuaucaaauaa

SEQ ID NO: 4011772 - RNA, 11 nt, Staphylococcus aureus subsp. aureus MW2
cacuaucuuuu

SEQ ID NO: 4011773 - RNA, 12 nt, Staphylococcus aureus subsp. aureus MW2
cacuauuuuuau

SEQ ID NO: 4011774 - RNA, 17 nt, Staphylococcus aureus subsp. aureus MW2
cacucaauucucuaacu

SEQ ID NO: 4011775 - RNA, 18 nt, Staphylococcus aureus subsp. aureus MW2
cacucauaaccgcuucuu

SEQ ID NO: 4011776 - RNA, 19 nt, Staphylococcus aureus subsp. aureus MW2
cacucauaaccgcuucuuu

SEQ ID NO: 4011777 - RNA, 20 nt, Staphylococcus aureus subsp. aureus MW2
cacucauaaccgcuucuuuu

SEQ ID NO: 4011778 - RNA, 19 nt, Staphylococcus aureus subsp. aureus MW2
cacucauaaucaagucugc

SEQ ID NO: 4011779 - RNA, 17 nt, Staphylococcus aureus subsp. aureus MW2
cacucauuuuuugcaaa

SEQ ID NO: 4011780 - RNA, 15 nt, Staphylococcus aureus subsp. aureus MW2
cacuccuuaaacaaa

SEQ ID NO: 4011781 - RNA, 22 nt, Staphylococcus aureus subsp. aureus MW2
cacuccuuaaacaaauaaaugu

SEQ ID NO: 4011782 - RNA, 14 nt, Staphylococcus aureus subsp. aureus MW2
cacugaaaucuaga

SEQ ID NO: 4011783 - RNA, 17 nt, Staphylococcus aureus subsp. aureus MW2
cacugagcaacaaaaga

SEQ ID NO: 4011784 - RNA, 15 nt, Staphylococcus aureus subsp. aureus MW2
cacugcaacacaggc

SEQ ID NO: 4011785 - RNA, 20 nt, Staphylococcus aureus subsp. aureus MW2
cacugcacaucauaauaaau

SEQ ID NO: 4011786 - RNA, 14 nt, Staphylococcus aureus subsp. aureus MW2
cacugccguuugaa

SEQ ID NO: 4011787 - RNA, 23 nt, Staphylococcus aureus subsp. aureus MW2
cacugcuaaaauuguauuauuau

SEQ ID NO: 4011788 - RNA, 14 nt, Staphylococcus aureus subsp. aureus MW2
cacugcuuuuaaau

SEQ ID NO: 4011789 - RNA, 23 nt, Staphylococcus aureus subsp. aureus MW2
cacugcuuuuaaaucauuaagaa

SEQ ID NO: 4011790 - RNA, 19 nt, Staphylococcus aureus subsp. aureus MW2
cacugucauguguucaaau

SEQ ID NO: 4011791 - RNA, 17 nt, Staphylococcus aureus subsp. aureus MW2
cacuuaauaaauaauuu

SEQ ID NO: 4011792 - RNA, 22 nt, Staphylococcus aureus subsp. aureus MW2
cacuuaauaucaguagcauauu

SEQ ID NO: 4011793 - RNA, 22 nt, Staphylococcus aureus subsp. aureus MW2
cacuuaaucguucccauucuuu

SEQ ID NO: 4011794 - RNA, 23 nt, Staphylococcus aureus subsp. aureus MW2
cacuuaaucguucccauucuuug

SEQ ID NO: 4011795 - RNA, 21 nt, Staphylococcus aureus subsp. aureus MW2
cacuuacugugaaaauaccaa

SEQ ID NO: 4011796 - RNA, 23 nt, Staphylococcus aureus subsp. aureus MW2
cacuuagauuccccuuuuugucu

SEQ ID NO: 4011797 - RNA, 15 nt, Staphylococcus aureus subsp. aureus MW2
cacuuagcaaucucu

SEQ ID NO: 4011798 - RNA, 12 nt, Staphylococcus aureus subsp. aureus MW2
cacuuauuauuu

SEQ ID NO: 4011799 - RNA, 20 nt, Staphylococcus aureus subsp. aureus MW2
cacuucaguuaaaccuucua

SEQ ID NO: 4011800 - RNA, 11 nt, Staphylococcus aureus subsp. aureus MW2
cacuucauaaa

SEQ ID NO: 4011801 - RNA, 14 nt, Staphylococcus aureus subsp. aureus MW2
cacuucgccaagcc

SEQ ID NO: 4011802 - RNA, 23 nt, Staphylococcus aureus subsp. aureus MW2
cacuucgccaagccaucuuucuu

SEQ ID NO: 4011803 - RNA, 21 nt, Staphylococcus aureus subsp. aureus MW2
cacuucuguaccgaauuggau

SEQ ID NO: 4011804 - RNA, 12 nt, Staphylococcus aureus subsp. aureus MW2
cacuucuucacc

SEQ ID NO: 4011805 - RNA, 16 nt, Staphylococcus aureus subsp. aureus MW2
cacuugcuaaaacuaa

SEQ ID NO: 4011806 - RNA, 18 nt, Staphylococcus aureus subsp. aureus MW2
cacuuggauucaaaugac

SEQ ID NO: 4011807 - RNA, 13 nt, Staphylococcus aureus subsp. aureus MW2
cacuugguacacc

SEQ ID NO: 4011808 - RNA, 15 nt, Staphylococcus aureus subsp. aureus MW2
cacuuucuacucuaa

SEQ ID NO: 4011809 - RNA, 20 nt, Staphylococcus aureus subsp. aureus MW2
cacuuucuacucuaauuaca

SEQ ID NO: 4011810 - RNA, 14 nt, Staphylococcus aureus subsp. aureus MW2
cacuuugaucuuua

SEQ ID NO: 4011811 - RNA, 14 nt, Staphylococcus aureus subsp. aureus MW2
cacuuuucaugaug

SEQ ID NO: 4011812 - RNA, 13 nt, Staphylococcus aureus subsp. aureus MW2
cacuuuuuaaacg

SEQ ID NO: 4011813 - RNA, 18 nt, Staphylococcus aureus subsp. aureus MW2
cacuuuuuuguucaauca

SEQ ID NO: 4011814 - RNA, 14 nt, Staphylococcus aureus subsp. aureus MW2
cagaaaugauauuu

SEQ ID NO: 4011815 - RNA, 15 nt, Staphylococcus aureus subsp. aureus MW2
cagaaauuuaauauu

SEQ ID NO: 4011816 - RNA, 13 nt, Staphylococcus aureus subsp. aureus MW2
cagaacuaaugua

SEQ ID NO: 4011817 - RNA, 17 nt, Staphylococcus aureus subsp. aureus MW2
cagaagcuggcggaaag

SEQ ID NO: 4011818 - RNA, 19 nt, Staphylococcus aureus subsp. aureus MW2
cagaaugguaauucaccau

SEQ ID NO: 4011819 - RNA, 22 nt, Staphylococcus aureus subsp. aureus MW2
cagaauuauuugauuauguaaa

SEQ ID NO: 4011820 - RNA, 16 nt, Staphylococcus aureus subsp. aureus MW2
cagaauuucaucaaau

SEQ ID NO: 4011821 - RNA, 23 nt, Staphylococcus aureus subsp. aureus MW2
cagacgaaacacacuaaaagcug

SEQ ID NO: 4011822 - RNA, 14 nt, Staphylococcus aureus subsp. aureus MW2
cagacgaaucaaag

SEQ ID NO: 4011823 - RNA, 23 nt, Staphylococcus aureus subsp. aureus MW2
cagaguugucauucuucaucgca

SEQ ID NO: 4011824 - RNA, 16 nt, Staphylococcus aureus subsp. aureus MW2
cagauaagaauauuua

SEQ ID NO: 4011825 - RNA, 18 nt, Staphylococcus aureus subsp. aureus MW2
cagauaagaauauuuaag

SEQ ID NO: 4011826 - RNA, 13 nt, Staphylococcus aureus subsp. aureus MW2
cagauaauuauuu

SEQ ID NO: 4011827 - RNA, 14 nt, Staphylococcus aureus subsp. aureus MW2
cagauaauuauuuc

SEQ ID NO: 4011828 - RNA, 16 nt, Staphylococcus aureus subsp. aureus MW2
cagauaauuauuucua

SEQ ID NO: 4011829 - RNA, 22 nt, Staphylococcus aureus subsp. aureus MW2
cagauagaaugucgauauuucu

SEQ ID NO: 4011830 - RNA, 23 nt, Staphylococcus aureus subsp. aureus MW2
cagauagaaugucgauauuucua

SEQ ID NO: 4011831 - RNA, 16 nt, Staphylococcus aureus subsp. aureus MW2
cagaugaaccaaaaaa

SEQ ID NO: 4011832 - RNA, 14 nt, Staphylococcus aureus subsp. aureus MW2
cagaugaauaaugu

SEQ ID NO: 4011833 - RNA, 14 nt, Staphylococcus aureus subsp. aureus MW2
cagauguugguuca

SEQ ID NO: 4011834 - RNA, 18 nt, Staphylococcus aureus subsp. aureus MW2
cagauguugguucaucaa

SEQ ID NO: 4011835 - RNA, 23 nt, Staphylococcus aureus subsp. aureus MW2
cagauguugguucaucaaacaac

SEQ ID NO: 4011836 - RNA, 14 nt, Staphylococcus aureus subsp. aureus MW2
cagauucaaacguu

SEQ ID NO: 4011837 - RNA, 22 nt, Staphylococcus aureus subsp. aureus MW2
cagauucauaucuuucaauuaa

SEQ ID NO: 4011838 - RNA, 15 nt, Staphylococcus aureus subsp. aureus MW2
cagauucuucaccaa

SEQ ID NO: 4011839 - RNA, 14 nt, Staphylococcus aureus subsp. aureus MW2
cagauugauauaaa

SEQ ID NO: 4011840 - RNA, 18 nt, Staphylococcus aureus subsp. aureus MW2
cagauuuauauuccauuu

SEQ ID NO: 4011841 - RNA, 23 nt, Staphylococcus aureus subsp. aureus MW2
cagauuuauauuccauuucaaau

SEQ ID NO: 4011842 - RNA, 13 nt, Staphylococcus aureus subsp. aureus MW2
cagauuuuauuaa

SEQ ID NO: 4011843 - RNA, 11 nt, Staphylococcus aureus subsp. aureus MW2
cagcaaauaaa

SEQ ID NO: 4011844 - RNA, 12 nt, Staphylococcus aureus subsp. aureus MW2
cagcaaauaaaa

SEQ ID NO: 4011845 - RNA, 20 nt, Staphylococcus aureus subsp. aureus MW2
cagcaaaugcuuaagaaauu

SEQ ID NO: 4011846 - RNA, 17 nt, Staphylococcus aureus subsp. aureus MW2
cagcacagcgauuaaau

SEQ ID NO: 4011847 - RNA, 14 nt, Staphylococcus aureus subsp. aureus MW2
cagcaccgccugaa

SEQ ID NO: 4011848 - RNA, 17 nt, Staphylococcus aureus subsp. aureus MW2
cagcaguaagauuauuu

SEQ ID NO: 4011849 - RNA, 18 nt, Staphylococcus aureus subsp. aureus MW2
cagcaguaagauuauuuu

SEQ ID NO: 4011850 - RNA, 19 nt, Staphylococcus aureus subsp. aureus MW2
cagcagugaaguuaacuau

SEQ ID NO: 4011851 - RNA, 15 nt, Staphylococcus aureus subsp. aureus MW2
cagcauacaauaaug

SEQ ID NO: 4011852 - RNA, 22 nt, Staphylococcus aureus subsp. aureus MW2
cagcauuaccagcaauuucgau

SEQ ID NO: 4011853 - RNA, 12 nt, Staphylococcus aureus subsp. aureus MW2
cagcauuuaagu

SEQ ID NO: 4011854 - RNA, 16 nt, Staphylococcus aureus subsp. aureus MW2
cagccauaauaucuuu

SEQ ID NO: 4011855 - RNA, 22 nt, Staphylococcus aureus subsp. aureus MW2
cagccauuuguuguaaaccagc

SEQ ID NO: 4011856 - RNA, 12 nt, Staphylococcus aureus subsp. aureus MW2
cagcgaaauuug

SEQ ID NO: 4011857 - RNA, 15 nt, Staphylococcus aureus subsp. aureus MW2
cagcgaaauuuguaa

SEQ ID NO: 4011858 - RNA, 14 nt, Staphylococcus aureus subsp. aureus MW2
cagcgacauuuuua

SEQ ID NO: 4011859 - RNA, 15 nt, Staphylococcus aureus subsp. aureus MW2
cagcgauuguuaaac

SEQ ID NO: 4011860 - RNA, 18 nt, Staphylococcus aureus subsp. aureus MW2
cagcguuaucuuuaagua

SEQ ID NO: 4011861 - RNA, 21 nt, Staphylococcus aureus subsp. aureus MW2
cagcuaaaaaguauacuaaac

SEQ ID NO: 4011862 - RNA, 19 nt, Staphylococcus aureus subsp. aureus MW2
cagcuaaaaguuucccaag

SEQ ID NO: 4011863 - RNA, 14 nt, Staphylococcus aureus subsp. aureus MW2
cagcucguuuuuug

SEQ ID NO: 4011864 - RNA, 22 nt, Staphylococcus aureus subsp. aureus MW2
cagcuuaauuugacaaucuaaa

SEQ ID NO: 4011865 - RNA, 14 nt, Staphylococcus aureus subsp. aureus MW2
cagcuuacaauaau

SEQ ID NO: 4011866 - RNA, 16 nt, Staphylococcus aureus subsp. aureus MW2
cagcuuacaauaaugu

SEQ ID NO: 4011867 - RNA, 15 nt, Staphylococcus aureus subsp. aureus MW2
cagcuucaaaaucaa

SEQ ID NO: 4011868 - RNA, 17 nt, Staphylococcus aureus subsp. aureus MW2
cagcuucuuuaacaauu

SEQ ID NO: 4011869 - RNA, 22 nt, Staphylococcus aureus subsp. aureus MW2
cagcuuguccauaguaaucgau

SEQ ID NO: 4011870 - RNA, 14 nt, Staphylococcus aureus subsp. aureus MW2
cagcuuuaauaaua

SEQ ID NO: 4011871 - RNA, 13 nt, Staphylococcus aureus subsp. aureus MW2
caggaauagaugu

SEQ ID NO: 4011872 - RNA, 14 nt, Staphylococcus aureus subsp. aureus MW2
caggaauuguuaaa

SEQ ID NO: 4011873 - RNA, 20 nt, Staphylococcus aureus subsp. aureus MW2
caggaccacucaauucucua

SEQ ID NO: 4011874 - RNA, 18 nt, Staphylococcus aureus subsp. aureus MW2
caggaucacguuuuucuu

SEQ ID NO: 4011875 - RNA, 13 nt, Staphylococcus aureus subsp. aureus MW2
caggcaaugcaag

SEQ ID NO: 4011876 - RNA, 17 nt, Staphylococcus aureus subsp. aureus MW2
caggcgcuccuacuuuu

SEQ ID NO: 4011877 - RNA, 19 nt, Staphylococcus aureus subsp. aureus MW2
caggcuggaacauuaaguu

SEQ ID NO: 4011878 - RNA, 14 nt, Staphylococcus aureus subsp. aureus MW2
cagggaaaucaucu

SEQ ID NO: 4011879 - RNA, 15 nt, Staphylococcus aureus subsp. aureus MW2
cagguaauguuugaa

SEQ ID NO: 4011880 - RNA, 16 nt, Staphylococcus aureus subsp. aureus MW2
cagguauguucaucag

SEQ ID NO: 4011881 - RNA, 13 nt, Staphylococcus aureus subsp. aureus MW2
caggugauugacg

SEQ ID NO: 4011882 - RNA, 13 nt, Staphylococcus aureus subsp. aureus MW2
cagguuaacauuu

SEQ ID NO: 4011883 - RNA, 22 nt, Staphylococcus aureus subsp. aureus MW2
cagguuacaauaaugugcaagu

SEQ ID NO: 4011884 - RNA, 14 nt, Staphylococcus aureus subsp. aureus MW2
cagguuauagaaua

SEQ ID NO: 4011885 - RNA, 16 nt, Staphylococcus aureus subsp. aureus MW2
cagguuauagaauacc

SEQ ID NO: 4011886 - RNA, 16 nt, Staphylococcus aureus subsp. aureus MW2
cagguuaucacaacag

SEQ ID NO: 4011887 - RNA, 18 nt, Staphylococcus aureus subsp. aureus MW2
cagguuaucacaacagua

SEQ ID NO: 4011888 - RNA, 16 nt, Staphylococcus aureus subsp. aureus MW2
cagguuuaauaaauuu

SEQ ID NO: 4011889 - RNA, 15 nt, Staphylococcus aureus subsp. aureus MW2
caguaaucaaaguau

SEQ ID NO: 4011890 - RNA, 19 nt, Staphylococcus aureus subsp. aureus MW2
caguaaucaaaguaucagu

SEQ ID NO: 4011891 - RNA, 21 nt, Staphylococcus aureus subsp. aureus MW2
caguaauugugacgaccgugu

SEQ ID NO: 4011892 - RNA, 22 nt, Staphylococcus aureus subsp. aureus MW2
caguaauuuuuaaacaaaaaua

SEQ ID NO: 4011893 - RNA, 13 nt, Staphylococcus aureus subsp. aureus MW2
caguacaaauaac

SEQ ID NO: 4011894 - RNA, 22 nt, Staphylococcus aureus subsp. aureus MW2
caguacgguuauuuaauaaugc

SEQ ID NO: 4011895 - RNA, 16 nt, Staphylococcus aureus subsp. aureus MW2
caguaggacacauaaa

SEQ ID NO: 4011896 - RNA, 15 nt, Staphylococcus aureus subsp. aureus MW2
caguaguugacugaa

SEQ ID NO: 4011897 - RNA, 21 nt, Staphylococcus aureus subsp. aureus MW2
caguaguugacuguaaaacaa

SEQ ID NO: 4011898 - RNA, 22 nt, Staphylococcus aureus subsp. aureus MW2
caguaguugacuguaaaacaau

SEQ ID NO: 4011899 - RNA, 15 nt, Staphylococcus aureus subsp. aureus MW2
caguauaauuuucug

SEQ ID NO: 4011900 - RNA, 17 nt, Staphylococcus aureus subsp. aureus MW2
caguauauaucaaauac

SEQ ID NO: 4011901 - RNA, 18 nt, Staphylococcus aureus subsp. aureus MW2
caguauauuuuaacaaug

SEQ ID NO: 4011902 - RNA, 23 nt, Staphylococcus aureus subsp. aureus MW2
caguauuugccuuuugaauaauu

SEQ ID NO: 4011903 - RNA, 14 nt, Staphylococcus aureus subsp. aureus MW2
caguauuuguauug

SEQ ID NO: 4011904 - RNA, 17 nt, Staphylococcus aureus subsp. aureus MW2
cagucaacuacugucaa

SEQ ID NO: 4011905 - RNA, 21 nt, Staphylococcus aureus subsp. aureus MW2
cagucaaugacuuaacaucuu

SEQ ID NO: 4011906 - RNA, 16 nt, Staphylococcus aureus subsp. aureus MW2
cagucaauuuuuucau

SEQ ID NO: 4011907 - RNA, 19 nt, Staphylococcus aureus subsp. aureus MW2
cagucaauuuuuucaucuu

SEQ ID NO: 4011908 - RNA, 15 nt, Staphylococcus aureus subsp. aureus MW2
cagucaguaaaaaua

SEQ ID NO: 4011909 - RNA, 18 nt, Staphylococcus aureus subsp. aureus MW2
cagucauuugauuuaaaa

SEQ ID NO: 4011910 - RNA, 17 nt, Staphylococcus aureus subsp. aureus MW2
caguccauuuuuuauag

SEQ ID NO: 4011911 - RNA, 15 nt, Staphylococcus aureus subsp. aureus MW2
cagucucuaaaacuu

SEQ ID NO: 4011912 - RNA, 20 nt, Staphylococcus aureus subsp. aureus MW2
cagucucuaaaacuuuuuca

SEQ ID NO: 4011913 - RNA, 17 nt, Staphylococcus aureus subsp. aureus MW2
cagucucuuugaagggu

SEQ ID NO: 4011914 - RNA, 18 nt, Staphylococcus aureus subsp. aureus MW2
cagugaaguuaacuauaa

SEQ ID NO: 4011915 - RNA, 22 nt, Staphylococcus aureus subsp. aureus MW2
cagugaaucuaaacuauaauaa

SEQ ID NO: 4011916 - RNA, 11 nt, Staphylococcus aureus subsp. aureus MW2
cagugcaauga

SEQ ID NO: 4011917 - RNA, 20 nt, Staphylococcus aureus subsp. aureus MW2
cagugcuaauuuugagacaa

SEQ ID NO: 4011918 - RNA, 16 nt, Staphylococcus aureus subsp. aureus MW2
cagugcuauguauuuu

SEQ ID NO: 4011919 - RNA, 23 nt, Staphylococcus aureus subsp. aureus MW2
cagugcuauguauuuuucuuaau

SEQ ID NO: 4011920 - RNA, 15 nt, Staphylococcus aureus subsp. aureus MW2
caguggcauuuaaaa

SEQ ID NO: 4011921 - RNA, 23 nt, Staphylococcus aureus subsp. aureus MW2
caguggcauuuaaaaaucuacau

SEQ ID NO: 4011922 - RNA, 18 nt, Staphylococcus aureus subsp. aureus MW2
caguguuauauuggcggg

SEQ ID NO: 4011923 - RNA, 12 nt, Staphylococcus aureus subsp. aureus MW2
caguuaauaauu

SEQ ID NO: 4011924 - RNA, 14 nt, Staphylococcus aureus subsp. aureus MW2
caguuaauaauuuu

SEQ ID NO: 4011925 - RNA, 14 nt, Staphylococcus aureus subsp. aureus MW2
caguuaauuauuua

SEQ ID NO: 4011926 - RNA, 21 nt, Staphylococcus aureus subsp. aureus MW2
caguuaauuauuuagauucuu

SEQ ID NO: 4011927 - RNA, 20 nt, Staphylococcus aureus subsp. aureus MW2
caguuacucuauagucaucu

SEQ ID NO: 4011928 - RNA, 18 nt, Staphylococcus aureus subsp. aureus MW2
caguuagaaacagaauua

SEQ ID NO: 4011929 - RNA, 21 nt, Staphylococcus aureus subsp. aureus MW2
caguuagaaacagaauuauuu

SEQ ID NO: 4011930 - RNA, 16 nt, Staphylococcus aureus subsp. aureus MW2
caguugaaguugaagc

SEQ ID NO: 4011931 - RNA, 15 nt, Staphylococcus aureus subsp. aureus MW2
caguugagucaauuu

SEQ ID NO: 4011932 - RNA, 14 nt, Staphylococcus aureus subsp. aureus MW2
caguuguuuuuuug

SEQ ID NO: 4011933 - RNA, 21 nt, Staphylococcus aureus subsp. aureus MW2
caguuucaucuucaacuuucu

SEQ ID NO: 4011934 - RNA, 22 nt, Staphylococcus aureus subsp. aureus MW2
caguuucuaauaaugcauguga

SEQ ID NO: 4011935 - RNA, 15 nt, Staphylococcus aureus subsp. aureus MW2
caguuucuauauuuu

SEQ ID NO: 4011936 - RNA, 17 nt, Staphylococcus aureus subsp. aureus MW2
caguuugaauugacuga

SEQ ID NO: 4011937 - RNA, 20 nt, Staphylococcus aureus subsp. aureus MW2
caguuugauuaaaauccgcu

SEQ ID NO: 4011938 - RNA, 14 nt, Staphylococcus aureus subsp. aureus MW2
caguuuuaugaaua

SEQ ID NO: 4011939 - RNA, 18 nt, Staphylococcus aureus subsp. aureus MW2
caguuuuauuaucuuugu

SEQ ID NO: 4011940 - RNA, 12 nt, Staphylococcus aureus subsp. aureus MW2
caguuuuuauau

SEQ ID NO: 4011941 - RNA, 17 nt, Staphylococcus aureus subsp. aureus MW2
caguuuuuauauuaaga

SEQ ID NO: 4011942 - RNA, 13 nt, Staphylococcus aureus subsp. aureus MW2
cauaaaaaaagag

SEQ ID NO: 4011943 - RNA, 13 nt, Staphylococcus aureus subsp. aureus MW2
cauaaaaauauuc

SEQ ID NO: 4011944 - RNA, 20 nt, Staphylococcus aureus subsp. aureus MW2
cauaaaaaucauaaauaaca

SEQ ID NO: 4011945 - RNA, 19 nt, Staphylococcus aureus subsp. aureus MW2
cauaaaacuuacauuacau

SEQ ID NO: 4011946 - RNA, 23 nt, Staphylococcus aureus subsp. aureus MW2
cauaaaacuuacauuacauauau

SEQ ID NO: 4011947 - RNA, 20 nt, Staphylococcus aureus subsp. aureus MW2
cauaaaagacagaaauuacu

SEQ ID NO: 4011948 - RNA, 14 nt, Staphylococcus aureus subsp. aureus MW2
cauaaaccaugauu

SEQ ID NO: 4011949 - RNA, 14 nt, Staphylococcus aureus subsp. aureus MW2
cauaaacucuuaua

SEQ ID NO: 4011950 - RNA, 22 nt, Staphylococcus aureus subsp. aureus MW2
cauaaagaauuucgaaaagaaa

SEQ ID NO: 4011951 - RNA, 17 nt, Staphylococcus aureus subsp. aureus MW2
cauaaagcuuugacaua

SEQ ID NO: 4011952 - RNA, 22 nt, Staphylococcus aureus subsp. aureus MW2
cauaaagugaguauaaguuugu

SEQ ID NO: 4011953 - RNA, 16 nt, Staphylococcus aureus subsp. aureus MW2
cauaaaguuuauuuau

SEQ ID NO: 4011954 - RNA, 23 nt, Staphylococcus aureus subsp. aureus MW2
cauaaauaagcguaaaaucaugu

SEQ ID NO: 4011955 - RNA, 16 nt, Staphylococcus aureus subsp. aureus MW2
cauaaauauaaaauau

SEQ ID NO: 4011956 - RNA, 14 nt, Staphylococcus aureus subsp. aureus MW2
cauaaauauaagau

SEQ ID NO: 4011957 - RNA, 19 nt, Staphylococcus aureus subsp. aureus MW2
cauaaauauuggaauacuc

SEQ ID NO: 4011958 - RNA, 12 nt, Staphylococcus aureus subsp. aureus MW2
cauaaaucaaug

SEQ ID NO: 4011959 - RNA, 17 nt, Staphylococcus aureus subsp. aureus MW2
cauaaaugcuaaaagua

SEQ ID NO: 4011960 - RNA, 23 nt, Staphylococcus aureus subsp. aureus MW2
cauaaaugcuucugguucuucaa

SEQ ID NO: 4011961 - RNA, 22 nt, Staphylococcus aureus subsp. aureus MW2
cauaaauuuauauauagaaaua

SEQ ID NO: 4011962 - RNA, 14 nt, Staphylococcus aureus subsp. aureus MW2
cauaacaaagaacc

SEQ ID NO: 4011963 - RNA, 15 nt, Staphylococcus aureus subsp. aureus MW2
cauaacaacaucaaa

SEQ ID NO: 4011964 - RNA, 21 nt, Staphylococcus aureus subsp. aureus MW2
cauaacaccgcaaugccacau

SEQ ID NO: 4011965 - RNA, 16 nt, Staphylococcus aureus subsp. aureus MW2
cauaacauaagaaaaa

SEQ ID NO: 4011966 - RNA, 19 nt, Staphylococcus aureus subsp. aureus MW2
cauaacauaagaaaaagca

SEQ ID NO: 4011967 - RNA, 17 nt, Staphylococcus aureus subsp. aureus MW2
cauaaccaaguaauucu

SEQ ID NO: 4011968 - RNA, 19 nt, Staphylococcus aureus subsp. aureus MW2
cauaaccuugcuuugcaua

SEQ ID NO: 4011969 - RNA, 23 nt, Staphylococcus aureus subsp. aureus MW2
cauaacgacaacuugaacuaaaa

SEQ ID NO: 4011970 - RNA, 14 nt, Staphylococcus aureus subsp. aureus MW2
cauaacucaaauau

SEQ ID NO: 4011971 - RNA, 14 nt, Staphylococcus aureus subsp. aureus MW2
cauaacugaauaaa

SEQ ID NO: 4011972 - RNA, 15 nt, Staphylococcus aureus subsp. aureus MW2
cauaagaaaaagcag

SEQ ID NO: 4011973 - RNA, 14 nt, Staphylococcus aureus subsp. aureus MW2
cauaagaaaauacu

SEQ ID NO: 4011974 - RNA, 13 nt, Staphylococcus aureus subsp. aureus MW2
cauaagcaaagau

SEQ ID NO: 4011975 - RNA, 20 nt, Staphylococcus aureus subsp. aureus MW2
cauaagucacaguaucuuca

SEQ ID NO: 4011976 - RNA, 13 nt, Staphylococcus aureus subsp. aureus MW2
cauaauaaaaagg

SEQ ID NO: 4011977 - RNA, 12 nt, Staphylococcus aureus subsp. aureus MW2
cauaauacacau

SEQ ID NO: 4011978 - RNA, 20 nt, Staphylococcus aureus subsp. aureus MW2
cauaauacacauugcaacgu

SEQ ID NO: 4011979 - RNA, 15 nt, Staphylococcus aureus subsp. aureus MW2
cauaauauauuaaaa

SEQ ID NO: 4011980 - RNA, 18 nt, Staphylococcus aureus subsp. aureus MW2
cauaauauauuaaaaauc

SEQ ID NO: 4011981 - RNA, 19 nt, Staphylococcus aureus subsp. aureus MW2
cauaauauuucuuaccauu

SEQ ID NO: 4011982 - RNA, 15 nt, Staphylococcus aureus subsp. aureus MW2
cauaaucaagucugc

SEQ ID NO: 4011983 - RNA, 12 nt, Staphylococcus aureus subsp. aureus MW2
cauaaucauaau

SEQ ID NO: 4011984 - RNA, 22 nt, Staphylococcus aureus subsp. aureus MW2
cauaaucauuaguuaugugcua

SEQ ID NO: 4011985 - RNA, 19 nt, Staphylococcus aureus subsp. aureus MW2
cauaauccauucuucuugu

SEQ ID NO: 4011986 - RNA, 21 nt, Staphylococcus aureus subsp. aureus MW2
cauaaucguauucauaucauu

SEQ ID NO: 4011987 - RNA, 14 nt, Staphylococcus aureus subsp. aureus MW2
cauaaucuucauua

SEQ ID NO: 4011988 - RNA, 12 nt, Staphylococcus aureus subsp. aureus MW2
cauaaucuuuau

SEQ ID NO: 4011989 - RNA, 23 nt, Staphylococcus aureus subsp. aureus MW2
cauaaucuuuauuaauaaauucu

SEQ ID NO: 4011990 - RNA, 20 nt, Staphylococcus aureus subsp. aureus MW2
cauaaugacuauaacaccaa

SEQ ID NO: 4011991 - RNA, 11 nt, Staphylococcus aureus subsp. aureus MW2
cauaaugguuc

SEQ ID NO: 4011992 - RNA, 21 nt, Staphylococcus aureus subsp. aureus MW2
cauaauuaaauagcuuuacuu

SEQ ID NO: 4011993 - RNA, 14 nt, Staphylococcus aureus subsp. aureus MW2
cauaauuaauaaca

SEQ ID NO: 4011994 - RNA, 18 nt, Staphylococcus aureus subsp. aureus MW2
cauaauuaggauuaacau

SEQ ID NO: 4011995 - RNA, 14 nt, Staphylococcus aureus subsp. aureus MW2
cauaauuccauagu

SEQ ID NO: 4011996 - RNA, 14 nt, Staphylococcus aureus subsp. aureus MW2
cauaauucuagaga

SEQ ID NO: 4011997 - RNA, 15 nt, Staphylococcus aureus subsp. aureus MW2
cauaauuuaaaugau

SEQ ID NO: 4011998 - RNA, 18 nt, Staphylococcus aureus subsp. aureus MW2
cauaauuuucuauuauuu

SEQ ID NO: 4011999 - RNA, 18 nt, Staphylococcus aureus subsp. aureus MW2
cauacaaauuuuuuuuau

SEQ ID NO: 4012000 - RNA, 13 nt, Staphylococcus aureus subsp. aureus MW2
cauacaauaaugu

SEQ ID NO: 4012001 - RNA, 15 nt, Staphylococcus aureus subsp. aureus MW2
cauacacaaugauua

SEQ ID NO: 4012002 - RNA, 14 nt, Staphylococcus aureus subsp. aureus MW2
cauacagaucucaa

SEQ ID NO: 4012003 - RNA, 15 nt, Staphylococcus aureus subsp. aureus MW2
cauacauaacacaag

SEQ ID NO: 4012004 - RNA, 15 nt, Staphylococcus aureus subsp. aureus MW2
cauacauaucuuuug

SEQ ID NO: 4012005 - RNA, 17 nt, Staphylococcus aureus subsp. aureus MW2
cauacauauuuauauuu

SEQ ID NO: 4012006 - RNA, 17 nt, Staphylococcus aureus subsp. aureus MW2
cauacccauauuaaauu

SEQ ID NO: 4012007 - RNA, 17 nt, Staphylococcus aureus subsp. aureus MW2
cauaccguacaaaggua

SEQ ID NO: 4012008 - RNA, 17 nt, Staphylococcus aureus subsp. aureus MW2
cauaccuaauaacgcau

SEQ ID NO: 4012009 - RNA, 17 nt, Staphylococcus aureus subsp. aureus MW2
cauaccuacaaauaugu

SEQ ID NO: 4012010 - RNA, 17 nt, Staphylococcus aureus subsp. aureus MW2
cauaccuuuauuauuua

SEQ ID NO: 4012011 - RNA, 18 nt, Staphylococcus aureus subsp. aureus MW2
cauacgaauuaaaauaac

SEQ ID NO: 4012012 - RNA, 23 nt, Staphylococcus aureus subsp. aureus MW2
cauacgaucuuuuucaaugugau

SEQ ID NO: 4012013 - RNA, 12 nt, Staphylococcus aureus subsp. aureus MW2
cauacguucaau

SEQ ID NO: 4012014 - RNA, 14 nt, Staphylococcus aureus subsp. aureus MW2
cauacguucaaucg

SEQ ID NO: 4012015 - RNA, 15 nt, Staphylococcus aureus subsp. aureus MW2
cauacuacucccccg

SEQ ID NO: 4012016 - RNA, 22 nt, Staphylococcus aureus subsp. aureus MW2
cauacuauacaauguauuuuga

SEQ ID NO: 4012017 - RNA, 17 nt, Staphylococcus aureus subsp. aureus MW2
cauacugauuaaacugu

SEQ ID NO: 4012018 - RNA, 13 nt, Staphylococcus aureus subsp. aureus MW2
cauacuucaauaa

SEQ ID NO: 4012019 - RNA, 16 nt, Staphylococcus aureus subsp. aureus MW2
cauacuucuauuuuau

SEQ ID NO: 4012020 - RNA, 18 nt, Staphylococcus aureus subsp. aureus MW2
cauacuucuauuuuauaa

SEQ ID NO: 4012021 - RNA, 14 nt, Staphylococcus aureus subsp. aureus MW2
cauagaagcuggcg

SEQ ID NO: 4012022 - RNA, 14 nt, Staphylococcus aureus subsp. aureus MW2
cauagagaaauuug

SEQ ID NO: 4012023 - RNA, 15 nt, Staphylococcus aureus subsp. aureus MW2
cauagagaaauuuga

SEQ ID NO: 4012024 - RNA, 14 nt, Staphylococcus aureus subsp. aureus MW2
cauagagaauuuca

SEQ ID NO: 4012025 - RNA, 18 nt, Staphylococcus aureus subsp. aureus MW2
cauagauaauugcuauaa

SEQ ID NO: 4012026 - RNA, 18 nt, Staphylococcus aureus subsp. aureus MW2
cauagaugacgaucuaua

SEQ ID NO: 4012027 - RNA, 16 nt, Staphylococcus aureus subsp. aureus MW2
cauagcauuaagauga

SEQ ID NO: 4012028 - RNA, 22 nt, Staphylococcus aureus subsp. aureus MW2
cauagcauuaagaugauugucu

SEQ ID NO: 4012029 - RNA, 15 nt, Staphylococcus aureus subsp. aureus MW2
cauagccucuuaaaa

SEQ ID NO: 4012030 - RNA, 18 nt, Staphylococcus aureus subsp. aureus MW2
cauagcucuucuuuuucu

SEQ ID NO: 4012031 - RNA, 23 nt, Staphylococcus aureus subsp. aureus MW2
cauaggcgcuguuccaaauucau

SEQ ID NO: 4012032 - RNA, 15 nt, Staphylococcus aureus subsp. aureus MW2
cauaggcgcuuuuuu

SEQ ID NO: 4012033 - RNA, 21 nt, Staphylococcus aureus subsp. aureus MW2
cauaggcgcuuuuuuuuauaa

SEQ ID NO: 4012034 - RNA, 20 nt, Staphylococcus aureus subsp. aureus MW2
cauaguauacauaauucaau

SEQ ID NO: 4012035 - RNA, 21 nt, Staphylococcus aureus subsp. aureus MW2
cauagucgguuauuacaaaau

SEQ ID NO: 4012036 - RNA, 18 nt, Staphylococcus aureus subsp. aureus MW2
cauagucugcuauuuuuu

SEQ ID NO: 4012037 - RNA, 16 nt, Staphylococcus aureus subsp. aureus MW2
cauaguuauuaaaucu

SEQ ID NO: 4012038 - RNA, 20 nt, Staphylococcus aureus subsp. aureus MW2
cauauaaagucguaucauau

SEQ ID NO: 4012039 - RNA, 14 nt, Staphylococcus aureus subsp. aureus MW2
cauauaagauaauu

SEQ ID NO: 4012040 - RNA, 21 nt, Staphylococcus aureus subsp. aureus MW2
cauauaagccccaccaugauu

SEQ ID NO: 4012041 - RNA, 14 nt, Staphylococcus aureus subsp. aureus MW2
cauauaauaugugc

SEQ ID NO: 4012042 - RNA, 15 nt, Staphylococcus aureus subsp. aureus MW2
cauauaauaugugca

SEQ ID NO: 4012043 - RNA, 18 nt, Staphylococcus aureus subsp. aureus MW2
cauauaaugguugaauaa

SEQ ID NO: 4012044 - RNA, 20 nt, Staphylococcus aureus subsp. aureus MW2
cauauaauuugggucguuag

SEQ ID NO: 4012045 - RNA, 21 nt, Staphylococcus aureus subsp. aureus MW2
cauauaauuuuaauauuaugu

SEQ ID NO: 4012046 - RNA, 20 nt, Staphylococcus aureus subsp. aureus MW2
cauauacaaauuuauauuaa

SEQ ID NO: 4012047 - RNA, 21 nt, Staphylococcus aureus subsp. aureus MW2
cauauacaaauuuauauuaaa

SEQ ID NO: 4012048 - RNA, 21 nt, Staphylococcus aureus subsp. aureus MW2
cauauacauaccacacuuuaa

SEQ ID NO: 4012049 - RNA, 15 nt, Staphylococcus aureus subsp. aureus MW2
cauauacgacauuuu

SEQ ID NO: 4012050 - RNA, 16 nt, Staphylococcus aureus subsp. aureus MW2
cauauacgacauuuuu

SEQ ID NO: 4012051 - RNA, 17 nt, Staphylococcus aureus subsp. aureus MW2
cauauacgacauuuuua

SEQ ID NO: 4012052 - RNA, 18 nt, Staphylococcus aureus subsp. aureus MW2
cauauacgacauuuuuag

SEQ ID NO: 4012053 - RNA, 19 nt, Staphylococcus aureus subsp. aureus MW2
cauauacgacauuuuuaga

SEQ ID NO: 4012054 - RNA, 14 nt, Staphylococcus aureus subsp. aureus MW2
cauauacuauaugu

SEQ ID NO: 4012055 - RNA, 17 nt, Staphylococcus aureus subsp. aureus MW2
cauauacucuaaaaaag

SEQ ID NO: 4012056 - RNA, 17 nt, Staphylococcus aureus subsp. aureus MW2
cauauaguuguaucaaa

SEQ ID NO: 4012057 - RNA, 18 nt, Staphylococcus aureus subsp. aureus MW2
cauauaugauaaauauug

SEQ ID NO: 4012058 - RNA, 16 nt, Staphylococcus aureus subsp. aureus MW2
cauauaugucucucuu

SEQ ID NO: 4012059 - RNA, 13 nt, Staphylococcus aureus subsp. aureus MW2
cauauauuuuguu

SEQ ID NO: 4012060 - RNA, 20 nt, Staphylococcus aureus subsp. aureus MW2
cauauauuuuguuaauaagc

SEQ ID NO: 4012061 - RNA, 15 nt, Staphylococcus aureus subsp. aureus MW2
cauaucauauuacuu

SEQ ID NO: 4012062 - RNA, 22 nt, Staphylococcus aureus subsp. aureus MW2
cauaucgugcguuaaauauaua

SEQ ID NO: 4012063 - RNA, 18 nt, Staphylococcus aureus subsp. aureus MW2
cauaucuauaucgucgau

SEQ ID NO: 4012064 - RNA, 19 nt, Staphylococcus aureus subsp. aureus MW2
cauaucucaagauauccau

SEQ ID NO: 4012065 - RNA, 17 nt, Staphylococcus aureus subsp. aureus MW2
cauaugaaaaaugucua

SEQ ID NO: 4012066 - RNA, 18 nt, Staphylococcus aureus subsp. aureus MW2
cauaugaaaaaugucuaa

SEQ ID NO: 4012067 - RNA, 15 nt, Staphylococcus aureus subsp. aureus MW2
cauauguaauacaaa

SEQ ID NO: 4012068 - RNA, 18 nt, Staphylococcus aureus subsp. aureus MW2
cauauguaauacaaaaga

SEQ ID NO: 4012069 - RNA, 15 nt, Staphylococcus aureus subsp. aureus MW2
cauauguacuauuau

SEQ ID NO: 4012070 - RNA, 18 nt, Staphylococcus aureus subsp. aureus MW2
cauaugucuguuccucaa

SEQ ID NO: 4012071 - RNA, 16 nt, Staphylococcus aureus subsp. aureus MW2
cauauguuguuucuaa

SEQ ID NO: 4012072 - RNA, 14 nt, Staphylococcus aureus subsp. aureus MW2
cauauuaacuguua

SEQ ID NO: 4012073 - RNA, 15 nt, Staphylococcus aureus subsp. aureus MW2
cauauuaauauguua

SEQ ID NO: 4012074 - RNA, 19 nt, Staphylococcus aureus subsp. aureus MW2
cauauuacuucucaucgaa

SEQ ID NO: 4012075 - RNA, 15 nt, Staphylococcus aureus subsp. aureus MW2
cauauucaaaauaac

SEQ ID NO: 4012076 - RNA, 21 nt, Staphylococcus aureus subsp. aureus MW2
cauauucaaaauaacuuaugg

SEQ ID NO: 4012077 - RNA, 18 nt, Staphylococcus aureus subsp. aureus MW2
cauauucauaauaucgau

SEQ ID NO: 4012078 - RNA, 15 nt, Staphylococcus aureus subsp. aureus MW2
cauauugcacauaaa

SEQ ID NO: 4012079 - RNA, 23 nt, Staphylococcus aureus subsp. aureus MW2
cauauugugccgcuucuacaacu

SEQ ID NO: 4012080 - RNA, 22 nt, Staphylococcus aureus subsp. aureus MW2
cauauuuacacagaaugauaua

SEQ ID NO: 4012081 - RNA, 22 nt, Staphylococcus aureus subsp. aureus MW2
cauauuuagguaauacaucauc

SEQ ID NO: 4012082 - RNA, 20 nt, Staphylococcus aureus subsp. aureus MW2
cauauuuaucgcgauuauua

SEQ ID NO: 4012083 - RNA, 23 nt, Staphylococcus aureus subsp. aureus MW2
cauauuuaucgcgauuauuacca

SEQ ID NO: 4012084 - RNA, 13 nt, Staphylococcus aureus subsp. aureus MW2
cauauuucuaaau

SEQ ID NO: 4012085 - RNA, 16 nt, Staphylococcus aureus subsp. aureus MW2
cauauuucuaaauuau

SEQ ID NO: 4012086 - RNA, 19 nt, Staphylococcus aureus subsp. aureus MW2
cauauuucuaaauuauuua

SEQ ID NO: 4012087 - RNA, 13 nt, Staphylococcus aureus subsp. aureus MW2
cauauuuucacaa

SEQ ID NO: 4012088 - RNA, 11 nt, Staphylococcus aureus subsp. aureus MW2
cauauuuugau

SEQ ID NO: 4012089 - RNA, 16 nt, Staphylococcus aureus subsp. aureus MW2
cauauuuuuugauaua

SEQ ID NO: 4012090 - RNA, 13 nt, Staphylococcus aureus subsp. aureus MW2
caucaaaaaugag

SEQ ID NO: 4012091 - RNA, 12 nt, Staphylococcus aureus subsp. aureus MW2
caucaaaauuua

SEQ ID NO: 4012092 - RNA, 14 nt, Staphylococcus aureus subsp. aureus MW2
caucaaauucaaau

SEQ ID NO: 4012093 - RNA, 14 nt, Staphylococcus aureus subsp. aureus MW2
caucaaauucucau

SEQ ID NO: 4012094 - RNA, 16 nt, Staphylococcus aureus subsp. aureus MW2
caucaacuauuuacau

SEQ ID NO: 4012095 - RNA, 18 nt, Staphylococcus aureus subsp. aureus MW2
caucaagguguccuuuuu

SEQ ID NO: 4012096 - RNA, 20 nt, Staphylococcus aureus subsp. aureus MW2
caucaaguauaaauguuauu

SEQ ID NO: 4012097 - RNA, 14 nt, Staphylococcus aureus subsp. aureus MW2
caucaaguugauaa

SEQ ID NO: 4012098 - RNA, 18 nt, Staphylococcus aureus subsp. aureus MW2
caucaauaaauauugauu

SEQ ID NO: 4012099 - RNA, 17 nt, Staphylococcus aureus subsp. aureus MW2
caucaauaccauaauua

SEQ ID NO: 4012100 - RNA, 14 nt, Staphylococcus aureus subsp. aureus MW2
caucaauaucaaau

SEQ ID NO: 4012101 - RNA, 22 nt, Staphylococcus aureus subsp. aureus MW2
caucaaucgcuuuagcaauuga

SEQ ID NO: 4012102 - RNA, 21 nt, Staphylococcus aureus subsp. aureus MW2
caucaaucguaacuaacaugu

SEQ ID NO: 4012103 - RNA, 22 nt, Staphylococcus aureus subsp. aureus MW2
caucaaugagcaagucuucuaa

SEQ ID NO: 4012104 - RNA, 18 nt, Staphylococcus aureus subsp. aureus MW2
caucaauuucuguaauaa

SEQ ID NO: 4012105 - RNA, 15 nt, Staphylococcus aureus subsp. aureus MW2
caucacagaaaauac

SEQ ID NO: 4012106 - RNA, 19 nt, Staphylococcus aureus subsp. aureus MW2
caucacuaaaguaaauaac

SEQ ID NO: 4012107 - RNA, 18 nt, Staphylococcus aureus subsp. aureus MW2
caucacucgcaaucgaga

SEQ ID NO: 4012108 - RNA, 13 nt, Staphylococcus aureus subsp. aureus MW2
caucacuugcugu

SEQ ID NO: 4012109 - RNA, 20 nt, Staphylococcus aureus subsp. aureus MW2
caucacuugcuguugcaaua

SEQ ID NO: 4012110 - RNA, 19 nt, Staphylococcus aureus subsp. aureus MW2
caucaguaacauguaauga

SEQ ID NO: 4012111 - RNA, 17 nt, Staphylococcus aureus subsp. aureus MW2
caucaguauuuguauug

SEQ ID NO: 4012112 - RNA, 21 nt, Staphylococcus aureus subsp. aureus MW2
caucauaaacgaaaauacuca

SEQ ID NO: 4012113 - RNA, 15 nt, Staphylococcus aureus subsp. aureus MW2
caucauaauaaaucu

SEQ ID NO: 4012114 - RNA, 23 nt, Staphylococcus aureus subsp. aureus MW2
caucauaaucuuuuccuaaaccu

SEQ ID NO: 4012115 - RNA, 15 nt, Staphylococcus aureus subsp. aureus MW2
caucauagcacuaca

SEQ ID NO: 4012116 - RNA, 12 nt, Staphylococcus aureus subsp. aureus MW2
caucauauacau

SEQ ID NO: 4012117 - RNA, 14 nt, Staphylococcus aureus subsp. aureus MW2
caucauauauaccu

SEQ ID NO: 4012118 - RNA, 14 nt, Staphylococcus aureus subsp. aureus MW2
caucaucaaguuca

SEQ ID NO: 4012119 - RNA, 12 nt, Staphylococcus aureus subsp. aureus MW2
caucaucaccau

SEQ ID NO: 4012120 - RNA, 22 nt, Staphylococcus aureus subsp. aureus MW2
caucaucacuguagauucaaau

SEQ ID NO: 4012121 - RNA, 12 nt, Staphylococcus aureus subsp. aureus MW2
caucaucuauuu

SEQ ID NO: 4012122 - RNA, 16 nt, Staphylococcus aureus subsp. aureus MW2
caucaugaaauuagau

SEQ ID NO: 4012123 - RNA, 21 nt, Staphylococcus aureus subsp. aureus MW2
caucaugauuauuucgccuuu

SEQ ID NO: 4012124 - RNA, 14 nt, Staphylococcus aureus subsp. aureus MW2
caucauguuuaucu

SEQ ID NO: 4012125 - RNA, 15 nt, Staphylococcus aureus subsp. aureus MW2
caucauguuuaucua

SEQ ID NO: 4012126 - RNA, 16 nt, Staphylococcus aureus subsp. aureus MW2
caucauguuuaucuac

SEQ ID NO: 4012127 - RNA, 15 nt, Staphylococcus aureus subsp. aureus MW2
caucauuaaauauuu

SEQ ID NO: 4012128 - RNA, 13 nt, Staphylococcus aureus subsp. aureus MW2
caucauucucaaa

SEQ ID NO: 4012129 - RNA, 13 nt, Staphylococcus aureus subsp. aureus MW2
caucauuguaaaa

SEQ ID NO: 4012130 - RNA, 16 nt, Staphylococcus aureus subsp. aureus MW2
caucauuguaaaacaa

SEQ ID NO: 4012131 - RNA, 21 nt, Staphylococcus aureus subsp. aureus MW2
caucauuuaauugaugucaca

SEQ ID NO: 4012132 - RNA, 21 nt, Staphylococcus aureus subsp. aureus MW2
caucauuuauauggaauacua

SEQ ID NO: 4012133 - RNA, 17 nt, Staphylococcus aureus subsp. aureus MW2
caucauuuguguuuuua

SEQ ID NO: 4012134 - RNA, 22 nt, Staphylococcus aureus subsp. aureus MW2
caucauuuuucguuguucauaa

SEQ ID NO: 4012135 - RNA, 19 nt, Staphylococcus aureus subsp. aureus MW2
cauccaauuauguuuaucu

SEQ ID NO: 4012136 - RNA, 18 nt, Staphylococcus aureus subsp. aureus MW2
cauccccagccauuuguu

SEQ ID NO: 4012137 - RNA, 18 nt, Staphylococcus aureus subsp. aureus MW2
cauccuaauguaauuauu

SEQ ID NO: 4012138 - RNA, 22 nt, Staphylococcus aureus subsp. aureus MW2
cauccuacgacacguguaaaaa

SEQ ID NO: 4012139 - RNA, 20 nt, Staphylococcus aureus subsp. aureus MW2
cauccuuaauacguugcuca

SEQ ID NO: 4012140 - RNA, 16 nt, Staphylococcus aureus subsp. aureus MW2
caucgaacaugaauga

SEQ ID NO: 4012141 - RNA, 14 nt, Staphylococcus aureus subsp. aureus MW2
caucgaagauguua

SEQ ID NO: 4012142 - RNA, 16 nt, Staphylococcus aureus subsp. aureus MW2
caucgauaucuaaguc

SEQ ID NO: 4012143 - RNA, 24 nt, Staphylococcus aureus subsp. aureus MW2
caucgauugauaauguaaaaugau

SEQ ID NO: 4012144 - RNA, 19 nt, Staphylococcus aureus subsp. aureus MW2
caucgcaaaaacauaauca

SEQ ID NO: 4012145 - RNA, 21 nt, Staphylococcus aureus subsp. aureus MW2
caucguauagaugugucuuuu

SEQ ID NO: 4012146 - RNA, 14 nt, Staphylococcus aureus subsp. aureus MW2
caucguauucuuuu

SEQ ID NO: 4012147 - RNA, 21 nt, Staphylococcus aureus subsp. aureus MW2
caucgucaucacuuuuuaaac

SEQ ID NO: 4012148 - RNA, 22 nt, Staphylococcus aureus subsp. aureus MW2
caucgucaucacuuuuuaaacg

SEQ ID NO: 4012149 - RNA, 19 nt, Staphylococcus aureus subsp. aureus MW2
caucgucgcuaaagaccuu

SEQ ID NO: 4012150 - RNA, 21 nt, Staphylococcus aureus subsp. aureus MW2
caucguuuacuacaucauaaa

SEQ ID NO: 4012151 - RNA, 17 nt, Staphylococcus aureus subsp. aureus MW2
caucuaaaugguuaucu

SEQ ID NO: 4012152 - RNA, 23 nt, Staphylococcus aureus subsp. aureus MW2
caucuaaaugguuaucuaaaauu

SEQ ID NO: 4012153 - RNA, 17 nt, Staphylococcus aureus subsp. aureus MW2
caucuaaauuugccaug

SEQ ID NO: 4012154 - RNA, 13 nt, Staphylococcus aureus subsp. aureus MW2
caucuauguggcu

SEQ ID NO: 4012155 - RNA, 19 nt, Staphylococcus aureus subsp. aureus MW2
caucucaacuaaucgugua

SEQ ID NO: 4012156 - RNA, 21 nt, Staphylococcus aureus subsp. aureus MW2
caucucuuauaaguucaacca

SEQ ID NO: 4012157 - RNA, 12 nt, Staphylococcus aureus subsp. aureus MW2
caucucuucugg

SEQ ID NO: 4012158 - RNA, 22 nt, Staphylococcus aureus subsp. aureus MW2
caucugaaaaaauuaauaauuu

SEQ ID NO: 4012159 - RNA, 13 nt, Staphylococcus aureus subsp. aureus MW2
caucugcaacuaa

SEQ ID NO: 4012160 - RNA, 15 nt, Staphylococcus aureus subsp. aureus MW2
caucugcaagggauc

SEQ ID NO: 4012161 - RNA, 15 nt, Staphylococcus aureus subsp. aureus MW2
caucugcaagugcuu

SEQ ID NO: 4012162 - RNA, 20 nt, Staphylococcus aureus subsp. aureus MW2
caucuggagacgaaccauuu

SEQ ID NO: 4012163 - RNA, 14 nt, Staphylococcus aureus subsp. aureus MW2
caucuguagguuua

SEQ ID NO: 4012164 - RNA, 16 nt, Staphylococcus aureus subsp. aureus MW2
caucuguagguuuaau

SEQ ID NO: 4012165 - RNA, 22 nt, Staphylococcus aureus subsp. aureus MW2
caucuguagguuuaauguuuaa

SEQ ID NO: 4012166 - RNA, 23 nt, Staphylococcus aureus subsp. aureus MW2
caucuguagguuuaauguuuaau

SEQ ID NO: 4012167 - RNA, 13 nt, Staphylococcus aureus subsp. aureus MW2
caucuguuaauuc

SEQ ID NO: 4012168 - RNA, 19 nt, Staphylococcus aureus subsp. aureus MW2
caucuguuaauucaggaug

SEQ ID NO: 4012169 - RNA, 12 nt, Staphylococcus aureus subsp. aureus MW2
caucuucaacau

SEQ ID NO: 4012170 - RNA, 19 nt, Staphylococcus aureus subsp. aureus MW2
caucuucaacuuucucuaa

SEQ ID NO: 4012171 - RNA, 22 nt, Staphylococcus aureus subsp. aureus MW2
caucuucaagacgcauuguugu

SEQ ID NO: 4012172 - RNA, 23 nt, Staphylococcus aureus subsp. aureus MW2
caucuucaagacgcauuguugua

SEQ ID NO: 4012173 - RNA, 23 nt, Staphylococcus aureus subsp. aureus MW2
caucuucuggauagguaucacua

SEQ ID NO: 4012174 - RNA, 13 nt, Staphylococcus aureus subsp. aureus MW2
caucuucuucauc

SEQ ID NO: 4012175 - RNA, 15 nt, Staphylococcus aureus subsp. aureus MW2
caucuucuucaucau

SEQ ID NO: 4012176 - RNA, 20 nt, Staphylococcus aureus subsp. aureus MW2
caucuucuugauuguaaaua

SEQ ID NO: 4012177 - RNA, 19 nt, Staphylococcus aureus subsp. aureus MW2
caucuugcgccuuguucaa

SEQ ID NO: 4012178 - RNA, 14 nt, Staphylococcus aureus subsp. aureus MW2
caucuuuaaagaaa

SEQ ID NO: 4012179 - RNA, 19 nt, Staphylococcus aureus subsp. aureus MW2
caucuuuaagcucuuaauc

SEQ ID NO: 4012180 - RNA, 18 nt, Staphylococcus aureus subsp. aureus MW2
caucuuuaagcuuaaaua

SEQ ID NO: 4012181 - RNA, 14 nt, Staphylococcus aureus subsp. aureus MW2
caucuuuauacaca

SEQ ID NO: 4012182 - RNA, 17 nt, Staphylococcus aureus subsp. aureus MW2
caucuuuauuuacaaug

SEQ ID NO: 4012183 - RNA, 21 nt, Staphylococcus aureus subsp. aureus MW2
caucuuuguaaccuaaaaaca

SEQ ID NO: 4012184 - RNA, 18 nt, Staphylococcus aureus subsp. aureus MW2
caucuuuguuuucaaacu

SEQ ID NO: 4012185 - RNA, 13 nt, Staphylococcus aureus subsp. aureus MW2
caucuuuuuaaaa

SEQ ID NO: 4012186 - RNA, 19 nt, Staphylococcus aureus subsp. aureus MW2
caucuuuuugauaauguuc

SEQ ID NO: 4012187 - RNA, 21 nt, Staphylococcus aureus subsp. aureus MW2
caugaaucgcauuuaaauaua

SEQ ID NO: 4012188 - RNA, 18 nt, Staphylococcus aureus subsp. aureus MW2
caugaauuuuaauauauu

SEQ ID NO: 4012189 - RNA, 15 nt, Staphylococcus aureus subsp. aureus MW2
caugaauuuucauca

SEQ ID NO: 4012190 - RNA, 16 nt, Staphylococcus aureus subsp. aureus MW2
caugaauuuucaucau

SEQ ID NO: 4012191 - RNA, 18 nt, Staphylococcus aureus subsp. aureus MW2
caugacacucauucaauu

SEQ ID NO: 4012192 - RNA, 12 nt, Staphylococcus aureus subsp. aureus MW2
caugaccaacag

SEQ ID NO: 4012193 - RNA, 23 nt, Staphylococcus aureus subsp. aureus MW2
caugacgaacgauagauucugau

SEQ ID NO: 4012194 - RNA, 15 nt, Staphylococcus aureus subsp. aureus MW2
caugacgauaaugaa

SEQ ID NO: 4012195 - RNA, 16 nt, Staphylococcus aureus subsp. aureus MW2
caugacgauuccaauc

SEQ ID NO: 4012196 - RNA, 18 nt, Staphylococcus aureus subsp. aureus MW2
caugagccuucuaucuuu

SEQ ID NO: 4012197 - RNA, 13 nt, Staphylococcus aureus subsp. aureus MW2
caugauaaaaaua

SEQ ID NO: 4012198 - RNA, 17 nt, Staphylococcus aureus subsp. aureus MW2
caugauaaaaauaaaaa

SEQ ID NO: 4012199 - RNA, 19 nt, Staphylococcus aureus subsp. aureus MW2
caugauacugaaauuucau

SEQ ID NO: 4012200 - RNA, 20 nt, Staphylococcus aureus subsp. aureus MW2
caugaugaacuuaaugcuuc

SEQ ID NO: 4012201 - RNA, 12 nt, Staphylococcus aureus subsp. aureus MW2
caugaugauaaa

SEQ ID NO: 4012202 - RNA, 12 nt, Staphylococcus aureus subsp. aureus MW2
caugauuuacua

SEQ ID NO: 4012203 - RNA, 14 nt, Staphylococcus aureus subsp. aureus MW2
caugauuucuucuc

SEQ ID NO: 4012204 - RNA, 14 nt, Staphylococcus aureus subsp. aureus MW2
caugccaauuaauu

SEQ ID NO: 4012205 - RNA, 22 nt, Staphylococcus aureus subsp. aureus MW2
caugccaauuaauucuuugaaa

SEQ ID NO: 4012206 - RNA, 20 nt, Staphylococcus aureus subsp. aureus MW2
caugccagaugcaaugauac

SEQ ID NO: 4012207 - RNA, 18 nt, Staphylococcus aureus subsp. aureus MW2
caugccuuaugucauaua

SEQ ID NO: 4012208 - RNA, 13 nt, Staphylococcus aureus subsp. aureus MW2
caugccuucauga

SEQ ID NO: 4012209 - RNA, 14 nt, Staphylococcus aureus subsp. aureus MW2
caugccuucaugaa

SEQ ID NO: 4012210 - RNA, 15 nt, Staphylococcus aureus subsp. aureus MW2
caugcgauucaaucu

SEQ ID NO: 4012211 - RNA, 18 nt, Staphylococcus aureus subsp. aureus MW2
caugcuuuuuaauguuau

SEQ ID NO: 4012212 - RNA, 12 nt, Staphylococcus aureus subsp. aureus MW2
caugcuuuuuag

SEQ ID NO: 4012213 - RNA, 22 nt, Staphylococcus aureus subsp. aureus MW2
caugcuuuuuagcauauucugc

SEQ ID NO: 4012214 - RNA, 17 nt, Staphylococcus aureus subsp. aureus MW2
cauggaaaagugcgauu

SEQ ID NO: 4012215 - RNA, 14 nt, Staphylococcus aureus subsp. aureus MW2
cauggaaaauauau

SEQ ID NO: 4012216 - RNA, 22 nt, Staphylococcus aureus subsp. aureus MW2
cauggaaaauauauuauaaaaa

SEQ ID NO: 4012217 - RNA, 16 nt, Staphylococcus aureus subsp. aureus MW2
cauggaauaaauuuau

SEQ ID NO: 4012218 - RNA, 17 nt, Staphylococcus aureus subsp. aureus MW2
cauggaauaaauuuaua

SEQ ID NO: 4012219 - RNA, 16 nt, Staphylococcus aureus subsp. aureus MW2
cauggcuuaaaucaaa

SEQ ID NO: 4012220 - RNA, 17 nt, Staphylococcus aureus subsp. aureus MW2
cauggcuuaaaucaaau

SEQ ID NO: 4012221 - RNA, 22 nt, Staphylococcus aureus subsp. aureus MW2
cauguaacaaaauacccugcuu

SEQ ID NO: 4012222 - RNA, 23 nt, Staphylococcus aureus subsp. aureus MW2
cauguaacagugugaaauaauaa

SEQ ID NO: 4012223 - RNA, 17 nt, Staphylococcus aureus subsp. aureus MW2
cauguaacguaaaaaug

SEQ ID NO: 4012224 - RNA, 15 nt, Staphylococcus aureus subsp. aureus MW2
cauguaaugaaucaa

SEQ ID NO: 4012225 - RNA, 16 nt, Staphylococcus aureus subsp. aureus MW2
cauguaaugcuuaaaa

SEQ ID NO: 4012226 - RNA, 19 nt, Staphylococcus aureus subsp. aureus MW2
cauguaaugcuuaaaaaca

SEQ ID NO: 4012227 - RNA, 21 nt, Staphylococcus aureus subsp. aureus MW2
cauguaaugcuuaaaaacaau

SEQ ID NO: 4012228 - RNA, 15 nt, Staphylococcus aureus subsp. aureus MW2
cauguacauugguuu

SEQ ID NO: 4012229 - RNA, 19 nt, Staphylococcus aureus subsp. aureus MW2
cauguacauugguuuuuac

SEQ ID NO: 4012230 - RNA, 12 nt, Staphylococcus aureus subsp. aureus MW2
cauguauaaaag

SEQ ID NO: 4012231 - RNA, 19 nt, Staphylococcus aureus subsp. aureus MW2
cauguauaaaagauauaaa

SEQ ID NO: 4012232 - RNA, 22 nt, Staphylococcus aureus subsp. aureus MW2
caugucuagauuucaaaucaau

SEQ ID NO: 4012233 - RNA, 23 nt, Staphylococcus aureus subsp. aureus MW2
caugugcaagugguaaaaaugaa

SEQ ID NO: 4012234 - RNA, 15 nt, Staphylococcus aureus subsp. aureus MW2
cauguuauauuauga

SEQ ID NO: 4012235 - RNA, 14 nt, Staphylococcus aureus subsp. aureus MW2
cauguucuuauaaa

SEQ ID NO: 4012236 - RNA, 16 nt, Staphylococcus aureus subsp. aureus MW2
cauguuggcaauuguu

SEQ ID NO: 4012237 - RNA, 20 nt, Staphylococcus aureus subsp. aureus MW2
cauguuugauucuaaauaau

SEQ ID NO: 4012238 - RNA, 21 nt, Staphylococcus aureus subsp. aureus MW2
cauguuuggaugaacaaaaua

SEQ ID NO: 4012239 - RNA, 21 nt, Staphylococcus aureus subsp. aureus MW2
cauuaaaaaaucgaacuagac

SEQ ID NO: 4012240 - RNA, 18 nt, Staphylococcus aureus subsp. aureus MW2
cauuaaaaauaaaagcaa

SEQ ID NO: 4012241 - RNA, 22 nt, Staphylococcus aureus subsp. aureus MW2
cauuaaaaggaugugacaaaua

SEQ ID NO: 4012242 - RNA, 23 nt, Staphylococcus aureus subsp. aureus MW2
cauuaaaaggaugugacaaauac

SEQ ID NO: 4012243 - RNA, 11 nt, Staphylococcus aureus subsp. aureus MW2
cauuaaaauaa

SEQ ID NO: 4012244 - RNA, 14 nt, Staphylococcus aureus subsp. aureus MW2
cauuaaaauaauua

SEQ ID NO: 4012245 - RNA, 21 nt, Staphylococcus aureus subsp. aureus MW2
cauuaaaauaauuaaauaaaa

SEQ ID NO: 4012246 - RNA, 14 nt, Staphylococcus aureus subsp. aureus MW2
cauuaaaccaauca

SEQ ID NO: 4012247 - RNA, 14 nt, Staphylococcus aureus subsp. aureus MW2
cauuaaauguacau

SEQ ID NO: 4012248 - RNA, 13 nt, Staphylococcus aureus subsp. aureus MW2
cauuaagaugauu

SEQ ID NO: 4012249 - RNA, 19 nt, Staphylococcus aureus subsp. aureus MW2
cauuaagcuaugcuuuuuu

SEQ ID NO: 4012250 - RNA, 15 nt, Staphylococcus aureus subsp. aureus MW2
cauuaaggcuuuagu

SEQ ID NO: 4012251 - RNA, 19 nt, Staphylococcus aureus subsp. aureus MW2
cauuaaguaaucugcaaau

SEQ ID NO: 4012252 - RNA, 22 nt, Staphylococcus aureus subsp. aureus MW2
cauuaauaaaacugcaauaauu

SEQ ID NO: 4012253 - RNA, 15 nt, Staphylococcus aureus subsp. aureus MW2
cauuaauaaauaaua

SEQ ID NO: 4012254 - RNA, 17 nt, Staphylococcus aureus subsp. aureus MW2
cauuaauaaauaauaac

SEQ ID NO: 4012255 - RNA, 13 nt, Staphylococcus aureus subsp. aureus MW2
cauuaauaauuaa

SEQ ID NO: 4012256 - RNA, 19 nt, Staphylococcus aureus subsp. aureus MW2
cauuaauaauuaaacaaaa

SEQ ID NO: 4012257 - RNA, 14 nt, Staphylococcus aureus subsp. aureus MW2
cauuaauauaaaua

SEQ ID NO: 4012258 - RNA, 14 nt, Staphylococcus aureus subsp. aureus MW2
cauuaaucguauuu

SEQ ID NO: 4012259 - RNA, 20 nt, Staphylococcus aureus subsp. aureus MW2
cauuaaucuauauaaaaacu

SEQ ID NO: 4012260 - RNA, 12 nt, Staphylococcus aureus subsp. aureus MW2
cauuaauguuca

SEQ ID NO: 4012261 - RNA, 13 nt, Staphylococcus aureus subsp. aureus MW2
cauuaauguucaa

SEQ ID NO: 4012262 - RNA, 17 nt, Staphylococcus aureus subsp. aureus MW2
cauuaauuucaugugca

SEQ ID NO: 4012263 - RNA, 19 nt, Staphylococcus aureus subsp. aureus MW2
cauuaauuuuucgucuuca

SEQ ID NO: 4012264 - RNA, 15 nt, Staphylococcus aureus subsp. aureus MW2
cauuacaaacauaau

SEQ ID NO: 4012265 - RNA, 14 nt, Staphylococcus aureus subsp. aureus MW2
cauuacagauaauu

SEQ ID NO: 4012266 - RNA, 19 nt, Staphylococcus aureus subsp. aureus MW2
cauuacauauaucaacaug

SEQ ID NO: 4012267 - RNA, 14 nt, Staphylococcus aureus subsp. aureus MW2
cauuacaucuuuaa

SEQ ID NO: 4012268 - RNA, 19 nt, Staphylococcus aureus subsp. aureus MW2
cauuacauguuacugauga

SEQ ID NO: 4012269 - RNA, 14 nt, Staphylococcus aureus subsp. aureus MW2
cauuaccagcaauu

SEQ ID NO: 4012270 - RNA, 15 nt, Staphylococcus aureus subsp. aureus MW2
cauuacguaucuuua

SEQ ID NO: 4012271 - RNA, 19 nt, Staphylococcus aureus subsp. aureus MW2
cauuacuaaaacaaauuca

SEQ ID NO: 4012272 - RNA, 14 nt, Staphylococcus aureus subsp. aureus MW2
cauuacuacuuuau

SEQ ID NO: 4012273 - RNA, 19 nt, Staphylococcus aureus subsp. aureus MW2
cauuacuaucuucaucaua

SEQ ID NO: 4012274 - RNA, 20 nt, Staphylococcus aureus subsp. aureus MW2
cauuagaacuaagaugugca

SEQ ID NO: 4012275 - RNA, 18 nt, Staphylococcus aureus subsp. aureus MW2
cauuagacuuucuuaauu

SEQ ID NO: 4012276 - RNA, 15 nt, Staphylococcus aureus subsp. aureus MW2
cauuagaucauacau

SEQ ID NO: 4012277 - RNA, 15 nt, Staphylococcus aureus subsp. aureus MW2
cauuagcaaauauua

SEQ ID NO: 4012278 - RNA, 15 nt, Staphylococcus aureus subsp. aureus MW2
cauuagcaugauaaa

SEQ ID NO: 4012279 - RNA, 15 nt, Staphylococcus aureus subsp. aureus MW2
cauuagcauuaaauu

SEQ ID NO: 4012280 - RNA, 21 nt, Staphylococcus aureus subsp. aureus MW2
cauuagcuucuacuuuuguac

SEQ ID NO: 4012281 - RNA, 18 nt, Staphylococcus aureus subsp. aureus MW2
cauuaggaaaacuucaau

SEQ ID NO: 4012282 - RNA, 19 nt, Staphylococcus aureus subsp. aureus MW2
cauuaggaaaacuucaaua

SEQ ID NO: 4012283 - RNA, 17 nt, Staphylococcus aureus subsp. aureus MW2
cauuaggauguucagcu

SEQ ID NO: 4012284 - RNA, 21 nt, Staphylococcus aureus subsp. aureus MW2
cauuaggucuacgaucaaaau

SEQ ID NO: 4012285 - RNA, 14 nt, Staphylococcus aureus subsp. aureus MW2
cauuaguacuaaac

SEQ ID NO: 4012286 - RNA, 17 nt, Staphylococcus aureus subsp. aureus MW2
cauuaguuaugugcuaa

SEQ ID NO: 4012287 - RNA, 20 nt, Staphylococcus aureus subsp. aureus MW2
cauuaguucuguugauauuu

SEQ ID NO: 4012288 - RNA, 15 nt, Staphylococcus aureus subsp. aureus MW2
cauuaguugcauaau

SEQ ID NO: 4012289 - RNA, 20 nt, Staphylococcus aureus subsp. aureus MW2
cauuaguuguaucagugaca

SEQ ID NO: 4012290 - RNA, 19 nt, Staphylococcus aureus subsp. aureus MW2
cauuaguuugaucauuuac

SEQ ID NO: 4012291 - RNA, 17 nt, Staphylococcus aureus subsp. aureus MW2
cauuauaaugauuuuua

SEQ ID NO: 4012292 - RNA, 18 nt, Staphylococcus aureus subsp. aureus MW2
cauuauagacauaagcaa

SEQ ID NO: 4012293 - RNA, 17 nt, Staphylococcus aureus subsp. aureus MW2
cauuauagucuuaaaca

SEQ ID NO: 4012294 - RNA, 16 nt, Staphylococcus aureus subsp. aureus MW2
cauuaucaacuuuaua

SEQ ID NO: 4012295 - RNA, 21 nt, Staphylococcus aureus subsp. aureus MW2
cauuaucaagaacuuuaaaaa

SEQ ID NO: 4012296 - RNA, 18 nt, Staphylococcus aureus subsp. aureus MW2
cauuaucaccuucaaacu

SEQ ID NO: 4012297 - RNA, 13 nt, Staphylococcus aureus subsp. aureus MW2
cauuaucauuaag

SEQ ID NO: 4012298 - RNA, 12 nt, Staphylococcus aureus subsp. aureus MW2
cauuauuaagug

SEQ ID NO: 4012299 - RNA, 20 nt, Staphylococcus aureus subsp. aureus MW2
cauuauuguuguaucaucau

SEQ ID NO: 4012300 - RNA, 17 nt, Staphylococcus aureus subsp. aureus MW2
cauuauuuauauuuaga

SEQ ID NO: 4012301 - RNA, 13 nt, Staphylococcus aureus subsp. aureus MW2
cauuauuugauaa

SEQ ID NO: 4012302 - RNA, 20 nt, Staphylococcus aureus subsp. aureus MW2
cauuauuugcugcuaauuga

SEQ ID NO: 4012303 - RNA, 23 nt, Staphylococcus aureus subsp. aureus MW2
cauuauuugcugcuaauugauac

SEQ ID NO: 4012304 - RNA, 23 nt, Staphylococcus aureus subsp. aureus MW2
cauuauuuuacgcuuacuuauau

SEQ ID NO: 4012305 - RNA, 14 nt, Staphylococcus aureus subsp. aureus MW2
cauucaaucaucaa

SEQ ID NO: 4012306 - RNA, 14 nt, Staphylococcus aureus subsp. aureus MW2
cauucaauguuuaa

SEQ ID NO: 4012307 - RNA, 13 nt, Staphylococcus aureus subsp. aureus MW2
cauucacuucaag

SEQ ID NO: 4012308 - RNA, 15 nt, Staphylococcus aureus subsp. aureus MW2
cauucagucaaacac

SEQ ID NO: 4012309 - RNA, 15 nt, Staphylococcus aureus subsp. aureus MW2
cauucauaaaugacu

SEQ ID NO: 4012310 - RNA, 17 nt, Staphylococcus aureus subsp. aureus MW2
cauucauaaaugacuga

SEQ ID NO: 4012311 - RNA, 14 nt, Staphylococcus aureus subsp. aureus MW2
cauucaucgucuca

SEQ ID NO: 4012312 - RNA, 15 nt, Staphylococcus aureus subsp. aureus MW2
cauucaucguuuacu

SEQ ID NO: 4012313 - RNA, 20 nt, Staphylococcus aureus subsp. aureus MW2
cauucauuaagcuuuguuug

SEQ ID NO: 4012314 - RNA, 13 nt, Staphylococcus aureus subsp. aureus MW2
cauuccaaaaauu

SEQ ID NO: 4012315 - RNA, 22 nt, Staphylococcus aureus subsp. aureus MW2
cauuccaaaguaccaucucuau

SEQ ID NO: 4012316 - RNA, 19 nt, Staphylococcus aureus subsp. aureus MW2
cauuccucuauuguaucuu

SEQ ID NO: 4012317 - RNA, 17 nt, Staphylococcus aureus subsp. aureus MW2
cauucuacguaaacucu

SEQ ID NO: 4012318 - RNA, 17 nt, Staphylococcus aureus subsp. aureus MW2
cauucuaguagcuagaa

SEQ ID NO: 4012319 - RNA, 14 nt, Staphylococcus aureus subsp. aureus MW2
cauucuauacuuuu

SEQ ID NO: 4012320 - RNA, 17 nt, Staphylococcus aureus subsp. aureus MW2
cauucuauacuuuuaau

SEQ ID NO: 4012321 - RNA, 18 nt, Staphylococcus aureus subsp. aureus MW2
cauucuaugaugcuucua

SEQ ID NO: 4012322 - RNA, 22 nt, Staphylococcus aureus subsp. aureus MW2
cauucucauucagucaaacacu

SEQ ID NO: 4012323 - RNA, 12 nt, Staphylococcus aureus subsp. aureus MW2
cauucuuauuug

SEQ ID NO: 4012324 - RNA, 15 nt, Staphylococcus aureus subsp. aureus MW2
cauucuucaaaaaau

SEQ ID NO: 4012325 - RNA, 16 nt, Staphylococcus aureus subsp. aureus MW2
cauucuucaaaaaaua

SEQ ID NO: 4012326 - RNA, 23 nt, Staphylococcus aureus subsp. aureus MW2
cauucuucaucgcaaugucaucu

SEQ ID NO: 4012327 - RNA, 15 nt, Staphylococcus aureus subsp. aureus MW2
cauucuucauuacag

SEQ ID NO: 4012328 - RNA, 19 nt, Staphylococcus aureus subsp. aureus MW2
cauucuucauuacaguauu

SEQ ID NO: 4012329 - RNA, 20 nt, Staphylococcus aureus subsp. aureus MW2
cauucuuuaauauaaauuuu

SEQ ID NO: 4012330 - RNA, 15 nt, Staphylococcus aureus subsp. aureus MW2
cauucuuuauagaaa

SEQ ID NO: 4012331 - RNA, 15 nt, Staphylococcus aureus subsp. aureus MW2
cauucuuuuucaaaa

SEQ ID NO: 4012332 - RNA, 19 nt, Staphylococcus aureus subsp. aureus MW2
cauucuuuuucucaaugug

SEQ ID NO: 4012333 - RNA, 19 nt, Staphylococcus aureus subsp. aureus MW2
cauugaaaggaacauuuca

SEQ ID NO: 4012334 - RNA, 18 nt, Staphylococcus aureus subsp. aureus MW2
cauugaaaucgucuuacu

SEQ ID NO: 4012335 - RNA, 21 nt, Staphylococcus aureus subsp. aureus MW2
cauugaaaucgucuuacugcu

SEQ ID NO: 4012336 - RNA, 11 nt, Staphylococcus aureus subsp. aureus MW2
cauugaaugau

SEQ ID NO: 4012337 - RNA, 18 nt, Staphylococcus aureus subsp. aureus MW2
cauugaccaccuuuaucu

SEQ ID NO: 4012338 - RNA, 21 nt, Staphylococcus aureus subsp. aureus MW2
cauugagauaucuuauaacaa

SEQ ID NO: 4012339 - RNA, 13 nt, Staphylococcus aureus subsp. aureus MW2
cauugauaaaaua

SEQ ID NO: 4012340 - RNA, 21 nt, Staphylococcus aureus subsp. aureus MW2
cauugauaaauuuuuaguuaa

SEQ ID NO: 4012341 - RNA, 17 nt, Staphylococcus aureus subsp. aureus MW2
cauugauaagucuugau

SEQ ID NO: 4012342 - RNA, 13 nt, Staphylococcus aureus subsp. aureus MW2
cauugaucuuuua

SEQ ID NO: 4012343 - RNA, 22 nt, Staphylococcus aureus subsp. aureus MW2
cauugauuugggcgcuuuuuaa

SEQ ID NO: 4012344 - RNA, 17 nt, Staphylococcus aureus subsp. aureus MW2
cauugccuaagaacuua

SEQ ID NO: 4012345 - RNA, 17 nt, Staphylococcus aureus subsp. aureus MW2
cauugcguaacaucaca

SEQ ID NO: 4012346 - RNA, 21 nt, Staphylococcus aureus subsp. aureus MW2
cauugcgugcuucacuaaaaa

SEQ ID NO: 4012347 - RNA, 14 nt, Staphylococcus aureus subsp. aureus MW2
cauugcuguaaccc

SEQ ID NO: 4012348 - RNA, 21 nt, Staphylococcus aureus subsp. aureus MW2
cauugcuuguccucuaaaaca

SEQ ID NO: 4012349 - RNA, 16 nt, Staphylococcus aureus subsp. aureus MW2
cauuguaaaacaaauu

SEQ ID NO: 4012350 - RNA, 13 nt, Staphylococcus aureus subsp. aureus MW2
cauuguaaaaugu

SEQ ID NO: 4012351 - RNA, 13 nt, Staphylococcus aureus subsp. aureus MW2
cauuguaacucaa

SEQ ID NO: 4012352 - RNA, 13 nt, Staphylococcus aureus subsp. aureus MW2
cauuguauaaaaa

SEQ ID NO: 4012353 - RNA, 16 nt, Staphylococcus aureus subsp. aureus MW2
cauuguauaugugugu

SEQ ID NO: 4012354 - RNA, 14 nt, Staphylococcus aureus subsp. aureus MW2
cauugucaugccuu

SEQ ID NO: 4012355 - RNA, 17 nt, Staphylococcus aureus subsp. aureus MW2
cauugucaugccuucau

SEQ ID NO: 4012356 - RNA, 22 nt, Staphylococcus aureus subsp. aureus MW2
cauugucaugccuucauuagcc

SEQ ID NO: 4012357 - RNA, 22 nt, Staphylococcus aureus subsp. aureus MW2
cauuguggcuuuuuuuauggug

SEQ ID NO: 4012358 - RNA, 22 nt, Staphylococcus aureus subsp. aureus MW2
cauuguguccauaaauauuaaa

SEQ ID NO: 4012359 - RNA, 21 nt, Staphylococcus aureus subsp. aureus MW2
cauuguuauuaucguaaaaaa

SEQ ID NO: 4012360 - RNA, 19 nt, Staphylococcus aureus subsp. aureus MW2
cauuguuucuagcuuuaau

SEQ ID NO: 4012361 - RNA, 17 nt, Staphylococcus aureus subsp. aureus MW2
cauuguuuguagaauuu

SEQ ID NO: 4012362 - RNA, 12 nt, Staphylococcus aureus subsp. aureus MW2
cauuuaaaaauc

SEQ ID NO: 4012363 - RNA, 17 nt, Staphylococcus aureus subsp. aureus MW2
cauuuaaaaaucuacau

SEQ ID NO: 4012364 - RNA, 14 nt, Staphylococcus aureus subsp. aureus MW2
cauuuaaacaacug

SEQ ID NO: 4012365 - RNA, 13 nt, Staphylococcus aureus subsp. aureus MW2
cauuuaaauauaa

SEQ ID NO: 4012366 - RNA, 11 nt, Staphylococcus aureus subsp. aureus MW2
cauuuaagccu

SEQ ID NO: 4012367 - RNA, 14 nt, Staphylococcus aureus subsp. aureus MW2
cauuuacuucauaa

SEQ ID NO: 4012368 - RNA, 18 nt, Staphylococcus aureus subsp. aureus MW2
cauuuacuugauuagauu

SEQ ID NO: 4012369 - RNA, 23 nt, Staphylococcus aureus subsp. aureus MW2
cauuuacuugauuagauuugugu

SEQ ID NO: 4012370 - RNA, 22 nt, Staphylococcus aureus subsp. aureus MW2
cauuuagaugauucuuaucauu

SEQ ID NO: 4012371 - RNA, 15 nt, Staphylococcus aureus subsp. aureus MW2
cauuuaguuaaauac

SEQ ID NO: 4012372 - RNA, 13 nt, Staphylococcus aureus subsp. aureus MW2
cauuuaucaacaa

SEQ ID NO: 4012373 - RNA, 20 nt, Staphylococcus aureus subsp. aureus MW2
cauuuauguguuggcuuuua

SEQ ID NO: 4012374 - RNA, 21 nt, Staphylococcus aureus subsp. aureus MW2
cauuuauguguuggcuuuuau

SEQ ID NO: 4012375 - RNA, 12 nt, Staphylococcus aureus subsp. aureus MW2
cauuuauuuuca

SEQ ID NO: 4012376 - RNA, 14 nt, Staphylococcus aureus subsp. aureus MW2
cauuucaaaugccu

SEQ ID NO: 4012377 - RNA, 15 nt, Staphylococcus aureus subsp. aureus MW2
cauuucaauauuaaa

SEQ ID NO: 4012378 - RNA, 16 nt, Staphylococcus aureus subsp. aureus MW2
cauuucaauauuaaaa

SEQ ID NO: 4012379 - RNA, 21 nt, Staphylococcus aureus subsp. aureus MW2
cauuucaucaauaauuucuug

SEQ ID NO: 4012380 - RNA, 15 nt, Staphylococcus aureus subsp. aureus MW2
cauuuccuauaugcu

SEQ ID NO: 4012381 - RNA, 20 nt, Staphylococcus aureus subsp. aureus MW2
cauuucuuuuuucaauguuu

SEQ ID NO: 4012382 - RNA, 22 nt, Staphylococcus aureus subsp. aureus MW2
cauuugcgauuucuucugcuaa

SEQ ID NO: 4012383 - RNA, 22 nt, Staphylococcus aureus subsp. aureus MW2
cauuuguaaauauuuuuuaaaa

SEQ ID NO: 4012384 - RNA, 21 nt, Staphylococcus aureus subsp. aureus MW2
cauuugucacucuuuaaauca

SEQ ID NO: 4012385 - RNA, 15 nt, Staphylococcus aureus subsp. aureus MW2
cauuugucauaauag

SEQ ID NO: 4012386 - RNA, 17 nt, Staphylococcus aureus subsp. aureus MW2
cauuugucuuaauuuuu

SEQ ID NO: 4012387 - RNA, 13 nt, Staphylococcus aureus subsp. aureus MW2
cauuuguguuuuu

SEQ ID NO: 4012388 - RNA, 17 nt, Staphylococcus aureus subsp. aureus MW2
cauuuguucugcagagu

SEQ ID NO: 4012389 - RNA, 12 nt, Staphylococcus aureus subsp. aureus MW2
cauuuuaaauaa

SEQ ID NO: 4012390 - RNA, 21 nt, Staphylococcus aureus subsp. aureus MW2
cauuuuaaauuuaacuaugaa

SEQ ID NO: 4012391 - RNA, 21 nt, Staphylococcus aureus subsp. aureus MW2
cauuuuagauugacuaaguuu

SEQ ID NO: 4012392 - RNA, 15 nt, Staphylococcus aureus subsp. aureus MW2
cauuuuauauuuuag

SEQ ID NO: 4012393 - RNA, 15 nt, Staphylococcus aureus subsp. aureus MW2
cauuuuauccaaacc

SEQ ID NO: 4012394 - RNA, 20 nt, Staphylococcus aureus subsp. aureus MW2
cauuuuauggugcuaaaaaa

SEQ ID NO: 4012395 - RNA, 22 nt, Staphylococcus aureus subsp. aureus MW2
cauuuuauggugcuaaaaaauu

SEQ ID NO: 4012396 - RNA, 15 nt, Staphylococcus aureus subsp. aureus MW2
cauuuucaauacuug

SEQ ID NO: 4012397 - RNA, 23 nt, Staphylococcus aureus subsp. aureus MW2
cauuuucaauacuugaaagauuu

SEQ ID NO: 4012398 - RNA, 20 nt, Staphylococcus aureus subsp. aureus MW2
cauuuucuacgaauacuaaa

SEQ ID NO: 4012399 - RNA, 20 nt, Staphylococcus aureus subsp. aureus MW2
cauuuugagucguagauacu

SEQ ID NO: 4012400 - RNA, 16 nt, Staphylococcus aureus subsp. aureus MW2
cauuuugguacaaaaa

SEQ ID NO: 4012401 - RNA, 21 nt, Staphylococcus aureus subsp. aureus MW2
cauuuuuaauuuugacauaaa

SEQ ID NO: 4012402 - RNA, 16 nt, Staphylococcus aureus subsp. aureus MW2
cauuuuuagacauuaa

SEQ ID NO: 4012403 - RNA, 16 nt, Staphylococcus aureus subsp. aureus MW2
cauuuuuauaaauuuu

SEQ ID NO: 4012404 - RNA, 23 nt, Staphylococcus aureus subsp. aureus MW2
cauuuuuuauuuuacuuacuuuu

SEQ ID NO: 4012405 - RNA, 12 nt, Staphylococcus aureus subsp. aureus MW2
cauuuuuuucaa

SEQ ID NO: 4012406 - RNA, 12 nt, Staphylococcus aureus subsp. aureus MW2
ccaaaaaguauu

SEQ ID NO: 4012407 - RNA, 22 nt, Staphylococcus aureus subsp. aureus MW2
ccaaaaauagauugaaaaaaua

SEQ ID NO: 4012408 - RNA, 16 nt, Staphylococcus aureus subsp. aureus MW2
ccaaaacauuuuguga

SEQ ID NO: 4012409 - RNA, 18 nt, Staphylococcus aureus subsp. aureus MW2
ccaaaaugguuaaaaucg

SEQ ID NO: 4012410 - RNA, 13 nt, Staphylococcus aureus subsp. aureus MW2
ccaaacauagaga

SEQ ID NO: 4012411 - RNA, 15 nt, Staphylococcus aureus subsp. aureus MW2
ccaaaccauuaauaa

SEQ ID NO: 4012412 - RNA, 20 nt, Staphylococcus aureus subsp. aureus MW2
ccaaagaaacggaaaugacu

SEQ ID NO: 4012413 - RNA, 17 nt, Staphylococcus aureus subsp. aureus MW2
ccaaagcuaaguuugaa

SEQ ID NO: 4012414 - RNA, 16 nt, Staphylococcus aureus subsp. aureus MW2
ccaaagcugaauuuua

SEQ ID NO: 4012415 - RNA, 17 nt, Staphylococcus aureus subsp. aureus MW2
ccaaaguaauaauggca

SEQ ID NO: 4012416 - RNA, 22 nt, Staphylococcus aureus subsp. aureus MW2
ccaaaguaccaucucuauuuuu

SEQ ID NO: 4012417 - RNA, 13 nt, Staphylococcus aureus subsp. aureus MW2
ccaaauaauaucu

SEQ ID NO: 4012418 - RNA, 11 nt, Staphylococcus aureus subsp. aureus MW2
ccaaauacuag

SEQ ID NO: 4012419 - RNA, 16 nt, Staphylococcus aureus subsp. aureus MW2
ccaaauauuaaaaaca

SEQ ID NO: 4012420 - RNA, 16 nt, Staphylococcus aureus subsp. aureus MW2
ccaaauccaucuaauu

SEQ ID NO: 4012421 - RNA, 21 nt, Staphylococcus aureus subsp. aureus MW2
ccaaaucggaauaaaauaaau

SEQ ID NO: 4012422 - RNA, 19 nt, Staphylococcus aureus subsp. aureus MW2
ccaaauuggaaaucaacuu

SEQ ID NO: 4012423 - RNA, 22 nt, Staphylococcus aureus subsp. aureus MW2
ccaaauuuaggcaugucaaauc

SEQ ID NO: 4012424 - RNA, 18 nt, Staphylococcus aureus subsp. aureus MW2
ccaacaaagaagcuggcg

SEQ ID NO: 4012425 - RNA, 12 nt, Staphylococcus aureus subsp. aureus MW2
ccaacaacuaag

SEQ ID NO: 4012426 - RNA, 15 nt, Staphylococcus aureus subsp. aureus MW2
ccaacacagaagcug

SEQ ID NO: 4012427 - RNA, 14 nt, Staphylococcus aureus subsp. aureus MW2
ccaacacagagaau

SEQ ID NO: 4012428 - RNA, 18 nt, Staphylococcus aureus subsp. aureus MW2
ccaacacccauauaauuu

SEQ ID NO: 4012429 - RNA, 16 nt, Staphylococcus aureus subsp. aureus MW2
ccaacaccuaauauuu

SEQ ID NO: 4012430 - RNA, 15 nt, Staphylococcus aureus subsp. aureus MW2
ccaacagcuucaaca

SEQ ID NO: 4012431 - RNA, 15 nt, Staphylococcus aureus subsp. aureus MW2
ccaacauagaagcug

SEQ ID NO: 4012432 - RNA, 22 nt, Staphylococcus aureus subsp. aureus MW2
ccaaccaugcuuuuuagcauau

SEQ ID NO: 4012433 - RNA, 19 nt, Staphylococcus aureus subsp. aureus MW2
ccaaccccuuuauuuugau

SEQ ID NO: 4012434 - RNA, 21 nt, Staphylococcus aureus subsp. aureus MW2
ccaacuaaaucaccauuuuuu

SEQ ID NO: 4012435 - RNA, 19 nt, Staphylococcus aureus subsp. aureus MW2
ccaacugucgguucaucua

SEQ ID NO: 4012436 - RNA, 21 nt, Staphylococcus aureus subsp. aureus MW2
ccaacugucgguucaucuaaa

SEQ ID NO: 4012437 - RNA, 16 nt, Staphylococcus aureus subsp. aureus MW2
ccaacuugcacauuau

SEQ ID NO: 4012438 - RNA, 21 nt, Staphylococcus aureus subsp. aureus MW2
ccaagacgaacaucaucuaug

SEQ ID NO: 4012439 - RNA, 19 nt, Staphylococcus aureus subsp. aureus MW2
ccaagauaaaucaucauuc

SEQ ID NO: 4012440 - RNA, 15 nt, Staphylococcus aureus subsp. aureus MW2
ccaagauauauaacu

SEQ ID NO: 4012441 - RNA, 16 nt, Staphylococcus aureus subsp. aureus MW2
ccaagauuaugacaac

SEQ ID NO: 4012442 - RNA, 17 nt, Staphylococcus aureus subsp. aureus MW2
ccaagcucguuaaauca

SEQ ID NO: 4012443 - RNA, 22 nt, Staphylococcus aureus subsp. aureus MW2
ccaaggauguuauaaaaugaau

SEQ ID NO: 4012444 - RNA, 19 nt, Staphylococcus aureus subsp. aureus MW2
ccaaguacgcaauuuaaua

SEQ ID NO: 4012445 - RNA, 19 nt, Staphylococcus aureus subsp. aureus MW2
ccaaguuacgauaucauac

SEQ ID NO: 4012446 - RNA, 14 nt, Staphylococcus aureus subsp. aureus MW2
ccaauaaaauguca

SEQ ID NO: 4012447 - RNA, 23 nt, Staphylococcus aureus subsp. aureus MW2
ccaauacaauuuagguuaauuaa

SEQ ID NO: 4012448 - RNA, 21 nt, Staphylococcus aureus subsp. aureus MW2
ccaauaccgaauaauuuugau

SEQ ID NO: 4012449 - RNA, 15 nt, Staphylococcus aureus subsp. aureus MW2
ccaauacuuuuuaua

SEQ ID NO: 4012450 - RNA, 14 nt, Staphylococcus aureus subsp. aureus MW2
ccaauauaacaagc

SEQ ID NO: 4012451 - RNA, 21 nt, Staphylococcus aureus subsp. aureus MW2
ccaauauauucaccuacaaca

SEQ ID NO: 4012452 - RNA, 16 nt, Staphylococcus aureus subsp. aureus MW2
ccaauaucauauuuga

SEQ ID NO: 4012453 - RNA, 17 nt, Staphylococcus aureus subsp. aureus MW2
ccaauaucauauuugaa

SEQ ID NO: 4012454 - RNA, 11 nt, Staphylococcus aureus subsp. aureus MW2
ccaaucaacuu

SEQ ID NO: 4012455 - RNA, 13 nt, Staphylococcus aureus subsp. aureus MW2
ccaaucaauaguu

SEQ ID NO: 4012456 - RNA, 18 nt, Staphylococcus aureus subsp. aureus MW2
ccaaucaucauuaaaucu

SEQ ID NO: 4012457 - RNA, 22 nt, Staphylococcus aureus subsp. aureus MW2
ccaaucuaaaaauccauucauc

SEQ ID NO: 4012458 - RNA, 16 nt, Staphylococcus aureus subsp. aureus MW2
ccaaugcauaaaaccu

SEQ ID NO: 4012459 - RNA, 14 nt, Staphylococcus aureus subsp. aureus MW2
ccaauguguuuaac

SEQ ID NO: 4012460 - RNA, 14 nt, Staphylococcus aureus subsp. aureus MW2
ccaauuaauaaaca

SEQ ID NO: 4012461 - RNA, 12 nt, Staphylococcus aureus subsp. aureus MW2
ccaauuaggauu

SEQ ID NO: 4012462 - RNA, 16 nt, Staphylococcus aureus subsp. aureus MW2
ccaauugauuuugcug

SEQ ID NO: 4012463 - RNA, 23 nt, Staphylococcus aureus subsp. aureus MW2
ccaauuuaguccuucuuuacuaa

SEQ ID NO: 4012464 - RNA, 17 nt, Staphylococcus aureus subsp. aureus MW2
ccaauuucucuguguug

SEQ ID NO: 4012465 - RNA, 21 nt, Staphylococcus aureus subsp. aureus MW2
ccaauuucucuguguuggggc

SEQ ID NO: 4012466 - RNA, 17 nt, Staphylococcus aureus subsp. aureus MW2
ccaauuugauuaguaau

SEQ ID NO: 4012467 - RNA, 11 nt, Staphylococcus aureus subsp. aureus MW2
ccacaaauaac

SEQ ID NO: 4012468 - RNA, 19 nt, Staphylococcus aureus subsp. aureus MW2
ccacaacaaucacgauuaa

SEQ ID NO: 4012469 - RNA, 13 nt, Staphylococcus aureus subsp. aureus MW2
ccacaacauguuu

SEQ ID NO: 4012470 - RNA, 23 nt, Staphylococcus aureus subsp. aureus MW2
ccacagcaauucacuuauacaug

SEQ ID NO: 4012471 - RNA, 13 nt, Staphylococcus aureus subsp. aureus MW2
ccacaucauagca

SEQ ID NO: 4012472 - RNA, 21 nt, Staphylococcus aureus subsp. aureus MW2
ccacaucauagcacuacauca

SEQ ID NO: 4012473 - RNA, 12 nt, Staphylococcus aureus subsp. aureus MW2
ccacauuuuccu

SEQ ID NO: 4012474 - RNA, 14 nt, Staphylococcus aureus subsp. aureus MW2
ccacauuuuccuug

SEQ ID NO: 4012475 - RNA, 21 nt, Staphylococcus aureus subsp. aureus MW2
ccacauuuuccuuguuucgaa

SEQ ID NO: 4012476 - RNA, 20 nt, Staphylococcus aureus subsp. aureus MW2
ccaccuacgcccaucaucac

SEQ ID NO: 4012477 - RNA, 11 nt, Staphylococcus aureus subsp. aureus MW2
ccaccugauaa

SEQ ID NO: 4012478 - RNA, 21 nt, Staphylococcus aureus subsp. aureus MW2
ccaccuuguuuaaguuuuuca

SEQ ID NO: 4012479 - RNA, 23 nt, Staphylococcus aureus subsp. aureus MW2
ccaccuuucuuuaucauaucuau

SEQ ID NO: 4012480 - RNA, 13 nt, Staphylococcus aureus subsp. aureus MW2
ccacgguuuacca

SEQ ID NO: 4012481 - RNA, 12 nt, Staphylococcus aureus subsp. aureus MW2
ccacucaauucu

SEQ ID NO: 4012482 - RNA, 23 nt, Staphylococcus aureus subsp. aureus MW2
ccacuccuuaaacaaauaaaugu

SEQ ID NO: 4012483 - RNA, 14 nt, Staphylococcus aureus subsp. aureus MW2
ccacuuaaucguuc

SEQ ID NO: 4012484 - RNA, 16 nt, Staphylococcus aureus subsp. aureus MW2
ccacuugaauacuuuu

SEQ ID NO: 4012485 - RNA, 21 nt, Staphylococcus aureus subsp. aureus MW2
ccacuugaauacuuuuuaacu

SEQ ID NO: 4012486 - RNA, 22 nt, Staphylococcus aureus subsp. aureus MW2
ccagaauguguuggcuuuuuga

SEQ ID NO: 4012487 - RNA, 14 nt, Staphylococcus aureus subsp. aureus MW2
ccagauaucauaau

SEQ ID NO: 4012488 - RNA, 23 nt, Staphylococcus aureus subsp. aureus MW2
ccagcaugaagugggauaugaau

SEQ ID NO: 4012489 - RNA, 22 nt, Staphylococcus aureus subsp. aureus MW2
ccagcaugaaucgcauuuaaau

SEQ ID NO: 4012490 - RNA, 22 nt, Staphylococcus aureus subsp. aureus MW2
ccagccccaauuagccccagua

SEQ ID NO: 4012491 - RNA, 23 nt, Staphylococcus aureus subsp. aureus MW2
ccagcuucuauguuggggccccg

SEQ ID NO: 4012492 - RNA, 22 nt, Staphylococcus aureus subsp. aureus MW2
ccagcuucuuuguuggggcccc

SEQ ID NO: 4012493 - RNA, 23 nt, Staphylococcus aureus subsp. aureus MW2
ccagcuucuuuguuggggccccg

SEQ ID NO: 4012494 - RNA, 23 nt, Staphylococcus aureus subsp. aureus MW2
ccagguucaauaguaccaugcuc

SEQ ID NO: 4012495 - RNA, 21 nt, Staphylococcus aureus subsp. aureus MW2
ccaguacuuucgaguaauacu

SEQ ID NO: 4012496 - RNA, 12 nt, Staphylococcus aureus subsp. aureus MW2
ccagucaauuuu

SEQ ID NO: 4012497 - RNA, 15 nt, Staphylococcus aureus subsp. aureus MW2
ccagucaauuuuuuc

SEQ ID NO: 4012498 - RNA, 14 nt, Staphylococcus aureus subsp. aureus MW2
ccaguccauuuuuu

SEQ ID NO: 4012499 - RNA, 17 nt, Staphylococcus aureus subsp. aureus MW2
ccaguuaauuauuuaga

SEQ ID NO: 4012500 - RNA, 18 nt, Staphylococcus aureus subsp. aureus MW2
ccaguugauuuaagauuu

SEQ ID NO: 4012501 - RNA, 15 nt, Staphylococcus aureus subsp. aureus MW2
ccaguuuucaauuua

SEQ ID NO: 4012502 - RNA, 23 nt, Staphylococcus aureus subsp. aureus MW2
ccaguuuuugguagcauuuuaga

SEQ ID NO: 4012503 - RNA, 20 nt, Staphylococcus aureus subsp. aureus MW2
ccauaaacguguacuucaau

SEQ ID NO: 4012504 - RNA, 21 nt, Staphylococcus aureus subsp. aureus MW2
ccauaaauaaaaugcuacaau

SEQ ID NO: 4012505 - RNA, 14 nt, Staphylococcus aureus subsp. aureus MW2
ccauaaauauuaaa

SEQ ID NO: 4012506 - RNA, 21 nt, Staphylococcus aureus subsp. aureus MW2
ccauaaggaaccugucuuaau

SEQ ID NO: 4012507 - RNA, 17 nt, Staphylococcus aureus subsp. aureus MW2
ccauaagguacauaaau

SEQ ID NO: 4012508 - RNA, 13 nt, Staphylococcus aureus subsp. aureus MW2
ccauaauuuaaau

SEQ ID NO: 4012509 - RNA, 16 nt, Staphylococcus aureus subsp. aureus MW2
ccauacccauauuaaa

SEQ ID NO: 4012510 - RNA, 14 nt, Staphylococcus aureus subsp. aureus MW2
ccauaccuacaaau

SEQ ID NO: 4012511 - RNA, 18 nt, Staphylococcus aureus subsp. aureus MW2
ccauacgaucuuuuucaa

SEQ ID NO: 4012512 - RNA, 19 nt, Staphylococcus aureus subsp. aureus MW2
ccauacuaaaacaugauac

SEQ ID NO: 4012513 - RNA, 15 nt, Staphylococcus aureus subsp. aureus MW2
ccauacuaaauaagu

SEQ ID NO: 4012514 - RNA, 21 nt, Staphylococcus aureus subsp. aureus MW2
ccauacuaaauaaguaguuca

SEQ ID NO: 4012515 - RNA, 20 nt, Staphylococcus aureus subsp. aureus MW2
ccauacuaaucguuccaaca

SEQ ID NO: 4012516 - RNA, 14 nt, Staphylococcus aureus subsp. aureus MW2
ccauacucuaacuu

SEQ ID NO: 4012517 - RNA, 14 nt, Staphylococcus aureus subsp. aureus MW2
ccauacuucuauuu

SEQ ID NO: 4012518 - RNA, 20 nt, Staphylococcus aureus subsp. aureus MW2
ccauacuucuauuuuauaau

SEQ ID NO: 4012519 - RNA, 24 nt, Staphylococcus aureus subsp. aureus MW2
ccauacuucuauuuuauaauaaau

SEQ ID NO: 4012520 - RNA, 15 nt, Staphylococcus aureus subsp. aureus MW2
ccauaguaacaaaau

SEQ ID NO: 4012521 - RNA, 17 nt, Staphylococcus aureus subsp. aureus MW2
ccauauagauauuagcu

SEQ ID NO: 4012522 - RNA, 21 nt, Staphylococcus aureus subsp. aureus MW2
ccauaucgugcguuaaauaua

SEQ ID NO: 4012523 - RNA, 22 nt, Staphylococcus aureus subsp. aureus MW2
ccauaucgugcguuaaauauau

SEQ ID NO: 4012524 - RNA, 19 nt, Staphylococcus aureus subsp. aureus MW2
ccauaugcuugcugugaau

SEQ ID NO: 4012525 - RNA, 16 nt, Staphylococcus aureus subsp. aureus MW2
ccauauguauuauaga

SEQ ID NO: 4012526 - RNA, 17 nt, Staphylococcus aureus subsp. aureus MW2
ccauaugugguggcuau

SEQ ID NO: 4012527 - RNA, 20 nt, Staphylococcus aureus subsp. aureus MW2
ccaucaauaccauaauuaaa

SEQ ID NO: 4012528 - RNA, 23 nt, Staphylococcus aureus subsp. aureus MW2
ccaucaauccaacuacugcaaca

SEQ ID NO: 4012529 - RNA, 14 nt, Staphylococcus aureus subsp. aureus MW2
ccaucauaaauguu

SEQ ID NO: 4012530 - RNA, 22 nt, Staphylococcus aureus subsp. aureus MW2
ccaucauaaauguuauuaacca

SEQ ID NO: 4012531 - RNA, 15 nt, Staphylococcus aureus subsp. aureus MW2
ccaucauuuguguuu

SEQ ID NO: 4012532 - RNA, 16 nt, Staphylococcus aureus subsp. aureus MW2
ccaucgcaacugauaa

SEQ ID NO: 4012533 - RNA, 20 nt, Staphylococcus aureus subsp. aureus MW2
ccaucguagcgcuuagauaa

SEQ ID NO: 4012534 - RNA, 19 nt, Staphylococcus aureus subsp. aureus MW2
ccaucugugucagcauuca

SEQ ID NO: 4012535 - RNA, 18 nt, Staphylococcus aureus subsp. aureus MW2
ccaucuucuugauuguaa

SEQ ID NO: 4012536 - RNA, 23 nt, Staphylococcus aureus subsp. aureus MW2
ccaucuuuguaaccuaaaaacaa

SEQ ID NO: 4012537 - RNA, 20 nt, Staphylococcus aureus subsp. aureus MW2
ccaucuuuuagguaauaauu

SEQ ID NO: 4012538 - RNA, 16 nt, Staphylococcus aureus subsp. aureus MW2
ccaugagaaaccgcuu

SEQ ID NO: 4012539 - RNA, 15 nt, Staphylococcus aureus subsp. aureus MW2
ccaugcuuccauaau

SEQ ID NO: 4012540 - RNA, 19 nt, Staphylococcus aureus subsp. aureus MW2
ccauggaauaaauuuauaa

SEQ ID NO: 4012541 - RNA, 13 nt, Staphylococcus aureus subsp. aureus MW2
ccauuaauaaaac

SEQ ID NO: 4012542 - RNA, 19 nt, Staphylococcus aureus subsp. aureus MW2
ccauuaauaaaacugcaau

SEQ ID NO: 4012543 - RNA, 19 nt, Staphylococcus aureus subsp. aureus MW2
ccauuacaaugcgcaauga

SEQ ID NO: 4012544 - RNA, 16 nt, Staphylococcus aureus subsp. aureus MW2
ccauuauuauuuuuuu

SEQ ID NO: 4012545 - RNA, 19 nt, Staphylococcus aureus subsp. aureus MW2
ccauucaucgucucacuua

SEQ ID NO: 4012546 - RNA, 23 nt, Staphylococcus aureus subsp. aureus MW2
ccauucgaaagccaauuaauaaa

SEQ ID NO: 4012547 - RNA, 18 nt, Staphylococcus aureus subsp. aureus MW2
ccauugaucuuuuauaau

SEQ ID NO: 4012548 - RNA, 17 nt, Staphylococcus aureus subsp. aureus MW2
ccauugcacuaugcaua

SEQ ID NO: 4012549 - RNA, 16 nt, Staphylococcus aureus subsp. aureus MW2
ccauugguuaugcugu

SEQ ID NO: 4012550 - RNA, 21 nt, Staphylococcus aureus subsp. aureus MW2
ccauuguuauccaaaacauuu

SEQ ID NO: 4012551 - RNA, 17 nt, Staphylococcus aureus subsp. aureus MW2
ccauuguugauaaaugg

SEQ ID NO: 4012552 - RNA, 18 nt, Staphylococcus aureus subsp. aureus MW2
ccauuuaacucaccuuua

SEQ ID NO: 4012553 - RNA, 13 nt, Staphylococcus aureus subsp. aureus MW2
ccauuucaaaugc

SEQ ID NO: 4012554 - RNA, 22 nt, Staphylococcus aureus subsp. aureus MW2
ccauuucgauaccuaaaauacc

SEQ ID NO: 4012555 - RNA, 16 nt, Staphylococcus aureus subsp. aureus MW2
ccauuucuuuuuucaa

SEQ ID NO: 4012556 - RNA, 12 nt, Staphylococcus aureus subsp. aureus MW2
ccauuuuucuuu

SEQ ID NO: 4012557 - RNA, 18 nt, Staphylococcus aureus subsp. aureus MW2
ccauuuuuuuccaagcau

SEQ ID NO: 4012558 - RNA, 14 nt, Staphylococcus aureus subsp. aureus MW2
cccaaaaaauugua

SEQ ID NO: 4012559 - RNA, 14 nt, Staphylococcus aureus subsp. aureus MW2
cccaaacauagaga

SEQ ID NO: 4012560 - RNA, 15 nt, Staphylococcus aureus subsp. aureus MW2
cccaacaaagaagcu

SEQ ID NO: 4012561 - RNA, 18 nt, Staphylococcus aureus subsp. aureus MW2
cccaacaaagaagcuggc

SEQ ID NO: 4012562 - RNA, 15 nt, Staphylococcus aureus subsp. aureus MW2
cccaacacagaagcu

SEQ ID NO: 4012563 - RNA, 12 nt, Staphylococcus aureus subsp. aureus MW2
cccaacacagag

SEQ ID NO: 4012564 - RNA, 15 nt, Staphylococcus aureus subsp. aureus MW2
cccaacauagaagcu

SEQ ID NO: 4012565 - RNA, 17 nt, Staphylococcus aureus subsp. aureus MW2
cccaacauagaagcugg

SEQ ID NO: 4012566 - RNA, 18 nt, Staphylococcus aureus subsp. aureus MW2
cccaagaugguauugcuu

SEQ ID NO: 4012567 - RNA, 20 nt, Staphylococcus aureus subsp. aureus MW2
cccaauucggauuauauuua

SEQ ID NO: 4012568 - RNA, 15 nt, Staphylococcus aureus subsp. aureus MW2
cccaauuucucugug

SEQ ID NO: 4012569 - RNA, 16 nt, Staphylococcus aureus subsp. aureus MW2
cccacaucuuuuuaaa

SEQ ID NO: 4012570 - RNA, 22 nt, Staphylococcus aureus subsp. aureus MW2
cccagcuugaccgccuaugaua

SEQ ID NO: 4012571 - RNA, 16 nt, Staphylococcus aureus subsp. aureus MW2
cccauaccuacaaaua

SEQ ID NO: 4012572 - RNA, 16 nt, Staphylococcus aureus subsp. aureus MW2
cccauguauaaggaua

SEQ ID NO: 4012573 - RNA, 19 nt, Staphylococcus aureus subsp. aureus MW2
cccauugcuuguccucuaa

SEQ ID NO: 4012574 - RNA, 13 nt, Staphylococcus aureus subsp. aureus MW2
cccauuuuuaaaa

SEQ ID NO: 4012575 - RNA, 19 nt, Staphylococcus aureus subsp. aureus MW2
cccauuuuuaaaauuauga

SEQ ID NO: 4012576 - RNA, 19 nt, Staphylococcus aureus subsp. aureus MW2
ccccaacacagaagcuggc

SEQ ID NO: 4012577 - RNA, 21 nt, Staphylococcus aureus subsp. aureus MW2
ccccaacacagaagcuggcgg

SEQ ID NO: 4012578 - RNA, 17 nt, Staphylococcus aureus subsp. aureus MW2
ccccaacacagagaaau

SEQ ID NO: 4012579 - RNA, 16 nt, Staphylococcus aureus subsp. aureus MW2
ccccaacuugcacauu

SEQ ID NO: 4012580 - RNA, 18 nt, Staphylococcus aureus subsp. aureus MW2
cccgcuuauugcauugua

SEQ ID NO: 4012581 - RNA, 13 nt, Staphylococcus aureus subsp. aureus MW2
cccguuugauuuc

SEQ ID NO: 4012582 - RNA, 15 nt, Staphylococcus aureus subsp. aureus MW2
cccuaaagcuaaugc

SEQ ID NO: 4012583 - RNA, 15 nt, Staphylococcus aureus subsp. aureus MW2
cccuaauucuuuaau

SEQ ID NO: 4012584 - RNA, 22 nt, Staphylococcus aureus subsp. aureus MW2
cccuacaaaguuuauacuuaau

SEQ ID NO: 4012585 - RNA, 23 nt, Staphylococcus aureus subsp. aureus MW2
cccuagcaaaaauacuuuuugau

SEQ ID NO: 4012586 - RNA, 21 nt, Staphylococcus aureus subsp. aureus MW2
cccuaucauacauauuuauau

SEQ ID NO: 4012587 - RNA, 18 nt, Staphylococcus aureus subsp. aureus MW2
cccuccuauuaauauaua

SEQ ID NO: 4012588 - RNA, 21 nt, Staphylococcus aureus subsp. aureus MW2
cccuccuggugcugcaccaag

SEQ ID NO: 4012589 - RNA, 15 nt, Staphylococcus aureus subsp. aureus MW2
cccugcuguuuuauu

SEQ ID NO: 4012590 - RNA, 14 nt, Staphylococcus aureus subsp. aureus MW2
cccuggaaaaugau

SEQ ID NO: 4012591 - RNA, 21 nt, Staphylococcus aureus subsp. aureus MW2
cccuggaaaaugauucgcugu

SEQ ID NO: 4012592 - RNA, 13 nt, Staphylococcus aureus subsp. aureus MW2
cccuguaaaacca

SEQ ID NO: 4012593 - RNA, 20 nt, Staphylococcus aureus subsp. aureus MW2
cccuucccuaucauacauau

SEQ ID NO: 4012594 - RNA, 19 nt, Staphylococcus aureus subsp. aureus MW2
cccuuuuugucucucaaca

SEQ ID NO: 4012595 - RNA, 23 nt, Staphylococcus aureus subsp. aureus MW2
ccgaaaaaaccgagaaucuccau

SEQ ID NO: 4012596 - RNA, 20 nt, Staphylococcus aureus subsp. aureus MW2
ccgaaaguuagacuaaaaaa

SEQ ID NO: 4012597 - RNA, 14 nt, Staphylococcus aureus subsp. aureus MW2
ccgaauaauuuuga

SEQ ID NO: 4012598 - RNA, 13 nt, Staphylococcus aureus subsp. aureus MW2
ccgauuguuucac

SEQ ID NO: 4012599 - RNA, 20 nt, Staphylococcus aureus subsp. aureus MW2
ccgauuuauuuauaaaauaa

SEQ ID NO: 4012600 - RNA, 18 nt, Staphylococcus aureus subsp. aureus MW2
ccgauuugauaaaaaaug

SEQ ID NO: 4012601 - RNA, 20 nt, Staphylococcus aureus subsp. aureus MW2
ccgauuugauaaaaaaugaa

SEQ ID NO: 4012602 - RNA, 18 nt, Staphylococcus aureus subsp. aureus MW2
ccgauuuugauauaaaaa

SEQ ID NO: 4012603 - RNA, 15 nt, Staphylococcus aureus subsp. aureus MW2
ccgcacuucuauauu

SEQ ID NO: 4012604 - RNA, 20 nt, Staphylococcus aureus subsp. aureus MW2
ccgccaacuaauguuaaaau

SEQ ID NO: 4012605 - RNA, 12 nt, Staphylococcus aureus subsp. aureus MW2
ccgcuauaaaau

SEQ ID NO: 4012606 - RNA, 13 nt, Staphylococcus aureus subsp. aureus MW2
ccgcugcucuucu

SEQ ID NO: 4012607 - RNA, 14 nt, Staphylococcus aureus subsp. aureus MW2
ccgcugcucuucuc

SEQ ID NO: 4012608 - RNA, 14 nt, Staphylococcus aureus subsp. aureus MW2
ccgcuuuauuuuau

SEQ ID NO: 4012609 - RNA, 13 nt, Staphylococcus aureus subsp. aureus MW2
ccggaauauuaac

SEQ ID NO: 4012610 - RNA, 14 nt, Staphylococcus aureus subsp. aureus MW2
ccggcuuuuucuuu

SEQ ID NO: 4012611 - RNA, 16 nt, Staphylococcus aureus subsp. aureus MW2
ccguauuuuaauauug

SEQ ID NO: 4012612 - RNA, 20 nt, Staphylococcus aureus subsp. aureus MW2
ccgucgaauauaauuuuuug

SEQ ID NO: 4012613 - RNA, 21 nt, Staphylococcus aureus subsp. aureus MW2
ccguguuuugauuuauuaucu

SEQ ID NO: 4012614 - RNA, 21 nt, Staphylococcus aureus subsp. aureus MW2
ccguuugaagucuguuuagaa

SEQ ID NO: 4012615 - RNA, 14 nt, Staphylococcus aureus subsp. aureus MW2
ccguuuuuuauaaa

SEQ ID NO: 4012616 - RNA, 12 nt, Staphylococcus aureus subsp. aureus MW2
ccuaaaaacaaa

SEQ ID NO: 4012617 - RNA, 16 nt, Staphylococcus aureus subsp. aureus MW2
ccuaaaauagaaaaau

SEQ ID NO: 4012618 - RNA, 19 nt, Staphylococcus aureus subsp. aureus MW2
ccuaaaccucuaaauaaaa

SEQ ID NO: 4012619 - RNA, 21 nt, Staphylococcus aureus subsp. aureus MW2
ccuaaaccucuaaauaaaauu

SEQ ID NO: 4012620 - RNA, 14 nt, Staphylococcus aureus subsp. aureus MW2
ccuaaagacuuuau

SEQ ID NO: 4012621 - RNA, 16 nt, Staphylococcus aureus subsp. aureus MW2
ccuaaagacuuuaugc

SEQ ID NO: 4012622 - RNA, 18 nt, Staphylococcus aureus subsp. aureus MW2
ccuaaagcuaaugcaagc

SEQ ID NO: 4012623 - RNA, 14 nt, Staphylococcus aureus subsp. aureus MW2
ccuaaagcugacaa

SEQ ID NO: 4012624 - RNA, 19 nt, Staphylococcus aureus subsp. aureus MW2
ccuaaagcugacaaaccaa

SEQ ID NO: 4012625 - RNA, 19 nt, Staphylococcus aureus subsp. aureus MW2
ccuaaagguaacuuuuuaa

SEQ ID NO: 4012626 - RNA, 21 nt, Staphylococcus aureus subsp. aureus MW2
ccuaaagguaacuuuuuaacu

SEQ ID NO: 4012627 - RNA, 19 nt, Staphylococcus aureus subsp. aureus MW2
ccuaacguguuugagauau

SEQ ID NO: 4012628 - RNA, 13 nt, Staphylococcus aureus subsp. aureus MW2
ccuaacuuuuauu

SEQ ID NO: 4012629 - RNA, 14 nt, Staphylococcus aureus subsp. aureus MW2
ccuaauaaauaucu

SEQ ID NO: 4012630 - RNA, 18 nt, Staphylococcus aureus subsp. aureus MW2
ccuaauaauaaaauagcu

SEQ ID NO: 4012631 - RNA, 21 nt, Staphylococcus aureus subsp. aureus MW2
ccuaauacacuugcuaaaacu

SEQ ID NO: 4012632 - RNA, 22 nt, Staphylococcus aureus subsp. aureus MW2
ccuaaucugcaacgauuuuaaa

SEQ ID NO: 4012633 - RNA, 21 nt, Staphylococcus aureus subsp. aureus MW2
ccuaaugagcccguuaaaaag

SEQ ID NO: 4012634 - RNA, 13 nt, Staphylococcus aureus subsp. aureus MW2
ccuaaugcgacau

SEQ ID NO: 4012635 - RNA, 20 nt, Staphylococcus aureus subsp. aureus MW2
ccuaauggucgugcuugcgg

SEQ ID NO: 4012636 - RNA, 17 nt, Staphylococcus aureus subsp. aureus MW2
ccuaauguaauuauugc

SEQ ID NO: 4012637 - RNA, 21 nt, Staphylococcus aureus subsp. aureus MW2
ccuaauguaauuauugcauca

SEQ ID NO: 4012638 - RNA, 17 nt, Staphylococcus aureus subsp. aureus MW2
ccuaauucgccaucuuu

SEQ ID NO: 4012639 - RNA, 13 nt, Staphylococcus aureus subsp. aureus MW2
ccuaauucuaagu

SEQ ID NO: 4012640 - RNA, 18 nt, Staphylococcus aureus subsp. aureus MW2
ccuacaaauauguaauca

SEQ ID NO: 4012641 - RNA, 18 nt, Staphylococcus aureus subsp. aureus MW2
ccuacaaauauuucuaaa

SEQ ID NO: 4012642 - RNA, 14 nt, Staphylococcus aureus subsp. aureus MW2
ccuacaacaccaau

SEQ ID NO: 4012643 - RNA, 19 nt, Staphylococcus aureus subsp. aureus MW2
ccuacaacaccaauugaaa

SEQ ID NO: 4012644 - RNA, 20 nt, Staphylococcus aureus subsp. aureus MW2
ccuacaauuuuccuuucaau

SEQ ID NO: 4012645 - RNA, 22 nt, Staphylococcus aureus subsp. aureus MW2
ccuacagauuuuaaaaauucau

SEQ ID NO: 4012646 - RNA, 19 nt, Staphylococcus aureus subsp. aureus MW2
ccuaccauuacugcagcau

SEQ ID NO: 4012647 - RNA, 21 nt, Staphylococcus aureus subsp. aureus MW2
ccuaccgcuaaaauucuuuca

SEQ ID NO: 4012648 - RNA, 21 nt, Staphylococcus aureus subsp. aureus MW2
ccuaccuauuugauuaaauua

SEQ ID NO: 4012649 - RNA, 23 nt, Staphylococcus aureus subsp. aureus MW2
ccuacuuugauauguuuccucuu

SEQ ID NO: 4012650 - RNA, 22 nt, Staphylococcus aureus subsp. aureus MW2
ccuagaacauugauuauuguuc

SEQ ID NO: 4012651 - RNA, 15 nt, Staphylococcus aureus subsp. aureus MW2
ccuagauaccaaacu

SEQ ID NO: 4012652 - RNA, 13 nt, Staphylococcus aureus subsp. aureus MW2
ccuagcaaaaaua

SEQ ID NO: 4012653 - RNA, 16 nt, Staphylococcus aureus subsp. aureus MW2
ccuagcaaaaauacuu

SEQ ID NO: 4012654 - RNA, 21 nt, Staphylococcus aureus subsp. aureus MW2
ccuagcaaaaauacuuuuuga

SEQ ID NO: 4012655 - RNA, 19 nt, Staphylococcus aureus subsp. aureus MW2
ccuaggaaauaaaaaauaa

SEQ ID NO: 4012656 - RNA, 18 nt, Staphylococcus aureus subsp. aureus MW2
ccuagguuuauauaucac

SEQ ID NO: 4012657 - RNA, 14 nt, Staphylococcus aureus subsp. aureus MW2
ccuauaagucucuu

SEQ ID NO: 4012658 - RNA, 17 nt, Staphylococcus aureus subsp. aureus MW2
ccuaucacgauuucagc

SEQ ID NO: 4012659 - RNA, 20 nt, Staphylococcus aureus subsp. aureus MW2
ccuaugccaaauaacguuaa

SEQ ID NO: 4012660 - RNA, 19 nt, Staphylococcus aureus subsp. aureus MW2
ccuauuaauugaaaugaua

SEQ ID NO: 4012661 - RNA, 18 nt, Staphylococcus aureus subsp. aureus MW2
ccuauuacacuaaaaccu

SEQ ID NO: 4012662 - RNA, 19 nt, Staphylococcus aureus subsp. aureus MW2
ccuauuugauuaaauuaaa

SEQ ID NO: 4012663 - RNA, 19 nt, Staphylococcus aureus subsp. aureus MW2
ccuauuuuacaaucaacuu

SEQ ID NO: 4012664 - RNA, 11 nt, Staphylococcus aureus subsp. aureus MW2
ccuauuuuuua

SEQ ID NO: 4012665 - RNA, 21 nt, Staphylococcus aureus subsp. aureus MW2
ccuauuuuuugagcacuuaau

SEQ ID NO: 4012666 - RNA, 22 nt, Staphylococcus aureus subsp. aureus MW2
ccucacuagauaguuuauacuu

SEQ ID NO: 4012667 - RNA, 21 nt, Staphylococcus aureus subsp. aureus MW2
ccucauaaaucaugaaauuaa

SEQ ID NO: 4012668 - RNA, 18 nt, Staphylococcus aureus subsp. aureus MW2
ccuccuggugcugcacca

SEQ ID NO: 4012669 - RNA, 17 nt, Staphylococcus aureus subsp. aureus MW2
ccucggauaccaaaacu

SEQ ID NO: 4012670 - RNA, 14 nt, Staphylococcus aureus subsp. aureus MW2
ccucuaaauaaaau

SEQ ID NO: 4012671 - RNA, 22 nt, Staphylococcus aureus subsp. aureus MW2
ccucugauacuucaccaucuuu

SEQ ID NO: 4012672 - RNA, 21 nt, Staphylococcus aureus subsp. aureus MW2
ccucugcuagacaaucaucuu

SEQ ID NO: 4012673 - RNA, 22 nt, Staphylococcus aureus subsp. aureus MW2
ccucuuaaaauaccugcaacuu

SEQ ID NO: 4012674 - RNA, 12 nt, Staphylococcus aureus subsp. aureus MW2
ccucuugccuug

SEQ ID NO: 4012675 - RNA, 22 nt, Staphylococcus aureus subsp. aureus MW2
ccucuuguucuccgaucaugcc

SEQ ID NO: 4012676 - RNA, 22 nt, Staphylococcus aureus subsp. aureus MW2
ccucuuuucuuuaaaaaaggaa

SEQ ID NO: 4012677 - RNA, 23 nt, Staphylococcus aureus subsp. aureus MW2
ccucuuuucuuuaaaaaaggaaa

SEQ ID NO: 4012678 - RNA, 21 nt, Staphylococcus aureus subsp. aureus MW2
ccugaaauuaacgucaacagc

SEQ ID NO: 4012679 - RNA, 14 nt, Staphylococcus aureus subsp. aureus MW2
ccugacuuuccgcc

SEQ ID NO: 4012680 - RNA, 21 nt, Staphylococcus aureus subsp. aureus MW2
ccugacuuuccgccagcuucu

SEQ ID NO: 4012681 - RNA, 18 nt, Staphylococcus aureus subsp. aureus MW2
ccugauacacguacaaaa

SEQ ID NO: 4012682 - RNA, 22 nt, Staphylococcus aureus subsp. aureus MW2
ccugauacacguacaaaauaau

SEQ ID NO: 4012683 - RNA, 21 nt, Staphylococcus aureus subsp. aureus MW2
ccugauauuucaacuuuuuaa

SEQ ID NO: 4012684 - RNA, 17 nt, Staphylococcus aureus subsp. aureus MW2
ccugcuacaacuucuuc

SEQ ID NO: 4012685 - RNA, 14 nt, Staphylococcus aureus subsp. aureus MW2
ccuggugauucacc

SEQ ID NO: 4012686 - RNA, 19 nt, Staphylococcus aureus subsp. aureus MW2
ccugucuuaauucauucca

SEQ ID NO: 4012687 - RNA, 15 nt, Staphylococcus aureus subsp. aureus MW2
ccuguugaauauacu

SEQ ID NO: 4012688 - RNA, 23 nt, Staphylococcus aureus subsp. aureus MW2
ccuguuuuaauugggucuuuauc

SEQ ID NO: 4012689 - RNA, 15 nt, Staphylococcus aureus subsp. aureus MW2
ccuuaaaauauuuaa

SEQ ID NO: 4012690 - RNA, 18 nt, Staphylococcus aureus subsp. aureus MW2
ccuuaacuucauaauaua

SEQ ID NO: 4012691 - RNA, 16 nt, Staphylococcus aureus subsp. aureus MW2
ccuuaauaauaaguau

SEQ ID NO: 4012692 - RNA, 16 nt, Staphylococcus aureus subsp. aureus MW2
ccuuaauacguugcuc

SEQ ID NO: 4012693 - RNA, 21 nt, Staphylococcus aureus subsp. aureus MW2
ccuuauggaaaauuuuaucaa

SEQ ID NO: 4012694 - RNA, 12 nt, Staphylococcus aureus subsp. aureus MW2
ccuucaaaaugc

SEQ ID NO: 4012695 - RNA, 20 nt, Staphylococcus aureus subsp. aureus MW2
ccuucaaagauuuuaccuug

SEQ ID NO: 4012696 - RNA, 16 nt, Staphylococcus aureus subsp. aureus MW2
ccuucaauccaagcaa

SEQ ID NO: 4012697 - RNA, 15 nt, Staphylococcus aureus subsp. aureus MW2
ccuucagucuucaug

SEQ ID NO: 4012698 - RNA, 13 nt, Staphylococcus aureus subsp. aureus MW2
ccuucaucacuau

SEQ ID NO: 4012699 - RNA, 21 nt, Staphylococcus aureus subsp. aureus MW2
ccuucauuagccaaaucuuua

SEQ ID NO: 4012700 - RNA, 20 nt, Staphylococcus aureus subsp. aureus MW2
ccuucauugaagaauauaaa

SEQ ID NO: 4012701 - RNA, 14 nt, Staphylococcus aureus subsp. aureus MW2
ccuucgcauacuuu

SEQ ID NO: 4012702 - RNA, 16 nt, Staphylococcus aureus subsp. aureus MW2
ccuucuauauaguaaa

SEQ ID NO: 4012703 - RNA, 17 nt, Staphylococcus aureus subsp. aureus MW2
ccuucuugagcaucacu

SEQ ID NO: 4012704 - RNA, 15 nt, Staphylococcus aureus subsp. aureus MW2
ccuucuuuauaacuu

SEQ ID NO: 4012705 - RNA, 21 nt, Staphylococcus aureus subsp. aureus MW2
ccuucuuuuugcguuuuuaaa

SEQ ID NO: 4012706 - RNA, 17 nt, Staphylococcus aureus subsp. aureus MW2
ccuugaaugauauuaac

SEQ ID NO: 4012707 - RNA, 18 nt, Staphylococcus aureus subsp. aureus MW2
ccuugauuuaauuuuuaa

SEQ ID NO: 4012708 - RNA, 21 nt, Staphylococcus aureus subsp. aureus MW2
ccuuggccuacuuuuucaaua

SEQ ID NO: 4012709 - RNA, 23 nt, Staphylococcus aureus subsp. aureus MW2
ccuuguucacccaagcaugucac

SEQ ID NO: 4012710 - RNA, 21 nt, Staphylococcus aureus subsp. aureus MW2
ccuuguuuaaguuuuucaggg

SEQ ID NO: 4012711 - RNA, 18 nt, Staphylococcus aureus subsp. aureus MW2
ccuuuaaaacaucauuca

SEQ ID NO: 4012712 - RNA, 13 nt, Staphylococcus aureus subsp. aureus MW2
ccuuuaaaucauu

SEQ ID NO: 4012713 - RNA, 17 nt, Staphylococcus aureus subsp. aureus MW2
ccuuuaauaauauugaa

SEQ ID NO: 4012714 - RNA, 15 nt, Staphylococcus aureus subsp. aureus MW2
ccuuuaauuacacua

SEQ ID NO: 4012715 - RNA, 17 nt, Staphylococcus aureus subsp. aureus MW2
ccuuuacucauauugaa

SEQ ID NO: 4012716 - RNA, 17 nt, Staphylococcus aureus subsp. aureus MW2
ccuuuagccaaugcuuc

SEQ ID NO: 4012717 - RNA, 18 nt, Staphylococcus aureus subsp. aureus MW2
ccuuuauauuuaguuagc

SEQ ID NO: 4012718 - RNA, 16 nt, Staphylococcus aureus subsp. aureus MW2
ccuuuaugugcaucau

SEQ ID NO: 4012719 - RNA, 19 nt, Staphylococcus aureus subsp. aureus MW2
ccuuuaugugcaucauuua

SEQ ID NO: 4012720 - RNA, 18 nt, Staphylococcus aureus subsp. aureus MW2
ccuuuauuaccagcuuuc

SEQ ID NO: 4012721 - RNA, 17 nt, Staphylococcus aureus subsp. aureus MW2
ccuuucaauaauaaauc

SEQ ID NO: 4012722 - RNA, 20 nt, Staphylococcus aureus subsp. aureus MW2
ccuuucauaggucugcuucc

SEQ ID NO: 4012723 - RNA, 20 nt, Staphylococcus aureus subsp. aureus MW2
ccuuuccauucguauaagaa

SEQ ID NO: 4012724 - RNA, 16 nt, Staphylococcus aureus subsp. aureus MW2
ccuuugcuaaauauua

SEQ ID NO: 4012725 - RNA, 19 nt, Staphylococcus aureus subsp. aureus MW2
ccuuugcuuuuuauuuugu

SEQ ID NO: 4012726 - RNA, 15 nt, Staphylococcus aureus subsp. aureus MW2
ccuuugguucaauca

SEQ ID NO: 4012727 - RNA, 23 nt, Staphylococcus aureus subsp. aureus MW2
ccuuuguuugaagugaaaaauuu

SEQ ID NO: 4012728 - RNA, 10 nt, Staphylococcus aureus subsp. aureus MW2
ccuuuuaaau

SEQ ID NO: 4012729 - RNA, 18 nt, Staphylococcus aureus subsp. aureus MW2
ccuuuuaauuuaguuaua

SEQ ID NO: 4012730 - RNA, 23 nt, Staphylococcus aureus subsp. aureus MW2
ccuuuugaacguuuacucuuacu

SEQ ID NO: 4012731 - RNA, 14 nt, Staphylococcus aureus subsp. aureus MW2
ccuuuugaauaauu

SEQ ID NO: 4012732 - RNA, 15 nt, Staphylococcus aureus subsp. aureus MW2
ccuuuuuuauuuuuc

SEQ ID NO: 4012733 - RNA, 16 nt, Staphylococcus aureus subsp. aureus MW2
ccuuuuuuauuuuucu

SEQ ID NO: 4012734 - RNA, 22 nt, Staphylococcus aureus subsp. aureus MW2
cgaaaaaaucggacagcugaaa

SEQ ID NO: 4012735 - RNA, 23 nt, Staphylococcus aureus subsp. aureus MW2
cgaaaaccucuguuuuguuggug

SEQ ID NO: 4012736 - RNA, 10 nt, Staphylococcus aureus subsp. aureus MW2
cgaaaagaaa

SEQ ID NO: 4012737 - RNA, 14 nt, Staphylococcus aureus subsp. aureus MW2
cgaaaagucagcuu

SEQ ID NO: 4012738 - RNA, 19 nt, Staphylococcus aureus subsp. aureus MW2
cgaaaagucagcuuacaau

SEQ ID NO: 4012739 - RNA, 21 nt, Staphylococcus aureus subsp. aureus MW2
cgaaaagucagcuuacaauaa

SEQ ID NO: 4012740 - RNA, 20 nt, Staphylococcus aureus subsp. aureus MW2
cgaaaauugcuaaaaaaauu

SEQ ID NO: 4012741 - RNA, 15 nt, Staphylococcus aureus subsp. aureus MW2
cgaaacauuaaaaua

SEQ ID NO: 4012742 - RNA, 13 nt, Staphylococcus aureus subsp. aureus MW2
cgaaauaaauuuu

SEQ ID NO: 4012743 - RNA, 19 nt, Staphylococcus aureus subsp. aureus MW2
cgaaauaguucaaaauacu

SEQ ID NO: 4012744 - RNA, 19 nt, Staphylococcus aureus subsp. aureus MW2
cgaacaaggcgacuucuau

SEQ ID NO: 4012745 - RNA, 18 nt, Staphylococcus aureus subsp. aureus MW2
cgaacaucugaaaaaauu

SEQ ID NO: 4012746 - RNA, 22 nt, Staphylococcus aureus subsp. aureus MW2
cgaacaucugaaaaaauuaaua

SEQ ID NO: 4012747 - RNA, 16 nt, Staphylococcus aureus subsp. aureus MW2
cgaacaugaaugauau

SEQ ID NO: 4012748 - RNA, 19 nt, Staphylococcus aureus subsp. aureus MW2
cgaaccauuuccgaauaaa

SEQ ID NO: 4012749 - RNA, 18 nt, Staphylococcus aureus subsp. aureus MW2
cgaacgauagauucugau

SEQ ID NO: 4012750 - RNA, 19 nt, Staphylococcus aureus subsp. aureus MW2
cgaacuugcuuuguucuuc

SEQ ID NO: 4012751 - RNA, 19 nt, Staphylococcus aureus subsp. aureus MW2
cgaaggucuacuaaauaac

SEQ ID NO: 4012752 - RNA, 22 nt, Staphylococcus aureus subsp. aureus MW2
cgaagugcaacaaaagugccag

SEQ ID NO: 4012753 - RNA, 22 nt, Staphylococcus aureus subsp. aureus MW2
cgaauaacuguuuaucaugaug

SEQ ID NO: 4012754 - RNA, 14 nt, Staphylococcus aureus subsp. aureus MW2
cgaauaauccaguc

SEQ ID NO: 4012755 - RNA, 15 nt, Staphylococcus aureus subsp. aureus MW2
cgaauacuaaaaugg

SEQ ID NO: 4012756 - RNA, 15 nt, Staphylococcus aureus subsp. aureus MW2
cgaauagaaaauaau

SEQ ID NO: 4012757 - RNA, 22 nt, Staphylococcus aureus subsp. aureus MW2
cgaauguauugcuauaagaacu

SEQ ID NO: 4012758 - RNA, 20 nt, Staphylococcus aureus subsp. aureus MW2
cgaauucaccuucccaguca

SEQ ID NO: 4012759 - RNA, 14 nt, Staphylococcus aureus subsp. aureus MW2
cgaauucauuaacg

SEQ ID NO: 4012760 - RNA, 22 nt, Staphylococcus aureus subsp. aureus MW2
cgaauucucgauuuuuuuauau

SEQ ID NO: 4012761 - RNA, 14 nt, Staphylococcus aureus subsp. aureus MW2
cgaauugccaccgc

SEQ ID NO: 4012762 - RNA, 15 nt, Staphylococcus aureus subsp. aureus MW2
cgaauuucauaguua

SEQ ID NO: 4012763 - RNA, 22 nt, Staphylococcus aureus subsp. aureus MW2
cgaauuuuuuuguacuuuucuu

SEQ ID NO: 4012764 - RNA, 19 nt, Staphylococcus aureus subsp. aureus MW2
cgacaaauuaaaaaacaau

SEQ ID NO: 4012765 - RNA, 22 nt, Staphylococcus aureus subsp. aureus MW2
cgacaauuauaauaaaacuugu

SEQ ID NO: 4012766 - RNA, 16 nt, Staphylococcus aureus subsp. aureus MW2
cgacaccaacauauuu

SEQ ID NO: 4012767 - RNA, 19 nt, Staphylococcus aureus subsp. aureus MW2
cgacacguguaaaaaugau

SEQ ID NO: 4012768 - RNA, 10 nt, Staphylococcus aureus subsp. aureus MW2
cgacaucuag

SEQ ID NO: 4012769 - RNA, 20 nt, Staphylococcus aureus subsp. aureus MW2
cgacaucuagaugaaauugu

SEQ ID NO: 4012770 - RNA, 20 nt, Staphylococcus aureus subsp. aureus MW2
cgacauguccauaauauccu

SEQ ID NO: 4012771 - RNA, 18 nt, Staphylococcus aureus subsp. aureus MW2
cgacauuuguaaauauuu

SEQ ID NO: 4012772 - RNA, 21 nt, Staphylococcus aureus subsp. aureus MW2
cgaccagucgcauauuuugau

SEQ ID NO: 4012773 - RNA, 16 nt, Staphylococcus aureus subsp. aureus MW2
cgacguuuaaaugccc

SEQ ID NO: 4012774 - RNA, 14 nt, Staphylococcus aureus subsp. aureus MW2
cgacuuaacuuaag

SEQ ID NO: 4012775 - RNA, 15 nt, Staphylococcus aureus subsp. aureus MW2
cgacuucauuacaaa

SEQ ID NO: 4012776 - RNA, 18 nt, Staphylococcus aureus subsp. aureus MW2
cgagaaauuagaaccauc

SEQ ID NO: 4012777 - RNA, 11 nt, Staphylococcus aureus subsp. aureus MW2
cgagaaucucc

SEQ ID NO: 4012778 - RNA, 16 nt, Staphylococcus aureus subsp. aureus MW2
cgagaauucaauuucu

SEQ ID NO: 4012779 - RNA, 17 nt, Staphylococcus aureus subsp. aureus MW2
cgagacauuucuucaau

SEQ ID NO: 4012780 - RNA, 19 nt, Staphylococcus aureus subsp. aureus MW2
cgagacauuucuucaauuu

SEQ ID NO: 4012781 - RNA, 16 nt, Staphylococcus aureus subsp. aureus MW2
cgagagagaaaagcua

SEQ ID NO: 4012782 - RNA, 19 nt, Staphylococcus aureus subsp. aureus MW2
cgagagagaaaagcuagaa

SEQ ID NO: 4012783 - RNA, 13 nt, Staphylococcus aureus subsp. aureus MW2
cgagcaauucuuc

SEQ ID NO: 4012784 - RNA, 17 nt, Staphylococcus aureus subsp. aureus MW2
cgagccauuauuauuuu

SEQ ID NO: 4012785 - RNA, 20 nt, Staphylococcus aureus subsp. aureus MW2
cgagcugcuucaacuacuuc

SEQ ID NO: 4012786 - RNA, 19 nt, Staphylococcus aureus subsp. aureus MW2
cgaggaaauccuuaaaugg

SEQ ID NO: 4012787 - RNA, 12 nt, Staphylococcus aureus subsp. aureus MW2
cgaggucuuuaa

SEQ ID NO: 4012788 - RNA, 20 nt, Staphylococcus aureus subsp. aureus MW2
cgaguguuuuaaucuuauuc

SEQ ID NO: 4012789 - RNA, 16 nt, Staphylococcus aureus subsp. aureus MW2
cgaguuauaucuucuu

SEQ ID NO: 4012790 - RNA, 12 nt, Staphylococcus aureus subsp. aureus MW2
cgauaaaaccac

SEQ ID NO: 4012791 - RNA, 11 nt, Staphylococcus aureus subsp. aureus MW2
cgauaaaugua

SEQ ID NO: 4012792 - RNA, 17 nt, Staphylococcus aureus subsp. aureus MW2
cgauaccaaauauauuu

SEQ ID NO: 4012793 - RNA, 13 nt, Staphylococcus aureus subsp. aureus MW2
cgauagauaucau

SEQ ID NO: 4012794 - RNA, 21 nt, Staphylococcus aureus subsp. aureus MW2
cgauagauuuaucaccuuuag

SEQ ID NO: 4012795 - RNA, 19 nt, Staphylococcus aureus subsp. aureus MW2
cgauauaacauuaaaauga

SEQ ID NO: 4012796 - RNA, 23 nt, Staphylococcus aureus subsp. aureus MW2
cgauauagugcuuguuuauuaca

SEQ ID NO: 4012797 - RNA, 16 nt, Staphylococcus aureus subsp. aureus MW2
cgauaucuaagucgau

SEQ ID NO: 4012798 - RNA, 21 nt, Staphylococcus aureus subsp. aureus MW2
cgauauguuuggauaucuuug

SEQ ID NO: 4012799 - RNA, 24 nt, Staphylococcus aureus subsp. aureus MW2
cgauauucuccaacucuaacagcu

SEQ ID NO: 4012800 - RNA, 15 nt, Staphylococcus aureus subsp. aureus MW2
cgaucaugccuucau

SEQ ID NO: 4012801 - RNA, 22 nt, Staphylococcus aureus subsp. aureus MW2
cgaucuucaugaacagcaucuu

SEQ ID NO: 4012802 - RNA, 18 nt, Staphylococcus aureus subsp. aureus MW2
cgaucuuuuucaauguga

SEQ ID NO: 4012803 - RNA, 18 nt, Staphylococcus aureus subsp. aureus MW2
cgaugacuuugucuuuaa

SEQ ID NO: 4012804 - RNA, 14 nt, Staphylococcus aureus subsp. aureus MW2
cgaugacuuuuuaa

SEQ ID NO: 4012805 - RNA, 17 nt, Staphylococcus aureus subsp. aureus MW2
cgaugcauauucaucau

SEQ ID NO: 4012806 - RNA, 11 nt, Staphylococcus aureus subsp. aureus MW2
cgauuaauaua

SEQ ID NO: 4012807 - RNA, 21 nt, Staphylococcus aureus subsp. aureus MW2
cgauuaauauaagucuauuau

SEQ ID NO: 4012808 - RNA, 23 nt, Staphylococcus aureus subsp. aureus MW2
cgauuaauauaagucuauuaugu

SEQ ID NO: 4012809 - RNA, 22 nt, Staphylococcus aureus subsp. aureus MW2
cgauugauaauguaaaaugaug

SEQ ID NO: 4012810 - RNA, 15 nt, Staphylococcus aureus subsp. aureus MW2
cgauuguuucaccag

SEQ ID NO: 4012811 - RNA, 16 nt, Staphylococcus aureus subsp. aureus MW2
cgauuuauuauuacca

SEQ ID NO: 4012812 - RNA, 19 nt, Staphylococcus aureus subsp. aureus MW2
cgauuucauuaauuuuuuc

SEQ ID NO: 4012813 - RNA, 22 nt, Staphylococcus aureus subsp. aureus MW2
cgauuucuuuaugauaauaaga

SEQ ID NO: 4012814 - RNA, 21 nt, Staphylococcus aureus subsp. aureus MW2
cgauuugauuuauauuuuuug

SEQ ID NO: 4012815 - RNA, 20 nt, Staphylococcus aureus subsp. aureus MW2
cgauuuuaaaagauaaauaa

SEQ ID NO: 4012816 - RNA, 12 nt, Staphylococcus aureus subsp. aureus MW2
cgauuuuaaaga

SEQ ID NO: 4012817 - RNA, 18 nt, Staphylococcus aureus subsp. aureus MW2
cgauuuuauuaugacaag

SEQ ID NO: 4012818 - RNA, 13 nt, Staphylococcus aureus subsp. aureus MW2
cgauuuucaagua

SEQ ID NO: 4012819 - RNA, 22 nt, Staphylococcus aureus subsp. aureus MW2
cgcaaaaacuugugaauuuuca

SEQ ID NO: 4012820 - RNA, 13 nt, Staphylococcus aureus subsp. aureus MW2
cgcaaagaaaaac

SEQ ID NO: 4012821 - RNA, 13 nt, Staphylococcus aureus subsp. aureus MW2
cgcaagagauaag

SEQ ID NO: 4012822 - RNA, 14 nt, Staphylococcus aureus subsp. aureus MW2
cgcaaugaaaacag

SEQ ID NO: 4012823 - RNA, 20 nt, Staphylococcus aureus subsp. aureus MW2
cgcaaugccacaucauagca

SEQ ID NO: 4012824 - RNA, 14 nt, Staphylococcus aureus subsp. aureus MW2
cgcaaugucuugug

SEQ ID NO: 4012825 - RNA, 12 nt, Staphylococcus aureus subsp. aureus MW2
cgcaauuuuuaa

SEQ ID NO: 4012826 - RNA, 21 nt, Staphylococcus aureus subsp. aureus MW2
cgcacaacugcauauaaaguc

SEQ ID NO: 4012827 - RNA, 18 nt, Staphylococcus aureus subsp. aureus MW2
cgcauacagaucucaauc

SEQ ID NO: 4012828 - RNA, 13 nt, Staphylococcus aureus subsp. aureus MW2
cgcauacaggaaa

SEQ ID NO: 4012829 - RNA, 11 nt, Staphylococcus aureus subsp. aureus MW2
cgcauacuuuu

SEQ ID NO: 4012830 - RNA, 18 nt, Staphylococcus aureus subsp. aureus MW2
cgcauacuuuuucagaau

SEQ ID NO: 4012831 - RNA, 15 nt, Staphylococcus aureus subsp. aureus MW2
cgcaucaaaaaugag

SEQ ID NO: 4012832 - RNA, 12 nt, Staphylococcus aureus subsp. aureus MW2
cgcauuguugua

SEQ ID NO: 4012833 - RNA, 14 nt, Staphylococcus aureus subsp. aureus MW2
cgcauuuaaauaua

SEQ ID NO: 4012834 - RNA, 16 nt, Staphylococcus aureus subsp. aureus MW2
cgccaacuaauguuaa

SEQ ID NO: 4012835 - RNA, 23 nt, Staphylococcus aureus subsp. aureus MW2
cgccaauacagaacuuuaauaau

SEQ ID NO: 4012836 - RNA, 11 nt, Staphylococcus aureus subsp. aureus MW2
cgccagcuucu

SEQ ID NO: 4012837 - RNA, 18 nt, Staphylococcus aureus subsp. aureus MW2
cgccauaaucuucauuaa

SEQ ID NO: 4012838 - RNA, 13 nt, Staphylococcus aureus subsp. aureus MW2
cgccauacauaug

SEQ ID NO: 4012839 - RNA, 23 nt, Staphylococcus aureus subsp. aureus MW2
cgccucaaauggagcaacgauac

SEQ ID NO: 4012840 - RNA, 16 nt, Staphylococcus aureus subsp. aureus MW2
cgccuuguuuauuuuu

SEQ ID NO: 4012841 - RNA, 18 nt, Staphylococcus aureus subsp. aureus MW2
cgccuuuuuuauuuuucu

SEQ ID NO: 4012842 - RNA, 23 nt, Staphylococcus aureus subsp. aureus MW2
cgccuuuuuuauuuuucuuuuug

SEQ ID NO: 4012843 - RNA, 18 nt, Staphylococcus aureus subsp. aureus MW2
cgcggguaauauuuuugu

SEQ ID NO: 4012844 - RNA, 22 nt, Staphylococcus aureus subsp. aureus MW2
cgcggugggcgaaaucaguuug

SEQ ID NO: 4012845 - RNA, 19 nt, Staphylococcus aureus subsp. aureus MW2
cgcgugccaacaucuucaa

SEQ ID NO: 4012846 - RNA, 16 nt, Staphylococcus aureus subsp. aureus MW2
cgcuaauacuuuaacu

SEQ ID NO: 4012847 - RNA, 14 nt, Staphylococcus aureus subsp. aureus MW2
cgcuacaaaacaua

SEQ ID NO: 4012848 - RNA, 16 nt, Staphylococcus aureus subsp. aureus MW2
cgcuccaagauuauga

SEQ ID NO: 4012849 - RNA, 14 nt, Staphylococcus aureus subsp. aureus MW2
cgcuccuacuuuuc

SEQ ID NO: 4012850 - RNA, 14 nt, Staphylococcus aureus subsp. aureus MW2
cgcucuuauaaaga

SEQ ID NO: 4012851 - RNA, 14 nt, Staphylococcus aureus subsp. aureus MW2
cgcugcuacaccac

SEQ ID NO: 4012852 - RNA, 13 nt, Staphylococcus aureus subsp. aureus MW2
cgcugcucuucuc

SEQ ID NO: 4012853 - RNA, 17 nt, Staphylococcus aureus subsp. aureus MW2
cgcuguuucaagcguuu

SEQ ID NO: 4012854 - RNA, 13 nt, Staphylococcus aureus subsp. aureus MW2
cgcuguuuuuaaa

SEQ ID NO: 4012855 - RNA, 23 nt, Staphylococcus aureus subsp. aureus MW2
cgcuguuuuuaaaugcuuuaaau

SEQ ID NO: 4012856 - RNA, 14 nt, Staphylococcus aureus subsp. aureus MW2
cgcuuaauucuuca

SEQ ID NO: 4012857 - RNA, 21 nt, Staphylococcus aureus subsp. aureus MW2
cgcuuagauaaauuaauauga

SEQ ID NO: 4012858 - RNA, 22 nt, Staphylococcus aureus subsp. aureus MW2
cgcuuagauaaauuaauaugaa

SEQ ID NO: 4012859 - RNA, 20 nt, Staphylococcus aureus subsp. aureus MW2
cgcuuauacuauauaauaau

SEQ ID NO: 4012860 - RNA, 14 nt, Staphylococcus aureus subsp. aureus MW2
cgcuuauuuuacua

SEQ ID NO: 4012861 - RNA, 14 nt, Staphylococcus aureus subsp. aureus MW2
cgcuucaauuauuu

SEQ ID NO: 4012862 - RNA, 20 nt, Staphylococcus aureus subsp. aureus MW2
cgcuucauagucacuuuuaa

SEQ ID NO: 4012863 - RNA, 14 nt, Staphylococcus aureus subsp. aureus MW2
cgcuucuaacucac

SEQ ID NO: 4012864 - RNA, 15 nt, Staphylococcus aureus subsp. aureus MW2
cgcuuggauuuuuug

SEQ ID NO: 4012865 - RNA, 16 nt, Staphylococcus aureus subsp. aureus MW2
cgcuuguaacaagcuu

SEQ ID NO: 4012866 - RNA, 16 nt, Staphylococcus aureus subsp. aureus MW2
cgcuuucuauuuauug

SEQ ID NO: 4012867 - RNA, 13 nt, Staphylococcus aureus subsp. aureus MW2
cgcuuuugaaguu

SEQ ID NO: 4012868 - RNA, 12 nt, Staphylococcus aureus subsp. aureus MW2
cgcuuuuuaaaa

SEQ ID NO: 4012869 - RNA, 22 nt, Staphylococcus aureus subsp. aureus MW2
cggaaaauaucacuaauauauu

SEQ ID NO: 4012870 - RNA, 21 nt, Staphylococcus aureus subsp. aureus MW2
cggaaagucagcuuacaauaa

SEQ ID NO: 4012871 - RNA, 18 nt, Staphylococcus aureus subsp. aureus MW2
cggaaauaugauugaaug

SEQ ID NO: 4012872 - RNA, 17 nt, Staphylococcus aureus subsp. aureus MW2
cggaauauuaacaccag

SEQ ID NO: 4012873 - RNA, 23 nt, Staphylococcus aureus subsp. aureus MW2
cggacaauaacagcuacaaauaa

SEQ ID NO: 4012874 - RNA, 14 nt, Staphylococcus aureus subsp. aureus MW2
cggauuuuucucau

SEQ ID NO: 4012875 - RNA, 14 nt, Staphylococcus aureus subsp. aureus MW2
cggcacauucauac

SEQ ID NO: 4012876 - RNA, 16 nt, Staphylococcus aureus subsp. aureus MW2
cggcacauucauaccg

SEQ ID NO: 4012877 - RNA, 22 nt, Staphylococcus aureus subsp. aureus MW2
cggcacauucauaccgaagaaa

SEQ ID NO: 4012878 - RNA, 14 nt, Staphylococcus aureus subsp. aureus MW2
cggcaccuuuauua

SEQ ID NO: 4012879 - RNA, 13 nt, Staphylococcus aureus subsp. aureus MW2
cggcuuuguaaaa

SEQ ID NO: 4012880 - RNA, 15 nt, Staphylococcus aureus subsp. aureus MW2
cgggaacaucauaau

SEQ ID NO: 4012881 - RNA, 23 nt, Staphylococcus aureus subsp. aureus MW2
cgggccccaacauagaagcuggc

SEQ ID NO: 4012882 - RNA, 17 nt, Staphylococcus aureus subsp. aureus MW2
cggggaauuuuuaugca

SEQ ID NO: 4012883 - RNA, 17 nt, Staphylococcus aureus subsp. aureus MW2
cggggccccaacacaga

SEQ ID NO: 4012884 - RNA, 18 nt, Staphylococcus aureus subsp. aureus MW2
cggggccccaacacagag

SEQ ID NO: 4012885 - RNA, 21 nt, Staphylococcus aureus subsp. aureus MW2
cggggccccaacauagaagcu

SEQ ID NO: 4012886 - RNA, 12 nt, Staphylococcus aureus subsp. aureus MW2
cggguaauauuu

SEQ ID NO: 4012887 - RNA, 16 nt, Staphylococcus aureus subsp. aureus MW2
cggguaauauuuuugu

SEQ ID NO: 4012888 - RNA, 18 nt, Staphylococcus aureus subsp. aureus MW2
cgguaaaacgaagucagu

SEQ ID NO: 4012889 - RNA, 21 nt, Staphylococcus aureus subsp. aureus MW2
cgguacuucgcccuuccauuc

SEQ ID NO: 4012890 - RNA, 15 nt, Staphylococcus aureus subsp. aureus MW2
cgguauuuucauuuu

SEQ ID NO: 4012891 - RNA, 21 nt, Staphylococcus aureus subsp. aureus MW2
cggucaaagcgaauagaaggu

SEQ ID NO: 4012892 - RNA, 17 nt, Staphylococcus aureus subsp. aureus MW2
cggugaccuuauauuuu

SEQ ID NO: 4012893 - RNA, 14 nt, Staphylococcus aureus subsp. aureus MW2
cgguucaucuaaaa

SEQ ID NO: 4012894 - RNA, 17 nt, Staphylococcus aureus subsp. aureus MW2
cgguuugaaaaauggug

SEQ ID NO: 4012895 - RNA, 12 nt, Staphylococcus aureus subsp. aureus MW2
cguaaaaucaug

SEQ ID NO: 4012896 - RNA, 13 nt, Staphylococcus aureus subsp. aureus MW2
cguaaacaacauc

SEQ ID NO: 4012897 - RNA, 18 nt, Staphylococcus aureus subsp. aureus MW2
cguaacauuuaaaaaaug

SEQ ID NO: 4012898 - RNA, 14 nt, Staphylococcus aureus subsp. aureus MW2
cguaacuauaugaa

SEQ ID NO: 4012899 - RNA, 15 nt, Staphylococcus aureus subsp. aureus MW2
cguaacuauaugaaa

SEQ ID NO: 4012900 - RNA, 20 nt, Staphylococcus aureus subsp. aureus MW2
cguaagcaguuaauaagaaa

SEQ ID NO: 4012901 - RNA, 23 nt, Staphylococcus aureus subsp. aureus MW2
cguaaggaauuacacuuuaaaua

SEQ ID NO: 4012902 - RNA, 21 nt, Staphylococcus aureus subsp. aureus MW2
cguaauuuaugauuguuuauu

SEQ ID NO: 4012903 - RNA, 18 nt, Staphylococcus aureus subsp. aureus MW2
cguacaaaauaaugauac

SEQ ID NO: 4012904 - RNA, 18 nt, Staphylococcus aureus subsp. aureus MW2
cguacaaagguaauagaa

SEQ ID NO: 4012905 - RNA, 20 nt, Staphylococcus aureus subsp. aureus MW2
cguacguugauguguugcau

SEQ ID NO: 4012906 - RNA, 21 nt, Staphylococcus aureus subsp. aureus MW2
cguacguuuagugaaaauacc

SEQ ID NO: 4012907 - RNA, 14 nt, Staphylococcus aureus subsp. aureus MW2
cguagcauuauuua

SEQ ID NO: 4012908 - RNA, 20 nt, Staphylococcus aureus subsp. aureus MW2
cguagccguuuuugaaaugu

SEQ ID NO: 4012909 - RNA, 21 nt, Staphylococcus aureus subsp. aureus MW2
cguagcugaggauuuuuuagg

SEQ ID NO: 4012910 - RNA, 18 nt, Staphylococcus aureus subsp. aureus MW2
cguaguaaccuaauucua

SEQ ID NO: 4012911 - RNA, 13 nt, Staphylococcus aureus subsp. aureus MW2
cguaguauauaug

SEQ ID NO: 4012912 - RNA, 15 nt, Staphylococcus aureus subsp. aureus MW2
cguaucuuuacaaca

SEQ ID NO: 4012913 - RNA, 19 nt, Staphylococcus aureus subsp. aureus MW2
cguaugcccucauaaauca

SEQ ID NO: 4012914 - RNA, 17 nt, Staphylococcus aureus subsp. aureus MW2
cguauuucaaauguaau

SEQ ID NO: 4012915 - RNA, 15 nt, Staphylococcus aureus subsp. aureus MW2
cguauuuuaaugauu

SEQ ID NO: 4012916 - RNA, 14 nt, Staphylococcus aureus subsp. aureus MW2
cguauuuuuuuaua

SEQ ID NO: 4012917 - RNA, 17 nt, Staphylococcus aureus subsp. aureus MW2
cguauuuuuuuauaauu

SEQ ID NO: 4012918 - RNA, 23 nt, Staphylococcus aureus subsp. aureus MW2
cgucacaugccaucuuuguaacc

SEQ ID NO: 4012919 - RNA, 14 nt, Staphylococcus aureus subsp. aureus MW2
cgucacucacuuca

SEQ ID NO: 4012920 - RNA, 24 nt, Staphylococcus aureus subsp. aureus MW2
cgucagauucaaacguuuucacuu

SEQ ID NO: 4012921 - RNA, 18 nt, Staphylococcus aureus subsp. aureus MW2
cgucauauuaauauuuuu

SEQ ID NO: 4012922 - RNA, 12 nt, Staphylococcus aureus subsp. aureus MW2
cgucauuuuuaa

SEQ ID NO: 4012923 - RNA, 20 nt, Staphylococcus aureus subsp. aureus MW2
cgucccaccccaacuugcau

SEQ ID NO: 4012924 - RNA, 21 nt, Staphylococcus aureus subsp. aureus MW2
cgucccaccccaacuugcauu

SEQ ID NO: 4012925 - RNA, 13 nt, Staphylococcus aureus subsp. aureus MW2
cgucgugauggcu

SEQ ID NO: 4012926 - RNA, 18 nt, Staphylococcus aureus subsp. aureus MW2
cgucuaauuuuaaucauu

SEQ ID NO: 4012927 - RNA, 20 nt, Staphylococcus aureus subsp. aureus MW2
cgucuauacuccaguuuaua

SEQ ID NO: 4012928 - RNA, 13 nt, Staphylococcus aureus subsp. aureus MW2
cgucuguuucaua

SEQ ID NO: 4012929 - RNA, 12 nt, Staphylococcus aureus subsp. aureus MW2
cgucuuguaaac

SEQ ID NO: 4012930 - RNA, 16 nt, Staphylococcus aureus subsp. aureus MW2
cgucuuguaaacuucu

SEQ ID NO: 4012931 - RNA, 17 nt, Staphylococcus aureus subsp. aureus MW2
cgucuuguaaacuucuu

SEQ ID NO: 4012932 - RNA, 20 nt, Staphylococcus aureus subsp. aureus MW2
cgucuuuugcaaauuggaaa

SEQ ID NO: 4012933 - RNA, 22 nt, Staphylococcus aureus subsp. aureus MW2
cgucuuuuuuuaugaaaagaau

SEQ ID NO: 4012934 - RNA, 17 nt, Staphylococcus aureus subsp. aureus MW2
cgugaaagaaaaaacuu

SEQ ID NO: 4012935 - RNA, 22 nt, Staphylococcus aureus subsp. aureus MW2
cgugaauucgaugacuuuuuaa

SEQ ID NO: 4012936 - RNA, 18 nt, Staphylococcus aureus subsp. aureus MW2
cgugagggacgucaucau

SEQ ID NO: 4012937 - RNA, 20 nt, Staphylococcus aureus subsp. aureus MW2
cgugagggacgucaucaugg

SEQ ID NO: 4012938 - RNA, 18 nt, Staphylococcus aureus subsp. aureus MW2
cgugauggcuacuuuuuc

SEQ ID NO: 4012939 - RNA, 15 nt, Staphylococcus aureus subsp. aureus MW2
cgugauuuggaauac

SEQ ID NO: 4012940 - RNA, 20 nt, Staphylococcus aureus subsp. aureus MW2
cgugauuuggaauacuuuuc

SEQ ID NO: 4012941 - RNA, 13 nt, Staphylococcus aureus subsp. aureus MW2
cgugauuuuucau

SEQ ID NO: 4012942 - RNA, 18 nt, Staphylococcus aureus subsp. aureus MW2
cgugcauuguaauaccaa

SEQ ID NO: 4012943 - RNA, 17 nt, Staphylococcus aureus subsp. aureus MW2
cgugccuuaacuucaua

SEQ ID NO: 4012944 - RNA, 14 nt, Staphylococcus aureus subsp. aureus MW2
cgugguaugauuuu

SEQ ID NO: 4012945 - RNA, 17 nt, Staphylococcus aureus subsp. aureus MW2
cgugguaugauuuuuga

SEQ ID NO: 4012946 - RNA, 13 nt, Staphylococcus aureus subsp. aureus MW2
cgugguucccaau

SEQ ID NO: 4012947 - RNA, 20 nt, Staphylococcus aureus subsp. aureus MW2
cguguaaaaaugauuauucu

SEQ ID NO: 4012948 - RNA, 12 nt, Staphylococcus aureus subsp. aureus MW2
cguguguaguag

SEQ ID NO: 4012949 - RNA, 16 nt, Staphylococcus aureus subsp. aureus MW2
cguguuuaauauuguu

SEQ ID NO: 4012950 - RNA, 20 nt, Staphylococcus aureus subsp. aureus MW2
cguguuugaauggcaaauau

SEQ ID NO: 4012951 - RNA, 21 nt, Staphylococcus aureus subsp. aureus MW2
cguguuugaauguuuuugaua

SEQ ID NO: 4012952 - RNA, 11 nt, Staphylococcus aureus subsp. aureus MW2
cguuaaaaaga

SEQ ID NO: 4012953 - RNA, 17 nt, Staphylococcus aureus subsp. aureus MW2
cguuaaaacacccugcu

SEQ ID NO: 4012954 - RNA, 15 nt, Staphylococcus aureus subsp. aureus MW2
cguuaaauauauauu

SEQ ID NO: 4012955 - RNA, 21 nt, Staphylococcus aureus subsp. aureus MW2
cguuauaaguacaaauaauac

SEQ ID NO: 4012956 - RNA, 13 nt, Staphylococcus aureus subsp. aureus MW2
cguucauauauuu

SEQ ID NO: 4012957 - RNA, 14 nt, Staphylococcus aureus subsp. aureus MW2
cguucauauauuuu

SEQ ID NO: 4012958 - RNA, 17 nt, Staphylococcus aureus subsp. aureus MW2
cguucuaauaauuuaau

SEQ ID NO: 4012959 - RNA, 12 nt, Staphylococcus aureus subsp. aureus MW2
cguucugcuaau

SEQ ID NO: 4012960 - RNA, 21 nt, Staphylococcus aureus subsp. aureus MW2
cguucuugguauuuuuuaaau

SEQ ID NO: 4012961 - RNA, 21 nt, Staphylococcus aureus subsp. aureus MW2
cguugaauuaacaauauuaaa

SEQ ID NO: 4012962 - RNA, 18 nt, Staphylococcus aureus subsp. aureus MW2
cguugcaccuauuuuuug

SEQ ID NO: 4012963 - RNA, 16 nt, Staphylococcus aureus subsp. aureus MW2
cguugcgcucuuuucu

SEQ ID NO: 4012964 - RNA, 18 nt, Staphylococcus aureus subsp. aureus MW2
cguugguugugauuuguu

SEQ ID NO: 4012965 - RNA, 20 nt, Staphylococcus aureus subsp. aureus MW2
cguugugcagcaacugcauu

SEQ ID NO: 4012966 - RNA, 23 nt, Staphylococcus aureus subsp. aureus MW2
cguuguucauaaucauaauaaga

SEQ ID NO: 4012967 - RNA, 21 nt, Staphylococcus aureus subsp. aureus MW2
cguuuaacaaacguuguucaa

SEQ ID NO: 4012968 - RNA, 18 nt, Staphylococcus aureus subsp. aureus MW2
cguuuaagaaaucaacaa

SEQ ID NO: 4012969 - RNA, 18 nt, Staphylococcus aureus subsp. aureus MW2
cguuuaccgucuuuugca

SEQ ID NO: 4012970 - RNA, 16 nt, Staphylococcus aureus subsp. aureus MW2
cguuuacguucuucau

SEQ ID NO: 4012971 - RNA, 17 nt, Staphylococcus aureus subsp. aureus MW2
cguuuacguucuucaug

SEQ ID NO: 4012972 - RNA, 14 nt, Staphylococcus aureus subsp. aureus MW2
cguuuauuuuaaau

SEQ ID NO: 4012973 - RNA, 21 nt, Staphylococcus aureus subsp. aureus MW2
cguuucagaaguuguuuagaa

SEQ ID NO: 4012974 - RNA, 20 nt, Staphylococcus aureus subsp. aureus MW2
cguuucgucagauucaaacg

SEQ ID NO: 4012975 - RNA, 19 nt, Staphylococcus aureus subsp. aureus MW2
cguuugaagaauguuucau

SEQ ID NO: 4012976 - RNA, 19 nt, Staphylococcus aureus subsp. aureus MW2
cguuugaaugaaccuuuac

SEQ ID NO: 4012977 - RNA, 13 nt, Staphylococcus aureus subsp. aureus MW2
cguuugauuucac

SEQ ID NO: 4012978 - RNA, 20 nt, Staphylococcus aureus subsp. aureus MW2
cguuuuagcuagacauucgu

SEQ ID NO: 4012979 - RNA, 19 nt, Staphylococcus aureus subsp. aureus MW2
cguuuuauuaaugaagcug

SEQ ID NO: 4012980 - RNA, 23 nt, Staphylococcus aureus subsp. aureus MW2
cguuuugcuaaccaucauaaaug

SEQ ID NO: 4012981 - RNA, 14 nt, Staphylococcus aureus subsp. aureus MW2
cguuuuuaaauaau

SEQ ID NO: 4012982 - RNA, 13 nt, Staphylococcus aureus subsp. aureus MW2
cuaaaaaauuugc

SEQ ID NO: 4012983 - RNA, 18 nt, Staphylococcus aureus subsp. aureus MW2
cuaaaaaauuugcaugaa

SEQ ID NO: 4012984 - RNA, 13 nt, Staphylococcus aureus subsp. aureus MW2
cuaaaaacauaaa

SEQ ID NO: 4012985 - RNA, 20 nt, Staphylococcus aureus subsp. aureus MW2
cuaaaaacggacaaguugca

SEQ ID NO: 4012986 - RNA, 13 nt, Staphylococcus aureus subsp. aureus MW2
cuaaaaagucuuu

SEQ ID NO: 4012987 - RNA, 14 nt, Staphylococcus aureus subsp. aureus MW2
cuaaaaauaaaauc

SEQ ID NO: 4012988 - RNA, 19 nt, Staphylococcus aureus subsp. aureus MW2
cuaaaaaugucguauaugu

SEQ ID NO: 4012989 - RNA, 17 nt, Staphylococcus aureus subsp. aureus MW2
cuaaaacaaauucauau

SEQ ID NO: 4012990 - RNA, 21 nt, Staphylococcus aureus subsp. aureus MW2
cuaaaacaaauucauauuaac

SEQ ID NO: 4012991 - RNA, 19 nt, Staphylococcus aureus subsp. aureus MW2
cuaaaacauguugauaaaa

SEQ ID NO: 4012992 - RNA, 17 nt, Staphylococcus aureus subsp. aureus MW2
cuaaaacggaaauaacc

SEQ ID NO: 4012993 - RNA, 16 nt, Staphylococcus aureus subsp. aureus MW2
cuaaaacuaucugauu

SEQ ID NO: 4012994 - RNA, 15 nt, Staphylococcus aureus subsp. aureus MW2
cuaaaacuuuuucaa

SEQ ID NO: 4012995 - RNA, 21 nt, Staphylococcus aureus subsp. aureus MW2
cuaaaaguggccuuuuaaaca

SEQ ID NO: 4012996 - RNA, 18 nt, Staphylococcus aureus subsp. aureus MW2
cuaaaauacccauuuuuu

SEQ ID NO: 4012997 - RNA, 22 nt, Staphylococcus aureus subsp. aureus MW2
cuaaaauacuguuuucauuugu

SEQ ID NO: 4012998 - RNA, 19 nt, Staphylococcus aureus subsp. aureus MW2
cuaaaauagaaaaauuuca

SEQ ID NO: 4012999 - RNA, 23 nt, Staphylococcus aureus subsp. aureus MW2
cuaaaauaucaaaauauaaaauc

SEQ ID NO: 4013000 - RNA, 15 nt, Staphylococcus aureus subsp. aureus MW2
cuaaaaugucuuuga

SEQ ID NO: 4013001 - RNA, 23 nt, Staphylococcus aureus subsp. aureus MW2
cuaaaauuaaccauuucuuuuuu

SEQ ID NO: 4013002 - RNA, 16 nt, Staphylococcus aureus subsp. aureus MW2
cuaaaauucuuucagc

SEQ ID NO: 4013003 - RNA, 18 nt, Staphylococcus aureus subsp. aureus MW2
cuaaaauucuuucagcua

SEQ ID NO: 4013004 - RNA, 21 nt, Staphylococcus aureus subsp. aureus MW2
cuaaaauuugcucgugaaaag

SEQ ID NO: 4013005 - RNA, 18 nt, Staphylococcus aureus subsp. aureus MW2
cuaaaauuuguaauuuaa

SEQ ID NO: 4013006 - RNA, 18 nt, Staphylococcus aureus subsp. aureus MW2
cuaaacaaugaugggaaa

SEQ ID NO: 4013007 - RNA, 20 nt, Staphylococcus aureus subsp. aureus MW2
cuaaacacugccguuugaag

SEQ ID NO: 4013008 - RNA, 17 nt, Staphylococcus aureus subsp. aureus MW2
cuaaacauuuuauacuc

SEQ ID NO: 4013009 - RNA, 19 nt, Staphylococcus aureus subsp. aureus MW2
cuaaacauuuuauacucug

SEQ ID NO: 4013010 - RNA, 20 nt, Staphylococcus aureus subsp. aureus MW2
cuaaacauuuuugugcaaaa

SEQ ID NO: 4013011 - RNA, 23 nt, Staphylococcus aureus subsp. aureus MW2
cuaaaccaaugauuguuaauaca

SEQ ID NO: 4013012 - RNA, 15 nt, Staphylococcus aureus subsp. aureus MW2
cuaaaccauugaaug

SEQ ID NO: 4013013 - RNA, 19 nt, Staphylococcus aureus subsp. aureus MW2
cuaaaccgauuaauauaau

SEQ ID NO: 4013014 - RNA, 15 nt, Staphylococcus aureus subsp. aureus MW2
cuaaaccucuaaaua

SEQ ID NO: 4013015 - RNA, 16 nt, Staphylococcus aureus subsp. aureus MW2
cuaaaccucuaaauaa

SEQ ID NO: 4013016 - RNA, 15 nt, Staphylococcus aureus subsp. aureus MW2
cuaaagaccuuucuu

SEQ ID NO: 4013017 - RNA, 16 nt, Staphylococcus aureus subsp. aureus MW2
cuaaagacuuuaugcc

SEQ ID NO: 4013018 - RNA, 14 nt, Staphylococcus aureus subsp. aureus MW2
cuaaagauaauauu

SEQ ID NO: 4013019 - RNA, 21 nt, Staphylococcus aureus subsp. aureus MW2
cuaaagcgauuuccaucauuu

SEQ ID NO: 4013020 - RNA, 14 nt, Staphylococcus aureus subsp. aureus MW2
cuaaagcuaaugca

SEQ ID NO: 4013021 - RNA, 13 nt, Staphylococcus aureus subsp. aureus MW2
cuaaagguaacuu

SEQ ID NO: 4013022 - RNA, 15 nt, Staphylococcus aureus subsp. aureus MW2
cuaaaguaaauaaca

SEQ ID NO: 4013023 - RNA, 15 nt, Staphylococcus aureus subsp. aureus MW2
cuaaaguauuaucua

SEQ ID NO: 4013024 - RNA, 14 nt, Staphylococcus aureus subsp. aureus MW2
cuaaauaaaauuaa

SEQ ID NO: 4013025 - RNA, 16 nt, Staphylococcus aureus subsp. aureus MW2
cuaaauaaaauuaaaa

SEQ ID NO: 4013026 - RNA, 22 nt, Staphylococcus aureus subsp. aureus MW2
cuaaauaaaauuaaaacagcaa

SEQ ID NO: 4013027 - RNA, 13 nt, Staphylococcus aureus subsp. aureus MW2
cuaaauacgagug

SEQ ID NO: 4013028 - RNA, 22 nt, Staphylococcus aureus subsp. aureus MW2
cuaaauaguuuuucauauucac

SEQ ID NO: 4013029 - RNA, 21 nt, Staphylococcus aureus subsp. aureus MW2
cuaaaugaauugcuuguucuu

SEQ ID NO: 4013030 - RNA, 17 nt, Staphylococcus aureus subsp. aureus MW2
cuaaaugcacuagcaac

SEQ ID NO: 4013031 - RNA, 18 nt, Staphylococcus aureus subsp. aureus MW2
cuaaauggugucgauacu

SEQ ID NO: 4013032 - RNA, 12 nt, Staphylococcus aureus subsp. aureus MW2
cuaaauguaaaa

SEQ ID NO: 4013033 - RNA, 17 nt, Staphylococcus aureus subsp. aureus MW2
cuaaauguaaaaucauu

SEQ ID NO: 4013034 - RNA, 22 nt, Staphylococcus aureus subsp. aureus MW2
cuaaauuauuuauucauuauag

SEQ ID NO: 4013035 - RNA, 18 nt, Staphylococcus aureus subsp. aureus MW2
cuaaauuuucuaaaugug

SEQ ID NO: 4013036 - RNA, 23 nt, Staphylococcus aureus subsp. aureus MW2
cuaacauaccuaauaacgcauau

SEQ ID NO: 4013037 - RNA, 21 nt, Staphylococcus aureus subsp. aureus MW2
cuaacaugggguuuuauuuuu

SEQ ID NO: 4013038 - RNA, 13 nt, Staphylococcus aureus subsp. aureus MW2
cuaacauugguac

SEQ ID NO: 4013039 - RNA, 12 nt, Staphylococcus aureus subsp. aureus MW2
cuaaccaaauaa

SEQ ID NO: 4013040 - RNA, 14 nt, Staphylococcus aureus subsp. aureus MW2
cuaaccaaauaauu

SEQ ID NO: 4013041 - RNA, 15 nt, Staphylococcus aureus subsp. aureus MW2
cuaaccacuucuuca

SEQ ID NO: 4013042 - RNA, 14 nt, Staphylococcus aureus subsp. aureus MW2
cuaaccuauuaaaa

SEQ ID NO: 4013043 - RNA, 16 nt, Staphylococcus aureus subsp. aureus MW2
cuaaccuauuaaaaua

SEQ ID NO: 4013044 - RNA, 22 nt, Staphylococcus aureus subsp. aureus MW2
cuaacguguuugagauauauua

SEQ ID NO: 4013045 - RNA, 14 nt, Staphylococcus aureus subsp. aureus MW2
cuaacucaccugca

SEQ ID NO: 4013046 - RNA, 18 nt, Staphylococcus aureus subsp. aureus MW2
cuaacucauaaucaacau

SEQ ID NO: 4013047 - RNA, 22 nt, Staphylococcus aureus subsp. aureus MW2
cuaacucugaucuaaaaccaua

SEQ ID NO: 4013048 - RNA, 16 nt, Staphylococcus aureus subsp. aureus MW2
cuaacuuguuuauuca

SEQ ID NO: 4013049 - RNA, 16 nt, Staphylococcus aureus subsp. aureus MW2
cuaagaauguaaugag

SEQ ID NO: 4013050 - RNA, 12 nt, Staphylococcus aureus subsp. aureus MW2
cuaagcagucug

SEQ ID NO: 4013051 - RNA, 21 nt, Staphylococcus aureus subsp. aureus MW2
cuaagcaucguaaaaaacaaa

SEQ ID NO: 4013052 - RNA, 18 nt, Staphylococcus aureus subsp. aureus MW2
cuaagcugauuaaaauau

SEQ ID NO: 4013053 - RNA, 22 nt, Staphylococcus aureus subsp. aureus MW2
cuaagguaagacgccgaaaaga

SEQ ID NO: 4013054 - RNA, 14 nt, Staphylococcus aureus subsp. aureus MW2
cuaagguuguucua

SEQ ID NO: 4013055 - RNA, 17 nt, Staphylococcus aureus subsp. aureus MW2
cuaaguaaccaagucua

SEQ ID NO: 4013056 - RNA, 13 nt, Staphylococcus aureus subsp. aureus MW2
cuaagucuuuuga

SEQ ID NO: 4013057 - RNA, 16 nt, Staphylococcus aureus subsp. aureus MW2
cuaagucuuuugaagu

SEQ ID NO: 4013058 - RNA, 22 nt, Staphylococcus aureus subsp. aureus MW2
cuaauaaaaccgguacuuucau

SEQ ID NO: 4013059 - RNA, 16 nt, Staphylococcus aureus subsp. aureus MW2
cuaauaacucuucuaa

SEQ ID NO: 4013060 - RNA, 19 nt, Staphylococcus aureus subsp. aureus MW2
cuaauaauuuguaauuccu

SEQ ID NO: 4013061 - RNA, 15 nt, Staphylococcus aureus subsp. aureus MW2
cuaauacuuuaacug

SEQ ID NO: 4013062 - RNA, 18 nt, Staphylococcus aureus subsp. aureus MW2
cuaauacuuucacuuuuu

SEQ ID NO: 4013063 - RNA, 22 nt, Staphylococcus aureus subsp. aureus MW2
cuaauacuuucacuuuuuauau

SEQ ID NO: 4013064 - RNA, 15 nt, Staphylococcus aureus subsp. aureus MW2
cuaauagcauuugua

SEQ ID NO: 4013065 - RNA, 20 nt, Staphylococcus aureus subsp. aureus MW2
cuaauagcuauauuuaaaau

SEQ ID NO: 4013066 - RNA, 15 nt, Staphylococcus aureus subsp. aureus MW2
cuaauauauuaauuu

SEQ ID NO: 4013067 - RNA, 14 nt, Staphylococcus aureus subsp. aureus MW2
cuaauaucaauaau

SEQ ID NO: 4013068 - RNA, 21 nt, Staphylococcus aureus subsp. aureus MW2
cuaauaugucuagacuuauuu

SEQ ID NO: 4013069 - RNA, 18 nt, Staphylococcus aureus subsp. aureus MW2
cuaauauuagauaucuua

SEQ ID NO: 4013070 - RNA, 15 nt, Staphylococcus aureus subsp. aureus MW2
cuaauauuuaaaaaa

SEQ ID NO: 4013071 - RNA, 18 nt, Staphylococcus aureus subsp. aureus MW2
cuaauauuuauuuuaaau

SEQ ID NO: 4013072 - RNA, 12 nt, Staphylococcus aureus subsp. aureus MW2
cuaaucaauacu

SEQ ID NO: 4013073 - RNA, 16 nt, Staphylococcus aureus subsp. aureus MW2
cuaaucagauauuagg

SEQ ID NO: 4013074 - RNA, 19 nt, Staphylococcus aureus subsp. aureus MW2
cuaaucaugaaguugguuu

SEQ ID NO: 4013075 - RNA, 13 nt, Staphylococcus aureus subsp. aureus MW2
cuaaucauuuuuu

SEQ ID NO: 4013076 - RNA, 16 nt, Staphylococcus aureus subsp. aureus MW2
cuaaucauuuuuucaa

SEQ ID NO: 4013077 - RNA, 20 nt, Staphylococcus aureus subsp. aureus MW2
cuaaucauuuuuucaauagu

SEQ ID NO: 4013078 - RNA, 17 nt, Staphylococcus aureus subsp. aureus MW2
cuaaucguguauuauug

SEQ ID NO: 4013079 - RNA, 22 nt, Staphylococcus aureus subsp. aureus MW2
cuaaucguguauuauugaaacu

SEQ ID NO: 4013080 - RNA, 14 nt, Staphylococcus aureus subsp. aureus MW2
cuaaucucagauuu

SEQ ID NO: 4013081 - RNA, 18 nt, Staphylococcus aureus subsp. aureus MW2
cuaaucuugguucagcuu

SEQ ID NO: 4013082 - RNA, 20 nt, Staphylococcus aureus subsp. aureus MW2
cuaaucuugguucagcuuua

SEQ ID NO: 4013083 - RNA, 22 nt, Staphylococcus aureus subsp. aureus MW2
cuaaugagcccguuaaaaagac

SEQ ID NO: 4013084 - RNA, 15 nt, Staphylococcus aureus subsp. aureus MW2
cuaaugcuaauuuaa

SEQ ID NO: 4013085 - RNA, 17 nt, Staphylococcus aureus subsp. aureus MW2
cuaaugcuaauuuaacu

SEQ ID NO: 4013086 - RNA, 22 nt, Staphylococcus aureus subsp. aureus MW2
cuaauggauaugauaaccaaac

SEQ ID NO: 4013087 - RNA, 18 nt, Staphylococcus aureus subsp. aureus MW2
cuaaugguuucauaaacu

SEQ ID NO: 4013088 - RNA, 18 nt, Staphylococcus aureus subsp. aureus MW2
cuaaugucgcacuauaaa

SEQ ID NO: 4013089 - RNA, 22 nt, Staphylococcus aureus subsp. aureus MW2
cuaauuagguauaguguuugac

SEQ ID NO: 4013090 - RNA, 12 nt, Staphylococcus aureus subsp. aureus MW2
cuaauucacuuu

SEQ ID NO: 4013091 - RNA, 14 nt, Staphylococcus aureus subsp. aureus MW2
cuaauucauucaau

SEQ ID NO: 4013092 - RNA, 23 nt, Staphylococcus aureus subsp. aureus MW2
cuaauucguuuugcuaaccauca

SEQ ID NO: 4013093 - RNA, 14 nt, Staphylococcus aureus subsp. aureus MW2
cuaauucugaaauc

SEQ ID NO: 4013094 - RNA, 20 nt, Staphylococcus aureus subsp. aureus MW2
cuaauucuguuucaaagcug

SEQ ID NO: 4013095 - RNA, 21 nt, Staphylococcus aureus subsp. aureus MW2
cuaauugaaggccauuuuuau

SEQ ID NO: 4013096 - RNA, 23 nt, Staphylococcus aureus subsp. aureus MW2
cuaauugaaggccauuuuuauuu

SEQ ID NO: 4013097 - RNA, 22 nt, Staphylococcus aureus subsp. aureus MW2
cuaauugaucagcauuuaaguu

SEQ ID NO: 4013098 - RNA, 13 nt, Staphylococcus aureus subsp. aureus MW2
cuaauugcacauu

SEQ ID NO: 4013099 - RNA, 24 nt, Staphylococcus aureus subsp. aureus MW2
cuaauugcacauuuaaacuucgua

SEQ ID NO: 4013100 - RNA, 22 nt, Staphylococcus aureus subsp. aureus MW2
cuaauuguuguaauucuuuuuc

SEQ ID NO: 4013101 - RNA, 21 nt, Staphylococcus aureus subsp. aureus MW2
cuaauuuaaaugauuucacuu

SEQ ID NO: 4013102 - RNA, 16 nt, Staphylococcus aureus subsp. aureus MW2
cuaauuuaguuuuaau

SEQ ID NO: 4013103 - RNA, 19 nt, Staphylococcus aureus subsp. aureus MW2
cuaauuuauaaacaauuac

SEQ ID NO: 4013104 - RNA, 22 nt, Staphylococcus aureus subsp. aureus MW2
cuaauuucuaauacauacugau

SEQ ID NO: 4013105 - RNA, 17 nt, Staphylococcus aureus subsp. aureus MW2
cuaauuugcaaaaucaa

SEQ ID NO: 4013106 - RNA, 18 nt, Staphylococcus aureus subsp. aureus MW2
cuaauuugcaaaaucaac

SEQ ID NO: 4013107 - RNA, 21 nt, Staphylococcus aureus subsp. aureus MW2
cuaauuuuguacauaaaaaua

SEQ ID NO: 4013108 - RNA, 22 nt, Staphylococcus aureus subsp. aureus MW2
cuaauuuuguacauaaaaauaa

SEQ ID NO: 4013109 - RNA, 23 nt, Staphylococcus aureus subsp. aureus MW2
cuaauuuugugaauuuauuuugu

SEQ ID NO: 4013110 - RNA, 13 nt, Staphylococcus aureus subsp. aureus MW2
cuaauuuuucuuu

SEQ ID NO: 4013111 - RNA, 14 nt, Staphylococcus aureus subsp. aureus MW2
cuaauuuuucuuua

SEQ ID NO: 4013112 - RNA, 20 nt, Staphylococcus aureus subsp. aureus MW2
cuacaaaguuuauacuuaau

SEQ ID NO: 4013113 - RNA, 17 nt, Staphylococcus aureus subsp. aureus MW2
cuacaaauuuuaaaaua

SEQ ID NO: 4013114 - RNA, 13 nt, Staphylococcus aureus subsp. aureus MW2
cuacaauccuaug

SEQ ID NO: 4013115 - RNA, 21 nt, Staphylococcus aureus subsp. aureus MW2
cuacaauuauaaaugauuaaa

SEQ ID NO: 4013116 - RNA, 14 nt, Staphylococcus aureus subsp. aureus MW2
cuacaauuauaugu

SEQ ID NO: 4013117 - RNA, 20 nt, Staphylococcus aureus subsp. aureus MW2
cuacaauucauaagaaaaau

SEQ ID NO: 4013118 - RNA, 16 nt, Staphylococcus aureus subsp. aureus MW2
cuacaauuuucucauu

SEQ ID NO: 4013119 - RNA, 12 nt, Staphylococcus aureus subsp. aureus MW2
cuacacccauuu

SEQ ID NO: 4013120 - RNA, 17 nt, Staphylococcus aureus subsp. aureus MW2
cuacacgaguguuauca

SEQ ID NO: 4013121 - RNA, 15 nt, Staphylococcus aureus subsp. aureus MW2
cuacacggucccaag

SEQ ID NO: 4013122 - RNA, 14 nt, Staphylococcus aureus subsp. aureus MW2
cuacacuguuuuau

SEQ ID NO: 4013123 - RNA, 14 nt, Staphylococcus aureus subsp. aureus MW2
cuacacuuaauaua

SEQ ID NO: 4013124 - RNA, 19 nt, Staphylococcus aureus subsp. aureus MW2
cuacagaaguggugcuuua

SEQ ID NO: 4013125 - RNA, 23 nt, Staphylococcus aureus subsp. aureus MW2
cuacagaauggauaccuaaagcu

SEQ ID NO: 4013126 - RNA, 18 nt, Staphylococcus aureus subsp. aureus MW2
cuacagauuuuaaaaauu

SEQ ID NO: 4013127 - RNA, 19 nt, Staphylococcus aureus subsp. aureus MW2
cuacauaauuuaucaauuu

SEQ ID NO: 4013128 - RNA, 23 nt, Staphylococcus aureus subsp. aureus MW2
cuacauaauuuaucaauuucuau

SEQ ID NO: 4013129 - RNA, 12 nt, Staphylococcus aureus subsp. aureus MW2
cuacauauacaa

SEQ ID NO: 4013130 - RNA, 19 nt, Staphylococcus aureus subsp. aureus MW2
cuacauauacaaauuuaua

SEQ ID NO: 4013131 - RNA, 12 nt, Staphylococcus aureus subsp. aureus MW2
cuacaucaauau

SEQ ID NO: 4013132 - RNA, 17 nt, Staphylococcus aureus subsp. aureus MW2
cuacaucaauauugucu

SEQ ID NO: 4013133 - RNA, 15 nt, Staphylococcus aureus subsp. aureus MW2
cuacauuaauuuauc

SEQ ID NO: 4013134 - RNA, 16 nt, Staphylococcus aureus subsp. aureus MW2
cuacauuaauuuaucg

SEQ ID NO: 4013135 - RNA, 19 nt, Staphylococcus aureus subsp. aureus MW2
cuacauucuucauuacagu

SEQ ID NO: 4013136 - RNA, 14 nt, Staphylococcus aureus subsp. aureus MW2
cuaccaauaauucc

SEQ ID NO: 4013137 - RNA, 13 nt, Staphylococcus aureus subsp. aureus MW2
cuacccuauuuua

SEQ ID NO: 4013138 - RNA, 22 nt, Staphylococcus aureus subsp. aureus MW2
cuaccgauugucaauuuaaagu

SEQ ID NO: 4013139 - RNA, 15 nt, Staphylococcus aureus subsp. aureus MW2
cuaccuguuggcuuu

SEQ ID NO: 4013140 - RNA, 20 nt, Staphylococcus aureus subsp. aureus MW2
cuaccuguuggcuuuaaagg

SEQ ID NO: 4013141 - RNA, 16 nt, Staphylococcus aureus subsp. aureus MW2
cuacgaaguuauauug

SEQ ID NO: 4013142 - RNA, 15 nt, Staphylococcus aureus subsp. aureus MW2
cuacgaauacuaaaa

SEQ ID NO: 4013143 - RNA, 23 nt, Staphylococcus aureus subsp. aureus MW2
cuacguguguaguagcaccgauu

SEQ ID NO: 4013144 - RNA, 15 nt, Staphylococcus aureus subsp. aureus MW2
cuacuaaauaacuau

SEQ ID NO: 4013145 - RNA, 14 nt, Staphylococcus aureus subsp. aureus MW2
cuacuagaauaacu

SEQ ID NO: 4013146 - RNA, 14 nt, Staphylococcus aureus subsp. aureus MW2
cuacuauuaaauaa

SEQ ID NO: 4013147 - RNA, 16 nt, Staphylococcus aureus subsp. aureus MW2
cuacuccauagaaauu

SEQ ID NO: 4013148 - RNA, 15 nt, Staphylococcus aureus subsp. aureus MW2
cuacucgacacauau

SEQ ID NO: 4013149 - RNA, 16 nt, Staphylococcus aureus subsp. aureus MW2
cuacucgacacauaua

SEQ ID NO: 4013150 - RNA, 23 nt, Staphylococcus aureus subsp. aureus MW2
cuacugcaccgauaucauauaau

SEQ ID NO: 4013151 - RNA, 14 nt, Staphylococcus aureus subsp. aureus MW2
cuacugcuugugug

SEQ ID NO: 4013152 - RNA, 18 nt, Staphylococcus aureus subsp. aureus MW2
cuacugucucaucuucua

SEQ ID NO: 4013153 - RNA, 13 nt, Staphylococcus aureus subsp. aureus MW2
cuacuuaaaauaa

SEQ ID NO: 4013154 - RNA, 23 nt, Staphylococcus aureus subsp. aureus MW2
cuacuuaaaauaaguauuuuuuu

SEQ ID NO: 4013155 - RNA, 19 nt, Staphylococcus aureus subsp. aureus MW2
cuacuuccuuacagacaaa

SEQ ID NO: 4013156 - RNA, 18 nt, Staphylococcus aureus subsp. aureus MW2
cuacuuguucaauacuuc

SEQ ID NO: 4013157 - RNA, 22 nt, Staphylococcus aureus subsp. aureus MW2
cuacuuugaagggagcauuuca

SEQ ID NO: 4013158 - RNA, 21 nt, Staphylococcus aureus subsp. aureus MW2
cuacuuugauauguuuccucu

SEQ ID NO: 4013159 - RNA, 23 nt, Staphylococcus aureus subsp. aureus MW2
cuacuuugucugcaauuucauag

SEQ ID NO: 4013160 - RNA, 14 nt, Staphylococcus aureus subsp. aureus MW2
cuacuuuuucaaua

SEQ ID NO: 4013161 - RNA, 14 nt, Staphylococcus aureus subsp. aureus MW2
cuagaaaacauaaa

SEQ ID NO: 4013162 - RNA, 18 nt, Staphylococcus aureus subsp. aureus MW2
cuagaaaguaaugcuuua

SEQ ID NO: 4013163 - RNA, 16 nt, Staphylococcus aureus subsp. aureus MW2
cuagaacauugauuau

SEQ ID NO: 4013164 - RNA, 18 nt, Staphylococcus aureus subsp. aureus MW2
cuagaaguucuuaugcag

SEQ ID NO: 4013165 - RNA, 18 nt, Staphylococcus aureus subsp. aureus MW2
cuagacaaucaucuuaau

SEQ ID NO: 4013166 - RNA, 17 nt, Staphylococcus aureus subsp. aureus MW2
cuagagauaacuagaau

SEQ ID NO: 4013167 - RNA, 19 nt, Staphylococcus aureus subsp. aureus MW2
cuagagcguuuugcuuuag

SEQ ID NO: 4013168 - RNA, 20 nt, Staphylococcus aureus subsp. aureus MW2
cuagagcuaauucagcauau

SEQ ID NO: 4013169 - RNA, 22 nt, Staphylococcus aureus subsp. aureus MW2
cuagcaugcuuugagcaauaau

SEQ ID NO: 4013170 - RNA, 20 nt, Staphylococcus aureus subsp. aureus MW2
cuagcuuucuuuuucaucuu

SEQ ID NO: 4013171 - RNA, 18 nt, Staphylococcus aureus subsp. aureus MW2
cuaggaauauaaaacugu

SEQ ID NO: 4013172 - RNA, 17 nt, Staphylococcus aureus subsp. aureus MW2
cuaggauguucaucaac

SEQ ID NO: 4013173 - RNA, 17 nt, Staphylococcus aureus subsp. aureus MW2
cuaggauuaaaagcauc

SEQ ID NO: 4013174 - RNA, 19 nt, Staphylococcus aureus subsp. aureus MW2
cuagguacauaaauaccug

SEQ ID NO: 4013175 - RNA, 23 nt, Staphylococcus aureus subsp. aureus MW2
cuaguaaaucaaagaugacuugg

SEQ ID NO: 4013176 - RNA, 14 nt, Staphylococcus aureus subsp. aureus MW2
cuaguaauaauagg

SEQ ID NO: 4013177 - RNA, 16 nt, Staphylococcus aureus subsp. aureus MW2
cuaguaauucuucauc

SEQ ID NO: 4013178 - RNA, 18 nt, Staphylococcus aureus subsp. aureus MW2
cuaguagcuagaacagau

SEQ ID NO: 4013179 - RNA, 14 nt, Staphylococcus aureus subsp. aureus MW2
cuaguagcuugaau

SEQ ID NO: 4013180 - RNA, 21 nt, Staphylococcus aureus subsp. aureus MW2
cuaguauccuuuauaaauaaa

SEQ ID NO: 4013181 - RNA, 22 nt, Staphylococcus aureus subsp. aureus MW2
cuagucuuuaacuuuaauuaaa

SEQ ID NO: 4013182 - RNA, 18 nt, Staphylococcus aureus subsp. aureus MW2
cuaguguucucauuauaa

SEQ ID NO: 4013183 - RNA, 23 nt, Staphylococcus aureus subsp. aureus MW2
cuaguuacaaugcgguauugcau

SEQ ID NO: 4013184 - RNA, 15 nt, Staphylococcus aureus subsp. aureus MW2
cuaguucagcuucua

SEQ ID NO: 4013185 - RNA, 18 nt, Staphylococcus aureus subsp. aureus MW2
cuaguucagcuucuaagu

SEQ ID NO: 4013186 - RNA, 16 nt, Staphylococcus aureus subsp. aureus MW2
cuaguucgauuuuuua

SEQ ID NO: 4013187 - RNA, 12 nt, Staphylococcus aureus subsp. aureus MW2
cuaguuguuuua

SEQ ID NO: 4013188 - RNA, 16 nt, Staphylococcus aureus subsp. aureus MW2
cuaguuuguaauaauu

SEQ ID NO: 4013189 - RNA, 19 nt, Staphylococcus aureus subsp. aureus MW2
cuauaaaaguacuuuaaaa

SEQ ID NO: 4013190 - RNA, 14 nt, Staphylococcus aureus subsp. aureus MW2
cuauaaaauucacc

SEQ ID NO: 4013191 - RNA, 16 nt, Staphylococcus aureus subsp. aureus MW2
cuauaaaauucaccaa

SEQ ID NO: 4013192 - RNA, 11 nt, Staphylococcus aureus subsp. aureus MW2
cuauaaacaua

SEQ ID NO: 4013193 - RNA, 15 nt, Staphylococcus aureus subsp. aureus MW2
cuauaaauaaaaaua

SEQ ID NO: 4013194 - RNA, 17 nt, Staphylococcus aureus subsp. aureus MW2
cuauaaauacgucaucu

SEQ ID NO: 4013195 - RNA, 23 nt, Staphylococcus aureus subsp. aureus MW2
cuauaaauacgucaucuuuauuu

SEQ ID NO: 4013196 - RNA, 20 nt, Staphylococcus aureus subsp. aureus MW2
cuauaaauacuuuugcauca

SEQ ID NO: 4013197 - RNA, 14 nt, Staphylococcus aureus subsp. aureus MW2
cuauaaauaucaau

SEQ ID NO: 4013198 - RNA, 20 nt, Staphylococcus aureus subsp. aureus MW2
cuauaacgauagauuuuuuc

SEQ ID NO: 4013199 - RNA, 19 nt, Staphylococcus aureus subsp. aureus MW2
cuauaacucuaaauauaau

SEQ ID NO: 4013200 - RNA, 13 nt, Staphylococcus aureus subsp. aureus MW2
cuauaauaauuaa

SEQ ID NO: 4013201 - RNA, 23 nt, Staphylococcus aureus subsp. aureus MW2
cuauaauaauuggaaucaucuuu

SEQ ID NO: 4013202 - RNA, 17 nt, Staphylococcus aureus subsp. aureus MW2
cuauaaucauuaaguaa

SEQ ID NO: 4013203 - RNA, 20 nt, Staphylococcus aureus subsp. aureus MW2
cuauaauuggcagauagaau

SEQ ID NO: 4013204 - RNA, 17 nt, Staphylococcus aureus subsp. aureus MW2
cuauaauuucuuaauua

SEQ ID NO: 4013205 - RNA, 21 nt, Staphylococcus aureus subsp. aureus MW2
cuauacaauuauggauaaaau

SEQ ID NO: 4013206 - RNA, 22 nt, Staphylococcus aureus subsp. aureus MW2
cuauacaauuauggauaaaauu

SEQ ID NO: 4013207 - RNA, 17 nt, Staphylococcus aureus subsp. aureus MW2
cuauaccauuccaaaaa

SEQ ID NO: 4013208 - RNA, 21 nt, Staphylococcus aureus subsp. aureus MW2
cuauaccauuccaaaaauugu

SEQ ID NO: 4013209 - RNA, 23 nt, Staphylococcus aureus subsp. aureus MW2
cuauagcacugaaaucuagaccu

SEQ ID NO: 4013210 - RNA, 21 nt, Staphylococcus aureus subsp. aureus MW2
cuauagccaaaggcaaaaugu

SEQ ID NO: 4013211 - RNA, 14 nt, Staphylococcus aureus subsp. aureus MW2
cuauaguaagaaaa

SEQ ID NO: 4013212 - RNA, 16 nt, Staphylococcus aureus subsp. aureus MW2
cuauagucauucauaa

SEQ ID NO: 4013213 - RNA, 13 nt, Staphylococcus aureus subsp. aureus MW2
cuauauaaaaacu

SEQ ID NO: 4013214 - RNA, 14 nt, Staphylococcus aureus subsp. aureus MW2
cuauauaaaguuga

SEQ ID NO: 4013215 - RNA, 14 nt, Staphylococcus aureus subsp. aureus MW2
cuauauaauaauua

SEQ ID NO: 4013216 - RNA, 18 nt, Staphylococcus aureus subsp. aureus MW2
cuauauaaugauuuaauu

SEQ ID NO: 4013217 - RNA, 13 nt, Staphylococcus aureus subsp. aureus MW2
cuauauaauuuau

SEQ ID NO: 4013218 - RNA, 18 nt, Staphylococcus aureus subsp. aureus MW2
cuauauaauuuauaaaaa

SEQ ID NO: 4013219 - RNA, 14 nt, Staphylococcus aureus subsp. aureus MW2
cuauauaguaaaau

SEQ ID NO: 4013220 - RNA, 18 nt, Staphylococcus aureus subsp. aureus MW2
cuauauaguaaaauaaau

SEQ ID NO: 4013221 - RNA, 16 nt, Staphylococcus aureus subsp. aureus MW2
cuauauauaugcaucc

SEQ ID NO: 4013222 - RNA, 16 nt, Staphylococcus aureus subsp. aureus MW2
cuauauauauuuaaau

SEQ ID NO: 4013223 - RNA, 19 nt, Staphylococcus aureus subsp. aureus MW2
cuauauauauuuaaaucaa

SEQ ID NO: 4013224 - RNA, 13 nt, Staphylococcus aureus subsp. aureus MW2
cuauaugaaaaga

SEQ ID NO: 4013225 - RNA, 23 nt, Staphylococcus aureus subsp. aureus MW2
cuauaugaaauguucccuucaaa

SEQ ID NO: 4013226 - RNA, 11 nt, Staphylococcus aureus subsp. aureus MW2
cuauaugcaua

SEQ ID NO: 4013227 - RNA, 21 nt, Staphylococcus aureus subsp. aureus MW2
cuauauuaguagaaaccuuaa

SEQ ID NO: 4013228 - RNA, 18 nt, Staphylococcus aureus subsp. aureus MW2
cuauauuuuuguauuuau

SEQ ID NO: 4013229 - RNA, 12 nt, Staphylococcus aureus subsp. aureus MW2
cuaucaaauaau

SEQ ID NO: 4013230 - RNA, 15 nt, Staphylococcus aureus subsp. aureus MW2
cuaucaaauuacuua

SEQ ID NO: 4013231 - RNA, 13 nt, Staphylococcus aureus subsp. aureus MW2
cuaucaauauaau

SEQ ID NO: 4013232 - RNA, 17 nt, Staphylococcus aureus subsp. aureus MW2
cuaucgccuaaaaauaa

SEQ ID NO: 4013233 - RNA, 18 nt, Staphylococcus aureus subsp. aureus MW2
cuaucgccuaaaaauaaa

SEQ ID NO: 4013234 - RNA, 17 nt, Staphylococcus aureus subsp. aureus MW2
cuaucgucgcuaauaaa

SEQ ID NO: 4013235 - RNA, 12 nt, Staphylococcus aureus subsp. aureus MW2
cuaucuauuuua

SEQ ID NO: 4013236 - RNA, 24 nt, Staphylococcus aureus subsp. aureus MW2
cuaucuccgcuacaauuauaugua

SEQ ID NO: 4013237 - RNA, 21 nt, Staphylococcus aureus subsp. aureus MW2
cuaucuguaccguauuuuaau

SEQ ID NO: 4013238 - RNA, 14 nt, Staphylococcus aureus subsp. aureus MW2
cuaucuucagauuc

SEQ ID NO: 4013239 - RNA, 13 nt, Staphylococcus aureus subsp. aureus MW2
cuaucuucaucau

SEQ ID NO: 4013240 - RNA, 23 nt, Staphylococcus aureus subsp. aureus MW2
cuaugaauuuagcaucaaaaaua

SEQ ID NO: 4013241 - RNA, 11 nt, Staphylococcus aureus subsp. aureus MW2
cuaugauauau

SEQ ID NO: 4013242 - RNA, 21 nt, Staphylococcus aureus subsp. aureus MW2
cuaugauauauguaacauaaa

SEQ ID NO: 4013243 - RNA, 20 nt, Staphylococcus aureus subsp. aureus MW2
cuaugauaugugaaaaagcu

SEQ ID NO: 4013244 - RNA, 20 nt, Staphylococcus aureus subsp. aureus MW2
cuaugauuaaagcuuaagug

SEQ ID NO: 4013245 - RNA, 20 nt, Staphylococcus aureus subsp. aureus MW2
cuaugauuugauauuucaaa

SEQ ID NO: 4013246 - RNA, 21 nt, Staphylococcus aureus subsp. aureus MW2
cuaugauuugauauuucaaau

SEQ ID NO: 4013247 - RNA, 16 nt, Staphylococcus aureus subsp. aureus MW2
cuaugcauaauaccaa

SEQ ID NO: 4013248 - RNA, 14 nt, Staphylococcus aureus subsp. aureus MW2
cuaugguuauggug

SEQ ID NO: 4013249 - RNA, 15 nt, Staphylococcus aureus subsp. aureus MW2
cuauguacaaucauu

SEQ ID NO: 4013250 - RNA, 13 nt, Staphylococcus aureus subsp. aureus MW2
cuauguauaauac

SEQ ID NO: 4013251 - RNA, 12 nt, Staphylococcus aureus subsp. aureus MW2
cuauguggcuac

SEQ ID NO: 4013252 - RNA, 22 nt, Staphylococcus aureus subsp. aureus MW2
cuauuaaacuuccuuuuuuuau

SEQ ID NO: 4013253 - RNA, 21 nt, Staphylococcus aureus subsp. aureus MW2
cuauuaaaggaaaucaaucca

SEQ ID NO: 4013254 - RNA, 12 nt, Staphylococcus aureus subsp. aureus MW2
cuauuaaaucau

SEQ ID NO: 4013255 - RNA, 20 nt, Staphylococcus aureus subsp. aureus MW2
cuauuaacugaccuaacaau

SEQ ID NO: 4013256 - RNA, 16 nt, Staphylococcus aureus subsp. aureus MW2
cuauuaauagcaccau

SEQ ID NO: 4013257 - RNA, 13 nt, Staphylococcus aureus subsp. aureus MW2
cuauuaauauaua

SEQ ID NO: 4013258 - RNA, 19 nt, Staphylococcus aureus subsp. aureus MW2
cuauuaauuacgucauaaa

SEQ ID NO: 4013259 - RNA, 16 nt, Staphylococcus aureus subsp. aureus MW2
cuauuaauuuucucaa

SEQ ID NO: 4013260 - RNA, 15 nt, Staphylococcus aureus subsp. aureus MW2
cuauuacuauaaaaa

SEQ ID NO: 4013261 - RNA, 20 nt, Staphylococcus aureus subsp. aureus MW2
cuauuagauacauauaagaa

SEQ ID NO: 4013262 - RNA, 18 nt, Staphylococcus aureus subsp. aureus MW2
cuauuaggauccaauuua

SEQ ID NO: 4013263 - RNA, 22 nt, Staphylococcus aureus subsp. aureus MW2
cuauuaggauccaauuuauaau

SEQ ID NO: 4013264 - RNA, 21 nt, Staphylococcus aureus subsp. aureus MW2
cuauuagggggcauauuaaua

SEQ ID NO: 4013265 - RNA, 23 nt, Staphylococcus aureus subsp. aureus MW2
cuauuauguaccaaauuuauaau

SEQ ID NO: 4013266 - RNA, 14 nt, Staphylococcus aureus subsp. aureus MW2
cuauucaaauauaa

SEQ ID NO: 4013267 - RNA, 20 nt, Staphylococcus aureus subsp. aureus MW2
cuauucaaauauaaauaaaa

SEQ ID NO: 4013268 - RNA, 20 nt, Staphylococcus aureus subsp. aureus MW2
cuauuccuauuacuacauaa

SEQ ID NO: 4013269 - RNA, 23 nt, Staphylococcus aureus subsp. aureus MW2
cuauucguuugaauuauuuaauu

SEQ ID NO: 4013270 - RNA, 21 nt, Staphylococcus aureus subsp. aureus MW2
cuauugauauucuaaaaaauu

SEQ ID NO: 4013271 - RNA, 23 nt, Staphylococcus aureus subsp. aureus MW2
cuauugauauucuaaaaaauuaa

SEQ ID NO: 4013272 - RNA, 17 nt, Staphylococcus aureus subsp. aureus MW2
cuauugcuauauuagua

SEQ ID NO: 4013273 - RNA, 19 nt, Staphylococcus aureus subsp. aureus MW2
cuauugugauauaugaaau

SEQ ID NO: 4013274 - RNA, 16 nt, Staphylococcus aureus subsp. aureus MW2
cuauuuaaaagacaau

SEQ ID NO: 4013275 - RNA, 14 nt, Staphylococcus aureus subsp. aureus MW2
cuauuuauaacacu

SEQ ID NO: 4013276 - RNA, 17 nt, Staphylococcus aureus subsp. aureus MW2
cuauuucacucuacaau

SEQ ID NO: 4013277 - RNA, 22 nt, Staphylococcus aureus subsp. aureus MW2
cuauuugcugaaugaagcauuu

SEQ ID NO: 4013278 - RNA, 18 nt, Staphylococcus aureus subsp. aureus MW2
cuauuuuacucuuuuuaa

SEQ ID NO: 4013279 - RNA, 16 nt, Staphylococcus aureus subsp. aureus MW2
cuauuuuauacauaaa

SEQ ID NO: 4013280 - RNA, 14 nt, Staphylococcus aureus subsp. aureus MW2
cuauuuuccaucac

SEQ ID NO: 4013281 - RNA, 21 nt, Staphylococcus aureus subsp. aureus MW2
cuauuuuccaucacauaacua

SEQ ID NO: 4013282 - RNA, 11 nt, Staphylococcus aureus subsp. aureus MW2
cuauuuuuaau

SEQ ID NO: 4013283 - RNA, 12 nt, Staphylococcus aureus subsp. aureus MW2
cuauuuuuuaga

SEQ ID NO: 4013284 - RNA, 19 nt, Staphylococcus aureus subsp. aureus MW2
cuauuuuuuauguuuuaau

SEQ ID NO: 4013285 - RNA, 13 nt, Staphylococcus aureus subsp. aureus MW2
cuauuuuuuuaug

SEQ ID NO: 4013286 - RNA, 14 nt, Staphylococcus aureus subsp. aureus MW2
cucaaaacaauuua

SEQ ID NO: 4013287 - RNA, 20 nt, Staphylococcus aureus subsp. aureus MW2
cucaaaagcuguaguuucaa

SEQ ID NO: 4013288 - RNA, 18 nt, Staphylococcus aureus subsp. aureus MW2
cucaaagguuuacuauua

SEQ ID NO: 4013289 - RNA, 19 nt, Staphylococcus aureus subsp. aureus MW2
cucaaagguuuacuauuaa

SEQ ID NO: 4013290 - RNA, 17 nt, Staphylococcus aureus subsp. aureus MW2
cucaaauauuaauuuau

SEQ ID NO: 4013291 - RNA, 16 nt, Staphylococcus aureus subsp. aureus MW2
cucaaauuagauaaaa

SEQ ID NO: 4013292 - RNA, 17 nt, Staphylococcus aureus subsp. aureus MW2
cucaacauuaaaaugug

SEQ ID NO: 4013293 - RNA, 12 nt, Staphylococcus aureus subsp. aureus MW2
cucaacauuuug

SEQ ID NO: 4013294 - RNA, 19 nt, Staphylococcus aureus subsp. aureus MW2
cucaacugaugaaaagguu

SEQ ID NO: 4013295 - RNA, 15 nt, Staphylococcus aureus subsp. aureus MW2
cucaacuuaaauauc

SEQ ID NO: 4013296 - RNA, 16 nt, Staphylococcus aureus subsp. aureus MW2
cucaagugauuuccca

SEQ ID NO: 4013297 - RNA, 23 nt, Staphylococcus aureus subsp. aureus MW2
cucaagugauuucccacgugccu

SEQ ID NO: 4013298 - RNA, 23 nt, Staphylococcus aureus subsp. aureus MW2
cucaauccugauuccacuacaau

SEQ ID NO: 4013299 - RNA, 22 nt, Staphylococcus aureus subsp. aureus MW2
cucaaugauuguaauaucuaaa

SEQ ID NO: 4013300 - RNA, 12 nt, Staphylococcus aureus subsp. aureus MW2
cucaauucucua

SEQ ID NO: 4013301 - RNA, 18 nt, Staphylococcus aureus subsp. aureus MW2
cucaauucucuaacuuua

SEQ ID NO: 4013302 - RNA, 19 nt, Staphylococcus aureus subsp. aureus MW2
cucaauuuaguauaaauaa

SEQ ID NO: 4013303 - RNA, 21 nt, Staphylococcus aureus subsp. aureus MW2
cucaauuuaguauaaauaaaa

SEQ ID NO: 4013304 - RNA, 23 nt, Staphylococcus aureus subsp. aureus MW2
cucaauuuaguauaaauaaaaau

SEQ ID NO: 4013305 - RNA, 13 nt, Staphylococcus aureus subsp. aureus MW2
cucacaugugaaa

SEQ ID NO: 4013306 - RNA, 13 nt, Staphylococcus aureus subsp. aureus MW2
cucaccaaguuca

SEQ ID NO: 4013307 - RNA, 15 nt, Staphylococcus aureus subsp. aureus MW2
cucaccuuuaucauu

SEQ ID NO: 4013308 - RNA, 19 nt, Staphylococcus aureus subsp. aureus MW2
cucacuuguccuaaguuau

SEQ ID NO: 4013309 - RNA, 19 nt, Staphylococcus aureus subsp. aureus MW2
cucagauucauaucuuuca

SEQ ID NO: 4013310 - RNA, 14 nt, Staphylococcus aureus subsp. aureus MW2
cucagcguauuuua

SEQ ID NO: 4013311 - RNA, 13 nt, Staphylococcus aureus subsp. aureus MW2
cucaguaaauuua

SEQ ID NO: 4013312 - RNA, 17 nt, Staphylococcus aureus subsp. aureus MW2
cucaguauuuaauguuu

SEQ ID NO: 4013313 - RNA, 21 nt, Staphylococcus aureus subsp. aureus MW2
cucagucucuuugaaggguuu

SEQ ID NO: 4013314 - RNA, 15 nt, Staphylococcus aureus subsp. aureus MW2
cucagugcauuuuuu

SEQ ID NO: 4013315 - RNA, 17 nt, Staphylococcus aureus subsp. aureus MW2
cucagugcauuuuuuau

SEQ ID NO: 4013316 - RNA, 17 nt, Staphylococcus aureus subsp. aureus MW2
cucauaaaauacgcaaa

SEQ ID NO: 4013317 - RNA, 22 nt, Staphylococcus aureus subsp. aureus MW2
cucauaauuuucuauuauuuua

SEQ ID NO: 4013318 - RNA, 14 nt, Staphylococcus aureus subsp. aureus MW2
cucauacaaauuuu

SEQ ID NO: 4013319 - RNA, 15 nt, Staphylococcus aureus subsp. aureus MW2
cucauagucaucuua

SEQ ID NO: 4013320 - RNA, 22 nt, Staphylococcus aureus subsp. aureus MW2
cucauccauugaucuuuuauaa

SEQ ID NO: 4013321 - RNA, 20 nt, Staphylococcus aureus subsp. aureus MW2
cucaucgaguuuguuucuaa

SEQ ID NO: 4013322 - RNA, 17 nt, Staphylococcus aureus subsp. aureus MW2
cucaucuacuauuuaau

SEQ ID NO: 4013323 - RNA, 22 nt, Staphylococcus aureus subsp. aureus MW2
cucaucuauuuaauaauguauc

SEQ ID NO: 4013324 - RNA, 17 nt, Staphylococcus aureus subsp. aureus MW2
cucaucuucuaaaucaa

SEQ ID NO: 4013325 - RNA, 18 nt, Staphylococcus aureus subsp. aureus MW2
cucaugagcacaaacuaa

SEQ ID NO: 4013326 - RNA, 14 nt, Staphylococcus aureus subsp. aureus MW2
cucaugcacuuuau

SEQ ID NO: 4013327 - RNA, 19 nt, Staphylococcus aureus subsp. aureus MW2
cucaugcugaaauguagac

SEQ ID NO: 4013328 - RNA, 16 nt, Staphylococcus aureus subsp. aureus MW2
cucauguuucaguaua

SEQ ID NO: 4013329 - RNA, 16 nt, Staphylococcus aureus subsp. aureus MW2
cucauuaaccuuacau

SEQ ID NO: 4013330 - RNA, 14 nt, Staphylococcus aureus subsp. aureus MW2
cucauuagcgcaag

SEQ ID NO: 4013331 - RNA, 14 nt, Staphylococcus aureus subsp. aureus MW2
cucauuauaaugau

SEQ ID NO: 4013332 - RNA, 20 nt, Staphylococcus aureus subsp. aureus MW2
cucauuauaaugauuuuuau

SEQ ID NO: 4013333 - RNA, 13 nt, Staphylococcus aureus subsp. aureus MW2
cucauuauuguug

SEQ ID NO: 4013334 - RNA, 16 nt, Staphylococcus aureus subsp. aureus MW2
cucauugugcuugaua

SEQ ID NO: 4013335 - RNA, 21 nt, Staphylococcus aureus subsp. aureus MW2
cucauuuguauagauuguauu

SEQ ID NO: 4013336 - RNA, 21 nt, Staphylococcus aureus subsp. aureus MW2
cucauuuucuacgaauacuaa

SEQ ID NO: 4013337 - RNA, 14 nt, Staphylococcus aureus subsp. aureus MW2
cucauuuuuuuaau

SEQ ID NO: 4013338 - RNA, 17 nt, Staphylococcus aureus subsp. aureus MW2
cuccaaaaauaauuaaa

SEQ ID NO: 4013339 - RNA, 12 nt, Staphylococcus aureus subsp. aureus MW2
cuccaaacauag

SEQ ID NO: 4013340 - RNA, 17 nt, Staphylococcus aureus subsp. aureus MW2
cuccaacucuaacagcu

SEQ ID NO: 4013341 - RNA, 13 nt, Staphylococcus aureus subsp. aureus MW2
cuccaacuuuaaa

SEQ ID NO: 4013342 - RNA, 20 nt, Staphylococcus aureus subsp. aureus MW2
cuccaagauuaugacaacau

SEQ ID NO: 4013343 - RNA, 22 nt, Staphylococcus aureus subsp. aureus MW2
cuccaagauuaugacaacauaa

SEQ ID NO: 4013344 - RNA, 19 nt, Staphylococcus aureus subsp. aureus MW2
cuccaauacuuuuuauaua

SEQ ID NO: 4013345 - RNA, 15 nt, Staphylococcus aureus subsp. aureus MW2
cuccaaucaucauua

SEQ ID NO: 4013346 - RNA, 18 nt, Staphylococcus aureus subsp. aureus MW2
cuccauggcuuaaaucaa

SEQ ID NO: 4013347 - RNA, 16 nt, Staphylococcus aureus subsp. aureus MW2
cuccauuagcuaauuc

SEQ ID NO: 4013348 - RNA, 13 nt, Staphylococcus aureus subsp. aureus MW2
cuccauuauaaag

SEQ ID NO: 4013349 - RNA, 20 nt, Staphylococcus aureus subsp. aureus MW2
cuccauuauaaagccugcaa

SEQ ID NO: 4013350 - RNA, 14 nt, Staphylococcus aureus subsp. aureus MW2
cucccauccccuuu

SEQ ID NO: 4013351 - RNA, 14 nt, Staphylococcus aureus subsp. aureus MW2
cuccccaacuuaau

SEQ ID NO: 4013352 - RNA, 18 nt, Staphylococcus aureus subsp. aureus MW2
cucccuuaaauacaauuu

SEQ ID NO: 4013353 - RNA, 22 nt, Staphylococcus aureus subsp. aureus MW2
cucccuuaaauacaauuucuuc

SEQ ID NO: 4013354 - RNA, 19 nt, Staphylococcus aureus subsp. aureus MW2
cuccguauuuaccuucuuc

SEQ ID NO: 4013355 - RNA, 17 nt, Staphylococcus aureus subsp. aureus MW2
cuccuaaagcugcaauu

SEQ ID NO: 4013356 - RNA, 18 nt, Staphylococcus aureus subsp. aureus MW2
cuccuaaagcugcaauua

SEQ ID NO: 4013357 - RNA, 22 nt, Staphylococcus aureus subsp. aureus MW2
cuccuaaagguaacuuuuuaac

SEQ ID NO: 4013358 - RNA, 14 nt, Staphylococcus aureus subsp. aureus MW2
cuccuacuccauag

SEQ ID NO: 4013359 - RNA, 18 nt, Staphylococcus aureus subsp. aureus MW2
cuccuauuaauauauaua

SEQ ID NO: 4013360 - RNA, 13 nt, Staphylococcus aureus subsp. aureus MW2
cuccucuauuuua

SEQ ID NO: 4013361 - RNA, 23 nt, Staphylococcus aureus subsp. aureus MW2
cuccucuauuuuaugauuugauu

SEQ ID NO: 4013362 - RNA, 15 nt, Staphylococcus aureus subsp. aureus MW2
cuccuggauuuuuug

SEQ ID NO: 4013363 - RNA, 12 nt, Staphylococcus aureus subsp. aureus MW2
cuccuuacaaua

SEQ ID NO: 4013364 - RNA, 13 nt, Staphylococcus aureus subsp. aureus MW2
cuccuuacaauaa

SEQ ID NO: 4013365 - RNA, 13 nt, Staphylococcus aureus subsp. aureus MW2
cucgaaaccagcu

SEQ ID NO: 4013366 - RNA, 15 nt, Staphylococcus aureus subsp. aureus MW2
cucgaagucagcgau

SEQ ID NO: 4013367 - RNA, 14 nt, Staphylococcus aureus subsp. aureus MW2
cucgaccuuuauau

SEQ ID NO: 4013368 - RNA, 20 nt, Staphylococcus aureus subsp. aureus MW2
cucgacuugguauuuauccu

SEQ ID NO: 4013369 - RNA, 18 nt, Staphylococcus aureus subsp. aureus MW2
cucgauuuuuuuauauuu

SEQ ID NO: 4013370 - RNA, 19 nt, Staphylococcus aureus subsp. aureus MW2
cucgauuuuuuuauauuuu

SEQ ID NO: 4013371 - RNA, 17 nt, Staphylococcus aureus subsp. aureus MW2
cucgcauacugucaucu

SEQ ID NO: 4013372 - RNA, 19 nt, Staphylococcus aureus subsp. aureus MW2
cucgguacuucgcccuucc

SEQ ID NO: 4013373 - RNA, 12 nt, Staphylococcus aureus subsp. aureus MW2
cucgguuuuuuc

SEQ ID NO: 4013374 - RNA, 23 nt, Staphylococcus aureus subsp. aureus MW2
cucgguuuuuucgguuuauuuaa

SEQ ID NO: 4013375 - RNA, 18 nt, Staphylococcus aureus subsp. aureus MW2
cucguaaauuuuaucuaa

SEQ ID NO: 4013376 - RNA, 12 nt, Staphylococcus aureus subsp. aureus MW2
cucguaauaaug

SEQ ID NO: 4013377 - RNA, 14 nt, Staphylococcus aureus subsp. aureus MW2
cucgugaaaagcag

SEQ ID NO: 4013378 - RNA, 18 nt, Staphylococcus aureus subsp. aureus MW2
cucuaaaacgauuaauag

SEQ ID NO: 4013379 - RNA, 17 nt, Staphylococcus aureus subsp. aureus MW2
cucuaaaagccaucuua

SEQ ID NO: 4013380 - RNA, 20 nt, Staphylococcus aureus subsp. aureus MW2
cucuaaagguaccacuguau

SEQ ID NO: 4013381 - RNA, 16 nt, Staphylococcus aureus subsp. aureus MW2
cucuaaauauaauaga

SEQ ID NO: 4013382 - RNA, 23 nt, Staphylococcus aureus subsp. aureus MW2
cucuaacuuuaccaauaucaugc

SEQ ID NO: 4013383 - RNA, 15 nt, Staphylococcus aureus subsp. aureus MW2
cucuaaguucaccua

SEQ ID NO: 4013384 - RNA, 15 nt, Staphylococcus aureus subsp. aureus MW2
cucuagugcuuuguc

SEQ ID NO: 4013385 - RNA, 19 nt, Staphylococcus aureus subsp. aureus MW2
cucuaucaaauuaccauuc

SEQ ID NO: 4013386 - RNA, 17 nt, Staphylococcus aureus subsp. aureus MW2
cucuaucaguccgcuuu

SEQ ID NO: 4013387 - RNA, 22 nt, Staphylococcus aureus subsp. aureus MW2
cucuaugcuuuuauagauuuua

SEQ ID NO: 4013388 - RNA, 17 nt, Staphylococcus aureus subsp. aureus MW2
cucuauuuauaacacuu

SEQ ID NO: 4013389 - RNA, 17 nt, Staphylococcus aureus subsp. aureus MW2
cucuauuuuuuauguuu

SEQ ID NO: 4013390 - RNA, 16 nt, Staphylococcus aureus subsp. aureus MW2
cucucaacauuuugau

SEQ ID NO: 4013391 - RNA, 17 nt, Staphylococcus aureus subsp. aureus MW2
cucugaaaaacuucuua

SEQ ID NO: 4013392 - RNA, 19 nt, Staphylococcus aureus subsp. aureus MW2
cucugauacuucaccaucu

SEQ ID NO: 4013393 - RNA, 12 nt, Staphylococcus aureus subsp. aureus MW2
cucugaucuaaa

SEQ ID NO: 4013394 - RNA, 22 nt, Staphylococcus aureus subsp. aureus MW2
cucugcgauuucuaaagcgauu

SEQ ID NO: 4013395 - RNA, 15 nt, Staphylococcus aureus subsp. aureus MW2
cucuggaacuuuaau

SEQ ID NO: 4013396 - RNA, 15 nt, Staphylococcus aureus subsp. aureus MW2
cucuggauuuuucuu

SEQ ID NO: 4013397 - RNA, 22 nt, Staphylococcus aureus subsp. aureus MW2
cucuggauuuuucuuauaaaaa

SEQ ID NO: 4013398 - RNA, 16 nt, Staphylococcus aureus subsp. aureus MW2
cucuguguuggggccc

SEQ ID NO: 4013399 - RNA, 14 nt, Staphylococcus aureus subsp. aureus MW2
cucuguuuaacagg

SEQ ID NO: 4013400 - RNA, 21 nt, Staphylococcus aureus subsp. aureus MW2
cucuuaaucuauaaauuauuu

SEQ ID NO: 4013401 - RNA, 21 nt, Staphylococcus aureus subsp. aureus MW2
cucuuauaaagacaccuucaa

SEQ ID NO: 4013402 - RNA, 23 nt, Staphylococcus aureus subsp. aureus MW2
cucuucaguacgaacaacuaaca

SEQ ID NO: 4013403 - RNA, 19 nt, Staphylococcus aureus subsp. aureus MW2
cucuuccuccgccaucaau

SEQ ID NO: 4013404 - RNA, 14 nt, Staphylococcus aureus subsp. aureus MW2
cucuugcaauagca

SEQ ID NO: 4013405 - RNA, 14 nt, Staphylococcus aureus subsp. aureus MW2
cucuugcuaaagug

SEQ ID NO: 4013406 - RNA, 20 nt, Staphylococcus aureus subsp. aureus MW2
cucuuguucaaguaaucauu

SEQ ID NO: 4013407 - RNA, 22 nt, Staphylococcus aureus subsp. aureus MW2
cucuuuaaacucguaaauuuua

SEQ ID NO: 4013408 - RNA, 18 nt, Staphylococcus aureus subsp. aureus MW2
cucuuuacggauugcugc

SEQ ID NO: 4013409 - RNA, 19 nt, Staphylococcus aureus subsp. aureus MW2
cucuuuacggauugcugcc

SEQ ID NO: 4013410 - RNA, 20 nt, Staphylococcus aureus subsp. aureus MW2
cucuuuacggucgaauuuuu

SEQ ID NO: 4013411 - RNA, 22 nt, Staphylococcus aureus subsp. aureus MW2
cucuuuacggucgaauuuuuuu

SEQ ID NO: 4013412 - RNA, 14 nt, Staphylococcus aureus subsp. aureus MW2
cucuuuccacagcu

SEQ ID NO: 4013413 - RNA, 21 nt, Staphylococcus aureus subsp. aureus MW2
cucuuugaaggguuuuuuuau

SEQ ID NO: 4013414 - RNA, 18 nt, Staphylococcus aureus subsp. aureus MW2
cucuuuuuaauauuuuuu

SEQ ID NO: 4013415 - RNA, 19 nt, Staphylococcus aureus subsp. aureus MW2
cucuuuuuaauauuuuuuu

SEQ ID NO: 4013416 - RNA, 17 nt, Staphylococcus aureus subsp. aureus MW2
cucuuuuucccaugcuu

SEQ ID NO: 4013417 - RNA, 13 nt, Staphylococcus aureus subsp. aureus MW2
cugaaaaacuucu

SEQ ID NO: 4013418 - RNA, 15 nt, Staphylococcus aureus subsp. aureus MW2
cugaaaaacuucuua

SEQ ID NO: 4013419 - RNA, 16 nt, Staphylococcus aureus subsp. aureus MW2
cugaaaacuuaauaga

SEQ ID NO: 4013420 - RNA, 16 nt, Staphylococcus aureus subsp. aureus MW2
cugaaaagccuacuuu

SEQ ID NO: 4013421 - RNA, 15 nt, Staphylococcus aureus subsp. aureus MW2
cugaaacauuuauaa

SEQ ID NO: 4013422 - RNA, 18 nt, Staphylococcus aureus subsp. aureus MW2
cugaaacauuuauaaauc

SEQ ID NO: 4013423 - RNA, 21 nt, Staphylococcus aureus subsp. aureus MW2
cugaaacauuuauaaaucuuu

SEQ ID NO: 4013424 - RNA, 20 nt, Staphylococcus aureus subsp. aureus MW2
cugaaacuaaguuuaaugau

SEQ ID NO: 4013425 - RNA, 17 nt, Staphylococcus aureus subsp. aureus MW2
cugaaacuuuaauacua

SEQ ID NO: 4013426 - RNA, 16 nt, Staphylococcus aureus subsp. aureus MW2
cugaaauagcuuuuuc

SEQ ID NO: 4013427 - RNA, 18 nt, Staphylococcus aureus subsp. aureus MW2
cugaaaucaguuuuugaa

SEQ ID NO: 4013428 - RNA, 16 nt, Staphylococcus aureus subsp. aureus MW2
cugaaaucuagaccuu

SEQ ID NO: 4013429 - RNA, 18 nt, Staphylococcus aureus subsp. aureus MW2
cugaaaucuagaccuuca

SEQ ID NO: 4013430 - RNA, 22 nt, Staphylococcus aureus subsp. aureus MW2
cugaaauuucauaaaguuuauu

SEQ ID NO: 4013431 - RNA, 17 nt, Staphylococcus aureus subsp. aureus MW2
cugaagcgcuuggauuu

SEQ ID NO: 4013432 - RNA, 18 nt, Staphylococcus aureus subsp. aureus MW2
cugaagguaauuuaacau

SEQ ID NO: 4013433 - RNA, 21 nt, Staphylococcus aureus subsp. aureus MW2
cugaauaaauaacuucguuuu

SEQ ID NO: 4013434 - RNA, 18 nt, Staphylococcus aureus subsp. aureus MW2
cugaaucaggaauguuug

SEQ ID NO: 4013435 - RNA, 20 nt, Staphylococcus aureus subsp. aureus MW2
cugaaucugcuaauuuauaa

SEQ ID NO: 4013436 - RNA, 20 nt, Staphylococcus aureus subsp. aureus MW2
cugaaugaagcauuuuauuu

SEQ ID NO: 4013437 - RNA, 17 nt, Staphylococcus aureus subsp. aureus MW2
cugaaugcuaauacuaa

SEQ ID NO: 4013438 - RNA, 21 nt, Staphylococcus aureus subsp. aureus MW2
cugaaugcucaucuucuaauu

SEQ ID NO: 4013439 - RNA, 23 nt, Staphylococcus aureus subsp. aureus MW2
cugaauguucgaagauuuuuuuc

SEQ ID NO: 4013440 - RNA, 16 nt, Staphylococcus aureus subsp. aureus MW2
cugacaaaccaauuuu

SEQ ID NO: 4013441 - RNA, 21 nt, Staphylococcus aureus subsp. aureus MW2
cugacauuguugcuaaucuca

SEQ ID NO: 4013442 - RNA, 18 nt, Staphylococcus aureus subsp. aureus MW2
cugaccuaacaauuugag

SEQ ID NO: 4013443 - RNA, 12 nt, Staphylococcus aureus subsp. aureus MW2
cugacuaacauu

SEQ ID NO: 4013444 - RNA, 21 nt, Staphylococcus aureus subsp. aureus MW2
cugacuuuccgccagcuucua

SEQ ID NO: 4013445 - RNA, 19 nt, Staphylococcus aureus subsp. aureus MW2
cugacuuuuaaaaaacaua

SEQ ID NO: 4013446 - RNA, 18 nt, Staphylococcus aureus subsp. aureus MW2
cugagaaaaauauuucua

SEQ ID NO: 4013447 - RNA, 23 nt, Staphylococcus aureus subsp. aureus MW2
cugagcaacaaaagauguugcua

SEQ ID NO: 4013448 - RNA, 21 nt, Staphylococcus aureus subsp. aureus MW2
cugaguauuguuauugaugau

SEQ ID NO: 4013449 - RNA, 13 nt, Staphylococcus aureus subsp. aureus MW2
cugaguucaauua

SEQ ID NO: 4013450 - RNA, 18 nt, Staphylococcus aureus subsp. aureus MW2
cugaguucaauuaaauua

SEQ ID NO: 4013451 - RNA, 20 nt, Staphylococcus aureus subsp. aureus MW2
cugauaacaaccuauuaauu

SEQ ID NO: 4013452 - RNA, 22 nt, Staphylococcus aureus subsp. aureus MW2
cugauaauuuuucuucuuuuuu

SEQ ID NO: 4013453 - RNA, 20 nt, Staphylococcus aureus subsp. aureus MW2
cugauacacguacaaaauaa

SEQ ID NO: 4013454 - RNA, 17 nt, Staphylococcus aureus subsp. aureus MW2
cugauacagaaccaaca

SEQ ID NO: 4013455 - RNA, 22 nt, Staphylococcus aureus subsp. aureus MW2
cugauacagaaccaacaauaaa

SEQ ID NO: 4013456 - RNA, 22 nt, Staphylococcus aureus subsp. aureus MW2
cugauauugaucugauuucacu

SEQ ID NO: 4013457 - RNA, 14 nt, Staphylococcus aureus subsp. aureus MW2
cugaucguaacauu

SEQ ID NO: 4013458 - RNA, 18 nt, Staphylococcus aureus subsp. aureus MW2
cugaugaacauaccugca

SEQ ID NO: 4013459 - RNA, 23 nt, Staphylococcus aureus subsp. aureus MW2
cugaugcuagcuuucuuuuucau

SEQ ID NO: 4013460 - RNA, 22 nt, Staphylococcus aureus subsp. aureus MW2
cugauguaccacucauaaucaa

SEQ ID NO: 4013461 - RNA, 17 nt, Staphylococcus aureus subsp. aureus MW2
cugaugugacaaaguuu

SEQ ID NO: 4013462 - RNA, 16 nt, Staphylococcus aureus subsp. aureus MW2
cugauuaauuauugag

SEQ ID NO: 4013463 - RNA, 18 nt, Staphylococcus aureus subsp. aureus MW2
cugauuauguucagaacu

SEQ ID NO: 4013464 - RNA, 13 nt, Staphylococcus aureus subsp. aureus MW2
cugauucauuaaa

SEQ ID NO: 4013465 - RNA, 18 nt, Staphylococcus aureus subsp. aureus MW2
cugauuguucauguuuaa

SEQ ID NO: 4013466 - RNA, 17 nt, Staphylococcus aureus subsp. aureus MW2
cugauuucuauuaauua

SEQ ID NO: 4013467 - RNA, 14 nt, Staphylococcus aureus subsp. aureus MW2
cugauuuuuuauca

SEQ ID NO: 4013468 - RNA, 16 nt, Staphylococcus aureus subsp. aureus MW2
cugcaaacacaguaca

SEQ ID NO: 4013469 - RNA, 19 nt, Staphylococcus aureus subsp. aureus MW2
cugcaaacacaguacaaau

SEQ ID NO: 4013470 - RNA, 21 nt, Staphylococcus aureus subsp. aureus MW2
cugcaaacacaguacaaauaa

SEQ ID NO: 4013471 - RNA, 23 nt, Staphylococcus aureus subsp. aureus MW2
cugcaaacacaguacaaauaaca

SEQ ID NO: 4013472 - RNA, 21 nt, Staphylococcus aureus subsp. aureus MW2
cugcaaacuugauucaauaua

SEQ ID NO: 4013473 - RNA, 16 nt, Staphylococcus aureus subsp. aureus MW2
cugcaaaugccucuuu

SEQ ID NO: 4013474 - RNA, 14 nt, Staphylococcus aureus subsp. aureus MW2
cugcaagugcuuca

SEQ ID NO: 4013475 - RNA, 13 nt, Staphylococcus aureus subsp. aureus MW2
cugcaccaagaaa

SEQ ID NO: 4013476 - RNA, 18 nt, Staphylococcus aureus subsp. aureus MW2
cugcaccgauaucauaua

SEQ ID NO: 4013477 - RNA, 20 nt, Staphylococcus aureus subsp. aureus MW2
cugcaccuaacgcuaaugau

SEQ ID NO: 4013478 - RNA, 22 nt, Staphylococcus aureus subsp. aureus MW2
cugcaccuaacgcuaaugauaa

SEQ ID NO: 4013479 - RNA, 13 nt, Staphylococcus aureus subsp. aureus MW2
cugcaccuccaac

SEQ ID NO: 4013480 - RNA, 22 nt, Staphylococcus aureus subsp. aureus MW2
cugcagaguaaccuuucgcagc

SEQ ID NO: 4013481 - RNA, 15 nt, Staphylococcus aureus subsp. aureus MW2
cugcaguugauugca

SEQ ID NO: 4013482 - RNA, 19 nt, Staphylococcus aureus subsp. aureus MW2
cugcauagcgcucuggauu

SEQ ID NO: 4013483 - RNA, 13 nt, Staphylococcus aureus subsp. aureus MW2
cugcauauaaagu

SEQ ID NO: 4013484 - RNA, 21 nt, Staphylococcus aureus subsp. aureus MW2
cugcaucaauaugaccuuuau

SEQ ID NO: 4013485 - RNA, 13 nt, Staphylococcus aureus subsp. aureus MW2
cugcaucagaucu

SEQ ID NO: 4013486 - RNA, 18 nt, Staphylococcus aureus subsp. aureus MW2
cugcauuacgcugucuca

SEQ ID NO: 4013487 - RNA, 13 nt, Staphylococcus aureus subsp. aureus MW2
cugccaaaaagua

SEQ ID NO: 4013488 - RNA, 23 nt, Staphylococcus aureus subsp. aureus MW2
cugccaauaaaaugcaauuuuuc

SEQ ID NO: 4013489 - RNA, 14 nt, Staphylococcus aureus subsp. aureus MW2
cugccaauauauuc

SEQ ID NO: 4013490 - RNA, 15 nt, Staphylococcus aureus subsp. aureus MW2
cugccauauagauau

SEQ ID NO: 4013491 - RNA, 20 nt, Staphylococcus aureus subsp. aureus MW2
cugccauuaaacgaaugauu

SEQ ID NO: 4013492 - RNA, 17 nt, Staphylococcus aureus subsp. aureus MW2
cugccguuugaagucug

SEQ ID NO: 4013493 - RNA, 15 nt, Staphylococcus aureus subsp. aureus MW2
cugcgugaauguuac

SEQ ID NO: 4013494 - RNA, 20 nt, Staphylococcus aureus subsp. aureus MW2
cugcuaacucugaucuaaaa

SEQ ID NO: 4013495 - RNA, 20 nt, Staphylococcus aureus subsp. aureus MW2
cugcuaauuuuuucaucauu

SEQ ID NO: 4013496 - RNA, 18 nt, Staphylococcus aureus subsp. aureus MW2
cugcuagacaaucaucuu

SEQ ID NO: 4013497 - RNA, 22 nt, Staphylococcus aureus subsp. aureus MW2
cugcucuuuaucaccauaaaaa

SEQ ID NO: 4013498 - RNA, 20 nt, Staphylococcus aureus subsp. aureus MW2
cugcuguucucuauuuauaa

SEQ ID NO: 4013499 - RNA, 16 nt, Staphylococcus aureus subsp. aureus MW2
cugcuuaucauuacuu

SEQ ID NO: 4013500 - RNA, 18 nt, Staphylococcus aureus subsp. aureus MW2
cugcuucagccauaauau

SEQ ID NO: 4013501 - RNA, 16 nt, Staphylococcus aureus subsp. aureus MW2
cugcuucggcaccuuu

SEQ ID NO: 4013502 - RNA, 18 nt, Staphylococcus aureus subsp. aureus MW2
cugcuucuacccuugcaa

SEQ ID NO: 4013503 - RNA, 14 nt, Staphylococcus aureus subsp. aureus MW2
cugcuuuaacugua

SEQ ID NO: 4013504 - RNA, 13 nt, Staphylococcus aureus subsp. aureus MW2
cugcuuuaaggaa

SEQ ID NO: 4013505 - RNA, 18 nt, Staphylococcus aureus subsp. aureus MW2
cugcuuuuuuaaauuuaa

SEQ ID NO: 4013506 - RNA, 22 nt, Staphylococcus aureus subsp. aureus MW2
cuggaacaauaaucaauguucu

SEQ ID NO: 4013507 - RNA, 20 nt, Staphylococcus aureus subsp. aureus MW2
cuggaucgcccauacuaaau

SEQ ID NO: 4013508 - RNA, 21 nt, Staphylococcus aureus subsp. aureus MW2
cuggcaaauugccuuucauuu

SEQ ID NO: 4013509 - RNA, 14 nt, Staphylococcus aureus subsp. aureus MW2
cuggcggaaaguca

SEQ ID NO: 4013510 - RNA, 16 nt, Staphylococcus aureus subsp. aureus MW2
cuggcggaaagucagg

SEQ ID NO: 4013511 - RNA, 20 nt, Staphylococcus aureus subsp. aureus MW2
cuggcguuaaagcuuuucuu

SEQ ID NO: 4013512 - RNA, 19 nt, Staphylococcus aureus subsp. aureus MW2
cugggaacgcuguuuuuaa

SEQ ID NO: 4013513 - RNA, 17 nt, Staphylococcus aureus subsp. aureus MW2
cugggcuuucuuuuuug

SEQ ID NO: 4013514 - RNA, 12 nt, Staphylococcus aureus subsp. aureus MW2
cugguaaaaaaa

SEQ ID NO: 4013515 - RNA, 14 nt, Staphylococcus aureus subsp. aureus MW2
cugguaaaaaaaua

SEQ ID NO: 4013516 - RNA, 22 nt, Staphylococcus aureus subsp. aureus MW2
cuggugcaggcaucauaucaua

SEQ ID NO: 4013517 - RNA, 21 nt, Staphylococcus aureus subsp. aureus MW2
cuggugguaacguaaacaugg

SEQ ID NO: 4013518 - RNA, 15 nt, Staphylococcus aureus subsp. aureus MW2
cugguugauaaauaa

SEQ ID NO: 4013519 - RNA, 20 nt, Staphylococcus aureus subsp. aureus MW2
cuguaaaaccauagauaauu

SEQ ID NO: 4013520 - RNA, 19 nt, Staphylococcus aureus subsp. aureus MW2
cuguaaacgauacugcuuu

SEQ ID NO: 4013521 - RNA, 16 nt, Staphylococcus aureus subsp. aureus MW2
cuguaaauaugaacuu

SEQ ID NO: 4013522 - RNA, 15 nt, Staphylococcus aureus subsp. aureus MW2
cuguaaaugaaaugg

SEQ ID NO: 4013523 - RNA, 17 nt, Staphylococcus aureus subsp. aureus MW2
cuguaaauuaucuaaag

SEQ ID NO: 4013524 - RNA, 19 nt, Staphylococcus aureus subsp. aureus MW2
cuguaaugcacuaccauca

SEQ ID NO: 4013525 - RNA, 16 nt, Staphylococcus aureus subsp. aureus MW2
cuguaccaucacuaaa

SEQ ID NO: 4013526 - RNA, 19 nt, Staphylococcus aureus subsp. aureus MW2
cuguaccaucacuaaagua

SEQ ID NO: 4013527 - RNA, 20 nt, Staphylococcus aureus subsp. aureus MW2
cuguaccguauuuuaauauu

SEQ ID NO: 4013528 - RNA, 12 nt, Staphylococcus aureus subsp. aureus MW2
cuguaccugcua

SEQ ID NO: 4013529 - RNA, 18 nt, Staphylococcus aureus subsp. aureus MW2
cuguacgauucaauuuaa

SEQ ID NO: 4013530 - RNA, 13 nt, Staphylococcus aureus subsp. aureus MW2
cuguagaauuucu

SEQ ID NO: 4013531 - RNA, 23 nt, Staphylococcus aureus subsp. aureus MW2
cuguagacaauuguaguaaugaa

SEQ ID NO: 4013532 - RNA, 22 nt, Staphylococcus aureus subsp. aureus MW2
cuguagguuuaauguuuaauaa

SEQ ID NO: 4013533 - RNA, 17 nt, Staphylococcus aureus subsp. aureus MW2
cuguaguacuauaguca

SEQ ID NO: 4013534 - RNA, 19 nt, Staphylococcus aureus subsp. aureus MW2
cuguaguuucaacuuuuga

SEQ ID NO: 4013535 - RNA, 23 nt, Staphylococcus aureus subsp. aureus MW2
cuguauaaauaaccgcacuuucu

SEQ ID NO: 4013536 - RNA, 18 nt, Staphylococcus aureus subsp. aureus MW2
cuguauaaccauaaugaa

SEQ ID NO: 4013537 - RNA, 19 nt, Staphylococcus aureus subsp. aureus MW2
cuguauagcuggcuuuuua

SEQ ID NO: 4013538 - RNA, 14 nt, Staphylococcus aureus subsp. aureus MW2
cuguauuuaauaaa

SEQ ID NO: 4013539 - RNA, 12 nt, Staphylococcus aureus subsp. aureus MW2
cuguauuuacua

SEQ ID NO: 4013540 - RNA, 14 nt, Staphylococcus aureus subsp. aureus MW2
cuguccgauuuuua

SEQ ID NO: 4013541 - RNA, 15 nt, Staphylococcus aureus subsp. aureus MW2
cugucgcucauccuc

SEQ ID NO: 4013542 - RNA, 16 nt, Staphylococcus aureus subsp. aureus MW2
cugucucauuaaugua

SEQ ID NO: 4013543 - RNA, 15 nt, Staphylococcus aureus subsp. aureus MW2
cugugauaaaaaucu

SEQ ID NO: 4013544 - RNA, 20 nt, Staphylococcus aureus subsp. aureus MW2
cugugauauuaauugaaaaa

SEQ ID NO: 4013545 - RNA, 15 nt, Staphylococcus aureus subsp. aureus MW2
cugugcucauuuuuu

SEQ ID NO: 4013546 - RNA, 21 nt, Staphylococcus aureus subsp. aureus MW2
cuguggacaaacugauuuuuu

SEQ ID NO: 4013547 - RNA, 23 nt, Staphylococcus aureus subsp. aureus MW2
cuguggcucgaaaauaaaacaaa

SEQ ID NO: 4013548 - RNA, 17 nt, Staphylococcus aureus subsp. aureus MW2
cuguguaaaauaaauca

SEQ ID NO: 4013549 - RNA, 13 nt, Staphylococcus aureus subsp. aureus MW2
cuguguaucauca

SEQ ID NO: 4013550 - RNA, 13 nt, Staphylococcus aureus subsp. aureus MW2
cugugugcuguuc

SEQ ID NO: 4013551 - RNA, 15 nt, Staphylococcus aureus subsp. aureus MW2
cuguguuggggccca

SEQ ID NO: 4013552 - RNA, 15 nt, Staphylococcus aureus subsp. aureus MW2
cuguguuggggcccc

SEQ ID NO: 4013553 - RNA, 16 nt, Staphylococcus aureus subsp. aureus MW2
cuguuaaacucauaca

SEQ ID NO: 4013554 - RNA, 22 nt, Staphylococcus aureus subsp. aureus MW2
cuguuaaacucauacaaauuuu

SEQ ID NO: 4013555 - RNA, 16 nt, Staphylococcus aureus subsp. aureus MW2
cuguuaaagauguuga

SEQ ID NO: 4013556 - RNA, 15 nt, Staphylococcus aureus subsp. aureus MW2
cuguuaauguuccaa

SEQ ID NO: 4013557 - RNA, 16 nt, Staphylococcus aureus subsp. aureus MW2
cuguuacacuuuucuu

SEQ ID NO: 4013558 - RNA, 15 nt, Staphylococcus aureus subsp. aureus MW2
cuguuacugcacaca

SEQ ID NO: 4013559 - RNA, 15 nt, Staphylococcus aureus subsp. aureus MW2
cuguuccaaauucau

SEQ ID NO: 4013560 - RNA, 17 nt, Staphylococcus aureus subsp. aureus MW2
cuguucucuauuuauaa

SEQ ID NO: 4013561 - RNA, 16 nt, Staphylococcus aureus subsp. aureus MW2
cuguugcauuaagugc

SEQ ID NO: 4013562 - RNA, 20 nt, Staphylococcus aureus subsp. aureus MW2
cuguuggaauaccuuuuucu

SEQ ID NO: 4013563 - RNA, 21 nt, Staphylococcus aureus subsp. aureus MW2
cuguuggaauaccuuuuucua

SEQ ID NO: 4013564 - RNA, 20 nt, Staphylococcus aureus subsp. aureus MW2
cuguuuaaauuuaaaagaaa

SEQ ID NO: 4013565 - RNA, 13 nt, Staphylococcus aureus subsp. aureus MW2
cuguuugcuuuau

SEQ ID NO: 4013566 - RNA, 22 nt, Staphylococcus aureus subsp. aureus MW2
cuguuuuaauugggucuuuauc

SEQ ID NO: 4013567 - RNA, 18 nt, Staphylococcus aureus subsp. aureus MW2
cuguuuuaucuacaguuu

SEQ ID NO: 4013568 - RNA, 13 nt, Staphylococcus aureus subsp. aureus MW2
cuguuuucauuug

SEQ ID NO: 4013569 - RNA, 15 nt, Staphylococcus aureus subsp. aureus MW2
cuguuuucauuuguu

SEQ ID NO: 4013570 - RNA, 18 nt, Staphylococcus aureus subsp. aureus MW2
cuguuuucauuuguuaac

SEQ ID NO: 4013571 - RNA, 19 nt, Staphylococcus aureus subsp. aureus MW2
cuguuuugcgguuuuuuug

SEQ ID NO: 4013572 - RNA, 11 nt, Staphylococcus aureus subsp. aureus MW2
cuuaaaaacaa

SEQ ID NO: 4013573 - RNA, 12 nt, Staphylococcus aureus subsp. aureus MW2
cuuaaaaacaau

SEQ ID NO: 4013574 - RNA, 19 nt, Staphylococcus aureus subsp. aureus MW2
cuuaaaaacgcuuuuaaac

SEQ ID NO: 4013575 - RNA, 20 nt, Staphylococcus aureus subsp. aureus MW2
cuuaaaagagaauauaaaau

SEQ ID NO: 4013576 - RNA, 22 nt, Staphylococcus aureus subsp. aureus MW2
cuuaaaagagaauauaaaauaa

SEQ ID NO: 4013577 - RNA, 18 nt, Staphylococcus aureus subsp. aureus MW2
cuuaaaauaaguauuuuu

SEQ ID NO: 4013578 - RNA, 21 nt, Staphylococcus aureus subsp. aureus MW2
cuuaaaauaccugcaacuuuu

SEQ ID NO: 4013579 - RNA, 18 nt, Staphylococcus aureus subsp. aureus MW2
cuuaaaauaugauuuaaa

SEQ ID NO: 4013580 - RNA, 21 nt, Staphylococcus aureus subsp. aureus MW2
cuuaaaauaugauuuaaaaua

SEQ ID NO: 4013581 - RNA, 16 nt, Staphylococcus aureus subsp. aureus MW2
cuuaaaauauuuaacu

SEQ ID NO: 4013582 - RNA, 17 nt, Staphylococcus aureus subsp. aureus MW2
cuuaaaaugauuguuuu

SEQ ID NO: 4013583 - RNA, 14 nt, Staphylococcus aureus subsp. aureus MW2
cuuaaaauuuaaau

SEQ ID NO: 4013584 - RNA, 15 nt, Staphylococcus aureus subsp. aureus MW2
cuuaaaauuuaaaua

SEQ ID NO: 4013585 - RNA, 18 nt, Staphylococcus aureus subsp. aureus MW2
cuuaaacaaauaaauguc

SEQ ID NO: 4013586 - RNA, 21 nt, Staphylococcus aureus subsp. aureus MW2
cuuaaacgcucuucuucuuca

SEQ ID NO: 4013587 - RNA, 23 nt, Staphylococcus aureus subsp. aureus MW2
cuuaaacgcucuucuucuucagg

SEQ ID NO: 4013588 - RNA, 16 nt, Staphylococcus aureus subsp. aureus MW2
cuuaaagaauuaagua

SEQ ID NO: 4013589 - RNA, 21 nt, Staphylococcus aureus subsp. aureus MW2
cuuaaagauuuacccauuaca

SEQ ID NO: 4013590 - RNA, 22 nt, Staphylococcus aureus subsp. aureus MW2
cuuaaauacaauuucuucauuu

SEQ ID NO: 4013591 - RNA, 20 nt, Staphylococcus aureus subsp. aureus MW2
cuuaaaucaacaucaucuuu

SEQ ID NO: 4013592 - RNA, 23 nt, Staphylococcus aureus subsp. aureus MW2
cuuaaauggagauucucgguuuu

SEQ ID NO: 4013593 - RNA, 23 nt, Staphylococcus aureus subsp. aureus MW2
cuuaacaauuuuaauuuuucauu

SEQ ID NO: 4013594 - RNA, 17 nt, Staphylococcus aureus subsp. aureus MW2
cuuaacauaaaaugagu

SEQ ID NO: 4013595 - RNA, 15 nt, Staphylococcus aureus subsp. aureus MW2
cuuaacaucuuuuuc

SEQ ID NO: 4013596 - RNA, 17 nt, Staphylococcus aureus subsp. aureus MW2
cuuaacaucuuuuucac

SEQ ID NO: 4013597 - RNA, 16 nt, Staphylococcus aureus subsp. aureus MW2
cuuaacguugcagaga

SEQ ID NO: 4013598 - RNA, 13 nt, Staphylococcus aureus subsp. aureus MW2
cuuaacuugaaau

SEQ ID NO: 4013599 - RNA, 18 nt, Staphylococcus aureus subsp. aureus MW2
cuuaagaaauuuuuucua

SEQ ID NO: 4013600 - RNA, 21 nt, Staphylococcus aureus subsp. aureus MW2
cuuaagcuuuaaucauagcau

SEQ ID NO: 4013601 - RNA, 17 nt, Staphylococcus aureus subsp. aureus MW2
cuuaauaagcugaaaua

SEQ ID NO: 4013602 - RNA, 15 nt, Staphylococcus aureus subsp. aureus MW2
cuuaauaagucagcu

SEQ ID NO: 4013603 - RNA, 14 nt, Staphylococcus aureus subsp. aureus MW2
cuuaauacuaauuu

SEQ ID NO: 4013604 - RNA, 21 nt, Staphylococcus aureus subsp. aureus MW2
cuuaauaggauaugcuaaaca

SEQ ID NO: 4013605 - RNA, 18 nt, Staphylococcus aureus subsp. aureus MW2
cuuaauauauucggcaaa

SEQ ID NO: 4013606 - RNA, 18 nt, Staphylococcus aureus subsp. aureus MW2
cuuaauaucauauucaaa

SEQ ID NO: 4013607 - RNA, 22 nt, Staphylococcus aureus subsp. aureus MW2
cuuaaucaagcuagcaucaugu

SEQ ID NO: 4013608 - RNA, 22 nt, Staphylococcus aureus subsp. aureus MW2
cuuaaucagcuauaaaaguacu

SEQ ID NO: 4013609 - RNA, 22 nt, Staphylococcus aureus subsp. aureus MW2
cuuaaucauugcuccccucuuu

SEQ ID NO: 4013610 - RNA, 19 nt, Staphylococcus aureus subsp. aureus MW2
cuuaaucuauaaauuauuu

SEQ ID NO: 4013611 - RNA, 18 nt, Staphylococcus aureus subsp. aureus MW2
cuuaaugcuaugauuaaa

SEQ ID NO: 4013612 - RNA, 15 nt, Staphylococcus aureus subsp. aureus MW2
cuuaaugcuucaaau

SEQ ID NO: 4013613 - RNA, 16 nt, Staphylococcus aureus subsp. aureus MW2
cuuaauggcgugcuuu

SEQ ID NO: 4013614 - RNA, 17 nt, Staphylococcus aureus subsp. aureus MW2
cuuaauggcgugcuuuu

SEQ ID NO: 4013615 - RNA, 21 nt, Staphylococcus aureus subsp. aureus MW2
cuuaauggcgugcuuuucaaa

SEQ ID NO: 4013616 - RNA, 23 nt, Staphylococcus aureus subsp. aureus MW2
cuuaaugucccaagcucuuuuuu

SEQ ID NO: 4013617 - RNA, 14 nt, Staphylococcus aureus subsp. aureus MW2
cuuaauuaauaauu

SEQ ID NO: 4013618 - RNA, 20 nt, Staphylococcus aureus subsp. aureus MW2
cuuaauuauuuauuguucuc

SEQ ID NO: 4013619 - RNA, 14 nt, Staphylococcus aureus subsp. aureus MW2
cuuaauucauucca

SEQ ID NO: 4013620 - RNA, 14 nt, Staphylococcus aureus subsp. aureus MW2
cuuaauucuucauc

SEQ ID NO: 4013621 - RNA, 20 nt, Staphylococcus aureus subsp. aureus MW2
cuuaauugaaaauaaucuua

SEQ ID NO: 4013622 - RNA, 13 nt, Staphylococcus aureus subsp. aureus MW2
cuuaauuuaaauc

SEQ ID NO: 4013623 - RNA, 14 nt, Staphylococcus aureus subsp. aureus MW2
cuuaauuuaaaucu

SEQ ID NO: 4013624 - RNA, 23 nt, Staphylococcus aureus subsp. aureus MW2
cuuaauuuaaaucuguacuucua

SEQ ID NO: 4013625 - RNA, 15 nt, Staphylococcus aureus subsp. aureus MW2
cuuaauuuguuuuaa

SEQ ID NO: 4013626 - RNA, 15 nt, Staphylococcus aureus subsp. aureus MW2
cuuacaacuuuaguu

SEQ ID NO: 4013627 - RNA, 14 nt, Staphylococcus aureus subsp. aureus MW2
cuuacaauaaagac

SEQ ID NO: 4013628 - RNA, 14 nt, Staphylococcus aureus subsp. aureus MW2
cuuacaauaaucac

SEQ ID NO: 4013629 - RNA, 13 nt, Staphylococcus aureus subsp. aureus MW2
cuuacaauaaugu

SEQ ID NO: 4013630 - RNA, 17 nt, Staphylococcus aureus subsp. aureus MW2
cuuacagacaaacauua

SEQ ID NO: 4013631 - RNA, 14 nt, Staphylococcus aureus subsp. aureus MW2
cuuacauuaugaac

SEQ ID NO: 4013632 - RNA, 18 nt, Staphylococcus aureus subsp. aureus MW2
cuuacauugauaaaauaa

SEQ ID NO: 4013633 - RNA, 19 nt, Staphylococcus aureus subsp. aureus MW2
cuuacauuuuaauaaaauc

SEQ ID NO: 4013634 - RNA, 15 nt, Staphylococcus aureus subsp. aureus MW2
cuuacccaaaaaauu

SEQ ID NO: 4013635 - RNA, 17 nt, Staphylococcus aureus subsp. aureus MW2
cuuacccaaaaaauugu

SEQ ID NO: 4013636 - RNA, 18 nt, Staphylococcus aureus subsp. aureus MW2
cuuacccaaaaaauugua

SEQ ID NO: 4013637 - RNA, 19 nt, Staphylococcus aureus subsp. aureus MW2
cuuaccuuuauguucaaau

SEQ ID NO: 4013638 - RNA, 18 nt, Staphylococcus aureus subsp. aureus MW2
cuuaccuuucaaauauau

SEQ ID NO: 4013639 - RNA, 13 nt, Staphylococcus aureus subsp. aureus MW2
cuuacuacucauu

SEQ ID NO: 4013640 - RNA, 15 nt, Staphylococcus aureus subsp. aureus MW2
cuuacuacucauuau

SEQ ID NO: 4013641 - RNA, 15 nt, Staphylococcus aureus subsp. aureus MW2
cuuacuacuuaauua

SEQ ID NO: 4013642 - RNA, 16 nt, Staphylococcus aureus subsp. aureus MW2
cuuacuacuuaauuaa

SEQ ID NO: 4013643 - RNA, 17 nt, Staphylococcus aureus subsp. aureus MW2
cuuacugcuguucucua

SEQ ID NO: 4013644 - RNA, 22 nt, Staphylococcus aureus subsp. aureus MW2
cuuacugcuguuuuuuauagua

SEQ ID NO: 4013645 - RNA, 17 nt, Staphylococcus aureus subsp. aureus MW2
cuuacugucaccuucua

SEQ ID NO: 4013646 - RNA, 14 nt, Staphylococcus aureus subsp. aureus MW2
cuuagaauuuacaa

SEQ ID NO: 4013647 - RNA, 19 nt, Staphylococcus aureus subsp. aureus MW2
cuuagacgcuguuuuaaau

SEQ ID NO: 4013648 - RNA, 14 nt, Staphylococcus aureus subsp. aureus MW2
cuuagauaaauuaa

SEQ ID NO: 4013649 - RNA, 16 nt, Staphylococcus aureus subsp. aureus MW2
cuuagauucuauuagg

SEQ ID NO: 4013650 - RNA, 23 nt, Staphylococcus aureus subsp. aureus MW2
cuuagcguacgauauagugcuug

SEQ ID NO: 4013651 - RNA, 20 nt, Staphylococcus aureus subsp. aureus MW2
cuuagcuaauucauucaaua

SEQ ID NO: 4013652 - RNA, 20 nt, Staphylococcus aureus subsp. aureus MW2
cuuaggguuugguauuauuc

SEQ ID NO: 4013653 - RNA, 18 nt, Staphylococcus aureus subsp. aureus MW2
cuuaguaaggaauauuuc

SEQ ID NO: 4013654 - RNA, 17 nt, Staphylococcus aureus subsp. aureus MW2
cuuaguaaguuguacuu

SEQ ID NO: 4013655 - RNA, 20 nt, Staphylococcus aureus subsp. aureus MW2
cuuaguaaguuguacuucuu

SEQ ID NO: 4013656 - RNA, 23 nt, Staphylococcus aureus subsp. aureus MW2
cuuaguacacguguauuguauuu

SEQ ID NO: 4013657 - RNA, 17 nt, Staphylococcus aureus subsp. aureus MW2
cuuaguaucagucagcu

SEQ ID NO: 4013658 - RNA, 13 nt, Staphylococcus aureus subsp. aureus MW2
cuuauaaaauaaa

SEQ ID NO: 4013659 - RNA, 13 nt, Staphylococcus aureus subsp. aureus MW2
cuuauaaagacac

SEQ ID NO: 4013660 - RNA, 18 nt, Staphylococcus aureus subsp. aureus MW2
cuuauaaagacaccuuca

SEQ ID NO: 4013661 - RNA, 17 nt, Staphylococcus aureus subsp. aureus MW2
cuuauaacaaaaauugc

SEQ ID NO: 4013662 - RNA, 15 nt, Staphylococcus aureus subsp. aureus MW2
cuuauaacauucuuc

SEQ ID NO: 4013663 - RNA, 17 nt, Staphylococcus aureus subsp. aureus MW2
cuuauaacauucuucaa

SEQ ID NO: 4013664 - RNA, 14 nt, Staphylococcus aureus subsp. aureus MW2
cuuauaauauuaaa

SEQ ID NO: 4013665 - RNA, 20 nt, Staphylococcus aureus subsp. aureus MW2
cuuauacacuuacaaauauu

SEQ ID NO: 4013666 - RNA, 13 nt, Staphylococcus aureus subsp. aureus MW2
cuuauacuauaua

SEQ ID NO: 4013667 - RNA, 22 nt, Staphylococcus aureus subsp. aureus MW2
cuuauagaaugauuaaaauuaa

SEQ ID NO: 4013668 - RNA, 18 nt, Staphylococcus aureus subsp. aureus MW2
cuuauagauuuuucagcu

SEQ ID NO: 4013669 - RNA, 18 nt, Staphylococcus aureus subsp. aureus MW2
cuuauauuuuuuacaagc

SEQ ID NO: 4013670 - RNA, 22 nt, Staphylococcus aureus subsp. aureus MW2
cuuaucaaaaccgcuauaaaau

SEQ ID NO: 4013671 - RNA, 21 nt, Staphylococcus aureus subsp. aureus MW2
cuuaucagcauuaaucguauu

SEQ ID NO: 4013672 - RNA, 12 nt, Staphylococcus aureus subsp. aureus MW2
cuuaucagugua

SEQ ID NO: 4013673 - RNA, 18 nt, Staphylococcus aureus subsp. aureus MW2
cuuaucauuucaaauaag

SEQ ID NO: 4013674 - RNA, 15 nt, Staphylococcus aureus subsp. aureus MW2
cuuaugacugcuuuu

SEQ ID NO: 4013675 - RNA, 16 nt, Staphylococcus aureus subsp. aureus MW2
cuuaugauagugcuuu

SEQ ID NO: 4013676 - RNA, 20 nt, Staphylococcus aureus subsp. aureus MW2
cuuaugcaguuuuaauuaaa

SEQ ID NO: 4013677 - RNA, 15 nt, Staphylococcus aureus subsp. aureus MW2
cuuaugcauagcucu

SEQ ID NO: 4013678 - RNA, 23 nt, Staphylococcus aureus subsp. aureus MW2
cuuaugcucaucuacuuaaaaua

SEQ ID NO: 4013679 - RNA, 15 nt, Staphylococcus aureus subsp. aureus MW2
cuuauggaaaauuuu

SEQ ID NO: 4013680 - RNA, 16 nt, Staphylococcus aureus subsp. aureus MW2
cuuauggaaaauuuua

SEQ ID NO: 4013681 - RNA, 19 nt, Staphylococcus aureus subsp. aureus MW2
cuuaugucauauacuauau

SEQ ID NO: 4013682 - RNA, 11 nt, Staphylococcus aureus subsp. aureus MW2
cuuauuaacuu

SEQ ID NO: 4013683 - RNA, 11 nt, Staphylococcus aureus subsp. aureus MW2
cuuauuauuua

SEQ ID NO: 4013684 - RNA, 20 nt, Staphylococcus aureus subsp. aureus MW2
cuuauuauuuuguauuuuuc

SEQ ID NO: 4013685 - RNA, 22 nt, Staphylococcus aureus subsp. aureus MW2
cuuauuauuuuguauuuuucaa

SEQ ID NO: 4013686 - RNA, 23 nt, Staphylococcus aureus subsp. aureus MW2
cuuauucaaauguuuacugucau

SEQ ID NO: 4013687 - RNA, 18 nt, Staphylococcus aureus subsp. aureus MW2
cuuauuccgcaacuugua

SEQ ID NO: 4013688 - RNA, 17 nt, Staphylococcus aureus subsp. aureus MW2
cuuauucugaaaaauau

SEQ ID NO: 4013689 - RNA, 21 nt, Staphylococcus aureus subsp. aureus MW2
cuuauugauauaagauucaua

SEQ ID NO: 4013690 - RNA, 16 nt, Staphylococcus aureus subsp. aureus MW2
cuuauugcauuguaua

SEQ ID NO: 4013691 - RNA, 22 nt, Staphylococcus aureus subsp. aureus MW2
cuuauuuagaaaguuuuauuua

SEQ ID NO: 4013692 - RNA, 13 nt, Staphylococcus aureus subsp. aureus MW2
cuuauuuauuuua

SEQ ID NO: 4013693 - RNA, 14 nt, Staphylococcus aureus subsp. aureus MW2
cuuauuucuuuuca

SEQ ID NO: 4013694 - RNA, 15 nt, Staphylococcus aureus subsp. aureus MW2
cuuauuugaaaugau

SEQ ID NO: 4013695 - RNA, 22 nt, Staphylococcus aureus subsp. aureus MW2
cuuauuuguuuaauuaucuuua

SEQ ID NO: 4013696 - RNA, 15 nt, Staphylococcus aureus subsp. aureus MW2
cuuauuuuguuuuaa

SEQ ID NO: 4013697 - RNA, 13 nt, Staphylococcus aureus subsp. aureus MW2
cuucaaaaugccg

SEQ ID NO: 4013698 - RNA, 20 nt, Staphylococcus aureus subsp. aureus MW2
cuucaaagcaucuaaucccc

SEQ ID NO: 4013699 - RNA, 14 nt, Staphylococcus aureus subsp. aureus MW2
cuucaaaguuuuca

SEQ ID NO: 4013700 - RNA, 21 nt, Staphylococcus aureus subsp. aureus MW2
cuucaacacgacguucuucaa

SEQ ID NO: 4013701 - RNA, 22 nt, Staphylococcus aureus subsp. aureus MW2
cuucaacauagacacuuaacuu

SEQ ID NO: 4013702 - RNA, 14 nt, Staphylococcus aureus subsp. aureus MW2
cuucaacgucaucu

SEQ ID NO: 4013703 - RNA, 16 nt, Staphylococcus aureus subsp. aureus MW2
cuucaacgucaucugc

SEQ ID NO: 4013704 - RNA, 17 nt, Staphylococcus aureus subsp. aureus MW2
cuucaacuacuucauca

SEQ ID NO: 4013705 - RNA, 13 nt, Staphylococcus aureus subsp. aureus MW2
cuucaacuucauc

SEQ ID NO: 4013706 - RNA, 16 nt, Staphylococcus aureus subsp. aureus MW2
cuucaacuucaucuaa

SEQ ID NO: 4013707 - RNA, 15 nt, Staphylococcus aureus subsp. aureus MW2
cuucaacuuucucua

SEQ ID NO: 4013708 - RNA, 19 nt, Staphylococcus aureus subsp. aureus MW2
cuucaagugccauuuuuaa

SEQ ID NO: 4013709 - RNA, 16 nt, Staphylococcus aureus subsp. aureus MW2
cuucaauccaagcaau

SEQ ID NO: 4013710 - RNA, 19 nt, Staphylococcus aureus subsp. aureus MW2
cuucaaucgucacaucacg

SEQ ID NO: 4013711 - RNA, 12 nt, Staphylococcus aureus subsp. aureus MW2
cuucaauuauuu

SEQ ID NO: 4013712 - RNA, 18 nt, Staphylococcus aureus subsp. aureus MW2
cuucaauucuuacaccug

SEQ ID NO: 4013713 - RNA, 16 nt, Staphylococcus aureus subsp. aureus MW2
cuucaauugucucaau

SEQ ID NO: 4013714 - RNA, 22 nt, Staphylococcus aureus subsp. aureus MW2
cuucaauuuaauguauugagaa

SEQ ID NO: 4013715 - RNA, 17 nt, Staphylococcus aureus subsp. aureus MW2
cuucaauuuauuuuuau

SEQ ID NO: 4013716 - RNA, 21 nt, Staphylococcus aureus subsp. aureus MW2
cuucaauuuuaccagcaugaa

SEQ ID NO: 4013717 - RNA, 14 nt, Staphylococcus aureus subsp. aureus MW2
cuucaccaucuuua

SEQ ID NO: 4013718 - RNA, 15 nt, Staphylococcus aureus subsp. aureus MW2
cuucacuaaaaauau

SEQ ID NO: 4013719 - RNA, 17 nt, Staphylococcus aureus subsp. aureus MW2
cuucacuaaaaauauau

SEQ ID NO: 4013720 - RNA, 18 nt, Staphylococcus aureus subsp. aureus MW2
cuucacucuuuuagaauc

SEQ ID NO: 4013721 - RNA, 22 nt, Staphylococcus aureus subsp. aureus MW2
cuucagcuaaaaguuucccaag

SEQ ID NO: 4013722 - RNA, 15 nt, Staphylococcus aureus subsp. aureus MW2
cuucagguguaguag

SEQ ID NO: 4013723 - RNA, 23 nt, Staphylococcus aureus subsp. aureus MW2
cuucaguaacaguauaaauauuu

SEQ ID NO: 4013724 - RNA, 15 nt, Staphylococcus aureus subsp. aureus MW2
cuucaguacgguuau

SEQ ID NO: 4013725 - RNA, 20 nt, Staphylococcus aureus subsp. aureus MW2
cuucaguacgguuauuuaau

SEQ ID NO: 4013726 - RNA, 16 nt, Staphylococcus aureus subsp. aureus MW2
cuucaguuaaaucuuu

SEQ ID NO: 4013727 - RNA, 20 nt, Staphylococcus aureus subsp. aureus MW2
cuucauaaucguauucauau

SEQ ID NO: 4013728 - RNA, 15 nt, Staphylococcus aureus subsp. aureus MW2
cuucauaguucaaau

SEQ ID NO: 4013729 - RNA, 17 nt, Staphylococcus aureus subsp. aureus MW2
cuucauauuuagguaau

SEQ ID NO: 4013730 - RNA, 21 nt, Staphylococcus aureus subsp. aureus MW2
cuucaucaauaaauauugauu

SEQ ID NO: 4013731 - RNA, 16 nt, Staphylococcus aureus subsp. aureus MW2
cuucaucaauaacuau

SEQ ID NO: 4013732 - RNA, 18 nt, Staphylococcus aureus subsp. aureus MW2
cuucaucaguuguguaau

SEQ ID NO: 4013733 - RNA, 22 nt, Staphylococcus aureus subsp. aureus MW2
cuucaucuuuuuuaucauguga

SEQ ID NO: 4013734 - RNA, 21 nt, Staphylococcus aureus subsp. aureus MW2
cuucauuacaaacauaaucau

SEQ ID NO: 4013735 - RNA, 21 nt, Staphylococcus aureus subsp. aureus MW2
cuucauuaguugcauaaucaa

SEQ ID NO: 4013736 - RNA, 23 nt, Staphylococcus aureus subsp. aureus MW2
cuucauuauauaauucuucaaau

SEQ ID NO: 4013737 - RNA, 20 nt, Staphylococcus aureus subsp. aureus MW2
cuucauuaucaauagaugaa

SEQ ID NO: 4013738 - RNA, 15 nt, Staphylococcus aureus subsp. aureus MW2
cuucauugaugaugu

SEQ ID NO: 4013739 - RNA, 21 nt, Staphylococcus aureus subsp. aureus MW2
cuuccaaucaacuucauauaa

SEQ ID NO: 4013740 - RNA, 16 nt, Staphylococcus aureus subsp. aureus MW2
cuuccaucacaucaua

SEQ ID NO: 4013741 - RNA, 21 nt, Staphylococcus aureus subsp. aureus MW2
cuuccuccgccaucaauauuu

SEQ ID NO: 4013742 - RNA, 23 nt, Staphylococcus aureus subsp. aureus MW2
cuuccuuuuuuuaugucuuuuuu

SEQ ID NO: 4013743 - RNA, 18 nt, Staphylococcus aureus subsp. aureus MW2
cuucgcacaacugcauau

SEQ ID NO: 4013744 - RNA, 13 nt, Staphylococcus aureus subsp. aureus MW2
cuucgccaagcca

SEQ ID NO: 4013745 - RNA, 21 nt, Staphylococcus aureus subsp. aureus MW2
cuucgccaagccaucuuucuu

SEQ ID NO: 4013746 - RNA, 19 nt, Staphylococcus aureus subsp. aureus MW2
cuucgucaaugacuaagau

SEQ ID NO: 4013747 - RNA, 13 nt, Staphylococcus aureus subsp. aureus MW2
cuucuaacaaauu

SEQ ID NO: 4013748 - RNA, 17 nt, Staphylococcus aureus subsp. aureus MW2
cuucuaacucaccugca

SEQ ID NO: 4013749 - RNA, 17 nt, Staphylococcus aureus subsp. aureus MW2
cuucuaaucguuaauaa

SEQ ID NO: 4013750 - RNA, 22 nt, Staphylococcus aureus subsp. aureus MW2
cuucuaauuuaguuuuaauaua

SEQ ID NO: 4013751 - RNA, 23 nt, Staphylococcus aureus subsp. aureus MW2
cuucuaauuuaguuuuaauauaa

SEQ ID NO: 4013752 - RNA, 19 nt, Staphylococcus aureus subsp. aureus MW2
cuucuacagauuuauauuc

SEQ ID NO: 4013753 - RNA, 23 nt, Staphylococcus aureus subsp. aureus MW2
cuucuacuuuuguaccaucaaua

SEQ ID NO: 4013754 - RNA, 13 nt, Staphylococcus aureus subsp. aureus MW2
cuucuaucucuuu

SEQ ID NO: 4013755 - RNA, 14 nt, Staphylococcus aureus subsp. aureus MW2
cuucuaucucuuua

SEQ ID NO: 4013756 - RNA, 16 nt, Staphylococcus aureus subsp. aureus MW2
cuucuauuaauaauuu

SEQ ID NO: 4013757 - RNA, 16 nt, Staphylococcus aureus subsp. aureus MW2
cuucuauuuuauaaua

SEQ ID NO: 4013758 - RNA, 17 nt, Staphylococcus aureus subsp. aureus MW2
cuucuauuuuauaauaa

SEQ ID NO: 4013759 - RNA, 22 nt, Staphylococcus aureus subsp. aureus MW2
cuucucaacaaaucuauaaaua

SEQ ID NO: 4013760 - RNA, 13 nt, Staphylococcus aureus subsp. aureus MW2
cuucucaucauuu

SEQ ID NO: 4013761 - RNA, 18 nt, Staphylococcus aureus subsp. aureus MW2
cuucucaucauuuucaau

SEQ ID NO: 4013762 - RNA, 20 nt, Staphylococcus aureus subsp. aureus MW2
cuucucaucgaauucauuug

SEQ ID NO: 4013763 - RNA, 18 nt, Staphylococcus aureus subsp. aureus MW2
cuucucccuuaaauacaa

SEQ ID NO: 4013764 - RNA, 17 nt, Staphylococcus aureus subsp. aureus MW2
cuucuccguauuuaccu

SEQ ID NO: 4013765 - RNA, 23 nt, Staphylococcus aureus subsp. aureus MW2
cuucuccguauuuaccuucuucu

SEQ ID NO: 4013766 - RNA, 13 nt, Staphylococcus aureus subsp. aureus MW2
cuucucuuugaac

SEQ ID NO: 4013767 - RNA, 11 nt, Staphylococcus aureus subsp. aureus MW2
cuucugcuaac

SEQ ID NO: 4013768 - RNA, 21 nt, Staphylococcus aureus subsp. aureus MW2
cuucuggagccucuuguucuc

SEQ ID NO: 4013769 - RNA, 14 nt, Staphylococcus aureus subsp. aureus MW2
cuucuguuuauaua

SEQ ID NO: 4013770 - RNA, 21 nt, Staphylococcus aureus subsp. aureus MW2
cuucuuaaaauaugauuuaaa

SEQ ID NO: 4013771 - RNA, 20 nt, Staphylococcus aureus subsp. aureus MW2
cuucuuaacuugaaauguug

SEQ ID NO: 4013772 - RNA, 22 nt, Staphylococcus aureus subsp. aureus MW2
cuucuucaggaauaucuuucaa

SEQ ID NO: 4013773 - RNA, 12 nt, Staphylococcus aureus subsp. aureus MW2
cuucuucaguaa

SEQ ID NO: 4013774 - RNA, 12 nt, Staphylococcus aureus subsp. aureus MW2
cuucuucaucau

SEQ ID NO: 4013775 - RNA, 22 nt, Staphylococcus aureus subsp. aureus MW2
cuucuucuaaccacuucuucac

SEQ ID NO: 4013776 - RNA, 15 nt, Staphylococcus aureus subsp. aureus MW2
cuucuuguuucaaac

SEQ ID NO: 4013777 - RNA, 22 nt, Staphylococcus aureus subsp. aureus MW2
cuucuuuguuuuuaauuuuuaa

SEQ ID NO: 4013778 - RNA, 23 nt, Staphylococcus aureus subsp. aureus MW2
cuucuuuuguaacguucuuauau

SEQ ID NO: 4013779 - RNA, 19 nt, Staphylococcus aureus subsp. aureus MW2
cuucuuuuguuuuaccauc

SEQ ID NO: 4013780 - RNA, 20 nt, Staphylococcus aureus subsp. aureus MW2
cuucuuuuuguccccagccc

SEQ ID NO: 4013781 - RNA, 22 nt, Staphylococcus aureus subsp. aureus MW2
cuugaaacaucuugauauucau

SEQ ID NO: 4013782 - RNA, 17 nt, Staphylococcus aureus subsp. aureus MW2
cuugaaauuauuauuua

SEQ ID NO: 4013783 - RNA, 17 nt, Staphylococcus aureus subsp. aureus MW2
cuugaacagauucaccu

SEQ ID NO: 4013784 - RNA, 22 nt, Staphylococcus aureus subsp. aureus MW2
cuugaaguuguuucuccaguuu

SEQ ID NO: 4013785 - RNA, 20 nt, Staphylococcus aureus subsp. aureus MW2
cuugaauaaauuuuauucuu

SEQ ID NO: 4013786 - RNA, 15 nt, Staphylococcus aureus subsp. aureus MW2
cuugaauaauauauu

SEQ ID NO: 4013787 - RNA, 16 nt, Staphylococcus aureus subsp. aureus MW2
cuugaauaauauauuu

SEQ ID NO: 4013788 - RNA, 15 nt, Staphylococcus aureus subsp. aureus MW2
cuugaauguaagaag

SEQ ID NO: 4013789 - RNA, 14 nt, Staphylococcus aureus subsp. aureus MW2
cuugaauguuugaa

SEQ ID NO: 4013790 - RNA, 15 nt, Staphylococcus aureus subsp. aureus MW2
cuugaccuucaguuu

SEQ ID NO: 4013791 - RNA, 14 nt, Staphylococcus aureus subsp. aureus MW2
cuugagcaucacuc

SEQ ID NO: 4013792 - RNA, 15 nt, Staphylococcus aureus subsp. aureus MW2
cuugagcuauucaua

SEQ ID NO: 4013793 - RNA, 15 nt, Staphylococcus aureus subsp. aureus MW2
cuugauaaaauaaau

SEQ ID NO: 4013794 - RNA, 15 nt, Staphylococcus aureus subsp. aureus MW2
cuugauuguaaauaa

SEQ ID NO: 4013795 - RNA, 17 nt, Staphylococcus aureus subsp. aureus MW2
cuugauuuaauuuuuaa

SEQ ID NO: 4013796 - RNA, 18 nt, Staphylococcus aureus subsp. aureus MW2
cuugcaaauauaucaucu

SEQ ID NO: 4013797 - RNA, 17 nt, Staphylococcus aureus subsp. aureus MW2
cuugcaauaccucccca

SEQ ID NO: 4013798 - RNA, 22 nt, Staphylococcus aureus subsp. aureus MW2
cuugcauaaccaaguaauucuu

SEQ ID NO: 4013799 - RNA, 20 nt, Staphylococcus aureus subsp. aureus MW2
cuugcauacgaauuaaaaua

SEQ ID NO: 4013800 - RNA, 17 nt, Staphylococcus aureus subsp. aureus MW2
cuugccuacuuuuuugg

SEQ ID NO: 4013801 - RNA, 15 nt, Staphylococcus aureus subsp. aureus MW2
cuugccuauuuuuuu

SEQ ID NO: 4013802 - RNA, 22 nt, Staphylococcus aureus subsp. aureus MW2
cuugccugguaacguucuacuc

SEQ ID NO: 4013803 - RNA, 14 nt, Staphylococcus aureus subsp. aureus MW2
cuugccuucaaauu

SEQ ID NO: 4013804 - RNA, 14 nt, Staphylococcus aureus subsp. aureus MW2
cuugccuuuuuagg

SEQ ID NO: 4013805 - RNA, 20 nt, Staphylococcus aureus subsp. aureus MW2
cuugcuggauuacaccuuug

SEQ ID NO: 4013806 - RNA, 12 nt, Staphylococcus aureus subsp. aureus MW2
cuugcuuacaau

SEQ ID NO: 4013807 - RNA, 19 nt, Staphylococcus aureus subsp. aureus MW2
cuugcuucuuuccucuccu

SEQ ID NO: 4013808 - RNA, 20 nt, Staphylococcus aureus subsp. aureus MW2
cuugcuucuuuccucuccuu

SEQ ID NO: 4013809 - RNA, 21 nt, Staphylococcus aureus subsp. aureus MW2
cuuggaaguaucugugaauau

SEQ ID NO: 4013810 - RNA, 14 nt, Staphylococcus aureus subsp. aureus MW2
cuuggacauuguaa

SEQ ID NO: 4013811 - RNA, 17 nt, Staphylococcus aureus subsp. aureus MW2
cuuggauuuuuugguuu

SEQ ID NO: 4013812 - RNA, 16 nt, Staphylococcus aureus subsp. aureus MW2
cuuggccuacuuuuuc

SEQ ID NO: 4013813 - RNA, 20 nt, Staphylococcus aureus subsp. aureus MW2
cuuggccuacuuuuucaaua

SEQ ID NO: 4013814 - RNA, 13 nt, Staphylococcus aureus subsp. aureus MW2
cuuggcguauuuu

SEQ ID NO: 4013815 - RNA, 16 nt, Staphylococcus aureus subsp. aureus MW2
cuuggcguauuuuuug

SEQ ID NO: 4013816 - RNA, 14 nt, Staphylococcus aureus subsp. aureus MW2
cuugggacagaaaa

SEQ ID NO: 4013817 - RNA, 18 nt, Staphylococcus aureus subsp. aureus MW2
cuugggacagaaaacaaa

SEQ ID NO: 4013818 - RNA, 23 nt, Staphylococcus aureus subsp. aureus MW2
cuugguacaccuacaaauauuuc

SEQ ID NO: 4013819 - RNA, 13 nt, Staphylococcus aureus subsp. aureus MW2
cuugguauuuuuu

SEQ ID NO: 4013820 - RNA, 17 nt, Staphylococcus aureus subsp. aureus MW2
cuuggugccgaaauugu

SEQ ID NO: 4013821 - RNA, 16 nt, Staphylococcus aureus subsp. aureus MW2
cuuguaaacuucuuuu

SEQ ID NO: 4013822 - RNA, 22 nt, Staphylococcus aureus subsp. aureus MW2
cuuguaaaucacgauuuucaag

SEQ ID NO: 4013823 - RNA, 19 nt, Staphylococcus aureus subsp. aureus MW2
cuuguaaauuuauuuuuaa

SEQ ID NO: 4013824 - RNA, 12 nt, Staphylococcus aureus subsp. aureus MW2
cuuguaacaagc

SEQ ID NO: 4013825 - RNA, 22 nt, Staphylococcus aureus subsp. aureus MW2
cuuguaacaagcuuuucauuuu

SEQ ID NO: 4013826 - RNA, 15 nt, Staphylococcus aureus subsp. aureus MW2
cuuguaauauaacaa

SEQ ID NO: 4013827 - RNA, 16 nt, Staphylococcus aureus subsp. aureus MW2
cuuguacgauaacuac

SEQ ID NO: 4013828 - RNA, 15 nt, Staphylococcus aureus subsp. aureus MW2
cuugucaguuuuuuu

SEQ ID NO: 4013829 - RNA, 17 nt, Staphylococcus aureus subsp. aureus MW2
cuuguccucuaaaacau

SEQ ID NO: 4013830 - RNA, 22 nt, Staphylococcus aureus subsp. aureus MW2
cuugugacaaucgcuugcuucu

SEQ ID NO: 4013831 - RNA, 19 nt, Staphylococcus aureus subsp. aureus MW2
cuugugauaauucuucaac

SEQ ID NO: 4013832 - RNA, 19 nt, Staphylococcus aureus subsp. aureus MW2
cuugugguuggaagucugc

SEQ ID NO: 4013833 - RNA, 14 nt, Staphylococcus aureus subsp. aureus MW2
cuugugugaaauua

SEQ ID NO: 4013834 - RNA, 22 nt, Staphylococcus aureus subsp. aureus MW2
cuuguucgauaaucguuaaaac

SEQ ID NO: 4013835 - RNA, 14 nt, Staphylococcus aureus subsp. aureus MW2
cuuguucuaaaaaa

SEQ ID NO: 4013836 - RNA, 13 nt, Staphylococcus aureus subsp. aureus MW2
cuuguucuaauug

SEQ ID NO: 4013837 - RNA, 19 nt, Staphylococcus aureus subsp. aureus MW2
cuuguucuccgaucaugcc

SEQ ID NO: 4013838 - RNA, 21 nt, Staphylococcus aureus subsp. aureus MW2
cuuguucuccgaucaugccuu

SEQ ID NO: 4013839 - RNA, 16 nt, Staphylococcus aureus subsp. aureus MW2
cuuguucuucuuuacg

SEQ ID NO: 4013840 - RNA, 19 nt, Staphylococcus aureus subsp. aureus MW2
cuuguuggaaagcuuuaac

SEQ ID NO: 4013841 - RNA, 18 nt, Staphylococcus aureus subsp. aureus MW2
cuuguuuagggaauccca

SEQ ID NO: 4013842 - RNA, 16 nt, Staphylococcus aureus subsp. aureus MW2
cuuguuuauuuuuaau

SEQ ID NO: 4013843 - RNA, 14 nt, Staphylococcus aureus subsp. aureus MW2
cuuguuuuaaacuu

SEQ ID NO: 4013844 - RNA, 17 nt, Staphylococcus aureus subsp. aureus MW2
cuuuaaaaauuaaguaa

SEQ ID NO: 4013845 - RNA, 23 nt, Staphylococcus aureus subsp. aureus MW2
cuuuaaaaauugcaaugcuauca

SEQ ID NO: 4013846 - RNA, 15 nt, Staphylococcus aureus subsp. aureus MW2
cuuuaaaacaucauu

SEQ ID NO: 4013847 - RNA, 19 nt, Staphylococcus aureus subsp. aureus MW2
cuuuaaaacaucauucaca

SEQ ID NO: 4013848 - RNA, 22 nt, Staphylococcus aureus subsp. aureus MW2
cuuuaaaacaucauucacaagu

SEQ ID NO: 4013849 - RNA, 23 nt, Staphylococcus aureus subsp. aureus MW2
cuuuaaaacguuaguacuuugau

SEQ ID NO: 4013850 - RNA, 22 nt, Staphylococcus aureus subsp. aureus MW2
cuuuaaaauucucuagugcuuu

SEQ ID NO: 4013851 - RNA, 19 nt, Staphylococcus aureus subsp. aureus MW2
cuuuaaaauuguauagaau

SEQ ID NO: 4013852 - RNA, 15 nt, Staphylococcus aureus subsp. aureus MW2
cuuuaaaauuuuuug

SEQ ID NO: 4013853 - RNA, 17 nt, Staphylococcus aureus subsp. aureus MW2
cuuuaaacucguaaauu

SEQ ID NO: 4013854 - RNA, 20 nt, Staphylococcus aureus subsp. aureus MW2
cuuuaaacucguaaauuuua

SEQ ID NO: 4013855 - RNA, 14 nt, Staphylococcus aureus subsp. aureus MW2
cuuuaaagguauug

SEQ ID NO: 4013856 - RNA, 22 nt, Staphylococcus aureus subsp. aureus MW2
cuuuaaauauacuucuauuaaa

SEQ ID NO: 4013857 - RNA, 13 nt, Staphylococcus aureus subsp. aureus MW2
cuuuaaauauugu

SEQ ID NO: 4013858 - RNA, 16 nt, Staphylococcus aureus subsp. aureus MW2
cuuuaaaucuacuuug

SEQ ID NO: 4013859 - RNA, 16 nt, Staphylococcus aureus subsp. aureus MW2
cuuuaaaucuuguucu

SEQ ID NO: 4013860 - RNA, 21 nt, Staphylococcus aureus subsp. aureus MW2
cuuuaaaucuuguucuaauug

SEQ ID NO: 4013861 - RNA, 14 nt, Staphylococcus aureus subsp. aureus MW2
cuuuaaauguauca

SEQ ID NO: 4013862 - RNA, 23 nt, Staphylococcus aureus subsp. aureus MW2
cuuuaacuguacgauucaauuua

SEQ ID NO: 4013863 - RNA, 18 nt, Staphylococcus aureus subsp. aureus MW2
cuuuaacuucugguucuu

SEQ ID NO: 4013864 - RNA, 13 nt, Staphylococcus aureus subsp. aureus MW2
cuuuaacuucuuu

SEQ ID NO: 4013865 - RNA, 19 nt, Staphylococcus aureus subsp. aureus MW2
cuuuaacuucuuuuguuuu

SEQ ID NO: 4013866 - RNA, 14 nt, Staphylococcus aureus subsp. aureus MW2
cuuuaagcuuaaau

SEQ ID NO: 4013867 - RNA, 18 nt, Staphylococcus aureus subsp. aureus MW2
cuuuaaguaauucauuug

SEQ ID NO: 4013868 - RNA, 15 nt, Staphylococcus aureus subsp. aureus MW2
cuuuaauaaccuuua

SEQ ID NO: 4013869 - RNA, 22 nt, Staphylococcus aureus subsp. aureus MW2
cuuuaauaaccuuuaaaacauc

SEQ ID NO: 4013870 - RNA, 21 nt, Staphylococcus aureus subsp. aureus MW2
cuuuaauacuaccguuuuuau

SEQ ID NO: 4013871 - RNA, 19 nt, Staphylococcus aureus subsp. aureus MW2
cuuuaauagcgucaaguuu

SEQ ID NO: 4013872 - RNA, 19 nt, Staphylococcus aureus subsp. aureus MW2
cuuuaauauaauuauuaaa

SEQ ID NO: 4013873 - RNA, 16 nt, Staphylococcus aureus subsp. aureus MW2
cuuuaauaucuaauuc

SEQ ID NO: 4013874 - RNA, 18 nt, Staphylococcus aureus subsp. aureus MW2
cuuuaaucauagcauuaa

SEQ ID NO: 4013875 - RNA, 18 nt, Staphylococcus aureus subsp. aureus MW2
cuuuaauuaaaguuaaag

SEQ ID NO: 4013876 - RNA, 14 nt, Staphylococcus aureus subsp. aureus MW2
cuuuaauugcucuu

SEQ ID NO: 4013877 - RNA, 23 nt, Staphylococcus aureus subsp. aureus MW2
cuuuaauuuaucauuauuuaauu

SEQ ID NO: 4013878 - RNA, 13 nt, Staphylococcus aureus subsp. aureus MW2
cuuuaauuuucuu

SEQ ID NO: 4013879 - RNA, 16 nt, Staphylococcus aureus subsp. aureus MW2
cuuuacaacaguaauc

SEQ ID NO: 4013880 - RNA, 14 nt, Staphylococcus aureus subsp. aureus MW2
cuuuacgauaaaua

SEQ ID NO: 4013881 - RNA, 13 nt, Staphylococcus aureus subsp. aureus MW2
cuuuacuauauuc

SEQ ID NO: 4013882 - RNA, 13 nt, Staphylococcus aureus subsp. aureus MW2
cuuuacuuucauu

SEQ ID NO: 4013883 - RNA, 14 nt, Staphylococcus aureus subsp. aureus MW2
cuuuacuuucauua

SEQ ID NO: 4013884 - RNA, 16 nt, Staphylococcus aureus subsp. aureus MW2
cuuuagaaacaccuuu

SEQ ID NO: 4013885 - RNA, 21 nt, Staphylococcus aureus subsp. aureus MW2
cuuuagaaagugauucccaaa

SEQ ID NO: 4013886 - RNA, 22 nt, Staphylococcus aureus subsp. aureus MW2
cuuuagaugagauuucguuaga

SEQ ID NO: 4013887 - RNA, 22 nt, Staphylococcus aureus subsp. aureus MW2
cuuuagcaaaaauauuuaaacu

SEQ ID NO: 4013888 - RNA, 15 nt, Staphylococcus aureus subsp. aureus MW2
cuuuagcuauugcuu

SEQ ID NO: 4013889 - RNA, 15 nt, Staphylococcus aureus subsp. aureus MW2
cuuuagcucuuuuuu

SEQ ID NO: 4013890 - RNA, 21 nt, Staphylococcus aureus subsp. aureus MW2
cuuuaguaguguauucauuuu

SEQ ID NO: 4013891 - RNA, 19 nt, Staphylococcus aureus subsp. aureus MW2
cuuuagucgguguuuucuu

SEQ ID NO: 4013892 - RNA, 12 nt, Staphylococcus aureus subsp. aureus MW2
cuuuaguuacua

SEQ ID NO: 4013893 - RNA, 18 nt, Staphylococcus aureus subsp. aureus MW2
cuuuauaaauaaacauaa

SEQ ID NO: 4013894 - RNA, 15 nt, Staphylococcus aureus subsp. aureus MW2
cuuuauacaauuuuu

SEQ ID NO: 4013895 - RNA, 17 nt, Staphylococcus aureus subsp. aureus MW2
cuuuauacguuacggcu

SEQ ID NO: 4013896 - RNA, 12 nt, Staphylococcus aureus subsp. aureus MW2
cuuuauaugaag

SEQ ID NO: 4013897 - RNA, 12 nt, Staphylococcus aureus subsp. aureus MW2
cuuuaucaacaa

SEQ ID NO: 4013898 - RNA, 20 nt, Staphylococcus aureus subsp. aureus MW2
cuuuaucgaauucuucuuua

SEQ ID NO: 4013899 - RNA, 13 nt, Staphylococcus aureus subsp. aureus MW2
cuuuaucuauaug

SEQ ID NO: 4013900 - RNA, 19 nt, Staphylococcus aureus subsp. aureus MW2
cuuuaucuauuucuauaua

SEQ ID NO: 4013901 - RNA, 14 nt, Staphylococcus aureus subsp. aureus MW2
cuuuaugauaauaa

SEQ ID NO: 4013902 - RNA, 21 nt, Staphylococcus aureus subsp. aureus MW2
cuuuaugugcaucauuuauau

SEQ ID NO: 4013903 - RNA, 20 nt, Staphylococcus aureus subsp. aureus MW2
cuuuaugugguuuugauuaa

SEQ ID NO: 4013904 - RNA, 16 nt, Staphylococcus aureus subsp. aureus MW2
cuuuauguuggggccu

SEQ ID NO: 4013905 - RNA, 14 nt, Staphylococcus aureus subsp. aureus MW2
cuuuauuaaaaauc

SEQ ID NO: 4013906 - RNA, 17 nt, Staphylococcus aureus subsp. aureus MW2
cuuuauuaaaaauccuc

SEQ ID NO: 4013907 - RNA, 16 nt, Staphylococcus aureus subsp. aureus MW2
cuuuauuaaauaacuc

SEQ ID NO: 4013908 - RNA, 16 nt, Staphylococcus aureus subsp. aureus MW2
cuuuauuauuuaaucu

SEQ ID NO: 4013909 - RNA, 20 nt, Staphylococcus aureus subsp. aureus MW2
cuuuauuucuuucgaaaaca

SEQ ID NO: 4013910 - RNA, 20 nt, Staphylococcus aureus subsp. aureus MW2
cuuuauuugauaauauugga

SEQ ID NO: 4013911 - RNA, 15 nt, Staphylococcus aureus subsp. aureus MW2
cuuuauuugauucuu

SEQ ID NO: 4013912 - RNA, 20 nt, Staphylococcus aureus subsp. aureus MW2
cuuuauuugauucuucacca

SEQ ID NO: 4013913 - RNA, 14 nt, Staphylococcus aureus subsp. aureus MW2
cuuuauuuuaaaca

SEQ ID NO: 4013914 - RNA, 16 nt, Staphylococcus aureus subsp. aureus MW2
cuuuauuuuaaacaug

SEQ ID NO: 4013915 - RNA, 12 nt, Staphylococcus aureus subsp. aureus MW2
cuuuauuuuuug

SEQ ID NO: 4013916 - RNA, 23 nt, Staphylococcus aureus subsp. aureus MW2
cuuucaaauauaucuaauacuuu

SEQ ID NO: 4013917 - RNA, 19 nt, Staphylococcus aureus subsp. aureus MW2
cuuucaaaugcuuaauaaa

SEQ ID NO: 4013918 - RNA, 13 nt, Staphylococcus aureus subsp. aureus MW2
cuuucaacaaaau

SEQ ID NO: 4013919 - RNA, 19 nt, Staphylococcus aureus subsp. aureus MW2
cuuucaaugcauauucuau

SEQ ID NO: 4013920 - RNA, 15 nt, Staphylococcus aureus subsp. aureus MW2
cuuucaauuaauuua

SEQ ID NO: 4013921 - RNA, 16 nt, Staphylococcus aureus subsp. aureus MW2
cuuucaccauuuacuu

SEQ ID NO: 4013922 - RNA, 20 nt, Staphylococcus aureus subsp. aureus MW2
cuuucaccauuuacuucaua

SEQ ID NO: 4013923 - RNA, 16 nt, Staphylococcus aureus subsp. aureus MW2
cuuucacuacauuaaa

SEQ ID NO: 4013924 - RNA, 22 nt, Staphylococcus aureus subsp. aureus MW2
cuuucagcaccagaacaauuca

SEQ ID NO: 4013925 - RNA, 21 nt, Staphylococcus aureus subsp. aureus MW2
cuuucaggcuuuguuuuucac

SEQ ID NO: 4013926 - RNA, 18 nt, Staphylococcus aureus subsp. aureus MW2
cuuucagucguuaaaaua

SEQ ID NO: 4013927 - RNA, 19 nt, Staphylococcus aureus subsp. aureus MW2
cuuucagucguuaaaauac

SEQ ID NO: 4013928 - RNA, 23 nt, Staphylococcus aureus subsp. aureus MW2
cuuucagucguuaaaauaccaaa

SEQ ID NO: 4013929 - RNA, 17 nt, Staphylococcus aureus subsp. aureus MW2
cuuucauacauaacaca

SEQ ID NO: 4013930 - RNA, 20 nt, Staphylococcus aureus subsp. aureus MW2
cuuucauaguuauuaaaucu

SEQ ID NO: 4013931 - RNA, 15 nt, Staphylococcus aureus subsp. aureus MW2
cuuucauuguaaauu

SEQ ID NO: 4013932 - RNA, 22 nt, Staphylococcus aureus subsp. aureus MW2
cuuuccacagcuuguucaauac

SEQ ID NO: 4013933 - RNA, 23 nt, Staphylococcus aureus subsp. aureus MW2
cuuuccacagcuuguucaauacu

SEQ ID NO: 4013934 - RNA, 13 nt, Staphylococcus aureus subsp. aureus MW2
cuuuccgccagcu

SEQ ID NO: 4013935 - RNA, 21 nt, Staphylococcus aureus subsp. aureus MW2
cuuuccgccagucaucaucau

SEQ ID NO: 4013936 - RNA, 13 nt, Staphylococcus aureus subsp. aureus MW2
cuuucgcgacuuc

SEQ ID NO: 4013937 - RNA, 19 nt, Staphylococcus aureus subsp. aureus MW2
cuuucgggcuaguuuuuug

SEQ ID NO: 4013938 - RNA, 14 nt, Staphylococcus aureus subsp. aureus MW2
cuuucguaccugcu

SEQ ID NO: 4013939 - RNA, 12 nt, Staphylococcus aureus subsp. aureus MW2
cuuucuauuaau

SEQ ID NO: 4013940 - RNA, 12 nt, Staphylococcus aureus subsp. aureus MW2
cuuucuauuuau

SEQ ID NO: 4013941 - RNA, 23 nt, Staphylococcus aureus subsp. aureus MW2
cuuucucaaauuagauaaaacaa

SEQ ID NO: 4013942 - RNA, 16 nt, Staphylococcus aureus subsp. aureus MW2
cuuucucaucuauuua

SEQ ID NO: 4013943 - RNA, 18 nt, Staphylococcus aureus subsp. aureus MW2
cuuucucaucuauuuaau

SEQ ID NO: 4013944 - RNA, 23 nt, Staphylococcus aureus subsp. aureus MW2
cuuucucuaaagguaccacugua

SEQ ID NO: 4013945 - RNA, 23 nt, Staphylococcus aureus subsp. aureus MW2
cuuucugaucgacuaauuuuucu

SEQ ID NO: 4013946 - RNA, 11 nt, Staphylococcus aureus subsp. aureus MW2
cuuucuuaauu

SEQ ID NO: 4013947 - RNA, 23 nt, Staphylococcus aureus subsp. aureus MW2
cuuucuucagaaccuugaaugau

SEQ ID NO: 4013948 - RNA, 22 nt, Staphylococcus aureus subsp. aureus MW2
cuuucuugaugaauuaaacuga

SEQ ID NO: 4013949 - RNA, 17 nt, Staphylococcus aureus subsp. aureus MW2
cuuucuuuaucauaucu

SEQ ID NO: 4013950 - RNA, 22 nt, Staphylococcus aureus subsp. aureus MW2
cuuucuuuccgccagucaucau

SEQ ID NO: 4013951 - RNA, 13 nt, Staphylococcus aureus subsp. aureus MW2
cuuucuuuuucau

SEQ ID NO: 4013952 - RNA, 16 nt, Staphylococcus aureus subsp. aureus MW2
cuuucuuuuucaucuu

SEQ ID NO: 4013953 - RNA, 17 nt, Staphylococcus aureus subsp. aureus MW2
cuuucuuuuucaucuuu

SEQ ID NO: 4013954 - RNA, 17 nt, Staphylococcus aureus subsp. aureus MW2
cuuugaaaaauugcuca

SEQ ID NO: 4013955 - RNA, 18 nt, Staphylococcus aureus subsp. aureus MW2
cuuugaaagaaggaauaa

SEQ ID NO: 4013956 - RNA, 21 nt, Staphylococcus aureus subsp. aureus MW2
cuuugaaagaaggaauaauuu

SEQ ID NO: 4013957 - RNA, 22 nt, Staphylococcus aureus subsp. aureus MW2
cuuugaaaggaauguuuaaaaa

SEQ ID NO: 4013958 - RNA, 20 nt, Staphylococcus aureus subsp. aureus MW2
cuuugaacgaaagagaaaag

SEQ ID NO: 4013959 - RNA, 21 nt, Staphylococcus aureus subsp. aureus MW2
cuuugaacgaaagagaaaagc

SEQ ID NO: 4013960 - RNA, 20 nt, Staphylococcus aureus subsp. aureus MW2
cuuugaacgagagagaaaag

SEQ ID NO: 4013961 - RNA, 21 nt, Staphylococcus aureus subsp. aureus MW2
cuuugaacgagagagaaaagc

SEQ ID NO: 4013962 - RNA, 19 nt, Staphylococcus aureus subsp. aureus MW2
cuuugaagggagcauuuca

SEQ ID NO: 4013963 - RNA, 17 nt, Staphylococcus aureus subsp. aureus MW2
cuuugaaggguuuuuuu

SEQ ID NO: 4013964 - RNA, 20 nt, Staphylococcus aureus subsp. aureus MW2
cuuugaauggcucguuuuuu

SEQ ID NO: 4013965 - RNA, 22 nt, Staphylococcus aureus subsp. aureus MW2
cuuugacguuuugguuguucuu

SEQ ID NO: 4013966 - RNA, 20 nt, Staphylococcus aureus subsp. aureus MW2
cuuugauaacaauuuuaaau

SEQ ID NO: 4013967 - RNA, 15 nt, Staphylococcus aureus subsp. aureus MW2
cuuugauaucuacag

SEQ ID NO: 4013968 - RNA, 20 nt, Staphylococcus aureus subsp. aureus MW2
cuuugauauguuuccucuuu

SEQ ID NO: 4013969 - RNA, 19 nt, Staphylococcus aureus subsp. aureus MW2
cuuugaucuuuaaauauac

SEQ ID NO: 4013970 - RNA, 15 nt, Staphylococcus aureus subsp. aureus MW2
cuuugauuucauuug

SEQ ID NO: 4013971 - RNA, 19 nt, Staphylococcus aureus subsp. aureus MW2
cuuugcaauuuuuuaugua

SEQ ID NO: 4013972 - RNA, 20 nt, Staphylococcus aureus subsp. aureus MW2
cuuugccguauuucaaaugu

SEQ ID NO: 4013973 - RNA, 20 nt, Staphylococcus aureus subsp. aureus MW2
cuuugcuaaauauuauaaaa

SEQ ID NO: 4013974 - RNA, 21 nt, Staphylococcus aureus subsp. aureus MW2
cuuugcuaaauauuauaaaaa

SEQ ID NO: 4013975 - RNA, 14 nt, Staphylococcus aureus subsp. aureus MW2
cuuugcuaaaucaa

SEQ ID NO: 4013976 - RNA, 21 nt, Staphylococcus aureus subsp. aureus MW2
cuuugcuuaaaccuuaauaau

SEQ ID NO: 4013977 - RNA, 22 nt, Staphylococcus aureus subsp. aureus MW2
cuuuggaaauuuauuauaaaau

SEQ ID NO: 4013978 - RNA, 18 nt, Staphylococcus aureus subsp. aureus MW2
cuuuggacuuuaaaguua

SEQ ID NO: 4013979 - RNA, 15 nt, Staphylococcus aureus subsp. aureus MW2
cuuuggauuucuuuu

SEQ ID NO: 4013980 - RNA, 18 nt, Staphylococcus aureus subsp. aureus MW2
cuuuggauuucuuuuuaa

SEQ ID NO: 4013981 - RNA, 17 nt, Staphylococcus aureus subsp. aureus MW2
cuuuggcaccaguacuu

SEQ ID NO: 4013982 - RNA, 20 nt, Staphylococcus aureus subsp. aureus MW2
cuuuggcaucauaauuaaau

SEQ ID NO: 4013983 - RNA, 14 nt, Staphylococcus aureus subsp. aureus MW2
cuuuguaaauuuuu

SEQ ID NO: 4013984 - RNA, 17 nt, Staphylococcus aureus subsp. aureus MW2
cuuuguaaguauuuaaa

SEQ ID NO: 4013985 - RNA, 12 nt, Staphylococcus aureus subsp. aureus MW2
cuuuguaauucu

SEQ ID NO: 4013986 - RNA, 18 nt, Staphylococcus aureus subsp. aureus MW2
cuuuguagccuucaacua

SEQ ID NO: 4013987 - RNA, 14 nt, Staphylococcus aureus subsp. aureus MW2
cuuuguguuugcuu

SEQ ID NO: 4013988 - RNA, 13 nt, Staphylococcus aureus subsp. aureus MW2
cuuuguucugcuu

SEQ ID NO: 4013989 - RNA, 18 nt, Staphylococcus aureus subsp. aureus MW2
cuuuguucugcuuuuucu

SEQ ID NO: 4013990 - RNA, 19 nt, Staphylococcus aureus subsp. aureus MW2
cuuuguuguaagguggacu

SEQ ID NO: 4013991 - RNA, 16 nt, Staphylococcus aureus subsp. aureus MW2
cuuuguuuuuaguaau

SEQ ID NO: 4013992 - RNA, 12 nt, Staphylococcus aureus subsp. aureus MW2
cuuuuaaaaaac

SEQ ID NO: 4013993 - RNA, 18 nt, Staphylococcus aureus subsp. aureus MW2
cuuuuaaaccguguucuu

SEQ ID NO: 4013994 - RNA, 15 nt, Staphylococcus aureus subsp. aureus MW2
cuuuuaaaucauuaa

SEQ ID NO: 4013995 - RNA, 21 nt, Staphylococcus aureus subsp. aureus MW2
cuuuuaacugcgccaguuucu

SEQ ID NO: 4013996 - RNA, 16 nt, Staphylococcus aureus subsp. aureus MW2
cuuuuaauaguguuau

SEQ ID NO: 4013997 - RNA, 21 nt, Staphylococcus aureus subsp. aureus MW2
cuuuuaauauuugauaacaaa

SEQ ID NO: 4013998 - RNA, 23 nt, Staphylococcus aureus subsp. aureus MW2
cuuuuaauauuuucauuuuucuu

SEQ ID NO: 4013999 - RNA, 18 nt, Staphylococcus aureus subsp. aureus MW2
cuuuuaauuaauuaucau

SEQ ID NO: 4014000 - RNA, 17 nt, Staphylococcus aureus subsp. aureus MW2
cuuuuacaaacuucaca

SEQ ID NO: 4014001 - RNA, 18 nt, Staphylococcus aureus subsp. aureus MW2
cuuuuacaaacuucacau

SEQ ID NO: 4014002 - RNA, 15 nt, Staphylococcus aureus subsp. aureus MW2
cuuuuacaaucauca

SEQ ID NO: 4014003 - RNA, 21 nt, Staphylococcus aureus subsp. aureus MW2
cuuuuacagaacguucauaua

SEQ ID NO: 4014004 - RNA, 15 nt, Staphylococcus aureus subsp. aureus MW2
cuuuuaguaaauaau

SEQ ID NO: 4014005 - RNA, 13 nt, Staphylococcus aureus subsp. aureus MW2
cuuuuauauuuuu

SEQ ID NO: 4014006 - RNA, 18 nt, Staphylococcus aureus subsp. aureus MW2
cuuuuaugucuaguucuu

SEQ ID NO: 4014007 - RNA, 14 nt, Staphylococcus aureus subsp. aureus MW2
cuuuuauuacuuau

SEQ ID NO: 4014008 - RNA, 19 nt, Staphylococcus aureus subsp. aureus MW2
cuuuuauuacuuauuucuu

SEQ ID NO: 4014009 - RNA, 13 nt, Staphylococcus aureus subsp. aureus MW2
cuuuuauuauuuu

SEQ ID NO: 4014010 - RNA, 14 nt, Staphylococcus aureus subsp. aureus MW2
cuuuuauuuuuaau

SEQ ID NO: 4014011 - RNA, 18 nt, Staphylococcus aureus subsp. aureus MW2
cuuuuauuuuuaauguua

SEQ ID NO: 4014012 - RNA, 17 nt, Staphylococcus aureus subsp. aureus MW2
cuuuucaaacauauuca

SEQ ID NO: 4014013 - RNA, 18 nt, Staphylococcus aureus subsp. aureus MW2
cuuuucaaacauauucau

SEQ ID NO: 4014014 - RNA, 15 nt, Staphylococcus aureus subsp. aureus MW2
cuuuucacaauauac

SEQ ID NO: 4014015 - RNA, 18 nt, Staphylococcus aureus subsp. aureus MW2
cuuuucaucguucauaua

SEQ ID NO: 4014016 - RNA, 14 nt, Staphylococcus aureus subsp. aureus MW2
cuuuucauuuaaug

SEQ ID NO: 4014017 - RNA, 14 nt, Staphylococcus aureus subsp. aureus MW2
cuuuucauuuuuua

SEQ ID NO: 4014018 - RNA, 16 nt, Staphylococcus aureus subsp. aureus MW2
cuuuucauuuuuuaga

SEQ ID NO: 4014019 - RNA, 12 nt, Staphylococcus aureus subsp. aureus MW2
cuuuucgcuuuu

SEQ ID NO: 4014020 - RNA, 15 nt, Staphylococcus aureus subsp. aureus MW2
cuuuucuaauuuuuc

SEQ ID NO: 4014021 - RNA, 16 nt, Staphylococcus aureus subsp. aureus MW2
cuuuucuaauuuuucu

SEQ ID NO: 4014022 - RNA, 21 nt, Staphylococcus aureus subsp. aureus MW2
cuuuucuugaaauaaacauau

SEQ ID NO: 4014023 - RNA, 13 nt, Staphylococcus aureus subsp. aureus MW2
cuuuugcaccuuc

SEQ ID NO: 4014024 - RNA, 19 nt, Staphylococcus aureus subsp. aureus MW2
cuuuuguaauugaaaugau

SEQ ID NO: 4014025 - RNA, 16 nt, Staphylococcus aureus subsp. aureus MW2
cuuuuguaccaucaau

SEQ ID NO: 4014026 - RNA, 20 nt, Staphylococcus aureus subsp. aureus MW2
cuuuuguguuugcccugcug

SEQ ID NO: 4014027 - RNA, 22 nt, Staphylococcus aureus subsp. aureus MW2
cuuuuguuaauauugguuauau

SEQ ID NO: 4014028 - RNA, 15 nt, Staphylococcus aureus subsp. aureus MW2
cuuuuguuuuaccau

SEQ ID NO: 4014029 - RNA, 12 nt, Staphylococcus aureus subsp. aureus MW2
cuuuuuaaaaaa

SEQ ID NO: 4014030 - RNA, 15 nt, Staphylococcus aureus subsp. aureus MW2
cuuuuuaaaaaauuu

SEQ ID NO: 4014031 - RNA, 15 nt, Staphylococcus aureus subsp. aureus MW2
cuuuuuaaaaucguu

SEQ ID NO: 4014032 - RNA, 16 nt, Staphylococcus aureus subsp. aureus MW2
cuuuuuaaaaucguua

SEQ ID NO: 4014033 - RNA, 21 nt, Staphylococcus aureus subsp. aureus MW2
cuuuuuaaaaucguuaaggaa

SEQ ID NO: 4014034 - RNA, 12 nt, Staphylococcus aureus subsp. aureus MW2
cuuuuuaaagua

SEQ ID NO: 4014035 - RNA, 14 nt, Staphylococcus aureus subsp. aureus MW2
cuuuuuaaaugauu

SEQ ID NO: 4014036 - RNA, 15 nt, Staphylococcus aureus subsp. aureus MW2
cuuuuuaauauuuuu

SEQ ID NO: 4014037 - RNA, 21 nt, Staphylococcus aureus subsp. aureus MW2
cuuuuuacuaggaauauaaaa

SEQ ID NO: 4014038 - RNA, 16 nt, Staphylococcus aureus subsp. aureus MW2
cuuuuuagcauauucu

SEQ ID NO: 4014039 - RNA, 21 nt, Staphylococcus aureus subsp. aureus MW2
cuuuuuaggaaugauagauuu

SEQ ID NO: 4014040 - RNA, 13 nt, Staphylococcus aureus subsp. aureus MW2
cuuuuuauauaau

SEQ ID NO: 4014041 - RNA, 23 nt, Staphylococcus aureus subsp. aureus MW2
cuuuuuauuguaauaaagaaggg

SEQ ID NO: 4014042 - RNA, 21 nt, Staphylococcus aureus subsp. aureus MW2
cuuuuuauuuuaauauuuucu

SEQ ID NO: 4014043 - RNA, 13 nt, Staphylococcus aureus subsp. aureus MW2
cuuuuuauuuuau

SEQ ID NO: 4014044 - RNA, 15 nt, Staphylococcus aureus subsp. aureus MW2
cuuuuucacauugcc

SEQ ID NO: 4014045 - RNA, 19 nt, Staphylococcus aureus subsp. aureus MW2
cuuuuucacgauuuuuaaa

SEQ ID NO: 4014046 - RNA, 21 nt, Staphylococcus aureus subsp. aureus MW2
cuuuuucauaaauauuuaaaa

SEQ ID NO: 4014047 - RNA, 15 nt, Staphylococcus aureus subsp. aureus MW2
cuuuuucauagaaca

SEQ ID NO: 4014048 - RNA, 21 nt, Staphylococcus aureus subsp. aureus MW2
cuuuuucauagaacaaaaugu

SEQ ID NO: 4014049 - RNA, 22 nt, Staphylococcus aureus subsp. aureus MW2
cuuuuucgauuaauucuucuuc

SEQ ID NO: 4014050 - RNA, 23 nt, Staphylococcus aureus subsp. aureus MW2
cuuuuucgauuaauucuucuuca

SEQ ID NO: 4014051 - RNA, 17 nt, Staphylococcus aureus subsp. aureus MW2
cuuuuucuauacaauga

SEQ ID NO: 4014052 - RNA, 22 nt, Staphylococcus aureus subsp. aureus MW2
cuuuuugacauauuuuuuaaau

SEQ ID NO: 4014053 - RNA, 20 nt, Staphylococcus aureus subsp. aureus MW2
cuuuuugauuaaaguugauu

SEQ ID NO: 4014054 - RNA, 17 nt, Staphylococcus aureus subsp. aureus MW2
cuuuuugcguuuuuaaa

SEQ ID NO: 4014055 - RNA, 21 nt, Staphylococcus aureus subsp. aureus MW2
cuuuuugcguuuuuaaauaau

SEQ ID NO: 4014056 - RNA, 15 nt, Staphylococcus aureus subsp. aureus MW2
cuuuuugcuuaguac

SEQ ID NO: 4014057 - RNA, 22 nt, Staphylococcus aureus subsp. aureus MW2
cuuuuugggagugggacagaaa

SEQ ID NO: 4014058 - RNA, 20 nt, Staphylococcus aureus subsp. aureus MW2
cuuuuugucucucaacauuu

SEQ ID NO: 4014059 - RNA, 15 nt, Staphylococcus aureus subsp. aureus MW2
cuuuuuguguaucug

SEQ ID NO: 4014060 - RNA, 18 nt, Staphylococcus aureus subsp. aureus MW2
cuuuuuguuaauuuuuua

SEQ ID NO: 4014061 - RNA, 17 nt, Staphylococcus aureus subsp. aureus MW2
cuuuuuguuuugaaugu

SEQ ID NO: 4014062 - RNA, 14 nt, Staphylococcus aureus subsp. aureus MW2
cuuuuuuaacuuua

SEQ ID NO: 4014063 - RNA, 17 nt, Staphylococcus aureus subsp. aureus MW2
cuuuuuuaagcuuauca

SEQ ID NO: 4014064 - RNA, 12 nt, Staphylococcus aureus subsp. aureus MW2
cuuuuuuaaguu

SEQ ID NO: 4014065 - RNA, 19 nt, Staphylococcus aureus subsp. aureus MW2
cuuuuuuaccagcaugaau

SEQ ID NO: 4014066 - RNA, 20 nt, Staphylococcus aureus subsp. aureus MW2
cuuuuuuauuuuauaagaau

SEQ ID NO: 4014067 - RNA, 13 nt, Staphylococcus aureus subsp. aureus MW2
cuuuuuugugauu

SEQ ID NO: 4014068 - RNA, 17 nt, Staphylococcus aureus subsp. aureus MW2
cuuuuuuuauaaguauu

SEQ ID NO: 4014069 - RNA, 15 nt, Staphylococcus aureus subsp. aureus MW2
cuuuuuuuaugaaaa

SEQ ID NO: 4014070 - RNA, 17 nt, Staphylococcus aureus subsp. aureus MW2
cuuuuuuuaugaaaaga

SEQ ID NO: 4014071 - RNA, 13 nt, Staphylococcus aureus subsp. aureus MW2
cuuuuuuuuauaa

SEQ ID NO: 4014072 - RNA, 20 nt, Staphylococcus aureus subsp. aureus MW2
gaaaaaaucggacagcugaa

SEQ ID NO: 4014073 - RNA, 22 nt, Staphylococcus aureus subsp. aureus MW2
gaaaaaauuaauaauuuuccau

SEQ ID NO: 4014074 - RNA, 12 nt, Staphylococcus aureus subsp. aureus MW2
gaaaaaccaagu

SEQ ID NO: 4014075 - RNA, 19 nt, Staphylococcus aureus subsp. aureus MW2
gaaaaaccaaguuuugcac

SEQ ID NO: 4014076 - RNA, 20 nt, Staphylococcus aureus subsp. aureus MW2
gaaaaagugauaauuaaaau

SEQ ID NO: 4014077 - RNA, 18 nt, Staphylococcus aureus subsp. aureus MW2
gaaaaauuucaaaaauag

SEQ ID NO: 4014078 - RNA, 11 nt, Staphylococcus aureus subsp. aureus MW2
gaaaacaauaa

SEQ ID NO: 4014079 - RNA, 14 nt, Staphylococcus aureus subsp. aureus MW2
gaaaacagguggaa

SEQ ID NO: 4014080 - RNA, 23 nt, Staphylococcus aureus subsp. aureus MW2
gaaaacagguuaucacaacagua

SEQ ID NO: 4014081 - RNA, 17 nt, Staphylococcus aureus subsp. aureus MW2
gaaaacuucaauaaugu

SEQ ID NO: 4014082 - RNA, 23 nt, Staphylococcus aureus subsp. aureus MW2
gaaaagagggaccuuacuacuca

SEQ ID NO: 4014083 - RNA, 18 nt, Staphylococcus aureus subsp. aureus MW2
gaaaagcuagaaguucuu

SEQ ID NO: 4014084 - RNA, 20 nt, Staphylococcus aureus subsp. aureus MW2
gaaaagggaauggauuacag

SEQ ID NO: 4014085 - RNA, 15 nt, Staphylococcus aureus subsp. aureus MW2
gaaaaguauaugaau

SEQ ID NO: 4014086 - RNA, 13 nt, Staphylococcus aureus subsp. aureus MW2
gaaaagucagcuu

SEQ ID NO: 4014087 - RNA, 17 nt, Staphylococcus aureus subsp. aureus MW2
gaaaagucagcuuacaa

SEQ ID NO: 4014088 - RNA, 19 nt, Staphylococcus aureus subsp. aureus MW2
gaaaagucagcuuacaaua

SEQ ID NO: 4014089 - RNA, 21 nt, Staphylococcus aureus subsp. aureus MW2
gaaaagucagcuuacaauaau

SEQ ID NO: 4014090 - RNA, 18 nt, Staphylococcus aureus subsp. aureus MW2
gaaaagugaaaacuucuc

SEQ ID NO: 4014091 - RNA, 22 nt, Staphylococcus aureus subsp. aureus MW2
gaaaaguuuuuuacuuuucauc

SEQ ID NO: 4014092 - RNA, 14 nt, Staphylococcus aureus subsp. aureus MW2
gaaaauaaaaacca

SEQ ID NO: 4014093 - RNA, 20 nt, Staphylococcus aureus subsp. aureus MW2
gaaaauaaccauucacuuau

SEQ ID NO: 4014094 - RNA, 20 nt, Staphylococcus aureus subsp. aureus MW2
gaaaauaaucgaacagaaaa

SEQ ID NO: 4014095 - RNA, 21 nt, Staphylococcus aureus subsp. aureus MW2
gaaaauaaucgaacagaaaau

SEQ ID NO: 4014096 - RNA, 18 nt, Staphylococcus aureus subsp. aureus MW2
gaaaauaccaacugcaaa

SEQ ID NO: 4014097 - RNA, 17 nt, Staphylococcus aureus subsp. aureus MW2
gaaaauagccauaucau

SEQ ID NO: 4014098 - RNA, 19 nt, Staphylococcus aureus subsp. aureus MW2
gaaaauagcuauuaaaaua

SEQ ID NO: 4014099 - RNA, 21 nt, Staphylococcus aureus subsp. aureus MW2
gaaaauagcuauuaaaauaga

SEQ ID NO: 4014100 - RNA, 15 nt, Staphylococcus aureus subsp. aureus MW2
gaaaauaucauuucu

SEQ ID NO: 4014101 - RNA, 13 nt, Staphylococcus aureus subsp. aureus MW2
gaaaauaugauaa

SEQ ID NO: 4014102 - RNA, 15 nt, Staphylococcus aureus subsp. aureus MW2
gaaaauaugauaacu

SEQ ID NO: 4014103 - RNA, 22 nt, Staphylococcus aureus subsp. aureus MW2
gaaaaugcgcuuguaacaagcu

SEQ ID NO: 4014104 - RNA, 21 nt, Staphylococcus aureus subsp. aureus MW2
gaaaauuauuugauauuucau

SEQ ID NO: 4014105 - RNA, 18 nt, Staphylococcus aureus subsp. aureus MW2
gaaaauugaguauauuca

SEQ ID NO: 4014106 - RNA, 13 nt, Staphylococcus aureus subsp. aureus MW2
gaaaauuucucac

SEQ ID NO: 4014107 - RNA, 19 nt, Staphylococcus aureus subsp. aureus MW2
gaaacaaaacaaaaaauau

SEQ ID NO: 4014108 - RNA, 21 nt, Staphylococcus aureus subsp. aureus MW2
gaaacaagaaguuuccaacgu

SEQ ID NO: 4014109 - RNA, 22 nt, Staphylococcus aureus subsp. aureus MW2
gaaacaauucauuaauaggauu

SEQ ID NO: 4014110 - RNA, 15 nt, Staphylococcus aureus subsp. aureus MW2
gaaacaucuugauau

SEQ ID NO: 4014111 - RNA, 17 nt, Staphylococcus aureus subsp. aureus MW2
gaaacaugauugaaauc

SEQ ID NO: 4014112 - RNA, 14 nt, Staphylococcus aureus subsp. aureus MW2
gaaacauuaaaaua

SEQ ID NO: 4014113 - RNA, 21 nt, Staphylococcus aureus subsp. aureus MW2
gaaaccgcuucucgccuaauu

SEQ ID NO: 4014114 - RNA, 14 nt, Staphylococcus aureus subsp. aureus MW2
gaaaccuuaaaauc

SEQ ID NO: 4014115 - RNA, 21 nt, Staphylococcus aureus subsp. aureus MW2
gaaaccuuucgauaaacuaca

SEQ ID NO: 4014116 - RNA, 14 nt, Staphylococcus aureus subsp. aureus MW2
gaaacuuaaauauu

SEQ ID NO: 4014117 - RNA, 14 nt, Staphylococcus aureus subsp. aureus MW2
gaaacuuuaauacu

SEQ ID NO: 4014118 - RNA, 15 nt, Staphylococcus aureus subsp. aureus MW2
gaaacuuuaauacua

SEQ ID NO: 4014119 - RNA, 17 nt, Staphylococcus aureus subsp. aureus MW2
gaaagaugauauauuca

SEQ ID NO: 4014120 - RNA, 18 nt, Staphylococcus aureus subsp. aureus MW2
gaaagcaccuaaaauaga

SEQ ID NO: 4014121 - RNA, 17 nt, Staphylococcus aureus subsp. aureus MW2
gaaagccauuaaaccaa

SEQ ID NO: 4014122 - RNA, 21 nt, Staphylococcus aureus subsp. aureus MW2
gaaagcuaauaucaauaaugc

SEQ ID NO: 4014123 - RNA, 16 nt, Staphylococcus aureus subsp. aureus MW2
gaaagcuuuaacuuga

SEQ ID NO: 4014124 - RNA, 20 nt, Staphylococcus aureus subsp. aureus MW2
gaaagggguuugacaaagcu

SEQ ID NO: 4014125 - RNA, 23 nt, Staphylococcus aureus subsp. aureus MW2
gaaaguaauaaguaauaauuuau

SEQ ID NO: 4014126 - RNA, 20 nt, Staphylococcus aureus subsp. aureus MW2
gaaagucagcauacaauaau

SEQ ID NO: 4014127 - RNA, 15 nt, Staphylococcus aureus subsp. aureus MW2
gaaagucagcuuaca

SEQ ID NO: 4014128 - RNA, 22 nt, Staphylococcus aureus subsp. aureus MW2
gaaagucagcuuacaauaaugu

SEQ ID NO: 4014129 - RNA, 20 nt, Staphylococcus aureus subsp. aureus MW2
gaaagucagguuacaauaau

SEQ ID NO: 4014130 - RNA, 22 nt, Staphylococcus aureus subsp. aureus MW2
gaaagucagguuacaauaaugu

SEQ ID NO: 4014131 - RNA, 22 nt, Staphylococcus aureus subsp. aureus MW2
gaaaguugguuuuauuaauucu

SEQ ID NO: 4014132 - RNA, 19 nt, Staphylococcus aureus subsp. aureus MW2
gaaaguuucgacguaccaa

SEQ ID NO: 4014133 - RNA, 15 nt, Staphylococcus aureus subsp. aureus MW2
gaaauaaacauauca

SEQ ID NO: 4014134 - RNA, 16 nt, Staphylococcus aureus subsp. aureus MW2
gaaauaaacauaucau

SEQ ID NO: 4014135 - RNA, 18 nt, Staphylococcus aureus subsp. aureus MW2
gaaauaaacauaucauca

SEQ ID NO: 4014136 - RNA, 13 nt, Staphylococcus aureus subsp. aureus MW2
gaaauaaauuuug

SEQ ID NO: 4014137 - RNA, 18 nt, Staphylococcus aureus subsp. aureus MW2
gaaauaaauuuugagaaa

SEQ ID NO: 4014138 - RNA, 20 nt, Staphylococcus aureus subsp. aureus MW2
gaaauaaauuuugagaaaau

SEQ ID NO: 4014139 - RNA, 21 nt, Staphylococcus aureus subsp. aureus MW2
gaaauaaauuuugagaaaaua

SEQ ID NO: 4014140 - RNA, 12 nt, Staphylococcus aureus subsp. aureus MW2
gaaauaauaacg

SEQ ID NO: 4014141 - RNA, 15 nt, Staphylococcus aureus subsp. aureus MW2
gaaauaauauuaacg

SEQ ID NO: 4014142 - RNA, 16 nt, Staphylococcus aureus subsp. aureus MW2
gaaauaccuccugauu

SEQ ID NO: 4014143 - RNA, 16 nt, Staphylococcus aureus subsp. aureus MW2
gaaauacuugaaugua

SEQ ID NO: 4014144 - RNA, 21 nt, Staphylococcus aureus subsp. aureus MW2
gaaauagguaucuuaaagcau

SEQ ID NO: 4014145 - RNA, 18 nt, Staphylococcus aureus subsp. aureus MW2
gaaauaggugcuuguaaa

SEQ ID NO: 4014146 - RNA, 15 nt, Staphylococcus aureus subsp. aureus MW2
gaaauauaguaacag

SEQ ID NO: 4014147 - RNA, 15 nt, Staphylococcus aureus subsp. aureus MW2
gaaauaucaagaugu

SEQ ID NO: 4014148 - RNA, 16 nt, Staphylococcus aureus subsp. aureus MW2
gaaauaugaaaagaga

SEQ ID NO: 4014149 - RNA, 17 nt, Staphylococcus aureus subsp. aureus MW2
gaaauauuguaaucacu

SEQ ID NO: 4014150 - RNA, 18 nt, Staphylococcus aureus subsp. aureus MW2
gaaaucagcuuuucuuca

SEQ ID NO: 4014151 - RNA, 22 nt, Staphylococcus aureus subsp. aureus MW2
gaaaucagcuuuucuucaacua

SEQ ID NO: 4014152 - RNA, 16 nt, Staphylococcus aureus subsp. aureus MW2
gaaaucaguaauauca

SEQ ID NO: 4014153 - RNA, 20 nt, Staphylococcus aureus subsp. aureus MW2
gaaaucaguuuuugaauauu

SEQ ID NO: 4014154 - RNA, 11 nt, Staphylococcus aureus subsp. aureus MW2
gaaaucuauug

SEQ ID NO: 4014155 - RNA, 18 nt, Staphylococcus aureus subsp. aureus MW2
gaaaucucggcauuuuua

SEQ ID NO: 4014156 - RNA, 20 nt, Staphylococcus aureus subsp. aureus MW2
gaaaugauaagaaucaucua

SEQ ID NO: 4014157 - RNA, 13 nt, Staphylococcus aureus subsp. aureus MW2
gaaaugauaauuu

SEQ ID NO: 4014158 - RNA, 13 nt, Staphylococcus aureus subsp. aureus MW2
gaaaugcauugag

SEQ ID NO: 4014159 - RNA, 13 nt, Staphylococcus aureus subsp. aureus MW2
gaaauggaaagua

SEQ ID NO: 4014160 - RNA, 21 nt, Staphylococcus aureus subsp. aureus MW2
gaaaugguaucuaaaugugaa

SEQ ID NO: 4014161 - RNA, 14 nt, Staphylococcus aureus subsp. aureus MW2
gaaauguuuauaau

SEQ ID NO: 4014162 - RNA, 18 nt, Staphylococcus aureus subsp. aureus MW2
gaaauguuuauaauaaua

SEQ ID NO: 4014163 - RNA, 16 nt, Staphylococcus aureus subsp. aureus MW2
gaaauguuuuggaaaa

SEQ ID NO: 4014164 - RNA, 18 nt, Staphylococcus aureus subsp. aureus MW2
gaaauguuuuggaaaaau

SEQ ID NO: 4014165 - RNA, 16 nt, Staphylococcus aureus subsp. aureus MW2
gaaauuaaaucuacaa

SEQ ID NO: 4014166 - RNA, 13 nt, Staphylococcus aureus subsp. aureus MW2
gaaauuaaauuca

SEQ ID NO: 4014167 - RNA, 17 nt, Staphylococcus aureus subsp. aureus MW2
gaaauuagaaccaucau

SEQ ID NO: 4014168 - RNA, 20 nt, Staphylococcus aureus subsp. aureus MW2
gaaauuagaaccaucauuua

SEQ ID NO: 4014169 - RNA, 20 nt, Staphylococcus aureus subsp. aureus MW2
gaaauuauacgagaauauga

SEQ ID NO: 4014170 - RNA, 20 nt, Staphylococcus aureus subsp. aureus MW2
gaaauucucuguguuggggc

SEQ ID NO: 4014171 - RNA, 20 nt, Staphylococcus aureus subsp. aureus MW2
gaaauucuuuauguuggggc

SEQ ID NO: 4014172 - RNA, 17 nt, Staphylococcus aureus subsp. aureus MW2
gaaauuguaguauuuuu

SEQ ID NO: 4014173 - RNA, 21 nt, Staphylococcus aureus subsp. aureus MW2
gaaauuguguugaaucaacag

SEQ ID NO: 4014174 - RNA, 18 nt, Staphylococcus aureus subsp. aureus MW2
gaaauuguguuucuuuua

SEQ ID NO: 4014175 - RNA, 15 nt, Staphylococcus aureus subsp. aureus MW2
gaaauuguucuaaua

SEQ ID NO: 4014176 - RNA, 13 nt, Staphylococcus aureus subsp. aureus MW2
gaaauuuauuaua

SEQ ID NO: 4014177 - RNA, 16 nt, Staphylococcus aureus subsp. aureus MW2
gaaauuucgacaucua

SEQ ID NO: 4014178 - RNA, 16 nt, Staphylococcus aureus subsp. aureus MW2
gaaauuugauuuucaa

SEQ ID NO: 4014179 - RNA, 14 nt, Staphylococcus aureus subsp. aureus MW2
gaacaaaauguagg

SEQ ID NO: 4014180 - RNA, 16 nt, Staphylococcus aureus subsp. aureus MW2
gaacaacaaauuuuga

SEQ ID NO: 4014181 - RNA, 16 nt, Staphylococcus aureus subsp. aureus MW2
gaacaacauuaggaug

SEQ ID NO: 4014182 - RNA, 16 nt, Staphylococcus aureus subsp. aureus MW2
gaacaagucuugcaau

SEQ ID NO: 4014183 - RNA, 13 nt, Staphylococcus aureus subsp. aureus MW2
gaacaauaauaug

SEQ ID NO: 4014184 - RNA, 23 nt, Staphylococcus aureus subsp. aureus MW2
gaacaaucggaagcauauuucua

SEQ ID NO: 4014185 - RNA, 12 nt, Staphylococcus aureus subsp. aureus MW2
gaacaaugguua

SEQ ID NO: 4014186 - RNA, 21 nt, Staphylococcus aureus subsp. aureus MW2
gaacagauauacuacuuguuu

SEQ ID NO: 4014187 - RNA, 19 nt, Staphylococcus aureus subsp. aureus MW2
gaacagcaucuuguucuuc

SEQ ID NO: 4014188 - RNA, 17 nt, Staphylococcus aureus subsp. aureus MW2
gaacauagucugcuauu

SEQ ID NO: 4014189 - RNA, 15 nt, Staphylococcus aureus subsp. aureus MW2
gaacauauuauaaaa

SEQ ID NO: 4014190 - RNA, 14 nt, Staphylococcus aureus subsp. aureus MW2
gaacaucuaguuau

SEQ ID NO: 4014191 - RNA, 24 nt, Staphylococcus aureus subsp. aureus MW2
gaacaucucuucuggagccucuug

SEQ ID NO: 4014192 - RNA, 16 nt, Staphylococcus aureus subsp. aureus MW2
gaacaucugaaaaaau

SEQ ID NO: 4014193 - RNA, 14 nt, Staphylococcus aureus subsp. aureus MW2
gaaccaacaauaaa

SEQ ID NO: 4014194 - RNA, 18 nt, Staphylococcus aureus subsp. aureus MW2
gaaccauuuccgaauaaa

SEQ ID NO: 4014195 - RNA, 17 nt, Staphylococcus aureus subsp. aureus MW2
gaacccaggugcaucuu

SEQ ID NO: 4014196 - RNA, 17 nt, Staphylococcus aureus subsp. aureus MW2
gaacccuguuaagcuac

SEQ ID NO: 4014197 - RNA, 18 nt, Staphylococcus aureus subsp. aureus MW2
gaaccguaacuauaugaa

SEQ ID NO: 4014198 - RNA, 17 nt, Staphylococcus aureus subsp. aureus MW2
gaaccuauauuaagcau

SEQ ID NO: 4014199 - RNA, 21 nt, Staphylococcus aureus subsp. aureus MW2
gaaccuauuuuuuauaugaug

SEQ ID NO: 4014200 - RNA, 16 nt, Staphylococcus aureus subsp. aureus MW2
gaacgaaagagaaaag

SEQ ID NO: 4014201 - RNA, 18 nt, Staphylococcus aureus subsp. aureus MW2
gaacgagagagaaaagcu

SEQ ID NO: 4014202 - RNA, 21 nt, Staphylococcus aureus subsp. aureus MW2
gaacgagagagaaaagcuaga

SEQ ID NO: 4014203 - RNA, 20 nt, Staphylococcus aureus subsp. aureus MW2
gaacgauauuuuaaaaagua

SEQ ID NO: 4014204 - RNA, 19 nt, Staphylococcus aureus subsp. aureus MW2
gaacgcaagcauaucuuua

SEQ ID NO: 4014205 - RNA, 18 nt, Staphylococcus aureus subsp. aureus MW2
gaacguguuugaauggca

SEQ ID NO: 4014206 - RNA, 19 nt, Staphylococcus aureus subsp. aureus MW2
gaacuacgcauuuuaaaua

SEQ ID NO: 4014207 - RNA, 20 nt, Staphylococcus aureus subsp. aureus MW2
gaacugccaauauaacauuu

SEQ ID NO: 4014208 - RNA, 21 nt, Staphylococcus aureus subsp. aureus MW2
gaacuuacaagucuaguucga

SEQ ID NO: 4014209 - RNA, 19 nt, Staphylococcus aureus subsp. aureus MW2
gaacuuauaagucugauuu

SEQ ID NO: 4014210 - RNA, 23 nt, Staphylococcus aureus subsp. aureus MW2
gaacuuauaagucugauuugaua

SEQ ID NO: 4014211 - RNA, 14 nt, Staphylococcus aureus subsp. aureus MW2
gaacuucucuuuga

SEQ ID NO: 4014212 - RNA, 19 nt, Staphylococcus aureus subsp. aureus MW2
gaacuucuuuuuuguaucu

SEQ ID NO: 4014213 - RNA, 20 nt, Staphylococcus aureus subsp. aureus MW2
gaacuuuuauuuuuuauaaa

SEQ ID NO: 4014214 - RNA, 14 nt, Staphylococcus aureus subsp. aureus MW2
gaagaaaucaucga

SEQ ID NO: 4014215 - RNA, 14 nt, Staphylococcus aureus subsp. aureus MW2
gaagaauacaaaua

SEQ ID NO: 4014216 - RNA, 15 nt, Staphylococcus aureus subsp. aureus MW2
gaagaauacaaauau

SEQ ID NO: 4014217 - RNA, 15 nt, Staphylococcus aureus subsp. aureus MW2
gaagaauauaaacua

SEQ ID NO: 4014218 - RNA, 15 nt, Staphylococcus aureus subsp. aureus MW2
gaagaaugauacugu

SEQ ID NO: 4014219 - RNA, 13 nt, Staphylococcus aureus subsp. aureus MW2
gaagaccauuuua

SEQ ID NO: 4014220 - RNA, 19 nt, Staphylococcus aureus subsp. aureus MW2
gaagauuagaugauauuua

SEQ ID NO: 4014221 - RNA, 18 nt, Staphylococcus aureus subsp. aureus MW2
gaagcaaaagaugaaaau

SEQ ID NO: 4014222 - RNA, 15 nt, Staphylococcus aureus subsp. aureus MW2
gaagcacagaaaauu

SEQ ID NO: 4014223 - RNA, 22 nt, Staphylococcus aureus subsp. aureus MW2
gaagcgcuuggauuuuuugguu

SEQ ID NO: 4014224 - RNA, 15 nt, Staphylococcus aureus subsp. aureus MW2
gaagcggguugaagc

SEQ ID NO: 4014225 - RNA, 16 nt, Staphylococcus aureus subsp. aureus MW2
gaagcggguugaagca

SEQ ID NO: 4014226 - RNA, 16 nt, Staphylococcus aureus subsp. aureus MW2
gaagcuaaguauauaa

SEQ ID NO: 4014227 - RNA, 22 nt, Staphylococcus aureus subsp. aureus MW2
gaagcugacgaaaagucagcuu

SEQ ID NO: 4014228 - RNA, 20 nt, Staphylococcus aureus subsp. aureus MW2
gaagcuggcggaaagucagc

SEQ ID NO: 4014229 - RNA, 21 nt, Staphylococcus aureus subsp. aureus MW2
gaagcuggcggaaagucagcu

SEQ ID NO: 4014230 - RNA, 22 nt, Staphylococcus aureus subsp. aureus MW2
gaagcuggcggaaagucagcuu

SEQ ID NO: 4014231 - RNA, 20 nt, Staphylococcus aureus subsp. aureus MW2
gaaggucuacuaaauaacua

SEQ ID NO: 4014232 - RNA, 19 nt, Staphylococcus aureus subsp. aureus MW2
gaaguaaugugcauugcuu

SEQ ID NO: 4014233 - RNA, 21 nt, Staphylococcus aureus subsp. aureus MW2
gaaguaggcugaaguugaagc

SEQ ID NO: 4014234 - RNA, 16 nt, Staphylococcus aureus subsp. aureus MW2
gaaguauuuuccuuca

SEQ ID NO: 4014235 - RNA, 22 nt, Staphylococcus aureus subsp. aureus MW2
gaagucuugugauaauucuuca

SEQ ID NO: 4014236 - RNA, 19 nt, Staphylococcus aureus subsp. aureus MW2
gaagucuuucaacaaaaug

SEQ ID NO: 4014237 - RNA, 14 nt, Staphylococcus aureus subsp. aureus MW2
gaagugcuuaugaa

SEQ ID NO: 4014238 - RNA, 15 nt, Staphylococcus aureus subsp. aureus MW2
gaaguuacguucuaa

SEQ ID NO: 4014239 - RNA, 12 nt, Staphylococcus aureus subsp. aureus MW2
gaaguuguuucu

SEQ ID NO: 4014240 - RNA, 14 nt, Staphylococcus aureus subsp. aureus MW2
gaauaaaaaaacac

SEQ ID NO: 4014241 - RNA, 13 nt, Staphylococcus aureus subsp. aureus MW2
gaauaaaauauau

SEQ ID NO: 4014242 - RNA, 18 nt, Staphylococcus aureus subsp. aureus MW2
gaauaaauaauuuagaaa

SEQ ID NO: 4014243 - RNA, 13 nt, Staphylococcus aureus subsp. aureus MW2
gaauaaauugaua

SEQ ID NO: 4014244 - RNA, 21 nt, Staphylococcus aureus subsp. aureus MW2
gaauaaauuuugcgaaaauau

SEQ ID NO: 4014245 - RNA, 15 nt, Staphylococcus aureus subsp. aureus MW2
gaauaacgucauaug

SEQ ID NO: 4014246 - RNA, 19 nt, Staphylococcus aureus subsp. aureus MW2
gaauaauaaacuuaaaaga

SEQ ID NO: 4014247 - RNA, 20 nt, Staphylococcus aureus subsp. aureus MW2
gaauaauaaacuuaaaagag

SEQ ID NO: 4014248 - RNA, 21 nt, Staphylococcus aureus subsp. aureus MW2
gaauaauaaacuuaaaagaga

SEQ ID NO: 4014249 - RNA, 12 nt, Staphylococcus aureus subsp. aureus MW2
gaauaauauauu

SEQ ID NO: 4014250 - RNA, 13 nt, Staphylococcus aureus subsp. aureus MW2
gaauaauauauuu

SEQ ID NO: 4014251 - RNA, 18 nt, Staphylococcus aureus subsp. aureus MW2
gaauaauguuuucauugg

SEQ ID NO: 4014252 - RNA, 18 nt, Staphylococcus aureus subsp. aureus MW2
gaauaauuacuaaaauau

SEQ ID NO: 4014253 - RNA, 14 nt, Staphylococcus aureus subsp. aureus MW2
gaauaauugagaaa

SEQ ID NO: 4014254 - RNA, 20 nt, Staphylococcus aureus subsp. aureus MW2
gaauaauugagaaaaagguu

SEQ ID NO: 4014255 - RNA, 15 nt, Staphylococcus aureus subsp. aureus MW2
gaauacaaauauuaa

SEQ ID NO: 4014256 - RNA, 14 nt, Staphylococcus aureus subsp. aureus MW2
gaauacuaaaagug

SEQ ID NO: 4014257 - RNA, 15 nt, Staphylococcus aureus subsp. aureus MW2
gaauacuaaaagugu

SEQ ID NO: 4014258 - RNA, 20 nt, Staphylococcus aureus subsp. aureus MW2
gaauacucuuuaaucuacca

SEQ ID NO: 4014259 - RNA, 17 nt, Staphylococcus aureus subsp. aureus MW2
gaauacuuuauuugaua

SEQ ID NO: 4014260 - RNA, 20 nt, Staphylococcus aureus subsp. aureus MW2
gaauagacauuguuaaacua

SEQ ID NO: 4014261 - RNA, 16 nt, Staphylococcus aureus subsp. aureus MW2
gaauauaaaauaaugc

SEQ ID NO: 4014262 - RNA, 12 nt, Staphylococcus aureus subsp. aureus MW2
gaauauaaauga

SEQ ID NO: 4014263 - RNA, 22 nt, Staphylococcus aureus subsp. aureus MW2
gaauauaaguaaucauaauaau

SEQ ID NO: 4014264 - RNA, 20 nt, Staphylococcus aureus subsp. aureus MW2
gaauauacuaaaguucaaca

SEQ ID NO: 4014265 - RNA, 23 nt, Staphylococcus aureus subsp. aureus MW2
gaauauagauuuuguauuagcau

SEQ ID NO: 4014266 - RNA, 17 nt, Staphylococcus aureus subsp. aureus MW2
gaauauagcugugauuu

SEQ ID NO: 4014267 - RNA, 18 nt, Staphylococcus aureus subsp. aureus MW2
gaauaucuuaaagaauua

SEQ ID NO: 4014268 - RNA, 23 nt, Staphylococcus aureus subsp. aureus MW2
gaauauuaacguuaguauaaacg

SEQ ID NO: 4014269 - RNA, 23 nt, Staphylococcus aureus subsp. aureus MW2
gaauauuuauuguuuuuaaaauc

SEQ ID NO: 4014270 - RNA, 23 nt, Staphylococcus aureus subsp. aureus MW2
gaauauuucccuaugaaauaacu

SEQ ID NO: 4014271 - RNA, 23 nt, Staphylococcus aureus subsp. aureus MW2
gaauauuugcuuuuuguguaucu

SEQ ID NO: 4014272 - RNA, 19 nt, Staphylococcus aureus subsp. aureus MW2
gaaucaacaauauaaaagc

SEQ ID NO: 4014273 - RNA, 22 nt, Staphylococcus aureus subsp. aureus MW2
gaaucaacaauauaaaagcacu

SEQ ID NO: 4014274 - RNA, 18 nt, Staphylococcus aureus subsp. aureus MW2
gaaucaauugcauacgua

SEQ ID NO: 4014275 - RNA, 19 nt, Staphylococcus aureus subsp. aureus MW2
gaaucacaguuauauauua

SEQ ID NO: 4014276 - RNA, 23 nt, Staphylococcus aureus subsp. aureus MW2
gaaucacaguuauauauuacuua

SEQ ID NO: 4014277 - RNA, 12 nt, Staphylococcus aureus subsp. aureus MW2
gaaucacauuaa

SEQ ID NO: 4014278 - RNA, 17 nt, Staphylococcus aureus subsp. aureus MW2
gaaucagggacaaaaau

SEQ ID NO: 4014279 - RNA, 10 nt, Staphylococcus aureus subsp. aureus MW2
gaaucaguau

SEQ ID NO: 4014280 - RNA, 18 nt, Staphylococcus aureus subsp. aureus MW2
gaaucauuuucuugauuu

SEQ ID NO: 4014281 - RNA, 20 nt, Staphylococcus aureus subsp. aureus MW2
gaaucauuuucuugauuuua

SEQ ID NO: 4014282 - RNA, 19 nt, Staphylococcus aureus subsp. aureus MW2
gaauccuaugccaaauaac

SEQ ID NO: 4014283 - RNA, 13 nt, Staphylococcus aureus subsp. aureus MW2
gaauccuucauca

SEQ ID NO: 4014284 - RNA, 15 nt, Staphylococcus aureus subsp. aureus MW2
gaaucgauauaauga

SEQ ID NO: 4014285 - RNA, 17 nt, Staphylococcus aureus subsp. aureus MW2
gaaucuuauuuuguuuu

SEQ ID NO: 4014286 - RNA, 22 nt, Staphylococcus aureus subsp. aureus MW2
gaaucuuauuuuguuuuaaaaa

SEQ ID NO: 4014287 - RNA, 16 nt, Staphylococcus aureus subsp. aureus MW2
gaaucuuggaaguauc

SEQ ID NO: 4014288 - RNA, 13 nt, Staphylococcus aureus subsp. aureus MW2
gaaugaaccuuua

SEQ ID NO: 4014289 - RNA, 14 nt, Staphylococcus aureus subsp. aureus MW2
gaaugaaguaggcu

SEQ ID NO: 4014290 - RNA, 14 nt, Staphylococcus aureus subsp. aureus MW2
gaaugaauaauucc

SEQ ID NO: 4014291 - RNA, 18 nt, Staphylococcus aureus subsp. aureus MW2
gaaugacguuaucaucuc

SEQ ID NO: 4014292 - RNA, 14 nt, Staphylococcus aureus subsp. aureus MW2
gaaugauagauuua

SEQ ID NO: 4014293 - RNA, 12 nt, Staphylococcus aureus subsp. aureus MW2
gaaugaugcugc

SEQ ID NO: 4014294 - RNA, 14 nt, Staphylococcus aureus subsp. aureus MW2
gaaugauuuauaaa

SEQ ID NO: 4014295 - RNA, 21 nt, Staphylococcus aureus subsp. aureus MW2
gaaugcaaaucaaauacauca

SEQ ID NO: 4014296 - RNA, 15 nt, Staphylococcus aureus subsp. aureus MW2
gaauguauuuuucau

SEQ ID NO: 4014297 - RNA, 23 nt, Staphylococcus aureus subsp. aureus MW2
gaauguauuuuucauauugcuac

SEQ ID NO: 4014298 - RNA, 21 nt, Staphylococcus aureus subsp. aureus MW2
gaaugugcgaacuugcuuugu

SEQ ID NO: 4014299 - RNA, 17 nt, Staphylococcus aureus subsp. aureus MW2
gaauuacacuuuaaaua

SEQ ID NO: 4014300 - RNA, 14 nt, Staphylococcus aureus subsp. aureus MW2
gaauuagaucuaug

SEQ ID NO: 4014301 - RNA, 17 nt, Staphylococcus aureus subsp. aureus MW2
gaauuagaucuaugguu

SEQ ID NO: 4014302 - RNA, 20 nt, Staphylococcus aureus subsp. aureus MW2
gaauuagcuaagccuguuug

SEQ ID NO: 4014303 - RNA, 18 nt, Staphylococcus aureus subsp. aureus MW2
gaauuaucuauauaugaa

SEQ ID NO: 4014304 - RNA, 20 nt, Staphylococcus aureus subsp. aureus MW2
gaauuaucuauauaugaaga

SEQ ID NO: 4014305 - RNA, 17 nt, Staphylococcus aureus subsp. aureus MW2
gaauuauuuaaaaugcu

SEQ ID NO: 4014306 - RNA, 16 nt, Staphylococcus aureus subsp. aureus MW2
gaauucaaccaauuau

SEQ ID NO: 4014307 - RNA, 15 nt, Staphylococcus aureus subsp. aureus MW2
gaauugacugacuuc

SEQ ID NO: 4014308 - RNA, 20 nt, Staphylococcus aureus subsp. aureus MW2
gaauuuacuccuuacaauaa

SEQ ID NO: 4014309 - RNA, 23 nt, Staphylococcus aureus subsp. aureus MW2
gaauuuacuccuuacaauaaaga

SEQ ID NO: 4014310 - RNA, 23 nt, Staphylococcus aureus subsp. aureus MW2
gaauuuagaugcauaaaaaaaga

SEQ ID NO: 4014311 - RNA, 18 nt, Staphylococcus aureus subsp. aureus MW2
gaauuuagcaucaaaaau

SEQ ID NO: 4014312 - RNA, 12 nt, Staphylococcus aureus subsp. aureus MW2
gaauuucaaaaa

SEQ ID NO: 4014313 - RNA, 15 nt, Staphylococcus aureus subsp. aureus MW2
gaauuucaaaaagga

SEQ ID NO: 4014314 - RNA, 17 nt, Staphylococcus aureus subsp. aureus MW2
gaauuucaaaaaggaau

SEQ ID NO: 4014315 - RNA, 19 nt, Staphylococcus aureus subsp. aureus MW2
gaauuucguuauuaaacua

SEQ ID NO: 4014316 - RNA, 23 nt, Staphylococcus aureus subsp. aureus MW2
gaauuucguuauuaaacuacgaa

SEQ ID NO: 4014317 - RNA, 16 nt, Staphylococcus aureus subsp. aureus MW2
gaauuugcacaaagau

SEQ ID NO: 4014318 - RNA, 22 nt, Staphylococcus aureus subsp. aureus MW2
gaauuuuauuagguaauacuuu

SEQ ID NO: 4014319 - RNA, 14 nt, Staphylococcus aureus subsp. aureus MW2
gaauuuuauuuuuc

SEQ ID NO: 4014320 - RNA, 16 nt, Staphylococcus aureus subsp. aureus MW2
gacaaaaauucuuucu

SEQ ID NO: 4014321 - RNA, 13 nt, Staphylococcus aureus subsp. aureus MW2
gacaaauguucua

SEQ ID NO: 4014322 - RNA, 18 nt, Staphylococcus aureus subsp. aureus MW2
gacaaauguucuauagaa

SEQ ID NO: 4014323 - RNA, 13 nt, Staphylococcus aureus subsp. aureus MW2
gacaaauuaaaaa

SEQ ID NO: 4014324 - RNA, 14 nt, Staphylococcus aureus subsp. aureus MW2
gacaaauuaaaaaa

SEQ ID NO: 4014325 - RNA, 14 nt, Staphylococcus aureus subsp. aureus MW2
gacaaauucuauga

SEQ ID NO: 4014326 - RNA, 21 nt, Staphylococcus aureus subsp. aureus MW2
gacaaccuaucacgauuucag

SEQ ID NO: 4014327 - RNA, 14 nt, Staphylococcus aureus subsp. aureus MW2
gacaacugauuuaa

SEQ ID NO: 4014328 - RNA, 17 nt, Staphylococcus aureus subsp. aureus MW2
gacaagagacugaagag

SEQ ID NO: 4014329 - RNA, 22 nt, Staphylococcus aureus subsp. aureus MW2
gacaauaacagcuacaaauaau

SEQ ID NO: 4014330 - RNA, 12 nt, Staphylococcus aureus subsp. aureus MW2
gacaaucgaaug

SEQ ID NO: 4014331 - RNA, 12 nt, Staphylococcus aureus subsp. aureus MW2
gacaauuauaau

SEQ ID NO: 4014332 - RNA, 14 nt, Staphylococcus aureus subsp. aureus MW2
gacaauuauaauaa

SEQ ID NO: 4014333 - RNA, 20 nt, Staphylococcus aureus subsp. aureus MW2
gacaauuuucgaugcauauu

SEQ ID NO: 4014334 - RNA, 20 nt, Staphylococcus aureus subsp. aureus MW2
gacacaucacuauacgcaau

SEQ ID NO: 4014335 - RNA, 19 nt, Staphylococcus aureus subsp. aureus MW2
gacacauuuacuuaagaac

SEQ ID NO: 4014336 - RNA, 18 nt, Staphylococcus aureus subsp. aureus MW2
gacaccaacauauuuuaa

SEQ ID NO: 4014337 - RNA, 23 nt, Staphylococcus aureus subsp. aureus MW2
gacacguccgacaucauaaauga

SEQ ID NO: 4014338 - RNA, 18 nt, Staphylococcus aureus subsp. aureus MW2
gacacuuaacuuguguua

SEQ ID NO: 4014339 - RNA, 19 nt, Staphylococcus aureus subsp. aureus MW2
gacagaaaugauauuuucg

SEQ ID NO: 4014340 - RNA, 15 nt, Staphylococcus aureus subsp. aureus MW2
gacaguaaucaaagu

SEQ ID NO: 4014341 - RNA, 18 nt, Staphylococcus aureus subsp. aureus MW2
gacaguuuccauaaauaa

SEQ ID NO: 4014342 - RNA, 15 nt, Staphylococcus aureus subsp. aureus MW2
gacauaaaaaaauag

SEQ ID NO: 4014343 - RNA, 16 nt, Staphylococcus aureus subsp. aureus MW2
gacauaaaacuuacau

SEQ ID NO: 4014344 - RNA, 13 nt, Staphylococcus aureus subsp. aureus MW2
gacauaaauaugg

SEQ ID NO: 4014345 - RNA, 18 nt, Staphylococcus aureus subsp. aureus MW2
gacauaaaucaauauucu

SEQ ID NO: 4014346 - RNA, 21 nt, Staphylococcus aureus subsp. aureus MW2
gacauacagucaauacaaaac

SEQ ID NO: 4014347 - RNA, 22 nt, Staphylococcus aureus subsp. aureus MW2
gacauaccagguuauagaauac

SEQ ID NO: 4014348 - RNA, 22 nt, Staphylococcus aureus subsp. aureus MW2
gacauacuugucguauucuuca

SEQ ID NO: 4014349 - RNA, 16 nt, Staphylococcus aureus subsp. aureus MW2
gacauaugcagugacu

SEQ ID NO: 4014350 - RNA, 22 nt, Staphylococcus aureus subsp. aureus MW2
gacaucgucuucuuuuuguccc

SEQ ID NO: 4014351 - RNA, 17 nt, Staphylococcus aureus subsp. aureus MW2
gacauguccauaauauc

SEQ ID NO: 4014352 - RNA, 20 nt, Staphylococcus aureus subsp. aureus MW2
gacauuaaaaaaucgaacua

SEQ ID NO: 4014353 - RNA, 14 nt, Staphylococcus aureus subsp. aureus MW2
gacauuaaucaugc

SEQ ID NO: 4014354 - RNA, 18 nt, Staphylococcus aureus subsp. aureus MW2
gacauuacauuuaguaca

SEQ ID NO: 4014355 - RNA, 20 nt, Staphylococcus aureus subsp. aureus MW2
gacauucauuuaguuaaaua

SEQ ID NO: 4014356 - RNA, 16 nt, Staphylococcus aureus subsp. aureus MW2
gacauuuguaaauauu

SEQ ID NO: 4014357 - RNA, 21 nt, Staphylococcus aureus subsp. aureus MW2
gacauuuuaucugaaaauauc

SEQ ID NO: 4014358 - RNA, 23 nt, Staphylococcus aureus subsp. aureus MW2
gacauuuuuggcuuguuaagcag

SEQ ID NO: 4014359 - RNA, 15 nt, Staphylococcus aureus subsp. aureus MW2
gaccaacagcuucaa

SEQ ID NO: 4014360 - RNA, 15 nt, Staphylococcus aureus subsp. aureus MW2
gaccaacuugcacau

SEQ ID NO: 4014361 - RNA, 18 nt, Staphylococcus aureus subsp. aureus MW2
gaccaacuugcacauuau

SEQ ID NO: 4014362 - RNA, 13 nt, Staphylococcus aureus subsp. aureus MW2
gaccaaguaugag

SEQ ID NO: 4014363 - RNA, 14 nt, Staphylococcus aureus subsp. aureus MW2
gaccaaguaugaga

SEQ ID NO: 4014364 - RNA, 23 nt, Staphylococcus aureus subsp. aureus MW2
gaccaaguaugagacgcauugca

SEQ ID NO: 4014365 - RNA, 17 nt, Staphylococcus aureus subsp. aureus MW2
gaccacggucuugauau

SEQ ID NO: 4014366 - RNA, 18 nt, Staphylococcus aureus subsp. aureus MW2
gaccacucaauucucuaa

SEQ ID NO: 4014367 - RNA, 21 nt, Staphylococcus aureus subsp. aureus MW2
gaccacucaauucucuaacuu

SEQ ID NO: 4014368 - RNA, 19 nt, Staphylococcus aureus subsp. aureus MW2
gaccauugucaugccuuca

SEQ ID NO: 4014369 - RNA, 21 nt, Staphylococcus aureus subsp. aureus MW2
gacccacucccuauaauguuu

SEQ ID NO: 4014370 - RNA, 23 nt, Staphylococcus aureus subsp. aureus MW2
gacccuugucaguuuuuuuauaa

SEQ ID NO: 4014371 - RNA, 16 nt, Staphylococcus aureus subsp. aureus MW2
gaccuuacuacucauu

SEQ ID NO: 4014372 - RNA, 14 nt, Staphylococcus aureus subsp. aureus MW2
gaccuuauauuuua

SEQ ID NO: 4014373 - RNA, 23 nt, Staphylococcus aureus subsp. aureus MW2
gaccuuaucugaccaguauacga

SEQ ID NO: 4014374 - RNA, 19 nt, Staphylococcus aureus subsp. aureus MW2
gacgaaacacacuaaaagc

SEQ ID NO: 4014375 - RNA, 23 nt, Staphylococcus aureus subsp. aureus MW2
gacgaaauaaauuuugagaaaau

SEQ ID NO: 4014376 - RNA, 20 nt, Staphylococcus aureus subsp. aureus MW2
gacgauuuauuaguuuuuac

SEQ ID NO: 4014377 - RNA, 18 nt, Staphylococcus aureus subsp. aureus MW2
gacggcuacaauuuucuc

SEQ ID NO: 4014378 - RNA, 14 nt, Staphylococcus aureus subsp. aureus MW2
gacguaauuaauag

SEQ ID NO: 4014379 - RNA, 13 nt, Staphylococcus aureus subsp. aureus MW2
gacguaucaucaa

SEQ ID NO: 4014380 - RNA, 15 nt, Staphylococcus aureus subsp. aureus MW2
gacgucaaucaaugu

SEQ ID NO: 4014381 - RNA, 15 nt, Staphylococcus aureus subsp. aureus MW2
gacguucauggauuc

SEQ ID NO: 4014382 - RNA, 17 nt, Staphylococcus aureus subsp. aureus MW2
gacguuuacguucuuca

SEQ ID NO: 4014383 - RNA, 17 nt, Staphylococcus aureus subsp. aureus MW2
gacguuuugguuguucu

SEQ ID NO: 4014384 - RNA, 16 nt, Staphylococcus aureus subsp. aureus MW2
gacguuuuuuuauaaa

SEQ ID NO: 4014385 - RNA, 14 nt, Staphylococcus aureus subsp. aureus MW2
gacuaaaaaacuaa

SEQ ID NO: 4014386 - RNA, 19 nt, Staphylococcus aureus subsp. aureus MW2
gacuaaaaguggccuuuua

SEQ ID NO: 4014387 - RNA, 17 nt, Staphylococcus aureus subsp. aureus MW2
gacuacaaguuuauaau

SEQ ID NO: 4014388 - RNA, 16 nt, Staphylococcus aureus subsp. aureus MW2
gacuagaggauagaca

SEQ ID NO: 4014389 - RNA, 20 nt, Staphylococcus aureus subsp. aureus MW2
gacuaguguaccuuguuuca

SEQ ID NO: 4014390 - RNA, 20 nt, Staphylococcus aureus subsp. aureus MW2
gacuauaacaccaauuaaau

SEQ ID NO: 4014391 - RNA, 16 nt, Staphylococcus aureus subsp. aureus MW2
gacuaugaaacuggau

SEQ ID NO: 4014392 - RNA, 11 nt, Staphylococcus aureus subsp. aureus MW2
gacuauuuuug

SEQ ID NO: 4014393 - RNA, 11 nt, Staphylococcus aureus subsp. aureus MW2
gacugaaagaa

SEQ ID NO: 4014394 - RNA, 20 nt, Staphylococcus aureus subsp. aureus MW2
gacugaacgaaaaugcacuu

SEQ ID NO: 4014395 - RNA, 19 nt, Staphylococcus aureus subsp. aureus MW2
gacugaacgaaaaugcgcu

SEQ ID NO: 4014396 - RNA, 20 nt, Staphylococcus aureus subsp. aureus MW2
gacugaagagcuuuuaguaa

SEQ ID NO: 4014397 - RNA, 19 nt, Staphylococcus aureus subsp. aureus MW2
gacugaaugagaaugcgcu

SEQ ID NO: 4014398 - RNA, 14 nt, Staphylococcus aureus subsp. aureus MW2
gacugauaauaaaa

SEQ ID NO: 4014399 - RNA, 22 nt, Staphylococcus aureus subsp. aureus MW2
gacugcagacuucuuucaauua

SEQ ID NO: 4014400 - RNA, 13 nt, Staphylococcus aureus subsp. aureus MW2
gacuuaacaucuu

SEQ ID NO: 4014401 - RNA, 19 nt, Staphylococcus aureus subsp. aureus MW2
gacuuaacaucuuuuucac

SEQ ID NO: 4014402 - RNA, 20 nt, Staphylococcus aureus subsp. aureus MW2
gacuuauucaacguauaagu

SEQ ID NO: 4014403 - RNA, 18 nt, Staphylococcus aureus subsp. aureus MW2
gacuuauuugaaugcaaa

SEQ ID NO: 4014404 - RNA, 15 nt, Staphylococcus aureus subsp. aureus MW2
gacuuggugcccaag

SEQ ID NO: 4014405 - RNA, 16 nt, Staphylococcus aureus subsp. aureus MW2
gacuuggugcccaagu

SEQ ID NO: 4014406 - RNA, 22 nt, Staphylococcus aureus subsp. aureus MW2
gacuugugcgcgacguuuaaau

SEQ ID NO: 4014407 - RNA, 14 nt, Staphylococcus aureus subsp. aureus MW2
gacuuuccgccagc

SEQ ID NO: 4014408 - RNA, 23 nt, Staphylococcus aureus subsp. aureus MW2
gacuuuuaaaaaacauaccugca

SEQ ID NO: 4014409 - RNA, 20 nt, Staphylococcus aureus subsp. aureus MW2
gacuuuucuaucaaaaaaac

SEQ ID NO: 4014410 - RNA, 18 nt, Staphylococcus aureus subsp. aureus MW2
gagaaaagcuagaaguuc

SEQ ID NO: 4014411 - RNA, 14 nt, Staphylococcus aureus subsp. aureus MW2
gagaagcugucuua

SEQ ID NO: 4014412 - RNA, 16 nt, Staphylococcus aureus subsp. aureus MW2
gagaauagacauuguu

SEQ ID NO: 4014413 - RNA, 14 nt, Staphylococcus aureus subsp. aureus MW2
gagaaucuccauuu

SEQ ID NO: 4014414 - RNA, 16 nt, Staphylococcus aureus subsp. aureus MW2
gagaaugcgcuuguaa

SEQ ID NO: 4014415 - RNA, 17 nt, Staphylococcus aureus subsp. aureus MW2
gagaauuucaaaaagga

SEQ ID NO: 4014416 - RNA, 17 nt, Staphylococcus aureus subsp. aureus MW2
gagaauuucgaaaagaa

SEQ ID NO: 4014417 - RNA, 15 nt, Staphylococcus aureus subsp. aureus MW2
gagacaauaaugcac

SEQ ID NO: 4014418 - RNA, 16 nt, Staphylococcus aureus subsp. aureus MW2
gagacauuucuucaau

SEQ ID NO: 4014419 - RNA, 17 nt, Staphylococcus aureus subsp. aureus MW2
gagacauuuuaucugaa

SEQ ID NO: 4014420 - RNA, 15 nt, Staphylococcus aureus subsp. aureus MW2
gagacuguuuuuuug

SEQ ID NO: 4014421 - RNA, 14 nt, Staphylococcus aureus subsp. aureus MW2
gagagagaaaagcu

SEQ ID NO: 4014422 - RNA, 17 nt, Staphylococcus aureus subsp. aureus MW2
gagagauguauaaaacu

SEQ ID NO: 4014423 - RNA, 16 nt, Staphylococcus aureus subsp. aureus MW2
gagagauuauuuaaaa

SEQ ID NO: 4014424 - RNA, 22 nt, Staphylococcus aureus subsp. aureus MW2
gagagauuauuuaaaacuugua

SEQ ID NO: 4014425 - RNA, 14 nt, Staphylococcus aureus subsp. aureus MW2
gagauaaaaucaua

SEQ ID NO: 4014426 - RNA, 21 nt, Staphylococcus aureus subsp. aureus MW2
gagauauauuaauauuugauu

SEQ ID NO: 4014427 - RNA, 16 nt, Staphylococcus aureus subsp. aureus MW2
gagauauugucuucuc

SEQ ID NO: 4014428 - RNA, 24 nt, Staphylococcus aureus subsp. aureus MW2
gagauccaccguuaaaauauauga

SEQ ID NO: 4014429 - RNA, 19 nt, Staphylococcus aureus subsp. aureus MW2
gagaugaaagauacugcuu

SEQ ID NO: 4014430 - RNA, 20 nt, Staphylococcus aureus subsp. aureus MW2
gagauuaucuuuagacauaa

SEQ ID NO: 4014431 - RNA, 19 nt, Staphylococcus aureus subsp. aureus MW2
gagauuggcaauuuggaca

SEQ ID NO: 4014432 - RNA, 20 nt, Staphylococcus aureus subsp. aureus MW2
gagcaaagcuuuuuugcuuu

SEQ ID NO: 4014433 - RNA, 16 nt, Staphylococcus aureus subsp. aureus MW2
gagcaacgauaccaaa

SEQ ID NO: 4014434 - RNA, 19 nt, Staphylococcus aureus subsp. aureus MW2
gagcaauucuucaauuuca

SEQ ID NO: 4014435 - RNA, 14 nt, Staphylococcus aureus subsp. aureus MW2
gagcauaguuuuca

SEQ ID NO: 4014436 - RNA, 22 nt, Staphylococcus aureus subsp. aureus MW2
gagccauuauuauuuuuuucuu

SEQ ID NO: 4014437 - RNA, 21 nt, Staphylococcus aureus subsp. aureus MW2
gagcccgagacauaaauuaau

SEQ ID NO: 4014438 - RNA, 20 nt, Staphylococcus aureus subsp. aureus MW2
gagcccuuagcaauaucauc

SEQ ID NO: 4014439 - RNA, 20 nt, Staphylococcus aureus subsp. aureus MW2
gagcgaccgugguucaaaaa

SEQ ID NO: 4014440 - RNA, 15 nt, Staphylococcus aureus subsp. aureus MW2
gagcggaaauaugau

SEQ ID NO: 4014441 - RNA, 23 nt, Staphylococcus aureus subsp. aureus MW2
gagcuauucauagaccuaugaau

SEQ ID NO: 4014442 - RNA, 20 nt, Staphylococcus aureus subsp. aureus MW2
gagcuugggacagaaaacaa

SEQ ID NO: 4014443 - RNA, 15 nt, Staphylococcus aureus subsp. aureus MW2
gaggauauuuauucu

SEQ ID NO: 4014444 - RNA, 16 nt, Staphylococcus aureus subsp. aureus MW2
gagggccccaacacag

SEQ ID NO: 4014445 - RNA, 16 nt, Staphylococcus aureus subsp. aureus MW2
gaggucuccaauacuu

SEQ ID NO: 4014446 - RNA, 22 nt, Staphylococcus aureus subsp. aureus MW2
gaguagcccuauuuuuaaugua

SEQ ID NO: 4014447 - RNA, 16 nt, Staphylococcus aureus subsp. aureus MW2
gaguauuuuugcguua

SEQ ID NO: 4014448 - RNA, 18 nt, Staphylococcus aureus subsp. aureus MW2
gagucauucaaucaucaa

SEQ ID NO: 4014449 - RNA, 19 nt, Staphylococcus aureus subsp. aureus MW2
gaguguguccaucauuugu

SEQ ID NO: 4014450 - RNA, 14 nt, Staphylococcus aureus subsp. aureus MW2
gaguuaauaaaauu

SEQ ID NO: 4014451 - RNA, 22 nt, Staphylococcus aureus subsp. aureus MW2
gaguuaccuuugccaacaccau

SEQ ID NO: 4014452 - RNA, 16 nt, Staphylococcus aureus subsp. aureus MW2
gaguucaauuaaauua

SEQ ID NO: 4014453 - RNA, 17 nt, Staphylococcus aureus subsp. aureus MW2
gaguucaucuuguacag

SEQ ID NO: 4014454 - RNA, 13 nt, Staphylococcus aureus subsp. aureus MW2
gaguucuugauug

SEQ ID NO: 4014455 - RNA, 20 nt, Staphylococcus aureus subsp. aureus MW2
gaguucuuuuugaugaucau

SEQ ID NO: 4014456 - RNA, 14 nt, Staphylococcus aureus subsp. aureus MW2
gaguugaacaacua

SEQ ID NO: 4014457 - RNA, 19 nt, Staphylococcus aureus subsp. aureus MW2
gaguuggcaucagacuaaa

SEQ ID NO: 4014458 - RNA, 17 nt, Staphylococcus aureus subsp. aureus MW2
gaguuuaaucgcauugu

SEQ ID NO: 4014459 - RNA, 21 nt, Staphylococcus aureus subsp. aureus MW2
gauaaaaaauaaagucauaug

SEQ ID NO: 4014460 - RNA, 14 nt, Staphylococcus aureus subsp. aureus MW2
gauaaaaaauacua

SEQ ID NO: 4014461 - RNA, 12 nt, Staphylococcus aureus subsp. aureus MW2
gauaaaaaauga

SEQ ID NO: 4014462 - RNA, 19 nt, Staphylococcus aureus subsp. aureus MW2
gauaaaaauuuaugucuua

SEQ ID NO: 4014463 - RNA, 21 nt, Staphylococcus aureus subsp. aureus MW2
gauaaaacaaaaccaaaauac

SEQ ID NO: 4014464 - RNA, 15 nt, Staphylococcus aureus subsp. aureus MW2
gauaaaaguuguauu

SEQ ID NO: 4014465 - RNA, 21 nt, Staphylococcus aureus subsp. aureus MW2
gauaaacaagccaagauaaau

SEQ ID NO: 4014466 - RNA, 13 nt, Staphylococcus aureus subsp. aureus MW2
gauaaauaaugca

SEQ ID NO: 4014467 - RNA, 18 nt, Staphylococcus aureus subsp. aureus MW2
gauaaaucuucuuuagcu

SEQ ID NO: 4014468 - RNA, 19 nt, Staphylococcus aureus subsp. aureus MW2
gauaaaugcgguuaaugac

SEQ ID NO: 4014469 - RNA, 21 nt, Staphylococcus aureus subsp. aureus MW2
gauaacaaccuauuaauugaa

SEQ ID NO: 4014470 - RNA, 21 nt, Staphylococcus aureus subsp. aureus MW2
gauaacaagaaguaauguuaa

SEQ ID NO: 4014471 - RNA, 22 nt, Staphylococcus aureus subsp. aureus MW2
gauaacaauuuuaaaucuuuua

SEQ ID NO: 4014472 - RNA, 14 nt, Staphylococcus aureus subsp. aureus MW2
gauaacuauuuaau

SEQ ID NO: 4014473 - RNA, 13 nt, Staphylococcus aureus subsp. aureus MW2
gauaagaaaauac

SEQ ID NO: 4014474 - RNA, 21 nt, Staphylococcus aureus subsp. aureus MW2
gauaagaaucaucuaaaugca

SEQ ID NO: 4014475 - RNA, 14 nt, Staphylococcus aureus subsp. aureus MW2
gauaaguucagcgu

SEQ ID NO: 4014476 - RNA, 20 nt, Staphylococcus aureus subsp. aureus MW2
gauaauacuguuuaaauaaa

SEQ ID NO: 4014477 - RNA, 22 nt, Staphylococcus aureus subsp. aureus MW2
gauaaucucauucuuuaauaua

SEQ ID NO: 4014478 - RNA, 15 nt, Staphylococcus aureus subsp. aureus MW2
gauaaugcaccugug

SEQ ID NO: 4014479 - RNA, 18 nt, Staphylococcus aureus subsp. aureus MW2
gauaauguaaaaugauga

SEQ ID NO: 4014480 - RNA, 22 nt, Staphylococcus aureus subsp. aureus MW2
gauaauguacauguauaaaaga

SEQ ID NO: 4014481 - RNA, 19 nt, Staphylococcus aureus subsp. aureus MW2
gauaauuaauuaaaagccc

SEQ ID NO: 4014482 - RNA, 15 nt, Staphylococcus aureus subsp. aureus MW2
gauaauuuuuaacag

SEQ ID NO: 4014483 - RNA, 18 nt, Staphylococcus aureus subsp. aureus MW2
gauacaccaauauuuuuc

SEQ ID NO: 4014484 - RNA, 21 nt, Staphylococcus aureus subsp. aureus MW2
gauacacguaacgcaguugaa

SEQ ID NO: 4014485 - RNA, 14 nt, Staphylococcus aureus subsp. aureus MW2
gauacauaaaacau

SEQ ID NO: 4014486 - RNA, 14 nt, Staphylococcus aureus subsp. aureus MW2
gauacauaaaucua

SEQ ID NO: 4014487 - RNA, 19 nt, Staphylococcus aureus subsp. aureus MW2
gauaccaaauauauuuuua

SEQ ID NO: 4014488 - RNA, 20 nt, Staphylococcus aureus subsp. aureus MW2
gauaccuaagcugauuaaaa

SEQ ID NO: 4014489 - RNA, 18 nt, Staphylococcus aureus subsp. aureus MW2
gauaccuuuaauaucuaa

SEQ ID NO: 4014490 - RNA, 14 nt, Staphylococcus aureus subsp. aureus MW2
gauacgcuuuuuaa

SEQ ID NO: 4014491 - RNA, 19 nt, Staphylococcus aureus subsp. aureus MW2
gauacgcuuuuuaaaaaau

SEQ ID NO: 4014492 - RNA, 20 nt, Staphylococcus aureus subsp. aureus MW2
gauacuaaacgauaaauuaa

SEQ ID NO: 4014493 - RNA, 16 nt, Staphylococcus aureus subsp. aureus MW2
gauacuaauaucuucu

SEQ ID NO: 4014494 - RNA, 13 nt, Staphylococcus aureus subsp. aureus MW2
gauagaaaaaguu

SEQ ID NO: 4014495 - RNA, 14 nt, Staphylococcus aureus subsp. aureus MW2
gauagaaaggcagg

SEQ ID NO: 4014496 - RNA, 15 nt, Staphylococcus aureus subsp. aureus MW2
gauagaaguuuuuug

SEQ ID NO: 4014497 - RNA, 15 nt, Staphylococcus aureus subsp. aureus MW2
gauagaauacuaaaa

SEQ ID NO: 4014498 - RNA, 20 nt, Staphylococcus aureus subsp. aureus MW2
gauagaauacuaaaaguguu

SEQ ID NO: 4014499 - RNA, 14 nt, Staphylococcus aureus subsp. aureus MW2
gauagaugaaaaug

SEQ ID NO: 4014500 - RNA, 21 nt, Staphylococcus aureus subsp. aureus MW2
gauagcaccguaacauaugua

SEQ ID NO: 4014501 - RNA, 19 nt, Staphylococcus aureus subsp. aureus MW2
gauagcggauuuauuuuuu

SEQ ID NO: 4014502 - RNA, 14 nt, Staphylococcus aureus subsp. aureus MW2
gauagcuaaacauu

SEQ ID NO: 4014503 - RNA, 16 nt, Staphylococcus aureus subsp. aureus MW2
gauaggaaacuuaaau

SEQ ID NO: 4014504 - RNA, 14 nt, Staphylococcus aureus subsp. aureus MW2
gauagugaauaaug

SEQ ID NO: 4014505 - RNA, 15 nt, Staphylococcus aureus subsp. aureus MW2
gauaguuuuauaauu

SEQ ID NO: 4014506 - RNA, 14 nt, Staphylococcus aureus subsp. aureus MW2
gauauaaacauuua

SEQ ID NO: 4014507 - RNA, 16 nt, Staphylococcus aureus subsp. aureus MW2
gauauaaacuacuaaa

SEQ ID NO: 4014508 - RNA, 17 nt, Staphylococcus aureus subsp. aureus MW2
gauauaaugaaguuaug

SEQ ID NO: 4014509 - RNA, 16 nt, Staphylococcus aureus subsp. aureus MW2
gauauacgacaaucac

SEQ ID NO: 4014510 - RNA, 22 nt, Staphylococcus aureus subsp. aureus MW2
gauauagugcuuguuuauuaca

SEQ ID NO: 4014511 - RNA, 15 nt, Staphylococcus aureus subsp. aureus MW2
gauaucugaaguaga

SEQ ID NO: 4014512 - RNA, 17 nt, Staphylococcus aureus subsp. aureus MW2
gauaucuggauuaacug

SEQ ID NO: 4014513 - RNA, 19 nt, Staphylococcus aureus subsp. aureus MW2
gauaucuuaaucuaaaaau

SEQ ID NO: 4014514 - RNA, 21 nt, Staphylococcus aureus subsp. aureus MW2
gauaucuuaaucuaaaaauag

SEQ ID NO: 4014515 - RNA, 19 nt, Staphylococcus aureus subsp. aureus MW2
gauaucuuuuaauucuuaa

SEQ ID NO: 4014516 - RNA, 21 nt, Staphylococcus aureus subsp. aureus MW2
gauaugaauaaccaucuucuu

SEQ ID NO: 4014517 - RNA, 19 nt, Staphylococcus aureus subsp. aureus MW2
gauaugaauggcauuuaau

SEQ ID NO: 4014518 - RNA, 19 nt, Staphylococcus aureus subsp. aureus MW2
gauaugguuagaaaaaaau

SEQ ID NO: 4014519 - RNA, 20 nt, Staphylococcus aureus subsp. aureus MW2
gauauguuuggauaucuuug

SEQ ID NO: 4014520 - RNA, 17 nt, Staphylococcus aureus subsp. aureus MW2
gauauuaggugacuuau

SEQ ID NO: 4014521 - RNA, 20 nt, Staphylococcus aureus subsp. aureus MW2
gauauucauguucuuguaau

SEQ ID NO: 4014522 - RNA, 18 nt, Staphylococcus aureus subsp. aureus MW2
gauauucgcgaacguuau

SEQ ID NO: 4014523 - RNA, 19 nt, Staphylococcus aureus subsp. aureus MW2
gauauucuaaaaaauuaaa

SEQ ID NO: 4014524 - RNA, 20 nt, Staphylococcus aureus subsp. aureus MW2
gauauugacccccuguaucu

SEQ ID NO: 4014525 - RNA, 16 nt, Staphylococcus aureus subsp. aureus MW2
gauauugucuucucaa

SEQ ID NO: 4014526 - RNA, 13 nt, Staphylococcus aureus subsp. aureus MW2
gauauuuaguaca

SEQ ID NO: 4014527 - RNA, 23 nt, Staphylococcus aureus subsp. aureus MW2
gauauuucaacuuuuuaauaaua

SEQ ID NO: 4014528 - RNA, 18 nt, Staphylococcus aureus subsp. aureus MW2
gauauuucuaaauugucg

SEQ ID NO: 4014529 - RNA, 14 nt, Staphylococcus aureus subsp. aureus MW2
gaucaagugcagau

SEQ ID NO: 4014530 - RNA, 14 nt, Staphylococcus aureus subsp. aureus MW2
gaucacacgacaug

SEQ ID NO: 4014531 - RNA, 15 nt, Staphylococcus aureus subsp. aureus MW2
gaucacguuuuucuu

SEQ ID NO: 4014532 - RNA, 21 nt, Staphylococcus aureus subsp. aureus MW2
gaucacuuacugugaaaauac

SEQ ID NO: 4014533 - RNA, 18 nt, Staphylococcus aureus subsp. aureus MW2
gaucauaaauauuuucug

SEQ ID NO: 4014534 - RNA, 13 nt, Staphylococcus aureus subsp. aureus MW2
gaucaugccuuca

SEQ ID NO: 4014535 - RNA, 17 nt, Staphylococcus aureus subsp. aureus MW2
gaucaugccuucaugaa

SEQ ID NO: 4014536 - RNA, 20 nt, Staphylococcus aureus subsp. aureus MW2
gaucauuuucauuuaacccu

SEQ ID NO: 4014537 - RNA, 15 nt, Staphylococcus aureus subsp. aureus MW2
gauccaauuuauaau

SEQ ID NO: 4014538 - RNA, 18 nt, Staphylococcus aureus subsp. aureus MW2
gauccaccguuaaaauau

SEQ ID NO: 4014539 - RNA, 22 nt, Staphylococcus aureus subsp. aureus MW2
gaucgaacugauggaaaaguuu

SEQ ID NO: 4014540 - RNA, 13 nt, Staphylococcus aureus subsp. aureus MW2
gaucgguauuuuc

SEQ ID NO: 4014541 - RNA, 13 nt, Staphylococcus aureus subsp. aureus MW2
gaucuaaaaccau

SEQ ID NO: 4014542 - RNA, 17 nt, Staphylococcus aureus subsp. aureus MW2
gaucuaaaguacucaag

SEQ ID NO: 4014543 - RNA, 16 nt, Staphylococcus aureus subsp. aureus MW2
gaucuaacaucauuaa

SEQ ID NO: 4014544 - RNA, 18 nt, Staphylococcus aureus subsp. aureus MW2
gaucuaugguuauggugu

SEQ ID NO: 4014545 - RNA, 16 nt, Staphylococcus aureus subsp. aureus MW2
gaucuugcuuaucuau

SEQ ID NO: 4014546 - RNA, 18 nt, Staphylococcus aureus subsp. aureus MW2
gaucuugcuuaucuaugu

SEQ ID NO: 4014547 - RNA, 12 nt, Staphylococcus aureus subsp. aureus MW2
gaugaaaaagau

SEQ ID NO: 4014548 - RNA, 15 nt, Staphylococcus aureus subsp. aureus MW2
gaugaaaaaguggau

SEQ ID NO: 4014549 - RNA, 22 nt, Staphylococcus aureus subsp. aureus MW2
gaugaaaacuuaaaaaugaaau

SEQ ID NO: 4014550 - RNA, 19 nt, Staphylococcus aureus subsp. aureus MW2
gaugaaaaucuuuaacucu

SEQ ID NO: 4014551 - RNA, 21 nt, Staphylococcus aureus subsp. aureus MW2
gaugaaauuguguugaaucaa

SEQ ID NO: 4014552 - RNA, 19 nt, Staphylococcus aureus subsp. aureus MW2
gaugaacaaaauaacaugu

SEQ ID NO: 4014553 - RNA, 23 nt, Staphylococcus aureus subsp. aureus MW2
gaugaacaaaauaacauguuugu

SEQ ID NO: 4014554 - RNA, 18 nt, Staphylococcus aureus subsp. aureus MW2
gaugaacuuaaugcuuca

SEQ ID NO: 4014555 - RNA, 16 nt, Staphylococcus aureus subsp. aureus MW2
gaugaaugauugcauu

SEQ ID NO: 4014556 - RNA, 14 nt, Staphylococcus aureus subsp. aureus MW2
gaugaauuguaaaa

SEQ ID NO: 4014557 - RNA, 19 nt, Staphylococcus aureus subsp. aureus MW2
gaugacaaaaauaaaaccg

SEQ ID NO: 4014558 - RNA, 18 nt, Staphylococcus aureus subsp. aureus MW2
gaugacuguagaaaacau

SEQ ID NO: 4014559 - RNA, 13 nt, Staphylococcus aureus subsp. aureus MW2
gaugagaaauguu

SEQ ID NO: 4014560 - RNA, 16 nt, Staphylococcus aureus subsp. aureus MW2
gaugagauaaaaucau

SEQ ID NO: 4014561 - RNA, 22 nt, Staphylococcus aureus subsp. aureus MW2
gaugauauucauauaucaagua

SEQ ID NO: 4014562 - RNA, 16 nt, Staphylococcus aureus subsp. aureus MW2
gaugaucaauuaacac

SEQ ID NO: 4014563 - RNA, 13 nt, Staphylococcus aureus subsp. aureus MW2
gaugauucuuauc

SEQ ID NO: 4014564 - RNA, 14 nt, Staphylococcus aureus subsp. aureus MW2
gaugauucuuauca

SEQ ID NO: 4014565 - RNA, 18 nt, Staphylococcus aureus subsp. aureus MW2
gaugauuuauuaacucau

SEQ ID NO: 4014566 - RNA, 20 nt, Staphylococcus aureus subsp. aureus MW2
gaugcuaauguaaucugaac

SEQ ID NO: 4014567 - RNA, 18 nt, Staphylococcus aureus subsp. aureus MW2
gaugcuuuaauuaaaguu

SEQ ID NO: 4014568 - RNA, 14 nt, Staphylococcus aureus subsp. aureus MW2
gauggaaaaguuuu

SEQ ID NO: 4014569 - RNA, 20 nt, Staphylococcus aureus subsp. aureus MW2
gauggcaacuaaaauuugua

SEQ ID NO: 4014570 - RNA, 18 nt, Staphylococcus aureus subsp. aureus MW2
gauggcugcaacaauuug

SEQ ID NO: 4014571 - RNA, 19 nt, Staphylococcus aureus subsp. aureus MW2
gaugggaaaucaguaauau

SEQ ID NO: 4014572 - RNA, 18 nt, Staphylococcus aureus subsp. aureus MW2
gaugggccccaacacaga

SEQ ID NO: 4014573 - RNA, 16 nt, Staphylococcus aureus subsp. aureus MW2
gaugguacuaaaguug

SEQ ID NO: 4014574 - RNA, 16 nt, Staphylococcus aureus subsp. aureus MW2
gauggucauguguugc

SEQ ID NO: 4014575 - RNA, 13 nt, Staphylococcus aureus subsp. aureus MW2
gauggucuuuuaa

SEQ ID NO: 4014576 - RNA, 14 nt, Staphylococcus aureus subsp. aureus MW2
gaugguuaucacuu

SEQ ID NO: 4014577 - RNA, 17 nt, Staphylococcus aureus subsp. aureus MW2
gauguaccacucauaau

SEQ ID NO: 4014578 - RNA, 16 nt, Staphylococcus aureus subsp. aureus MW2
gaugucacauaugacu

SEQ ID NO: 4014579 - RNA, 16 nt, Staphylococcus aureus subsp. aureus MW2
gaugucagacgaauca

SEQ ID NO: 4014580 - RNA, 18 nt, Staphylococcus aureus subsp. aureus MW2
gaugucaugucuagauuu

SEQ ID NO: 4014581 - RNA, 14 nt, Staphylococcus aureus subsp. aureus MW2
gaugugacaaauac

SEQ ID NO: 4014582 - RNA, 14 nt, Staphylococcus aureus subsp. aureus MW2
gauguuauaaaaug

SEQ ID NO: 4014583 - RNA, 16 nt, Staphylococcus aureus subsp. aureus MW2
gauguucacuaaaugu

SEQ ID NO: 4014584 - RNA, 18 nt, Staphylococcus aureus subsp. aureus MW2
gauguugaaaaguauaug

SEQ ID NO: 4014585 - RNA, 16 nt, Staphylococcus aureus subsp. aureus MW2
gauguugguucaucaa

SEQ ID NO: 4014586 - RNA, 17 nt, Staphylococcus aureus subsp. aureus MW2
gauguuucaaaauaauu

SEQ ID NO: 4014587 - RNA, 13 nt, Staphylococcus aureus subsp. aureus MW2
gauguuuuauaag

SEQ ID NO: 4014588 - RNA, 17 nt, Staphylococcus aureus subsp. aureus MW2
gauuaaaagcaucuuua

SEQ ID NO: 4014589 - RNA, 12 nt, Staphylococcus aureus subsp. aureus MW2
gauuaaaagugu

SEQ ID NO: 4014590 - RNA, 17 nt, Staphylococcus aureus subsp. aureus MW2
gauuaaaauaugacaca

SEQ ID NO: 4014591 - RNA, 20 nt, Staphylococcus aureus subsp. aureus MW2
gauuaaaauccgcuuuauuu

SEQ ID NO: 4014592 - RNA, 11 nt, Staphylococcus aureus subsp. aureus MW2
gauuaaacugc

SEQ ID NO: 4014593 - RNA, 20 nt, Staphylococcus aureus subsp. aureus MW2
gauuaaaguguuucaacaua

SEQ ID NO: 4014594 - RNA, 14 nt, Staphylococcus aureus subsp. aureus MW2
gauuaacauaacua

SEQ ID NO: 4014595 - RNA, 12 nt, Staphylococcus aureus subsp. aureus MW2
gauuaacauuau

SEQ ID NO: 4014596 - RNA, 20 nt, Staphylococcus aureus subsp. aureus MW2
gauuaauaguuuuauaagaa

SEQ ID NO: 4014597 - RNA, 17 nt, Staphylococcus aureus subsp. aureus MW2
gauuaauauaagucuau

SEQ ID NO: 4014598 - RNA, 19 nt, Staphylococcus aureus subsp. aureus MW2
gauuaauccaguaaucaaa

SEQ ID NO: 4014599 - RNA, 17 nt, Staphylococcus aureus subsp. aureus MW2
gauuaauucuucuucag

SEQ ID NO: 4014600 - RNA, 18 nt, Staphylococcus aureus subsp. aureus MW2
gauuaauucuucuucagu

SEQ ID NO: 4014601 - RNA, 23 nt, Staphylococcus aureus subsp. aureus MW2
gauuacagcguacuaaagaauga

SEQ ID NO: 4014602 - RNA, 17 nt, Staphylococcus aureus subsp. aureus MW2
gauuacauucuauacuu

SEQ ID NO: 4014603 - RNA, 17 nt, Staphylococcus aureus subsp. aureus MW2
gauuaccaaguaaugau

SEQ ID NO: 4014604 - RNA, 16 nt, Staphylococcus aureus subsp. aureus MW2
gauuauaaugauuguc

SEQ ID NO: 4014605 - RNA, 16 nt, Staphylococcus aureus subsp. aureus MW2
gauuauagguauaaga

SEQ ID NO: 4014606 - RNA, 18 nt, Staphylococcus aureus subsp. aureus MW2
gauuauagguauaagaau

SEQ ID NO: 4014607 - RNA, 20 nt, Staphylococcus aureus subsp. aureus MW2
gauuauagguauaagaaugu

SEQ ID NO: 4014608 - RNA, 11 nt, Staphylococcus aureus subsp. aureus MW2
gauuauauaua

SEQ ID NO: 4014609 - RNA, 22 nt, Staphylococcus aureus subsp. aureus MW2
gauuaucugacauuguugcuaa

SEQ ID NO: 4014610 - RNA, 22 nt, Staphylococcus aureus subsp. aureus MW2
gauuaucuguaauuaauccauc

SEQ ID NO: 4014611 - RNA, 13 nt, Staphylococcus aureus subsp. aureus MW2
gauuauucuucau

SEQ ID NO: 4014612 - RNA, 22 nt, Staphylococcus aureus subsp. aureus MW2
gauuauucuucauuuauaacau

SEQ ID NO: 4014613 - RNA, 18 nt, Staphylococcus aureus subsp. aureus MW2
gauuauugguugaaauua

SEQ ID NO: 4014614 - RNA, 20 nt, Staphylococcus aureus subsp. aureus MW2
gauuauuuaaaacuuguaaa

SEQ ID NO: 4014615 - RNA, 21 nt, Staphylococcus aureus subsp. aureus MW2
gauuauuuagauaaaaaauac

SEQ ID NO: 4014616 - RNA, 15 nt, Staphylococcus aureus subsp. aureus MW2
gauucaaaaauuguu

SEQ ID NO: 4014617 - RNA, 16 nt, Staphylococcus aureus subsp. aureus MW2
gauucaaaaauuguua

SEQ ID NO: 4014618 - RNA, 13 nt, Staphylococcus aureus subsp. aureus MW2
gauucaaaugaca

SEQ ID NO: 4014619 - RNA, 13 nt, Staphylococcus aureus subsp. aureus MW2
gauucaaccuuaa

SEQ ID NO: 4014620 - RNA, 16 nt, Staphylococcus aureus subsp. aureus MW2
gauucaacuuguuucc

SEQ ID NO: 4014621 - RNA, 15 nt, Staphylococcus aureus subsp. aureus MW2
gauucaccagguuuu

SEQ ID NO: 4014622 - RNA, 20 nt, Staphylococcus aureus subsp. aureus MW2
gauucaggauuguagaaucu

SEQ ID NO: 4014623 - RNA, 16 nt, Staphylococcus aureus subsp. aureus MW2
gauucauaaaauuuaa

SEQ ID NO: 4014624 - RNA, 21 nt, Staphylococcus aureus subsp. aureus MW2
gauucauaaaauuuaaaacaa

SEQ ID NO: 4014625 - RNA, 17 nt, Staphylococcus aureus subsp. aureus MW2
gauucauaucuuucaau

SEQ ID NO: 4014626 - RNA, 14 nt, Staphylococcus aureus subsp. aureus MW2
gauuccaaauugga

SEQ ID NO: 4014627 - RNA, 15 nt, Staphylococcus aureus subsp. aureus MW2
gauuccaaucuauuu

SEQ ID NO: 4014628 - RNA, 18 nt, Staphylococcus aureus subsp. aureus MW2
gauuccaucucauacuau

SEQ ID NO: 4014629 - RNA, 18 nt, Staphylococcus aureus subsp. aureus MW2
gauuccuguaacaagaac

SEQ ID NO: 4014630 - RNA, 14 nt, Staphylococcus aureus subsp. aureus MW2
gauucggaaaauau

SEQ ID NO: 4014631 - RNA, 19 nt, Staphylococcus aureus subsp. aureus MW2
gauucguuuuguuauugaa

SEQ ID NO: 4014632 - RNA, 22 nt, Staphylococcus aureus subsp. aureus MW2
gauucuaacggcguuuguuucu

SEQ ID NO: 4014633 - RNA, 16 nt, Staphylococcus aureus subsp. aureus MW2
gauucuuaucuuuaau

SEQ ID NO: 4014634 - RNA, 18 nt, Staphylococcus aureus subsp. aureus MW2
gauucuuaucuuuaauca

SEQ ID NO: 4014635 - RNA, 12 nt, Staphylococcus aureus subsp. aureus MW2
gauugaaaaaau

SEQ ID NO: 4014636 - RNA, 14 nt, Staphylococcus aureus subsp. aureus MW2
gauugaaaaaauaa

SEQ ID NO: 4014637 - RNA, 13 nt, Staphylococcus aureus subsp. aureus MW2
gauugaaugaagc

SEQ ID NO: 4014638 - RNA, 22 nt, Staphylococcus aureus subsp. aureus MW2
gauugauauaaauuaucagaau

SEQ ID NO: 4014639 - RNA, 21 nt, Staphylococcus aureus subsp. aureus MW2
gauugcaaauuaucauuaaau

SEQ ID NO: 4014640 - RNA, 21 nt, Staphylococcus aureus subsp. aureus MW2
gauugcacguuugaaugaacc

SEQ ID NO: 4014641 - RNA, 22 nt, Staphylococcus aureus subsp. aureus MW2
gauuggaaaguuucuccaccug

SEQ ID NO: 4014642 - RNA, 21 nt, Staphylococcus aureus subsp. aureus MW2
gauuggcuugaaguuguuucu

SEQ ID NO: 4014643 - RNA, 14 nt, Staphylococcus aureus subsp. aureus MW2
gauuguaaauaaaa

SEQ ID NO: 4014644 - RNA, 19 nt, Staphylococcus aureus subsp. aureus MW2
gauuguccagcucuuaaau

SEQ ID NO: 4014645 - RNA, 15 nt, Staphylococcus aureus subsp. aureus MW2
gauuguuaauacaac

SEQ ID NO: 4014646 - RNA, 16 nt, Staphylococcus aureus subsp. aureus MW2
gauuguuucaccagcu

SEQ ID NO: 4014647 - RNA, 23 nt, Staphylococcus aureus subsp. aureus MW2
gauuguuucaccagcuuguaaau

SEQ ID NO: 4014648 - RNA, 22 nt, Staphylococcus aureus subsp. aureus MW2
gauuuaaaaaaauuaauguuuu

SEQ ID NO: 4014649 - RNA, 21 nt, Staphylococcus aureus subsp. aureus MW2
gauuuaaaauauaaauuucuu

SEQ ID NO: 4014650 - RNA, 14 nt, Staphylococcus aureus subsp. aureus MW2
gauuuaaaugcuuc

SEQ ID NO: 4014651 - RNA, 22 nt, Staphylococcus aureus subsp. aureus MW2
gauuuaaguugauacuugaucu

SEQ ID NO: 4014652 - RNA, 21 nt, Staphylococcus aureus subsp. aureus MW2
gauuuaccucuugauaaaaua

SEQ ID NO: 4014653 - RNA, 16 nt, Staphylococcus aureus subsp. aureus MW2
gauuuagcauacauua

SEQ ID NO: 4014654 - RNA, 14 nt, Staphylococcus aureus subsp. aureus MW2
gauuuauauuuuuu

SEQ ID NO: 4014655 - RNA, 21 nt, Staphylococcus aureus subsp. aureus MW2
gauuuaucaccuuuaggcaaa

SEQ ID NO: 4014656 - RNA, 15 nt, Staphylococcus aureus subsp. aureus MW2
gauuucacuucuaaa

SEQ ID NO: 4014657 - RNA, 16 nt, Staphylococcus aureus subsp. aureus MW2
gauuucaguucaucau

SEQ ID NO: 4014658 - RNA, 20 nt, Staphylococcus aureus subsp. aureus MW2
gauuucccacgugccucauc

SEQ ID NO: 4014659 - RNA, 15 nt, Staphylococcus aureus subsp. aureus MW2
gauuuccucgguuuu

SEQ ID NO: 4014660 - RNA, 12 nt, Staphylococcus aureus subsp. aureus MW2
gauuucuuauuu

SEQ ID NO: 4014661 - RNA, 20 nt, Staphylococcus aureus subsp. aureus MW2
gauuucuucgcauuguuucu

SEQ ID NO: 4014662 - RNA, 14 nt, Staphylococcus aureus subsp. aureus MW2
gauuugaaauuuau

SEQ ID NO: 4014663 - RNA, 12 nt, Staphylococcus aureus subsp. aureus MW2
gauuuuaauuau

SEQ ID NO: 4014664 - RNA, 14 nt, Staphylococcus aureus subsp. aureus MW2
gauuuuacuugaau

SEQ ID NO: 4014665 - RNA, 23 nt, Staphylococcus aureus subsp. aureus MW2
gauuuuaggcaagguaaugguua

SEQ ID NO: 4014666 - RNA, 16 nt, Staphylococcus aureus subsp. aureus MW2
gauuuucaaaaccuuc

SEQ ID NO: 4014667 - RNA, 20 nt, Staphylococcus aureus subsp. aureus MW2
gauuuucuaaagcuugauca

SEQ ID NO: 4014668 - RNA, 22 nt, Staphylococcus aureus subsp. aureus MW2
gauuuugcugccaaaaaguauu

SEQ ID NO: 4014669 - RNA, 10 nt, Staphylococcus aureus subsp. aureus MW2
gauuuugcuu

SEQ ID NO: 4014670 - RNA, 16 nt, Staphylococcus aureus subsp. aureus MW2
gauuuuggaugaagcg

SEQ ID NO: 4014671 - RNA, 13 nt, Staphylococcus aureus subsp. aureus MW2
gauuuuuaaaaug

SEQ ID NO: 4014672 - RNA, 16 nt, Staphylococcus aureus subsp. aureus MW2
gauuuuucauauuuuu

SEQ ID NO: 4014673 - RNA, 14 nt, Staphylococcus aureus subsp. aureus MW2
gauuuuuugauaug

SEQ ID NO: 4014674 - RNA, 15 nt, Staphylococcus aureus subsp. aureus MW2
gauuuuuugguuucu

SEQ ID NO: 4014675 - RNA, 18 nt, Staphylococcus aureus subsp. aureus MW2
gcaaaaauauuuaaacua

SEQ ID NO: 4014676 - RNA, 22 nt, Staphylococcus aureus subsp. aureus MW2
gcaaaacgcauuucauguguca

SEQ ID NO: 4014677 - RNA, 19 nt, Staphylococcus aureus subsp. aureus MW2
gcaaaauacgauuuguuca

SEQ ID NO: 4014678 - RNA, 19 nt, Staphylococcus aureus subsp. aureus MW2
gcaaaauuauguaaaaaau

SEQ ID NO: 4014679 - RNA, 15 nt, Staphylococcus aureus subsp. aureus MW2
gcaaacacaguacaa

SEQ ID NO: 4014680 - RNA, 14 nt, Staphylococcus aureus subsp. aureus MW2
gcaaagaaaaacau

SEQ ID NO: 4014681 - RNA, 13 nt, Staphylococcus aureus subsp. aureus MW2
gcaaagacucaau

SEQ ID NO: 4014682 - RNA, 18 nt, Staphylococcus aureus subsp. aureus MW2
gcaaagacucaauuucau

SEQ ID NO: 4014683 - RNA, 19 nt, Staphylococcus aureus subsp. aureus MW2
gcaaagucauuaaauguac

SEQ ID NO: 4014684 - RNA, 17 nt, Staphylococcus aureus subsp. aureus MW2
gcaaauaaaaucauaac

SEQ ID NO: 4014685 - RNA, 11 nt, Staphylococcus aureus subsp. aureus MW2
gcaaauacuuc

SEQ ID NO: 4014686 - RNA, 16 nt, Staphylococcus aureus subsp. aureus MW2
gcaaauagcgauuuua

SEQ ID NO: 4014687 - RNA, 16 nt, Staphylococcus aureus subsp. aureus MW2
gcaaauauuauuaaau

SEQ ID NO: 4014688 - RNA, 19 nt, Staphylococcus aureus subsp. aureus MW2
gcaaauauuauuaaaucaa

SEQ ID NO: 4014689 - RNA, 21 nt, Staphylococcus aureus subsp. aureus MW2
gcaaaugccucuuuugaguau

SEQ ID NO: 4014690 - RNA, 18 nt, Staphylococcus aureus subsp. aureus MW2
gcaaaugguccaacugga

SEQ ID NO: 4014691 - RNA, 17 nt, Staphylococcus aureus subsp. aureus MW2
gcaaauuaguaugacuu

SEQ ID NO: 4014692 - RNA, 20 nt, Staphylococcus aureus subsp. aureus MW2
gcaaauuaguaugacuuacc

SEQ ID NO: 4014693 - RNA, 13 nt, Staphylococcus aureus subsp. aureus MW2
gcaaauuaucauu

SEQ ID NO: 4014694 - RNA, 14 nt, Staphylococcus aureus subsp. aureus MW2
gcaaauuaucauua

SEQ ID NO: 4014695 - RNA, 18 nt, Staphylococcus aureus subsp. aureus MW2
gcaaauugauuaaauaaa

SEQ ID NO: 4014696 - RNA, 13 nt, Staphylococcus aureus subsp. aureus MW2
gcaaauuggaaaa

SEQ ID NO: 4014697 - RNA, 21 nt, Staphylococcus aureus subsp. aureus MW2
gcaacacucggaaacauguua

SEQ ID NO: 4014698 - RNA, 18 nt, Staphylococcus aureus subsp. aureus MW2
gcaacagcgcaucauaac

SEQ ID NO: 4014699 - RNA, 12 nt, Staphylococcus aureus subsp. aureus MW2
gcaacuaagaug

SEQ ID NO: 4014700 - RNA, 16 nt, Staphylococcus aureus subsp. aureus MW2
gcaacuguaaaugaaa

SEQ ID NO: 4014701 - RNA, 13 nt, Staphylococcus aureus subsp. aureus MW2
gcaacuuauaaua

SEQ ID NO: 4014702 - RNA, 22 nt, Staphylococcus aureus subsp. aureus MW2
gcaacuuguauuguuuguagaa

SEQ ID NO: 4014703 - RNA, 18 nt, Staphylococcus aureus subsp. aureus MW2
gcaacuuuugguaauuua

SEQ ID NO: 4014704 - RNA, 21 nt, Staphylococcus aureus subsp. aureus MW2
gcaagaauagauugauuguau

SEQ ID NO: 4014705 - RNA, 15 nt, Staphylococcus aureus subsp. aureus MW2
gcaagcauaucuuua

SEQ ID NO: 4014706 - RNA, 14 nt, Staphylococcus aureus subsp. aureus MW2
gcaagccaucaaua

SEQ ID NO: 4014707 - RNA, 22 nt, Staphylococcus aureus subsp. aureus MW2
gcaagccaucaauauugauauc

SEQ ID NO: 4014708 - RNA, 19 nt, Staphylococcus aureus subsp. aureus MW2
gcaagguuuucgccaauaa

SEQ ID NO: 4014709 - RNA, 22 nt, Staphylococcus aureus subsp. aureus MW2
gcaagucucauaucuauuuuuc

SEQ ID NO: 4014710 - RNA, 23 nt, Staphylococcus aureus subsp. aureus MW2
gcaagugccguccauuuccauga

SEQ ID NO: 4014711 - RNA, 16 nt, Staphylococcus aureus subsp. aureus MW2
gcaagugcuucaacuu

SEQ ID NO: 4014712 - RNA, 19 nt, Staphylococcus aureus subsp. aureus MW2
gcaaguguaucgcccauac

SEQ ID NO: 4014713 - RNA, 21 nt, Staphylococcus aureus subsp. aureus MW2
gcaaguuauaucauaacuuaa

SEQ ID NO: 4014714 - RNA, 15 nt, Staphylococcus aureus subsp. aureus MW2
gcaauaacacaucau

SEQ ID NO: 4014715 - RNA, 19 nt, Staphylococcus aureus subsp. aureus MW2
gcaauaacaccaauugaau

SEQ ID NO: 4014716 - RNA, 15 nt, Staphylococcus aureus subsp. aureus MW2
gcaauacgcaauguu

SEQ ID NO: 4014717 - RNA, 16 nt, Staphylococcus aureus subsp. aureus MW2
gcaauagcaacacguu

SEQ ID NO: 4014718 - RNA, 18 nt, Staphylococcus aureus subsp. aureus MW2
gcaauagcuauaacucua

SEQ ID NO: 4014719 - RNA, 14 nt, Staphylococcus aureus subsp. aureus MW2
gcaaucauaauacu

SEQ ID NO: 4014720 - RNA, 11 nt, Staphylococcus aureus subsp. aureus MW2
gcaaucaucug

SEQ ID NO: 4014721 - RNA, 14 nt, Staphylococcus aureus subsp. aureus MW2
gcaaucuauauaaa

SEQ ID NO: 4014722 - RNA, 16 nt, Staphylococcus aureus subsp. aureus MW2
gcaaugcaaguugggg

SEQ ID NO: 4014723 - RNA, 15 nt, Staphylococcus aureus subsp. aureus MW2
gcaaugcaugcuucu

SEQ ID NO: 4014724 - RNA, 15 nt, Staphylococcus aureus subsp. aureus MW2
gcaaugccacaucau

SEQ ID NO: 4014725 - RNA, 16 nt, Staphylococcus aureus subsp. aureus MW2
gcaaugcgaguugggg

SEQ ID NO: 4014726 - RNA, 17 nt, Staphylococcus aureus subsp. aureus MW2
gcaaugcgaguuggggu

SEQ ID NO: 4014727 - RNA, 17 nt, Staphylococcus aureus subsp. aureus MW2
gcaauggcuaaugacuu

SEQ ID NO: 4014728 - RNA, 19 nt, Staphylococcus aureus subsp. aureus MW2
gcaauggcuaaugacuucg

SEQ ID NO: 4014729 - RNA, 22 nt, Staphylococcus aureus subsp. aureus MW2
gcaaugucaucuugacacaaug

SEQ ID NO: 4014730 - RNA, 23 nt, Staphylococcus aureus subsp. aureus MW2
gcaaugucaucuugacacaauga

SEQ ID NO: 4014731 - RNA, 22 nt, Staphylococcus aureus subsp. aureus MW2
gcaauuaaaacuauaauaaaga

SEQ ID NO: 4014732 - RNA, 14 nt, Staphylococcus aureus subsp. aureus MW2
gcaauuaaagucaa

SEQ ID NO: 4014733 - RNA, 21 nt, Staphylococcus aureus subsp. aureus MW2
gcaauuaaagucaauuuaaau

SEQ ID NO: 4014734 - RNA, 19 nt, Staphylococcus aureus subsp. aureus MW2
gcaauuaaccuugauuuaa

SEQ ID NO: 4014735 - RNA, 13 nt, Staphylococcus aureus subsp. aureus MW2
gcaauuuguaaua

SEQ ID NO: 4014736 - RNA, 16 nt, Staphylococcus aureus subsp. aureus MW2
gcacaacugcauauaa

SEQ ID NO: 4014737 - RNA, 19 nt, Staphylococcus aureus subsp. aureus MW2
gcacagcgauuaaaugaug

SEQ ID NO: 4014738 - RNA, 19 nt, Staphylococcus aureus subsp. aureus MW2
gcacaucagauauaaguag

SEQ ID NO: 4014739 - RNA, 18 nt, Staphylococcus aureus subsp. aureus MW2
gcaccacauacauaucuu

SEQ ID NO: 4014740 - RNA, 15 nt, Staphylococcus aureus subsp. aureus MW2
gcaccagcacaucaa

SEQ ID NO: 4014741 - RNA, 21 nt, Staphylococcus aureus subsp. aureus MW2
gcaccgucaaacuuaaaacua

SEQ ID NO: 4014742 - RNA, 13 nt, Staphylococcus aureus subsp. aureus MW2
gcaccuaaaauag

SEQ ID NO: 4014743 - RNA, 15 nt, Staphylococcus aureus subsp. aureus MW2
gcaccuccaaccgcu

SEQ ID NO: 4014744 - RNA, 16 nt, Staphylococcus aureus subsp. aureus MW2
gcacgagacaauaaug

SEQ ID NO: 4014745 - RNA, 22 nt, Staphylococcus aureus subsp. aureus MW2
gcacgcgugccaacaucuucaa

SEQ ID NO: 4014746 - RNA, 13 nt, Staphylococcus aureus subsp. aureus MW2
gcacuagcaacau

SEQ ID NO: 4014747 - RNA, 13 nt, Staphylococcus aureus subsp. aureus MW2
gcacuaucuuuug

SEQ ID NO: 4014748 - RNA, 19 nt, Staphylococcus aureus subsp. aureus MW2
gcacuaugcauaauaccaa

SEQ ID NO: 4014749 - RNA, 20 nt, Staphylococcus aureus subsp. aureus MW2
gcacucgguucauaaugauc

SEQ ID NO: 4014750 - RNA, 14 nt, Staphylococcus aureus subsp. aureus MW2
gcacugagcaacaa

SEQ ID NO: 4014751 - RNA, 23 nt, Staphylococcus aureus subsp. aureus MW2
gcacuuauuuggaugguaaguau

SEQ ID NO: 4014752 - RNA, 20 nt, Staphylococcus aureus subsp. aureus MW2
gcacuucuauauuaauagaa

SEQ ID NO: 4014753 - RNA, 17 nt, Staphylococcus aureus subsp. aureus MW2
gcacuugucucaaauua

SEQ ID NO: 4014754 - RNA, 20 nt, Staphylococcus aureus subsp. aureus MW2
gcacuugucucaaauuaaau

SEQ ID NO: 4014755 - RNA, 22 nt, Staphylococcus aureus subsp. aureus MW2
gcacuugucucaaauuaaauca

SEQ ID NO: 4014756 - RNA, 14 nt, Staphylococcus aureus subsp. aureus MW2
gcacuuuauuaaaa

SEQ ID NO: 4014757 - RNA, 22 nt, Staphylococcus aureus subsp. aureus MW2
gcagacguaucaucaaaauuua

SEQ ID NO: 4014758 - RNA, 15 nt, Staphylococcus aureus subsp. aureus MW2
gcagagaauauagau

SEQ ID NO: 4014759 - RNA, 19 nt, Staphylococcus aureus subsp. aureus MW2
gcagauguugguucaucaa

SEQ ID NO: 4014760 - RNA, 15 nt, Staphylococcus aureus subsp. aureus MW2
gcagauugauauaaa

SEQ ID NO: 4014761 - RNA, 15 nt, Staphylococcus aureus subsp. aureus MW2
gcagcaaugacacua

SEQ ID NO: 4014762 - RNA, 15 nt, Staphylococcus aureus subsp. aureus MW2
gcagcuaaaaaguau

SEQ ID NO: 4014763 - RNA, 13 nt, Staphylococcus aureus subsp. aureus MW2
gcaggaaugauau

SEQ ID NO: 4014764 - RNA, 12 nt, Staphylococcus aureus subsp. aureus MW2
gcaguaaaacca

SEQ ID NO: 4014765 - RNA, 19 nt, Staphylococcus aureus subsp. aureus MW2
gcaguaagauauuuccaaa

SEQ ID NO: 4014766 - RNA, 23 nt, Staphylococcus aureus subsp. aureus MW2
gcaguaagauuauuuucaauuag

SEQ ID NO: 4014767 - RNA, 15 nt, Staphylococcus aureus subsp. aureus MW2
gcaguauauaucaaa

SEQ ID NO: 4014768 - RNA, 19 nt, Staphylococcus aureus subsp. aureus MW2
gcaguauauaucaaauaca

SEQ ID NO: 4014769 - RNA, 22 nt, Staphylococcus aureus subsp. aureus MW2
gcagugcuaauuuugagacaaa

SEQ ID NO: 4014770 - RNA, 14 nt, Staphylococcus aureus subsp. aureus MW2
gcaguugaaaaaga

SEQ ID NO: 4014771 - RNA, 14 nt, Staphylococcus aureus subsp. aureus MW2
gcauaaaucaacuu

SEQ ID NO: 4014772 - RNA, 22 nt, Staphylococcus aureus subsp. aureus MW2
gcauaacgagcaguauauauca

SEQ ID NO: 4014773 - RNA, 17 nt, Staphylococcus aureus subsp. aureus MW2
gcauaauauauuaaaaa

SEQ ID NO: 4014774 - RNA, 19 nt, Staphylococcus aureus subsp. aureus MW2
gcauaauuaggauuaacau

SEQ ID NO: 4014775 - RNA, 19 nt, Staphylococcus aureus subsp. aureus MW2
gcauaauuugugguaugac

SEQ ID NO: 4014776 - RNA, 14 nt, Staphylococcus aureus subsp. aureus MW2
gcauaauuuuuuaa

SEQ ID NO: 4014777 - RNA, 14 nt, Staphylococcus aureus subsp. aureus MW2
gcauacaauaaugu

SEQ ID NO: 4014778 - RNA, 17 nt, Staphylococcus aureus subsp. aureus MW2
gcauacaauaaugugca

SEQ ID NO: 4014779 - RNA, 18 nt, Staphylococcus aureus subsp. aureus MW2
gcauacaggaaauugaag

SEQ ID NO: 4014780 - RNA, 13 nt, Staphylococcus aureus subsp. aureus MW2
gcauacguaaaug

SEQ ID NO: 4014781 - RNA, 19 nt, Staphylococcus aureus subsp. aureus MW2
gcauacugucaucuuucaa

SEQ ID NO: 4014782 - RNA, 19 nt, Staphylococcus aureus subsp. aureus MW2
gcauauaaagucauacuua

SEQ ID NO: 4014783 - RNA, 22 nt, Staphylococcus aureus subsp. aureus MW2
gcauauaaagucauacuuauga

SEQ ID NO: 4014784 - RNA, 14 nt, Staphylococcus aureus subsp. aureus MW2
gcauauauauagau

SEQ ID NO: 4014785 - RNA, 18 nt, Staphylococcus aureus subsp. aureus MW2
gcauaucgauaaauguau

SEQ ID NO: 4014786 - RNA, 18 nt, Staphylococcus aureus subsp. aureus MW2
gcauaucuuuaucauuau

SEQ ID NO: 4014787 - RNA, 22 nt, Staphylococcus aureus subsp. aureus MW2
gcauaugguaaaucgucauuau

SEQ ID NO: 4014788 - RNA, 15 nt, Staphylococcus aureus subsp. aureus MW2
gcauauuaauauguu

SEQ ID NO: 4014789 - RNA, 14 nt, Staphylococcus aureus subsp. aureus MW2
gcauauucaucaua

SEQ ID NO: 4014790 - RNA, 15 nt, Staphylococcus aureus subsp. aureus MW2
gcauauucugcaccu

SEQ ID NO: 4014791 - RNA, 19 nt, Staphylococcus aureus subsp. aureus MW2
gcaucaaaaauaaaaaugc

SEQ ID NO: 4014792 - RNA, 13 nt, Staphylococcus aureus subsp. aureus MW2
gcaucaaaaauga

SEQ ID NO: 4014793 - RNA, 15 nt, Staphylococcus aureus subsp. aureus MW2
gcaucacaaaauugu

SEQ ID NO: 4014794 - RNA, 15 nt, Staphylococcus aureus subsp. aureus MW2
gcaucauugaauguu

SEQ ID NO: 4014795 - RNA, 14 nt, Staphylococcus aureus subsp. aureus MW2
gcaucccgaaaguu

SEQ ID NO: 4014796 - RNA, 12 nt, Staphylococcus aureus subsp. aureus MW2
gcauccuuaaua

SEQ ID NO: 4014797 - RNA, 18 nt, Staphylococcus aureus subsp. aureus MW2
gcaucuccgaaggccaug

SEQ ID NO: 4014798 - RNA, 19 nt, Staphylococcus aureus subsp. aureus MW2
gcaucuguuaacugaauuu

SEQ ID NO: 4014799 - RNA, 16 nt, Staphylococcus aureus subsp. aureus MW2
gcaucuuuaccauaua

SEQ ID NO: 4014800 - RNA, 21 nt, Staphylococcus aureus subsp. aureus MW2
gcaugaaaauuaaaaaaugcu

SEQ ID NO: 4014801 - RNA, 20 nt, Staphylococcus aureus subsp. aureus MW2
gcaugaagugggauaugaau

SEQ ID NO: 4014802 - RNA, 15 nt, Staphylococcus aureus subsp. aureus MW2
gcaugaaucgcauuu

SEQ ID NO: 4014803 - RNA, 14 nt, Staphylococcus aureus subsp. aureus MW2
gcaugacagcaaau

SEQ ID NO: 4014804 - RNA, 14 nt, Staphylococcus aureus subsp. aureus MW2
gcaugacuguaagu

SEQ ID NO: 4014805 - RNA, 15 nt, Staphylococcus aureus subsp. aureus MW2
gcaugacuguaagua

SEQ ID NO: 4014806 - RNA, 16 nt, Staphylococcus aureus subsp. aureus MW2
gcaugcuucucaauuu

SEQ ID NO: 4014807 - RNA, 20 nt, Staphylococcus aureus subsp. aureus MW2
gcauguuauauuaugaacau

SEQ ID NO: 4014808 - RNA, 15 nt, Staphylococcus aureus subsp. aureus MW2
gcauuaaauuccaug

SEQ ID NO: 4014809 - RNA, 18 nt, Staphylococcus aureus subsp. aureus MW2
gcauuaagaugauugucu

SEQ ID NO: 4014810 - RNA, 22 nt, Staphylococcus aureus subsp. aureus MW2
gcauuaaucguauuuuuaagcu

SEQ ID NO: 4014811 - RNA, 13 nt, Staphylococcus aureus subsp. aureus MW2
gcauuaauguuca

SEQ ID NO: 4014812 - RNA, 17 nt, Staphylococcus aureus subsp. aureus MW2
gcauuaauguucaauuu

SEQ ID NO: 4014813 - RNA, 13 nt, Staphylococcus aureus subsp. aureus MW2
gcauuaauuucau

SEQ ID NO: 4014814 - RNA, 15 nt, Staphylococcus aureus subsp. aureus MW2
gcauuacuacaaacu

SEQ ID NO: 4014815 - RNA, 18 nt, Staphylococcus aureus subsp. aureus MW2
gcauuacuaucuucauca

SEQ ID NO: 4014816 - RNA, 13 nt, Staphylococcus aureus subsp. aureus MW2
gcauuaucaacuu

SEQ ID NO: 4014817 - RNA, 20 nt, Staphylococcus aureus subsp. aureus MW2
gcauuauuauuucauuagaa

SEQ ID NO: 4014818 - RNA, 19 nt, Staphylococcus aureus subsp. aureus MW2
gcauugaaugaugcugcca

SEQ ID NO: 4014819 - RNA, 15 nt, Staphylococcus aureus subsp. aureus MW2
gcauugagauggucu

SEQ ID NO: 4014820 - RNA, 14 nt, Staphylococcus aureus subsp. aureus MW2
gcauugcuuuuguu

SEQ ID NO: 4014821 - RNA, 20 nt, Staphylococcus aureus subsp. aureus MW2
gcauuguaauaccaauuuuu

SEQ ID NO: 4014822 - RNA, 18 nt, Staphylococcus aureus subsp. aureus MW2
gcauuuaaauauaaccua

SEQ ID NO: 4014823 - RNA, 20 nt, Staphylococcus aureus subsp. aureus MW2
gcauuuaaauauaaccuaaa

SEQ ID NO: 4014824 - RNA, 17 nt, Staphylococcus aureus subsp. aureus MW2
gcauuuguaaacaguau

SEQ ID NO: 4014825 - RNA, 15 nt, Staphylococcus aureus subsp. aureus MW2
gcauuuuaaauaaaa

SEQ ID NO: 4014826 - RNA, 21 nt, Staphylococcus aureus subsp. aureus MW2
gccaaacaaccugugauaaaa

SEQ ID NO: 4014827 - RNA, 22 nt, Staphylococcus aureus subsp. aureus MW2
gccaaaccggucuauaacacca

SEQ ID NO: 4014828 - RNA, 18 nt, Staphylococcus aureus subsp. aureus MW2
gccaaaggcaaaauguau

SEQ ID NO: 4014829 - RNA, 19 nt, Staphylococcus aureus subsp. aureus MW2
gccaaauacuaguaauaau

SEQ ID NO: 4014830 - RNA, 20 nt, Staphylococcus aureus subsp. aureus MW2
gccaacaucuucaacauaac

SEQ ID NO: 4014831 - RNA, 17 nt, Staphylococcus aureus subsp. aureus MW2
gccaacuaaaucaccau

SEQ ID NO: 4014832 - RNA, 17 nt, Staphylococcus aureus subsp. aureus MW2
gccaacuugcacauuau

SEQ ID NO: 4014833 - RNA, 14 nt, Staphylococcus aureus subsp. aureus MW2
gccaauguuuuacu

SEQ ID NO: 4014834 - RNA, 12 nt, Staphylococcus aureus subsp. aureus MW2
gccaauuaauaa

SEQ ID NO: 4014835 - RNA, 14 nt, Staphylococcus aureus subsp. aureus MW2
gccaauuaauucuu

SEQ ID NO: 4014836 - RNA, 21 nt, Staphylococcus aureus subsp. aureus MW2
gccacaacauguuuggaugaa

SEQ ID NO: 4014837 - RNA, 12 nt, Staphylococcus aureus subsp. aureus MW2
gccacuuuugug

SEQ ID NO: 4014838 - RNA, 20 nt, Staphylococcus aureus subsp. aureus MW2
gccagcuucuauguuggggc

SEQ ID NO: 4014839 - RNA, 21 nt, Staphylococcus aureus subsp. aureus MW2
gccagcuucuauguuggggcc

SEQ ID NO: 4014840 - RNA, 21 nt, Staphylococcus aureus subsp. aureus MW2
gccagcuucuuuguuggggcc

SEQ ID NO: 4014841 - RNA, 22 nt, Staphylococcus aureus subsp. aureus MW2
gccagcuucuuuguuggggccc

SEQ ID NO: 4014842 - RNA, 15 nt, Staphylococcus aureus subsp. aureus MW2
gccauauguauuaua

SEQ ID NO: 4014843 - RNA, 16 nt, Staphylococcus aureus subsp. aureus MW2
gccaucaauauugaua

SEQ ID NO: 4014844 - RNA, 16 nt, Staphylococcus aureus subsp. aureus MW2
gccaucaauuucugua

SEQ ID NO: 4014845 - RNA, 11 nt, Staphylococcus aureus subsp. aureus MW2
gccaucuuuuu

SEQ ID NO: 4014846 - RNA, 16 nt, Staphylococcus aureus subsp. aureus MW2
gccauuuguaacaaua

SEQ ID NO: 4014847 - RNA, 23 nt, Staphylococcus aureus subsp. aureus MW2
gccauuuuuauuuaacacuucag

SEQ ID NO: 4014848 - RNA, 14 nt, Staphylococcus aureus subsp. aureus MW2
gcccaaacauagag

SEQ ID NO: 4014849 - RNA, 15 nt, Staphylococcus aureus subsp. aureus MW2
gcccaaacauagaga

SEQ ID NO: 4014850 - RNA, 12 nt, Staphylococcus aureus subsp. aureus MW2
gcccauccccaa

SEQ ID NO: 4014851 - RNA, 15 nt, Staphylococcus aureus subsp. aureus MW2
gcccauccccaacuu

SEQ ID NO: 4014852 - RNA, 15 nt, Staphylococcus aureus subsp. aureus MW2
gccccaacaaagaga

SEQ ID NO: 4014853 - RNA, 11 nt, Staphylococcus aureus subsp. aureus MW2
gccccaacaca

SEQ ID NO: 4014854 - RNA, 13 nt, Staphylococcus aureus subsp. aureus MW2
gccccaacacaga

SEQ ID NO: 4014855 - RNA, 15 nt, Staphylococcus aureus subsp. aureus MW2
gccccaacacagaga

SEQ ID NO: 4014856 - RNA, 16 nt, Staphylococcus aureus subsp. aureus MW2
gccccaacacagagaa

SEQ ID NO: 4014857 - RNA, 14 nt, Staphylococcus aureus subsp. aureus MW2
gccccaacauagaa

SEQ ID NO: 4014858 - RNA, 16 nt, Staphylococcus aureus subsp. aureus MW2
gccccaacauagaagc

SEQ ID NO: 4014859 - RNA, 21 nt, Staphylococcus aureus subsp. aureus MW2
gccccaacauagaagcuggcg

SEQ ID NO: 4014860 - RNA, 17 nt, Staphylococcus aureus subsp. aureus MW2
gccccaucuauuagaaa

SEQ ID NO: 4014861 - RNA, 20 nt, Staphylococcus aureus subsp. aureus MW2
gccccuagcaaaaauacuuu

SEQ ID NO: 4014862 - RNA, 16 nt, Staphylococcus aureus subsp. aureus MW2
gccccuggugauucac

SEQ ID NO: 4014863 - RNA, 19 nt, Staphylococcus aureus subsp. aureus MW2
gccccuuacaacuuuaguu

SEQ ID NO: 4014864 - RNA, 16 nt, Staphylococcus aureus subsp. aureus MW2
gcccucauaaaucaug

SEQ ID NO: 4014865 - RNA, 17 nt, Staphylococcus aureus subsp. aureus MW2
gcccucauuuuuauaaa

SEQ ID NO: 4014866 - RNA, 21 nt, Staphylococcus aureus subsp. aureus MW2
gccgagauuauuauguggaaa

SEQ ID NO: 4014867 - RNA, 15 nt, Staphylococcus aureus subsp. aureus MW2
gccgcuucauugaug

SEQ ID NO: 4014868 - RNA, 16 nt, Staphylococcus aureus subsp. aureus MW2
gccguccauuuccaug

SEQ ID NO: 4014869 - RNA, 17 nt, Staphylococcus aureus subsp. aureus MW2
gccgucuccauuauaaa

SEQ ID NO: 4014870 - RNA, 22 nt, Staphylococcus aureus subsp. aureus MW2
gccgugaaagaaaaaacuuuuc

SEQ ID NO: 4014871 - RNA, 14 nt, Staphylococcus aureus subsp. aureus MW2
gccguuauuuucaa

SEQ ID NO: 4014872 - RNA, 13 nt, Staphylococcus aureus subsp. aureus MW2
gccuaauaauaaa

SEQ ID NO: 4014873 - RNA, 17 nt, Staphylococcus aureus subsp. aureus MW2
gccuaauaauaaaauag

SEQ ID NO: 4014874 - RNA, 19 nt, Staphylococcus aureus subsp. aureus MW2
gccuaauaauaaaauagcu

SEQ ID NO: 4014875 - RNA, 20 nt, Staphylococcus aureus subsp. aureus MW2
gccuacuguuucacguaaug

SEQ ID NO: 4014876 - RNA, 14 nt, Staphylococcus aureus subsp. aureus MW2
gccuacuuuuucaa

SEQ ID NO: 4014877 - RNA, 21 nt, Staphylococcus aureus subsp. aureus MW2
gccugccccuuagucauguuu

SEQ ID NO: 4014878 - RNA, 16 nt, Staphylococcus aureus subsp. aureus MW2
gccuguagaauuucuu

SEQ ID NO: 4014879 - RNA, 23 nt, Staphylococcus aureus subsp. aureus MW2
gccuguagaauuucuuuucgaaa

SEQ ID NO: 4014880 - RNA, 14 nt, Staphylococcus aureus subsp. aureus MW2
gccuuaaaauauuu

SEQ ID NO: 4014881 - RNA, 18 nt, Staphylococcus aureus subsp. aureus MW2
gccuuaacuucauaauau

SEQ ID NO: 4014882 - RNA, 13 nt, Staphylococcus aureus subsp. aureus MW2
gccuucauuagcc

SEQ ID NO: 4014883 - RNA, 15 nt, Staphylococcus aureus subsp. aureus MW2
gccuucuauauagua

SEQ ID NO: 4014884 - RNA, 21 nt, Staphylococcus aureus subsp. aureus MW2
gccuucuauauaguaaaauaa

SEQ ID NO: 4014885 - RNA, 19 nt, Staphylococcus aureus subsp. aureus MW2
gccuugauuuuuugaaaug

SEQ ID NO: 4014886 - RNA, 14 nt, Staphylococcus aureus subsp. aureus MW2
gccuuguucaauuc

SEQ ID NO: 4014887 - RNA, 20 nt, Staphylococcus aureus subsp. aureus MW2
gccuuuccauuguugauaaa

SEQ ID NO: 4014888 - RNA, 19 nt, Staphylococcus aureus subsp. aureus MW2
gccuuuuaaacaaauaaaa

SEQ ID NO: 4014889 - RNA, 15 nt, Staphylococcus aureus subsp. aureus MW2
gccuuuugaauaauu

SEQ ID NO: 4014890 - RNA, 16 nt, Staphylococcus aureus subsp. aureus MW2
gccuuuuuauuguaau

SEQ ID NO: 4014891 - RNA, 16 nt, Staphylococcus aureus subsp. aureus MW2
gcgaaaaagcuaaaga

SEQ ID NO: 4014892 - RNA, 21 nt, Staphylococcus aureus subsp. aureus MW2
gcgaaacuuagugucacauua

SEQ ID NO: 4014893 - RNA, 22 nt, Staphylococcus aureus subsp. aureus MW2
gcgaaacuuagugucacauuau

SEQ ID NO: 4014894 - RNA, 19 nt, Staphylococcus aureus subsp. aureus MW2
gcgaacagcugcuucucuu

SEQ ID NO: 4014895 - RNA, 19 nt, Staphylococcus aureus subsp. aureus MW2
gcgaacgcaagcauaucuu

SEQ ID NO: 4014896 - RNA, 14 nt, Staphylococcus aureus subsp. aureus MW2
gcgaacguuauuuu

SEQ ID NO: 4014897 - RNA, 22 nt, Staphylococcus aureus subsp. aureus MW2
gcgaagaccuccucuuuuauuu

SEQ ID NO: 4014898 - RNA, 22 nt, Staphylococcus aureus subsp. aureus MW2
gcgaauagaagguuauuuuuua

SEQ ID NO: 4014899 - RNA, 18 nt, Staphylococcus aureus subsp. aureus MW2
gcgacauuuguaaauauu

SEQ ID NO: 4014900 - RNA, 23 nt, Staphylococcus aureus subsp. aureus MW2
gcgacguuuaaaugcccaccaug

SEQ ID NO: 4014901 - RNA, 23 nt, Staphylococcus aureus subsp. aureus MW2
gcgaggccccaacauaaagaauu

SEQ ID NO: 4014902 - RNA, 20 nt, Staphylococcus aureus subsp. aureus MW2
gcgaguucuuuuugaugauc

SEQ ID NO: 4014903 - RNA, 13 nt, Staphylococcus aureus subsp. aureus MW2
gcgauaaaguaug

SEQ ID NO: 4014904 - RNA, 21 nt, Staphylococcus aureus subsp. aureus MW2
gcgauaagcaugauaaaaaua

SEQ ID NO: 4014905 - RNA, 22 nt, Staphylococcus aureus subsp. aureus MW2
gcgauaauuguugcauuacuuu

SEQ ID NO: 4014906 - RNA, 15 nt, Staphylococcus aureus subsp. aureus MW2
gcgauacguuuauau

SEQ ID NO: 4014907 - RNA, 22 nt, Staphylococcus aureus subsp. aureus MW2
gcgauuacaguguggucuugug

SEQ ID NO: 4014908 - RNA, 22 nt, Staphylococcus aureus subsp. aureus MW2
gcgauucaaucuaaucuuaauu

SEQ ID NO: 4014909 - RNA, 15 nt, Staphylococcus aureus subsp. aureus MW2
gcgcagcaaaugcuu

SEQ ID NO: 4014910 - RNA, 14 nt, Staphylococcus aureus subsp. aureus MW2
gcgccauaaucauu

SEQ ID NO: 4014911 - RNA, 15 nt, Staphylococcus aureus subsp. aureus MW2
gcgccauaaucauua

SEQ ID NO: 4014912 - RNA, 21 nt, Staphylococcus aureus subsp. aureus MW2
gcgccuuguucaauucagcaa

SEQ ID NO: 4014913 - RNA, 23 nt, Staphylococcus aureus subsp. aureus MW2
gcgcucuggauuuuucuuauaaa

SEQ ID NO: 4014914 - RNA, 14 nt, Staphylococcus aureus subsp. aureus MW2
gcggaaagucagca

SEQ ID NO: 4014915 - RNA, 14 nt, Staphylococcus aureus subsp. aureus MW2
gcggaaagucagcu

SEQ ID NO: 4014916 - RNA, 19 nt, Staphylococcus aureus subsp. aureus MW2
gcggauuaucuaacucaua

SEQ ID NO: 4014917 - RNA, 22 nt, Staphylococcus aureus subsp. aureus MW2
gcggccuuuuuauuguaauaaa

SEQ ID NO: 4014918 - RNA, 23 nt, Staphylococcus aureus subsp. aureus MW2
gcggggccccaacacagaagcug

SEQ ID NO: 4014919 - RNA, 23 nt, Staphylococcus aureus subsp. aureus MW2
gcggggccccaacauagaagcug

SEQ ID NO: 4014920 - RNA, 19 nt, Staphylococcus aureus subsp. aureus MW2
gcggguaauauuuuuguug

SEQ ID NO: 4014921 - RNA, 22 nt, Staphylococcus aureus subsp. aureus MW2
gcguaacaucacagaaaauaca

SEQ ID NO: 4014922 - RNA, 13 nt, Staphylococcus aureus subsp. aureus MW2
gcguacauauaau

SEQ ID NO: 4014923 - RNA, 23 nt, Staphylococcus aureus subsp. aureus MW2
gcguacuuggcucaaaacuuuua

SEQ ID NO: 4014924 - RNA, 15 nt, Staphylococcus aureus subsp. aureus MW2
gcguaguuugaauug

SEQ ID NO: 4014925 - RNA, 18 nt, Staphylococcus aureus subsp. aureus MW2
gcguauccccauuuaugu

SEQ ID NO: 4014926 - RNA, 13 nt, Staphylococcus aureus subsp. aureus MW2
gcguauuuuaaug

SEQ ID NO: 4014927 - RNA, 11 nt, Staphylococcus aureus subsp. aureus MW2
gcguauuuuuu

SEQ ID NO: 4014928 - RNA, 15 nt, Staphylococcus aureus subsp. aureus MW2
gcgugcuuuucaaac

SEQ ID NO: 4014929 - RNA, 21 nt, Staphylococcus aureus subsp. aureus MW2
gcguucgugauagaaguuuuu

SEQ ID NO: 4014930 - RNA, 17 nt, Staphylococcus aureus subsp. aureus MW2
gcguuguuucauuauca

SEQ ID NO: 4014931 - RNA, 16 nt, Staphylococcus aureus subsp. aureus MW2
gcuaaaaaaauuaaaa

SEQ ID NO: 4014932 - RNA, 14 nt, Staphylococcus aureus subsp. aureus MW2
gcuaaaaguauaaa

SEQ ID NO: 4014933 - RNA, 18 nt, Staphylococcus aureus subsp. aureus MW2
gcuaaaauuguauuauua

SEQ ID NO: 4014934 - RNA, 18 nt, Staphylococcus aureus subsp. aureus MW2
gcuaacauucagugcaau

SEQ ID NO: 4014935 - RNA, 22 nt, Staphylococcus aureus subsp. aureus MW2
gcuaacgaaucgccuacuauaa

SEQ ID NO: 4014936 - RNA, 11 nt, Staphylococcus aureus subsp. aureus MW2
gcuaaguauau

SEQ ID NO: 4014937 - RNA, 16 nt, Staphylococcus aureus subsp. aureus MW2
gcuaaguuugaaggag

SEQ ID NO: 4014938 - RNA, 12 nt, Staphylococcus aureus subsp. aureus MW2
gcuaaucuauuu

SEQ ID NO: 4014939 - RNA, 13 nt, Staphylococcus aureus subsp. aureus MW2
gcuaaucuucuca

SEQ ID NO: 4014940 - RNA, 15 nt, Staphylococcus aureus subsp. aureus MW2
gcuaaugauaaucca

SEQ ID NO: 4014941 - RNA, 23 nt, Staphylococcus aureus subsp. aureus MW2
gcuaaugcaacuaaaacuaucug

SEQ ID NO: 4014942 - RNA, 23 nt, Staphylococcus aureus subsp. aureus MW2
gcuaaugcauuauuauaauagcu

SEQ ID NO: 4014943 - RNA, 14 nt, Staphylococcus aureus subsp. aureus MW2
gcuaauucauucaa

SEQ ID NO: 4014944 - RNA, 22 nt, Staphylococcus aureus subsp. aureus MW2
gcuaauugauacggaucauaau

SEQ ID NO: 4014945 - RNA, 14 nt, Staphylococcus aureus subsp. aureus MW2
gcuacaaauaauga

SEQ ID NO: 4014946 - RNA, 19 nt, Staphylococcus aureus subsp. aureus MW2
gcuacuugaauaccuuuua

SEQ ID NO: 4014947 - RNA, 18 nt, Staphylococcus aureus subsp. aureus MW2
gcuagaaguucuuaugca

SEQ ID NO: 4014948 - RNA, 15 nt, Staphylococcus aureus subsp. aureus MW2
gcuagauaauaaucc

SEQ ID NO: 4014949 - RNA, 17 nt, Staphylococcus aureus subsp. aureus MW2
gcuagcuuucuuuuuca

SEQ ID NO: 4014950 - RNA, 19 nt, Staphylococcus aureus subsp. aureus MW2
gcuagucauaauuuagaag

SEQ ID NO: 4014951 - RNA, 20 nt, Staphylococcus aureus subsp. aureus MW2
gcuagucauaauuuagaaga

SEQ ID NO: 4014952 - RNA, 24 nt, Staphylococcus aureus subsp. aureus MW2
gcuaguugaaccguaacuauauga

SEQ ID NO: 4014953 - RNA, 14 nt, Staphylococcus aureus subsp. aureus MW2
gcuauaaaauuuug

SEQ ID NO: 4014954 - RNA, 18 nt, Staphylococcus aureus subsp. aureus MW2
gcuauauaauuuauaaaa

SEQ ID NO: 4014955 - RNA, 20 nt, Staphylococcus aureus subsp. aureus MW2
gcuauauuuuuguauuuaug

SEQ ID NO: 4014956 - RNA, 15 nt, Staphylococcus aureus subsp. aureus MW2
gcuauguauuuuucu

SEQ ID NO: 4014957 - RNA, 13 nt, Staphylococcus aureus subsp. aureus MW2
gcuauuaaaauag

SEQ ID NO: 4014958 - RNA, 19 nt, Staphylococcus aureus subsp. aureus MW2
gcuauuccuaguucuaugu

SEQ ID NO: 4014959 - RNA, 13 nt, Staphylococcus aureus subsp. aureus MW2
gcuauuuaaaauu

SEQ ID NO: 4014960 - RNA, 22 nt, Staphylococcus aureus subsp. aureus MW2
gcucaagacauuacaucuuuaa

SEQ ID NO: 4014961 - RNA, 16 nt, Staphylococcus aureus subsp. aureus MW2
gcucaucuacuuaaaa

SEQ ID NO: 4014962 - RNA, 18 nt, Staphylococcus aureus subsp. aureus MW2
gcucauuucaauauuaaa

SEQ ID NO: 4014963 - RNA, 15 nt, Staphylococcus aureus subsp. aureus MW2
gcuccaaacauagag

SEQ ID NO: 4014964 - RNA, 15 nt, Staphylococcus aureus subsp. aureus MW2
gcuccccaauuucuc

SEQ ID NO: 4014965 - RNA, 18 nt, Staphylococcus aureus subsp. aureus MW2
gcucuaauucaaugauuu

SEQ ID NO: 4014966 - RNA, 14 nt, Staphylococcus aureus subsp. aureus MW2
gcucuaugcuuuua

SEQ ID NO: 4014967 - RNA, 15 nt, Staphylococcus aureus subsp. aureus MW2
gcucuggauuuuucu

SEQ ID NO: 4014968 - RNA, 22 nt, Staphylococcus aureus subsp. aureus MW2
gcucuggauuuuucuuauaaaa

SEQ ID NO: 4014969 - RNA, 13 nt, Staphylococcus aureus subsp. aureus MW2
gcucuuaaaucac

SEQ ID NO: 4014970 - RNA, 18 nt, Staphylococcus aureus subsp. aureus MW2
gcucuuaaaucacuagcu

SEQ ID NO: 4014971 - RNA, 22 nt, Staphylococcus aureus subsp. aureus MW2
gcucuuaauguacuuuucuguc

SEQ ID NO: 4014972 - RNA, 22 nt, Staphylococcus aureus subsp. aureus MW2
gcucuuauaaagacaccuucaa

SEQ ID NO: 4014973 - RNA, 12 nt, Staphylococcus aureus subsp. aureus MW2
gcucuucuucuu

SEQ ID NO: 4014974 - RNA, 14 nt, Staphylococcus aureus subsp. aureus MW2
gcucuucuucuuca

SEQ ID NO: 4014975 - RNA, 13 nt, Staphylococcus aureus subsp. aureus MW2
gcucuugcuaaag

SEQ ID NO: 4014976 - RNA, 19 nt, Staphylococcus aureus subsp. aureus MW2
gcucuugcuaaaguguagc

SEQ ID NO: 4014977 - RNA, 17 nt, Staphylococcus aureus subsp. aureus MW2
gcucuuuucuuguuucg

SEQ ID NO: 4014978 - RNA, 18 nt, Staphylococcus aureus subsp. aureus MW2
gcugaaacuaaguuuaau

SEQ ID NO: 4014979 - RNA, 23 nt, Staphylococcus aureus subsp. aureus MW2
gcugaacguaaguuuaguucaaa

SEQ ID NO: 4014980 - RNA, 20 nt, Staphylococcus aureus subsp. aureus MW2
gcugaaucgaguuugaaaua

SEQ ID NO: 4014981 - RNA, 14 nt, Staphylococcus aureus subsp. aureus MW2
gcugauaauuuuuc

SEQ ID NO: 4014982 - RNA, 20 nt, Staphylococcus aureus subsp. aureus MW2
gcugaugaacuucuacaguu

SEQ ID NO: 4014983 - RNA, 15 nt, Staphylococcus aureus subsp. aureus MW2
gcugcaucaauauga

SEQ ID NO: 4014984 - RNA, 15 nt, Staphylococcus aureus subsp. aureus MW2
gcugcuguacaauuu

SEQ ID NO: 4014985 - RNA, 22 nt, Staphylococcus aureus subsp. aureus MW2
gcugguugcuucuuaucaacaa

SEQ ID NO: 4014986 - RNA, 21 nt, Staphylococcus aureus subsp. aureus MW2
gcugucacuaauggauaugau

SEQ ID NO: 4014987 - RNA, 12 nt, Staphylococcus aureus subsp. aureus MW2
gcugucauaccu

SEQ ID NO: 4014988 - RNA, 17 nt, Staphylococcus aureus subsp. aureus MW2
gcuguccacuauauccu

SEQ ID NO: 4014989 - RNA, 21 nt, Staphylococcus aureus subsp. aureus MW2
gcuguguacguuucaauguau

SEQ ID NO: 4014990 - RNA, 18 nt, Staphylococcus aureus subsp. aureus MW2
gcuguguaucaucauaau

SEQ ID NO: 4014991 - RNA, 20 nt, Staphylococcus aureus subsp. aureus MW2
gcuguuaauaaaucauuagu

SEQ ID NO: 4014992 - RNA, 17 nt, Staphylococcus aureus subsp. aureus MW2
gcuguuacacuuuucuu

SEQ ID NO: 4014993 - RNA, 18 nt, Staphylococcus aureus subsp. aureus MW2
gcuguucuuuuuauuuac

SEQ ID NO: 4014994 - RNA, 20 nt, Staphylococcus aureus subsp. aureus MW2
gcuguucuuuuuauuuacuc

SEQ ID NO: 4014995 - RNA, 13 nt, Staphylococcus aureus subsp. aureus MW2
gcuguuugauauu

SEQ ID NO: 4014996 - RNA, 14 nt, Staphylococcus aureus subsp. aureus MW2
gcuguuuuauucaa

SEQ ID NO: 4014997 - RNA, 19 nt, Staphylococcus aureus subsp. aureus MW2
gcuguuuuuauuugaaaua

SEQ ID NO: 4014998 - RNA, 12 nt, Staphylococcus aureus subsp. aureus MW2
gcuuaaaucaaa

SEQ ID NO: 4014999 - RNA, 13 nt, Staphylococcus aureus subsp. aureus MW2
gcuuaauagaggu

SEQ ID NO: 4015000 - RNA, 13 nt, Staphylococcus aureus subsp. aureus MW2
gcuuaauuuaugu

SEQ ID NO: 4015001 - RNA, 13 nt, Staphylococcus aureus subsp. aureus MW2
gcuuaauuugaca

SEQ ID NO: 4015002 - RNA, 19 nt, Staphylococcus aureus subsp. aureus MW2
gcuuaauuuguuuuaaaua

SEQ ID NO: 4015003 - RNA, 16 nt, Staphylococcus aureus subsp. aureus MW2
gcuuaauuuuauuauu

SEQ ID NO: 4015004 - RNA, 20 nt, Staphylococcus aureus subsp. aureus MW2
gcuuacaauaaugugcaagu

SEQ ID NO: 4015005 - RNA, 22 nt, Staphylococcus aureus subsp. aureus MW2
gcuuagcgcaggcgcuccuacu

SEQ ID NO: 4015006 - RNA, 15 nt, Staphylococcus aureus subsp. aureus MW2
gcuuaguaaguugua

SEQ ID NO: 4015007 - RNA, 18 nt, Staphylococcus aureus subsp. aureus MW2
gcuuauacuauauaauaa

SEQ ID NO: 4015008 - RNA, 17 nt, Staphylococcus aureus subsp. aureus MW2
gcuuauucugaaaaaua

SEQ ID NO: 4015009 - RNA, 18 nt, Staphylococcus aureus subsp. aureus MW2
gcuuauucugaaaaauau

SEQ ID NO: 4015010 - RNA, 17 nt, Staphylococcus aureus subsp. aureus MW2
gcuuauugaaaagauaa

SEQ ID NO: 4015011 - RNA, 15 nt, Staphylococcus aureus subsp. aureus MW2
gcuucaaaagcgaaa

SEQ ID NO: 4015012 - RNA, 17 nt, Staphylococcus aureus subsp. aureus MW2
gcuucaacuucaucuaa

SEQ ID NO: 4015013 - RNA, 18 nt, Staphylococcus aureus subsp. aureus MW2
gcuucaacuucaucuaaa

SEQ ID NO: 4015014 - RNA, 20 nt, Staphylococcus aureus subsp. aureus MW2
gcuucaacuucaucuaaaug

SEQ ID NO: 4015015 - RNA, 16 nt, Staphylococcus aureus subsp. aureus MW2
gcuucagccauaauau

SEQ ID NO: 4015016 - RNA, 22 nt, Staphylococcus aureus subsp. aureus MW2
gcuucagccauaauaucuuuua

SEQ ID NO: 4015017 - RNA, 21 nt, Staphylococcus aureus subsp. aureus MW2
gcuucaucaguuguguaauaa

SEQ ID NO: 4015018 - RNA, 21 nt, Staphylococcus aureus subsp. aureus MW2
gcuucauuauauaauucuuca

SEQ ID NO: 4015019 - RNA, 21 nt, Staphylococcus aureus subsp. aureus MW2
gcuuccaccgcugcucuucuc

SEQ ID NO: 4015020 - RNA, 22 nt, Staphylococcus aureus subsp. aureus MW2
gcuuccaccgcugcucuucucu

SEQ ID NO: 4015021 - RNA, 22 nt, Staphylococcus aureus subsp. aureus MW2
gcuucggcaccuuuauuaccag

SEQ ID NO: 4015022 - RNA, 19 nt, Staphylococcus aureus subsp. aureus MW2
gcuucgucacguaaaauau

SEQ ID NO: 4015023 - RNA, 14 nt, Staphylococcus aureus subsp. aureus MW2
gcuucucuuugaac

SEQ ID NO: 4015024 - RNA, 16 nt, Staphylococcus aureus subsp. aureus MW2
gcuucugguucuucaa

SEQ ID NO: 4015025 - RNA, 13 nt, Staphylococcus aureus subsp. aureus MW2
gcuucuuaaauca

SEQ ID NO: 4015026 - RNA, 20 nt, Staphylococcus aureus subsp. aureus MW2
gcuucuuuaaauacaucgga

SEQ ID NO: 4015027 - RNA, 17 nt, Staphylococcus aureus subsp. aureus MW2
gcuucuuucuaaaauaa

SEQ ID NO: 4015028 - RNA, 16 nt, Staphylococcus aureus subsp. aureus MW2
gcuugcuuacaauaau

SEQ ID NO: 4015029 - RNA, 15 nt, Staphylococcus aureus subsp. aureus MW2
gcuugcuucuuuccu

SEQ ID NO: 4015030 - RNA, 14 nt, Staphylococcus aureus subsp. aureus MW2
gcuuggacauauac

SEQ ID NO: 4015031 - RNA, 16 nt, Staphylococcus aureus subsp. aureus MW2
gcuugggcugacauuu

SEQ ID NO: 4015032 - RNA, 15 nt, Staphylococcus aureus subsp. aureus MW2
gcuuguaaaauuuuc

SEQ ID NO: 4015033 - RNA, 21 nt, Staphylococcus aureus subsp. aureus MW2
gcuuguaacaagcuuuucauu

SEQ ID NO: 4015034 - RNA, 16 nt, Staphylococcus aureus subsp. aureus MW2
gcuuguccucuaaaac

SEQ ID NO: 4015035 - RNA, 15 nt, Staphylococcus aureus subsp. aureus MW2
gcuugugugaaauua

SEQ ID NO: 4015036 - RNA, 17 nt, Staphylococcus aureus subsp. aureus MW2
gcuugugugaaauuaga

SEQ ID NO: 4015037 - RNA, 12 nt, Staphylococcus aureus subsp. aureus MW2
gcuuuaaacauu

SEQ ID NO: 4015038 - RNA, 22 nt, Staphylococcus aureus subsp. aureus MW2
gcuuuaaaggcauuguguauga

SEQ ID NO: 4015039 - RNA, 13 nt, Staphylococcus aureus subsp. aureus MW2
gcuuuaaaucauu

SEQ ID NO: 4015040 - RNA, 18 nt, Staphylococcus aureus subsp. aureus MW2
gcuuuaacuugauuuucu

SEQ ID NO: 4015041 - RNA, 13 nt, Staphylococcus aureus subsp. aureus MW2
gcuuuaauauaau

SEQ ID NO: 4015042 - RNA, 13 nt, Staphylococcus aureus subsp. aureus MW2
gcuuuaauuaaag

SEQ ID NO: 4015043 - RNA, 19 nt, Staphylococcus aureus subsp. aureus MW2
gcuuuacguucugauucau

SEQ ID NO: 4015044 - RNA, 23 nt, Staphylococcus aureus subsp. aureus MW2
gcuuuacucuuugcaauuuuuua

SEQ ID NO: 4015045 - RNA, 16 nt, Staphylococcus aureus subsp. aureus MW2
gcuuuagcaauugaau

SEQ ID NO: 4015046 - RNA, 19 nt, Staphylococcus aureus subsp. aureus MW2
gcuuuagucgguguuuucu

SEQ ID NO: 4015047 - RNA, 14 nt, Staphylococcus aureus subsp. aureus MW2
gcuuucaucuuuuu

SEQ ID NO: 4015048 - RNA, 18 nt, Staphylococcus aureus subsp. aureus MW2
gcuuucuuaauuauggua

SEQ ID NO: 4015049 - RNA, 17 nt, Staphylococcus aureus subsp. aureus MW2
gcuuugauuucauuugu

SEQ ID NO: 4015050 - RNA, 17 nt, Staphylococcus aureus subsp. aureus MW2
gcuuuggauuucuuuuu

SEQ ID NO: 4015051 - RNA, 20 nt, Staphylococcus aureus subsp. aureus MW2
gcuuugucacgauagauuua

SEQ ID NO: 4015052 - RNA, 23 nt, Staphylococcus aureus subsp. aureus MW2
gcuuugucacgauagauuuauca

SEQ ID NO: 4015053 - RNA, 15 nt, Staphylococcus aureus subsp. aureus MW2
gcuuuguuuuuagua

SEQ ID NO: 4015054 - RNA, 14 nt, Staphylococcus aureus subsp. aureus MW2
gcuuuguuuuucac

SEQ ID NO: 4015055 - RNA, 20 nt, Staphylococcus aureus subsp. aureus MW2
gcuuuuaauuaauuaucaua

SEQ ID NO: 4015056 - RNA, 22 nt, Staphylococcus aureus subsp. aureus MW2
gcuuuuaauuaauuaucauaaa

SEQ ID NO: 4015057 - RNA, 15 nt, Staphylococcus aureus subsp. aureus MW2
gcuuuuaguaaauaa

SEQ ID NO: 4015058 - RNA, 15 nt, Staphylococcus aureus subsp. aureus MW2
gcuuuucuaauuuuu

SEQ ID NO: 4015059 - RNA, 17 nt, Staphylococcus aureus subsp. aureus MW2
gcuuuucuaauuuuucu

SEQ ID NO: 4015060 - RNA, 18 nt, Staphylococcus aureus subsp. aureus MW2
gcuuuucuaauuuuucuu

SEQ ID NO: 4015061 - RNA, 18 nt, Staphylococcus aureus subsp. aureus MW2
gcuuuuucaaaaucuuua

SEQ ID NO: 4015062 - RNA, 15 nt, Staphylococcus aureus subsp. aureus MW2
gcuuuuucaaauaau

SEQ ID NO: 4015063 - RNA, 18 nt, Staphylococcus aureus subsp. aureus MW2
gcuuuuucaaauaauaua

SEQ ID NO: 4015064 - RNA, 19 nt, Staphylococcus aureus subsp. aureus MW2
gcuuuuucuucuacauaua

SEQ ID NO: 4015065 - RNA, 21 nt, Staphylococcus aureus subsp. aureus MW2
gcuuuuuuauucuaauacaaa

SEQ ID NO: 4015066 - RNA, 20 nt, Staphylococcus aureus subsp. aureus MW2
gcuuuuuucaauucuaguca

SEQ ID NO: 4015067 - RNA, 21 nt, Staphylococcus aureus subsp. aureus MW2
gcuuuuuucaauucuagucaa

SEQ ID NO: 4015068 - RNA, 17 nt, Staphylococcus aureus subsp. aureus MW2
gcuuuuuuuauggugug

SEQ ID NO: 4015069 - RNA, 15 nt, Staphylococcus aureus subsp. aureus MW2
ggaaaauacuauacu

SEQ ID NO: 4015070 - RNA, 23 nt, Staphylococcus aureus subsp. aureus MW2
ggaaaauacuauacugaugaaaa

SEQ ID NO: 4015071 - RNA, 17 nt, Staphylococcus aureus subsp. aureus MW2
ggaaaauauauuauaaa

SEQ ID NO: 4015072 - RNA, 21 nt, Staphylococcus aureus subsp. aureus MW2
ggaaaauaucacuaauauauu

SEQ ID NO: 4015073 - RNA, 16 nt, Staphylococcus aureus subsp. aureus MW2
ggaaagucagcauaca

SEQ ID NO: 4015074 - RNA, 21 nt, Staphylococcus aureus subsp. aureus MW2
ggaaagucagcauacaauaau

SEQ ID NO: 4015075 - RNA, 13 nt, Staphylococcus aureus subsp. aureus MW2
ggaaagucagcuu

SEQ ID NO: 4015076 - RNA, 15 nt, Staphylococcus aureus subsp. aureus MW2
ggaaauaaaaaauaa

SEQ ID NO: 4015077 - RNA, 13 nt, Staphylococcus aureus subsp. aureus MW2
ggaaauaugaaaa

SEQ ID NO: 4015078 - RNA, 15 nt, Staphylococcus aureus subsp. aureus MW2
ggaaauaugaaaaga

SEQ ID NO: 4015079 - RNA, 18 nt, Staphylococcus aureus subsp. aureus MW2
ggaaauaugaaaagagau

SEQ ID NO: 4015080 - RNA, 16 nt, Staphylococcus aureus subsp. aureus MW2
ggaacaugauucauga

SEQ ID NO: 4015081 - RNA, 19 nt, Staphylococcus aureus subsp. aureus MW2
ggaaccacgguucaccauu

SEQ ID NO: 4015082 - RNA, 19 nt, Staphylococcus aureus subsp. aureus MW2
ggaacccaggugcaucuuu

SEQ ID NO: 4015083 - RNA, 21 nt, Staphylococcus aureus subsp. aureus MW2
ggaaguuacguucuaauacuu

SEQ ID NO: 4015084 - RNA, 16 nt, Staphylococcus aureus subsp. aureus MW2
ggaauaccuuuuucua

SEQ ID NO: 4015085 - RNA, 21 nt, Staphylococcus aureus subsp. aureus MW2
ggaauagauguugaugaagua

SEQ ID NO: 4015086 - RNA, 20 nt, Staphylococcus aureus subsp. aureus MW2
ggaauauacaauaguauaaa

SEQ ID NO: 4015087 - RNA, 20 nt, Staphylococcus aureus subsp. aureus MW2
ggaauauuucccuaugaaau

SEQ ID NO: 4015088 - RNA, 23 nt, Staphylococcus aureus subsp. aureus MW2
ggaaucagggacaaaaauucuuu

SEQ ID NO: 4015089 - RNA, 18 nt, Staphylococcus aureus subsp. aureus MW2
ggaauccaauuucucuau

SEQ ID NO: 4015090 - RNA, 23 nt, Staphylococcus aureus subsp. aureus MW2
ggaauguuccuccaccaccugca

SEQ ID NO: 4015091 - RNA, 22 nt, Staphylococcus aureus subsp. aureus MW2
ggaauuaauuauaggaauuuuu

SEQ ID NO: 4015092 - RNA, 21 nt, Staphylococcus aureus subsp. aureus MW2
ggaauuucaaacgcaccuggc

SEQ ID NO: 4015093 - RNA, 19 nt, Staphylococcus aureus subsp. aureus MW2
ggacauagguauaaucauu

SEQ ID NO: 4015094 - RNA, 16 nt, Staphylococcus aureus subsp. aureus MW2
ggacauguucacuuau

SEQ ID NO: 4015095 - RNA, 16 nt, Staphylococcus aureus subsp. aureus MW2
ggacgacgaaauaauu

SEQ ID NO: 4015096 - RNA, 19 nt, Staphylococcus aureus subsp. aureus MW2
ggagaaaucaguuaggaug

SEQ ID NO: 4015097 - RNA, 23 nt, Staphylococcus aureus subsp. aureus MW2
ggagaaaucaguuaggaugaaaa

SEQ ID NO: 4015098 - RNA, 13 nt, Staphylococcus aureus subsp. aureus MW2
ggagaaccauauu

SEQ ID NO: 4015099 - RNA, 15 nt, Staphylococcus aureus subsp. aureus MW2
ggagcauuucauuag

SEQ ID NO: 4015100 - RNA, 23 nt, Staphylococcus aureus subsp. aureus MW2
ggaguauuuuugcguuaauaauu

SEQ ID NO: 4015101 - RNA, 13 nt, Staphylococcus aureus subsp. aureus MW2
ggauaaaaauuua

SEQ ID NO: 4015102 - RNA, 16 nt, Staphylococcus aureus subsp. aureus MW2
ggauaaugguuucaaa

SEQ ID NO: 4015103 - RNA, 14 nt, Staphylococcus aureus subsp. aureus MW2
ggauaauuuuauug

SEQ ID NO: 4015104 - RNA, 13 nt, Staphylococcus aureus subsp. aureus MW2
ggaucggcauugu

SEQ ID NO: 4015105 - RNA, 15 nt, Staphylococcus aureus subsp. aureus MW2
ggaucuuucaaagua

SEQ ID NO: 4015106 - RNA, 10 nt, Staphylococcus aureus subsp. aureus MW2
ggaugaagcg

SEQ ID NO: 4015107 - RNA, 17 nt, Staphylococcus aureus subsp. aureus MW2
ggaugaguuuaaaaaua

SEQ ID NO: 4015108 - RNA, 19 nt, Staphylococcus aureus subsp. aureus MW2
ggaugaguuuaaaaauaug

SEQ ID NO: 4015109 - RNA, 22 nt, Staphylococcus aureus subsp. aureus MW2
ggauguuauaaaaugaauaauu

SEQ ID NO: 4015110 - RNA, 19 nt, Staphylococcus aureus subsp. aureus MW2
ggauuaaaagcaucuuuaa

SEQ ID NO: 4015111 - RNA, 15 nt, Staphylococcus aureus subsp. aureus MW2
ggauuaucuguaauu

SEQ ID NO: 4015112 - RNA, 16 nt, Staphylococcus aureus subsp. aureus MW2
ggauucgauugguuua

SEQ ID NO: 4015113 - RNA, 20 nt, Staphylococcus aureus subsp. aureus MW2
ggauuuacucuaaaacgauu

SEQ ID NO: 4015114 - RNA, 20 nt, Staphylococcus aureus subsp. aureus MW2
ggauuuccucgguuuuauuu

SEQ ID NO: 4015115 - RNA, 14 nt, Staphylococcus aureus subsp. aureus MW2
ggcaaaaucaacuu

SEQ ID NO: 4015116 - RNA, 13 nt, Staphylococcus aureus subsp. aureus MW2
ggcaaaucaaaca

SEQ ID NO: 4015117 - RNA, 16 nt, Staphylococcus aureus subsp. aureus MW2
ggcaauagcaccauac

SEQ ID NO: 4015118 - RNA, 15 nt, Staphylococcus aureus subsp. aureus MW2
ggcacauaaaucaau

SEQ ID NO: 4015119 - RNA, 13 nt, Staphylococcus aureus subsp. aureus MW2
ggcacgcauugaa

SEQ ID NO: 4015120 - RNA, 22 nt, Staphylococcus aureus subsp. aureus MW2
ggcacuaauauuuaaaaaacaa

SEQ ID NO: 4015121 - RNA, 21 nt, Staphylococcus aureus subsp. aureus MW2
ggcacuuaagcuuuaaucaua

SEQ ID NO: 4015122 - RNA, 22 nt, Staphylococcus aureus subsp. aureus MW2
ggcagcuaaaaaguauacuaaa

SEQ ID NO: 4015123 - RNA, 15 nt, Staphylococcus aureus subsp. aureus MW2
ggcaggaaugauaua

SEQ ID NO: 4015124 - RNA, 11 nt, Staphylococcus aureus subsp. aureus MW2
ggcaguucuga

SEQ ID NO: 4015125 - RNA, 16 nt, Staphylococcus aureus subsp. aureus MW2
ggcaguucugaaacau

SEQ ID NO: 4015126 - RNA, 17 nt, Staphylococcus aureus subsp. aureus MW2
ggcaguucugaaacauu

SEQ ID NO: 4015127 - RNA, 23 nt, Staphylococcus aureus subsp. aureus MW2
ggcauaaccuguuuuuauuuguu

SEQ ID NO: 4015128 - RNA, 14 nt, Staphylococcus aureus subsp. aureus MW2
ggcauccauaucca

SEQ ID NO: 4015129 - RNA, 20 nt, Staphylococcus aureus subsp. aureus MW2
ggcauuagcuucuacuuuug

SEQ ID NO: 4015130 - RNA, 18 nt, Staphylococcus aureus subsp. aureus MW2
ggcauuaggaaaacuuca

SEQ ID NO: 4015131 - RNA, 13 nt, Staphylococcus aureus subsp. aureus MW2
ggccaugagcucu

SEQ ID NO: 4015132 - RNA, 16 nt, Staphylococcus aureus subsp. aureus MW2
ggccccaacacagaga

SEQ ID NO: 4015133 - RNA, 20 nt, Staphylococcus aureus subsp. aureus MW2
ggccuacuuuuucaauaugu

SEQ ID NO: 4015134 - RNA, 14 nt, Staphylococcus aureus subsp. aureus MW2
ggccuuuaaugauu

SEQ ID NO: 4015135 - RNA, 19 nt, Staphylococcus aureus subsp. aureus MW2
ggccuuuuaaacaaauaaa

SEQ ID NO: 4015136 - RNA, 22 nt, Staphylococcus aureus subsp. aureus MW2
ggccuuuuaaacaaauaaaaaa

SEQ ID NO: 4015137 - RNA, 13 nt, Staphylococcus aureus subsp. aureus MW2
ggccuuuuuauug

SEQ ID NO: 4015138 - RNA, 13 nt, Staphylococcus aureus subsp. aureus MW2
ggcgaggccccaa

SEQ ID NO: 4015139 - RNA, 23 nt, Staphylococcus aureus subsp. aureus MW2
ggcgcuguuccaaauucauuugu

SEQ ID NO: 4015140 - RNA, 14 nt, Staphylococcus aureus subsp. aureus MW2
ggcggaaagucagc

SEQ ID NO: 4015141 - RNA, 13 nt, Staphylococcus aureus subsp. aureus MW2
ggcgggccccaac

SEQ ID NO: 4015142 - RNA, 16 nt, Staphylococcus aureus subsp. aureus MW2
ggcggggcccaaacau

SEQ ID NO: 4015143 - RNA, 12 nt, Staphylococcus aureus subsp. aureus MW2
ggcguaaugaua

SEQ ID NO: 4015144 - RNA, 23 nt, Staphylococcus aureus subsp. aureus MW2
ggcguuucagaaguuguuuagaa

SEQ ID NO: 4015145 - RNA, 16 nt, Staphylococcus aureus subsp. aureus MW2
ggcuagcuaaaauuug

SEQ ID NO: 4015146 - RNA, 17 nt, Staphylococcus aureus subsp. aureus MW2
ggcuccaaacauagaga

SEQ ID NO: 4015147 - RNA, 16 nt, Staphylococcus aureus subsp. aureus MW2
ggcuucauguucuuaa

SEQ ID NO: 4015148 - RNA, 18 nt, Staphylococcus aureus subsp. aureus MW2
ggcuucuuucuaaaauaa

SEQ ID NO: 4015149 - RNA, 17 nt, Staphylococcus aureus subsp. aureus MW2
ggcuugguuauuuucaa

SEQ ID NO: 4015150 - RNA, 13 nt, Staphylococcus aureus subsp. aureus MW2
ggcuuguuaagca

SEQ ID NO: 4015151 - RNA, 11 nt, Staphylococcus aureus subsp. aureus MW2
ggcuuuaaaau

SEQ ID NO: 4015152 - RNA, 21 nt, Staphylococcus aureus subsp. aureus MW2
ggcuuuguuuucugucccaag

SEQ ID NO: 4015153 - RNA, 14 nt, Staphylococcus aureus subsp. aureus MW2
ggcuuuguuuuuca

SEQ ID NO: 4015154 - RNA, 22 nt, Staphylococcus aureus subsp. aureus MW2
ggcuuuuuauaccaauaauuac

SEQ ID NO: 4015155 - RNA, 19 nt, Staphylococcus aureus subsp. aureus MW2
ggcuuuuuguuuugaaugu

SEQ ID NO: 4015156 - RNA, 19 nt, Staphylococcus aureus subsp. aureus MW2
ggcuuuuuuuauggugugg

SEQ ID NO: 4015157 - RNA, 21 nt, Staphylococcus aureus subsp. aureus MW2
gggaauacagcuagcaagaau

SEQ ID NO: 4015158 - RNA, 14 nt, Staphylococcus aureus subsp. aureus MW2
gggacagaaaacaa

SEQ ID NO: 4015159 - RNA, 15 nt, Staphylococcus aureus subsp. aureus MW2
gggagaaaucaguua

SEQ ID NO: 4015160 - RNA, 23 nt, Staphylococcus aureus subsp. aureus MW2
gggagccaauuucuacagacaau

SEQ ID NO: 4015161 - RNA, 17 nt, Staphylococcus aureus subsp. aureus MW2
gggagugggacagaaau

SEQ ID NO: 4015162 - RNA, 22 nt, Staphylococcus aureus subsp. aureus MW2
gggaugggccccaacacagaga

SEQ ID NO: 4015163 - RNA, 13 nt, Staphylococcus aureus subsp. aureus MW2
gggcagaucauaa

SEQ ID NO: 4015164 - RNA, 14 nt, Staphylococcus aureus subsp. aureus MW2
gggcccaaacauag

SEQ ID NO: 4015165 - RNA, 21 nt, Staphylococcus aureus subsp. aureus MW2
gggccccaacacagaagcugg

SEQ ID NO: 4015166 - RNA, 21 nt, Staphylococcus aureus subsp. aureus MW2
gggccccaacauagaagcugg

SEQ ID NO: 4015167 - RNA, 20 nt, Staphylococcus aureus subsp. aureus MW2
gggcuagagcguuuugcuuu

SEQ ID NO: 4015168 - RNA, 21 nt, Staphylococcus aureus subsp. aureus MW2
gggcuauuugauacaacuaua

SEQ ID NO: 4015169 - RNA, 15 nt, Staphylococcus aureus subsp. aureus MW2
ggggaugggccccaa

SEQ ID NO: 4015170 - RNA, 20 nt, Staphylococcus aureus subsp. aureus MW2
ggggaugggccccaacacag

SEQ ID NO: 4015171 - RNA, 19 nt, Staphylococcus aureus subsp. aureus MW2
ggggcccaaacauagagaa

SEQ ID NO: 4015172 - RNA, 23 nt, Staphylococcus aureus subsp. aureus MW2
ggggccccaacaaagaagcuggc

SEQ ID NO: 4015173 - RNA, 23 nt, Staphylococcus aureus subsp. aureus MW2
ggggccccaacacagaagcuggc

SEQ ID NO: 4015174 - RNA, 19 nt, Staphylococcus aureus subsp. aureus MW2
ggggccccaacacagagaa

SEQ ID NO: 4015175 - RNA, 18 nt, Staphylococcus aureus subsp. aureus MW2
ggggugggacgacgaaau

SEQ ID NO: 4015176 - RNA, 15 nt, Staphylococcus aureus subsp. aureus MW2
gggugagggccccaa

SEQ ID NO: 4015177 - RNA, 15 nt, Staphylococcus aureus subsp. aureus MW2
gggugugggccccaa

SEQ ID NO: 4015178 - RNA, 12 nt, Staphylococcus aureus subsp. aureus MW2
gguaaaaaaaua

SEQ ID NO: 4015179 - RNA, 18 nt, Staphylococcus aureus subsp. aureus MW2
gguaaaaaucucaaaauu

SEQ ID NO: 4015180 - RNA, 18 nt, Staphylococcus aureus subsp. aureus MW2
gguaaaaaugaaccauuu

SEQ ID NO: 4015181 - RNA, 12 nt, Staphylococcus aureus subsp. aureus MW2
gguaaacauaac

SEQ ID NO: 4015182 - RNA, 21 nt, Staphylococcus aureus subsp. aureus MW2
gguaaggugauugaacaauaa

SEQ ID NO: 4015183 - RNA, 21 nt, Staphylococcus aureus subsp. aureus MW2
gguaauacuauaugaaaagag

SEQ ID NO: 4015184 - RNA, 15 nt, Staphylococcus aureus subsp. aureus MW2
gguaauugaucuaaa

SEQ ID NO: 4015185 - RNA, 16 nt, Staphylococcus aureus subsp. aureus MW2
gguaauuuaacaacug

SEQ ID NO: 4015186 - RNA, 14 nt, Staphylococcus aureus subsp. aureus MW2
gguacaaaaaauua

SEQ ID NO: 4015187 - RNA, 17 nt, Staphylococcus aureus subsp. aureus MW2
gguacaacuaaauaugc

SEQ ID NO: 4015188 - RNA, 23 nt, Staphylococcus aureus subsp. aureus MW2
gguacacauguacguuuuuuuaa

SEQ ID NO: 4015189 - RNA, 22 nt, Staphylococcus aureus subsp. aureus MW2
gguacaccuacaaauauuucua

SEQ ID NO: 4015190 - RNA, 22 nt, Staphylococcus aureus subsp. aureus MW2
gguaccuuuuuauuaucuuuaa

SEQ ID NO: 4015191 - RNA, 17 nt, Staphylococcus aureus subsp. aureus MW2
gguauagauuuuauaaa

SEQ ID NO: 4015192 - RNA, 18 nt, Staphylococcus aureus subsp. aureus MW2
gguauccuucucaucauu

SEQ ID NO: 4015193 - RNA, 13 nt, Staphylococcus aureus subsp. aureus MW2
gguaucuaaaugu

SEQ ID NO: 4015194 - RNA, 22 nt, Staphylococcus aureus subsp. aureus MW2
gguaugacaguaaucaaaguau

SEQ ID NO: 4015195 - RNA, 15 nt, Staphylococcus aureus subsp. aureus MW2
gguaugacugcaaau

SEQ ID NO: 4015196 - RNA, 21 nt, Staphylococcus aureus subsp. aureus MW2
gguaugauauuucuaaauugu

SEQ ID NO: 4015197 - RNA, 18 nt, Staphylococcus aureus subsp. aureus MW2
gguaugauuuuugaacca

SEQ ID NO: 4015198 - RNA, 18 nt, Staphylococcus aureus subsp. aureus MW2
gguauuagaacuucucuu

SEQ ID NO: 4015199 - RNA, 14 nt, Staphylococcus aureus subsp. aureus MW2
gguauucaaauaaa

SEQ ID NO: 4015200 - RNA, 19 nt, Staphylococcus aureus subsp. aureus MW2
gguauucaaauaaacacau

SEQ ID NO: 4015201 - RNA, 17 nt, Staphylococcus aureus subsp. aureus MW2
ggucaacuguaguggaa

SEQ ID NO: 4015202 - RNA, 15 nt, Staphylococcus aureus subsp. aureus MW2
ggucaauuuuaccau

SEQ ID NO: 4015203 - RNA, 14 nt, Staphylococcus aureus subsp. aureus MW2
ggucacuuuuaauc

SEQ ID NO: 4015204 - RNA, 22 nt, Staphylococcus aureus subsp. aureus MW2
ggucauuuaaacaacugaguca

SEQ ID NO: 4015205 - RNA, 21 nt, Staphylococcus aureus subsp. aureus MW2
gguccaaaucgugauaucuug

SEQ ID NO: 4015206 - RNA, 21 nt, Staphylococcus aureus subsp. aureus MW2
ggucuacgaucaaaaucaugc

SEQ ID NO: 4015207 - RNA, 16 nt, Staphylococcus aureus subsp. aureus MW2
ggucuccaauacuuuu

SEQ ID NO: 4015208 - RNA, 22 nt, Staphylococcus aureus subsp. aureus MW2
ggucuucgcaaucauuagcgaa

SEQ ID NO: 4015209 - RNA, 18 nt, Staphylococcus aureus subsp. aureus MW2
ggucuuuuaauuaaaagu

SEQ ID NO: 4015210 - RNA, 19 nt, Staphylococcus aureus subsp. aureus MW2
ggugaaaguacuuggaaaa

SEQ ID NO: 4015211 - RNA, 13 nt, Staphylococcus aureus subsp. aureus MW2
ggugagggcccca

SEQ ID NO: 4015212 - RNA, 21 nt, Staphylococcus aureus subsp. aureus MW2
ggugagggccccaacacagaa

SEQ ID NO: 4015213 - RNA, 19 nt, Staphylococcus aureus subsp. aureus MW2
ggugauucaccuaauaaug

SEQ ID NO: 4015214 - RNA, 21 nt, Staphylococcus aureus subsp. aureus MW2
ggugcaauaauaaauaggaug

SEQ ID NO: 4015215 - RNA, 14 nt, Staphylococcus aureus subsp. aureus MW2
gguggcaccacaua

SEQ ID NO: 4015216 - RNA, 14 nt, Staphylococcus aureus subsp. aureus MW2
gguguuuagucuuu

SEQ ID NO: 4015217 - RNA, 12 nt, Staphylococcus aureus subsp. aureus MW2
gguuaacacguu

SEQ ID NO: 4015218 - RNA, 20 nt, Staphylococcus aureus subsp. aureus MW2
gguuaaugacuaugcaaaug

SEQ ID NO: 4015219 - RNA, 15 nt, Staphylococcus aureus subsp. aureus MW2
gguuaccaucuuuaa

SEQ ID NO: 4015220 - RNA, 14 nt, Staphylococcus aureus subsp. aureus MW2
gguuagaaaaaaau

SEQ ID NO: 4015221 - RNA, 22 nt, Staphylococcus aureus subsp. aureus MW2
gguuauauaaacaaaaggcugg

SEQ ID NO: 4015222 - RNA, 12 nt, Staphylococcus aureus subsp. aureus MW2
gguuauuugaua

SEQ ID NO: 4015223 - RNA, 16 nt, Staphylococcus aureus subsp. aureus MW2
gguuauuuucaaugau

SEQ ID NO: 4015224 - RNA, 11 nt, Staphylococcus aureus subsp. aureus MW2
gguucaaaucc

SEQ ID NO: 4015225 - RNA, 12 nt, Staphylococcus aureus subsp. aureus MW2
gguucaucuaaa

SEQ ID NO: 4015226 - RNA, 13 nt, Staphylococcus aureus subsp. aureus MW2
gguucgaaucccu

SEQ ID NO: 4015227 - RNA, 14 nt, Staphylococcus aureus subsp. aureus MW2
gguuguuucaauuc

SEQ ID NO: 4015228 - RNA, 19 nt, Staphylococcus aureus subsp. aureus MW2
gguuguuuuucaucauuaa

SEQ ID NO: 4015229 - RNA, 19 nt, Staphylococcus aureus subsp. aureus MW2
gguuuaaucuauauauaug

SEQ ID NO: 4015230 - RNA, 16 nt, Staphylococcus aureus subsp. aureus MW2
gguuuaauguuuaaua

SEQ ID NO: 4015231 - RNA, 21 nt, Staphylococcus aureus subsp. aureus MW2
gguuuaucagcuuuaauaaua

SEQ ID NO: 4015232 - RNA, 18 nt, Staphylococcus aureus subsp. aureus MW2
guaaaaacguucaaucgu

SEQ ID NO: 4015233 - RNA, 21 nt, Staphylococcus aureus subsp. aureus MW2
guaaaaagugguuaauaacag

SEQ ID NO: 4015234 - RNA, 23 nt, Staphylococcus aureus subsp. aureus MW2
guaaaacaaauuacacccuuuaa

SEQ ID NO: 4015235 - RNA, 21 nt, Staphylococcus aureus subsp. aureus MW2
guaaaacauucccuuaauaau

SEQ ID NO: 4015236 - RNA, 21 nt, Staphylococcus aureus subsp. aureus MW2
guaaaaccuuacccaaaaaau

SEQ ID NO: 4015237 - RNA, 16 nt, Staphylococcus aureus subsp. aureus MW2
guaaaagugaauaauu

SEQ ID NO: 4015238 - RNA, 20 nt, Staphylococcus aureus subsp. aureus MW2
guaaaaucauuaauaauuaa

SEQ ID NO: 4015239 - RNA, 11 nt, Staphylococcus aureus subsp. aureus MW2
guaaaaugaug

SEQ ID NO: 4015240 - RNA, 18 nt, Staphylococcus aureus subsp. aureus MW2
guaaaaugaugauuuaaa

SEQ ID NO: 4015241 - RNA, 22 nt, Staphylococcus aureus subsp. aureus MW2
guaaaaugaugauuuaaagcaa

SEQ ID NO: 4015242 - RNA, 21 nt, Staphylococcus aureus subsp. aureus MW2
guaaaaugcucccuucaaagu

SEQ ID NO: 4015243 - RNA, 21 nt, Staphylococcus aureus subsp. aureus MW2
guaaacaacaucgauuuauca

SEQ ID NO: 4015244 - RNA, 14 nt, Staphylococcus aureus subsp. aureus MW2
guaaacacuauaaa

SEQ ID NO: 4015245 - RNA, 18 nt, Staphylococcus aureus subsp. aureus MW2
guaaaccagcuaaaccau

SEQ ID NO: 4015246 - RNA, 21 nt, Staphylococcus aureus subsp. aureus MW2
guaaaccgaggugucaauaaa

SEQ ID NO: 4015247 - RNA, 18 nt, Staphylococcus aureus subsp. aureus MW2
guaaaccuacuaauauau

SEQ ID NO: 4015248 - RNA, 18 nt, Staphylococcus aureus subsp. aureus MW2
guaaacgauacugcuuug

SEQ ID NO: 4015249 - RNA, 19 nt, Staphylococcus aureus subsp. aureus MW2
guaaacggaauaacuuuuu

SEQ ID NO: 4015250 - RNA, 21 nt, Staphylococcus aureus subsp. aureus MW2
guaaaggcgauauuugcuagu

SEQ ID NO: 4015251 - RNA, 14 nt, Staphylococcus aureus subsp. aureus MW2
guaaauaaaacuau

SEQ ID NO: 4015252 - RNA, 14 nt, Staphylococcus aureus subsp. aureus MW2
guaaauaauuuaaa

SEQ ID NO: 4015253 - RNA, 21 nt, Staphylococcus aureus subsp. aureus MW2
guaaauauaguaauaaaaguc

SEQ ID NO: 4015254 - RNA, 22 nt, Staphylococcus aureus subsp. aureus MW2
guaaauauuuuuuaaaaugaua

SEQ ID NO: 4015255 - RNA, 18 nt, Staphylococcus aureus subsp. aureus MW2
guaaaucacgauuuucaa

SEQ ID NO: 4015256 - RNA, 13 nt, Staphylococcus aureus subsp. aureus MW2
guaaaucaucaua

SEQ ID NO: 4015257 - RNA, 14 nt, Staphylococcus aureus subsp. aureus MW2
guaaaucaugacau

SEQ ID NO: 4015258 - RNA, 21 nt, Staphylococcus aureus subsp. aureus MW2
guaaaucgugcuguuaucaug

SEQ ID NO: 4015259 - RNA, 20 nt, Staphylococcus aureus subsp. aureus MW2
guaaaucuuguuggauuuua

SEQ ID NO: 4015260 - RNA, 13 nt, Staphylococcus aureus subsp. aureus MW2
guaaaugaaaugg

SEQ ID NO: 4015261 - RNA, 14 nt, Staphylococcus aureus subsp. aureus MW2
guaaauguuaaauu

SEQ ID NO: 4015262 - RNA, 16 nt, Staphylococcus aureus subsp. aureus MW2
guaaauguuaaauucu

SEQ ID NO: 4015263 - RNA, 16 nt, Staphylococcus aureus subsp. aureus MW2
guaacaaaugcguauc

SEQ ID NO: 4015264 - RNA, 19 nt, Staphylococcus aureus subsp. aureus MW2
guaacaaguucauuucaau

SEQ ID NO: 4015265 - RNA, 22 nt, Staphylococcus aureus subsp. aureus MW2
guaacagcuaaggcugauucaa

SEQ ID NO: 4015266 - RNA, 23 nt, Staphylococcus aureus subsp. aureus MW2
guaacaucuguagguuuaauguu

SEQ ID NO: 4015267 - RNA, 14 nt, Staphylococcus aureus subsp. aureus MW2
guaacauguaauga

SEQ ID NO: 4015268 - RNA, 19 nt, Staphylococcus aureus subsp. aureus MW2
guaacauuagcaugauaaa

SEQ ID NO: 4015269 - RNA, 15 nt, Staphylococcus aureus subsp. aureus MW2
guaaccccauuuuaa

SEQ ID NO: 4015270 - RNA, 13 nt, Staphylococcus aureus subsp. aureus MW2
guaaccugacuuu

SEQ ID NO: 4015271 - RNA, 16 nt, Staphylococcus aureus subsp. aureus MW2
guaaccugacuuuccg

SEQ ID NO: 4015272 - RNA, 18 nt, Staphylococcus aureus subsp. aureus MW2
guaacgaagauuuuguug

SEQ ID NO: 4015273 - RNA, 13 nt, Staphylococcus aureus subsp. aureus MW2
guaacuaaaaugu

SEQ ID NO: 4015274 - RNA, 16 nt, Staphylococcus aureus subsp. aureus MW2
guaagacgauuucaau

SEQ ID NO: 4015275 - RNA, 18 nt, Staphylococcus aureus subsp. aureus MW2
guaagacgccgaaaagag

SEQ ID NO: 4015276 - RNA, 20 nt, Staphylococcus aureus subsp. aureus MW2
guaagcuuagaaacgaaauu

SEQ ID NO: 4015277 - RNA, 21 nt, Staphylococcus aureus subsp. aureus MW2
guaaggaauuacacuuuaaau

SEQ ID NO: 4015278 - RNA, 20 nt, Staphylococcus aureus subsp. aureus MW2
guaagguggacuucuaucuu

SEQ ID NO: 4015279 - RNA, 21 nt, Staphylococcus aureus subsp. aureus MW2
guaaguaaaauaaaaaaugca

SEQ ID NO: 4015280 - RNA, 21 nt, Staphylococcus aureus subsp. aureus MW2
guaaguacgaggaccaucucu

SEQ ID NO: 4015281 - RNA, 16 nt, Staphylococcus aureus subsp. aureus MW2
guaaguuguacuucuu

SEQ ID NO: 4015282 - RNA, 16 nt, Staphylococcus aureus subsp. aureus MW2
guaaguuugguuucuu

SEQ ID NO: 4015283 - RNA, 18 nt, Staphylococcus aureus subsp. aureus MW2
guaauaacaucuaaauuu

SEQ ID NO: 4015284 - RNA, 16 nt, Staphylococcus aureus subsp. aureus MW2
guaauaaguaauaauu

SEQ ID NO: 4015285 - RNA, 19 nt, Staphylococcus aureus subsp. aureus MW2
guaauaauucagaugaaua

SEQ ID NO: 4015286 - RNA, 14 nt, Staphylococcus aureus subsp. aureus MW2
guaauaauuuacag

SEQ ID NO: 4015287 - RNA, 21 nt, Staphylococcus aureus subsp. aureus MW2
guaauacaagcaauacgauug

SEQ ID NO: 4015288 - RNA, 19 nt, Staphylococcus aureus subsp. aureus MW2
guaauacaucaucaaguuc

SEQ ID NO: 4015289 - RNA, 19 nt, Staphylococcus aureus subsp. aureus MW2
guaauaccuuuacuuucau

SEQ ID NO: 4015290 - RNA, 19 nt, Staphylococcus aureus subsp. aureus MW2
guaauacuauaugaaaaga

SEQ ID NO: 4015291 - RNA, 21 nt, Staphylococcus aureus subsp. aureus MW2
guaauagaacgaaauaguuca

SEQ ID NO: 4015292 - RNA, 22 nt, Staphylococcus aureus subsp. aureus MW2
guaauagaacgaaauaguucaa

SEQ ID NO: 4015293 - RNA, 18 nt, Staphylococcus aureus subsp. aureus MW2
guaauauauuaauauuga

SEQ ID NO: 4015294 - RNA, 19 nt, Staphylococcus aureus subsp. aureus MW2
guaauauuuuuguugcaau

SEQ ID NO: 4015295 - RNA, 22 nt, Staphylococcus aureus subsp. aureus MW2
guaaucacuauuuguuguuaua

SEQ ID NO: 4015296 - RNA, 23 nt, Staphylococcus aureus subsp. aureus MW2
guaaucauuauagcagguggcau

SEQ ID NO: 4015297 - RNA, 23 nt, Staphylococcus aureus subsp. aureus MW2
guaaucgauugguaaaucuacua

SEQ ID NO: 4015298 - RNA, 11 nt, Staphylococcus aureus subsp. aureus MW2
guaaucuauuu

SEQ ID NO: 4015299 - RNA, 17 nt, Staphylococcus aureus subsp. aureus MW2
guaaugaaucaauugca

SEQ ID NO: 4015300 - RNA, 13 nt, Staphylococcus aureus subsp. aureus MW2
guaaugauacgca

SEQ ID NO: 4015301 - RNA, 12 nt, Staphylococcus aureus subsp. aureus MW2
guaaugauuuug

SEQ ID NO: 4015302 - RNA, 23 nt, Staphylococcus aureus subsp. aureus MW2
guaaugcuuaaaaacaauauuga

SEQ ID NO: 4015303 - RNA, 11 nt, Staphylococcus aureus subsp. aureus MW2
guaauguguua

SEQ ID NO: 4015304 - RNA, 23 nt, Staphylococcus aureus subsp. aureus MW2
guaauguguuaauacuucauauc

SEQ ID NO: 4015305 - RNA, 20 nt, Staphylococcus aureus subsp. aureus MW2
guaauguuccccugaaaaga

SEQ ID NO: 4015306 - RNA, 13 nt, Staphylococcus aureus subsp. aureus MW2
guaauuaaauacu

SEQ ID NO: 4015307 - RNA, 13 nt, Staphylococcus aureus subsp. aureus MW2
guaauuaauacau

SEQ ID NO: 4015308 - RNA, 13 nt, Staphylococcus aureus subsp. aureus MW2
guaauuauuuuuc

SEQ ID NO: 4015309 - RNA, 21 nt, Staphylococcus aureus subsp. aureus MW2
guaauucaccaucauauucaa

SEQ ID NO: 4015310 - RNA, 16 nt, Staphylococcus aureus subsp. aureus MW2
guaauucauuugcuuu

SEQ ID NO: 4015311 - RNA, 15 nt, Staphylococcus aureus subsp. aureus MW2
guaauucuuguaaau

SEQ ID NO: 4015312 - RNA, 18 nt, Staphylococcus aureus subsp. aureus MW2
guaauucuuguaaaucau

SEQ ID NO: 4015313 - RNA, 14 nt, Staphylococcus aureus subsp. aureus MW2
guaauucuuuacca

SEQ ID NO: 4015314 - RNA, 21 nt, Staphylococcus aureus subsp. aureus MW2
guaauugaucuaaauuaguua

SEQ ID NO: 4015315 - RNA, 18 nt, Staphylococcus aureus subsp. aureus MW2
guaauugaugauuacucc

SEQ ID NO: 4015316 - RNA, 17 nt, Staphylococcus aureus subsp. aureus MW2
guaauuguaaucuauuu

SEQ ID NO: 4015317 - RNA, 20 nt, Staphylococcus aureus subsp. aureus MW2
guaauuuaauagguucuucu

SEQ ID NO: 4015318 - RNA, 12 nt, Staphylococcus aureus subsp. aureus MW2
guaauuuuaaug

SEQ ID NO: 4015319 - RNA, 15 nt, Staphylococcus aureus subsp. aureus MW2
guaauuuuuaaacaa

SEQ ID NO: 4015320 - RNA, 23 nt, Staphylococcus aureus subsp. aureus MW2
guaauuuuuaaacaaaaauaagu

SEQ ID NO: 4015321 - RNA, 14 nt, Staphylococcus aureus subsp. aureus MW2
guacaaaauaauga

SEQ ID NO: 4015322 - RNA, 11 nt, Staphylococcus aureus subsp. aureus MW2
guacaaauaac

SEQ ID NO: 4015323 - RNA, 14 nt, Staphylococcus aureus subsp. aureus MW2
guacaaauaauaca

SEQ ID NO: 4015324 - RNA, 19 nt, Staphylococcus aureus subsp. aureus MW2
guacaauuuuuaaaaaccu

SEQ ID NO: 4015325 - RNA, 14 nt, Staphylococcus aureus subsp. aureus MW2
guacagauaagaau

SEQ ID NO: 4015326 - RNA, 15 nt, Staphylococcus aureus subsp. aureus MW2
guacaguaauauuca

SEQ ID NO: 4015327 - RNA, 16 nt, Staphylococcus aureus subsp. aureus MW2
guacaguaauauucaa

SEQ ID NO: 4015328 - RNA, 19 nt, Staphylococcus aureus subsp. aureus MW2
guacaguaauauucaacuu

SEQ ID NO: 4015329 - RNA, 12 nt, Staphylococcus aureus subsp. aureus MW2
guacauaaaaau

SEQ ID NO: 4015330 - RNA, 17 nt, Staphylococcus aureus subsp. aureus MW2
guacauaaaugcuaaaa

SEQ ID NO: 4015331 - RNA, 17 nt, Staphylococcus aureus subsp. aureus MW2
guacauauguuguuucu

SEQ ID NO: 4015332 - RNA, 16 nt, Staphylococcus aureus subsp. aureus MW2
guacauguauuggcca

SEQ ID NO: 4015333 - RNA, 15 nt, Staphylococcus aureus subsp. aureus MW2
guacauugguuuuua

SEQ ID NO: 4015334 - RNA, 16 nt, Staphylococcus aureus subsp. aureus MW2
guacauuuauuuucaa

SEQ ID NO: 4015335 - RNA, 20 nt, Staphylococcus aureus subsp. aureus MW2
guacauuuauuuucaauaaa

SEQ ID NO: 4015336 - RNA, 22 nt, Staphylococcus aureus subsp. aureus MW2
guacauuuauuuucaauaaaua

SEQ ID NO: 4015337 - RNA, 13 nt, Staphylococcus aureus subsp. aureus MW2
guaccaagcuuca

SEQ ID NO: 4015338 - RNA, 16 nt, Staphylococcus aureus subsp. aureus MW2
guaccacuguauuuac

SEQ ID NO: 4015339 - RNA, 13 nt, Staphylococcus aureus subsp. aureus MW2
guaccguauuuua

SEQ ID NO: 4015340 - RNA, 22 nt, Staphylococcus aureus subsp. aureus MW2
guaccuuuuuauugauauuaau

SEQ ID NO: 4015341 - RNA, 15 nt, Staphylococcus aureus subsp. aureus MW2
guacgaggaccaucu

SEQ ID NO: 4015342 - RNA, 20 nt, Staphylococcus aureus subsp. aureus MW2
guacggcugcuuuaacugua

SEQ ID NO: 4015343 - RNA, 20 nt, Staphylococcus aureus subsp. aureus MW2
guacgguuauuuaauaaugc

SEQ ID NO: 4015344 - RNA, 14 nt, Staphylococcus aureus subsp. aureus MW2
guacguuugcauau

SEQ ID NO: 4015345 - RNA, 15 nt, Staphylococcus aureus subsp. aureus MW2
guacguuuuaaauaa

SEQ ID NO: 4015346 - RNA, 20 nt, Staphylococcus aureus subsp. aureus MW2
guacguuuuuuuaaauacau

SEQ ID NO: 4015347 - RNA, 15 nt, Staphylococcus aureus subsp. aureus MW2
guacuaaucaauacu

SEQ ID NO: 4015348 - RNA, 12 nt, Staphylococcus aureus subsp. aureus MW2
guacuauuaaaa

SEQ ID NO: 4015349 - RNA, 19 nt, Staphylococcus aureus subsp. aureus MW2
guacuauuaucuauccauu

SEQ ID NO: 4015350 - RNA, 21 nt, Staphylococcus aureus subsp. aureus MW2
guacuuaccuuucaaauauau

SEQ ID NO: 4015351 - RNA, 19 nt, Staphylococcus aureus subsp. aureus MW2
guacuucaaagcaucuaau

SEQ ID NO: 4015352 - RNA, 22 nt, Staphylococcus aureus subsp. aureus MW2
guacuucuaauuugcaaaauca

SEQ ID NO: 4015353 - RNA, 23 nt, Staphylococcus aureus subsp. aureus MW2
guagaaaauagcuguuugauauu

SEQ ID NO: 4015354 - RNA, 15 nt, Staphylococcus aureus subsp. aureus MW2
guagaaacacaagga

SEQ ID NO: 4015355 - RNA, 18 nt, Staphylococcus aureus subsp. aureus MW2
guagaaacacaaggaaua

SEQ ID NO: 4015356 - RNA, 13 nt, Staphylococcus aureus subsp. aureus MW2
guagaguuuagga

SEQ ID NO: 4015357 - RNA, 14 nt, Staphylococcus aureus subsp. aureus MW2
guagcaaugacgac

SEQ ID NO: 4015358 - RNA, 20 nt, Staphylococcus aureus subsp. aureus MW2
guagcauuuuagauugacua

SEQ ID NO: 4015359 - RNA, 14 nt, Staphylococcus aureus subsp. aureus MW2
guagcuugaauaau

SEQ ID NO: 4015360 - RNA, 16 nt, Staphylococcus aureus subsp. aureus MW2
guaggagugaacuaua

SEQ ID NO: 4015361 - RNA, 13 nt, Staphylococcus aureus subsp. aureus MW2
guaggcauuuuau

SEQ ID NO: 4015362 - RNA, 20 nt, Staphylococcus aureus subsp. aureus MW2
guaggggagucuuauuuuua

SEQ ID NO: 4015363 - RNA, 16 nt, Staphylococcus aureus subsp. aureus MW2
guaguacuauagucau

SEQ ID NO: 4015364 - RNA, 23 nt, Staphylococcus aureus subsp. aureus MW2
guaguauauaugacuuuagcauu

SEQ ID NO: 4015365 - RNA, 21 nt, Staphylococcus aureus subsp. aureus MW2
guagucgaagaagauuaugaa

SEQ ID NO: 4015366 - RNA, 13 nt, Staphylococcus aureus subsp. aureus MW2
guaguuaauauaa

SEQ ID NO: 4015367 - RNA, 17 nt, Staphylococcus aureus subsp. aureus MW2
guaguuagguaaaaauu

SEQ ID NO: 4015368 - RNA, 20 nt, Staphylococcus aureus subsp. aureus MW2
guaguuccucgguauucaau

SEQ ID NO: 4015369 - RNA, 18 nt, Staphylococcus aureus subsp. aureus MW2
guaguucggaugagaaau

SEQ ID NO: 4015370 - RNA, 18 nt, Staphylococcus aureus subsp. aureus MW2
guaguugacuguaaaaca

SEQ ID NO: 4015371 - RNA, 22 nt, Staphylococcus aureus subsp. aureus MW2
guaguuggcugauagaugaaaa

SEQ ID NO: 4015372 - RNA, 23 nt, Staphylococcus aureus subsp. aureus MW2
guaguuggcugauagaugaaaau

SEQ ID NO: 4015373 - RNA, 14 nt, Staphylococcus aureus subsp. aureus MW2
guauaaaacagaau

SEQ ID NO: 4015374 - RNA, 20 nt, Staphylococcus aureus subsp. aureus MW2
guauaaacgcaaauuaaaua

SEQ ID NO: 4015375 - RNA, 22 nt, Staphylococcus aureus subsp. aureus MW2
guauaaagggcuauuugauaca

SEQ ID NO: 4015376 - RNA, 18 nt, Staphylococcus aureus subsp. aureus MW2
guauaaauaaaaauacau

SEQ ID NO: 4015377 - RNA, 19 nt, Staphylococcus aureus subsp. aureus MW2
guauaaauaucauaaaugc

SEQ ID NO: 4015378 - RNA, 22 nt, Staphylococcus aureus subsp. aureus MW2
guauaaauaucauaaaugcaua

SEQ ID NO: 4015379 - RNA, 13 nt, Staphylococcus aureus subsp. aureus MW2
guauaaaugcagc

SEQ ID NO: 4015380 - RNA, 14 nt, Staphylococcus aureus subsp. aureus MW2
guauaaccauaaug

SEQ ID NO: 4015381 - RNA, 20 nt, Staphylococcus aureus subsp. aureus MW2
guauaauacaugauauaaau

SEQ ID NO: 4015382 - RNA, 21 nt, Staphylococcus aureus subsp. aureus MW2
guauaauggacgguauuuuca

SEQ ID NO: 4015383 - RNA, 22 nt, Staphylococcus aureus subsp. aureus MW2
guauaauggacgguauuuucaa

SEQ ID NO: 4015384 - RNA, 14 nt, Staphylococcus aureus subsp. aureus MW2
guauaauuaaacua

SEQ ID NO: 4015385 - RNA, 23 nt, Staphylococcus aureus subsp. aureus MW2
guauacacaaauuuuuuggaaac

SEQ ID NO: 4015386 - RNA, 17 nt, Staphylococcus aureus subsp. aureus MW2
guauagaugcuaaugua

SEQ ID NO: 4015387 - RNA, 22 nt, Staphylococcus aureus subsp. aureus MW2
guauagauuguauuuaauaagu

SEQ ID NO: 4015388 - RNA, 17 nt, Staphylococcus aureus subsp. aureus MW2
guauagauuuuauaaaa

SEQ ID NO: 4015389 - RNA, 14 nt, Staphylococcus aureus subsp. aureus MW2
guauauaagcaaag

SEQ ID NO: 4015390 - RNA, 13 nt, Staphylococcus aureus subsp. aureus MW2
guauauacgauug

SEQ ID NO: 4015391 - RNA, 20 nt, Staphylococcus aureus subsp. aureus MW2
guauaucuguauaaaaacca

SEQ ID NO: 4015392 - RNA, 22 nt, Staphylococcus aureus subsp. aureus MW2
guauaugaauuuuauaaauuaa

SEQ ID NO: 4015393 - RNA, 13 nt, Staphylococcus aureus subsp. aureus MW2
guauauguauaga

SEQ ID NO: 4015394 - RNA, 18 nt, Staphylococcus aureus subsp. aureus MW2
guauauguguguugcuuu

SEQ ID NO: 4015395 - RNA, 18 nt, Staphylococcus aureus subsp. aureus MW2
guauauugcuuauguaca

SEQ ID NO: 4015396 - RNA, 17 nt, Staphylococcus aureus subsp. aureus MW2
guaucaacauuaauaaa

SEQ ID NO: 4015397 - RNA, 21 nt, Staphylococcus aureus subsp. aureus MW2
guaucaaggucaacaaugcca

SEQ ID NO: 4015398 - RNA, 16 nt, Staphylococcus aureus subsp. aureus MW2
guaucaucaaaauuua

SEQ ID NO: 4015399 - RNA, 20 nt, Staphylococcus aureus subsp. aureus MW2
guaucaugcuuuuuaauguu

SEQ ID NO: 4015400 - RNA, 14 nt, Staphylococcus aureus subsp. aureus MW2
guaucauuucagaa

SEQ ID NO: 4015401 - RNA, 20 nt, Staphylococcus aureus subsp. aureus MW2
guaucccaaccaugcuuuuu

SEQ ID NO: 4015402 - RNA, 20 nt, Staphylococcus aureus subsp. aureus MW2
guauccccauuuauguguug

SEQ ID NO: 4015403 - RNA, 21 nt, Staphylococcus aureus subsp. aureus MW2
guauccuguguaaaauaaauc

SEQ ID NO: 4015404 - RNA, 15 nt, Staphylococcus aureus subsp. aureus MW2
guauccuuuauaaau

SEQ ID NO: 4015405 - RNA, 17 nt, Staphylococcus aureus subsp. aureus MW2
guauccuuuauaaauaa

SEQ ID NO: 4015406 - RNA, 15 nt, Staphylococcus aureus subsp. aureus MW2
guaucguuaccuuuu

SEQ ID NO: 4015407 - RNA, 23 nt, Staphylococcus aureus subsp. aureus MW2
guaucuaguguucucauuauaau

SEQ ID NO: 4015408 - RNA, 14 nt, Staphylococcus aureus subsp. aureus MW2
guaucuauaaaaag

SEQ ID NO: 4015409 - RNA, 16 nt, Staphylococcus aureus subsp. aureus MW2
guaucuauacaauuau

SEQ ID NO: 4015410 - RNA, 20 nt, Staphylococcus aureus subsp. aureus MW2
guaucucugaaaaacuucuu

SEQ ID NO: 4015411 - RNA, 22 nt, Staphylococcus aureus subsp. aureus MW2
guaucucugaaaaacuucuuaa

SEQ ID NO: 4015412 - RNA, 14 nt, Staphylococcus aureus subsp. aureus MW2
guaugagucaaauu

SEQ ID NO: 4015413 - RNA, 19 nt, Staphylococcus aureus subsp. aureus MW2
guaugcccucauaaaucau

SEQ ID NO: 4015414 - RNA, 22 nt, Staphylococcus aureus subsp. aureus MW2
guaugcuuguacaaaaaauugu

SEQ ID NO: 4015415 - RNA, 13 nt, Staphylococcus aureus subsp. aureus MW2
guauggaauaaau

SEQ ID NO: 4015416 - RNA, 18 nt, Staphylococcus aureus subsp. aureus MW2
guauggaauaaaugguuu

SEQ ID NO: 4015417 - RNA, 13 nt, Staphylococcus aureus subsp. aureus MW2
guauggauguauu

SEQ ID NO: 4015418 - RNA, 21 nt, Staphylococcus aureus subsp. aureus MW2
guauguaagcagacuaaaagu

SEQ ID NO: 4015419 - RNA, 20 nt, Staphylococcus aureus subsp. aureus MW2
guauuaaauuucaaauauaa

SEQ ID NO: 4015420 - RNA, 20 nt, Staphylococcus aureus subsp. aureus MW2
guauuaacuaauaacuagua

SEQ ID NO: 4015421 - RNA, 17 nt, Staphylococcus aureus subsp. aureus MW2
guauuagaacuucucuu

SEQ ID NO: 4015422 - RNA, 13 nt, Staphylococcus aureus subsp. aureus MW2
guauuauuauaau

SEQ ID NO: 4015423 - RNA, 19 nt, Staphylococcus aureus subsp. aureus MW2
guauuauucucucauuugu

SEQ ID NO: 4015424 - RNA, 20 nt, Staphylococcus aureus subsp. aureus MW2
guauucaaaguuuucauuua

SEQ ID NO: 4015425 - RNA, 19 nt, Staphylococcus aureus subsp. aureus MW2
guauucuuggcguauuuuu

SEQ ID NO: 4015426 - RNA, 19 nt, Staphylococcus aureus subsp. aureus MW2
guauugccguuauuuucaa

SEQ ID NO: 4015427 - RNA, 18 nt, Staphylococcus aureus subsp. aureus MW2
guauuugccuuuugaaua

SEQ ID NO: 4015428 - RNA, 17 nt, Staphylococcus aureus subsp. aureus MW2
guauuuuaaugauuuuu

SEQ ID NO: 4015429 - RNA, 20 nt, Staphylococcus aureus subsp. aureus MW2
guauuuuaaugauuuuucau

SEQ ID NO: 4015430 - RNA, 23 nt, Staphylococcus aureus subsp. aureus MW2
guauuuuauuuauuuugauuaac

SEQ ID NO: 4015431 - RNA, 22 nt, Staphylococcus aureus subsp. aureus MW2
guauuuuuauuguuuuggcuuu

SEQ ID NO: 4015432 - RNA, 21 nt, Staphylococcus aureus subsp. aureus MW2
guauuuuucauauugcuaccc

SEQ ID NO: 4015433 - RNA, 19 nt, Staphylococcus aureus subsp. aureus MW2
guauuuuuuuauaauuuug

SEQ ID NO: 4015434 - RNA, 22 nt, Staphylococcus aureus subsp. aureus MW2
gucaaacggcacuaauauuuaa

SEQ ID NO: 4015435 - RNA, 23 nt, Staphylococcus aureus subsp. aureus MW2
gucaaacggcacuaauauuuaaa

SEQ ID NO: 4015436 - RNA, 18 nt, Staphylococcus aureus subsp. aureus MW2
gucaaauuggacuuaugg

SEQ ID NO: 4015437 - RNA, 16 nt, Staphylococcus aureus subsp. aureus MW2
gucaacuuuuuuaacu

SEQ ID NO: 4015438 - RNA, 14 nt, Staphylococcus aureus subsp. aureus MW2
gucaaguaaauguu

SEQ ID NO: 4015439 - RNA, 19 nt, Staphylococcus aureus subsp. aureus MW2
gucaauuucuuuaaagucu

SEQ ID NO: 4015440 - RNA, 16 nt, Staphylococcus aureus subsp. aureus MW2
gucacaaacaagaaua

SEQ ID NO: 4015441 - RNA, 15 nt, Staphylococcus aureus subsp. aureus MW2
gucacuuuauuaaau

SEQ ID NO: 4015442 - RNA, 21 nt, Staphylococcus aureus subsp. aureus MW2
gucacuuuauuaaauaacuca

SEQ ID NO: 4015443 - RNA, 22 nt, Staphylococcus aureus subsp. aureus MW2
gucagcaaaaagcccuauuauu

SEQ ID NO: 4015444 - RNA, 15 nt, Staphylococcus aureus subsp. aureus MW2
gucagcauacaauaa

SEQ ID NO: 4015445 - RNA, 16 nt, Staphylococcus aureus subsp. aureus MW2
gucaggggccccaaca

SEQ ID NO: 4015446 - RNA, 20 nt, Staphylococcus aureus subsp. aureus MW2
gucaggggccccaacacaga

SEQ ID NO: 4015447 - RNA, 22 nt, Staphylococcus aureus subsp. aureus MW2
gucauaauuuagaagauuagau

SEQ ID NO: 4015448 - RNA, 14 nt, Staphylococcus aureus subsp. aureus MW2
gucauaccuuuuaa

SEQ ID NO: 4015449 - RNA, 20 nt, Staphylococcus aureus subsp. aureus MW2
gucauaguauacauaauuca

SEQ ID NO: 4015450 - RNA, 18 nt, Staphylococcus aureus subsp. aureus MW2
gucauauguuuuauaaua

SEQ ID NO: 4015451 - RNA, 18 nt, Staphylococcus aureus subsp. aureus MW2
gucauauuaauauuuuuu

SEQ ID NO: 4015452 - RNA, 11 nt, Staphylococcus aureus subsp. aureus MW2
gucaucaacac

SEQ ID NO: 4015453 - RNA, 23 nt, Staphylococcus aureus subsp. aureus MW2
gucaugaauuuucaucauuaaac

SEQ ID NO: 4015454 - RNA, 18 nt, Staphylococcus aureus subsp. aureus MW2
gucaugucuagauuucaa

SEQ ID NO: 4015455 - RNA, 20 nt, Staphylococcus aureus subsp. aureus MW2
gucauguguucaaauaacgc

SEQ ID NO: 4015456 - RNA, 19 nt, Staphylococcus aureus subsp. aureus MW2
gucauuaacauaauaauaa

SEQ ID NO: 4015457 - RNA, 23 nt, Staphylococcus aureus subsp. aureus MW2
gucauuaacauaauaauaauaca

SEQ ID NO: 4015458 - RNA, 13 nt, Staphylococcus aureus subsp. aureus MW2
gucauuacaaauc

SEQ ID NO: 4015459 - RNA, 15 nt, Staphylococcus aureus subsp. aureus MW2
gucauucaaucauca

SEQ ID NO: 4015460 - RNA, 21 nt, Staphylococcus aureus subsp. aureus MW2
gucauugguggagauuguaaa

SEQ ID NO: 4015461 - RNA, 13 nt, Staphylococcus aureus subsp. aureus MW2
guccacagaugca

SEQ ID NO: 4015462 - RNA, 15 nt, Staphylococcus aureus subsp. aureus MW2
guccacagaugcauc

SEQ ID NO: 4015463 - RNA, 18 nt, Staphylococcus aureus subsp. aureus MW2
guccacagaugcaucggu

SEQ ID NO: 4015464 - RNA, 22 nt, Staphylococcus aureus subsp. aureus MW2
guccauaaauauuaaauucauc

SEQ ID NO: 4015465 - RNA, 15 nt, Staphylococcus aureus subsp. aureus MW2
gucccaccccaacuu

SEQ ID NO: 4015466 - RNA, 18 nt, Staphylococcus aureus subsp. aureus MW2
gucccaccccaacuugca

SEQ ID NO: 4015467 - RNA, 17 nt, Staphylococcus aureus subsp. aureus MW2
gucccauaaaagacaga

SEQ ID NO: 4015468 - RNA, 18 nt, Staphylococcus aureus subsp. aureus MW2
gucccauaaggaaccugu

SEQ ID NO: 4015469 - RNA, 19 nt, Staphylococcus aureus subsp. aureus MW2
gucccauaaggaaccuguc

SEQ ID NO: 4015470 - RNA, 15 nt, Staphylococcus aureus subsp. aureus MW2
guccgauuugauaaa

SEQ ID NO: 4015471 - RNA, 21 nt, Staphylococcus aureus subsp. aureus MW2
gucgccuaacuuuuauuauca

SEQ ID NO: 4015472 - RNA, 21 nt, Staphylococcus aureus subsp. aureus MW2
gucgcuaaagaccuuucuuga

SEQ ID NO: 4015473 - RNA, 19 nt, Staphylococcus aureus subsp. aureus MW2
gucggggccccaacacaga

SEQ ID NO: 4015474 - RNA, 22 nt, Staphylococcus aureus subsp. aureus MW2
gucggggccccaacacagagaa

SEQ ID NO: 4015475 - RNA, 15 nt, Staphylococcus aureus subsp. aureus MW2
gucguuuaaugggau

SEQ ID NO: 4015476 - RNA, 22 nt, Staphylococcus aureus subsp. aureus MW2
gucguuuagacucaguugugcg

SEQ ID NO: 4015477 - RNA, 16 nt, Staphylococcus aureus subsp. aureus MW2
gucuaaaaaaauguug

SEQ ID NO: 4015478 - RNA, 12 nt, Staphylococcus aureus subsp. aureus MW2
gucuaaaaaugu

SEQ ID NO: 4015479 - RNA, 17 nt, Staphylococcus aureus subsp. aureus MW2
gucuaaagcuuauuaaa

SEQ ID NO: 4015480 - RNA, 12 nt, Staphylococcus aureus subsp. aureus MW2
gucuaacaguua

SEQ ID NO: 4015481 - RNA, 13 nt, Staphylococcus aureus subsp. aureus MW2
gucuacuaaauaa

SEQ ID NO: 4015482 - RNA, 21 nt, Staphylococcus aureus subsp. aureus MW2
gucuaucuccgcuacaauuau

SEQ ID NO: 4015483 - RNA, 10 nt, Staphylococcus aureus subsp. aureus MW2
gucuaugaau

SEQ ID NO: 4015484 - RNA, 16 nt, Staphylococcus aureus subsp. aureus MW2
gucuaugaauaauguu

SEQ ID NO: 4015485 - RNA, 18 nt, Staphylococcus aureus subsp. aureus MW2
gucucacuuaauaaauaa

SEQ ID NO: 4015486 - RNA, 15 nt, Staphylococcus aureus subsp. aureus MW2
gucuccauuauaaag

SEQ ID NO: 4015487 - RNA, 18 nt, Staphylococcus aureus subsp. aureus MW2
gucucuaaaacuuuuuca

SEQ ID NO: 4015488 - RNA, 17 nt, Staphylococcus aureus subsp. aureus MW2
gucugcuauuuuuuuaa

SEQ ID NO: 4015489 - RNA, 15 nt, Staphylococcus aureus subsp. aureus MW2
gucuggaacaauaau

SEQ ID NO: 4015490 - RNA, 11 nt, Staphylococcus aureus subsp. aureus MW2
gucuuaaacau

SEQ ID NO: 4015491 - RNA, 13 nt, Staphylococcus aureus subsp. aureus MW2
gucuuaauucauu

SEQ ID NO: 4015492 - RNA, 22 nt, Staphylococcus aureus subsp. aureus MW2
gucuuaauucauuccaaacaca

SEQ ID NO: 4015493 - RNA, 15 nt, Staphylococcus aureus subsp. aureus MW2
gucuucauuaacauc

SEQ ID NO: 4015494 - RNA, 14 nt, Staphylococcus aureus subsp. aureus MW2
gucuucucuaucag

SEQ ID NO: 4015495 - RNA, 16 nt, Staphylococcus aureus subsp. aureus MW2
gucuugcaauaccucc

SEQ ID NO: 4015496 - RNA, 15 nt, Staphylococcus aureus subsp. aureus MW2
gucuuguaaacuucu

SEQ ID NO: 4015497 - RNA, 14 nt, Staphylococcus aureus subsp. aureus MW2
gucuugugauaauu

SEQ ID NO: 4015498 - RNA, 18 nt, Staphylococcus aureus subsp. aureus MW2
gucuuuaauuuauuuauu

SEQ ID NO: 4015499 - RNA, 12 nt, Staphylococcus aureus subsp. aureus MW2
gucuuuuuauuu

SEQ ID NO: 4015500 - RNA, 11 nt, Staphylococcus aureus subsp. aureus MW2
gugaaaagugu

SEQ ID NO: 4015501 - RNA, 11 nt, Staphylococcus aureus subsp. aureus MW2
gugaaagaaaa

SEQ ID NO: 4015502 - RNA, 21 nt, Staphylococcus aureus subsp. aureus MW2
gugaaaguauuagauauauuu

SEQ ID NO: 4015503 - RNA, 22 nt, Staphylococcus aureus subsp. aureus MW2
gugaaauuagaaaaauaugauu

SEQ ID NO: 4015504 - RNA, 22 nt, Staphylococcus aureus subsp. aureus MW2
gugaaauugcgugcguuuaaca

SEQ ID NO: 4015505 - RNA, 23 nt, Staphylococcus aureus subsp. aureus MW2
gugaauauaaguaaucauaauaa

SEQ ID NO: 4015506 - RNA, 20 nt, Staphylococcus aureus subsp. aureus MW2
gugaaucuuauuuuguuuua

SEQ ID NO: 4015507 - RNA, 23 nt, Staphylococcus aureus subsp. aureus MW2
gugaaucuuauuuuguuuuaaaa

SEQ ID NO: 4015508 - RNA, 22 nt, Staphylococcus aureus subsp. aureus MW2
gugaauguuuucuaaaucuaac

SEQ ID NO: 4015509 - RNA, 19 nt, Staphylococcus aureus subsp. aureus MW2
gugaauuuucagcaucuac

SEQ ID NO: 4015510 - RNA, 13 nt, Staphylococcus aureus subsp. aureus MW2
gugacauuuucaa

SEQ ID NO: 4015511 - RNA, 21 nt, Staphylococcus aureus subsp. aureus MW2
gugaccaauagaauucauuaa

SEQ ID NO: 4015512 - RNA, 22 nt, Staphylococcus aureus subsp. aureus MW2
gugacuuuuauaauucuaaguc

SEQ ID NO: 4015513 - RNA, 20 nt, Staphylococcus aureus subsp. aureus MW2
gugagauacguuauuucaau

SEQ ID NO: 4015514 - RNA, 19 nt, Staphylococcus aureus subsp. aureus MW2
gugagggccccaacacaga

SEQ ID NO: 4015515 - RNA, 11 nt, Staphylococcus aureus subsp. aureus MW2
gugauaaaaau

SEQ ID NO: 4015516 - RNA, 17 nt, Staphylococcus aureus subsp. aureus MW2
gugauaaauagaaacag

SEQ ID NO: 4015517 - RNA, 17 nt, Staphylococcus aureus subsp. aureus MW2
gugauaauguacaugua

SEQ ID NO: 4015518 - RNA, 13 nt, Staphylococcus aureus subsp. aureus MW2
gugauagucuucg

SEQ ID NO: 4015519 - RNA, 18 nt, Staphylococcus aureus subsp. aureus MW2
gugaugcuugaauguuug

SEQ ID NO: 4015520 - RNA, 14 nt, Staphylococcus aureus subsp. aureus MW2
gugaugguaaauca

SEQ ID NO: 4015521 - RNA, 13 nt, Staphylococcus aureus subsp. aureus MW2
gugauucaucuau

SEQ ID NO: 4015522 - RNA, 17 nt, Staphylococcus aureus subsp. aureus MW2
gugauuuguuacuucua

SEQ ID NO: 4015523 - RNA, 14 nt, Staphylococcus aureus subsp. aureus MW2
gugauuuuaccugu

SEQ ID NO: 4015524 - RNA, 22 nt, Staphylococcus aureus subsp. aureus MW2
gugauuuuggaacauauucaua

SEQ ID NO: 4015525 - RNA, 16 nt, Staphylococcus aureus subsp. aureus MW2
gugauuuuuaauaauu

SEQ ID NO: 4015526 - RNA, 22 nt, Staphylococcus aureus subsp. aureus MW2
gugcaagugguaaaaaugaacc

SEQ ID NO: 4015527 - RNA, 16 nt, Staphylococcus aureus subsp. aureus MW2
gugcaaguuggggugg

SEQ ID NO: 4015528 - RNA, 18 nt, Staphylococcus aureus subsp. aureus MW2
gugcaauaauaaauagga

SEQ ID NO: 4015529 - RNA, 14 nt, Staphylococcus aureus subsp. aureus MW2
gugcaucuuuuggu

SEQ ID NO: 4015530 - RNA, 16 nt, Staphylococcus aureus subsp. aureus MW2
gugcaugaugaacuua

SEQ ID NO: 4015531 - RNA, 22 nt, Staphylococcus aureus subsp. aureus MW2
gugccggcuuuuucuuuuguuu

SEQ ID NO: 4015532 - RNA, 15 nt, Staphylococcus aureus subsp. aureus MW2
gugccuuugcuuuuu

SEQ ID NO: 4015533 - RNA, 12 nt, Staphylococcus aureus subsp. aureus MW2
gugccuuuuguu

SEQ ID NO: 4015534 - RNA, 13 nt, Staphylococcus aureus subsp. aureus MW2
gugccuuuuguua

SEQ ID NO: 4015535 - RNA, 21 nt, Staphylococcus aureus subsp. aureus MW2
gugcgcucaucuauaaauacu

SEQ ID NO: 4015536 - RNA, 12 nt, Staphylococcus aureus subsp. aureus MW2
gugcguaucgag

SEQ ID NO: 4015537 - RNA, 18 nt, Staphylococcus aureus subsp. aureus MW2
gugcguuaaauauauauu

SEQ ID NO: 4015538 - RNA, 16 nt, Staphylococcus aureus subsp. aureus MW2
gugcuauguuuuggua

SEQ ID NO: 4015539 - RNA, 20 nt, Staphylococcus aureus subsp. aureus MW2
gugcucuugcaauagcaaca

SEQ ID NO: 4015540 - RNA, 15 nt, Staphylococcus aureus subsp. aureus MW2
gugcuguuaucaugg

SEQ ID NO: 4015541 - RNA, 22 nt, Staphylococcus aureus subsp. aureus MW2
gugcuguucuguuccacaacaa

SEQ ID NO: 4015542 - RNA, 16 nt, Staphylococcus aureus subsp. aureus MW2
gugcuuguaaaauuuu

SEQ ID NO: 4015543 - RNA, 12 nt, Staphylococcus aureus subsp. aureus MW2
gugcuuuuucaa

SEQ ID NO: 4015544 - RNA, 12 nt, Staphylococcus aureus subsp. aureus MW2
gugcuuuuucau

SEQ ID NO: 4015545 - RNA, 21 nt, Staphylococcus aureus subsp. aureus MW2
gugcuuuuucauaaauauuua

SEQ ID NO: 4015546 - RNA, 15 nt, Staphylococcus aureus subsp. aureus MW2
gugggcuccaaacau

SEQ ID NO: 4015547 - RNA, 16 nt, Staphylococcus aureus subsp. aureus MW2
gugguaugacugcaaa

SEQ ID NO: 4015548 - RNA, 23 nt, Staphylococcus aureus subsp. aureus MW2
gugguuuucuuuauuuuaaacau

SEQ ID NO: 4015549 - RNA, 13 nt, Staphylococcus aureus subsp. aureus MW2
guguaaacuagac

SEQ ID NO: 4015550 - RNA, 14 nt, Staphylococcus aureus subsp. aureus MW2
guguaugauagaau

SEQ ID NO: 4015551 - RNA, 22 nt, Staphylococcus aureus subsp. aureus MW2
guguaugauagaauacuaaaag

SEQ ID NO: 4015552 - RNA, 17 nt, Staphylococcus aureus subsp. aureus MW2
guguauucauuuuaaau

SEQ ID NO: 4015553 - RNA, 19 nt, Staphylococcus aureus subsp. aureus MW2
gugucuaacgcuguuucaa

SEQ ID NO: 4015554 - RNA, 20 nt, Staphylococcus aureus subsp. aureus MW2
gugugcaggauaacguucac

SEQ ID NO: 4015555 - RNA, 18 nt, Staphylococcus aureus subsp. aureus MW2
guguggauuuaauuuuua

SEQ ID NO: 4015556 - RNA, 14 nt, Staphylococcus aureus subsp. aureus MW2
guguuaauucuucu

SEQ ID NO: 4015557 - RNA, 17 nt, Staphylococcus aureus subsp. aureus MW2
guguuauauuguauuuu

SEQ ID NO: 4015558 - RNA, 24 nt, Staphylococcus aureus subsp. aureus MW2
guguucaaauaacgcaaugucuug

SEQ ID NO: 4015559 - RNA, 18 nt, Staphylococcus aureus subsp. aureus MW2
guguucgggaauuuuuua

SEQ ID NO: 4015560 - RNA, 19 nt, Staphylococcus aureus subsp. aureus MW2
guguugaaaucuguuuguu

SEQ ID NO: 4015561 - RNA, 13 nt, Staphylococcus aureus subsp. aureus MW2
guguuggggccca

SEQ ID NO: 4015562 - RNA, 13 nt, Staphylococcus aureus subsp. aureus MW2
guguuggggcccc

SEQ ID NO: 4015563 - RNA, 19 nt, Staphylococcus aureus subsp. aureus MW2
guguuucuuuuauuuucau

SEQ ID NO: 4015564 - RNA, 20 nt, Staphylococcus aureus subsp. aureus MW2
guguuuuuaauguuugcuuu

SEQ ID NO: 4015565 - RNA, 16 nt, Staphylococcus aureus subsp. aureus MW2
guuaaaaaauauguau

SEQ ID NO: 4015566 - RNA, 15 nt, Staphylococcus aureus subsp. aureus MW2
guuaaaaaauuaaaa

SEQ ID NO: 4015567 - RNA, 16 nt, Staphylococcus aureus subsp. aureus MW2
guuaaaauauaugaau

SEQ ID NO: 4015568 - RNA, 18 nt, Staphylococcus aureus subsp. aureus MW2
guuaaacuagaaaacaua

SEQ ID NO: 4015569 - RNA, 22 nt, Staphylococcus aureus subsp. aureus MW2
guuaaagucuguugguuuauca

SEQ ID NO: 4015570 - RNA, 15 nt, Staphylococcus aureus subsp. aureus MW2
guuaaaguuuuguuc

SEQ ID NO: 4015571 - RNA, 14 nt, Staphylococcus aureus subsp. aureus MW2
guuaacaucuucau

SEQ ID NO: 4015572 - RNA, 21 nt, Staphylococcus aureus subsp. aureus MW2
guuaacauuugucauaauaga

SEQ ID NO: 4015573 - RNA, 13 nt, Staphylococcus aureus subsp. aureus MW2
guuaacgauauug

SEQ ID NO: 4015574 - RNA, 14 nt, Staphylococcus aureus subsp. aureus MW2
guuaauaaaauuac

SEQ ID NO: 4015575 - RNA, 21 nt, Staphylococcus aureus subsp. aureus MW2
guuaauacaaccaucagcauu

SEQ ID NO: 4015576 - RNA, 13 nt, Staphylococcus aureus subsp. aureus MW2
guuaauauaauua

SEQ ID NO: 4015577 - RNA, 18 nt, Staphylococcus aureus subsp. aureus MW2
guuaauauaauuaaacau

SEQ ID NO: 4015578 - RNA, 21 nt, Staphylococcus aureus subsp. aureus MW2
guuaauauaauuaaacauuua

SEQ ID NO: 4015579 - RNA, 14 nt, Staphylococcus aureus subsp. aureus MW2
guuaaucaacguau

SEQ ID NO: 4015580 - RNA, 13 nt, Staphylococcus aureus subsp. aureus MW2
guuaaucauacau

SEQ ID NO: 4015581 - RNA, 17 nt, Staphylococcus aureus subsp. aureus MW2
guuaaucccguuauauc

SEQ ID NO: 4015582 - RNA, 23 nt, Staphylococcus aureus subsp. aureus MW2
guuaauccgauuuugauauaaaa

SEQ ID NO: 4015583 - RNA, 16 nt, Staphylococcus aureus subsp. aureus MW2
guuaauuaaacaaguu

SEQ ID NO: 4015584 - RNA, 15 nt, Staphylococcus aureus subsp. aureus MW2
guuaauuuaauaauu

SEQ ID NO: 4015585 - RNA, 16 nt, Staphylococcus aureus subsp. aureus MW2
guuacaauaaugugca

SEQ ID NO: 4015586 - RNA, 18 nt, Staphylococcus aureus subsp. aureus MW2
guuacagguuuuaaaauu

SEQ ID NO: 4015587 - RNA, 13 nt, Staphylococcus aureus subsp. aureus MW2
guuacauuugaag

SEQ ID NO: 4015588 - RNA, 19 nt, Staphylococcus aureus subsp. aureus MW2
guuaccaaaauuugaaaua

SEQ ID NO: 4015589 - RNA, 20 nt, Staphylococcus aureus subsp. aureus MW2
guuaccaucuuuaauacgaa

SEQ ID NO: 4015590 - RNA, 21 nt, Staphylococcus aureus subsp. aureus MW2
guuaccuacuacauucuaugu

SEQ ID NO: 4015591 - RNA, 20 nt, Staphylococcus aureus subsp. aureus MW2
guuaccuuugccaacaccau

SEQ ID NO: 4015592 - RNA, 23 nt, Staphylococcus aureus subsp. aureus MW2
guuacuauacaugguacugcuuc

SEQ ID NO: 4015593 - RNA, 19 nt, Staphylococcus aureus subsp. aureus MW2
guuacuuucacauuuucaa

SEQ ID NO: 4015594 - RNA, 13 nt, Staphylococcus aureus subsp. aureus MW2
guuagaaaaaaau

SEQ ID NO: 4015595 - RNA, 16 nt, Staphylococcus aureus subsp. aureus MW2
guuagcuauauuuuuu

SEQ ID NO: 4015596 - RNA, 23 nt, Staphylococcus aureus subsp. aureus MW2
guuaguacggcugcuuuaacugu

SEQ ID NO: 4015597 - RNA, 23 nt, Staphylococcus aureus subsp. aureus MW2
guuauaaguacaaauaauacagg

SEQ ID NO: 4015598 - RNA, 14 nt, Staphylococcus aureus subsp. aureus MW2
guuauaccauauuu

SEQ ID NO: 4015599 - RNA, 13 nt, Staphylococcus aureus subsp. aureus MW2
guuauaucuuuuu

SEQ ID NO: 4015600 - RNA, 13 nt, Staphylococcus aureus subsp. aureus MW2
guuaugguguguu

SEQ ID NO: 4015601 - RNA, 17 nt, Staphylococcus aureus subsp. aureus MW2
guuaugguguguuggug

SEQ ID NO: 4015602 - RNA, 16 nt, Staphylococcus aureus subsp. aureus MW2
guuauuauaaaauaaa

SEQ ID NO: 4015603 - RNA, 17 nt, Staphylococcus aureus subsp. aureus MW2
guuauugcuuauuuuug

SEQ ID NO: 4015604 - RNA, 17 nt, Staphylococcus aureus subsp. aureus MW2
guuauuguuccaaucuu

SEQ ID NO: 4015605 - RNA, 15 nt, Staphylococcus aureus subsp. aureus MW2
guucaagcuuuauuu

SEQ ID NO: 4015606 - RNA, 18 nt, Staphylococcus aureus subsp. aureus MW2
guucaagcuuuauuuuuu

SEQ ID NO: 4015607 - RNA, 14 nt, Staphylococcus aureus subsp. aureus MW2
guucaauacuucuu

SEQ ID NO: 4015608 - RNA, 21 nt, Staphylococcus aureus subsp. aureus MW2
guucaauaguaccaugcucuu

SEQ ID NO: 4015609 - RNA, 19 nt, Staphylococcus aureus subsp. aureus MW2
guucaaucacuauauuuca

SEQ ID NO: 4015610 - RNA, 20 nt, Staphylococcus aureus subsp. aureus MW2
guucaauuguuacuuuaacu

SEQ ID NO: 4015611 - RNA, 17 nt, Staphylococcus aureus subsp. aureus MW2
guucacaugaauuuuaa

SEQ ID NO: 4015612 - RNA, 16 nt, Staphylococcus aureus subsp. aureus MW2
guucacccaagcaugu

SEQ ID NO: 4015613 - RNA, 16 nt, Staphylococcus aureus subsp. aureus MW2
guucacuugguacacc

SEQ ID NO: 4015614 - RNA, 18 nt, Staphylococcus aureus subsp. aureus MW2
guucagauuuguauuuug

SEQ ID NO: 4015615 - RNA, 17 nt, Staphylococcus aureus subsp. aureus MW2
guucagguguaucuuug

SEQ ID NO: 4015616 - RNA, 12 nt, Staphylococcus aureus subsp. aureus MW2
guucaguuguuu

SEQ ID NO: 4015617 - RNA, 22 nt, Staphylococcus aureus subsp. aureus MW2
guucauaaugaucaaguaguua

SEQ ID NO: 4015618 - RNA, 13 nt, Staphylococcus aureus subsp. aureus MW2
guucaucaaacaa

SEQ ID NO: 4015619 - RNA, 18 nt, Staphylococcus aureus subsp. aureus MW2
guucaucaaacaacauca

SEQ ID NO: 4015620 - RNA, 14 nt, Staphylococcus aureus subsp. aureus MW2
guucaucuaaaauu

SEQ ID NO: 4015621 - RNA, 15 nt, Staphylococcus aureus subsp. aureus MW2
guucaucuaaaauua

SEQ ID NO: 4015622 - RNA, 17 nt, Staphylococcus aureus subsp. aureus MW2
guucaucuaaaauuaga

SEQ ID NO: 4015623 - RNA, 20 nt, Staphylococcus aureus subsp. aureus MW2
guucauugcuagugcucuug

SEQ ID NO: 4015624 - RNA, 17 nt, Staphylococcus aureus subsp. aureus MW2
guucauuggcaauauac

SEQ ID NO: 4015625 - RNA, 22 nt, Staphylococcus aureus subsp. aureus MW2
guucauuggcaauauacuuuuu

SEQ ID NO: 4015626 - RNA, 18 nt, Staphylococcus aureus subsp. aureus MW2
guuccaacaacuaagaua

SEQ ID NO: 4015627 - RNA, 16 nt, Staphylococcus aureus subsp. aureus MW2
guuccaccgaacccug

SEQ ID NO: 4015628 - RNA, 15 nt, Staphylococcus aureus subsp. aureus MW2
guuccguugaauuaa

SEQ ID NO: 4015629 - RNA, 16 nt, Staphylococcus aureus subsp. aureus MW2
guuccuuugauguuca

SEQ ID NO: 4015630 - RNA, 14 nt, Staphylococcus aureus subsp. aureus MW2
guucggaugagaaa

SEQ ID NO: 4015631 - RNA, 15 nt, Staphylococcus aureus subsp. aureus MW2
guucgggaauuuuuu

SEQ ID NO: 4015632 - RNA, 17 nt, Staphylococcus aureus subsp. aureus MW2
guucuaaaauuaaccau

SEQ ID NO: 4015633 - RNA, 15 nt, Staphylococcus aureus subsp. aureus MW2
guucuauauaauuua

SEQ ID NO: 4015634 - RNA, 20 nt, Staphylococcus aureus subsp. aureus MW2
guucuucacuaaaaauauau

SEQ ID NO: 4015635 - RNA, 20 nt, Staphylococcus aureus subsp. aureus MW2
guucuucaugucguuuucuu

SEQ ID NO: 4015636 - RNA, 17 nt, Staphylococcus aureus subsp. aureus MW2
guucuuuuugaugauca

SEQ ID NO: 4015637 - RNA, 13 nt, Staphylococcus aureus subsp. aureus MW2
guucuuuuuguug

SEQ ID NO: 4015638 - RNA, 17 nt, Staphylococcus aureus subsp. aureus MW2
guugaaaaccucuuuuu

SEQ ID NO: 4015639 - RNA, 14 nt, Staphylococcus aureus subsp. aureus MW2
guugaaaaguauau

SEQ ID NO: 4015640 - RNA, 21 nt, Staphylococcus aureus subsp. aureus MW2
guugaagccccuggugauuca

SEQ ID NO: 4015641 - RNA, 15 nt, Staphylococcus aureus subsp. aureus MW2
guugaagcuaauuca

SEQ ID NO: 4015642 - RNA, 21 nt, Staphylococcus aureus subsp. aureus MW2
guugaagcuaauucauauuca

SEQ ID NO: 4015643 - RNA, 22 nt, Staphylococcus aureus subsp. aureus MW2
guugaauaauuaauguuucuuc

SEQ ID NO: 4015644 - RNA, 16 nt, Staphylococcus aureus subsp. aureus MW2
guugacuguaaaacaa

SEQ ID NO: 4015645 - RNA, 19 nt, Staphylococcus aureus subsp. aureus MW2
guugauauauauuuugcaa

SEQ ID NO: 4015646 - RNA, 19 nt, Staphylococcus aureus subsp. aureus MW2
guugaugguuuaucuuuuu

SEQ ID NO: 4015647 - RNA, 12 nt, Staphylococcus aureus subsp. aureus MW2
guugauuuaaaa

SEQ ID NO: 4015648 - RNA, 22 nt, Staphylococcus aureus subsp. aureus MW2
guugcaaauuggauaauuucuu

SEQ ID NO: 4015649 - RNA, 19 nt, Staphylococcus aureus subsp. aureus MW2
guugcaauugaagugaaau

SEQ ID NO: 4015650 - RNA, 19 nt, Staphylococcus aureus subsp. aureus MW2
guugcauaaucaauuucac

SEQ ID NO: 4015651 - RNA, 20 nt, Staphylococcus aureus subsp. aureus MW2
guugcauuacuuucugccca

SEQ ID NO: 4015652 - RNA, 21 nt, Staphylococcus aureus subsp. aureus MW2
guugcgaauaccguuucuauu

SEQ ID NO: 4015653 - RNA, 15 nt, Staphylococcus aureus subsp. aureus MW2
guugcgcucuuuucu

SEQ ID NO: 4015654 - RNA, 21 nt, Staphylococcus aureus subsp. aureus MW2
guugcugaauaaaauauaucu

SEQ ID NO: 4015655 - RNA, 18 nt, Staphylococcus aureus subsp. aureus MW2
guuggcggggccccaaca

SEQ ID NO: 4015656 - RNA, 13 nt, Staphylococcus aureus subsp. aureus MW2
guuggcuuuaaag

SEQ ID NO: 4015657 - RNA, 12 nt, Staphylococcus aureus subsp. aureus MW2
guuggggccucg

SEQ ID NO: 4015658 - RNA, 17 nt, Staphylococcus aureus subsp. aureus MW2
guugguauuaauuuuuc

SEQ ID NO: 4015659 - RNA, 22 nt, Staphylococcus aureus subsp. aureus MW2
guuggugaguguuucauaaucu

SEQ ID NO: 4015660 - RNA, 16 nt, Staphylococcus aureus subsp. aureus MW2
guugguucaucaaaca

SEQ ID NO: 4015661 - RNA, 15 nt, Staphylococcus aureus subsp. aureus MW2
guugguugugauuug

SEQ ID NO: 4015662 - RNA, 18 nt, Staphylococcus aureus subsp. aureus MW2
guugguuuuauuaauucu

SEQ ID NO: 4015663 - RNA, 13 nt, Staphylococcus aureus subsp. aureus MW2
guuguaccaauga

SEQ ID NO: 4015664 - RNA, 22 nt, Staphylococcus aureus subsp. aureus MW2
guuguauaaaaauguauuaaau

SEQ ID NO: 4015665 - RNA, 22 nt, Staphylococcus aureus subsp. aureus MW2
guugucacuuggauucaaauga

SEQ ID NO: 4015666 - RNA, 16 nt, Staphylococcus aureus subsp. aureus MW2
guugugcaauaccugu

SEQ ID NO: 4015667 - RNA, 17 nt, Staphylococcus aureus subsp. aureus MW2
guuguggcaugcugaau

SEQ ID NO: 4015668 - RNA, 16 nt, Staphylococcus aureus subsp. aureus MW2
guuguuauauaaagag

SEQ ID NO: 4015669 - RNA, 19 nt, Staphylococcus aureus subsp. aureus MW2
guuguucccauuuuuaaaa

SEQ ID NO: 4015670 - RNA, 15 nt, Staphylococcus aureus subsp. aureus MW2
guuguucuuuuuguu

SEQ ID NO: 4015671 - RNA, 13 nt, Staphylococcus aureus subsp. aureus MW2
guuguuucaauuc

SEQ ID NO: 4015672 - RNA, 14 nt, Staphylococcus aureus subsp. aureus MW2
guuuaaaaauaugu

SEQ ID NO: 4015673 - RNA, 19 nt, Staphylococcus aureus subsp. aureus MW2
guuuaaauucauuuuaagu

SEQ ID NO: 4015674 - RNA, 19 nt, Staphylococcus aureus subsp. aureus MW2
guuuaaauuuaaaagaaaa

SEQ ID NO: 4015675 - RNA, 16 nt, Staphylococcus aureus subsp. aureus MW2
guuuaacuaaaccauu

SEQ ID NO: 4015676 - RNA, 17 nt, Staphylococcus aureus subsp. aureus MW2
guuuaagauuuuaucuu

SEQ ID NO: 4015677 - RNA, 17 nt, Staphylococcus aureus subsp. aureus MW2
guuuaaucgcauuguua

SEQ ID NO: 4015678 - RNA, 19 nt, Staphylococcus aureus subsp. aureus MW2
guuuaaucgcauuguuaaa

SEQ ID NO: 4015679 - RNA, 14 nt, Staphylococcus aureus subsp. aureus MW2
guuuaaucuauaua

SEQ ID NO: 4015680 - RNA, 23 nt, Staphylococcus aureus subsp. aureus MW2
guuuaauuugauuaaauucaucu

SEQ ID NO: 4015681 - RNA, 15 nt, Staphylococcus aureus subsp. aureus MW2
guuuaauuuuaaaua

SEQ ID NO: 4015682 - RNA, 13 nt, Staphylococcus aureus subsp. aureus MW2
guuuacguucuuc

SEQ ID NO: 4015683 - RNA, 15 nt, Staphylococcus aureus subsp. aureus MW2
guuuacuauacuuug

SEQ ID NO: 4015684 - RNA, 23 nt, Staphylococcus aureus subsp. aureus MW2
guuuagaaaaguaaguaaaauaa

SEQ ID NO: 4015685 - RNA, 18 nt, Staphylococcus aureus subsp. aureus MW2
guuuagauucacuguaua

SEQ ID NO: 4015686 - RNA, 20 nt, Staphylococcus aureus subsp. aureus MW2
guuuaguuaaguauuuuaau

SEQ ID NO: 4015687 - RNA, 19 nt, Staphylococcus aureus subsp. aureus MW2
guuuauaauaauauugaaa

SEQ ID NO: 4015688 - RNA, 23 nt, Staphylococcus aureus subsp. aureus MW2
guuuauaaucuuuuuuacuaaaa

SEQ ID NO: 4015689 - RNA, 13 nt, Staphylococcus aureus subsp. aureus MW2
guuuaucagcuuu

SEQ ID NO: 4015690 - RNA, 16 nt, Staphylococcus aureus subsp. aureus MW2
guuuaucagcuuuaau

SEQ ID NO: 4015691 - RNA, 15 nt, Staphylococcus aureus subsp. aureus MW2
guuuauccuuuaaau

SEQ ID NO: 4015692 - RNA, 18 nt, Staphylococcus aureus subsp. aureus MW2
guuuauccuuuaaaucau

SEQ ID NO: 4015693 - RNA, 22 nt, Staphylococcus aureus subsp. aureus MW2
guuuaucgaucgguauuuucau

SEQ ID NO: 4015694 - RNA, 23 nt, Staphylococcus aureus subsp. aureus MW2
guuuaucgaucgguauuuucauu

SEQ ID NO: 4015695 - RNA, 12 nt, Staphylococcus aureus subsp. aureus MW2
guuuaucuuuuu

SEQ ID NO: 4015696 - RNA, 15 nt, Staphylococcus aureus subsp. aureus MW2
guuuauggauuuauu

SEQ ID NO: 4015697 - RNA, 17 nt, Staphylococcus aureus subsp. aureus MW2
guuuauuacauaauuua

SEQ ID NO: 4015698 - RNA, 15 nt, Staphylococcus aureus subsp. aureus MW2
guuuauuuagaauaa

SEQ ID NO: 4015699 - RNA, 19 nt, Staphylococcus aureus subsp. aureus MW2
guuuauuucugaaaacuua

SEQ ID NO: 4015700 - RNA, 13 nt, Staphylococcus aureus subsp. aureus MW2
guuuauuuuaaau

SEQ ID NO: 4015701 - RNA, 16 nt, Staphylococcus aureus subsp. aureus MW2
guuuauuuuaaauuua

SEQ ID NO: 4015702 - RNA, 12 nt, Staphylococcus aureus subsp. aureus MW2
guuuauuuuaau

SEQ ID NO: 4015703 - RNA, 21 nt, Staphylococcus aureus subsp. aureus MW2
guuuauuuuuaaucuucaucu

SEQ ID NO: 4015704 - RNA, 17 nt, Staphylococcus aureus subsp. aureus MW2
guuuauuuuuuuagaag

SEQ ID NO: 4015705 - RNA, 13 nt, Staphylococcus aureus subsp. aureus MW2
guuucaaauuuug

SEQ ID NO: 4015706 - RNA, 23 nt, Staphylococcus aureus subsp. aureus MW2
guuucaacauuucagcauuugcu

SEQ ID NO: 4015707 - RNA, 21 nt, Staphylococcus aureus subsp. aureus MW2
guuucaagcguuucuugaucu

SEQ ID NO: 4015708 - RNA, 15 nt, Staphylococcus aureus subsp. aureus MW2
guuucacaaauucuu

SEQ ID NO: 4015709 - RNA, 19 nt, Staphylococcus aureus subsp. aureus MW2
guuucacaaauucuuuuac

SEQ ID NO: 4015710 - RNA, 16 nt, Staphylococcus aureus subsp. aureus MW2
guuucacauugucuac

SEQ ID NO: 4015711 - RNA, 17 nt, Staphylococcus aureus subsp. aureus MW2
guuucagaacugccaau

SEQ ID NO: 4015712 - RNA, 21 nt, Staphylococcus aureus subsp. aureus MW2
guuucauacacuuuaacauaa

SEQ ID NO: 4015713 - RNA, 22 nt, Staphylococcus aureus subsp. aureus MW2
guuucauacacuuuaacauaac

SEQ ID NO: 4015714 - RNA, 19 nt, Staphylococcus aureus subsp. aureus MW2
guuucauaugcaucaacag

SEQ ID NO: 4015715 - RNA, 19 nt, Staphylococcus aureus subsp. aureus MW2
guuucauauggugaacugu

SEQ ID NO: 4015716 - RNA, 14 nt, Staphylococcus aureus subsp. aureus MW2
guuucuaaauucuu

SEQ ID NO: 4015717 - RNA, 17 nt, Staphylococcus aureus subsp. aureus MW2
guuucuaaauucuuuuu

SEQ ID NO: 4015718 - RNA, 21 nt, Staphylococcus aureus subsp. aureus MW2
guuucuaaauucuuuuuguuc

SEQ ID NO: 4015719 - RNA, 20 nt, Staphylococcus aureus subsp. aureus MW2
guuucuauaaagaaugauuu

SEQ ID NO: 4015720 - RNA, 14 nt, Staphylococcus aureus subsp. aureus MW2
guuucuccaguuuu

SEQ ID NO: 4015721 - RNA, 19 nt, Staphylococcus aureus subsp. aureus MW2
guuucugacuuuuaaaaaa

SEQ ID NO: 4015722 - RNA, 15 nt, Staphylococcus aureus subsp. aureus MW2
guuucuuguucuaaa

SEQ ID NO: 4015723 - RNA, 18 nt, Staphylococcus aureus subsp. aureus MW2
guuucuuguucuaaaaaa

SEQ ID NO: 4015724 - RNA, 17 nt, Staphylococcus aureus subsp. aureus MW2
guuucuuuuauuuucau

SEQ ID NO: 4015725 - RNA, 19 nt, Staphylococcus aureus subsp. aureus MW2
guuugaacaacaucuuuug

SEQ ID NO: 4015726 - RNA, 21 nt, Staphylococcus aureus subsp. aureus MW2
guuugaagaccuucuaaaauc

SEQ ID NO: 4015727 - RNA, 20 nt, Staphylococcus aureus subsp. aureus MW2
guuugaaggugauaauguac

SEQ ID NO: 4015728 - RNA, 15 nt, Staphylococcus aureus subsp. aureus MW2
guuugaaucauuuga

SEQ ID NO: 4015729 - RNA, 15 nt, Staphylococcus aureus subsp. aureus MW2
guuugaauggcaaau

SEQ ID NO: 4015730 - RNA, 21 nt, Staphylococcus aureus subsp. aureus MW2
guuugaauguuuuugauagua

SEQ ID NO: 4015731 - RNA, 23 nt, Staphylococcus aureus subsp. aureus MW2
guuugacaaagcuaaagugaagu

SEQ ID NO: 4015732 - RNA, 22 nt, Staphylococcus aureus subsp. aureus MW2
guuugacacauuauugaaguuu

SEQ ID NO: 4015733 - RNA, 16 nt, Staphylococcus aureus subsp. aureus MW2
guuugauagaugauac

SEQ ID NO: 4015734 - RNA, 13 nt, Staphylococcus aureus subsp. aureus MW2
guuugauuucacu

SEQ ID NO: 4015735 - RNA, 15 nt, Staphylococcus aureus subsp. aureus MW2
guuugcaacauauuu

SEQ ID NO: 4015736 - RNA, 14 nt, Staphylococcus aureus subsp. aureus MW2
guuugcauauccuu

SEQ ID NO: 4015737 - RNA, 13 nt, Staphylococcus aureus subsp. aureus MW2
guuugcuuuaaaa

SEQ ID NO: 4015738 - RNA, 18 nt, Staphylococcus aureus subsp. aureus MW2
guuuggauaaaaugauau

SEQ ID NO: 4015739 - RNA, 14 nt, Staphylococcus aureus subsp. aureus MW2
guuuggcauaauaa

SEQ ID NO: 4015740 - RNA, 15 nt, Staphylococcus aureus subsp. aureus MW2
guuugguauuauucu

SEQ ID NO: 4015741 - RNA, 22 nt, Staphylococcus aureus subsp. aureus MW2
guuuggucaccuacagauaaag

SEQ ID NO: 4015742 - RNA, 21 nt, Staphylococcus aureus subsp. aureus MW2
guuuguaagacaacaaaucga

SEQ ID NO: 4015743 - RNA, 19 nt, Staphylococcus aureus subsp. aureus MW2
guuuguauucacauagccu

SEQ ID NO: 4015744 - RNA, 17 nt, Staphylococcus aureus subsp. aureus MW2
guuuguuuauugagaau

SEQ ID NO: 4015745 - RNA, 14 nt, Staphylococcus aureus subsp. aureus MW2
guuuguuuucuuuc

SEQ ID NO: 4015746 - RNA, 17 nt, Staphylococcus aureus subsp. aureus MW2
guuuuaaauugaaaugu

SEQ ID NO: 4015747 - RNA, 13 nt, Staphylococcus aureus subsp. aureus MW2
guuuuaaauuuua

SEQ ID NO: 4015748 - RNA, 20 nt, Staphylococcus aureus subsp. aureus MW2
guuuuaauuucacuuuaacu

SEQ ID NO: 4015749 - RNA, 13 nt, Staphylococcus aureus subsp. aureus MW2
guuuuaauuucuu

SEQ ID NO: 4015750 - RNA, 19 nt, Staphylococcus aureus subsp. aureus MW2
guuuuagaauaguuaccaa

SEQ ID NO: 4015751 - RNA, 15 nt, Staphylococcus aureus subsp. aureus MW2
guuuuauagcauuuc

SEQ ID NO: 4015752 - RNA, 13 nt, Staphylococcus aureus subsp. aureus MW2
guuuuaucauaac

SEQ ID NO: 4015753 - RNA, 17 nt, Staphylococcus aureus subsp. aureus MW2
guuuuaucuacaguuuu

SEQ ID NO: 4015754 - RNA, 23 nt, Staphylococcus aureus subsp. aureus MW2
guuuuauguugacucuacuagaa

SEQ ID NO: 4015755 - RNA, 22 nt, Staphylococcus aureus subsp. aureus MW2
guuuuauuaauucugauuaugu

SEQ ID NO: 4015756 - RNA, 13 nt, Staphylococcus aureus subsp. aureus MW2
guuuucaacauaa

SEQ ID NO: 4015757 - RNA, 17 nt, Staphylococcus aureus subsp. aureus MW2
guuuucagccacuguca

SEQ ID NO: 4015758 - RNA, 23 nt, Staphylococcus aureus subsp. aureus MW2
guuuucaugugucauaauccauu

SEQ ID NO: 4015759 - RNA, 16 nt, Staphylococcus aureus subsp. aureus MW2
guuuucauuuuuucaa

SEQ ID NO: 4015760 - RNA, 15 nt, Staphylococcus aureus subsp. aureus MW2
guuuucuuaaacgcu

SEQ ID NO: 4015761 - RNA, 21 nt, Staphylococcus aureus subsp. aureus MW2
guuuucuuuauuuuaaacaug

SEQ ID NO: 4015762 - RNA, 15 nt, Staphylococcus aureus subsp. aureus MW2
guuuugaagaauaaa

SEQ ID NO: 4015763 - RNA, 12 nt, Staphylococcus aureus subsp. aureus MW2
guuuugaauguu

SEQ ID NO: 4015764 - RNA, 20 nt, Staphylococcus aureus subsp. aureus MW2
guuuugagagauuauuuaaa

SEQ ID NO: 4015765 - RNA, 19 nt, Staphylococcus aureus subsp. aureus MW2
guuuugcaacauuuugagu

SEQ ID NO: 4015766 - RNA, 17 nt, Staphylococcus aureus subsp. aureus MW2
guuuuggucaaguaaau

SEQ ID NO: 4015767 - RNA, 13 nt, Staphylococcus aureus subsp. aureus MW2
guuuuguuuugcu

SEQ ID NO: 4015768 - RNA, 13 nt, Staphylococcus aureus subsp. aureus MW2
guuuuuaaaauua

SEQ ID NO: 4015769 - RNA, 12 nt, Staphylococcus aureus subsp. aureus MW2
guuuuuacuaua

SEQ ID NO: 4015770 - RNA, 21 nt, Staphylococcus aureus subsp. aureus MW2
guuuuuagguuauauuuaaau

SEQ ID NO: 4015771 - RNA, 14 nt, Staphylococcus aureus subsp. aureus MW2
guuuuuauauuauu

SEQ ID NO: 4015772 - RNA, 20 nt, Staphylococcus aureus subsp. aureus MW2
guuuuuauuauaauagagaa

SEQ ID NO: 4015773 - RNA, 18 nt, Staphylococcus aureus subsp. aureus MW2
guuuuugaauuuucguuc

SEQ ID NO: 4015774 - RNA, 21 nt, Staphylococcus aureus subsp. aureus MW2
guuuuuuagauuugaaauuua

SEQ ID NO: 4015775 - RNA, 21 nt, Staphylococcus aureus subsp. aureus MW2
guuuuuugauuguaauaauaa

SEQ ID NO: 4015776 - RNA, 14 nt, Staphylococcus aureus subsp. aureus MW2
uaaaaaaauaaugc

SEQ ID NO: 4015777 - RNA, 21 nt, Staphylococcus aureus subsp. aureus MW2
uaaaaaaaucacgcuaacauu

SEQ ID NO: 4015778 - RNA, 15 nt, Staphylococcus aureus subsp. aureus MW2
uaaaaaaauuaaaau

SEQ ID NO: 4015779 - RNA, 13 nt, Staphylococcus aureus subsp. aureus MW2
uaaaaaaauuaau

SEQ ID NO: 4015780 - RNA, 13 nt, Staphylococcus aureus subsp. aureus MW2
uaaaaaacaaaaa

SEQ ID NO: 4015781 - RNA, 17 nt, Staphylococcus aureus subsp. aureus MW2
uaaaaaacaauaaaauu

SEQ ID NO: 4015782 - RNA, 17 nt, Staphylococcus aureus subsp. aureus MW2
uaaaaaaccaauaaucc

SEQ ID NO: 4015783 - RNA, 21 nt, Staphylococcus aureus subsp. aureus MW2
uaaaaaagcugauuucuauua

SEQ ID NO: 4015784 - RNA, 23 nt, Staphylococcus aureus subsp. aureus MW2
uaaaaaagcugauuucuauuaau

SEQ ID NO: 4015785 - RNA, 11 nt, Staphylococcus aureus subsp. aureus MW2
uaaaaaaggaa

SEQ ID NO: 4015786 - RNA, 16 nt, Staphylococcus aureus subsp. aureus MW2
uaaaaaaggaagaaca

SEQ ID NO: 4015787 - RNA, 23 nt, Staphylococcus aureus subsp. aureus MW2
uaaaaaauccggaacauuaaaag

SEQ ID NO: 4015788 - RNA, 22 nt, Staphylococcus aureus subsp. aureus MW2
uaaaaaaugcacugagcaacaa

SEQ ID NO: 4015789 - RNA, 18 nt, Staphylococcus aureus subsp. aureus MW2
uaaaaaaugcgcuuccaa

SEQ ID NO: 4015790 - RNA, 13 nt, Staphylococcus aureus subsp. aureus MW2
uaaaaaauuaaaa

SEQ ID NO: 4015791 - RNA, 21 nt, Staphylococcus aureus subsp. aureus MW2
uaaaaaauuccuagcuuuuau

SEQ ID NO: 4015792 - RNA, 13 nt, Staphylococcus aureus subsp. aureus MW2
uaaaaaauuuaaa

SEQ ID NO: 4015793 - RNA, 20 nt, Staphylococcus aureus subsp. aureus MW2
uaaaaaauuuaaauaauaau

SEQ ID NO: 4015794 - RNA, 19 nt, Staphylococcus aureus subsp. aureus MW2
uaaaaacaauauugacuuu

SEQ ID NO: 4015795 - RNA, 21 nt, Staphylococcus aureus subsp. aureus MW2
uaaaaacagcaguaagacagc

SEQ ID NO: 4015796 - RNA, 22 nt, Staphylococcus aureus subsp. aureus MW2
uaaaaaccaguuugauuaaaau

SEQ ID NO: 4015797 - RNA, 23 nt, Staphylococcus aureus subsp. aureus MW2
uaaaaacggacaaguugcacauu

SEQ ID NO: 4015798 - RNA, 13 nt, Staphylococcus aureus subsp. aureus MW2
uaaaaacuguuca

SEQ ID NO: 4015799 - RNA, 22 nt, Staphylococcus aureus subsp. aureus MW2
uaaaaagaauaugauauugauu

SEQ ID NO: 4015800 - RNA, 21 nt, Staphylococcus aureus subsp. aureus MW2
uaaaaagaccucguuacauuu

SEQ ID NO: 4015801 - RNA, 23 nt, Staphylococcus aureus subsp. aureus MW2
uaaaaagaccucguuacauuuau

SEQ ID NO: 4015802 - RNA, 22 nt, Staphylococcus aureus subsp. aureus MW2
uaaaaagacgcuuucuauuuau

SEQ ID NO: 4015803 - RNA, 18 nt, Staphylococcus aureus subsp. aureus MW2
uaaaaagacggugaccuu

SEQ ID NO: 4015804 - RNA, 19 nt, Staphylococcus aureus subsp. aureus MW2
uaaaaagagguuuucauua

SEQ ID NO: 4015805 - RNA, 22 nt, Staphylococcus aureus subsp. aureus MW2
uaaaaagagguuuucauuaagu

SEQ ID NO: 4015806 - RNA, 19 nt, Staphylococcus aureus subsp. aureus MW2
uaaaaagauauaagaaaaa

SEQ ID NO: 4015807 - RNA, 20 nt, Staphylococcus aureus subsp. aureus MW2
uaaaaagauauaagaaaaag

SEQ ID NO: 4015808 - RNA, 16 nt, Staphylococcus aureus subsp. aureus MW2
uaaaaaguaauuaauu

SEQ ID NO: 4015809 - RNA, 15 nt, Staphylococcus aureus subsp. aureus MW2
uaaaaaguuaauaaa

SEQ ID NO: 4015810 - RNA, 12 nt, Staphylococcus aureus subsp. aureus MW2
uaaaaaguuuaa

SEQ ID NO: 4015811 - RNA, 19 nt, Staphylococcus aureus subsp. aureus MW2
uaaaaaguuuaaaguauaa

SEQ ID NO: 4015812 - RNA, 21 nt, Staphylococcus aureus subsp. aureus MW2
uaaaaauacauuuugcucuaa

SEQ ID NO: 4015813 - RNA, 17 nt, Staphylococcus aureus subsp. aureus MW2
uaaaaauaguucuuuaa

SEQ ID NO: 4015814 - RNA, 21 nt, Staphylococcus aureus subsp. aureus MW2
uaaaaauaguucuuuaaauua

SEQ ID NO: 4015815 - RNA, 13 nt, Staphylococcus aureus subsp. aureus MW2
uaaaaauauauuu

SEQ ID NO: 4015816 - RNA, 19 nt, Staphylococcus aureus subsp. aureus MW2
uaaaaaucaaagaggcuuu

SEQ ID NO: 4015817 - RNA, 14 nt, Staphylococcus aureus subsp. aureus MW2
uaaaaaucauaaau

SEQ ID NO: 4015818 - RNA, 20 nt, Staphylococcus aureus subsp. aureus MW2
uaaaaauccuaugaauaaau

SEQ ID NO: 4015819 - RNA, 21 nt, Staphylococcus aureus subsp. aureus MW2
uaaaaauccuaugaauaaauu

SEQ ID NO: 4015820 - RNA, 15 nt, Staphylococcus aureus subsp. aureus MW2
uaaaaaucucaaaau

SEQ ID NO: 4015821 - RNA, 14 nt, Staphylococcus aureus subsp. aureus MW2
uaaaaaucuuggug

SEQ ID NO: 4015822 - RNA, 21 nt, Staphylococcus aureus subsp. aureus MW2
uaaaaaucuuggugauagucu

SEQ ID NO: 4015823 - RNA, 12 nt, Staphylococcus aureus subsp. aureus MW2
uaaaaaugaaaa

SEQ ID NO: 4015824 - RNA, 13 nt, Staphylococcus aureus subsp. aureus MW2
uaaaaauguaaau

SEQ ID NO: 4015825 - RNA, 16 nt, Staphylococcus aureus subsp. aureus MW2
uaaaaauguaaucacu

SEQ ID NO: 4015826 - RNA, 23 nt, Staphylococcus aureus subsp. aureus MW2
uaaaaauguauuaaauaugcacu

SEQ ID NO: 4015827 - RNA, 16 nt, Staphylococcus aureus subsp. aureus MW2
uaaaaauuaaguaaua

SEQ ID NO: 4015828 - RNA, 17 nt, Staphylococcus aureus subsp. aureus MW2
uaaaaauuaaguaauag

SEQ ID NO: 4015829 - RNA, 15 nt, Staphylococcus aureus subsp. aureus MW2
uaaaaauuauauaaa

SEQ ID NO: 4015830 - RNA, 14 nt, Staphylococcus aureus subsp. aureus MW2
uaaaaauugaauua

SEQ ID NO: 4015831 - RNA, 19 nt, Staphylococcus aureus subsp. aureus MW2
uaaaaauugauauugcaaa

SEQ ID NO: 4015832 - RNA, 20 nt, Staphylococcus aureus subsp. aureus MW2
uaaaacaaaaccaaaauacu

SEQ ID NO: 4015833 - RNA, 15 nt, Staphylococcus aureus subsp. aureus MW2
uaaaacaaauuauua

SEQ ID NO: 4015834 - RNA, 15 nt, Staphylococcus aureus subsp. aureus MW2
uaaaacaauaauaau

SEQ ID NO: 4015835 - RNA, 16 nt, Staphylococcus aureus subsp. aureus MW2
uaaaacaauaauaaua

SEQ ID NO: 4015836 - RNA, 19 nt, Staphylococcus aureus subsp. aureus MW2
uaaaacaaugauuaaaauu

SEQ ID NO: 4015837 - RNA, 14 nt, Staphylococcus aureus subsp. aureus MW2
uaaaacagcaaaua

SEQ ID NO: 4015838 - RNA, 21 nt, Staphylococcus aureus subsp. aureus MW2
uaaaacagcaaauaaaaucau

SEQ ID NO: 4015839 - RNA, 15 nt, Staphylococcus aureus subsp. aureus MW2
uaaaacauguugaua

SEQ ID NO: 4015840 - RNA, 22 nt, Staphylococcus aureus subsp. aureus MW2
uaaaacauguugauaaaaagga

SEQ ID NO: 4015841 - RNA, 23 nt, Staphylococcus aureus subsp. aureus MW2
uaaaacauuggcgaggccccaac

SEQ ID NO: 4015842 - RNA, 23 nt, Staphylococcus aureus subsp. aureus MW2
uaaaaccuuacccaaaaaauugu

SEQ ID NO: 4015843 - RNA, 14 nt, Staphylococcus aureus subsp. aureus MW2
uaaaaccuucaauc

SEQ ID NO: 4015844 - RNA, 15 nt, Staphylococcus aureus subsp. aureus MW2
uaaaacgaagucagu

SEQ ID NO: 4015845 - RNA, 19 nt, Staphylococcus aureus subsp. aureus MW2
uaaaacgaaguuauuuauu

SEQ ID NO: 4015846 - RNA, 14 nt, Staphylococcus aureus subsp. aureus MW2
uaaaacgauuaaua

SEQ ID NO: 4015847 - RNA, 15 nt, Staphylococcus aureus subsp. aureus MW2
uaaaacgauuaauag

SEQ ID NO: 4015848 - RNA, 15 nt, Staphylococcus aureus subsp. aureus MW2
uaaaacgcuucauau

SEQ ID NO: 4015849 - RNA, 15 nt, Staphylococcus aureus subsp. aureus MW2
uaaaacuaaugauag

SEQ ID NO: 4015850 - RNA, 16 nt, Staphylococcus aureus subsp. aureus MW2
uaaaacuaaugauagu

SEQ ID NO: 4015851 - RNA, 17 nt, Staphylococcus aureus subsp. aureus MW2
uaaaacuauaauaaaga

SEQ ID NO: 4015852 - RNA, 13 nt, Staphylococcus aureus subsp. aureus MW2
uaaaacuuacauu

SEQ ID NO: 4015853 - RNA, 16 nt, Staphylococcus aureus subsp. aureus MW2
uaaaacuuacauuaca

SEQ ID NO: 4015854 - RNA, 13 nt, Staphylococcus aureus subsp. aureus MW2
uaaaacuuuuuca

SEQ ID NO: 4015855 - RNA, 19 nt, Staphylococcus aureus subsp. aureus MW2
uaaaagacagaaauuacua

SEQ ID NO: 4015856 - RNA, 19 nt, Staphylococcus aureus subsp. aureus MW2
uaaaagacauccacagaau

SEQ ID NO: 4015857 - RNA, 17 nt, Staphylococcus aureus subsp. aureus MW2
uaaaagagaauauaaaa

SEQ ID NO: 4015858 - RNA, 22 nt, Staphylococcus aureus subsp. aureus MW2
uaaaagagaauauaaaauaaug

SEQ ID NO: 4015859 - RNA, 14 nt, Staphylococcus aureus subsp. aureus MW2
uaaaagcaacaaau

SEQ ID NO: 4015860 - RNA, 19 nt, Staphylococcus aureus subsp. aureus MW2
uaaaagcaacaaauauaau

SEQ ID NO: 4015861 - RNA, 19 nt, Staphylococcus aureus subsp. aureus MW2
uaaaagccaucuuaccuuu

SEQ ID NO: 4015862 - RNA, 20 nt, Staphylococcus aureus subsp. aureus MW2
uaaaagccccuuuuaaauuc

SEQ ID NO: 4015863 - RNA, 23 nt, Staphylococcus aureus subsp. aureus MW2
uaaaagccccuuuuaaauucuua

SEQ ID NO: 4015864 - RNA, 15 nt, Staphylococcus aureus subsp. aureus MW2
uaaaagcugauguga

SEQ ID NO: 4015865 - RNA, 17 nt, Staphylococcus aureus subsp. aureus MW2
uaaaaggacucauacau

SEQ ID NO: 4015866 - RNA, 21 nt, Staphylococcus aureus subsp. aureus MW2
uaaaaggacucauacaugugc

SEQ ID NO: 4015867 - RNA, 20 nt, Staphylococcus aureus subsp. aureus MW2
uaaaaggaugugacaaauac

SEQ ID NO: 4015868 - RNA, 17 nt, Staphylococcus aureus subsp. aureus MW2
uaaaaggcgaaacauua

SEQ ID NO: 4015869 - RNA, 20 nt, Staphylococcus aureus subsp. aureus MW2
uaaaaggcgaaacauuaaaa

SEQ ID NO: 4015870 - RNA, 21 nt, Staphylococcus aureus subsp. aureus MW2
uaaaaggcgaaacauuaaaau

SEQ ID NO: 4015871 - RNA, 16 nt, Staphylococcus aureus subsp. aureus MW2
uaaaaggggaaaucau

SEQ ID NO: 4015872 - RNA, 19 nt, Staphylococcus aureus subsp. aureus MW2
uaaaaggggcuuuuaauua

SEQ ID NO: 4015873 - RNA, 17 nt, Staphylococcus aureus subsp. aureus MW2
uaaaaguacuuuaaaau

SEQ ID NO: 4015874 - RNA, 17 nt, Staphylococcus aureus subsp. aureus MW2
uaaaagucgauaaauau

SEQ ID NO: 4015875 - RNA, 22 nt, Staphylococcus aureus subsp. aureus MW2
uaaaaguggccuuuuaaacaaa

SEQ ID NO: 4015876 - RNA, 15 nt, Staphylococcus aureus subsp. aureus MW2
uaaaaguuguauucu

SEQ ID NO: 4015877 - RNA, 12 nt, Staphylococcus aureus subsp. aureus MW2
uaaaauaaaaaa

SEQ ID NO: 4015878 - RNA, 16 nt, Staphylococcus aureus subsp. aureus MW2
uaaaauaaaaaaugca

SEQ ID NO: 4015879 - RNA, 18 nt, Staphylococcus aureus subsp. aureus MW2
uaaaauaaaaaaugcacu

SEQ ID NO: 4015880 - RNA, 20 nt, Staphylococcus aureus subsp. aureus MW2
uaaaauaaaaaaugcacuga

SEQ ID NO: 4015881 - RNA, 15 nt, Staphylococcus aureus subsp. aureus MW2
uaaaauaaaaugcaa

SEQ ID NO: 4015882 - RNA, 18 nt, Staphylococcus aureus subsp. aureus MW2
uaaaauaaaccacgcaca

SEQ ID NO: 4015883 - RNA, 23 nt, Staphylococcus aureus subsp. aureus MW2
uaaaauaaaccacgcacaucuaa

SEQ ID NO: 4015884 - RNA, 13 nt, Staphylococcus aureus subsp. aureus MW2
uaaaauaaaucau

SEQ ID NO: 4015885 - RNA, 11 nt, Staphylococcus aureus subsp. aureus MW2
uaaaauaacua

SEQ ID NO: 4015886 - RNA, 19 nt, Staphylococcus aureus subsp. aureus MW2
uaaaauaacuaagugaauu

SEQ ID NO: 4015887 - RNA, 15 nt, Staphylococcus aureus subsp. aureus MW2
uaaaauaagauauau

SEQ ID NO: 4015888 - RNA, 13 nt, Staphylococcus aureus subsp. aureus MW2
uaaaauaaguauu

SEQ ID NO: 4015889 - RNA, 18 nt, Staphylococcus aureus subsp. aureus MW2
uaaaauaauagauaauag

SEQ ID NO: 4015890 - RNA, 13 nt, Staphylococcus aureus subsp. aureus MW2
uaaaauaaucggu

SEQ ID NO: 4015891 - RNA, 19 nt, Staphylococcus aureus subsp. aureus MW2
uaaaauaaugcuuauuaaa

SEQ ID NO: 4015892 - RNA, 16 nt, Staphylococcus aureus subsp. aureus MW2
uaaaauaauuaaauaa

SEQ ID NO: 4015893 - RNA, 19 nt, Staphylococcus aureus subsp. aureus MW2
uaaaauaccaaauaugacu

SEQ ID NO: 4015894 - RNA, 20 nt, Staphylococcus aureus subsp. aureus MW2
uaaaauacccauuuuuuucc

SEQ ID NO: 4015895 - RNA, 13 nt, Staphylococcus aureus subsp. aureus MW2
uaaaauaccugca

SEQ ID NO: 4015896 - RNA, 21 nt, Staphylococcus aureus subsp. aureus MW2
uaaaauacgguacagauagga

SEQ ID NO: 4015897 - RNA, 19 nt, Staphylococcus aureus subsp. aureus MW2
uaaaauacuguuuucauuu

SEQ ID NO: 4015898 - RNA, 17 nt, Staphylococcus aureus subsp. aureus MW2
uaaaauagaguagacgu

SEQ ID NO: 4015899 - RNA, 15 nt, Staphylococcus aureus subsp. aureus MW2
uaaaauagcugcaau

SEQ ID NO: 4015900 - RNA, 13 nt, Staphylococcus aureus subsp. aureus MW2
uaaaauauaucuu

SEQ ID NO: 4015901 - RNA, 15 nt, Staphylococcus aureus subsp. aureus MW2
uaaaauauuuaacuu

SEQ ID NO: 4015902 - RNA, 15 nt, Staphylococcus aureus subsp. aureus MW2
uaaaaucaacuuuuc

SEQ ID NO: 4015903 - RNA, 21 nt, Staphylococcus aureus subsp. aureus MW2
uaaaaucacuugguaaaacau

SEQ ID NO: 4015904 - RNA, 19 nt, Staphylococcus aureus subsp. aureus MW2
uaaaaucauaugucuuaac

SEQ ID NO: 4015905 - RNA, 20 nt, Staphylococcus aureus subsp. aureus MW2
uaaaaucauuaauaauuaaa

SEQ ID NO: 4015906 - RNA, 19 nt, Staphylococcus aureus subsp. aureus MW2
uaaaauccaagugcuaaga

SEQ ID NO: 4015907 - RNA, 20 nt, Staphylococcus aureus subsp. aureus MW2
uaaaauccaagugcuaagag

SEQ ID NO: 4015908 - RNA, 18 nt, Staphylococcus aureus subsp. aureus MW2
uaaaauccuaagcaucgu

SEQ ID NO: 4015909 - RNA, 15 nt, Staphylococcus aureus subsp. aureus MW2
uaaaaucgcagcaau

SEQ ID NO: 4015910 - RNA, 22 nt, Staphylococcus aureus subsp. aureus MW2
uaaaaucuauaccauuccaaaa

SEQ ID NO: 4015911 - RNA, 13 nt, Staphylococcus aureus subsp. aureus MW2
uaaaaucucauaa

SEQ ID NO: 4015912 - RNA, 17 nt, Staphylococcus aureus subsp. aureus MW2
uaaaaucucauaauaau

SEQ ID NO: 4015913 - RNA, 21 nt, Staphylococcus aureus subsp. aureus MW2
uaaaaucuugaugauauucau

SEQ ID NO: 4015914 - RNA, 22 nt, Staphylococcus aureus subsp. aureus MW2
uaaaaucuugaugauauucaua

SEQ ID NO: 4015915 - RNA, 21 nt, Staphylococcus aureus subsp. aureus MW2
uaaaaugaauaauuacuaaaa

SEQ ID NO: 4015916 - RNA, 16 nt, Staphylococcus aureus subsp. aureus MW2
uaaaaugaugauuuaa

SEQ ID NO: 4015917 - RNA, 17 nt, Staphylococcus aureus subsp. aureus MW2
uaaaaugauuguuuuaa

SEQ ID NO: 4015918 - RNA, 18 nt, Staphylococcus aureus subsp. aureus MW2
uaaaaugcuacaauuucc

SEQ ID NO: 4015919 - RNA, 20 nt, Staphylococcus aureus subsp. aureus MW2
uaaaaugcuacaauuuccua

SEQ ID NO: 4015920 - RNA, 16 nt, Staphylococcus aureus subsp. aureus MW2
uaaaaugcucccuuca

SEQ ID NO: 4015921 - RNA, 17 nt, Staphylococcus aureus subsp. aureus MW2
uaaaaugcucccuucaa

SEQ ID NO: 4015922 - RNA, 22 nt, Staphylococcus aureus subsp. aureus MW2
uaaaaugcuuuuuugaaauggu

SEQ ID NO: 4015923 - RNA, 18 nt, Staphylococcus aureus subsp. aureus MW2
uaaaauggcaucuggcaa

SEQ ID NO: 4015924 - RNA, 19 nt, Staphylococcus aureus subsp. aureus MW2
uaaaauggcaucuggcaaa

SEQ ID NO: 4015925 - RNA, 20 nt, Staphylococcus aureus subsp. aureus MW2
uaaaauggugcgaauaauaa

SEQ ID NO: 4015926 - RNA, 17 nt, Staphylococcus aureus subsp. aureus MW2
uaaaauguuaauaauga

SEQ ID NO: 4015927 - RNA, 19 nt, Staphylococcus aureus subsp. aureus MW2
uaaaauguuaauaaugacu

SEQ ID NO: 4015928 - RNA, 14 nt, Staphylococcus aureus subsp. aureus MW2
uaaaauuaaaacag

SEQ ID NO: 4015929 - RNA, 14 nt, Staphylococcus aureus subsp. aureus MW2
uaaaauuaaaacuu

SEQ ID NO: 4015930 - RNA, 21 nt, Staphylococcus aureus subsp. aureus MW2
uaaaauuaacuuaaaauuuaa

SEQ ID NO: 4015931 - RNA, 20 nt, Staphylococcus aureus subsp. aureus MW2
uaaaauuacgcaaagaaaaa

SEQ ID NO: 4015932 - RNA, 21 nt, Staphylococcus aureus subsp. aureus MW2
uaaaauuacgcaaagaaaaac

SEQ ID NO: 4015933 - RNA, 18 nt, Staphylococcus aureus subsp. aureus MW2
uaaaauuacuugaauauu

SEQ ID NO: 4015934 - RNA, 23 nt, Staphylococcus aureus subsp. aureus MW2
uaaaauuagggguggaaauauga

SEQ ID NO: 4015935 - RNA, 13 nt, Staphylococcus aureus subsp. aureus MW2
uaaaauuaugauu

SEQ ID NO: 4015936 - RNA, 22 nt, Staphylococcus aureus subsp. aureus MW2
uaaaauuaugauuauuuuucuc

SEQ ID NO: 4015937 - RNA, 19 nt, Staphylococcus aureus subsp. aureus MW2
uaaaauuauugacauugca

SEQ ID NO: 4015938 - RNA, 20 nt, Staphylococcus aureus subsp. aureus MW2
uaaaauugccaguaucucuu

SEQ ID NO: 4015939 - RNA, 20 nt, Staphylococcus aureus subsp. aureus MW2
uaaaauuggaacacgaaauu

SEQ ID NO: 4015940 - RNA, 15 nt, Staphylococcus aureus subsp. aureus MW2
uaaaauuguauagaa

SEQ ID NO: 4015941 - RNA, 15 nt, Staphylococcus aureus subsp. aureus MW2
uaaaauuuaaaacaa

SEQ ID NO: 4015942 - RNA, 16 nt, Staphylococcus aureus subsp. aureus MW2
uaaaauuuaaaacaau

SEQ ID NO: 4015943 - RNA, 15 nt, Staphylococcus aureus subsp. aureus MW2
uaaaauuuguaauuu

SEQ ID NO: 4015944 - RNA, 18 nt, Staphylococcus aureus subsp. aureus MW2
uaaaauuuguuaauuuaa

SEQ ID NO: 4015945 - RNA, 22 nt, Staphylococcus aureus subsp. aureus MW2
uaaaauuuugaagaagugccgu

SEQ ID NO: 4015946 - RNA, 23 nt, Staphylococcus aureus subsp. aureus MW2
uaaaauuuuuugggcuuuuucac

SEQ ID NO: 4015947 - RNA, 22 nt, Staphylococcus aureus subsp. aureus MW2
uaaaauuuuuuucauaauuaau

SEQ ID NO: 4015948 - RNA, 23 nt, Staphylococcus aureus subsp. aureus MW2
uaaaauuuuuuucauaauuaaua

SEQ ID NO: 4015949 - RNA, 15 nt, Staphylococcus aureus subsp. aureus MW2
uaaacaaauaaaaaa

SEQ ID NO: 4015950 - RNA, 13 nt, Staphylococcus aureus subsp. aureus MW2
uaaacaaauaaau

SEQ ID NO: 4015951 - RNA, 15 nt, Staphylococcus aureus subsp. aureus MW2
uaaacaaauaaaugu

SEQ ID NO: 4015952 - RNA, 17 nt, Staphylococcus aureus subsp. aureus MW2
uaaacaaauaaaugucc

SEQ ID NO: 4015953 - RNA, 23 nt, Staphylococcus aureus subsp. aureus MW2
uaaacaacauacagccauugaca

SEQ ID NO: 4015954 - RNA, 19 nt, Staphylococcus aureus subsp. aureus MW2
uaaacaagcaucaugaaau

SEQ ID NO: 4015955 - RNA, 20 nt, Staphylococcus aureus subsp. aureus MW2
uaaacaagcaucaugaaauu

SEQ ID NO: 4015956 - RNA, 17 nt, Staphylococcus aureus subsp. aureus MW2
uaaacaauacguuuucg

SEQ ID NO: 4015957 - RNA, 20 nt, Staphylococcus aureus subsp. aureus MW2
uaaacaccaauauuucuggg

SEQ ID NO: 4015958 - RNA, 16 nt, Staphylococcus aureus subsp. aureus MW2
uaaacacccaauaauu

SEQ ID NO: 4015959 - RNA, 18 nt, Staphylococcus aureus subsp. aureus MW2
uaaacacuuuaguauuau

SEQ ID NO: 4015960 - RNA, 22 nt, Staphylococcus aureus subsp. aureus MW2
uaaacauaaccuugcuuugcau

SEQ ID NO: 4015961 - RNA, 19 nt, Staphylococcus aureus subsp. aureus MW2
uaaacaugggcaaucacuc

SEQ ID NO: 4015962 - RNA, 21 nt, Staphylococcus aureus subsp. aureus MW2
uaaacaugggcaaucacuccu

SEQ ID NO: 4015963 - RNA, 13 nt, Staphylococcus aureus subsp. aureus MW2
uaaacauuuagau

SEQ ID NO: 4015964 - RNA, 14 nt, Staphylococcus aureus subsp. aureus MW2
uaaacauuuagauu

SEQ ID NO: 4015965 - RNA, 11 nt, Staphylococcus aureus subsp. aureus MW2
uaaacauuuuu

SEQ ID NO: 4015966 - RNA, 20 nt, Staphylococcus aureus subsp. aureus MW2
uaaacauuuuugauuuuaau

SEQ ID NO: 4015967 - RNA, 18 nt, Staphylococcus aureus subsp. aureus MW2
uaaaccaacuuucucaag

SEQ ID NO: 4015968 - RNA, 19 nt, Staphylococcus aureus subsp. aureus MW2
uaaaccagcugauuccauu

SEQ ID NO: 4015969 - RNA, 20 nt, Staphylococcus aureus subsp. aureus MW2
uaaaccaucugugucagcau

SEQ ID NO: 4015970 - RNA, 19 nt, Staphylococcus aureus subsp. aureus MW2
uaaaccauuuucaagagga

SEQ ID NO: 4015971 - RNA, 22 nt, Staphylococcus aureus subsp. aureus MW2
uaaaccgaggugucaauaaauu

SEQ ID NO: 4015972 - RNA, 20 nt, Staphylococcus aureus subsp. aureus MW2
uaaaccgcacuucuauauua

SEQ ID NO: 4015973 - RNA, 23 nt, Staphylococcus aureus subsp. aureus MW2
uaaaccgcacuucuauauuaaua

SEQ ID NO: 4015974 - RNA, 16 nt, Staphylococcus aureus subsp. aureus MW2
uaaaccuacaauauag

SEQ ID NO: 4015975 - RNA, 15 nt, Staphylococcus aureus subsp. aureus MW2
uaaacgcaaauuaaa

SEQ ID NO: 4015976 - RNA, 21 nt, Staphylococcus aureus subsp. aureus MW2
uaaacgcgcuucguugauuaa

SEQ ID NO: 4015977 - RNA, 18 nt, Staphylococcus aureus subsp. aureus MW2
uaaacggaauaacuuuuu

SEQ ID NO: 4015978 - RNA, 23 nt, Staphylococcus aureus subsp. aureus MW2
uaaacgguaacaaagauuauuga

SEQ ID NO: 4015979 - RNA, 19 nt, Staphylococcus aureus subsp. aureus MW2
uaaacgucacuuuauuaaa

SEQ ID NO: 4015980 - RNA, 19 nt, Staphylococcus aureus subsp. aureus MW2
uaaacuaauagcauuugua

SEQ ID NO: 4015981 - RNA, 20 nt, Staphylococcus aureus subsp. aureus MW2
uaaacuagaaaacauaaaua

SEQ ID NO: 4015982 - RNA, 23 nt, Staphylococcus aureus subsp. aureus MW2
uaaacuagaaaacauaaauacaa

SEQ ID NO: 4015983 - RNA, 14 nt, Staphylococcus aureus subsp. aureus MW2
uaaacuauaauaau

SEQ ID NO: 4015984 - RNA, 16 nt, Staphylococcus aureus subsp. aureus MW2
uaaacuauuaaaucau

SEQ ID NO: 4015985 - RNA, 24 nt, Staphylococcus aureus subsp. aureus MW2
uaaacucaaaaagccaacacauuc

SEQ ID NO: 4015986 - RNA, 18 nt, Staphylococcus aureus subsp. aureus MW2
uaaacucaccaaguucac

SEQ ID NO: 4015987 - RNA, 16 nt, Staphylococcus aureus subsp. aureus MW2
uaaacuuaaaagagaa

SEQ ID NO: 4015988 - RNA, 17 nt, Staphylococcus aureus subsp. aureus MW2
uaaacuuaaaagagaau

SEQ ID NO: 4015989 - RNA, 19 nt, Staphylococcus aureus subsp. aureus MW2
uaaacuuauuaauuaauag

SEQ ID NO: 4015990 - RNA, 16 nt, Staphylococcus aureus subsp. aureus MW2
uaaacuucuauuaaua

SEQ ID NO: 4015991 - RNA, 12 nt, Staphylococcus aureus subsp. aureus MW2
uaaacuucuuuu

SEQ ID NO: 4015992 - RNA, 18 nt, Staphylococcus aureus subsp. aureus MW2
uaaacuuuggcaaaguca

SEQ ID NO: 4015993 - RNA, 23 nt, Staphylococcus aureus subsp. aureus MW2
uaaagaacuauguucaauuuaug

SEQ ID NO: 4015994 - RNA, 13 nt, Staphylococcus aureus subsp. aureus MW2
uaaagaaugauuu

SEQ ID NO: 4015995 - RNA, 15 nt, Staphylococcus aureus subsp. aureus MW2
uaaagaauuaaguag

SEQ ID NO: 4015996 - RNA, 16 nt, Staphylococcus aureus subsp. aureus MW2
uaaagaauuaaguagu

SEQ ID NO: 4015997 - RNA, 22 nt, Staphylococcus aureus subsp. aureus MW2
uaaagaauuucgaaaagaaauu

SEQ ID NO: 4015998 - RNA, 14 nt, Staphylococcus aureus subsp. aureus MW2
uaaagacaccuuca

SEQ ID NO: 4015999 - RNA, 14 nt, Staphylococcus aureus subsp. aureus MW2
uaaagacuuuaugc

SEQ ID NO: 4016000 - RNA, 17 nt, Staphylococcus aureus subsp. aureus MW2
uaaagauagaaugaaua

SEQ ID NO: 4016001 - RNA, 15 nt, Staphylococcus aureus subsp. aureus MW2
uaaagauguugaaaa

SEQ ID NO: 4016002 - RNA, 17 nt, Staphylococcus aureus subsp. aureus MW2
uaaagauuuacccauua

SEQ ID NO: 4016003 - RNA, 15 nt, Staphylococcus aureus subsp. aureus MW2
uaaagcuaaugcaag

SEQ ID NO: 4016004 - RNA, 15 nt, Staphylococcus aureus subsp. aureus MW2
uaaagcuauaaaaaa

SEQ ID NO: 4016005 - RNA, 18 nt, Staphylococcus aureus subsp. aureus MW2
uaaagcugauuuuucauu

SEQ ID NO: 4016006 - RNA, 18 nt, Staphylococcus aureus subsp. aureus MW2
uaaagcugcgauauaacu

SEQ ID NO: 4016007 - RNA, 21 nt, Staphylococcus aureus subsp. aureus MW2
uaaagcuucgucaaugacuaa

SEQ ID NO: 4016008 - RNA, 19 nt, Staphylococcus aureus subsp. aureus MW2
uaaaggguguuuagauagc

SEQ ID NO: 4016009 - RNA, 22 nt, Staphylococcus aureus subsp. aureus MW2
uaaaggguguuuagauagcucu

SEQ ID NO: 4016010 - RNA, 15 nt, Staphylococcus aureus subsp. aureus MW2
uaaaggucuauauau

SEQ ID NO: 4016011 - RNA, 19 nt, Staphylococcus aureus subsp. aureus MW2
uaaaggucuauauauauuu

SEQ ID NO: 4016012 - RNA, 15 nt, Staphylococcus aureus subsp. aureus MW2
uaaaguaaaauauac

SEQ ID NO: 4016013 - RNA, 22 nt, Staphylococcus aureus subsp. aureus MW2
uaaaguaaagggaggaauuaau

SEQ ID NO: 4016014 - RNA, 21 nt, Staphylococcus aureus subsp. aureus MW2
uaaaguauaagguugaagaag

SEQ ID NO: 4016015 - RNA, 21 nt, Staphylococcus aureus subsp. aureus MW2
uaaagucaacaucguauucuu

SEQ ID NO: 4016016 - RNA, 21 nt, Staphylococcus aureus subsp. aureus MW2
uaaagucguaucauauauuga

SEQ ID NO: 4016017 - RNA, 15 nt, Staphylococcus aureus subsp. aureus MW2
uaaagugaaauaaag

SEQ ID NO: 4016018 - RNA, 21 nt, Staphylococcus aureus subsp. aureus MW2
uaaaguguagccaaauaaauu

SEQ ID NO: 4016019 - RNA, 23 nt, Staphylococcus aureus subsp. aureus MW2
uaaaguugacaauacaaaucgau

SEQ ID NO: 4016020 - RNA, 15 nt, Staphylococcus aureus subsp. aureus MW2
uaaaguuuuguucaa

SEQ ID NO: 4016021 - RNA, 15 nt, Staphylococcus aureus subsp. aureus MW2
uaaauaaaaauuaua

SEQ ID NO: 4016022 - RNA, 20 nt, Staphylococcus aureus subsp. aureus MW2
uaaauaaaaauuauauaaau

SEQ ID NO: 4016023 - RNA, 13 nt, Staphylococcus aureus subsp. aureus MW2
uaaauaaaacuau

SEQ ID NO: 4016024 - RNA, 18 nt, Staphylococcus aureus subsp. aureus MW2
uaaauaaaaggcauucuu

SEQ ID NO: 4016025 - RNA, 23 nt, Staphylococcus aureus subsp. aureus MW2
uaaauaaaaguuaccuacuacau

SEQ ID NO: 4016026 - RNA, 13 nt, Staphylococcus aureus subsp. aureus MW2
uaaauaaaaugcu

SEQ ID NO: 4016027 - RNA, 14 nt, Staphylococcus aureus subsp. aureus MW2
uaaauaaaauuaaa

SEQ ID NO: 4016028 - RNA, 14 nt, Staphylococcus aureus subsp. aureus MW2
uaaauaaaauuguu

SEQ ID NO: 4016029 - RNA, 15 nt, Staphylococcus aureus subsp. aureus MW2
uaaauaaacaacugc

SEQ ID NO: 4016030 - RNA, 15 nt, Staphylococcus aureus subsp. aureus MW2
uaaauaaacauaaaa

SEQ ID NO: 4016031 - RNA, 15 nt, Staphylococcus aureus subsp. aureus MW2
uaaauaaagauucaa

SEQ ID NO: 4016032 - RNA, 16 nt, Staphylococcus aureus subsp. aureus MW2
uaaauaaauucucuaa

SEQ ID NO: 4016033 - RNA, 21 nt, Staphylococcus aureus subsp. aureus MW2
uaaauaaccgcacuuucuauu

SEQ ID NO: 4016034 - RNA, 13 nt, Staphylococcus aureus subsp. aureus MW2
uaaauaacuucgu

SEQ ID NO: 4016035 - RNA, 19 nt, Staphylococcus aureus subsp. aureus MW2
uaaauaacuuuuuaaagga

SEQ ID NO: 4016036 - RNA, 19 nt, Staphylococcus aureus subsp. aureus MW2
uaaauaagcaaucauaaua

SEQ ID NO: 4016037 - RNA, 12 nt, Staphylococcus aureus subsp. aureus MW2
uaaauaaguagu

SEQ ID NO: 4016038 - RNA, 19 nt, Staphylococcus aureus subsp. aureus MW2
uaaauaaguaguucaauaa

SEQ ID NO: 4016039 - RNA, 17 nt, Staphylococcus aureus subsp. aureus MW2
uaaauaagugauaaaua

SEQ ID NO: 4016040 - RNA, 20 nt, Staphylococcus aureus subsp. aureus MW2
uaaauaauuuaaauuaaaau

SEQ ID NO: 4016041 - RNA, 17 nt, Staphylococcus aureus subsp. aureus MW2
uaaauacaaaaauauag

SEQ ID NO: 4016042 - RNA, 19 nt, Staphylococcus aureus subsp. aureus MW2
uaaauacaauuucuucauu

SEQ ID NO: 4016043 - RNA, 19 nt, Staphylococcus aureus subsp. aureus MW2
uaaauacgccaaauacuag

SEQ ID NO: 4016044 - RNA, 21 nt, Staphylococcus aureus subsp. aureus MW2
uaaauacuuuugcaucacaga

SEQ ID NO: 4016045 - RNA, 21 nt, Staphylococcus aureus subsp. aureus MW2
uaaauagacugccaauaaaau

SEQ ID NO: 4016046 - RNA, 19 nt, Staphylococcus aureus subsp. aureus MW2
uaaauaggaugaaaaagau

SEQ ID NO: 4016047 - RNA, 19 nt, Staphylococcus aureus subsp. aureus MW2
uaaauaggugauuauauau

SEQ ID NO: 4016048 - RNA, 22 nt, Staphylococcus aureus subsp. aureus MW2
uaaauaguaagguuugaacucu

SEQ ID NO: 4016049 - RNA, 18 nt, Staphylococcus aureus subsp. aureus MW2
uaaauaguuuuucauauu

SEQ ID NO: 4016050 - RNA, 20 nt, Staphylococcus aureus subsp. aureus MW2
uaaauaguuuuucauauuca

SEQ ID NO: 4016051 - RNA, 13 nt, Staphylococcus aureus subsp. aureus MW2
uaaauauaaaaua

SEQ ID NO: 4016052 - RNA, 20 nt, Staphylococcus aureus subsp. aureus MW2
uaaauauaaaccagcugauu

SEQ ID NO: 4016053 - RNA, 22 nt, Staphylococcus aureus subsp. aureus MW2
uaaauauaauagaaauaaucac

SEQ ID NO: 4016054 - RNA, 17 nt, Staphylococcus aureus subsp. aureus MW2
uaaauauacuucuauua

SEQ ID NO: 4016055 - RNA, 13 nt, Staphylococcus aureus subsp. aureus MW2
uaaauauauauua

SEQ ID NO: 4016056 - RNA, 17 nt, Staphylococcus aureus subsp. aureus MW2
uaaauaucaauaauucg

SEQ ID NO: 4016057 - RNA, 16 nt, Staphylococcus aureus subsp. aureus MW2
uaaauaucauaaaugc

SEQ ID NO: 4016058 - RNA, 18 nt, Staphylococcus aureus subsp. aureus MW2
uaaauaucauaaaugcau

SEQ ID NO: 4016059 - RNA, 21 nt, Staphylococcus aureus subsp. aureus MW2
uaaauaucauaccguacaaag

SEQ ID NO: 4016060 - RNA, 12 nt, Staphylococcus aureus subsp. aureus MW2
uaaauaucaugc

SEQ ID NO: 4016061 - RNA, 19 nt, Staphylococcus aureus subsp. aureus MW2
uaaauaucgacaaauuaaa

SEQ ID NO: 4016062 - RNA, 22 nt, Staphylococcus aureus subsp. aureus MW2
uaaauaugacgcgugaauuaaa

SEQ ID NO: 4016063 - RNA, 22 nt, Staphylococcus aureus subsp. aureus MW2
uaaauaugauagccaauauaac

SEQ ID NO: 4016064 - RNA, 19 nt, Staphylococcus aureus subsp. aureus MW2
uaaauaugauguuaaaaaa

SEQ ID NO: 4016065 - RNA, 16 nt, Staphylococcus aureus subsp. aureus MW2
uaaauauuaaauucau

SEQ ID NO: 4016066 - RNA, 18 nt, Staphylococcus aureus subsp. aureus MW2
uaaauauuauaaaaagau

SEQ ID NO: 4016067 - RNA, 14 nt, Staphylococcus aureus subsp. aureus MW2
uaaauauucuuauc

SEQ ID NO: 4016068 - RNA, 14 nt, Staphylococcus aureus subsp. aureus MW2
uaaauauugauaua

SEQ ID NO: 4016069 - RNA, 15 nt, Staphylococcus aureus subsp. aureus MW2
uaaauauugauauaa

SEQ ID NO: 4016070 - RNA, 18 nt, Staphylococcus aureus subsp. aureus MW2
uaaauauuggaauacucu

SEQ ID NO: 4016071 - RNA, 20 nt, Staphylococcus aureus subsp. aureus MW2
uaaauauuggaauacucuuu

SEQ ID NO: 4016072 - RNA, 21 nt, Staphylococcus aureus subsp. aureus MW2
uaaauauuuaaaauauuauuu

SEQ ID NO: 4016073 - RNA, 15 nt, Staphylococcus aureus subsp. aureus MW2
uaaauauuuuuuaaa

SEQ ID NO: 4016074 - RNA, 16 nt, Staphylococcus aureus subsp. aureus MW2
uaaauauuuuuuaaaa

SEQ ID NO: 4016075 - RNA, 22 nt, Staphylococcus aureus subsp. aureus MW2
uaaaucaaagggcuucgauuca

SEQ ID NO: 4016076 - RNA, 21 nt, Staphylococcus aureus subsp. aureus MW2
uaaaucaaaugguacaguuaa

SEQ ID NO: 4016077 - RNA, 14 nt, Staphylococcus aureus subsp. aureus MW2
uaaaucaacuuaaa

SEQ ID NO: 4016078 - RNA, 17 nt, Staphylococcus aureus subsp. aureus MW2
uaaaucaacuuaaaugg

SEQ ID NO: 4016079 - RNA, 14 nt, Staphylococcus aureus subsp. aureus MW2
uaaaucaagaaaug

SEQ ID NO: 4016080 - RNA, 23 nt, Staphylococcus aureus subsp. aureus MW2
uaaaucacgccauaaucuucauu

SEQ ID NO: 4016081 - RNA, 22 nt, Staphylococcus aureus subsp. aureus MW2
uaaaucauacgagaaauuagaa

SEQ ID NO: 4016082 - RNA, 12 nt, Staphylococcus aureus subsp. aureus MW2
uaaaucaucauu

SEQ ID NO: 4016083 - RNA, 17 nt, Staphylococcus aureus subsp. aureus MW2
uaaaucaucuucaguua

SEQ ID NO: 4016084 - RNA, 17 nt, Staphylococcus aureus subsp. aureus MW2
uaaaucaugaaauuaaa

SEQ ID NO: 4016085 - RNA, 12 nt, Staphylococcus aureus subsp. aureus MW2
uaaaucauuauu

SEQ ID NO: 4016086 - RNA, 13 nt, Staphylococcus aureus subsp. aureus MW2
uaaaucauuauuu

SEQ ID NO: 4016087 - RNA, 16 nt, Staphylococcus aureus subsp. aureus MW2
uaaauccgcuuguuca

SEQ ID NO: 4016088 - RNA, 14 nt, Staphylococcus aureus subsp. aureus MW2
uaaauccuuuggac

SEQ ID NO: 4016089 - RNA, 14 nt, Staphylococcus aureus subsp. aureus MW2
uaaaucgauaacag

SEQ ID NO: 4016090 - RNA, 20 nt, Staphylococcus aureus subsp. aureus MW2
uaaaucgugcuguuaucaug

SEQ ID NO: 4016091 - RNA, 21 nt, Staphylococcus aureus subsp. aureus MW2
uaaaucgugcuguuaucaugg

SEQ ID NO: 4016092 - RNA, 19 nt, Staphylococcus aureus subsp. aureus MW2
uaaaucguguuaauucuuc

SEQ ID NO: 4016093 - RNA, 15 nt, Staphylococcus aureus subsp. aureus MW2
uaaaucuaaaucuau

SEQ ID NO: 4016094 - RNA, 22 nt, Staphylococcus aureus subsp. aureus MW2
uaaaucuaauacuuucaaacaa

SEQ ID NO: 4016095 - RNA, 14 nt, Staphylococcus aureus subsp. aureus MW2
uaaaucuacaauau

SEQ ID NO: 4016096 - RNA, 22 nt, Staphylococcus aureus subsp. aureus MW2
uaaaucuauauaaaguugacaa

SEQ ID NO: 4016097 - RNA, 16 nt, Staphylococcus aureus subsp. aureus MW2
uaaaucuaucuauuca

SEQ ID NO: 4016098 - RNA, 21 nt, Staphylococcus aureus subsp. aureus MW2
uaaaucuguuuaaauuuaaaa

SEQ ID NO: 4016099 - RNA, 19 nt, Staphylococcus aureus subsp. aureus MW2
uaaaucuucuaguaauucu

SEQ ID NO: 4016100 - RNA, 20 nt, Staphylococcus aureus subsp. aureus MW2
uaaaucuuguuggauuuuaa

SEQ ID NO: 4016101 - RNA, 23 nt, Staphylococcus aureus subsp. aureus MW2
uaaaucuuguuggauuuuaacaa

SEQ ID NO: 4016102 - RNA, 18 nt, Staphylococcus aureus subsp. aureus MW2
uaaaugaaagcaccuaaa

SEQ ID NO: 4016103 - RNA, 21 nt, Staphylococcus aureus subsp. aureus MW2
uaaaugaaagcaccuaaaaua

SEQ ID NO: 4016104 - RNA, 23 nt, Staphylococcus aureus subsp. aureus MW2
uaaaugaaagcaccuaaaauaga

SEQ ID NO: 4016105 - RNA, 22 nt, Staphylococcus aureus subsp. aureus MW2
uaaaugacauggaaaauauauu

SEQ ID NO: 4016106 - RNA, 18 nt, Staphylococcus aureus subsp. aureus MW2
uaaaugacugaauuaaua

SEQ ID NO: 4016107 - RNA, 20 nt, Staphylococcus aureus subsp. aureus MW2
uaaaugaugcaguaaaacca

SEQ ID NO: 4016108 - RNA, 20 nt, Staphylococcus aureus subsp. aureus MW2
uaaaugauggguaguuaaua

SEQ ID NO: 4016109 - RNA, 23 nt, Staphylococcus aureus subsp. aureus MW2
uaaaugauggguaguuaauauaa

SEQ ID NO: 4016110 - RNA, 14 nt, Staphylococcus aureus subsp. aureus MW2
uaaaugauuuaaua

SEQ ID NO: 4016111 - RNA, 22 nt, Staphylococcus aureus subsp. aureus MW2
uaaaugcaauacauuaauauaa

SEQ ID NO: 4016112 - RNA, 18 nt, Staphylococcus aureus subsp. aureus MW2
uaaaugcaauauguaaca

SEQ ID NO: 4016113 - RNA, 13 nt, Staphylococcus aureus subsp. aureus MW2
uaaaugcauaaua

SEQ ID NO: 4016114 - RNA, 21 nt, Staphylococcus aureus subsp. aureus MW2
uaaaugcuucugguucuucaa

SEQ ID NO: 4016115 - RNA, 20 nt, Staphylococcus aureus subsp. aureus MW2
uaaaugcuuucaaauacaca

SEQ ID NO: 4016116 - RNA, 19 nt, Staphylococcus aureus subsp. aureus MW2
uaaaugguuaucuaaaauu

SEQ ID NO: 4016117 - RNA, 16 nt, Staphylococcus aureus subsp. aureus MW2
uaaauguacauuguaa

SEQ ID NO: 4016118 - RNA, 16 nt, Staphylococcus aureus subsp. aureus MW2
uaaauguauuaaacau

SEQ ID NO: 4016119 - RNA, 16 nt, Staphylococcus aureus subsp. aureus MW2
uaaaugucacugcaaa

SEQ ID NO: 4016120 - RNA, 19 nt, Staphylococcus aureus subsp. aureus MW2
uaaaugucacugcaaacac

SEQ ID NO: 4016121 - RNA, 17 nt, Staphylococcus aureus subsp. aureus MW2
uaaauguuaaauucuaa

SEQ ID NO: 4016122 - RNA, 18 nt, Staphylococcus aureus subsp. aureus MW2
uaaauguuaaauucuaaa

SEQ ID NO: 4016123 - RNA, 22 nt, Staphylococcus aureus subsp. aureus MW2
uaaauguuaaugcuucguaauc

SEQ ID NO: 4016124 - RNA, 13 nt, Staphylococcus aureus subsp. aureus MW2
uaaauguuauauu

SEQ ID NO: 4016125 - RNA, 22 nt, Staphylococcus aureus subsp. aureus MW2
uaaauguugacucguuauucaa

SEQ ID NO: 4016126 - RNA, 16 nt, Staphylococcus aureus subsp. aureus MW2
uaaauguuuauaucuu

SEQ ID NO: 4016127 - RNA, 14 nt, Staphylococcus aureus subsp. aureus MW2
uaaauuaaaucgau

SEQ ID NO: 4016128 - RNA, 13 nt, Staphylococcus aureus subsp. aureus MW2
uaaauuaaaugca

SEQ ID NO: 4016129 - RNA, 12 nt, Staphylococcus aureus subsp. aureus MW2
uaaauuaauaug

SEQ ID NO: 4016130 - RNA, 13 nt, Staphylococcus aureus subsp. aureus MW2
uaaauuaauauga

SEQ ID NO: 4016131 - RNA, 19 nt, Staphylococcus aureus subsp. aureus MW2
uaaauuacaaaaguaugau

SEQ ID NO: 4016132 - RNA, 16 nt, Staphylococcus aureus subsp. aureus MW2
uaaauuacaauuaauu

SEQ ID NO: 4016133 - RNA, 14 nt, Staphylococcus aureus subsp. aureus MW2
uaaauuacaauuag

SEQ ID NO: 4016134 - RNA, 13 nt, Staphylococcus aureus subsp. aureus MW2
uaaauuacuauau

SEQ ID NO: 4016135 - RNA, 15 nt, Staphylococcus aureus subsp. aureus MW2
uaaauuacuauauuu

SEQ ID NO: 4016136 - RNA, 21 nt, Staphylococcus aureus subsp. aureus MW2
uaaauuacuugcacaccagug

SEQ ID NO: 4016137 - RNA, 18 nt, Staphylococcus aureus subsp. aureus MW2
uaaauuagaugaaaugga

SEQ ID NO: 4016138 - RNA, 17 nt, Staphylococcus aureus subsp. aureus MW2
uaaauuagccauuucaa

SEQ ID NO: 4016139 - RNA, 23 nt, Staphylococcus aureus subsp. aureus MW2
uaaauuagugguuagcuauauuu

SEQ ID NO: 4016140 - RNA, 14 nt, Staphylococcus aureus subsp. aureus MW2
uaaauuauauguuu

SEQ ID NO: 4016141 - RNA, 18 nt, Staphylococcus aureus subsp. aureus MW2
uaaauucaaaucuggcac

SEQ ID NO: 4016142 - RNA, 14 nt, Staphylococcus aureus subsp. aureus MW2
uaaauucaccaguu

SEQ ID NO: 4016143 - RNA, 14 nt, Staphylococcus aureus subsp. aureus MW2
uaaauucaucuguu

SEQ ID NO: 4016144 - RNA, 18 nt, Staphylococcus aureus subsp. aureus MW2
uaaauuccauguauucuu

SEQ ID NO: 4016145 - RNA, 19 nt, Staphylococcus aureus subsp. aureus MW2
uaaauucggaaaauaucac

SEQ ID NO: 4016146 - RNA, 16 nt, Staphylococcus aureus subsp. aureus MW2
uaaauucuaaaacgga

SEQ ID NO: 4016147 - RNA, 18 nt, Staphylococcus aureus subsp. aureus MW2
uaaauucuuauaaaauaa

SEQ ID NO: 4016148 - RNA, 19 nt, Staphylococcus aureus subsp. aureus MW2
uaaauucuuauaaaauaaa

SEQ ID NO: 4016149 - RNA, 23 nt, Staphylococcus aureus subsp. aureus MW2
uaaauugacucaaagauauacuu

SEQ ID NO: 4016150 - RNA, 22 nt, Staphylococcus aureus subsp. aureus MW2
uaaauugaguuuuuuaaaauaa

SEQ ID NO: 4016151 - RNA, 18 nt, Staphylococcus aureus subsp. aureus MW2
uaaauugcuugaaauuau

SEQ ID NO: 4016152 - RNA, 20 nt, Staphylococcus aureus subsp. aureus MW2
uaaauugcuugaaauuauua

SEQ ID NO: 4016153 - RNA, 17 nt, Staphylococcus aureus subsp. aureus MW2
uaaauugguucuauaau

SEQ ID NO: 4016154 - RNA, 19 nt, Staphylococcus aureus subsp. aureus MW2
uaaauuguaugaauaauau

SEQ ID NO: 4016155 - RNA, 19 nt, Staphylococcus aureus subsp. aureus MW2
uaaauuguuuacuauacuu

SEQ ID NO: 4016156 - RNA, 20 nt, Staphylococcus aureus subsp. aureus MW2
uaaauuguuuacuauacuuu

SEQ ID NO: 4016157 - RNA, 14 nt, Staphylococcus aureus subsp. aureus MW2
uaaauuguuuuaca

SEQ ID NO: 4016158 - RNA, 14 nt, Staphylococcus aureus subsp. aureus MW2
uaaauuuaaaagaa

SEQ ID NO: 4016159 - RNA, 17 nt, Staphylococcus aureus subsp. aureus MW2
uaaauuuaaaagaaaaa

SEQ ID NO: 4016160 - RNA, 14 nt, Staphylococcus aureus subsp. aureus MW2
uaaauuuaaaauaa

SEQ ID NO: 4016161 - RNA, 16 nt, Staphylococcus aureus subsp. aureus MW2
uaaauuuaaaauaaua

SEQ ID NO: 4016162 - RNA, 13 nt, Staphylococcus aureus subsp. aureus MW2
uaaauuuacaaaa

SEQ ID NO: 4016163 - RNA, 18 nt, Staphylococcus aureus subsp. aureus MW2
uaaauuuacaaaaacuau

SEQ ID NO: 4016164 - RNA, 14 nt, Staphylococcus aureus subsp. aureus MW2
uaaauuuaguaucu

SEQ ID NO: 4016165 - RNA, 13 nt, Staphylococcus aureus subsp. aureus MW2
uaaauuuauauau

SEQ ID NO: 4016166 - RNA, 15 nt, Staphylococcus aureus subsp. aureus MW2
uaaauuuauuauucg

SEQ ID NO: 4016167 - RNA, 23 nt, Staphylococcus aureus subsp. aureus MW2
uaaauuuauuauucguuucuuua

SEQ ID NO: 4016168 - RNA, 16 nt, Staphylococcus aureus subsp. aureus MW2
uaaauuuauuuuuaau

SEQ ID NO: 4016169 - RNA, 17 nt, Staphylococcus aureus subsp. aureus MW2
uaaauuuauuuuuaauu

SEQ ID NO: 4016170 - RNA, 13 nt, Staphylococcus aureus subsp. aureus MW2
uaaauuucaaaua

SEQ ID NO: 4016171 - RNA, 14 nt, Staphylococcus aureus subsp. aureus MW2
uaaauuucuucaua

SEQ ID NO: 4016172 - RNA, 22 nt, Staphylococcus aureus subsp. aureus MW2
uaaauuucuucauaguucaaau

SEQ ID NO: 4016173 - RNA, 18 nt, Staphylococcus aureus subsp. aureus MW2
uaaauuuuaucuaaacau

SEQ ID NO: 4016174 - RNA, 12 nt, Staphylococcus aureus subsp. aureus MW2
uaaauuuucauc

SEQ ID NO: 4016175 - RNA, 14 nt, Staphylococcus aureus subsp. aureus MW2
uaaauuuucaucau

SEQ ID NO: 4016176 - RNA, 17 nt, Staphylococcus aureus subsp. aureus MW2
uaaauuuugaauuacag

SEQ ID NO: 4016177 - RNA, 15 nt, Staphylococcus aureus subsp. aureus MW2
uaaauuuugagaaaa

SEQ ID NO: 4016178 - RNA, 16 nt, Staphylococcus aureus subsp. aureus MW2
uaaauuuugagaaaau

SEQ ID NO: 4016179 - RNA, 17 nt, Staphylococcus aureus subsp. aureus MW2
uaaauuuugcgaaaaua

SEQ ID NO: 4016180 - RNA, 23 nt, Staphylococcus aureus subsp. aureus MW2
uaaauuuugcgaaaauaucauuu

SEQ ID NO: 4016181 - RNA, 15 nt, Staphylococcus aureus subsp. aureus MW2
uaaauuuuguauaac

SEQ ID NO: 4016182 - RNA, 14 nt, Staphylococcus aureus subsp. aureus MW2
uaaauuuuuaagaa

SEQ ID NO: 4016183 - RNA, 23 nt, Staphylococcus aureus subsp. aureus MW2
uaaauuuuuauccaagucuaaau

SEQ ID NO: 4016184 - RNA, 16 nt, Staphylococcus aureus subsp. aureus MW2
uaaauuuuuuaauaua

SEQ ID NO: 4016185 - RNA, 14 nt, Staphylococcus aureus subsp. aureus MW2
uaacaaacauuaau

SEQ ID NO: 4016186 - RNA, 23 nt, Staphylococcus aureus subsp. aureus MW2
uaacaaacauuaaucuauauaaa

SEQ ID NO: 4016187 - RNA, 17 nt, Staphylococcus aureus subsp. aureus MW2
uaacaacaucaaaaccc

SEQ ID NO: 4016188 - RNA, 20 nt, Staphylococcus aureus subsp. aureus MW2
uaacaaccuauuaauugaaa

SEQ ID NO: 4016189 - RNA, 19 nt, Staphylococcus aureus subsp. aureus MW2
uaacaacuguucuaaaauu

SEQ ID NO: 4016190 - RNA, 20 nt, Staphylococcus aureus subsp. aureus MW2
uaacaagaaguaauguuaaa

SEQ ID NO: 4016191 - RNA, 17 nt, Staphylococcus aureus subsp. aureus MW2
uaacaaguacaauaaua

SEQ ID NO: 4016192 - RNA, 13 nt, Staphylococcus aureus subsp. aureus MW2
uaacaaguauaaa

SEQ ID NO: 4016193 - RNA, 16 nt, Staphylococcus aureus subsp. aureus MW2
uaacaaguauaaaugc

SEQ ID NO: 4016194 - RNA, 14 nt, Staphylococcus aureus subsp. aureus MW2
uaacaagugaugaa

SEQ ID NO: 4016195 - RNA, 16 nt, Staphylococcus aureus subsp. aureus MW2
uaacaagugaugaaaa

SEQ ID NO: 4016196 - RNA, 17 nt, Staphylococcus aureus subsp. aureus MW2
uaacaagugaugaaaaa

SEQ ID NO: 4016197 - RNA, 18 nt, Staphylococcus aureus subsp. aureus MW2
uaacaagugaugaaaaag

SEQ ID NO: 4016198 - RNA, 16 nt, Staphylococcus aureus subsp. aureus MW2
uaacaaguucauuuca

SEQ ID NO: 4016199 - RNA, 19 nt, Staphylococcus aureus subsp. aureus MW2
uaacaaguucauuucaaua

SEQ ID NO: 4016200 - RNA, 15 nt, Staphylococcus aureus subsp. aureus MW2
uaacaauauuaaauu

SEQ ID NO: 4016201 - RNA, 17 nt, Staphylococcus aureus subsp. aureus MW2
uaacaaucguuuuaaug

SEQ ID NO: 4016202 - RNA, 15 nt, Staphylococcus aureus subsp. aureus MW2
uaacaaugaaccauc

SEQ ID NO: 4016203 - RNA, 13 nt, Staphylococcus aureus subsp. aureus MW2
uaacaaugcgauu

SEQ ID NO: 4016204 - RNA, 16 nt, Staphylococcus aureus subsp. aureus MW2
uaacaauuuauuaaaa

SEQ ID NO: 4016205 - RNA, 17 nt, Staphylococcus aureus subsp. aureus MW2
uaacaauuuauuaaaac

SEQ ID NO: 4016206 - RNA, 17 nt, Staphylococcus aureus subsp. aureus MW2
uaacaauuuuaaaucuu

SEQ ID NO: 4016207 - RNA, 15 nt, Staphylococcus aureus subsp. aureus MW2
uaacaauuuuaauuu

SEQ ID NO: 4016208 - RNA, 22 nt, Staphylococcus aureus subsp. aureus MW2
uaacaauuuuaauuuuucauua

SEQ ID NO: 4016209 - RNA, 15 nt, Staphylococcus aureus subsp. aureus MW2
uaacaauuuuaucug

SEQ ID NO: 4016210 - RNA, 21 nt, Staphylococcus aureus subsp. aureus MW2
uaacaauuuuaucugaaucug

SEQ ID NO: 4016211 - RNA, 17 nt, Staphylococcus aureus subsp. aureus MW2
uaacacaucaugacauu

SEQ ID NO: 4016212 - RNA, 14 nt, Staphylococcus aureus subsp. aureus MW2
uaacacaugcuuca

SEQ ID NO: 4016213 - RNA, 15 nt, Staphylococcus aureus subsp. aureus MW2
uaacacaugcuucau

SEQ ID NO: 4016214 - RNA, 17 nt, Staphylococcus aureus subsp. aureus MW2
uaacaccaauugaauau

SEQ ID NO: 4016215 - RNA, 20 nt, Staphylococcus aureus subsp. aureus MW2
uaacacccgucccauaaaag

SEQ ID NO: 4016216 - RNA, 20 nt, Staphylococcus aureus subsp. aureus MW2
uaacagacuuuguuaaaaaa

SEQ ID NO: 4016217 - RNA, 16 nt, Staphylococcus aureus subsp. aureus MW2
uaacagaguugucauu

SEQ ID NO: 4016218 - RNA, 18 nt, Staphylococcus aureus subsp. aureus MW2
uaacagcuacaaauaaug

SEQ ID NO: 4016219 - RNA, 21 nt, Staphylococcus aureus subsp. aureus MW2
uaacagucccaaccccuuuau

SEQ ID NO: 4016220 - RNA, 17 nt, Staphylococcus aureus subsp. aureus MW2
uaacagugugaaauaau

SEQ ID NO: 4016221 - RNA, 19 nt, Staphylococcus aureus subsp. aureus MW2
uaacagugugaaauaauaa

SEQ ID NO: 4016222 - RNA, 23 nt, Staphylococcus aureus subsp. aureus MW2
uaacauaaaaaggucuauguaca

SEQ ID NO: 4016223 - RNA, 15 nt, Staphylococcus aureus subsp. aureus MW2
uaacauaaaaugagu

SEQ ID NO: 4016224 - RNA, 14 nt, Staphylococcus aureus subsp. aureus MW2
uaacauaagaaaaa

SEQ ID NO: 4016225 - RNA, 21 nt, Staphylococcus aureus subsp. aureus MW2
uaacauagcuuaauaauuaau

SEQ ID NO: 4016226 - RNA, 21 nt, Staphylococcus aureus subsp. aureus MW2
uaacauaucgcgcaucaaaaa

SEQ ID NO: 4016227 - RNA, 13 nt, Staphylococcus aureus subsp. aureus MW2
uaacauaugcaag

SEQ ID NO: 4016228 - RNA, 16 nt, Staphylococcus aureus subsp. aureus MW2
uaacaucaaauagaca

SEQ ID NO: 4016229 - RNA, 14 nt, Staphylococcus aureus subsp. aureus MW2
uaacaucacagaaa

SEQ ID NO: 4016230 - RNA, 20 nt, Staphylococcus aureus subsp. aureus MW2
uaacaucacagaaaauacau

SEQ ID NO: 4016231 - RNA, 21 nt, Staphylococcus aureus subsp. aureus MW2
uaacaucacagaaaauacauu

SEQ ID NO: 4016232 - RNA, 19 nt, Staphylococcus aureus subsp. aureus MW2
uaacauccugcuuauuaau

SEQ ID NO: 4016233 - RNA, 21 nt, Staphylococcus aureus subsp. aureus MW2
uaacauccugcuuauuaauug

SEQ ID NO: 4016234 - RNA, 14 nt, Staphylococcus aureus subsp. aureus MW2
uaacaucuaaauuu

SEQ ID NO: 4016235 - RNA, 12 nt, Staphylococcus aureus subsp. aureus MW2
uaacaucugaau

SEQ ID NO: 4016236 - RNA, 15 nt, Staphylococcus aureus subsp. aureus MW2
uaacaucugaaucug

SEQ ID NO: 4016237 - RNA, 18 nt, Staphylococcus aureus subsp. aureus MW2
uaacaucuucauguauga

SEQ ID NO: 4016238 - RNA, 13 nt, Staphylococcus aureus subsp. aureus MW2
uaacaucuuuuuc

SEQ ID NO: 4016239 - RNA, 14 nt, Staphylococcus aureus subsp. aureus MW2
uaacaucuuuuuca

SEQ ID NO: 4016240 - RNA, 19 nt, Staphylococcus aureus subsp. aureus MW2
uaacaugaccuaauauauu

SEQ ID NO: 4016241 - RNA, 23 nt, Staphylococcus aureus subsp. aureus MW2
uaacaugggguuuuauuuuugga

SEQ ID NO: 4016242 - RNA, 21 nt, Staphylococcus aureus subsp. aureus MW2
uaacauguauuuaguaucaua

SEQ ID NO: 4016243 - RNA, 23 nt, Staphylococcus aureus subsp. aureus MW2
uaacauguuuguggcaccucuuu

SEQ ID NO: 4016244 - RNA, 22 nt, Staphylococcus aureus subsp. aureus MW2
uaacauuacguucuaauaauuu

SEQ ID NO: 4016245 - RNA, 21 nt, Staphylococcus aureus subsp. aureus MW2
uaacauuagcauuaaauucca

SEQ ID NO: 4016246 - RNA, 16 nt, Staphylococcus aureus subsp. aureus MW2
uaacauucuucaaaaa

SEQ ID NO: 4016247 - RNA, 19 nt, Staphylococcus aureus subsp. aureus MW2
uaacauucuucaaaaaaua

SEQ ID NO: 4016248 - RNA, 13 nt, Staphylococcus aureus subsp. aureus MW2
uaacauuuaaaaa

SEQ ID NO: 4016249 - RNA, 14 nt, Staphylococcus aureus subsp. aureus MW2
uaacauuuaaaaaa

SEQ ID NO: 4016250 - RNA, 15 nt, Staphylococcus aureus subsp. aureus MW2
uaacauuuaaaaaau

SEQ ID NO: 4016251 - RNA, 20 nt, Staphylococcus aureus subsp. aureus MW2
uaacauuugcuaguagaguu

SEQ ID NO: 4016252 - RNA, 13 nt, Staphylococcus aureus subsp. aureus MW2
uaacauuugucau

SEQ ID NO: 4016253 - RNA, 12 nt, Staphylococcus aureus subsp. aureus MW2
uaacauuuugaa

SEQ ID NO: 4016254 - RNA, 14 nt, Staphylococcus aureus subsp. aureus MW2
uaacauuuuuuuca

SEQ ID NO: 4016255 - RNA, 16 nt, Staphylococcus aureus subsp. aureus MW2
uaaccaaaccauuaau

SEQ ID NO: 4016256 - RNA, 13 nt, Staphylococcus aureus subsp. aureus MW2
uaaccacaucauu

SEQ ID NO: 4016257 - RNA, 22 nt, Staphylococcus aureus subsp. aureus MW2
uaaccaccaucccauuaaacca

SEQ ID NO: 4016258 - RNA, 19 nt, Staphylococcus aureus subsp. aureus MW2
uaaccacuccuuaaacaaa

SEQ ID NO: 4016259 - RNA, 19 nt, Staphylococcus aureus subsp. aureus MW2
uaaccaguauaauuuucug

SEQ ID NO: 4016260 - RNA, 17 nt, Staphylococcus aureus subsp. aureus MW2
uaaccauaguaacaaaa

SEQ ID NO: 4016261 - RNA, 16 nt, Staphylococcus aureus subsp. aureus MW2
uaaccaucauaaaugu

SEQ ID NO: 4016262 - RNA, 13 nt, Staphylococcus aureus subsp. aureus MW2
uaaccauuaugau

SEQ ID NO: 4016263 - RNA, 14 nt, Staphylococcus aureus subsp. aureus MW2
uaaccauuaugauu

SEQ ID NO: 4016264 - RNA, 21 nt, Staphylococcus aureus subsp. aureus MW2
uaaccauuaugauuaauccua

SEQ ID NO: 4016265 - RNA, 15 nt, Staphylococcus aureus subsp. aureus MW2
uaaccauuuaaaaau

SEQ ID NO: 4016266 - RNA, 14 nt, Staphylococcus aureus subsp. aureus MW2
uaaccauuucauuu

SEQ ID NO: 4016267 - RNA, 19 nt, Staphylococcus aureus subsp. aureus MW2
uaaccauuucuuuuuucaa

SEQ ID NO: 4016268 - RNA, 15 nt, Staphylococcus aureus subsp. aureus MW2
uaaccccuccuggug

SEQ ID NO: 4016269 - RNA, 13 nt, Staphylococcus aureus subsp. aureus MW2
uaaccccuucaaa

SEQ ID NO: 4016270 - RNA, 21 nt, Staphylococcus aureus subsp. aureus MW2
uaaccccuucaaaauuuugac

SEQ ID NO: 4016271 - RNA, 14 nt, Staphylococcus aureus subsp. aureus MW2
uaaccgaaauauug

SEQ ID NO: 4016272 - RNA, 14 nt, Staphylococcus aureus subsp. aureus MW2
uaaccgaugugauu

SEQ ID NO: 4016273 - RNA, 15 nt, Staphylococcus aureus subsp. aureus MW2
uaaccgcauacagau

SEQ ID NO: 4016274 - RNA, 19 nt, Staphylococcus aureus subsp. aureus MW2
uaaccgcuucuuuuaaguu

SEQ ID NO: 4016275 - RNA, 20 nt, Staphylococcus aureus subsp. aureus MW2
uaaccuaaagauaauauuaa

SEQ ID NO: 4016276 - RNA, 16 nt, Staphylococcus aureus subsp. aureus MW2
uaaccuauuaaaucug

SEQ ID NO: 4016277 - RNA, 12 nt, Staphylococcus aureus subsp. aureus MW2
uaaccugacuuu

SEQ ID NO: 4016278 - RNA, 15 nt, Staphylococcus aureus subsp. aureus MW2
uaaccugacuuuccg

SEQ ID NO: 4016279 - RNA, 14 nt, Staphylococcus aureus subsp. aureus MW2
uaaccuuaauuauu

SEQ ID NO: 4016280 - RNA, 13 nt, Staphylococcus aureus subsp. aureus MW2
uaaccuuuaaaac

SEQ ID NO: 4016281 - RNA, 15 nt, Staphylococcus aureus subsp. aureus MW2
uaaccuuuaaaacau

SEQ ID NO: 4016282 - RNA, 17 nt, Staphylococcus aureus subsp. aureus MW2
uaaccuuuaaaacguua

SEQ ID NO: 4016283 - RNA, 22 nt, Staphylococcus aureus subsp. aureus MW2
uaacgaaaaagaugguuuuguu

SEQ ID NO: 4016284 - RNA, 23 nt, Staphylococcus aureus subsp. aureus MW2
uaacgaguuuucaguauguaaaa

SEQ ID NO: 4016285 - RNA, 19 nt, Staphylococcus aureus subsp. aureus MW2
uaacgauagauuuuuucau

SEQ ID NO: 4016286 - RNA, 20 nt, Staphylococcus aureus subsp. aureus MW2
uaacgaugguugcuucacug

SEQ ID NO: 4016287 - RNA, 23 nt, Staphylococcus aureus subsp. aureus MW2
uaacgaugguugcuucacuguuu

SEQ ID NO: 4016288 - RNA, 13 nt, Staphylococcus aureus subsp. aureus MW2
uaacgauuaauau

SEQ ID NO: 4016289 - RNA, 15 nt, Staphylococcus aureus subsp. aureus MW2
uaacgcaaugucuug

SEQ ID NO: 4016290 - RNA, 19 nt, Staphylococcus aureus subsp. aureus MW2
uaacgcacugcauuaucaa

SEQ ID NO: 4016291 - RNA, 17 nt, Staphylococcus aureus subsp. aureus MW2
uaacgcaguugaaaaag

SEQ ID NO: 4016292 - RNA, 21 nt, Staphylococcus aureus subsp. aureus MW2
uaacgcucaugaguuucucau

SEQ ID NO: 4016293 - RNA, 20 nt, Staphylococcus aureus subsp. aureus MW2
uaacgcuuauacuauauaau

SEQ ID NO: 4016294 - RNA, 17 nt, Staphylococcus aureus subsp. aureus MW2
uaacgcuuuaaaucauu

SEQ ID NO: 4016295 - RNA, 19 nt, Staphylococcus aureus subsp. aureus MW2
uaacgugaggcccauaaau

SEQ ID NO: 4016296 - RNA, 16 nt, Staphylococcus aureus subsp. aureus MW2
uaacguugcagagaau

SEQ ID NO: 4016297 - RNA, 14 nt, Staphylococcus aureus subsp. aureus MW2
uaacuaaaaugucu

SEQ ID NO: 4016298 - RNA, 15 nt, Staphylococcus aureus subsp. aureus MW2
uaacuacacuuaaua

SEQ ID NO: 4016299 - RNA, 16 nt, Staphylococcus aureus subsp. aureus MW2
uaacuagaaugauuaa

SEQ ID NO: 4016300 - RNA, 17 nt, Staphylococcus aureus subsp. aureus MW2
uaacuagaaugauuaaa

SEQ ID NO: 4016301 - RNA, 22 nt, Staphylococcus aureus subsp. aureus MW2
uaacuagauguucacauucuug

SEQ ID NO: 4016302 - RNA, 17 nt, Staphylococcus aureus subsp. aureus MW2
uaacuagcaaaugcacu

SEQ ID NO: 4016303 - RNA, 20 nt, Staphylococcus aureus subsp. aureus MW2
uaacuaguauccuuuauaaa

SEQ ID NO: 4016304 - RNA, 17 nt, Staphylococcus aureus subsp. aureus MW2
uaacuagugccucuuuu

SEQ ID NO: 4016305 - RNA, 22 nt, Staphylococcus aureus subsp. aureus MW2
uaacuauaacaauaguuuucuu

SEQ ID NO: 4016306 - RNA, 17 nt, Staphylococcus aureus subsp. aureus MW2
uaacuaugaaugcugug

SEQ ID NO: 4016307 - RNA, 12 nt, Staphylococcus aureus subsp. aureus MW2
uaacuauuuaau

SEQ ID NO: 4016308 - RNA, 13 nt, Staphylococcus aureus subsp. aureus MW2
uaacuauuuaauu

SEQ ID NO: 4016309 - RNA, 22 nt, Staphylococcus aureus subsp. aureus MW2
uaacucaaauaucuaaacaauu

SEQ ID NO: 4016310 - RNA, 14 nt, Staphylococcus aureus subsp. aureus MW2
uaacucaagugauu

SEQ ID NO: 4016311 - RNA, 13 nt, Staphylococcus aureus subsp. aureus MW2
uaacucaguaaau

SEQ ID NO: 4016312 - RNA, 19 nt, Staphylococcus aureus subsp. aureus MW2
uaacucuaucaaauuacuu

SEQ ID NO: 4016313 - RNA, 17 nt, Staphylococcus aureus subsp. aureus MW2
uaacucuucuaaguuau

SEQ ID NO: 4016314 - RNA, 15 nt, Staphylococcus aureus subsp. aureus MW2
uaacucuuuaauuuu

SEQ ID NO: 4016315 - RNA, 16 nt, Staphylococcus aureus subsp. aureus MW2
uaacucuuuguauaag

SEQ ID NO: 4016316 - RNA, 15 nt, Staphylococcus aureus subsp. aureus MW2
uaacugaccuaacaa

SEQ ID NO: 4016317 - RNA, 13 nt, Staphylococcus aureus subsp. aureus MW2
uaacugauaaaag

SEQ ID NO: 4016318 - RNA, 14 nt, Staphylococcus aureus subsp. aureus MW2
uaacugauaauacu

SEQ ID NO: 4016319 - RNA, 16 nt, Staphylococcus aureus subsp. aureus MW2
uaacugcaaacuugau

SEQ ID NO: 4016320 - RNA, 19 nt, Staphylococcus aureus subsp. aureus MW2
uaacugcaaacuugauuca

SEQ ID NO: 4016321 - RNA, 16 nt, Staphylococcus aureus subsp. aureus MW2
uaacugcgugaauguu

SEQ ID NO: 4016322 - RNA, 19 nt, Staphylococcus aureus subsp. aureus MW2
uaacugcuaauuuuuucau

SEQ ID NO: 4016323 - RNA, 20 nt, Staphylococcus aureus subsp. aureus MW2
uaacuggcaaaucaaacaau

SEQ ID NO: 4016324 - RNA, 23 nt, Staphylococcus aureus subsp. aureus MW2
uaacugguugauaaauaaacuca

SEQ ID NO: 4016325 - RNA, 15 nt, Staphylococcus aureus subsp. aureus MW2
uaacuguaaaacauu

SEQ ID NO: 4016326 - RNA, 17 nt, Staphylococcus aureus subsp. aureus MW2
uaacuguagcuccuaaa

SEQ ID NO: 4016327 - RNA, 15 nt, Staphylococcus aureus subsp. aureus MW2
uaacuguguauggca

SEQ ID NO: 4016328 - RNA, 16 nt, Staphylococcus aureus subsp. aureus MW2
uaacuguuuauccaua

SEQ ID NO: 4016329 - RNA, 17 nt, Staphylococcus aureus subsp. aureus MW2
uaacuguuuuaaauuaa

SEQ ID NO: 4016330 - RNA, 18 nt, Staphylococcus aureus subsp. aureus MW2
uaacuuaaaauuuaaaua

SEQ ID NO: 4016331 - RNA, 17 nt, Staphylococcus aureus subsp. aureus MW2
uaacuuaacucuaucaa

SEQ ID NO: 4016332 - RNA, 20 nt, Staphylococcus aureus subsp. aureus MW2
uaacuugaacagauucaccu

SEQ ID NO: 4016333 - RNA, 14 nt, Staphylococcus aureus subsp. aureus MW2
uaacuugauaucau

SEQ ID NO: 4016334 - RNA, 16 nt, Staphylococcus aureus subsp. aureus MW2
uaacuugauaucaucu

SEQ ID NO: 4016335 - RNA, 19 nt, Staphylococcus aureus subsp. aureus MW2
uaacuugauauuauauaaa

SEQ ID NO: 4016336 - RNA, 15 nt, Staphylococcus aureus subsp. aureus MW2
uaacuugauuuucua

SEQ ID NO: 4016337 - RNA, 16 nt, Staphylococcus aureus subsp. aureus MW2
uaacuuguuuauucag

SEQ ID NO: 4016338 - RNA, 18 nt, Staphylococcus aureus subsp. aureus MW2
uaacuuuaaaaauuaagu

SEQ ID NO: 4016339 - RNA, 18 nt, Staphylococcus aureus subsp. aureus MW2
uaacuuuaacaucugaau

SEQ ID NO: 4016340 - RNA, 21 nt, Staphylococcus aureus subsp. aureus MW2
uaacuuuaauauaaguauaau

SEQ ID NO: 4016341 - RNA, 16 nt, Staphylococcus aureus subsp. aureus MW2
uaacuuucagcaccag

SEQ ID NO: 4016342 - RNA, 18 nt, Staphylococcus aureus subsp. aureus MW2
uaacuuucagcaccagaa

SEQ ID NO: 4016343 - RNA, 22 nt, Staphylococcus aureus subsp. aureus MW2
uaacuuuccgccuucaauccaa

SEQ ID NO: 4016344 - RNA, 13 nt, Staphylococcus aureus subsp. aureus MW2
uaacuuucuuuug

SEQ ID NO: 4016345 - RNA, 20 nt, Staphylococcus aureus subsp. aureus MW2
uaacuuucuuuuguuuuuau

SEQ ID NO: 4016346 - RNA, 14 nt, Staphylococcus aureus subsp. aureus MW2
uaacuuuggcauca

SEQ ID NO: 4016347 - RNA, 15 nt, Staphylococcus aureus subsp. aureus MW2
uaacuuugucuguau

SEQ ID NO: 4016348 - RNA, 21 nt, Staphylococcus aureus subsp. aureus MW2
uaacuuugucuguauuauuau

SEQ ID NO: 4016349 - RNA, 14 nt, Staphylococcus aureus subsp. aureus MW2
uaacuuuuuaaagg

SEQ ID NO: 4016350 - RNA, 15 nt, Staphylococcus aureus subsp. aureus MW2
uaagaaaaggcuccc

SEQ ID NO: 4016351 - RNA, 17 nt, Staphylococcus aureus subsp. aureus MW2
uaagaaaaucauucauu

SEQ ID NO: 4016352 - RNA, 14 nt, Staphylococcus aureus subsp. aureus MW2
uaagaagcuuucug

SEQ ID NO: 4016353 - RNA, 22 nt, Staphylococcus aureus subsp. aureus MW2
uaagaagugacaucguugcuuu

SEQ ID NO: 4016354 - RNA, 15 nt, Staphylococcus aureus subsp. aureus MW2
uaagaaguuaaacga

SEQ ID NO: 4016355 - RNA, 22 nt, Staphylococcus aureus subsp. aureus MW2
uaagaauauuuaaguuuccuau

SEQ ID NO: 4016356 - RNA, 19 nt, Staphylococcus aureus subsp. aureus MW2
uaagaaugccauaccugca

SEQ ID NO: 4016357 - RNA, 22 nt, Staphylococcus aureus subsp. aureus MW2
uaagaaugugagauacguuauu

SEQ ID NO: 4016358 - RNA, 13 nt, Staphylococcus aureus subsp. aureus MW2
uaagaauuaacaa

SEQ ID NO: 4016359 - RNA, 14 nt, Staphylococcus aureus subsp. aureus MW2
uaagaauuuaaaag

SEQ ID NO: 4016360 - RNA, 22 nt, Staphylococcus aureus subsp. aureus MW2
uaagacagcuucucauugaaau

SEQ ID NO: 4016361 - RNA, 16 nt, Staphylococcus aureus subsp. aureus MW2
uaagacauaugcagug

SEQ ID NO: 4016362 - RNA, 23 nt, Staphylococcus aureus subsp. aureus MW2
uaagaccacaucgauaucuaagu

SEQ ID NO: 4016363 - RNA, 22 nt, Staphylococcus aureus subsp. aureus MW2
uaagagauuuucuuaauugaaa

SEQ ID NO: 4016364 - RNA, 23 nt, Staphylococcus aureus subsp. aureus MW2
uaagauaauguguaccuuuuuau

SEQ ID NO: 4016365 - RNA, 15 nt, Staphylococcus aureus subsp. aureus MW2
uaagauagauaaauc

SEQ ID NO: 4016366 - RNA, 18 nt, Staphylococcus aureus subsp. aureus MW2
uaagauagauaaaucaag

SEQ ID NO: 4016367 - RNA, 19 nt, Staphylococcus aureus subsp. aureus MW2
uaagauaguuugagaaaau

SEQ ID NO: 4016368 - RNA, 12 nt, Staphylococcus aureus subsp. aureus MW2
uaagauauauug

SEQ ID NO: 4016369 - RNA, 13 nt, Staphylococcus aureus subsp. aureus MW2
uaagauauuucca

SEQ ID NO: 4016370 - RNA, 14 nt, Staphylococcus aureus subsp. aureus MW2
uaagaucaauauca

SEQ ID NO: 4016371 - RNA, 16 nt, Staphylococcus aureus subsp. aureus MW2
uaagaugacugaacca

SEQ ID NO: 4016372 - RNA, 12 nt, Staphylococcus aureus subsp. aureus MW2
uaagauuagcua

SEQ ID NO: 4016373 - RNA, 15 nt, Staphylococcus aureus subsp. aureus MW2
uaagauuuaaacauc

SEQ ID NO: 4016374 - RNA, 12 nt, Staphylococcus aureus subsp. aureus MW2
uaagcaaaaauu

SEQ ID NO: 4016375 - RNA, 22 nt, Staphylococcus aureus subsp. aureus MW2
uaagcagagccguaaugagagu

SEQ ID NO: 4016376 - RNA, 19 nt, Staphylococcus aureus subsp. aureus MW2
uaagcaguuaauaagaaac

SEQ ID NO: 4016377 - RNA, 18 nt, Staphylococcus aureus subsp. aureus MW2
uaagcaucguaaaaaaca

SEQ ID NO: 4016378 - RNA, 17 nt, Staphylococcus aureus subsp. aureus MW2
uaagcauuaauguucaa

SEQ ID NO: 4016379 - RNA, 23 nt, Staphylococcus aureus subsp. aureus MW2
uaagcauuaauguucaauuuaua

SEQ ID NO: 4016380 - RNA, 14 nt, Staphylococcus aureus subsp. aureus MW2
uaagccuguuugac

SEQ ID NO: 4016381 - RNA, 21 nt, Staphylococcus aureus subsp. aureus MW2
uaagcgcaauggccauuugau

SEQ ID NO: 4016382 - RNA, 23 nt, Staphylococcus aureus subsp. aureus MW2
uaagcgcaauggccauuugauuu

SEQ ID NO: 4016383 - RNA, 22 nt, Staphylococcus aureus subsp. aureus MW2
uaagcguaauauuuaagaaguu

SEQ ID NO: 4016384 - RNA, 13 nt, Staphylococcus aureus subsp. aureus MW2
uaagcuaauauuu

SEQ ID NO: 4016385 - RNA, 23 nt, Staphylococcus aureus subsp. aureus MW2
uaagcucuuaaucuauaaauuau

SEQ ID NO: 4016386 - RNA, 12 nt, Staphylococcus aureus subsp. aureus MW2
uaagcugaaaua

SEQ ID NO: 4016387 - RNA, 21 nt, Staphylococcus aureus subsp. aureus MW2
uaagcugcucgauauaagucu

SEQ ID NO: 4016388 - RNA, 19 nt, Staphylococcus aureus subsp. aureus MW2
uaagcuuacgacauacuug

SEQ ID NO: 4016389 - RNA, 21 nt, Staphylococcus aureus subsp. aureus MW2
uaagcuuaucaacgauuuugu

SEQ ID NO: 4016390 - RNA, 21 nt, Staphylococcus aureus subsp. aureus MW2
uaagcuuucuaucuuguucuu

SEQ ID NO: 4016391 - RNA, 15 nt, Staphylococcus aureus subsp. aureus MW2
uaagcuuuguuugac

SEQ ID NO: 4016392 - RNA, 14 nt, Staphylococcus aureus subsp. aureus MW2
uaaggaaccugucu

SEQ ID NO: 4016393 - RNA, 19 nt, Staphylococcus aureus subsp. aureus MW2
uaaggaaccugucuuaauu

SEQ ID NO: 4016394 - RNA, 19 nt, Staphylococcus aureus subsp. aureus MW2
uaaggaugauuuauuaacu

SEQ ID NO: 4016395 - RNA, 22 nt, Staphylococcus aureus subsp. aureus MW2
uaaggaugauuuauuaacucau

SEQ ID NO: 4016396 - RNA, 17 nt, Staphylococcus aureus subsp. aureus MW2
uaaggcugauucaaaaa

SEQ ID NO: 4016397 - RNA, 23 nt, Staphylococcus aureus subsp. aureus MW2
uaagguaagacgccgaaaagagg

SEQ ID NO: 4016398 - RNA, 23 nt, Staphylococcus aureus subsp. aureus MW2
uaagguauuucauugauaagucu

SEQ ID NO: 4016399 - RNA, 20 nt, Staphylococcus aureus subsp. aureus MW2
uaaggugauugaacaauaau

SEQ ID NO: 4016400 - RNA, 15 nt, Staphylococcus aureus subsp. aureus MW2
uaagguuugaacucu

SEQ ID NO: 4016401 - RNA, 18 nt, Staphylococcus aureus subsp. aureus MW2
uaaguaagauuuaaacau

SEQ ID NO: 4016402 - RNA, 18 nt, Staphylococcus aureus subsp. aureus MW2
uaaguaagcguaauauuu

SEQ ID NO: 4016403 - RNA, 15 nt, Staphylococcus aureus subsp. aureus MW2
uaaguacaaauaaua

SEQ ID NO: 4016404 - RNA, 17 nt, Staphylococcus aureus subsp. aureus MW2
uaaguacagcauauaau

SEQ ID NO: 4016405 - RNA, 15 nt, Staphylococcus aureus subsp. aureus MW2
uaaguacauaaaugc

SEQ ID NO: 4016406 - RNA, 16 nt, Staphylococcus aureus subsp. aureus MW2
uaaguacgaggaccau

SEQ ID NO: 4016407 - RNA, 22 nt, Staphylococcus aureus subsp. aureus MW2
uaaguacgaggaccaucucuaa

SEQ ID NO: 4016408 - RNA, 15 nt, Staphylococcus aureus subsp. aureus MW2
uaaguacuuuuacaa

SEQ ID NO: 4016409 - RNA, 17 nt, Staphylococcus aureus subsp. aureus MW2
uaaguagaaaauaugac

SEQ ID NO: 4016410 - RNA, 12 nt, Staphylococcus aureus subsp. aureus MW2
uaaguagcucaa

SEQ ID NO: 4016411 - RNA, 17 nt, Staphylococcus aureus subsp. aureus MW2
uaaguagcucaaaacaa

SEQ ID NO: 4016412 - RNA, 18 nt, Staphylococcus aureus subsp. aureus MW2
uaaguaguucaauaaauu

SEQ ID NO: 4016413 - RNA, 20 nt, Staphylococcus aureus subsp. aureus MW2
uaaguauaaugaugugccuc

SEQ ID NO: 4016414 - RNA, 20 nt, Staphylococcus aureus subsp. aureus MW2
uaaguauaauuaaacuaaua

SEQ ID NO: 4016415 - RNA, 13 nt, Staphylococcus aureus subsp. aureus MW2
uaaguauuuaaac

SEQ ID NO: 4016416 - RNA, 17 nt, Staphylococcus aureus subsp. aureus MW2
uaaguauuuuaauaaca

SEQ ID NO: 4016417 - RNA, 21 nt, Staphylococcus aureus subsp. aureus MW2
uaaguauuuuaauaacaagua

SEQ ID NO: 4016418 - RNA, 20 nt, Staphylococcus aureus subsp. aureus MW2
uaagucgccuaacuuuuauu

SEQ ID NO: 4016419 - RNA, 20 nt, Staphylococcus aureus subsp. aureus MW2
uaagugaauuaucuauauau

SEQ ID NO: 4016420 - RNA, 15 nt, Staphylococcus aureus subsp. aureus MW2
uaagugauaaauaau

SEQ ID NO: 4016421 - RNA, 23 nt, Staphylococcus aureus subsp. aureus MW2
uaagugaugaccaauauucugga

SEQ ID NO: 4016422 - RNA, 12 nt, Staphylococcus aureus subsp. aureus MW2
uaaguuaaaaau

SEQ ID NO: 4016423 - RNA, 22 nt, Staphylococcus aureus subsp. aureus MW2
uaaguuaauuuuaugucccaau

SEQ ID NO: 4016424 - RNA, 13 nt, Staphylococcus aureus subsp. aureus MW2
uaaguucaccuaa

SEQ ID NO: 4016425 - RNA, 17 nt, Staphylococcus aureus subsp. aureus MW2
uaaguugacuauauaau

SEQ ID NO: 4016426 - RNA, 20 nt, Staphylococcus aureus subsp. aureus MW2
uaaguugacuauauaaugau

SEQ ID NO: 4016427 - RNA, 17 nt, Staphylococcus aureus subsp. aureus MW2
uaaguuguugauuuaaa

SEQ ID NO: 4016428 - RNA, 20 nt, Staphylococcus aureus subsp. aureus MW2
uaaguuucgcugcuacacca

SEQ ID NO: 4016429 - RNA, 22 nt, Staphylococcus aureus subsp. aureus MW2
uaaguuucgcugcuacaccacc

SEQ ID NO: 4016430 - RNA, 20 nt, Staphylococcus aureus subsp. aureus MW2
uaaguuugucuuugaacaua

SEQ ID NO: 4016431 - RNA, 15 nt, Staphylococcus aureus subsp. aureus MW2
uaauaaaacugcaau

SEQ ID NO: 4016432 - RNA, 19 nt, Staphylococcus aureus subsp. aureus MW2
uaauaaaacugcaauaauu

SEQ ID NO: 4016433 - RNA, 13 nt, Staphylococcus aureus subsp. aureus MW2
uaauaaaaucauc

SEQ ID NO: 4016434 - RNA, 19 nt, Staphylococcus aureus subsp. aureus MW2
uaauaaaauucuauaaccu

SEQ ID NO: 4016435 - RNA, 14 nt, Staphylococcus aureus subsp. aureus MW2
uaauaaacuuaaaa

SEQ ID NO: 4016436 - RNA, 16 nt, Staphylococcus aureus subsp. aureus MW2
uaauaaacuuaaaaga

SEQ ID NO: 4016437 - RNA, 16 nt, Staphylococcus aureus subsp. aureus MW2
uaauaaagaauaaaca

SEQ ID NO: 4016438 - RNA, 19 nt, Staphylococcus aureus subsp. aureus MW2
uaauaaagcugauuuuuca

SEQ ID NO: 4016439 - RNA, 16 nt, Staphylococcus aureus subsp. aureus MW2
uaauaaaguaaucagu

SEQ ID NO: 4016440 - RNA, 21 nt, Staphylococcus aureus subsp. aureus MW2
uaauaaauaggaugaaaaaga

SEQ ID NO: 4016441 - RNA, 11 nt, Staphylococcus aureus subsp. aureus MW2
uaauaaauauc

SEQ ID NO: 4016442 - RNA, 22 nt, Staphylococcus aureus subsp. aureus MW2
uaauaaaucacgccauaaucuu

SEQ ID NO: 4016443 - RNA, 15 nt, Staphylococcus aureus subsp. aureus MW2
uaauaaaucauuagu

SEQ ID NO: 4016444 - RNA, 21 nt, Staphylococcus aureus subsp. aureus MW2
uaauaaauuagccauuucaau

SEQ ID NO: 4016445 - RNA, 23 nt, Staphylococcus aureus subsp. aureus MW2
uaauaaauuagccauuucaauug

SEQ ID NO: 4016446 - RNA, 11 nt, Staphylococcus aureus subsp. aureus MW2
uaauaaauugu

SEQ ID NO: 4016447 - RNA, 22 nt, Staphylococcus aureus subsp. aureus MW2
uaauaaauuguuaucguucaau

SEQ ID NO: 4016448 - RNA, 13 nt, Staphylococcus aureus subsp. aureus MW2
uaauaaauuuaac

SEQ ID NO: 4016449 - RNA, 15 nt, Staphylococcus aureus subsp. aureus MW2
uaauaaauuuaacgu

SEQ ID NO: 4016450 - RNA, 21 nt, Staphylococcus aureus subsp. aureus MW2
uaauaaauuuccaaaguaaua

SEQ ID NO: 4016451 - RNA, 12 nt, Staphylococcus aureus subsp. aureus MW2
uaauaacaaaau

SEQ ID NO: 4016452 - RNA, 14 nt, Staphylococcus aureus subsp. aureus MW2
uaauaacaucuaaa

SEQ ID NO: 4016453 - RNA, 17 nt, Staphylococcus aureus subsp. aureus MW2
uaauaacaucuaaauuu

SEQ ID NO: 4016454 - RNA, 18 nt, Staphylococcus aureus subsp. aureus MW2
uaauaaccauguaaaauu

SEQ ID NO: 4016455 - RNA, 19 nt, Staphylococcus aureus subsp. aureus MW2
uaauaaccauguaaaauua

SEQ ID NO: 4016456 - RNA, 18 nt, Staphylococcus aureus subsp. aureus MW2
uaauaaccuuuaaaacau

SEQ ID NO: 4016457 - RNA, 19 nt, Staphylococcus aureus subsp. aureus MW2
uaauaacucaguaaauuua

SEQ ID NO: 4016458 - RNA, 15 nt, Staphylococcus aureus subsp. aureus MW2
uaauaagcuaauauu

SEQ ID NO: 4016459 - RNA, 22 nt, Staphylococcus aureus subsp. aureus MW2
uaauaagcuaauauuuauuuua

SEQ ID NO: 4016460 - RNA, 15 nt, Staphylococcus aureus subsp. aureus MW2
uaauaagucagcuaa

SEQ ID NO: 4016461 - RNA, 13 nt, Staphylococcus aureus subsp. aureus MW2
uaauaauaaucuu

SEQ ID NO: 4016462 - RNA, 15 nt, Staphylococcus aureus subsp. aureus MW2
uaauaauacauucau

SEQ ID NO: 4016463 - RNA, 18 nt, Staphylococcus aureus subsp. aureus MW2
uaauaauacauucauuaa

SEQ ID NO: 4016464 - RNA, 15 nt, Staphylococcus aureus subsp. aureus MW2
uaauaauacuucuaa

SEQ ID NO: 4016465 - RNA, 15 nt, Staphylococcus aureus subsp. aureus MW2
uaauaauaggcuaga

SEQ ID NO: 4016466 - RNA, 19 nt, Staphylococcus aureus subsp. aureus MW2
uaauaauaggcuagauaau

SEQ ID NO: 4016467 - RNA, 15 nt, Staphylococcus aureus subsp. aureus MW2
uaauaauauaaauaa

SEQ ID NO: 4016468 - RNA, 14 nt, Staphylococcus aureus subsp. aureus MW2
uaauaauauugaaa

SEQ ID NO: 4016469 - RNA, 21 nt, Staphylococcus aureus subsp. aureus MW2
uaauaauccaccuaaaaagua

SEQ ID NO: 4016470 - RNA, 14 nt, Staphylococcus aureus subsp. aureus MW2
uaauaaucuuuaac

SEQ ID NO: 4016471 - RNA, 17 nt, Staphylococcus aureus subsp. aureus MW2
uaauaaucuuuaacauu

SEQ ID NO: 4016472 - RNA, 19 nt, Staphylococcus aureus subsp. aureus MW2
uaauaaugaauucuauccu

SEQ ID NO: 4016473 - RNA, 13 nt, Staphylococcus aureus subsp. aureus MW2
uaauaaugcaugu

SEQ ID NO: 4016474 - RNA, 18 nt, Staphylococcus aureus subsp. aureus MW2
uaauaaugggaauuguau

SEQ ID NO: 4016475 - RNA, 14 nt, Staphylococcus aureus subsp. aureus MW2
uaauaauguaucau

SEQ ID NO: 4016476 - RNA, 16 nt, Staphylococcus aureus subsp. aureus MW2
uaauaauguaucauuu

SEQ ID NO: 4016477 - RNA, 20 nt, Staphylococcus aureus subsp. aureus MW2
uaauaauuagucauugaaaa

SEQ ID NO: 4016478 - RNA, 18 nt, Staphylococcus aureus subsp. aureus MW2
uaauaauucauaaaugcu

SEQ ID NO: 4016479 - RNA, 14 nt, Staphylococcus aureus subsp. aureus MW2
uaauaauuguccau

SEQ ID NO: 4016480 - RNA, 12 nt, Staphylococcus aureus subsp. aureus MW2
uaauaauuuaca

SEQ ID NO: 4016481 - RNA, 16 nt, Staphylococcus aureus subsp. aureus MW2
uaauaauuuauugaua

SEQ ID NO: 4016482 - RNA, 14 nt, Staphylococcus aureus subsp. aureus MW2
uaauacaagcaaua

SEQ ID NO: 4016483 - RNA, 19 nt, Staphylococcus aureus subsp. aureus MW2
uaauacaagucuuuacucu

SEQ ID NO: 4016484 - RNA, 14 nt, Staphylococcus aureus subsp. aureus MW2
uaauacacauugca

SEQ ID NO: 4016485 - RNA, 20 nt, Staphylococcus aureus subsp. aureus MW2
uaauacacuugcuaaaacua

SEQ ID NO: 4016486 - RNA, 20 nt, Staphylococcus aureus subsp. aureus MW2
uaauacauauggcaaaauca

SEQ ID NO: 4016487 - RNA, 13 nt, Staphylococcus aureus subsp. aureus MW2
uaauacaucuaau

SEQ ID NO: 4016488 - RNA, 16 nt, Staphylococcus aureus subsp. aureus MW2
uaauacaucuaauaaa

SEQ ID NO: 4016489 - RNA, 19 nt, Staphylococcus aureus subsp. aureus MW2
uaauaccaauuuuuagcau

SEQ ID NO: 4016490 - RNA, 13 nt, Staphylococcus aureus subsp. aureus MW2
uaauaccaucauc

SEQ ID NO: 4016491 - RNA, 14 nt, Staphylococcus aureus subsp. aureus MW2
uaauaccaucaucg

SEQ ID NO: 4016492 - RNA, 17 nt, Staphylococcus aureus subsp. aureus MW2
uaauaccuuuacuuuca

SEQ ID NO: 4016493 - RNA, 19 nt, Staphylococcus aureus subsp. aureus MW2
uaauaccuuuacuuucauu

SEQ ID NO: 4016494 - RNA, 16 nt, Staphylococcus aureus subsp. aureus MW2
uaauacgcaauugaua

SEQ ID NO: 4016495 - RNA, 18 nt, Staphylococcus aureus subsp. aureus MW2
uaauacguugcucaccua

SEQ ID NO: 4016496 - RNA, 17 nt, Staphylococcus aureus subsp. aureus MW2
uaauacguuuaauaaug

SEQ ID NO: 4016497 - RNA, 22 nt, Staphylococcus aureus subsp. aureus MW2
uaauacuaauuuuguacauaaa

SEQ ID NO: 4016498 - RNA, 20 nt, Staphylococcus aureus subsp. aureus MW2
uaauacuaccguuuuuauau

SEQ ID NO: 4016499 - RNA, 16 nt, Staphylococcus aureus subsp. aureus MW2
uaauacuauaugaaaa

SEQ ID NO: 4016500 - RNA, 17 nt, Staphylococcus aureus subsp. aureus MW2
uaauacuguuuaaauaa

SEQ ID NO: 4016501 - RNA, 20 nt, Staphylococcus aureus subsp. aureus MW2
uaauacuguuuaaauaaaau

SEQ ID NO: 4016502 - RNA, 21 nt, Staphylococcus aureus subsp. aureus MW2
uaauacuguuuaaauaaaauu

SEQ ID NO: 4016503 - RNA, 19 nt, Staphylococcus aureus subsp. aureus MW2
uaauacuucucaauuuagu

SEQ ID NO: 4016504 - RNA, 17 nt, Staphylococcus aureus subsp. aureus MW2
uaauacuuucaaacaaa

SEQ ID NO: 4016505 - RNA, 15 nt, Staphylococcus aureus subsp. aureus MW2
uaauagaaauaauca

SEQ ID NO: 4016506 - RNA, 17 nt, Staphylococcus aureus subsp. aureus MW2
uaauagaacgaaauagu

SEQ ID NO: 4016507 - RNA, 15 nt, Staphylococcus aureus subsp. aureus MW2
uaauagacauuaacu

SEQ ID NO: 4016508 - RNA, 16 nt, Staphylococcus aureus subsp. aureus MW2
uaauagagaaaaaaua

SEQ ID NO: 4016509 - RNA, 16 nt, Staphylococcus aureus subsp. aureus MW2
uaauagagaaacguaa

SEQ ID NO: 4016510 - RNA, 24 nt, Staphylococcus aureus subsp. aureus MW2
uaauagagacauuuuaucugaaaa

SEQ ID NO: 4016511 - RNA, 16 nt, Staphylococcus aureus subsp. aureus MW2
uaauagauaauggauu

SEQ ID NO: 4016512 - RNA, 17 nt, Staphylococcus aureus subsp. aureus MW2
uaauagcaaaauuaugu

SEQ ID NO: 4016513 - RNA, 18 nt, Staphylococcus aureus subsp. aureus MW2
uaauagcaaccauauuuu

SEQ ID NO: 4016514 - RNA, 16 nt, Staphylococcus aureus subsp. aureus MW2
uaauagcuuguuuauu

SEQ ID NO: 4016515 - RNA, 15 nt, Staphylococcus aureus subsp. aureus MW2
uaauaggcuagauaa

SEQ ID NO: 4016516 - RNA, 19 nt, Staphylococcus aureus subsp. aureus MW2
uaauaggcuagauaauaau

SEQ ID NO: 4016517 - RNA, 16 nt, Staphylococcus aureus subsp. aureus MW2
uaauaguaaugaugug

SEQ ID NO: 4016518 - RNA, 18 nt, Staphylococcus aureus subsp. aureus MW2
uaauaguagccuagauac

SEQ ID NO: 4016519 - RNA, 15 nt, Staphylococcus aureus subsp. aureus MW2
uaauaguguuauauu

SEQ ID NO: 4016520 - RNA, 15 nt, Staphylococcus aureus subsp. aureus MW2
uaauauaaaaacaaa

SEQ ID NO: 4016521 - RNA, 14 nt, Staphylococcus aureus subsp. aureus MW2
uaauauaaaauaaa

SEQ ID NO: 4016522 - RNA, 16 nt, Staphylococcus aureus subsp. aureus MW2
uaauauaaauuuugaa

SEQ ID NO: 4016523 - RNA, 15 nt, Staphylococcus aureus subsp. aureus MW2
uaauauaaguauaau

SEQ ID NO: 4016524 - RNA, 13 nt, Staphylococcus aureus subsp. aureus MW2
uaauauaauuaaa

SEQ ID NO: 4016525 - RNA, 17 nt, Staphylococcus aureus subsp. aureus MW2
uaauauaauuaaacauu

SEQ ID NO: 4016526 - RNA, 14 nt, Staphylococcus aureus subsp. aureus MW2
uaauauaauuaauu

SEQ ID NO: 4016527 - RNA, 14 nt, Staphylococcus aureus subsp. aureus MW2
uaauauaauuauua

SEQ ID NO: 4016528 - RNA, 17 nt, Staphylococcus aureus subsp. aureus MW2
uaauauauccugccaau

SEQ ID NO: 4016529 - RNA, 13 nt, Staphylococcus aureus subsp. aureus MW2
uaauauauuaaaa

SEQ ID NO: 4016530 - RNA, 18 nt, Staphylococcus aureus subsp. aureus MW2
uaauauauuaaaaaucaa

SEQ ID NO: 4016531 - RNA, 21 nt, Staphylococcus aureus subsp. aureus MW2
uaauauauuaaaaaucaaaau

SEQ ID NO: 4016532 - RNA, 14 nt, Staphylococcus aureus subsp. aureus MW2
uaauauauuuauuu

SEQ ID NO: 4016533 - RNA, 16 nt, Staphylococcus aureus subsp. aureus MW2
uaauaucaauaaugcu

SEQ ID NO: 4016534 - RNA, 19 nt, Staphylococcus aureus subsp. aureus MW2
uaauaucaguagcauauug

SEQ ID NO: 4016535 - RNA, 21 nt, Staphylococcus aureus subsp. aureus MW2
uaauaucaguagcauauugau

SEQ ID NO: 4016536 - RNA, 17 nt, Staphylococcus aureus subsp. aureus MW2
uaauaucauauucaaaa

SEQ ID NO: 4016537 - RNA, 21 nt, Staphylococcus aureus subsp. aureus MW2
uaauaucauauucaaaauaac

SEQ ID NO: 4016538 - RNA, 24 nt, Staphylococcus aureus subsp. aureus MW2
uaauaucgacuuuucuaucaaaaa

SEQ ID NO: 4016539 - RNA, 14 nt, Staphylococcus aureus subsp. aureus MW2
uaauaucuucuuua

SEQ ID NO: 4016540 - RNA, 16 nt, Staphylococcus aureus subsp. aureus MW2
uaauaugaauuuagau

SEQ ID NO: 4016541 - RNA, 21 nt, Staphylococcus aureus subsp. aureus MW2
uaauaugaauuuagaugcaua

SEQ ID NO: 4016542 - RNA, 14 nt, Staphylococcus aureus subsp. aureus MW2
uaauaugagugaaa

SEQ ID NO: 4016543 - RNA, 21 nt, Staphylococcus aureus subsp. aureus MW2
uaauauuaaauugcguacuug

SEQ ID NO: 4016544 - RNA, 12 nt, Staphylococcus aureus subsp. aureus MW2
uaauauuauaag

SEQ ID NO: 4016545 - RNA, 13 nt, Staphylococcus aureus subsp. aureus MW2
uaauauucaacuu

SEQ ID NO: 4016546 - RNA, 14 nt, Staphylococcus aureus subsp. aureus MW2
uaauauugaaagau

SEQ ID NO: 4016547 - RNA, 17 nt, Staphylococcus aureus subsp. aureus MW2
uaauauugaaagauauu

SEQ ID NO: 4016548 - RNA, 17 nt, Staphylococcus aureus subsp. aureus MW2
uaauauugaaaugagcu

SEQ ID NO: 4016549 - RNA, 13 nt, Staphylococcus aureus subsp. aureus MW2
uaauauugaauaa

SEQ ID NO: 4016550 - RNA, 17 nt, Staphylococcus aureus subsp. aureus MW2
uaauauugaauaaaaaa

SEQ ID NO: 4016551 - RNA, 12 nt, Staphylococcus aureus subsp. aureus MW2
uaauauuuaaaa

SEQ ID NO: 4016552 - RNA, 13 nt, Staphylococcus aureus subsp. aureus MW2
uaauauuuaaaaa

SEQ ID NO: 4016553 - RNA, 14 nt, Staphylococcus aureus subsp. aureus MW2
uaauauuuaaaaaa

SEQ ID NO: 4016554 - RNA, 18 nt, Staphylococcus aureus subsp. aureus MW2
uaauauuuaaaaaacaaa

SEQ ID NO: 4016555 - RNA, 18 nt, Staphylococcus aureus subsp. aureus MW2
uaauauuucuuaccauuu

SEQ ID NO: 4016556 - RNA, 18 nt, Staphylococcus aureus subsp. aureus MW2
uaauauuugauaacaaaa

SEQ ID NO: 4016557 - RNA, 11 nt, Staphylococcus aureus subsp. aureus MW2
uaauauuugcu

SEQ ID NO: 4016558 - RNA, 12 nt, Staphylococcus aureus subsp. aureus MW2
uaauauuuucau

SEQ ID NO: 4016559 - RNA, 12 nt, Staphylococcus aureus subsp. aureus MW2
uaauauuuucuu

SEQ ID NO: 4016560 - RNA, 15 nt, Staphylococcus aureus subsp. aureus MW2
uaauauuuucuuaga

SEQ ID NO: 4016561 - RNA, 16 nt, Staphylococcus aureus subsp. aureus MW2
uaauauuuucuuagaa

SEQ ID NO: 4016562 - RNA, 15 nt, Staphylococcus aureus subsp. aureus MW2
uaauauuuuggcuua

SEQ ID NO: 4016563 - RNA, 11 nt, Staphylococcus aureus subsp. aureus MW2
uaauauuuuuu

SEQ ID NO: 4016564 - RNA, 14 nt, Staphylococcus aureus subsp. aureus MW2
uaauauuuuuugau

SEQ ID NO: 4016565 - RNA, 15 nt, Staphylococcus aureus subsp. aureus MW2
uaauauuuuuuucaa

SEQ ID NO: 4016566 - RNA, 16 nt, Staphylococcus aureus subsp. aureus MW2
uaaucaaaaagacuca

SEQ ID NO: 4016567 - RNA, 15 nt, Staphylococcus aureus subsp. aureus MW2
uaaucaaauuaguca

SEQ ID NO: 4016568 - RNA, 18 nt, Staphylococcus aureus subsp. aureus MW2
uaaucaagcaaugcaugc

SEQ ID NO: 4016569 - RNA, 17 nt, Staphylococcus aureus subsp. aureus MW2
uaaucacauuaauugga

SEQ ID NO: 4016570 - RNA, 21 nt, Staphylococcus aureus subsp. aureus MW2
uaaucacuucugaaaauaacc

SEQ ID NO: 4016571 - RNA, 15 nt, Staphylococcus aureus subsp. aureus MW2
uaaucagaaaagcag

SEQ ID NO: 4016572 - RNA, 18 nt, Staphylococcus aureus subsp. aureus MW2
uaaucagcuauaaaagua

SEQ ID NO: 4016573 - RNA, 12 nt, Staphylococcus aureus subsp. aureus MW2
uaaucauaaaaa

SEQ ID NO: 4016574 - RNA, 17 nt, Staphylococcus aureus subsp. aureus MW2
uaaucauacauaugcua

SEQ ID NO: 4016575 - RNA, 13 nt, Staphylococcus aureus subsp. aureus MW2
uaaucaugaaguu

SEQ ID NO: 4016576 - RNA, 19 nt, Staphylococcus aureus subsp. aureus MW2
uaaucaugaaguugguuua

SEQ ID NO: 4016577 - RNA, 14 nt, Staphylococcus aureus subsp. aureus MW2
uaaucauuguguau

SEQ ID NO: 4016578 - RNA, 14 nt, Staphylococcus aureus subsp. aureus MW2
uaaucauuguuuua

SEQ ID NO: 4016579 - RNA, 15 nt, Staphylococcus aureus subsp. aureus MW2
uaaucauuguuuuaa

SEQ ID NO: 4016580 - RNA, 20 nt, Staphylococcus aureus subsp. aureus MW2
uaaucauuguuuuaaauuuu

SEQ ID NO: 4016581 - RNA, 12 nt, Staphylococcus aureus subsp. aureus MW2
uaauccauucuu

SEQ ID NO: 4016582 - RNA, 16 nt, Staphylococcus aureus subsp. aureus MW2
uaauccccgaagcaca

SEQ ID NO: 4016583 - RNA, 21 nt, Staphylococcus aureus subsp. aureus MW2
uaauccccgaagcacagaaaa

SEQ ID NO: 4016584 - RNA, 21 nt, Staphylococcus aureus subsp. aureus MW2
uaaucccguuauaucuuuuuu

SEQ ID NO: 4016585 - RNA, 20 nt, Staphylococcus aureus subsp. aureus MW2
uaaucccuucaacaguaauu

SEQ ID NO: 4016586 - RNA, 18 nt, Staphylococcus aureus subsp. aureus MW2
uaauccgauuuugauaua

SEQ ID NO: 4016587 - RNA, 23 nt, Staphylococcus aureus subsp. aureus MW2
uaauccgucuuuuuuuaugaaaa

SEQ ID NO: 4016588 - RNA, 14 nt, Staphylococcus aureus subsp. aureus MW2
uaaucgauugguaa

SEQ ID NO: 4016589 - RNA, 20 nt, Staphylococcus aureus subsp. aureus MW2
uaaucgauugguaaaucuac

SEQ ID NO: 4016590 - RNA, 23 nt, Staphylococcus aureus subsp. aureus MW2
uaaucgauugguaaaucuacuac

SEQ ID NO: 4016591 - RNA, 15 nt, Staphylococcus aureus subsp. aureus MW2
uaaucgcauucuugg

SEQ ID NO: 4016592 - RNA, 19 nt, Staphylococcus aureus subsp. aureus MW2
uaaucguauucauaucauu

SEQ ID NO: 4016593 - RNA, 15 nt, Staphylococcus aureus subsp. aureus MW2
uaaucguauuuuuaa

SEQ ID NO: 4016594 - RNA, 18 nt, Staphylococcus aureus subsp. aureus MW2
uaaucguguauuauugaa

SEQ ID NO: 4016595 - RNA, 14 nt, Staphylococcus aureus subsp. aureus MW2
uaaucguucccauu

SEQ ID NO: 4016596 - RNA, 13 nt, Staphylococcus aureus subsp. aureus MW2
uaaucuaaauuca

SEQ ID NO: 4016597 - RNA, 18 nt, Staphylococcus aureus subsp. aureus MW2
uaaucuacugcuguugaa

SEQ ID NO: 4016598 - RNA, 15 nt, Staphylococcus aureus subsp. aureus MW2
uaaucuauaaauuau

SEQ ID NO: 4016599 - RNA, 17 nt, Staphylococcus aureus subsp. aureus MW2
uaaucuauaaauuauuu

SEQ ID NO: 4016600 - RNA, 18 nt, Staphylococcus aureus subsp. aureus MW2
uaaucucaugccaaaaac

SEQ ID NO: 4016601 - RNA, 22 nt, Staphylococcus aureus subsp. aureus MW2
uaaucucaugccaaaaacauua

SEQ ID NO: 4016602 - RNA, 14 nt, Staphylococcus aureus subsp. aureus MW2
uaaucucauucuuu

SEQ ID NO: 4016603 - RNA, 14 nt, Staphylococcus aureus subsp. aureus MW2
uaaucucuuuacac

SEQ ID NO: 4016604 - RNA, 18 nt, Staphylococcus aureus subsp. aureus MW2
uaaucucuuuacaccauu

SEQ ID NO: 4016605 - RNA, 12 nt, Staphylococcus aureus subsp. aureus MW2
uaaucuuauucg

SEQ ID NO: 4016606 - RNA, 16 nt, Staphylococcus aureus subsp. aureus MW2
uaaucuucuguuuaua

SEQ ID NO: 4016607 - RNA, 16 nt, Staphylococcus aureus subsp. aureus MW2
uaaucuuguuuucauu

SEQ ID NO: 4016608 - RNA, 22 nt, Staphylococcus aureus subsp. aureus MW2
uaaucuuguuuucauuuaaaag

SEQ ID NO: 4016609 - RNA, 18 nt, Staphylococcus aureus subsp. aureus MW2
uaaucuuuaacauuuauu

SEQ ID NO: 4016610 - RNA, 21 nt, Staphylococcus aureus subsp. aureus MW2
uaaucuuuuuuacuaaaauca

SEQ ID NO: 4016611 - RNA, 19 nt, Staphylococcus aureus subsp. aureus MW2
uaaugaagguaagugcuca

SEQ ID NO: 4016612 - RNA, 16 nt, Staphylococcus aureus subsp. aureus MW2
uaaugaaguuaugaag

SEQ ID NO: 4016613 - RNA, 15 nt, Staphylococcus aureus subsp. aureus MW2
uaaugaauaaauaau

SEQ ID NO: 4016614 - RNA, 13 nt, Staphylococcus aureus subsp. aureus MW2
uaaugaauaguaa

SEQ ID NO: 4016615 - RNA, 17 nt, Staphylococcus aureus subsp. aureus MW2
uaaugacacgcucaggc

SEQ ID NO: 4016616 - RNA, 12 nt, Staphylococcus aureus subsp. aureus MW2
uaaugacuaacu

SEQ ID NO: 4016617 - RNA, 16 nt, Staphylococcus aureus subsp. aureus MW2
uaaugauaaauuaaag

SEQ ID NO: 4016618 - RNA, 18 nt, Staphylococcus aureus subsp. aureus MW2
uaaugauaaauuaaagcu

SEQ ID NO: 4016619 - RNA, 18 nt, Staphylococcus aureus subsp. aureus MW2
uaaugauaauccaccaaa

SEQ ID NO: 4016620 - RNA, 13 nt, Staphylococcus aureus subsp. aureus MW2
uaaugauaauggu

SEQ ID NO: 4016621 - RNA, 15 nt, Staphylococcus aureus subsp. aureus MW2
uaaugauagcaauga

SEQ ID NO: 4016622 - RNA, 19 nt, Staphylococcus aureus subsp. aureus MW2
uaaugauaguacauuuauu

SEQ ID NO: 4016623 - RNA, 15 nt, Staphylococcus aureus subsp. aureus MW2
uaaugauaguguaug

SEQ ID NO: 4016624 - RNA, 17 nt, Staphylococcus aureus subsp. aureus MW2
uaaugauaguguaugaa

SEQ ID NO: 4016625 - RNA, 18 nt, Staphylococcus aureus subsp. aureus MW2
uaaugauauauuacauca

SEQ ID NO: 4016626 - RNA, 20 nt, Staphylococcus aureus subsp. aureus MW2
uaaugauauauuacaucauu

SEQ ID NO: 4016627 - RNA, 20 nt, Staphylococcus aureus subsp. aureus MW2
uaaugaugacaucaauaucu

SEQ ID NO: 4016628 - RNA, 11 nt, Staphylococcus aureus subsp. aureus MW2
uaaugauucac

SEQ ID NO: 4016629 - RNA, 14 nt, Staphylococcus aureus subsp. aureus MW2
uaaugauugucuua

SEQ ID NO: 4016630 - RNA, 16 nt, Staphylococcus aureus subsp. aureus MW2
uaaugauugucuuaua

SEQ ID NO: 4016631 - RNA, 13 nt, Staphylococcus aureus subsp. aureus MW2
uaaugauuuugcu

SEQ ID NO: 4016632 - RNA, 19 nt, Staphylococcus aureus subsp. aureus MW2
uaaugauuuuuauuauugu

SEQ ID NO: 4016633 - RNA, 20 nt, Staphylococcus aureus subsp. aureus MW2
uaaugcaacuaaguugacua

SEQ ID NO: 4016634 - RNA, 22 nt, Staphylococcus aureus subsp. aureus MW2
uaaugcaacuaaguugacuaua

SEQ ID NO: 4016635 - RNA, 16 nt, Staphylococcus aureus subsp. aureus MW2
uaaugcacuaccauca

SEQ ID NO: 4016636 - RNA, 16 nt, Staphylococcus aureus subsp. aureus MW2
uaaugcaugugaaauu

SEQ ID NO: 4016637 - RNA, 15 nt, Staphylococcus aureus subsp. aureus MW2
uaaugcauuauuaua

SEQ ID NO: 4016638 - RNA, 21 nt, Staphylococcus aureus subsp. aureus MW2
uaaugccuuuaccgugaauau

SEQ ID NO: 4016639 - RNA, 14 nt, Staphylococcus aureus subsp. aureus MW2
uaaugcuaauuuaa

SEQ ID NO: 4016640 - RNA, 15 nt, Staphylococcus aureus subsp. aureus MW2
uaaugcuaugauuaa

SEQ ID NO: 4016641 - RNA, 16 nt, Staphylococcus aureus subsp. aureus MW2
uaaugcugcuucuuca

SEQ ID NO: 4016642 - RNA, 15 nt, Staphylococcus aureus subsp. aureus MW2
uaaugcuuauuaaaa

SEQ ID NO: 4016643 - RNA, 14 nt, Staphylococcus aureus subsp. aureus MW2
uaauggcaacuaag

SEQ ID NO: 4016644 - RNA, 18 nt, Staphylococcus aureus subsp. aureus MW2
uaauggcacuuaauauaa

SEQ ID NO: 4016645 - RNA, 16 nt, Staphylococcus aureus subsp. aureus MW2
uaauggcgugcuuuuc

SEQ ID NO: 4016646 - RNA, 16 nt, Staphylococcus aureus subsp. aureus MW2
uaaugguauugauuau

SEQ ID NO: 4016647 - RNA, 22 nt, Staphylococcus aureus subsp. aureus MW2
uaaugguugaauaacacuagaa

SEQ ID NO: 4016648 - RNA, 13 nt, Staphylococcus aureus subsp. aureus MW2
uaauguaaaauga

SEQ ID NO: 4016649 - RNA, 15 nt, Staphylococcus aureus subsp. aureus MW2
uaauguaaaaugaug

SEQ ID NO: 4016650 - RNA, 23 nt, Staphylococcus aureus subsp. aureus MW2
uaauguaaaaugaugauuuaaag

SEQ ID NO: 4016651 - RNA, 20 nt, Staphylococcus aureus subsp. aureus MW2
uaauguaaaguugauaaugu

SEQ ID NO: 4016652 - RNA, 12 nt, Staphylococcus aureus subsp. aureus MW2
uaauguaacuug

SEQ ID NO: 4016653 - RNA, 20 nt, Staphylococcus aureus subsp. aureus MW2
uaauguacacuuuugauugu

SEQ ID NO: 4016654 - RNA, 17 nt, Staphylococcus aureus subsp. aureus MW2
uaauguacauguauaaa

SEQ ID NO: 4016655 - RNA, 23 nt, Staphylococcus aureus subsp. aureus MW2
uaauguacauguauaaaagauau

SEQ ID NO: 4016656 - RNA, 17 nt, Staphylococcus aureus subsp. aureus MW2
uaauguagguuauuaua

SEQ ID NO: 4016657 - RNA, 19 nt, Staphylococcus aureus subsp. aureus MW2
uaaugucucuuuucacgaa

SEQ ID NO: 4016658 - RNA, 13 nt, Staphylococcus aureus subsp. aureus MW2
uaaugucuucaua

SEQ ID NO: 4016659 - RNA, 19 nt, Staphylococcus aureus subsp. aureus MW2
uaaugugcauauugaguau

SEQ ID NO: 4016660 - RNA, 14 nt, Staphylococcus aureus subsp. aureus MW2
uaaugugcauugcu

SEQ ID NO: 4016661 - RNA, 20 nt, Staphylococcus aureus subsp. aureus MW2
uaaugugcgucacucacuuc

SEQ ID NO: 4016662 - RNA, 22 nt, Staphylococcus aureus subsp. aureus MW2
uaaugugcgucacucacuucaa

SEQ ID NO: 4016663 - RNA, 21 nt, Staphylococcus aureus subsp. aureus MW2
uaauguguaaauuuuguaaug

SEQ ID NO: 4016664 - RNA, 23 nt, Staphylococcus aureus subsp. aureus MW2
uaauguguaccuuuuuauugaua

SEQ ID NO: 4016665 - RNA, 13 nt, Staphylococcus aureus subsp. aureus MW2
uaauguuaaacac

SEQ ID NO: 4016666 - RNA, 16 nt, Staphylococcus aureus subsp. aureus MW2
uaauguuaaacacuca

SEQ ID NO: 4016667 - RNA, 22 nt, Staphylococcus aureus subsp. aureus MW2
uaauguuaaacuagaaaacaua

SEQ ID NO: 4016668 - RNA, 17 nt, Staphylococcus aureus subsp. aureus MW2
uaauguuacauuugaag

SEQ ID NO: 4016669 - RNA, 15 nt, Staphylococcus aureus subsp. aureus MW2
uaauguuacgcugug

SEQ ID NO: 4016670 - RNA, 20 nt, Staphylococcus aureus subsp. aureus MW2
uaauguugcaaaauuaagag

SEQ ID NO: 4016671 - RNA, 22 nt, Staphylococcus aureus subsp. aureus MW2
uaauguuggcaaacuauuaaua

SEQ ID NO: 4016672 - RNA, 21 nt, Staphylococcus aureus subsp. aureus MW2
uaauguuuccugauauuucaa

SEQ ID NO: 4016673 - RNA, 17 nt, Staphylococcus aureus subsp. aureus MW2
uaauguuuucauuggau

SEQ ID NO: 4016674 - RNA, 17 nt, Staphylococcus aureus subsp. aureus MW2
uaauuaaaaaauuccua

SEQ ID NO: 4016675 - RNA, 23 nt, Staphylococcus aureus subsp. aureus MW2
uaauuaaaagugcaaguccaaau

SEQ ID NO: 4016676 - RNA, 22 nt, Staphylococcus aureus subsp. aureus MW2
uaauuaaaauaagauauauaau

SEQ ID NO: 4016677 - RNA, 13 nt, Staphylococcus aureus subsp. aureus MW2
uaauuaaacaaaa

SEQ ID NO: 4016678 - RNA, 17 nt, Staphylococcus aureus subsp. aureus MW2
uaauuaaacauuuagau

SEQ ID NO: 4016679 - RNA, 18 nt, Staphylococcus aureus subsp. aureus MW2
uaauuaaacauuuagauu

SEQ ID NO: 4016680 - RNA, 22 nt, Staphylococcus aureus subsp. aureus MW2
uaauuaaacuaauagcauuugu

SEQ ID NO: 4016681 - RNA, 19 nt, Staphylococcus aureus subsp. aureus MW2
uaauuaaacuguaaacauu

SEQ ID NO: 4016682 - RNA, 16 nt, Staphylococcus aureus subsp. aureus MW2
uaauuaaacuuuauga

SEQ ID NO: 4016683 - RNA, 12 nt, Staphylococcus aureus subsp. aureus MW2
uaauuaaauaaa

SEQ ID NO: 4016684 - RNA, 16 nt, Staphylococcus aureus subsp. aureus MW2
uaauuaaauaaaaaua

SEQ ID NO: 4016685 - RNA, 22 nt, Staphylococcus aureus subsp. aureus MW2
uaauuaaauauaaagacgauuu

SEQ ID NO: 4016686 - RNA, 20 nt, Staphylococcus aureus subsp. aureus MW2
uaauuaaaucuucaagugcc

SEQ ID NO: 4016687 - RNA, 13 nt, Staphylococcus aureus subsp. aureus MW2
uaauuaauaauuu

SEQ ID NO: 4016688 - RNA, 21 nt, Staphylococcus aureus subsp. aureus MW2
uaauuaauacaucaauaucuu

SEQ ID NO: 4016689 - RNA, 15 nt, Staphylococcus aureus subsp. aureus MW2
uaauuaauguuucuu

SEQ ID NO: 4016690 - RNA, 15 nt, Staphylococcus aureus subsp. aureus MW2
uaauuaauuaaaagc

SEQ ID NO: 4016691 - RNA, 16 nt, Staphylococcus aureus subsp. aureus MW2
uaauuaauuuuguaau

SEQ ID NO: 4016692 - RNA, 16 nt, Staphylococcus aureus subsp. aureus MW2
uaauuaccuuuccauu

SEQ ID NO: 4016693 - RNA, 19 nt, Staphylococcus aureus subsp. aureus MW2
uaauuacgucauaaaauac

SEQ ID NO: 4016694 - RNA, 21 nt, Staphylococcus aureus subsp. aureus MW2
uaauuacuaaccuaaagauaa

SEQ ID NO: 4016695 - RNA, 18 nt, Staphylococcus aureus subsp. aureus MW2
uaauuagauuuaaaaugu

SEQ ID NO: 4016696 - RNA, 22 nt, Staphylococcus aureus subsp. aureus MW2
uaauuaggauuuccggaacaau

SEQ ID NO: 4016697 - RNA, 23 nt, Staphylococcus aureus subsp. aureus MW2
uaauuaggauuuccggaacaaua

SEQ ID NO: 4016698 - RNA, 22 nt, Staphylococcus aureus subsp. aureus MW2
uaauuagucauugaaaauauuu

SEQ ID NO: 4016699 - RNA, 18 nt, Staphylococcus aureus subsp. aureus MW2
uaauuaucauaaauauaa

SEQ ID NO: 4016700 - RNA, 14 nt, Staphylococcus aureus subsp. aureus MW2
uaauuaucuuaagu

SEQ ID NO: 4016701 - RNA, 14 nt, Staphylococcus aureus subsp. aureus MW2
uaauuaugaaaagu

SEQ ID NO: 4016702 - RNA, 15 nt, Staphylococcus aureus subsp. aureus MW2
uaauuauucaugaau

SEQ ID NO: 4016703 - RNA, 16 nt, Staphylococcus aureus subsp. aureus MW2
uaauuauuccuucauu

SEQ ID NO: 4016704 - RNA, 21 nt, Staphylococcus aureus subsp. aureus MW2
uaauuauuccuucauugaaga

SEQ ID NO: 4016705 - RNA, 23 nt, Staphylococcus aureus subsp. aureus MW2
uaauuauuccuucauugaagaau

SEQ ID NO: 4016706 - RNA, 16 nt, Staphylococcus aureus subsp. aureus MW2
uaauuauugagaauau

SEQ ID NO: 4016707 - RNA, 20 nt, Staphylococcus aureus subsp. aureus MW2
uaauuauugagaauauuuau

SEQ ID NO: 4016708 - RNA, 13 nt, Staphylococcus aureus subsp. aureus MW2
uaauuauuuagau

SEQ ID NO: 4016709 - RNA, 14 nt, Staphylococcus aureus subsp. aureus MW2
uaauuauuuagauu

SEQ ID NO: 4016710 - RNA, 21 nt, Staphylococcus aureus subsp. aureus MW2
uaauucaaugauuuuuaaaaa

SEQ ID NO: 4016711 - RNA, 20 nt, Staphylococcus aureus subsp. aureus MW2
uaauucaccaucauauucaa

SEQ ID NO: 4016712 - RNA, 13 nt, Staphylococcus aureus subsp. aureus MW2
uaauucauauuca

SEQ ID NO: 4016713 - RNA, 23 nt, Staphylococcus aureus subsp. aureus MW2
uaauucaucuugcgccuuguuca

SEQ ID NO: 4016714 - RNA, 18 nt, Staphylococcus aureus subsp. aureus MW2
uaauucauuuauuuucuu

SEQ ID NO: 4016715 - RNA, 20 nt, Staphylococcus aureus subsp. aureus MW2
uaauucccuaggaaauaaaa

SEQ ID NO: 4016716 - RNA, 17 nt, Staphylococcus aureus subsp. aureus MW2
uaauucccuguuaugaa

SEQ ID NO: 4016717 - RNA, 21 nt, Staphylococcus aureus subsp. aureus MW2
uaauuccuggugcaauaauaa

SEQ ID NO: 4016718 - RNA, 22 nt, Staphylococcus aureus subsp. aureus MW2
uaauucgccaucuuuuuuagcu

SEQ ID NO: 4016719 - RNA, 19 nt, Staphylococcus aureus subsp. aureus MW2
uaauucguaauuuaugauu

SEQ ID NO: 4016720 - RNA, 13 nt, Staphylococcus aureus subsp. aureus MW2
uaauucuaagucu

SEQ ID NO: 4016721 - RNA, 22 nt, Staphylococcus aureus subsp. aureus MW2
uaauucuagagauaacuagaau

SEQ ID NO: 4016722 - RNA, 14 nt, Staphylococcus aureus subsp. aureus MW2
uaauucugaaauca

SEQ ID NO: 4016723 - RNA, 16 nt, Staphylococcus aureus subsp. aureus MW2
uaauucuuaaucgagu

SEQ ID NO: 4016724 - RNA, 17 nt, Staphylococcus aureus subsp. aureus MW2
uaauucuucaaccauuu

SEQ ID NO: 4016725 - RNA, 14 nt, Staphylococcus aureus subsp. aureus MW2
uaauucuucaucaa

SEQ ID NO: 4016726 - RNA, 19 nt, Staphylococcus aureus subsp. aureus MW2
uaauucuucaucuucuuca

SEQ ID NO: 4016727 - RNA, 15 nt, Staphylococcus aureus subsp. aureus MW2
uaauugaaaaaccaa

SEQ ID NO: 4016728 - RNA, 20 nt, Staphylococcus aureus subsp. aureus MW2
uaauugaaaauaaucuuacu

SEQ ID NO: 4016729 - RNA, 15 nt, Staphylococcus aureus subsp. aureus MW2
uaauugaaaaucuaa

SEQ ID NO: 4016730 - RNA, 17 nt, Staphylococcus aureus subsp. aureus MW2
uaauugaaaugauaaaa

SEQ ID NO: 4016731 - RNA, 22 nt, Staphylococcus aureus subsp. aureus MW2
uaauugaaaugauagaugcugg

SEQ ID NO: 4016732 - RNA, 23 nt, Staphylococcus aureus subsp. aureus MW2
uaauugagaaaaagguuaauauu

SEQ ID NO: 4016733 - RNA, 20 nt, Staphylococcus aureus subsp. aureus MW2
uaauugauacggaucauaau

SEQ ID NO: 4016734 - RNA, 16 nt, Staphylococcus aureus subsp. aureus MW2
uaauugaucuaaauua

SEQ ID NO: 4016735 - RNA, 16 nt, Staphylococcus aureus subsp. aureus MW2
uaauugaugaaagacu

SEQ ID NO: 4016736 - RNA, 19 nt, Staphylococcus aureus subsp. aureus MW2
uaauugaugaugaugugcu

SEQ ID NO: 4016737 - RNA, 22 nt, Staphylococcus aureus subsp. aureus MW2
uaauugaugaugaugugcuuua

SEQ ID NO: 4016738 - RNA, 13 nt, Staphylococcus aureus subsp. aureus MW2
uaauugaugauua

SEQ ID NO: 4016739 - RNA, 17 nt, Staphylococcus aureus subsp. aureus MW2
uaauugcguuuaauaac

SEQ ID NO: 4016740 - RNA, 22 nt, Staphylococcus aureus subsp. aureus MW2
uaauuggaaucaucuuuuugaa

SEQ ID NO: 4016741 - RNA, 13 nt, Staphylococcus aureus subsp. aureus MW2
uaauuggcagaua

SEQ ID NO: 4016742 - RNA, 16 nt, Staphylococcus aureus subsp. aureus MW2
uaauugggucuuuauc

SEQ ID NO: 4016743 - RNA, 18 nt, Staphylococcus aureus subsp. aureus MW2
uaauugggucuuuaucaa

SEQ ID NO: 4016744 - RNA, 19 nt, Staphylococcus aureus subsp. aureus MW2
uaauugggucuuuaucaag

SEQ ID NO: 4016745 - RNA, 16 nt, Staphylococcus aureus subsp. aureus MW2
uaauuguaaucuauuu

SEQ ID NO: 4016746 - RNA, 23 nt, Staphylococcus aureus subsp. aureus MW2
uaauuguugagaaacuuuuucga

SEQ ID NO: 4016747 - RNA, 14 nt, Staphylococcus aureus subsp. aureus MW2
uaauuguugcauua

SEQ ID NO: 4016748 - RNA, 15 nt, Staphylococcus aureus subsp. aureus MW2
uaauuguugcauuac

SEQ ID NO: 4016749 - RNA, 14 nt, Staphylococcus aureus subsp. aureus MW2
uaauuguuuaauaa

SEQ ID NO: 4016750 - RNA, 14 nt, Staphylococcus aureus subsp. aureus MW2
uaauuuaaagcauc

SEQ ID NO: 4016751 - RNA, 20 nt, Staphylococcus aureus subsp. aureus MW2
uaauuuaaagcaucauauac

SEQ ID NO: 4016752 - RNA, 21 nt, Staphylococcus aureus subsp. aureus MW2
uaauuuaaaucuguacuucua

SEQ ID NO: 4016753 - RNA, 20 nt, Staphylococcus aureus subsp. aureus MW2
uaauuuaaaugauuucacuu

SEQ ID NO: 4016754 - RNA, 16 nt, Staphylococcus aureus subsp. aureus MW2
uaauuuaaauuaaaau

SEQ ID NO: 4016755 - RNA, 19 nt, Staphylococcus aureus subsp. aureus MW2
uaauuuaacaacuguucua

SEQ ID NO: 4016756 - RNA, 15 nt, Staphylococcus aureus subsp. aureus MW2
uaauuuaauaauuaa

SEQ ID NO: 4016757 - RNA, 23 nt, Staphylococcus aureus subsp. aureus MW2
uaauuuagaagauuagaugauau

SEQ ID NO: 4016758 - RNA, 16 nt, Staphylococcus aureus subsp. aureus MW2
uaauuuaguacucaau

SEQ ID NO: 4016759 - RNA, 22 nt, Staphylococcus aureus subsp. aureus MW2
uaauuuaguuauaauuucuguu

SEQ ID NO: 4016760 - RNA, 15 nt, Staphylococcus aureus subsp. aureus MW2
uaauuuaguuuuaau

SEQ ID NO: 4016761 - RNA, 16 nt, Staphylococcus aureus subsp. aureus MW2
uaauuuaguuuuaaua

SEQ ID NO: 4016762 - RNA, 21 nt, Staphylococcus aureus subsp. aureus MW2
uaauuuaguuuuaauauaauu

SEQ ID NO: 4016763 - RNA, 17 nt, Staphylococcus aureus subsp. aureus MW2
uaauuuauaaacaauua

SEQ ID NO: 4016764 - RNA, 19 nt, Staphylococcus aureus subsp. aureus MW2
uaauuuaucaauuucuauu

SEQ ID NO: 4016765 - RNA, 15 nt, Staphylococcus aureus subsp. aureus MW2
uaauuuaucauuauu

SEQ ID NO: 4016766 - RNA, 15 nt, Staphylococcus aureus subsp. aureus MW2
uaauuuaucuuaauc

SEQ ID NO: 4016767 - RNA, 22 nt, Staphylococcus aureus subsp. aureus MW2
uaauuucaauuuggaaauaucu

SEQ ID NO: 4016768 - RNA, 16 nt, Staphylococcus aureus subsp. aureus MW2
uaauuuccaauaucuu

SEQ ID NO: 4016769 - RNA, 17 nt, Staphylococcus aureus subsp. aureus MW2
uaauuucuaugaaaaaa

SEQ ID NO: 4016770 - RNA, 16 nt, Staphylococcus aureus subsp. aureus MW2
uaauuucucuauucua

SEQ ID NO: 4016771 - RNA, 17 nt, Staphylococcus aureus subsp. aureus MW2
uaauuucugguaaaaaa

SEQ ID NO: 4016772 - RNA, 18 nt, Staphylococcus aureus subsp. aureus MW2
uaauuucugguaaaaaaa

SEQ ID NO: 4016773 - RNA, 13 nt, Staphylococcus aureus subsp. aureus MW2
uaauuucuucuuc

SEQ ID NO: 4016774 - RNA, 22 nt, Staphylococcus aureus subsp. aureus MW2
uaauuucuugauggauauucaa

SEQ ID NO: 4016775 - RNA, 18 nt, Staphylococcus aureus subsp. aureus MW2
uaauuucuuuugaaucuu

SEQ ID NO: 4016776 - RNA, 16 nt, Staphylococcus aureus subsp. aureus MW2
uaauuugacaaucuaa

SEQ ID NO: 4016777 - RNA, 15 nt, Staphylococcus aureus subsp. aureus MW2
uaauuugauaaaugc

SEQ ID NO: 4016778 - RNA, 23 nt, Staphylococcus aureus subsp. aureus MW2
uaauuugauguucuugaaaacaa

SEQ ID NO: 4016779 - RNA, 13 nt, Staphylococcus aureus subsp. aureus MW2
uaauuuguauaau

SEQ ID NO: 4016780 - RNA, 15 nt, Staphylococcus aureus subsp. aureus MW2
uaauuuguauaauuu

SEQ ID NO: 4016781 - RNA, 18 nt, Staphylococcus aureus subsp. aureus MW2
uaauuuuaccuguuucuu

SEQ ID NO: 4016782 - RNA, 13 nt, Staphylococcus aureus subsp. aureus MW2
uaauuuucacuuu

SEQ ID NO: 4016783 - RNA, 15 nt, Staphylococcus aureus subsp. aureus MW2
uaauuuucuaaagau

SEQ ID NO: 4016784 - RNA, 13 nt, Staphylococcus aureus subsp. aureus MW2
uaauuuuguaauu

SEQ ID NO: 4016785 - RNA, 19 nt, Staphylococcus aureus subsp. aureus MW2
uaauuuugugaauuuauuu

SEQ ID NO: 4016786 - RNA, 20 nt, Staphylococcus aureus subsp. aureus MW2
uaauuuuuaaacaaaaauaa

SEQ ID NO: 4016787 - RNA, 16 nt, Staphylococcus aureus subsp. aureus MW2
uaauuuuuaacaucau

SEQ ID NO: 4016788 - RNA, 12 nt, Staphylococcus aureus subsp. aureus MW2
uaauuuuucauu

SEQ ID NO: 4016789 - RNA, 14 nt, Staphylococcus aureus subsp. aureus MW2
uaauuuuucuucuu

SEQ ID NO: 4016790 - RNA, 15 nt, Staphylococcus aureus subsp. aureus MW2
uaauuuuucuucuuu

SEQ ID NO: 4016791 - RNA, 22 nt, Staphylococcus aureus subsp. aureus MW2
uaauuuuucuuuaagcuuucua

SEQ ID NO: 4016792 - RNA, 13 nt, Staphylococcus aureus subsp. aureus MW2
uaauuuuuugaca

SEQ ID NO: 4016793 - RNA, 19 nt, Staphylococcus aureus subsp. aureus MW2
uacaaaaaauuaucucacc

SEQ ID NO: 4016794 - RNA, 13 nt, Staphylococcus aureus subsp. aureus MW2
uacaaaacauauu

SEQ ID NO: 4016795 - RNA, 17 nt, Staphylococcus aureus subsp. aureus MW2
uacaaaacauauucagu

SEQ ID NO: 4016796 - RNA, 15 nt, Staphylococcus aureus subsp. aureus MW2
uacaaaacauuacgu

SEQ ID NO: 4016797 - RNA, 17 nt, Staphylococcus aureus subsp. aureus MW2
uacaaaaugaugaaaau

SEQ ID NO: 4016798 - RNA, 15 nt, Staphylococcus aureus subsp. aureus MW2
uacaaaauugucuca

SEQ ID NO: 4016799 - RNA, 17 nt, Staphylococcus aureus subsp. aureus MW2
uacaaacaaugcaaguu

SEQ ID NO: 4016800 - RNA, 17 nt, Staphylococcus aureus subsp. aureus MW2
uacaaacacccacaauu

SEQ ID NO: 4016801 - RNA, 22 nt, Staphylococcus aureus subsp. aureus MW2
uacaaagcacaccuaauucaua

SEQ ID NO: 4016802 - RNA, 17 nt, Staphylococcus aureus subsp. aureus MW2
uacaaagccuuaauauc

SEQ ID NO: 4016803 - RNA, 19 nt, Staphylococcus aureus subsp. aureus MW2
uacaaagccuuaauaucau

SEQ ID NO: 4016804 - RNA, 17 nt, Staphylococcus aureus subsp. aureus MW2
uacaaaggguuauuaac

SEQ ID NO: 4016805 - RNA, 22 nt, Staphylococcus aureus subsp. aureus MW2
uacaaagucauuuucauucagu

SEQ ID NO: 4016806 - RNA, 15 nt, Staphylococcus aureus subsp. aureus MW2
uacaaagugauuuaa

SEQ ID NO: 4016807 - RNA, 21 nt, Staphylococcus aureus subsp. aureus MW2
uacaaagugauuuaaaaaaau

SEQ ID NO: 4016808 - RNA, 14 nt, Staphylococcus aureus subsp. aureus MW2
uacaaauaacaaac

SEQ ID NO: 4016809 - RNA, 19 nt, Staphylococcus aureus subsp. aureus MW2
uacaaauaacaaacauuaa

SEQ ID NO: 4016810 - RNA, 23 nt, Staphylococcus aureus subsp. aureus MW2
uacaaauaacaaacauuaaucua

SEQ ID NO: 4016811 - RNA, 17 nt, Staphylococcus aureus subsp. aureus MW2
uacaaauauguaaucag

SEQ ID NO: 4016812 - RNA, 14 nt, Staphylococcus aureus subsp. aureus MW2
uacaaaucgauauu

SEQ ID NO: 4016813 - RNA, 12 nt, Staphylococcus aureus subsp. aureus MW2
uacaaauugauu

SEQ ID NO: 4016814 - RNA, 16 nt, Staphylococcus aureus subsp. aureus MW2
uacaaauuuauauuaa

SEQ ID NO: 4016815 - RNA, 17 nt, Staphylococcus aureus subsp. aureus MW2
uacaaauuuauauuaaa

SEQ ID NO: 4016816 - RNA, 23 nt, Staphylococcus aureus subsp. aureus MW2
uacaaauuuuuuuuauuaauuaa

SEQ ID NO: 4016817 - RNA, 21 nt, Staphylococcus aureus subsp. aureus MW2
uacaacaccaauugaaauuaa

SEQ ID NO: 4016818 - RNA, 13 nt, Staphylococcus aureus subsp. aureus MW2
uacaacauacaug

SEQ ID NO: 4016819 - RNA, 14 nt, Staphylococcus aureus subsp. aureus MW2
uacaacauacaugc

SEQ ID NO: 4016820 - RNA, 21 nt, Staphylococcus aureus subsp. aureus MW2
uacaacgacacgaacaacauu

SEQ ID NO: 4016821 - RNA, 23 nt, Staphylococcus aureus subsp. aureus MW2
uacaacugaaucuccuugcucau

SEQ ID NO: 4016822 - RNA, 14 nt, Staphylococcus aureus subsp. aureus MW2
uacaagucuuauuu

SEQ ID NO: 4016823 - RNA, 21 nt, Staphylococcus aureus subsp. aureus MW2
uacaaguugaucaaaaauguu

SEQ ID NO: 4016824 - RNA, 18 nt, Staphylococcus aureus subsp. aureus MW2
uacaaguuuauaaucuuu

SEQ ID NO: 4016825 - RNA, 13 nt, Staphylococcus aureus subsp. aureus MW2
uacaauaaucacu

SEQ ID NO: 4016826 - RNA, 14 nt, Staphylococcus aureus subsp. aureus MW2
uacaauaaugugca

SEQ ID NO: 4016827 - RNA, 15 nt, Staphylococcus aureus subsp. aureus MW2
uacaauaaugugcaa

SEQ ID NO: 4016828 - RNA, 18 nt, Staphylococcus aureus subsp. aureus MW2
uacaauaaugugcaaguu

SEQ ID NO: 4016829 - RNA, 17 nt, Staphylococcus aureus subsp. aureus MW2
uacaauaguauaaauau

SEQ ID NO: 4016830 - RNA, 15 nt, Staphylococcus aureus subsp. aureus MW2
uacaauauagaaaau

SEQ ID NO: 4016831 - RNA, 17 nt, Staphylococcus aureus subsp. aureus MW2
uacaauauagaaaauga

SEQ ID NO: 4016832 - RNA, 16 nt, Staphylococcus aureus subsp. aureus MW2
uacaauaugauuaaua

SEQ ID NO: 4016833 - RNA, 15 nt, Staphylococcus aureus subsp. aureus MW2
uacaaucaaaaaacg

SEQ ID NO: 4016834 - RNA, 17 nt, Staphylococcus aureus subsp. aureus MW2
uacaaucaucacacaua

SEQ ID NO: 4016835 - RNA, 20 nt, Staphylococcus aureus subsp. aureus MW2
uacaauccugaagagaaaau

SEQ ID NO: 4016836 - RNA, 17 nt, Staphylococcus aureus subsp. aureus MW2
uacaaugaauuucuaau

SEQ ID NO: 4016837 - RNA, 21 nt, Staphylococcus aureus subsp. aureus MW2
uacaaugaauuucuaauuuag

SEQ ID NO: 4016838 - RNA, 16 nt, Staphylococcus aureus subsp. aureus MW2
uacaauguauuuugau

SEQ ID NO: 4016839 - RNA, 17 nt, Staphylococcus aureus subsp. aureus MW2
uacaauuaaagugaaua

SEQ ID NO: 4016840 - RNA, 16 nt, Staphylococcus aureus subsp. aureus MW2
uacaauuauaaaugau

SEQ ID NO: 4016841 - RNA, 17 nt, Staphylococcus aureus subsp. aureus MW2
uacaauuauaaaugauu

SEQ ID NO: 4016842 - RNA, 16 nt, Staphylococcus aureus subsp. aureus MW2
uacaauuauauguagg

SEQ ID NO: 4016843 - RNA, 19 nt, Staphylococcus aureus subsp. aureus MW2
uacaauuauggauaaaauu

SEQ ID NO: 4016844 - RNA, 16 nt, Staphylococcus aureus subsp. aureus MW2
uacaauucauaagaaa

SEQ ID NO: 4016845 - RNA, 18 nt, Staphylococcus aureus subsp. aureus MW2
uacaauucauaagaaaaa

SEQ ID NO: 4016846 - RNA, 19 nt, Staphylococcus aureus subsp. aureus MW2
uacaauucauaagaaaaau

SEQ ID NO: 4016847 - RNA, 20 nt, Staphylococcus aureus subsp. aureus MW2
uacaauuuagguuaauuaaa

SEQ ID NO: 4016848 - RNA, 23 nt, Staphylococcus aureus subsp. aureus MW2
uacaauuuagguuaauuaaacaa

SEQ ID NO: 4016849 - RNA, 13 nt, Staphylococcus aureus subsp. aureus MW2
uacaauuuccuac

SEQ ID NO: 4016850 - RNA, 18 nt, Staphylococcus aureus subsp. aureus MW2
uacaauuuuccuuucaau

SEQ ID NO: 4016851 - RNA, 20 nt, Staphylococcus aureus subsp. aureus MW2
uacaauuuuccuuucaauaa

SEQ ID NO: 4016852 - RNA, 14 nt, Staphylococcus aureus subsp. aureus MW2
uacaauuuuuaaaa

SEQ ID NO: 4016853 - RNA, 21 nt, Staphylococcus aureus subsp. aureus MW2
uacaauuuuuggaaugguaua

SEQ ID NO: 4016854 - RNA, 13 nt, Staphylococcus aureus subsp. aureus MW2
uacacaaaguauu

SEQ ID NO: 4016855 - RNA, 14 nt, Staphylococcus aureus subsp. aureus MW2
uacacaaaguauuu

SEQ ID NO: 4016856 - RNA, 15 nt, Staphylococcus aureus subsp. aureus MW2
uacacaaauuaaaac

SEQ ID NO: 4016857 - RNA, 17 nt, Staphylococcus aureus subsp. aureus MW2
uacacaaugauuauaaa

SEQ ID NO: 4016858 - RNA, 22 nt, Staphylococcus aureus subsp. aureus MW2
uacacaaugauuauaaauacau

SEQ ID NO: 4016859 - RNA, 19 nt, Staphylococcus aureus subsp. aureus MW2
uacacaaugccuuuaaagc

SEQ ID NO: 4016860 - RNA, 22 nt, Staphylococcus aureus subsp. aureus MW2
uacacacugcuaaaauuguauu

SEQ ID NO: 4016861 - RNA, 20 nt, Staphylococcus aureus subsp. aureus MW2
uacacgaguguuaucacaua

SEQ ID NO: 4016862 - RNA, 17 nt, Staphylococcus aureus subsp. aureus MW2
uacacuaucguuuuuau

SEQ ID NO: 4016863 - RNA, 20 nt, Staphylococcus aureus subsp. aureus MW2
uacacuccccuuaucaaaac

SEQ ID NO: 4016864 - RNA, 12 nt, Staphylococcus aureus subsp. aureus MW2
uacacuuuugau

SEQ ID NO: 4016865 - RNA, 15 nt, Staphylococcus aureus subsp. aureus MW2
uacagacaaugcaag

SEQ ID NO: 4016866 - RNA, 18 nt, Staphylococcus aureus subsp. aureus MW2
uacagauaaguaauaaua

SEQ ID NO: 4016867 - RNA, 14 nt, Staphylococcus aureus subsp. aureus MW2
uacagauaauuauu

SEQ ID NO: 4016868 - RNA, 18 nt, Staphylococcus aureus subsp. aureus MW2
uacagauaggaaacuuaa

SEQ ID NO: 4016869 - RNA, 19 nt, Staphylococcus aureus subsp. aureus MW2
uacagauaggaaacuuaaa

SEQ ID NO: 4016870 - RNA, 18 nt, Staphylococcus aureus subsp. aureus MW2
uacagaucucaauccaau

SEQ ID NO: 4016871 - RNA, 21 nt, Staphylococcus aureus subsp. aureus MW2
uacagauuucugcaaaauguu

SEQ ID NO: 4016872 - RNA, 20 nt, Staphylococcus aureus subsp. aureus MW2
uacagauuuuaaaaauucau

SEQ ID NO: 4016873 - RNA, 13 nt, Staphylococcus aureus subsp. aureus MW2
uacagcauauaau

SEQ ID NO: 4016874 - RNA, 20 nt, Staphylococcus aureus subsp. aureus MW2
uacagcgugauucaucuauu

SEQ ID NO: 4016875 - RNA, 22 nt, Staphylococcus aureus subsp. aureus MW2
uacagcgugauucaucuauuau

SEQ ID NO: 4016876 - RNA, 21 nt, Staphylococcus aureus subsp. aureus MW2
uacagguuuaauaaauuuaac

SEQ ID NO: 4016877 - RNA, 19 nt, Staphylococcus aureus subsp. aureus MW2
uacagguuuuaaaauuaaa

SEQ ID NO: 4016878 - RNA, 12 nt, Staphylococcus aureus subsp. aureus MW2
uacaguaauauu

SEQ ID NO: 4016879 - RNA, 15 nt, Staphylococcus aureus subsp. aureus MW2
uacaguaauauucaa

SEQ ID NO: 4016880 - RNA, 17 nt, Staphylococcus aureus subsp. aureus MW2
uacaguaauauucaacu

SEQ ID NO: 4016881 - RNA, 16 nt, Staphylococcus aureus subsp. aureus MW2
uacaguuucuauauuu

SEQ ID NO: 4016882 - RNA, 12 nt, Staphylococcus aureus subsp. aureus MW2
uacauaaaaaua

SEQ ID NO: 4016883 - RNA, 13 nt, Staphylococcus aureus subsp. aureus MW2
uacauaaaaauaa

SEQ ID NO: 4016884 - RNA, 14 nt, Staphylococcus aureus subsp. aureus MW2
uacauaaaaauaag

SEQ ID NO: 4016885 - RNA, 20 nt, Staphylococcus aureus subsp. aureus MW2
uacauaaagcuuugacauau

SEQ ID NO: 4016886 - RNA, 22 nt, Staphylococcus aureus subsp. aureus MW2
uacauaaaugcuaaaaguauaa

SEQ ID NO: 4016887 - RNA, 23 nt, Staphylococcus aureus subsp. aureus MW2
uacauaacacaaguuaagugucu

SEQ ID NO: 4016888 - RNA, 20 nt, Staphylococcus aureus subsp. aureus MW2
uacauaauuuaucaauuucu

SEQ ID NO: 4016889 - RNA, 15 nt, Staphylococcus aureus subsp. aureus MW2
uacauaauuugaauu

SEQ ID NO: 4016890 - RNA, 22 nt, Staphylococcus aureus subsp. aureus MW2
uacauaccacacuuuaaacaag

SEQ ID NO: 4016891 - RNA, 22 nt, Staphylococcus aureus subsp. aureus MW2
uacauaccgauuuucaaccauc

SEQ ID NO: 4016892 - RNA, 13 nt, Staphylococcus aureus subsp. aureus MW2
uacauauaagaau

SEQ ID NO: 4016893 - RNA, 17 nt, Staphylococcus aureus subsp. aureus MW2
uacauauaauaugugca

SEQ ID NO: 4016894 - RNA, 15 nt, Staphylococcus aureus subsp. aureus MW2
uacauauauucuaau

SEQ ID NO: 4016895 - RNA, 17 nt, Staphylococcus aureus subsp. aureus MW2
uacauaugaaaaauguc

SEQ ID NO: 4016896 - RNA, 16 nt, Staphylococcus aureus subsp. aureus MW2
uacauauguguaugau

SEQ ID NO: 4016897 - RNA, 16 nt, Staphylococcus aureus subsp. aureus MW2
uacauauguuguuucu

SEQ ID NO: 4016898 - RNA, 16 nt, Staphylococcus aureus subsp. aureus MW2
uacauauucucugcuu

SEQ ID NO: 4016899 - RNA, 13 nt, Staphylococcus aureus subsp. aureus MW2
uacaucaauuucu

SEQ ID NO: 4016900 - RNA, 17 nt, Staphylococcus aureus subsp. aureus MW2
uacaucaucaaguucac

SEQ ID NO: 4016901 - RNA, 21 nt, Staphylococcus aureus subsp. aureus MW2
uacaucauuaaauauuuagau

SEQ ID NO: 4016902 - RNA, 19 nt, Staphylococcus aureus subsp. aureus MW2
uacaucauuagacuuucuu

SEQ ID NO: 4016903 - RNA, 13 nt, Staphylococcus aureus subsp. aureus MW2
uacauccauacuu

SEQ ID NO: 4016904 - RNA, 14 nt, Staphylococcus aureus subsp. aureus MW2
uacauccauacuuc

SEQ ID NO: 4016905 - RNA, 18 nt, Staphylococcus aureus subsp. aureus MW2
uacaucgacaauuuucga

SEQ ID NO: 4016906 - RNA, 16 nt, Staphylococcus aureus subsp. aureus MW2
uacaucuauccuuguu

SEQ ID NO: 4016907 - RNA, 15 nt, Staphylococcus aureus subsp. aureus MW2
uacaugacuccaugc

SEQ ID NO: 4016908 - RNA, 14 nt, Staphylococcus aureus subsp. aureus MW2
uacaugauauaaau

SEQ ID NO: 4016909 - RNA, 22 nt, Staphylococcus aureus subsp. aureus MW2
uacauguaacagugugaaauaa

SEQ ID NO: 4016910 - RNA, 14 nt, Staphylococcus aureus subsp. aureus MW2
uacauguacauuau

SEQ ID NO: 4016911 - RNA, 22 nt, Staphylococcus aureus subsp. aureus MW2
uacauuaaacauauuuuuugau

SEQ ID NO: 4016912 - RNA, 18 nt, Staphylococcus aureus subsp. aureus MW2
uacauuaaagaaaauauc

SEQ ID NO: 4016913 - RNA, 18 nt, Staphylococcus aureus subsp. aureus MW2
uacauuaacgauuaauau

SEQ ID NO: 4016914 - RNA, 17 nt, Staphylococcus aureus subsp. aureus MW2
uacauuaauauaaauau

SEQ ID NO: 4016915 - RNA, 17 nt, Staphylococcus aureus subsp. aureus MW2
uacauuacauauaucaa

SEQ ID NO: 4016916 - RNA, 19 nt, Staphylococcus aureus subsp. aureus MW2
uacauuaguuugaucauuu

SEQ ID NO: 4016917 - RNA, 13 nt, Staphylococcus aureus subsp. aureus MW2
uacauuaugaaca

SEQ ID NO: 4016918 - RNA, 15 nt, Staphylococcus aureus subsp. aureus MW2
uacauuaugaacaga

SEQ ID NO: 4016919 - RNA, 15 nt, Staphylococcus aureus subsp. aureus MW2
uacauugauaaaaua

SEQ ID NO: 4016920 - RNA, 17 nt, Staphylococcus aureus subsp. aureus MW2
uacauugauaaaauaau

SEQ ID NO: 4016921 - RNA, 14 nt, Staphylococcus aureus subsp. aureus MW2
uacauugauaaauu

SEQ ID NO: 4016922 - RNA, 22 nt, Staphylococcus aureus subsp. aureus MW2
uacauugauaaauuuuuaguua

SEQ ID NO: 4016923 - RNA, 16 nt, Staphylococcus aureus subsp. aureus MW2
uacauuguaaauauag

SEQ ID NO: 4016924 - RNA, 17 nt, Staphylococcus aureus subsp. aureus MW2
uacauuguaaauauagu

SEQ ID NO: 4016925 - RNA, 16 nt, Staphylococcus aureus subsp. aureus MW2
uacauuuaguacauau

SEQ ID NO: 4016926 - RNA, 23 nt, Staphylococcus aureus subsp. aureus MW2
uacauuuaguuggacaaauucua

SEQ ID NO: 4016927 - RNA, 19 nt, Staphylococcus aureus subsp. aureus MW2
uacauuuauuuaaugugca

SEQ ID NO: 4016928 - RNA, 22 nt, Staphylococcus aureus subsp. aureus MW2
uacauuuauuuucaauaaauaa

SEQ ID NO: 4016929 - RNA, 23 nt, Staphylococcus aureus subsp. aureus MW2
uacauuucucguuucgucagauu

SEQ ID NO: 4016930 - RNA, 16 nt, Staphylococcus aureus subsp. aureus MW2
uacauuuugaaacauc

SEQ ID NO: 4016931 - RNA, 16 nt, Staphylococcus aureus subsp. aureus MW2
uaccaaauaaauaagu

SEQ ID NO: 4016932 - RNA, 13 nt, Staphylococcus aureus subsp. aureus MW2
uaccaaauuuaua

SEQ ID NO: 4016933 - RNA, 19 nt, Staphylococcus aureus subsp. aureus MW2
uaccaaccaaaaccaaaug

SEQ ID NO: 4016934 - RNA, 19 nt, Staphylococcus aureus subsp. aureus MW2
uaccaagugcuuuuuuacc

SEQ ID NO: 4016935 - RNA, 22 nt, Staphylococcus aureus subsp. aureus MW2
uaccaagugcuuuuuuaccagc

SEQ ID NO: 4016936 - RNA, 18 nt, Staphylococcus aureus subsp. aureus MW2
uaccaauacguuuccaau

SEQ ID NO: 4016937 - RNA, 20 nt, Staphylococcus aureus subsp. aureus MW2
uaccaaugaauaaauugaua

SEQ ID NO: 4016938 - RNA, 17 nt, Staphylococcus aureus subsp. aureus MW2
uaccaauugauuuugcu

SEQ ID NO: 4016939 - RNA, 17 nt, Staphylococcus aureus subsp. aureus MW2
uaccaauuuuuagcauu

SEQ ID NO: 4016940 - RNA, 18 nt, Staphylococcus aureus subsp. aureus MW2
uaccacacuuuaaacaag

SEQ ID NO: 4016941 - RNA, 20 nt, Staphylococcus aureus subsp. aureus MW2
uaccacacuuuaaacaagca

SEQ ID NO: 4016942 - RNA, 20 nt, Staphylococcus aureus subsp. aureus MW2
uaccacaucgcauaauaucu

SEQ ID NO: 4016943 - RNA, 16 nt, Staphylococcus aureus subsp. aureus MW2
uaccaccagccccaau

SEQ ID NO: 4016944 - RNA, 19 nt, Staphylococcus aureus subsp. aureus MW2
uaccacuugaauacuuuuu

SEQ ID NO: 4016945 - RNA, 12 nt, Staphylococcus aureus subsp. aureus MW2
uaccagcaugaa

SEQ ID NO: 4016946 - RNA, 15 nt, Staphylococcus aureus subsp. aureus MW2
uaccagguuauagaa

SEQ ID NO: 4016947 - RNA, 20 nt, Staphylococcus aureus subsp. aureus MW2
uaccagugggcuccaaacau

SEQ ID NO: 4016948 - RNA, 15 nt, Staphylococcus aureus subsp. aureus MW2
uaccaguugauuuaa

SEQ ID NO: 4016949 - RNA, 21 nt, Staphylococcus aureus subsp. aureus MW2
uaccauaaauuuauauauaga

SEQ ID NO: 4016950 - RNA, 16 nt, Staphylococcus aureus subsp. aureus MW2
uaccauagauuauauu

SEQ ID NO: 4016951 - RNA, 14 nt, Staphylococcus aureus subsp. aureus MW2
uaccauauaauucu

SEQ ID NO: 4016952 - RNA, 19 nt, Staphylococcus aureus subsp. aureus MW2
uaccauauuuuuuaguaau

SEQ ID NO: 4016953 - RNA, 16 nt, Staphylococcus aureus subsp. aureus MW2
uaccaucaauaaaaau

SEQ ID NO: 4016954 - RNA, 19 nt, Staphylococcus aureus subsp. aureus MW2
uaccaugaugagauaaaau

SEQ ID NO: 4016955 - RNA, 17 nt, Staphylococcus aureus subsp. aureus MW2
uaccauguuuuuuaagu

SEQ ID NO: 4016956 - RNA, 23 nt, Staphylococcus aureus subsp. aureus MW2
uaccauugugaugauaauuaaug

SEQ ID NO: 4016957 - RNA, 19 nt, Staphylococcus aureus subsp. aureus MW2
uacccaaaaaauuguauaa

SEQ ID NO: 4016958 - RNA, 20 nt, Staphylococcus aureus subsp. aureus MW2
uacccacaucuuuuuaaaag

SEQ ID NO: 4016959 - RNA, 14 nt, Staphylococcus aureus subsp. aureus MW2
uacccaccuuucuu

SEQ ID NO: 4016960 - RNA, 15 nt, Staphylococcus aureus subsp. aureus MW2
uacccaccuuucuuu

SEQ ID NO: 4016961 - RNA, 23 nt, Staphylococcus aureus subsp. aureus MW2
uacccaccuuucuuuaucauauc

SEQ ID NO: 4016962 - RNA, 19 nt, Staphylococcus aureus subsp. aureus MW2
uacccauuuuuuuccaagc

SEQ ID NO: 4016963 - RNA, 20 nt, Staphylococcus aureus subsp. aureus MW2
uaccccuguugaauauacua

SEQ ID NO: 4016964 - RNA, 15 nt, Staphylococcus aureus subsp. aureus MW2
uacccuauuuuacaa

SEQ ID NO: 4016965 - RNA, 19 nt, Staphylococcus aureus subsp. aureus MW2
uacccuccuauuaauauau

SEQ ID NO: 4016966 - RNA, 16 nt, Staphylococcus aureus subsp. aureus MW2
uaccgaauuggaugaa

SEQ ID NO: 4016967 - RNA, 21 nt, Staphylococcus aureus subsp. aureus MW2
uaccgauugucaauuuaaagu

SEQ ID NO: 4016968 - RNA, 18 nt, Staphylococcus aureus subsp. aureus MW2
uaccgucuucucuaucag

SEQ ID NO: 4016969 - RNA, 14 nt, Staphylococcus aureus subsp. aureus MW2
uaccuaaaauaccc

SEQ ID NO: 4016970 - RNA, 18 nt, Staphylococcus aureus subsp. aureus MW2
uaccuaaagcuaauacac

SEQ ID NO: 4016971 - RNA, 19 nt, Staphylococcus aureus subsp. aureus MW2
uaccuaagcugauuaaaau

SEQ ID NO: 4016972 - RNA, 15 nt, Staphylococcus aureus subsp. aureus MW2
uaccuaauaggauuu

SEQ ID NO: 4016973 - RNA, 23 nt, Staphylococcus aureus subsp. aureus MW2
uaccuaaugcgacaucgccaauu

SEQ ID NO: 4016974 - RNA, 22 nt, Staphylococcus aureus subsp. aureus MW2
uaccuacaauaagaacuugcuu

SEQ ID NO: 4016975 - RNA, 19 nt, Staphylococcus aureus subsp. aureus MW2
uaccuacacggucccaaga

SEQ ID NO: 4016976 - RNA, 14 nt, Staphylococcus aureus subsp. aureus MW2
uaccuauaaacaua

SEQ ID NO: 4016977 - RNA, 16 nt, Staphylococcus aureus subsp. aureus MW2
uaccuauuaauaucau

SEQ ID NO: 4016978 - RNA, 20 nt, Staphylococcus aureus subsp. aureus MW2
uaccuauuugauuaaauuaa

SEQ ID NO: 4016979 - RNA, 21 nt, Staphylococcus aureus subsp. aureus MW2
uaccuauuugauuaaauuaaa

SEQ ID NO: 4016980 - RNA, 18 nt, Staphylococcus aureus subsp. aureus MW2
uaccuccccaacuuaaua

SEQ ID NO: 4016981 - RNA, 16 nt, Staphylococcus aureus subsp. aureus MW2
uaccucuugauaaaau

SEQ ID NO: 4016982 - RNA, 21 nt, Staphylococcus aureus subsp. aureus MW2
uaccugcucuuuccacagcuu

SEQ ID NO: 4016983 - RNA, 20 nt, Staphylococcus aureus subsp. aureus MW2
uaccuggauuaccaaguaau

SEQ ID NO: 4016984 - RNA, 20 nt, Staphylococcus aureus subsp. aureus MW2
uaccugguucgauuguaaua

SEQ ID NO: 4016985 - RNA, 23 nt, Staphylococcus aureus subsp. aureus MW2
uaccuguuggcuuuaaagguauu

SEQ ID NO: 4016986 - RNA, 20 nt, Staphylococcus aureus subsp. aureus MW2
uaccuuaucaguguaaguuu

SEQ ID NO: 4016987 - RNA, 20 nt, Staphylococcus aureus subsp. aureus MW2
uaccuucaauugacauuaau

SEQ ID NO: 4016988 - RNA, 13 nt, Staphylococcus aureus subsp. aureus MW2
uaccuuuaauaau

SEQ ID NO: 4016989 - RNA, 18 nt, Staphylococcus aureus subsp. aureus MW2
uaccuuuaauaauauuga

SEQ ID NO: 4016990 - RNA, 14 nt, Staphylococcus aureus subsp. aureus MW2
uaccuuuaauaucu

SEQ ID NO: 4016991 - RNA, 14 nt, Staphylococcus aureus subsp. aureus MW2
uaccuuuauuauuu

SEQ ID NO: 4016992 - RNA, 18 nt, Staphylococcus aureus subsp. aureus MW2
uaccuuucaaauauaucu

SEQ ID NO: 4016993 - RNA, 19 nt, Staphylococcus aureus subsp. aureus MW2
uaccuuucaaauauaucua

SEQ ID NO: 4016994 - RNA, 22 nt, Staphylococcus aureus subsp. aureus MW2
uaccuuuuuauugauauuaaua

SEQ ID NO: 4016995 - RNA, 20 nt, Staphylococcus aureus subsp. aureus MW2
uaccuuuuucuaaaccaaca

SEQ ID NO: 4016996 - RNA, 20 nt, Staphylococcus aureus subsp. aureus MW2
uacgaaguuuaaaugugcaa

SEQ ID NO: 4016997 - RNA, 23 nt, Staphylococcus aureus subsp. aureus MW2
uacgaaguuuaaaugugcaauua

SEQ ID NO: 4016998 - RNA, 13 nt, Staphylococcus aureus subsp. aureus MW2
uacgaauacuaaa

SEQ ID NO: 4016999 - RNA, 22 nt, Staphylococcus aureus subsp. aureus MW2
uacgaaucacaguuauauauua

SEQ ID NO: 4017000 - RNA, 19 nt, Staphylococcus aureus subsp. aureus MW2
uacgaggucuuuaauuuau

SEQ ID NO: 4017001 - RNA, 20 nt, Staphylococcus aureus subsp. aureus MW2
uacgaggucuuuaauuuauu

SEQ ID NO: 4017002 - RNA, 20 nt, Staphylococcus aureus subsp. aureus MW2
uacgauaacuacacuuaaua

SEQ ID NO: 4017003 - RNA, 16 nt, Staphylococcus aureus subsp. aureus MW2
uacgauauagugcuug

SEQ ID NO: 4017004 - RNA, 19 nt, Staphylococcus aureus subsp. aureus MW2
uacgaucaaaaucaugcuc

SEQ ID NO: 4017005 - RNA, 16 nt, Staphylococcus aureus subsp. aureus MW2
uacgauugcaauggcu

SEQ ID NO: 4017006 - RNA, 18 nt, Staphylococcus aureus subsp. aureus MW2
uacgcaaagaaaaacauc

SEQ ID NO: 4017007 - RNA, 16 nt, Staphylococcus aureus subsp. aureus MW2
uacgcaacuugggauu

SEQ ID NO: 4017008 - RNA, 13 nt, Staphylococcus aureus subsp. aureus MW2
uacgcaagguauu

SEQ ID NO: 4017009 - RNA, 19 nt, Staphylococcus aureus subsp. aureus MW2
uacgccuucuuuauaacuu

SEQ ID NO: 4017010 - RNA, 16 nt, Staphylococcus aureus subsp. aureus MW2
uacgcugucucauuaa

SEQ ID NO: 4017011 - RNA, 17 nt, Staphylococcus aureus subsp. aureus MW2
uacgcugucucauuaau

SEQ ID NO: 4017012 - RNA, 17 nt, Staphylococcus aureus subsp. aureus MW2
uacgcuuacuuauauuu

SEQ ID NO: 4017013 - RNA, 22 nt, Staphylococcus aureus subsp. aureus MW2
uacgguuauuuaauaaugcuuu

SEQ ID NO: 4017014 - RNA, 23 nt, Staphylococcus aureus subsp. aureus MW2
uacgguuauuuaauaaugcuuua

SEQ ID NO: 4017015 - RNA, 21 nt, Staphylococcus aureus subsp. aureus MW2
uacgguuauuuggauaauuuu

SEQ ID NO: 4017016 - RNA, 17 nt, Staphylococcus aureus subsp. aureus MW2
uacguaucuuuacaaca

SEQ ID NO: 4017017 - RNA, 22 nt, Staphylococcus aureus subsp. aureus MW2
uacguaugcccucauaaaucau

SEQ ID NO: 4017018 - RNA, 14 nt, Staphylococcus aureus subsp. aureus MW2
uacgucauaaaaua

SEQ ID NO: 4017019 - RNA, 16 nt, Staphylococcus aureus subsp. aureus MW2
uacgucauaaaauacc

SEQ ID NO: 4017020 - RNA, 13 nt, Staphylococcus aureus subsp. aureus MW2
uacguggcucuaa

SEQ ID NO: 4017021 - RNA, 16 nt, Staphylococcus aureus subsp. aureus MW2
uacguggcucuaaaaa

SEQ ID NO: 4017022 - RNA, 21 nt, Staphylococcus aureus subsp. aureus MW2
uacguguguaguagcaccgau

SEQ ID NO: 4017023 - RNA, 18 nt, Staphylococcus aureus subsp. aureus MW2
uacguuauuucaauaaua

SEQ ID NO: 4017024 - RNA, 22 nt, Staphylococcus aureus subsp. aureus MW2
uacguucuucaugucguuuucu

SEQ ID NO: 4017025 - RNA, 17 nt, Staphylococcus aureus subsp. aureus MW2
uacguuuaauaaugguu

SEQ ID NO: 4017026 - RNA, 14 nt, Staphylococcus aureus subsp. aureus MW2
uacguuuauaucuu

SEQ ID NO: 4017027 - RNA, 21 nt, Staphylococcus aureus subsp. aureus MW2
uacguuuauccuuuaaaucau

SEQ ID NO: 4017028 - RNA, 15 nt, Staphylococcus aureus subsp. aureus MW2
uacguuuuuuuaaau

SEQ ID NO: 4017029 - RNA, 17 nt, Staphylococcus aureus subsp. aureus MW2
uacuaaaauaucaaaau

SEQ ID NO: 4017030 - RNA, 13 nt, Staphylococcus aureus subsp. aureus MW2
uacuaaaccgauu

SEQ ID NO: 4017031 - RNA, 17 nt, Staphylococcus aureus subsp. aureus MW2
uacuaaaccucaacauu

SEQ ID NO: 4017032 - RNA, 14 nt, Staphylococcus aureus subsp. aureus MW2
uacuaaacuuuuuu

SEQ ID NO: 4017033 - RNA, 14 nt, Staphylococcus aureus subsp. aureus MW2
uacuaaauaacuau

SEQ ID NO: 4017034 - RNA, 17 nt, Staphylococcus aureus subsp. aureus MW2
uacuaaaucaaauugac

SEQ ID NO: 4017035 - RNA, 13 nt, Staphylococcus aureus subsp. aureus MW2
uacuaaaugaauu

SEQ ID NO: 4017036 - RNA, 17 nt, Staphylococcus aureus subsp. aureus MW2
uacuaaccuauuaaaau

SEQ ID NO: 4017037 - RNA, 21 nt, Staphylococcus aureus subsp. aureus MW2
uacuaaccuauuaaaauaaac

SEQ ID NO: 4017038 - RNA, 14 nt, Staphylococcus aureus subsp. aureus MW2
uacuaauaacucuu

SEQ ID NO: 4017039 - RNA, 15 nt, Staphylococcus aureus subsp. aureus MW2
uacuaauauauuaau

SEQ ID NO: 4017040 - RNA, 22 nt, Staphylococcus aureus subsp. aureus MW2
uacuaauuuuguacauaaaaau

SEQ ID NO: 4017041 - RNA, 13 nt, Staphylococcus aureus subsp. aureus MW2
uacuacauuauua

SEQ ID NO: 4017042 - RNA, 19 nt, Staphylococcus aureus subsp. aureus MW2
uacuagcauuagcaaauau

SEQ ID NO: 4017043 - RNA, 18 nt, Staphylococcus aureus subsp. aureus MW2
uacuaggaauauaaaacu

SEQ ID NO: 4017044 - RNA, 14 nt, Staphylococcus aureus subsp. aureus MW2
uacuaguaauaaua

SEQ ID NO: 4017045 - RNA, 23 nt, Staphylococcus aureus subsp. aureus MW2
uacuaguuuguaauaauuaacuu

SEQ ID NO: 4017046 - RNA, 24 nt, Staphylococcus aureus subsp. aureus MW2
uacuauaaaaucaucguauuucau

SEQ ID NO: 4017047 - RNA, 14 nt, Staphylococcus aureus subsp. aureus MW2
uacuauacaaugua

SEQ ID NO: 4017048 - RNA, 16 nt, Staphylococcus aureus subsp. aureus MW2
uacuauacaauguauu

SEQ ID NO: 4017049 - RNA, 13 nt, Staphylococcus aureus subsp. aureus MW2
uacuauauauaau

SEQ ID NO: 4017050 - RNA, 13 nt, Staphylococcus aureus subsp. aureus MW2
uacuauaugaaaa

SEQ ID NO: 4017051 - RNA, 22 nt, Staphylococcus aureus subsp. aureus MW2
uacuauaugaaaagagaaacaa

SEQ ID NO: 4017052 - RNA, 16 nt, Staphylococcus aureus subsp. aureus MW2
uacuauauuuaaauug

SEQ ID NO: 4017053 - RNA, 13 nt, Staphylococcus aureus subsp. aureus MW2
uacuauauuuauu

SEQ ID NO: 4017054 - RNA, 16 nt, Staphylococcus aureus subsp. aureus MW2
uacuaucuucaucaua

SEQ ID NO: 4017055 - RNA, 17 nt, Staphylococcus aureus subsp. aureus MW2
uacuauggcauuauugc

SEQ ID NO: 4017056 - RNA, 23 nt, Staphylococcus aureus subsp. aureus MW2
uacuauuaaaggaaaucaaucca

SEQ ID NO: 4017057 - RNA, 13 nt, Staphylococcus aureus subsp. aureus MW2
uacuauuaaauaa

SEQ ID NO: 4017058 - RNA, 16 nt, Staphylococcus aureus subsp. aureus MW2
uacuauuaaauaaucg

SEQ ID NO: 4017059 - RNA, 16 nt, Staphylococcus aureus subsp. aureus MW2
uacuauugauauucua

SEQ ID NO: 4017060 - RNA, 20 nt, Staphylococcus aureus subsp. aureus MW2
uacuauugauauucuaaaaa

SEQ ID NO: 4017061 - RNA, 12 nt, Staphylococcus aureus subsp. aureus MW2
uacucauauuga

SEQ ID NO: 4017062 - RNA, 13 nt, Staphylococcus aureus subsp. aureus MW2
uacucauuuagcu

SEQ ID NO: 4017063 - RNA, 18 nt, Staphylococcus aureus subsp. aureus MW2
uacucauuuagcucuacu

SEQ ID NO: 4017064 - RNA, 21 nt, Staphylococcus aureus subsp. aureus MW2
uacucuaaaaaaggaagaaca

SEQ ID NO: 4017065 - RNA, 17 nt, Staphylococcus aureus subsp. aureus MW2
uacucuaaaacgauuaa

SEQ ID NO: 4017066 - RNA, 17 nt, Staphylococcus aureus subsp. aureus MW2
uacucuaauuacauaua

SEQ ID NO: 4017067 - RNA, 12 nt, Staphylococcus aureus subsp. aureus MW2
uacucugaaaag

SEQ ID NO: 4017068 - RNA, 19 nt, Staphylococcus aureus subsp. aureus MW2
uacucugaaaagccuacuu

SEQ ID NO: 4017069 - RNA, 16 nt, Staphylococcus aureus subsp. aureus MW2
uacucuuuuuaauauu

SEQ ID NO: 4017070 - RNA, 21 nt, Staphylococcus aureus subsp. aureus MW2
uacugaaacaugagcucaucu

SEQ ID NO: 4017071 - RNA, 14 nt, Staphylococcus aureus subsp. aureus MW2
uacugauauauacu

SEQ ID NO: 4017072 - RNA, 14 nt, Staphylococcus aureus subsp. aureus MW2
uacugaugaacaua

SEQ ID NO: 4017073 - RNA, 19 nt, Staphylococcus aureus subsp. aureus MW2
uacugaugaacauaccugc

SEQ ID NO: 4017074 - RNA, 21 nt, Staphylococcus aureus subsp. aureus MW2
uacugcagcaucauaaucuuu

SEQ ID NO: 4017075 - RNA, 23 nt, Staphylococcus aureus subsp. aureus MW2
uacugcucuuuauauauaaaauc

SEQ ID NO: 4017076 - RNA, 21 nt, Staphylococcus aureus subsp. aureus MW2
uacugcugcuucggcaccuuu

SEQ ID NO: 4017077 - RNA, 18 nt, Staphylococcus aureus subsp. aureus MW2
uacugcuucaaucgucac

SEQ ID NO: 4017078 - RNA, 15 nt, Staphylococcus aureus subsp. aureus MW2
uacugcuugugugaa

SEQ ID NO: 4017079 - RNA, 16 nt, Staphylococcus aureus subsp. aureus MW2
uacugcuuuuuuaaau

SEQ ID NO: 4017080 - RNA, 20 nt, Staphylococcus aureus subsp. aureus MW2
uacugcuuuuuuaaauuuaa

SEQ ID NO: 4017081 - RNA, 13 nt, Staphylococcus aureus subsp. aureus MW2
uacugguuaguaa

SEQ ID NO: 4017082 - RNA, 16 nt, Staphylococcus aureus subsp. aureus MW2
uacugguuaguaaaau

SEQ ID NO: 4017083 - RNA, 17 nt, Staphylococcus aureus subsp. aureus MW2
uacuguaguacuauagu

SEQ ID NO: 4017084 - RNA, 15 nt, Staphylococcus aureus subsp. aureus MW2
uacuguauaagugcu

SEQ ID NO: 4017085 - RNA, 20 nt, Staphylococcus aureus subsp. aureus MW2
uacugucucaucuucuaaau

SEQ ID NO: 4017086 - RNA, 18 nt, Staphylococcus aureus subsp. aureus MW2
uacuguuuaaauaaaauu

SEQ ID NO: 4017087 - RNA, 21 nt, Staphylococcus aureus subsp. aureus MW2
uacuguuuaaauaaaauuguu

SEQ ID NO: 4017088 - RNA, 13 nt, Staphylococcus aureus subsp. aureus MW2
uacuguuugcuuu

SEQ ID NO: 4017089 - RNA, 12 nt, Staphylococcus aureus subsp. aureus MW2
uacuguuuucau

SEQ ID NO: 4017090 - RNA, 15 nt, Staphylococcus aureus subsp. aureus MW2
uacuuaaaauaagua

SEQ ID NO: 4017091 - RNA, 21 nt, Staphylococcus aureus subsp. aureus MW2
uacuuaaaccguauagucauu

SEQ ID NO: 4017092 - RNA, 12 nt, Staphylococcus aureus subsp. aureus MW2
uacuuaauauag

SEQ ID NO: 4017093 - RNA, 15 nt, Staphylococcus aureus subsp. aureus MW2
uacuuaauuaauaau

SEQ ID NO: 4017094 - RNA, 14 nt, Staphylococcus aureus subsp. aureus MW2
uacuuaauuuaaau

SEQ ID NO: 4017095 - RNA, 19 nt, Staphylococcus aureus subsp. aureus MW2
uacuuacgaauagaaaaua

SEQ ID NO: 4017096 - RNA, 20 nt, Staphylococcus aureus subsp. aureus MW2
uacuuacgaauagaaaauaa

SEQ ID NO: 4017097 - RNA, 18 nt, Staphylococcus aureus subsp. aureus MW2
uacuuacgccaaucacaa

SEQ ID NO: 4017098 - RNA, 22 nt, Staphylococcus aureus subsp. aureus MW2
uacuuacuuuucuaaacaacuu

SEQ ID NO: 4017099 - RNA, 19 nt, Staphylococcus aureus subsp. aureus MW2
uacuuaguaaggaauauuu

SEQ ID NO: 4017100 - RNA, 17 nt, Staphylococcus aureus subsp. aureus MW2
uacuuauucaaauguuu

SEQ ID NO: 4017101 - RNA, 15 nt, Staphylococcus aureus subsp. aureus MW2
uacuuauuucuuuuc

SEQ ID NO: 4017102 - RNA, 17 nt, Staphylococcus aureus subsp. aureus MW2
uacuuauuucuuuucau

SEQ ID NO: 4017103 - RNA, 18 nt, Staphylococcus aureus subsp. aureus MW2
uacuuauuucuuuucauu

SEQ ID NO: 4017104 - RNA, 14 nt, Staphylococcus aureus subsp. aureus MW2
uacuucauaaguca

SEQ ID NO: 4017105 - RNA, 20 nt, Staphylococcus aureus subsp. aureus MW2
uacuuccuuacagacaaaca

SEQ ID NO: 4017106 - RNA, 19 nt, Staphylococcus aureus subsp. aureus MW2
uacuucuaacgcaacugaa

SEQ ID NO: 4017107 - RNA, 15 nt, Staphylococcus aureus subsp. aureus MW2
uacuucuaauuugca

SEQ ID NO: 4017108 - RNA, 20 nt, Staphylococcus aureus subsp. aureus MW2
uacuucuauuuuauaauaaa

SEQ ID NO: 4017109 - RNA, 16 nt, Staphylococcus aureus subsp. aureus MW2
uacuucuuuggucuaa

SEQ ID NO: 4017110 - RNA, 12 nt, Staphylococcus aureus subsp. aureus MW2
uacuugaaaaua

SEQ ID NO: 4017111 - RNA, 23 nt, Staphylococcus aureus subsp. aureus MW2
uacuugaaaauagccauaucaua

SEQ ID NO: 4017112 - RNA, 13 nt, Staphylococcus aureus subsp. aureus MW2
uacuugaaacauc

SEQ ID NO: 4017113 - RNA, 19 nt, Staphylococcus aureus subsp. aureus MW2
uacuugaauaccuuuuauu

SEQ ID NO: 4017114 - RNA, 18 nt, Staphylococcus aureus subsp. aureus MW2
uacuugaauguaagaagu

SEQ ID NO: 4017115 - RNA, 20 nt, Staphylococcus aureus subsp. aureus MW2
uacuugauuagauuugugug

SEQ ID NO: 4017116 - RNA, 23 nt, Staphylococcus aureus subsp. aureus MW2
uacuuggaaaauacuauacugau

SEQ ID NO: 4017117 - RNA, 15 nt, Staphylococcus aureus subsp. aureus MW2
uacuuguaauuaaua

SEQ ID NO: 4017118 - RNA, 19 nt, Staphylococcus aureus subsp. aureus MW2
uacuuguaauuaauacauc

SEQ ID NO: 4017119 - RNA, 22 nt, Staphylococcus aureus subsp. aureus MW2
uacuuguccuaacgcuaauuuu

SEQ ID NO: 4017120 - RNA, 18 nt, Staphylococcus aureus subsp. aureus MW2
uacuugucguauucuuca

SEQ ID NO: 4017121 - RNA, 14 nt, Staphylococcus aureus subsp. aureus MW2
uacuuuauaaauau

SEQ ID NO: 4017122 - RNA, 17 nt, Staphylococcus aureus subsp. aureus MW2
uacuuuauaaauaucuu

SEQ ID NO: 4017123 - RNA, 19 nt, Staphylococcus aureus subsp. aureus MW2
uacuuucaaauaaugugaa

SEQ ID NO: 4017124 - RNA, 17 nt, Staphylococcus aureus subsp. aureus MW2
uacuuucacauuuucaa

SEQ ID NO: 4017125 - RNA, 19 nt, Staphylococcus aureus subsp. aureus MW2
uacuuucacauuuucaaau

SEQ ID NO: 4017126 - RNA, 17 nt, Staphylococcus aureus subsp. aureus MW2
uacuuucaccauuuacu

SEQ ID NO: 4017127 - RNA, 17 nt, Staphylococcus aureus subsp. aureus MW2
uacuuucacuuuuuaua

SEQ ID NO: 4017128 - RNA, 18 nt, Staphylococcus aureus subsp. aureus MW2
uacuuucgaguaauacuu

SEQ ID NO: 4017129 - RNA, 15 nt, Staphylococcus aureus subsp. aureus MW2
uacuuucuaagauac

SEQ ID NO: 4017130 - RNA, 22 nt, Staphylococcus aureus subsp. aureus MW2
uacuuuggaaauuuauuauaaa

SEQ ID NO: 4017131 - RNA, 22 nt, Staphylococcus aureus subsp. aureus MW2
uacuuuggcagacguaucauca

SEQ ID NO: 4017132 - RNA, 15 nt, Staphylococcus aureus subsp. aureus MW2
uacuuuguaauucuu

SEQ ID NO: 4017133 - RNA, 18 nt, Staphylococcus aureus subsp. aureus MW2
uacuuuguaauucuugua

SEQ ID NO: 4017134 - RNA, 12 nt, Staphylococcus aureus subsp. aureus MW2
uacuuuuaaaau

SEQ ID NO: 4017135 - RNA, 15 nt, Staphylococcus aureus subsp. aureus MW2
uacuuuuauagaaaa

SEQ ID NO: 4017136 - RNA, 13 nt, Staphylococcus aureus subsp. aureus MW2
uacuuuucaacuu

SEQ ID NO: 4017137 - RNA, 11 nt, Staphylococcus aureus subsp. aureus MW2
uacuuuucauc

SEQ ID NO: 4017138 - RNA, 12 nt, Staphylococcus aureus subsp. aureus MW2
uacuuuucuaaa

SEQ ID NO: 4017139 - RNA, 13 nt, Staphylococcus aureus subsp. aureus MW2
uacuuuucuuuuu

SEQ ID NO: 4017140 - RNA, 15 nt, Staphylococcus aureus subsp. aureus MW2
uacuuuuucaucuuu

SEQ ID NO: 4017141 - RNA, 12 nt, Staphylococcus aureus subsp. aureus MW2
uagaaaaaaauc

SEQ ID NO: 4017142 - RNA, 19 nt, Staphylococcus aureus subsp. aureus MW2
uagaaaaagggcaaaaaag

SEQ ID NO: 4017143 - RNA, 22 nt, Staphylococcus aureus subsp. aureus MW2
uagaaaaagggcaaaaaaggau

SEQ ID NO: 4017144 - RNA, 18 nt, Staphylococcus aureus subsp. aureus MW2
uagaaaaauaugauugca

SEQ ID NO: 4017145 - RNA, 19 nt, Staphylococcus aureus subsp. aureus MW2
uagaaaaauuucaaaaaua

SEQ ID NO: 4017146 - RNA, 14 nt, Staphylococcus aureus subsp. aureus MW2
uagaaaauaugacg

SEQ ID NO: 4017147 - RNA, 16 nt, Staphylococcus aureus subsp. aureus MW2
uagaaacaccuuucgc

SEQ ID NO: 4017148 - RNA, 15 nt, Staphylococcus aureus subsp. aureus MW2
uagaaacacuuuuag

SEQ ID NO: 4017149 - RNA, 14 nt, Staphylococcus aureus subsp. aureus MW2
uagaaacgaaauua

SEQ ID NO: 4017150 - RNA, 18 nt, Staphylococcus aureus subsp. aureus MW2
uagaaagcgucuuuuuau

SEQ ID NO: 4017151 - RNA, 15 nt, Staphylococcus aureus subsp. aureus MW2
uagaaaggcaggcau

SEQ ID NO: 4017152 - RNA, 15 nt, Staphylococcus aureus subsp. aureus MW2
uagaaaguaaugcuu

SEQ ID NO: 4017153 - RNA, 20 nt, Staphylococcus aureus subsp. aureus MW2
uagaaagugcgguuauuuau

SEQ ID NO: 4017154 - RNA, 15 nt, Staphylococcus aureus subsp. aureus MW2
uagaaaguugugguc

SEQ ID NO: 4017155 - RNA, 17 nt, Staphylococcus aureus subsp. aureus MW2
uagaaauaauuuaaagg

SEQ ID NO: 4017156 - RNA, 18 nt, Staphylococcus aureus subsp. aureus MW2
uagaaaucagcuuuucuu

SEQ ID NO: 4017157 - RNA, 21 nt, Staphylococcus aureus subsp. aureus MW2
uagaaaucagcuuuucuucaa

SEQ ID NO: 4017158 - RNA, 21 nt, Staphylococcus aureus subsp. aureus MW2
uagaaaucgccuuguuuauuu

SEQ ID NO: 4017159 - RNA, 20 nt, Staphylococcus aureus subsp. aureus MW2
uagaaauugucuuuucauuu

SEQ ID NO: 4017160 - RNA, 23 nt, Staphylococcus aureus subsp. aureus MW2
uagaaauugucuuuucauuuuuu

SEQ ID NO: 4017161 - RNA, 18 nt, Staphylococcus aureus subsp. aureus MW2
uagaacaguuagaaacag

SEQ ID NO: 4017162 - RNA, 14 nt, Staphylococcus aureus subsp. aureus MW2
uagaaccaucauuu

SEQ ID NO: 4017163 - RNA, 16 nt, Staphylococcus aureus subsp. aureus MW2
uagaaccaucauuuau

SEQ ID NO: 4017164 - RNA, 15 nt, Staphylococcus aureus subsp. aureus MW2
uagaagaaaagaaca

SEQ ID NO: 4017165 - RNA, 17 nt, Staphylococcus aureus subsp. aureus MW2
uagaagaaaagaacauu

SEQ ID NO: 4017166 - RNA, 22 nt, Staphylococcus aureus subsp. aureus MW2
uagaagaaaagaacauucuaac

SEQ ID NO: 4017167 - RNA, 21 nt, Staphylococcus aureus subsp. aureus MW2
uagaagaugauuauucucuuu

SEQ ID NO: 4017168 - RNA, 14 nt, Staphylococcus aureus subsp. aureus MW2
uagaagauuagaug

SEQ ID NO: 4017169 - RNA, 22 nt, Staphylococcus aureus subsp. aureus MW2
uagaaguucuuaugcaguuuua

SEQ ID NO: 4017170 - RNA, 19 nt, Staphylococcus aureus subsp. aureus MW2
uagaauaacuugauauuau

SEQ ID NO: 4017171 - RNA, 18 nt, Staphylococcus aureus subsp. aureus MW2
uagaauacuaaaaguguu

SEQ ID NO: 4017172 - RNA, 19 nt, Staphylococcus aureus subsp. aureus MW2
uagaauaguuaccaaaauu

SEQ ID NO: 4017173 - RNA, 19 nt, Staphylococcus aureus subsp. aureus MW2
uagaaucuacgauuuucaa

SEQ ID NO: 4017174 - RNA, 23 nt, Staphylococcus aureus subsp. aureus MW2
uagaaucuacgauuuucaagacc

SEQ ID NO: 4017175 - RNA, 18 nt, Staphylococcus aureus subsp. aureus MW2
uagaaugauuaaaauuaa

SEQ ID NO: 4017176 - RNA, 18 nt, Staphylococcus aureus subsp. aureus MW2
uagaaugucgauauuucu

SEQ ID NO: 4017177 - RNA, 19 nt, Staphylococcus aureus subsp. aureus MW2
uagaaugucgauauuucua

SEQ ID NO: 4017178 - RNA, 20 nt, Staphylococcus aureus subsp. aureus MW2
uagaauucgagguugaccua

SEQ ID NO: 4017179 - RNA, 16 nt, Staphylococcus aureus subsp. aureus MW2
uagaauucuaaaagaa

SEQ ID NO: 4017180 - RNA, 18 nt, Staphylococcus aureus subsp. aureus MW2
uagaauucuaaaagaauu

SEQ ID NO: 4017181 - RNA, 14 nt, Staphylococcus aureus subsp. aureus MW2
uagaauuuaacauu

SEQ ID NO: 4017182 - RNA, 15 nt, Staphylococcus aureus subsp. aureus MW2
uagaauuuaacauuu

SEQ ID NO: 4017183 - RNA, 12 nt, Staphylococcus aureus subsp. aureus MW2
uagaauuucuuu

SEQ ID NO: 4017184 - RNA, 14 nt, Staphylococcus aureus subsp. aureus MW2
uagaauuucuuuuc

SEQ ID NO: 4017185 - RNA, 17 nt, Staphylococcus aureus subsp. aureus MW2
uagaauuucuuuucgaa

SEQ ID NO: 4017186 - RNA, 21 nt, Staphylococcus aureus subsp. aureus MW2
uagacaagaugcucaaugcau

SEQ ID NO: 4017187 - RNA, 20 nt, Staphylococcus aureus subsp. aureus MW2
uagacaauauuuuuacauau

SEQ ID NO: 4017188 - RNA, 21 nt, Staphylococcus aureus subsp. aureus MW2
uagacaauauuuuuacauauu

SEQ ID NO: 4017189 - RNA, 18 nt, Staphylococcus aureus subsp. aureus MW2
uagacaaucaucuuaaug

SEQ ID NO: 4017190 - RNA, 23 nt, Staphylococcus aureus subsp. aureus MW2
uagacaauguucuuuucaacauu

SEQ ID NO: 4017191 - RNA, 20 nt, Staphylococcus aureus subsp. aureus MW2
uagacaauuguaguaaugaa

SEQ ID NO: 4017192 - RNA, 13 nt, Staphylococcus aureus subsp. aureus MW2
uagacaccaaaaa

SEQ ID NO: 4017193 - RNA, 18 nt, Staphylococcus aureus subsp. aureus MW2
uagacauaaaaaaagaga

SEQ ID NO: 4017194 - RNA, 23 nt, Staphylococcus aureus subsp. aureus MW2
uagacauaaauauggauuuugaa

SEQ ID NO: 4017195 - RNA, 17 nt, Staphylococcus aureus subsp. aureus MW2
uagacauaagcaaagau

SEQ ID NO: 4017196 - RNA, 15 nt, Staphylococcus aureus subsp. aureus MW2
uagacgguaucaucu

SEQ ID NO: 4017197 - RNA, 19 nt, Staphylococcus aureus subsp. aureus MW2
uagacuaagcagucugcuc

SEQ ID NO: 4017198 - RNA, 20 nt, Staphylococcus aureus subsp. aureus MW2
uagacuuauuugaaugcaaa

SEQ ID NO: 4017199 - RNA, 21 nt, Staphylococcus aureus subsp. aureus MW2
uagacuuauuugaaugcaaau

SEQ ID NO: 4017200 - RNA, 18 nt, Staphylococcus aureus subsp. aureus MW2
uagacuuggauaaaaauu

SEQ ID NO: 4017201 - RNA, 15 nt, Staphylococcus aureus subsp. aureus MW2
uagagaaaaaauaaa

SEQ ID NO: 4017202 - RNA, 16 nt, Staphylococcus aureus subsp. aureus MW2
uagagaaaaaauaaau

SEQ ID NO: 4017203 - RNA, 22 nt, Staphylococcus aureus subsp. aureus MW2
uagagaaaaaauaaauguuaaa

SEQ ID NO: 4017204 - RNA, 20 nt, Staphylococcus aureus subsp. aureus MW2
uagagaaauuugauuuucaa

SEQ ID NO: 4017205 - RNA, 22 nt, Staphylococcus aureus subsp. aureus MW2
uagagaauuucaaaaaggaauu

SEQ ID NO: 4017206 - RNA, 16 nt, Staphylococcus aureus subsp. aureus MW2
uagagacuuauuuuau

SEQ ID NO: 4017207 - RNA, 17 nt, Staphylococcus aureus subsp. aureus MW2
uagagagcauaguuuuc

SEQ ID NO: 4017208 - RNA, 23 nt, Staphylococcus aureus subsp. aureus MW2
uagagcccgagacauaaauuaau

SEQ ID NO: 4017209 - RNA, 22 nt, Staphylococcus aureus subsp. aureus MW2
uagagccgugaaagaaaaaacu

SEQ ID NO: 4017210 - RNA, 14 nt, Staphylococcus aureus subsp. aureus MW2
uagagcguuuugcu

SEQ ID NO: 4017211 - RNA, 16 nt, Staphylococcus aureus subsp. aureus MW2
uagagguauaauuaaa

SEQ ID NO: 4017212 - RNA, 12 nt, Staphylococcus aureus subsp. aureus MW2
uagaguagaaag

SEQ ID NO: 4017213 - RNA, 13 nt, Staphylococcus aureus subsp. aureus MW2
uagaguagaaagu

SEQ ID NO: 4017214 - RNA, 15 nt, Staphylococcus aureus subsp. aureus MW2
uagaguuuaggacau

SEQ ID NO: 4017215 - RNA, 12 nt, Staphylococcus aureus subsp. aureus MW2
uagauaaaaaau

SEQ ID NO: 4017216 - RNA, 14 nt, Staphylococcus aureus subsp. aureus MW2
uagauaaaaaauac

SEQ ID NO: 4017217 - RNA, 18 nt, Staphylococcus aureus subsp. aureus MW2
uagauaaaucgauaaaau

SEQ ID NO: 4017218 - RNA, 14 nt, Staphylococcus aureus subsp. aureus MW2
uagauaaucucauu

SEQ ID NO: 4017219 - RNA, 18 nt, Staphylococcus aureus subsp. aureus MW2
uagauacauauaagaauu

SEQ ID NO: 4017220 - RNA, 13 nt, Staphylococcus aureus subsp. aureus MW2
uagauaccaaacu

SEQ ID NO: 4017221 - RNA, 17 nt, Staphylococcus aureus subsp. aureus MW2
uagauagaaauugugcu

SEQ ID NO: 4017222 - RNA, 19 nt, Staphylococcus aureus subsp. aureus MW2
uagauagaaauugugcuuu

SEQ ID NO: 4017223 - RNA, 18 nt, Staphylococcus aureus subsp. aureus MW2
uagauagcggauuuauuu

SEQ ID NO: 4017224 - RNA, 18 nt, Staphylococcus aureus subsp. aureus MW2
uagauaucuuaaucuaaa

SEQ ID NO: 4017225 - RNA, 20 nt, Staphylococcus aureus subsp. aureus MW2
uagaucgaacugauggaaaa

SEQ ID NO: 4017226 - RNA, 23 nt, Staphylococcus aureus subsp. aureus MW2
uagaugaaauuguguugaaucaa

SEQ ID NO: 4017227 - RNA, 18 nt, Staphylococcus aureus subsp. aureus MW2
uagaugaaugccuaauuu

SEQ ID NO: 4017228 - RNA, 21 nt, Staphylococcus aureus subsp. aureus MW2
uagaugaaugccuaauuuugu

SEQ ID NO: 4017229 - RNA, 21 nt, Staphylococcus aureus subsp. aureus MW2
uagaugagaaaguaaaaguuu

SEQ ID NO: 4017230 - RNA, 21 nt, Staphylococcus aureus subsp. aureus MW2
uagaugauauuuaacgaaaau

SEQ ID NO: 4017231 - RNA, 23 nt, Staphylococcus aureus subsp. aureus MW2
uagaugauuagugucacaaagaa

SEQ ID NO: 4017232 - RNA, 15 nt, Staphylococcus aureus subsp. aureus MW2
uagaugcauaaaaaa

SEQ ID NO: 4017233 - RNA, 18 nt, Staphylococcus aureus subsp. aureus MW2
uagaugcauaaaaaaaga

SEQ ID NO: 4017234 - RNA, 20 nt, Staphylococcus aureus subsp. aureus MW2
uagaugugucuuuuguuaug

SEQ ID NO: 4017235 - RNA, 15 nt, Staphylococcus aureus subsp. aureus MW2
uagauuagcuuaagu

SEQ ID NO: 4017236 - RNA, 20 nt, Staphylococcus aureus subsp. aureus MW2
uagauucacuguauaaauaa

SEQ ID NO: 4017237 - RNA, 14 nt, Staphylococcus aureus subsp. aureus MW2
uagauucuuuucug

SEQ ID NO: 4017238 - RNA, 18 nt, Staphylococcus aureus subsp. aureus MW2
uagauugcgguaauugaa

SEQ ID NO: 4017239 - RNA, 17 nt, Staphylococcus aureus subsp. aureus MW2
uagauuguauuuaauaa

SEQ ID NO: 4017240 - RNA, 23 nt, Staphylococcus aureus subsp. aureus MW2
uagauuguauuuaauaaguuaau

SEQ ID NO: 4017241 - RNA, 13 nt, Staphylococcus aureus subsp. aureus MW2
uagauuuaaaaug

SEQ ID NO: 4017242 - RNA, 17 nt, Staphylococcus aureus subsp. aureus MW2
uagauuuaggagagcca

SEQ ID NO: 4017243 - RNA, 19 nt, Staphylococcus aureus subsp. aureus MW2
uagauuuaucaccuuuagg

SEQ ID NO: 4017244 - RNA, 16 nt, Staphylococcus aureus subsp. aureus MW2
uagauuucaaaucaau

SEQ ID NO: 4017245 - RNA, 21 nt, Staphylococcus aureus subsp. aureus MW2
uagauuucaaaucaauaccaa

SEQ ID NO: 4017246 - RNA, 15 nt, Staphylococcus aureus subsp. aureus MW2
uagauuuuauaaaaa

SEQ ID NO: 4017247 - RNA, 16 nt, Staphylococcus aureus subsp. aureus MW2
uagauuuuauaaaaag

SEQ ID NO: 4017248 - RNA, 17 nt, Staphylococcus aureus subsp. aureus MW2
uagauuuuauaaaaagu

SEQ ID NO: 4017249 - RNA, 19 nt, Staphylococcus aureus subsp. aureus MW2
uagauuuuauauaaaaaga

SEQ ID NO: 4017250 - RNA, 22 nt, Staphylococcus aureus subsp. aureus MW2
uagauuuuguauuagcaucuga

SEQ ID NO: 4017251 - RNA, 14 nt, Staphylococcus aureus subsp. aureus MW2
uagauuuuuucaua

SEQ ID NO: 4017252 - RNA, 17 nt, Staphylococcus aureus subsp. aureus MW2
uagcaaauauuauuaaa

SEQ ID NO: 4017253 - RNA, 17 nt, Staphylococcus aureus subsp. aureus MW2
uagcaaauauuucuggc

SEQ ID NO: 4017254 - RNA, 22 nt, Staphylococcus aureus subsp. aureus MW2
uagcaaccauauuuuuagaaaa

SEQ ID NO: 4017255 - RNA, 16 nt, Staphylococcus aureus subsp. aureus MW2
uagcaauaucaucauu

SEQ ID NO: 4017256 - RNA, 19 nt, Staphylococcus aureus subsp. aureus MW2
uagcaauuugagcaauucu

SEQ ID NO: 4017257 - RNA, 17 nt, Staphylococcus aureus subsp. aureus MW2
uagcaccagcacaucaa

SEQ ID NO: 4017258 - RNA, 19 nt, Staphylococcus aureus subsp. aureus MW2
uagcaccagcacaucaaag

SEQ ID NO: 4017259 - RNA, 22 nt, Staphylococcus aureus subsp. aureus MW2
uagcaccguaacauauguacua

SEQ ID NO: 4017260 - RNA, 15 nt, Staphylococcus aureus subsp. aureus MW2
uagcacuacaucaag

SEQ ID NO: 4017261 - RNA, 18 nt, Staphylococcus aureus subsp. aureus MW2
uagcaguaauauguugcu

SEQ ID NO: 4017262 - RNA, 18 nt, Staphylococcus aureus subsp. aureus MW2
uagcaguguguaucucuu

SEQ ID NO: 4017263 - RNA, 14 nt, Staphylococcus aureus subsp. aureus MW2
uagcauacauuaag

SEQ ID NO: 4017264 - RNA, 19 nt, Staphylococcus aureus subsp. aureus MW2
uagcauauucgcuuaaaaa

SEQ ID NO: 4017265 - RNA, 17 nt, Staphylococcus aureus subsp. aureus MW2
uagcaucaaaaauaaaa

SEQ ID NO: 4017266 - RNA, 16 nt, Staphylococcus aureus subsp. aureus MW2
uagcaugacauuaagg

SEQ ID NO: 4017267 - RNA, 18 nt, Staphylococcus aureus subsp. aureus MW2
uagcaugauaaaguaugu

SEQ ID NO: 4017268 - RNA, 22 nt, Staphylococcus aureus subsp. aureus MW2
uagcauuagcaaauauuauuaa

SEQ ID NO: 4017269 - RNA, 21 nt, Staphylococcus aureus subsp. aureus MW2
uagcauucccguauaauaguu

SEQ ID NO: 4017270 - RNA, 15 nt, Staphylococcus aureus subsp. aureus MW2
uagcauugccccauc

SEQ ID NO: 4017271 - RNA, 22 nt, Staphylococcus aureus subsp. aureus MW2
uagccaaaggcaaaauguaucg

SEQ ID NO: 4017272 - RNA, 13 nt, Staphylococcus aureus subsp. aureus MW2
uagccaaauaaau

SEQ ID NO: 4017273 - RNA, 20 nt, Staphylococcus aureus subsp. aureus MW2
uagccauugaauagguggcu

SEQ ID NO: 4017274 - RNA, 22 nt, Staphylococcus aureus subsp. aureus MW2
uagcccuuuauacaauuuuuug

SEQ ID NO: 4017275 - RNA, 13 nt, Staphylococcus aureus subsp. aureus MW2
uagccuucauuug

SEQ ID NO: 4017276 - RNA, 14 nt, Staphylococcus aureus subsp. aureus MW2
uagcgaaaacuaaa

SEQ ID NO: 4017277 - RNA, 22 nt, Staphylococcus aureus subsp. aureus MW2
uagcgcucuggauuuuucuuau

SEQ ID NO: 4017278 - RNA, 15 nt, Staphylococcus aureus subsp. aureus MW2
uagcguaauuauuau

SEQ ID NO: 4017279 - RNA, 22 nt, Staphylococcus aureus subsp. aureus MW2
uagcguaauuauuauaauaaau

SEQ ID NO: 4017280 - RNA, 20 nt, Staphylococcus aureus subsp. aureus MW2
uagcguagcauuauuuaaag

SEQ ID NO: 4017281 - RNA, 15 nt, Staphylococcus aureus subsp. aureus MW2
uagcgucaaguuuuc

SEQ ID NO: 4017282 - RNA, 13 nt, Staphylococcus aureus subsp. aureus MW2
uagcgucagcaaa

SEQ ID NO: 4017283 - RNA, 16 nt, Staphylococcus aureus subsp. aureus MW2
uagcgugauuuuucau

SEQ ID NO: 4017284 - RNA, 12 nt, Staphylococcus aureus subsp. aureus MW2
uagcuaaugcaa

SEQ ID NO: 4017285 - RNA, 18 nt, Staphylococcus aureus subsp. aureus MW2
uagcuaaugcaacuaaaa

SEQ ID NO: 4017286 - RNA, 12 nt, Staphylococcus aureus subsp. aureus MW2
uagcuaaugcau

SEQ ID NO: 4017287 - RNA, 18 nt, Staphylococcus aureus subsp. aureus MW2
uagcuaaugcauuauuau

SEQ ID NO: 4017288 - RNA, 14 nt, Staphylococcus aureus subsp. aureus MW2
uagcuaauucacuu

SEQ ID NO: 4017289 - RNA, 17 nt, Staphylococcus aureus subsp. aureus MW2
uagcuacaauuaaagug

SEQ ID NO: 4017290 - RNA, 23 nt, Staphylococcus aureus subsp. aureus MW2
uagcuauaacucuaaauauaaua

SEQ ID NO: 4017291 - RNA, 15 nt, Staphylococcus aureus subsp. aureus MW2
uagcuauuaaaauag

SEQ ID NO: 4017292 - RNA, 20 nt, Staphylococcus aureus subsp. aureus MW2
uagcucaaaacaauuuaaaa

SEQ ID NO: 4017293 - RNA, 12 nt, Staphylococcus aureus subsp. aureus MW2
uagcucuacuaa

SEQ ID NO: 4017294 - RNA, 14 nt, Staphylococcus aureus subsp. aureus MW2
uagcucuucuuuuu

SEQ ID NO: 4017295 - RNA, 20 nt, Staphylococcus aureus subsp. aureus MW2
uagcucuuuuuugauuuaac

SEQ ID NO: 4017296 - RNA, 21 nt, Staphylococcus aureus subsp. aureus MW2
uagcugcaaucguugaaaaau

SEQ ID NO: 4017297 - RNA, 22 nt, Staphylococcus aureus subsp. aureus MW2
uagcuuaauaauuaauaagcau

SEQ ID NO: 4017298 - RNA, 22 nt, Staphylococcus aureus subsp. aureus MW2
uagcuuauuuagaaaguuuuau

SEQ ID NO: 4017299 - RNA, 18 nt, Staphylococcus aureus subsp. aureus MW2
uagcuucgucacguaaaa

SEQ ID NO: 4017300 - RNA, 15 nt, Staphylococcus aureus subsp. aureus MW2
uagcuugaauaauau

SEQ ID NO: 4017301 - RNA, 17 nt, Staphylococcus aureus subsp. aureus MW2
uagcuugaauaauauau

SEQ ID NO: 4017302 - RNA, 15 nt, Staphylococcus aureus subsp. aureus MW2
uagcuuuaguuacua

SEQ ID NO: 4017303 - RNA, 22 nt, Staphylococcus aureus subsp. aureus MW2
uagcuuucgggcuaguuuuuug

SEQ ID NO: 4017304 - RNA, 18 nt, Staphylococcus aureus subsp. aureus MW2
uagcuuucguuucuuuua

SEQ ID NO: 4017305 - RNA, 21 nt, Staphylococcus aureus subsp. aureus MW2
uagcuuuuucaacuaauaacu

SEQ ID NO: 4017306 - RNA, 15 nt, Staphylococcus aureus subsp. aureus MW2
uaggaaaacuucaau

SEQ ID NO: 4017307 - RNA, 20 nt, Staphylococcus aureus subsp. aureus MW2
uaggaaaacuucaauaaugu

SEQ ID NO: 4017308 - RNA, 16 nt, Staphylococcus aureus subsp. aureus MW2
uaggaauuuuuuuaau

SEQ ID NO: 4017309 - RNA, 16 nt, Staphylococcus aureus subsp. aureus MW2
uaggaccucuuauuua

SEQ ID NO: 4017310 - RNA, 16 nt, Staphylococcus aureus subsp. aureus MW2
uaggacuaucuauaau

SEQ ID NO: 4017311 - RNA, 17 nt, Staphylococcus aureus subsp. aureus MW2
uaggauguucaucaaca

SEQ ID NO: 4017312 - RNA, 18 nt, Staphylococcus aureus subsp. aureus MW2
uaggauuuccggaacaau

SEQ ID NO: 4017313 - RNA, 20 nt, Staphylococcus aureus subsp. aureus MW2
uaggcgccauaaucauuagu

SEQ ID NO: 4017314 - RNA, 20 nt, Staphylococcus aureus subsp. aureus MW2
uaggcgcuguuccaaauuca

SEQ ID NO: 4017315 - RNA, 12 nt, Staphylococcus aureus subsp. aureus MW2
uaggcuccuaaa

SEQ ID NO: 4017316 - RNA, 21 nt, Staphylococcus aureus subsp. aureus MW2
uaggcucuuaauguacuuuuc

SEQ ID NO: 4017317 - RNA, 21 nt, Staphylococcus aureus subsp. aureus MW2
uagggcuacucgacacauaua

SEQ ID NO: 4017318 - RNA, 12 nt, Staphylococcus aureus subsp. aureus MW2
uagguaauaauu

SEQ ID NO: 4017319 - RNA, 19 nt, Staphylococcus aureus subsp. aureus MW2
uagguacauaaauaccugg

SEQ ID NO: 4017320 - RNA, 19 nt, Staphylococcus aureus subsp. aureus MW2
uagguauaguguuugacaa

SEQ ID NO: 4017321 - RNA, 17 nt, Staphylococcus aureus subsp. aureus MW2
uagguggagauuuaaca

SEQ ID NO: 4017322 - RNA, 12 nt, Staphylococcus aureus subsp. aureus MW2
uagguuagaauu

SEQ ID NO: 4017323 - RNA, 16 nt, Staphylococcus aureus subsp. aureus MW2
uagguuaguaauauau

SEQ ID NO: 4017324 - RNA, 16 nt, Staphylococcus aureus subsp. aureus MW2
uagguuauuauaaaau

SEQ ID NO: 4017325 - RNA, 20 nt, Staphylococcus aureus subsp. aureus MW2
uagguuauuauaaaauaaau

SEQ ID NO: 4017326 - RNA, 16 nt, Staphylococcus aureus subsp. aureus MW2
uagguucaucuuuaug

SEQ ID NO: 4017327 - RNA, 13 nt, Staphylococcus aureus subsp. aureus MW2
uagguuuaauguu

SEQ ID NO: 4017328 - RNA, 14 nt, Staphylococcus aureus subsp. aureus MW2
uagguuuaauguuu

SEQ ID NO: 4017329 - RNA, 16 nt, Staphylococcus aureus subsp. aureus MW2
uagguuuaauuuuaaa

SEQ ID NO: 4017330 - RNA, 17 nt, Staphylococcus aureus subsp. aureus MW2
uagguuuaauuuuaaau

SEQ ID NO: 4017331 - RNA, 17 nt, Staphylococcus aureus subsp. aureus MW2
uaguaaauaauuuaaau

SEQ ID NO: 4017332 - RNA, 19 nt, Staphylococcus aureus subsp. aureus MW2
uaguaaauaauuuaaauua

SEQ ID NO: 4017333 - RNA, 22 nt, Staphylococcus aureus subsp. aureus MW2
uaguaaauaauuuaaauuaaaa

SEQ ID NO: 4017334 - RNA, 19 nt, Staphylococcus aureus subsp. aureus MW2
uaguaaauauaguuaaagu

SEQ ID NO: 4017335 - RNA, 22 nt, Staphylococcus aureus subsp. aureus MW2
uaguaacagacuuuguuaaaaa

SEQ ID NO: 4017336 - RNA, 21 nt, Staphylococcus aureus subsp. aureus MW2
uaguaaccuaauucuaagucu

SEQ ID NO: 4017337 - RNA, 23 nt, Staphylococcus aureus subsp. aureus MW2
uaguaaccuaauucuaagucuuu

SEQ ID NO: 4017338 - RNA, 17 nt, Staphylococcus aureus subsp. aureus MW2
uaguaagguuugaacuc

SEQ ID NO: 4017339 - RNA, 19 nt, Staphylococcus aureus subsp. aureus MW2
uaguaagguuugaacucug

SEQ ID NO: 4017340 - RNA, 19 nt, Staphylococcus aureus subsp. aureus MW2
uaguaaguagaagcaaaag

SEQ ID NO: 4017341 - RNA, 18 nt, Staphylococcus aureus subsp. aureus MW2
uaguaauagcuauauuuu

SEQ ID NO: 4017342 - RNA, 18 nt, Staphylococcus aureus subsp. aureus MW2
uaguaauaguuaacgaua

SEQ ID NO: 4017343 - RNA, 19 nt, Staphylococcus aureus subsp. aureus MW2
uaguaaugacuaacuuucu

SEQ ID NO: 4017344 - RNA, 14 nt, Staphylococcus aureus subsp. aureus MW2
uaguaaugauguga

SEQ ID NO: 4017345 - RNA, 23 nt, Staphylococcus aureus subsp. aureus MW2
uaguaauucuucaucuucuucaa

SEQ ID NO: 4017346 - RNA, 17 nt, Staphylococcus aureus subsp. aureus MW2
uaguaauuuuuaaaucu

SEQ ID NO: 4017347 - RNA, 19 nt, Staphylococcus aureus subsp. aureus MW2
uaguacaccucuaaguuca

SEQ ID NO: 4017348 - RNA, 14 nt, Staphylococcus aureus subsp. aureus MW2
uaguacacguguau

SEQ ID NO: 4017349 - RNA, 18 nt, Staphylococcus aureus subsp. aureus MW2
uaguacggcugcuuuaac

SEQ ID NO: 4017350 - RNA, 16 nt, Staphylococcus aureus subsp. aureus MW2
uaguacucaauguuag

SEQ ID NO: 4017351 - RNA, 13 nt, Staphylococcus aureus subsp. aureus MW2
uaguacuuaauac

SEQ ID NO: 4017352 - RNA, 18 nt, Staphylococcus aureus subsp. aureus MW2
uaguacuuaauacuaauu

SEQ ID NO: 4017353 - RNA, 22 nt, Staphylococcus aureus subsp. aureus MW2
uaguacuuaauacuaauuuugu

SEQ ID NO: 4017354 - RNA, 20 nt, Staphylococcus aureus subsp. aureus MW2
uaguacuuugauaucuacag

SEQ ID NO: 4017355 - RNA, 16 nt, Staphylococcus aureus subsp. aureus MW2
uaguaguuuauaucaa

SEQ ID NO: 4017356 - RNA, 19 nt, Staphylococcus aureus subsp. aureus MW2
uaguaguuuauaucaaaaa

SEQ ID NO: 4017357 - RNA, 13 nt, Staphylococcus aureus subsp. aureus MW2
uaguauauucaac

SEQ ID NO: 4017358 - RNA, 16 nt, Staphylococcus aureus subsp. aureus MW2
uaguauccuuuauaaa

SEQ ID NO: 4017359 - RNA, 13 nt, Staphylococcus aureus subsp. aureus MW2
uaguaucgauagu

SEQ ID NO: 4017360 - RNA, 19 nt, Staphylococcus aureus subsp. aureus MW2
uaguaugacaaauuaaaaa

SEQ ID NO: 4017361 - RNA, 15 nt, Staphylococcus aureus subsp. aureus MW2
uaguauggaauaaau

SEQ ID NO: 4017362 - RNA, 19 nt, Staphylococcus aureus subsp. aureus MW2
uaguauucaaaaaaauauu

SEQ ID NO: 4017363 - RNA, 20 nt, Staphylococcus aureus subsp. aureus MW2
uaguauucaaaaaaauauuu

SEQ ID NO: 4017364 - RNA, 15 nt, Staphylococcus aureus subsp. aureus MW2
uaguauuucaucauu

SEQ ID NO: 4017365 - RNA, 22 nt, Staphylococcus aureus subsp. aureus MW2
uaguauuucaucauuaguuuuu

SEQ ID NO: 4017366 - RNA, 17 nt, Staphylococcus aureus subsp. aureus MW2
uagucaauuaaugauaa

SEQ ID NO: 4017367 - RNA, 16 nt, Staphylococcus aureus subsp. aureus MW2
uagucauaauuuagaa

SEQ ID NO: 4017368 - RNA, 12 nt, Staphylococcus aureus subsp. aureus MW2
uagucaucuguu

SEQ ID NO: 4017369 - RNA, 22 nt, Staphylococcus aureus subsp. aureus MW2
uagucauguuuggcauaauaau

SEQ ID NO: 4017370 - RNA, 23 nt, Staphylococcus aureus subsp. aureus MW2
uagucauuacaaaucaugacaua

SEQ ID NO: 4017371 - RNA, 17 nt, Staphylococcus aureus subsp. aureus MW2
uagucauugaaaauauu

SEQ ID NO: 4017372 - RNA, 15 nt, Staphylococcus aureus subsp. aureus MW2
uagucgguguuuucu

SEQ ID NO: 4017373 - RNA, 18 nt, Staphylococcus aureus subsp. aureus MW2
uagucgguuauuacaaaa

SEQ ID NO: 4017374 - RNA, 14 nt, Staphylococcus aureus subsp. aureus MW2
uagucugcuauuuu

SEQ ID NO: 4017375 - RNA, 20 nt, Staphylococcus aureus subsp. aureus MW2
uagucuucggcuuuguaaaa

SEQ ID NO: 4017376 - RNA, 23 nt, Staphylococcus aureus subsp. aureus MW2
uagucuuuuuauuuuaauauuuu

SEQ ID NO: 4017377 - RNA, 13 nt, Staphylococcus aureus subsp. aureus MW2
uagugaaaauacc

SEQ ID NO: 4017378 - RNA, 17 nt, Staphylococcus aureus subsp. aureus MW2
uagugaaauaccuccug

SEQ ID NO: 4017379 - RNA, 21 nt, Staphylococcus aureus subsp. aureus MW2
uagugagcccgcaaaucgccu

SEQ ID NO: 4017380 - RNA, 16 nt, Staphylococcus aureus subsp. aureus MW2
uagugauuuuuuacau

SEQ ID NO: 4017381 - RNA, 17 nt, Staphylococcus aureus subsp. aureus MW2
uagugcaaguaauuuaa

SEQ ID NO: 4017382 - RNA, 22 nt, Staphylococcus aureus subsp. aureus MW2
uagugcuuuuuauuuuuauuca

SEQ ID NO: 4017383 - RNA, 14 nt, Staphylococcus aureus subsp. aureus MW2
uagugcuuuuucaa

SEQ ID NO: 4017384 - RNA, 23 nt, Staphylococcus aureus subsp. aureus MW2
uaguggaagacaaugauuugugg

SEQ ID NO: 4017385 - RNA, 19 nt, Staphylococcus aureus subsp. aureus MW2
uagugguucugauguuuua

SEQ ID NO: 4017386 - RNA, 15 nt, Staphylococcus aureus subsp. aureus MW2
uaguguacacgaauu

SEQ ID NO: 4017387 - RNA, 14 nt, Staphylococcus aureus subsp. aureus MW2
uagugucacauuau

SEQ ID NO: 4017388 - RNA, 17 nt, Staphylococcus aureus subsp. aureus MW2
uaguguuauauuguauu

SEQ ID NO: 4017389 - RNA, 12 nt, Staphylococcus aureus subsp. aureus MW2
uaguuaaauaca

SEQ ID NO: 4017390 - RNA, 21 nt, Staphylococcus aureus subsp. aureus MW2
uaguuaagauaccuuuuucua

SEQ ID NO: 4017391 - RNA, 17 nt, Staphylococcus aureus subsp. aureus MW2
uaguuagcccuauucaa

SEQ ID NO: 4017392 - RNA, 18 nt, Staphylococcus aureus subsp. aureus MW2
uaguucagcuucuaagua

SEQ ID NO: 4017393 - RNA, 12 nt, Staphylococcus aureus subsp. aureus MW2
uaguucuguuga

SEQ ID NO: 4017394 - RNA, 20 nt, Staphylococcus aureus subsp. aureus MW2
uaguugaaauguuuauaaua

SEQ ID NO: 4017395 - RNA, 18 nt, Staphylococcus aureus subsp. aureus MW2
uaguugacuguaaaacaa

SEQ ID NO: 4017396 - RNA, 23 nt, Staphylococcus aureus subsp. aureus MW2
uaguuggacaaauucuaugagaa

SEQ ID NO: 4017397 - RNA, 18 nt, Staphylococcus aureus subsp. aureus MW2
uaguuguuuauuauagaa

SEQ ID NO: 4017398 - RNA, 13 nt, Staphylococcus aureus subsp. aureus MW2
uaguuuauaauuu

SEQ ID NO: 4017399 - RNA, 18 nt, Staphylococcus aureus subsp. aureus MW2
uaguuucugacuuuuaaa

SEQ ID NO: 4017400 - RNA, 15 nt, Staphylococcus aureus subsp. aureus MW2
uaguuugaauuggga

SEQ ID NO: 4017401 - RNA, 20 nt, Staphylococcus aureus subsp. aureus MW2
uaguuugacaucuauuucuu

SEQ ID NO: 4017402 - RNA, 15 nt, Staphylococcus aureus subsp. aureus MW2
uaguuuguaauaauu

SEQ ID NO: 4017403 - RNA, 16 nt, Staphylococcus aureus subsp. aureus MW2
uaguuuuaauauaauu

SEQ ID NO: 4017404 - RNA, 13 nt, Staphylococcus aureus subsp. aureus MW2
uaguuuuaauauu

SEQ ID NO: 4017405 - RNA, 15 nt, Staphylococcus aureus subsp. aureus MW2
uaguuuuaauauuuu

SEQ ID NO: 4017406 - RNA, 15 nt, Staphylococcus aureus subsp. aureus MW2
uaguuuuucauauuc

SEQ ID NO: 4017407 - RNA, 13 nt, Staphylococcus aureus subsp. aureus MW2
uauaaaaacaaaa

SEQ ID NO: 4017408 - RNA, 19 nt, Staphylococcus aureus subsp. aureus MW2
uauaaaaaccaguuugauu

SEQ ID NO: 4017409 - RNA, 14 nt, Staphylococcus aureus subsp. aureus MW2
uauaaaaagaauau

SEQ ID NO: 4017410 - RNA, 23 nt, Staphylococcus aureus subsp. aureus MW2
uauaaaaagucccgcuuaaaaug

SEQ ID NO: 4017411 - RNA, 20 nt, Staphylococcus aureus subsp. aureus MW2
uauaaaaauguauuaaauau

SEQ ID NO: 4017412 - RNA, 22 nt, Staphylococcus aureus subsp. aureus MW2
uauaaaacagaauuucaucaaa

SEQ ID NO: 4017413 - RNA, 17 nt, Staphylococcus aureus subsp. aureus MW2
uauaaaacgauaagaau

SEQ ID NO: 4017414 - RNA, 20 nt, Staphylococcus aureus subsp. aureus MW2
uauaaaacgauaagaauuaa

SEQ ID NO: 4017415 - RNA, 22 nt, Staphylococcus aureus subsp. aureus MW2
uauaaaagcaauucguaacaca

SEQ ID NO: 4017416 - RNA, 21 nt, Staphylococcus aureus subsp. aureus MW2
uauaaaagcacuauuuuuaua

SEQ ID NO: 4017417 - RNA, 14 nt, Staphylococcus aureus subsp. aureus MW2
uauaaaauaaaaug

SEQ ID NO: 4017418 - RNA, 22 nt, Staphylococcus aureus subsp. aureus MW2
uauaaaauaaugcuuauuaaaa

SEQ ID NO: 4017419 - RNA, 21 nt, Staphylococcus aureus subsp. aureus MW2
uauaaaauaugagauuaucug

SEQ ID NO: 4017420 - RNA, 15 nt, Staphylococcus aureus subsp. aureus MW2
uauaaaaucauuaau

SEQ ID NO: 4017421 - RNA, 16 nt, Staphylococcus aureus subsp. aureus MW2
uauaaaauucaccaac

SEQ ID NO: 4017422 - RNA, 17 nt, Staphylococcus aureus subsp. aureus MW2
uauaaacaauuacaaaa

SEQ ID NO: 4017423 - RNA, 23 nt, Staphylococcus aureus subsp. aureus MW2
uauaaacaauuacaaaaucaccu

SEQ ID NO: 4017424 - RNA, 16 nt, Staphylococcus aureus subsp. aureus MW2
uauaaacauaucuucu

SEQ ID NO: 4017425 - RNA, 17 nt, Staphylococcus aureus subsp. aureus MW2
uauaaaccgccaacuaa

SEQ ID NO: 4017426 - RNA, 18 nt, Staphylococcus aureus subsp. aureus MW2
uauaaacgcaaauuaaau

SEQ ID NO: 4017427 - RNA, 21 nt, Staphylococcus aureus subsp. aureus MW2
uauaaacgucacuuuauuaaa

SEQ ID NO: 4017428 - RNA, 20 nt, Staphylococcus aureus subsp. aureus MW2
uauaaagaaugauuuauaaa

SEQ ID NO: 4017429 - RNA, 18 nt, Staphylococcus aureus subsp. aureus MW2
uauaaagacgauuuauua

SEQ ID NO: 4017430 - RNA, 22 nt, Staphylococcus aureus subsp. aureus MW2
uauaaaggaauagcuacaauua

SEQ ID NO: 4017431 - RNA, 16 nt, Staphylococcus aureus subsp. aureus MW2
uauaaagucguaucau

SEQ ID NO: 4017432 - RNA, 13 nt, Staphylococcus aureus subsp. aureus MW2
uauaaaguugaca

SEQ ID NO: 4017433 - RNA, 21 nt, Staphylococcus aureus subsp. aureus MW2
uauaaaguugacaauacaaau

SEQ ID NO: 4017434 - RNA, 14 nt, Staphylococcus aureus subsp. aureus MW2
uauaaauaaaaaua

SEQ ID NO: 4017435 - RNA, 13 nt, Staphylococcus aureus subsp. aureus MW2
uauaaauaaacau

SEQ ID NO: 4017436 - RNA, 20 nt, Staphylococcus aureus subsp. aureus MW2
uauaaauaaacauaaaaaua

SEQ ID NO: 4017437 - RNA, 22 nt, Staphylococcus aureus subsp. aureus MW2
uauaaauaaacauaaaaauauu

SEQ ID NO: 4017438 - RNA, 20 nt, Staphylococcus aureus subsp. aureus MW2
uauaaauaaccgcacuuucu

SEQ ID NO: 4017439 - RNA, 23 nt, Staphylococcus aureus subsp. aureus MW2
uauaaauaggucacuuuuaaucu

SEQ ID NO: 4017440 - RNA, 13 nt, Staphylococcus aureus subsp. aureus MW2
uauaaauaucaau

SEQ ID NO: 4017441 - RNA, 20 nt, Staphylococcus aureus subsp. aureus MW2
uauaaauaucauaaaugcau

SEQ ID NO: 4017442 - RNA, 13 nt, Staphylococcus aureus subsp. aureus MW2
uauaaauaucuuu

SEQ ID NO: 4017443 - RNA, 15 nt, Staphylococcus aureus subsp. aureus MW2
uauaaauauuuuuua

SEQ ID NO: 4017444 - RNA, 15 nt, Staphylococcus aureus subsp. aureus MW2
uauaaaugucauagu

SEQ ID NO: 4017445 - RNA, 16 nt, Staphylococcus aureus subsp. aureus MW2
uauaaauguuauugcu

SEQ ID NO: 4017446 - RNA, 15 nt, Staphylococcus aureus subsp. aureus MW2
uauaaauuaucagaa

SEQ ID NO: 4017447 - RNA, 11 nt, Staphylococcus aureus subsp. aureus MW2
uauaaauuaug

SEQ ID NO: 4017448 - RNA, 20 nt, Staphylococcus aureus subsp. aureus MW2
uauaacaaaaauugcuauau

SEQ ID NO: 4017449 - RNA, 15 nt, Staphylococcus aureus subsp. aureus MW2
uauaacaauauuaaa

SEQ ID NO: 4017450 - RNA, 19 nt, Staphylococcus aureus subsp. aureus MW2
uauaacaauuuuagacuac

SEQ ID NO: 4017451 - RNA, 20 nt, Staphylococcus aureus subsp. aureus MW2
uauaacacuucguauugaau

SEQ ID NO: 4017452 - RNA, 21 nt, Staphylococcus aureus subsp. aureus MW2
uauaacauguauauggcauua

SEQ ID NO: 4017453 - RNA, 12 nt, Staphylococcus aureus subsp. aureus MW2
uauaacauuaaa

SEQ ID NO: 4017454 - RNA, 13 nt, Staphylococcus aureus subsp. aureus MW2
uauaaccauaaug

SEQ ID NO: 4017455 - RNA, 18 nt, Staphylococcus aureus subsp. aureus MW2
uauaacccuaaugugugg

SEQ ID NO: 4017456 - RNA, 17 nt, Staphylococcus aureus subsp. aureus MW2
uauaaccgcuacaauua

SEQ ID NO: 4017457 - RNA, 21 nt, Staphylococcus aureus subsp. aureus MW2
uauaaccgugaugaugugcaa

SEQ ID NO: 4017458 - RNA, 16 nt, Staphylococcus aureus subsp. aureus MW2
uauaacgcuuuaaauc

SEQ ID NO: 4017459 - RNA, 20 nt, Staphylococcus aureus subsp. aureus MW2
uauaacugcauguacaucuu

SEQ ID NO: 4017460 - RNA, 21 nt, Staphylococcus aureus subsp. aureus MW2
uauaacugcauguacaucuuu

SEQ ID NO: 4017461 - RNA, 15 nt, Staphylococcus aureus subsp. aureus MW2
uauaacuuuaaaaau

SEQ ID NO: 4017462 - RNA, 16 nt, Staphylococcus aureus subsp. aureus MW2
uauaacuuuaaaaauu

SEQ ID NO: 4017463 - RNA, 18 nt, Staphylococcus aureus subsp. aureus MW2
uauaacuuuaaaaauuaa

SEQ ID NO: 4017464 - RNA, 14 nt, Staphylococcus aureus subsp. aureus MW2
uauaagaaaaagac

SEQ ID NO: 4017465 - RNA, 20 nt, Staphylococcus aureus subsp. aureus MW2
uauaagaauuguugaucaug

SEQ ID NO: 4017466 - RNA, 22 nt, Staphylococcus aureus subsp. aureus MW2
uauaagaauuguugaucaugag

SEQ ID NO: 4017467 - RNA, 16 nt, Staphylococcus aureus subsp. aureus MW2
uauaagauucauauuu

SEQ ID NO: 4017468 - RNA, 14 nt, Staphylococcus aureus subsp. aureus MW2
uauaagauuucuca

SEQ ID NO: 4017469 - RNA, 13 nt, Staphylococcus aureus subsp. aureus MW2
uauaagcaaagac

SEQ ID NO: 4017470 - RNA, 15 nt, Staphylococcus aureus subsp. aureus MW2
uauaagccuuuucaa

SEQ ID NO: 4017471 - RNA, 22 nt, Staphylococcus aureus subsp. aureus MW2
uauaagccuuuucaaacauauu

SEQ ID NO: 4017472 - RNA, 14 nt, Staphylococcus aureus subsp. aureus MW2
uauaaguauaauga

SEQ ID NO: 4017473 - RNA, 17 nt, Staphylococcus aureus subsp. aureus MW2
uauaaguauuuugaauu

SEQ ID NO: 4017474 - RNA, 18 nt, Staphylococcus aureus subsp. aureus MW2
uauaaguauuuugaauuu

SEQ ID NO: 4017475 - RNA, 13 nt, Staphylococcus aureus subsp. aureus MW2
uauaaguuaaaaa

SEQ ID NO: 4017476 - RNA, 19 nt, Staphylococcus aureus subsp. aureus MW2
uauaaguuugguucaguag

SEQ ID NO: 4017477 - RNA, 13 nt, Staphylococcus aureus subsp. aureus MW2
uauaauaaagauu

SEQ ID NO: 4017478 - RNA, 21 nt, Staphylococcus aureus subsp. aureus MW2
uauaauaaagauuauaucuuu

SEQ ID NO: 4017479 - RNA, 19 nt, Staphylococcus aureus subsp. aureus MW2
uauaauaaccuacauuaau

SEQ ID NO: 4017480 - RNA, 11 nt, Staphylococcus aureus subsp. aureus MW2
uauaauaauau

SEQ ID NO: 4017481 - RNA, 13 nt, Staphylococcus aureus subsp. aureus MW2
uauaauaauauug

SEQ ID NO: 4017482 - RNA, 15 nt, Staphylococcus aureus subsp. aureus MW2
uauaauaauauugaa

SEQ ID NO: 4017483 - RNA, 17 nt, Staphylococcus aureus subsp. aureus MW2
uauaauacaugauauaa

SEQ ID NO: 4017484 - RNA, 13 nt, Staphylococcus aureus subsp. aureus MW2
uauaauaccccaa

SEQ ID NO: 4017485 - RNA, 13 nt, Staphylococcus aureus subsp. aureus MW2
uauaauaccuaca

SEQ ID NO: 4017486 - RNA, 13 nt, Staphylococcus aureus subsp. aureus MW2
uauaauagagaaa

SEQ ID NO: 4017487 - RNA, 18 nt, Staphylococcus aureus subsp. aureus MW2
uauaauagagaaacguaa

SEQ ID NO: 4017488 - RNA, 16 nt, Staphylococcus aureus subsp. aureus MW2
uauaauauauacaaau

SEQ ID NO: 4017489 - RNA, 18 nt, Staphylococcus aureus subsp. aureus MW2
uauaauauauacaaauaa

SEQ ID NO: 4017490 - RNA, 19 nt, Staphylococcus aureus subsp. aureus MW2
uauaauauauacaaauaaa

SEQ ID NO: 4017491 - RNA, 20 nt, Staphylococcus aureus subsp. aureus MW2
uauaauauauacaaauaaac

SEQ ID NO: 4017492 - RNA, 14 nt, Staphylococcus aureus subsp. aureus MW2
uauaaucuaucuug

SEQ ID NO: 4017493 - RNA, 18 nt, Staphylococcus aureus subsp. aureus MW2
uauaaucuaucuugugcu

SEQ ID NO: 4017494 - RNA, 14 nt, Staphylococcus aureus subsp. aureus MW2
uauaaugaccaucu

SEQ ID NO: 4017495 - RNA, 21 nt, Staphylococcus aureus subsp. aureus MW2
uauaauggacgguauuuucaa

SEQ ID NO: 4017496 - RNA, 18 nt, Staphylococcus aureus subsp. aureus MW2
uauaaugguucuaaaaua

SEQ ID NO: 4017497 - RNA, 14 nt, Staphylococcus aureus subsp. aureus MW2
uauaauguauaaaa

SEQ ID NO: 4017498 - RNA, 15 nt, Staphylococcus aureus subsp. aureus MW2
uauaauuaaacauuu

SEQ ID NO: 4017499 - RNA, 13 nt, Staphylococcus aureus subsp. aureus MW2
uauaauuauuaaa

SEQ ID NO: 4017500 - RNA, 14 nt, Staphylococcus aureus subsp. aureus MW2
uauaauuauuaaac

SEQ ID NO: 4017501 - RNA, 14 nt, Staphylococcus aureus subsp. aureus MW2
uauaauuccugaaa

SEQ ID NO: 4017502 - RNA, 17 nt, Staphylococcus aureus subsp. aureus MW2
uauaauucuaagucucu

SEQ ID NO: 4017503 - RNA, 19 nt, Staphylococcus aureus subsp. aureus MW2
uauaauucuuguuugauuu

SEQ ID NO: 4017504 - RNA, 17 nt, Staphylococcus aureus subsp. aureus MW2
uauaauuuauaaaaaga

SEQ ID NO: 4017505 - RNA, 12 nt, Staphylococcus aureus subsp. aureus MW2
uauaauuuauuu

SEQ ID NO: 4017506 - RNA, 18 nt, Staphylococcus aureus subsp. aureus MW2
uauaauuucuaaaucuaa

SEQ ID NO: 4017507 - RNA, 20 nt, Staphylococcus aureus subsp. aureus MW2
uauaauuucuguuuacgcca

SEQ ID NO: 4017508 - RNA, 12 nt, Staphylococcus aureus subsp. aureus MW2
uauaauuuuggc

SEQ ID NO: 4017509 - RNA, 13 nt, Staphylococcus aureus subsp. aureus MW2
uauacaaauuuau

SEQ ID NO: 4017510 - RNA, 19 nt, Staphylococcus aureus subsp. aureus MW2
uauacacaaaguauuugaa

SEQ ID NO: 4017511 - RNA, 20 nt, Staphylococcus aureus subsp. aureus MW2
uauacacuuuuugacauauu

SEQ ID NO: 4017512 - RNA, 16 nt, Staphylococcus aureus subsp. aureus MW2
uauacagguuuaauaa

SEQ ID NO: 4017513 - RNA, 21 nt, Staphylococcus aureus subsp. aureus MW2
uauacauaccacacuuuaaac

SEQ ID NO: 4017514 - RNA, 16 nt, Staphylococcus aureus subsp. aureus MW2
uauacauguaacagug

SEQ ID NO: 4017515 - RNA, 21 nt, Staphylococcus aureus subsp. aureus MW2
uauacauguaacagugugaaa

SEQ ID NO: 4017516 - RNA, 22 nt, Staphylococcus aureus subsp. aureus MW2
uauacauuaacgauuaauauaa

SEQ ID NO: 4017517 - RNA, 14 nt, Staphylococcus aureus subsp. aureus MW2
uauaccaaccaaaa

SEQ ID NO: 4017518 - RNA, 21 nt, Staphylococcus aureus subsp. aureus MW2
uauaccucuuagcacuuggau

SEQ ID NO: 4017519 - RNA, 20 nt, Staphylococcus aureus subsp. aureus MW2
uauacgagaauaugaucuaa

SEQ ID NO: 4017520 - RNA, 15 nt, Staphylococcus aureus subsp. aureus MW2
uauacuaaacuuuuu

SEQ ID NO: 4017521 - RNA, 12 nt, Staphylococcus aureus subsp. aureus MW2
uauacuaaauug

SEQ ID NO: 4017522 - RNA, 17 nt, Staphylococcus aureus subsp. aureus MW2
uauacuacuauugauau

SEQ ID NO: 4017523 - RNA, 13 nt, Staphylococcus aureus subsp. aureus MW2
uauacuauauaau

SEQ ID NO: 4017524 - RNA, 20 nt, Staphylococcus aureus subsp. aureus MW2
uauacugcccaauguguuua

SEQ ID NO: 4017525 - RNA, 21 nt, Staphylococcus aureus subsp. aureus MW2
uauacuuuaucuauuucuaua

SEQ ID NO: 4017526 - RNA, 15 nt, Staphylococcus aureus subsp. aureus MW2
uauacuuuuauagaa

SEQ ID NO: 4017527 - RNA, 20 nt, Staphylococcus aureus subsp. aureus MW2
uauacuuuuggucuguugaa

SEQ ID NO: 4017528 - RNA, 14 nt, Staphylococcus aureus subsp. aureus MW2
uauacuuuuuaaau

SEQ ID NO: 4017529 - RNA, 21 nt, Staphylococcus aureus subsp. aureus MW2
uauagaaaaagggcaaaaaag

SEQ ID NO: 4017530 - RNA, 18 nt, Staphylococcus aureus subsp. aureus MW2
uauagaaauaauuuaaag

SEQ ID NO: 4017531 - RNA, 18 nt, Staphylococcus aureus subsp. aureus MW2
uauagaagcugaacguaa

SEQ ID NO: 4017532 - RNA, 13 nt, Staphylococcus aureus subsp. aureus MW2
uauagaauaccaa

SEQ ID NO: 4017533 - RNA, 16 nt, Staphylococcus aureus subsp. aureus MW2
uauagaaugauuaaaa

SEQ ID NO: 4017534 - RNA, 22 nt, Staphylococcus aureus subsp. aureus MW2
uauagaccguugaaauguucaa

SEQ ID NO: 4017535 - RNA, 16 nt, Staphylococcus aureus subsp. aureus MW2
uauagaggauauuuau

SEQ ID NO: 4017536 - RNA, 18 nt, Staphylococcus aureus subsp. aureus MW2
uauagaugacuguagaaa

SEQ ID NO: 4017537 - RNA, 21 nt, Staphylococcus aureus subsp. aureus MW2
uauagaugacuguagaaaaca

SEQ ID NO: 4017538 - RNA, 15 nt, Staphylococcus aureus subsp. aureus MW2
uauagaugugucuuu

SEQ ID NO: 4017539 - RNA, 21 nt, Staphylococcus aureus subsp. aureus MW2
uauagcacgcuuauugaaaag

SEQ ID NO: 4017540 - RNA, 19 nt, Staphylococcus aureus subsp. aureus MW2
uauagcaucauaaaguaaa

SEQ ID NO: 4017541 - RNA, 21 nt, Staphylococcus aureus subsp. aureus MW2
uauagccaaaggcaaaaugua

SEQ ID NO: 4017542 - RNA, 20 nt, Staphylococcus aureus subsp. aureus MW2
uauagccgccuuuuaacaua

SEQ ID NO: 4017543 - RNA, 13 nt, Staphylococcus aureus subsp. aureus MW2
uauagccuucauu

SEQ ID NO: 4017544 - RNA, 18 nt, Staphylococcus aureus subsp. aureus MW2
uauagcuuuggaugauuc

SEQ ID NO: 4017545 - RNA, 18 nt, Staphylococcus aureus subsp. aureus MW2
uauaggaauuuuuuuaau

SEQ ID NO: 4017546 - RNA, 17 nt, Staphylococcus aureus subsp. aureus MW2
uauagggcgcacauuau

SEQ ID NO: 4017547 - RNA, 19 nt, Staphylococcus aureus subsp. aureus MW2
uauaggugcaguuaaauua

SEQ ID NO: 4017548 - RNA, 21 nt, Staphylococcus aureus subsp. aureus MW2
uauaggugcaguuaaauuaaa

SEQ ID NO: 4017549 - RNA, 21 nt, Staphylococcus aureus subsp. aureus MW2
uauaguaacgcauaugauugc

SEQ ID NO: 4017550 - RNA, 18 nt, Staphylococcus aureus subsp. aureus MW2
uauaguaagaaaagucac

SEQ ID NO: 4017551 - RNA, 14 nt, Staphylococcus aureus subsp. aureus MW2
uauagucaucuguu

SEQ ID NO: 4017552 - RNA, 15 nt, Staphylococcus aureus subsp. aureus MW2
uauagucuuaaacau

SEQ ID NO: 4017553 - RNA, 20 nt, Staphylococcus aureus subsp. aureus MW2
uauagucuuaaacauaacau

SEQ ID NO: 4017554 - RNA, 22 nt, Staphylococcus aureus subsp. aureus MW2
uauagugcuuguuuauuacaua

SEQ ID NO: 4017555 - RNA, 14 nt, Staphylococcus aureus subsp. aureus MW2
uauagugguaaaaa

SEQ ID NO: 4017556 - RNA, 19 nt, Staphylococcus aureus subsp. aureus MW2
uauaguguuuuauucgaua

SEQ ID NO: 4017557 - RNA, 16 nt, Staphylococcus aureus subsp. aureus MW2
uauaguuggcaauccu

SEQ ID NO: 4017558 - RNA, 20 nt, Staphylococcus aureus subsp. aureus MW2
uauauaaaguugacaauaca

SEQ ID NO: 4017559 - RNA, 21 nt, Staphylococcus aureus subsp. aureus MW2
uauauaaaguugacaauacaa

SEQ ID NO: 4017560 - RNA, 23 nt, Staphylococcus aureus subsp. aureus MW2
uauauaaaguugacaauacaaau

SEQ ID NO: 4017561 - RNA, 20 nt, Staphylococcus aureus subsp. aureus MW2
uauauaaccauaguaacaaa

SEQ ID NO: 4017562 - RNA, 21 nt, Staphylococcus aureus subsp. aureus MW2
uauauaaccauaguaacaaaa

SEQ ID NO: 4017563 - RNA, 19 nt, Staphylococcus aureus subsp. aureus MW2
uauauaacgcuuuaaauca

SEQ ID NO: 4017564 - RNA, 14 nt, Staphylococcus aureus subsp. aureus MW2
uauauaagcaaaga

SEQ ID NO: 4017565 - RNA, 18 nt, Staphylococcus aureus subsp. aureus MW2
uauauaauuuauaaaaag

SEQ ID NO: 4017566 - RNA, 18 nt, Staphylococcus aureus subsp. aureus MW2
uauauaccuugaacauag

SEQ ID NO: 4017567 - RNA, 20 nt, Staphylococcus aureus subsp. aureus MW2
uauauagaaauaauuuaaag

SEQ ID NO: 4017568 - RNA, 16 nt, Staphylococcus aureus subsp. aureus MW2
uauauagauugccauu

SEQ ID NO: 4017569 - RNA, 19 nt, Staphylococcus aureus subsp. aureus MW2
uauauagauugccauucau

SEQ ID NO: 4017570 - RNA, 21 nt, Staphylococcus aureus subsp. aureus MW2
uauauagcacgcuuauugaaa

SEQ ID NO: 4017571 - RNA, 13 nt, Staphylococcus aureus subsp. aureus MW2
uauauauauuaaa

SEQ ID NO: 4017572 - RNA, 18 nt, Staphylococcus aureus subsp. aureus MW2
uauauaucacaacacaua

SEQ ID NO: 4017573 - RNA, 21 nt, Staphylococcus aureus subsp. aureus MW2
uauauaucacaacacauaaau

SEQ ID NO: 4017574 - RNA, 17 nt, Staphylococcus aureus subsp. aureus MW2
uauauaucacauauuau

SEQ ID NO: 4017575 - RNA, 18 nt, Staphylococcus aureus subsp. aureus MW2
uauauauccuguuucaua

SEQ ID NO: 4017576 - RNA, 15 nt, Staphylococcus aureus subsp. aureus MW2
uauauauuaaaguaa

SEQ ID NO: 4017577 - RNA, 21 nt, Staphylococcus aureus subsp. aureus MW2
uauauauuccacgcucacauu

SEQ ID NO: 4017578 - RNA, 14 nt, Staphylococcus aureus subsp. aureus MW2
uauauauugucuuu

SEQ ID NO: 4017579 - RNA, 14 nt, Staphylococcus aureus subsp. aureus MW2
uauauauuuugcaa

SEQ ID NO: 4017580 - RNA, 19 nt, Staphylococcus aureus subsp. aureus MW2
uauaucaaauacauuucaa

SEQ ID NO: 4017581 - RNA, 23 nt, Staphylococcus aureus subsp. aureus MW2
uauaucaaauacauuucaaaaaa

SEQ ID NO: 4017582 - RNA, 19 nt, Staphylococcus aureus subsp. aureus MW2
uauauccaguuaauuauuu

SEQ ID NO: 4017583 - RNA, 23 nt, Staphylococcus aureus subsp. aureus MW2
uauauccaguuaauuauuuagau

SEQ ID NO: 4017584 - RNA, 14 nt, Staphylococcus aureus subsp. aureus MW2
uauauccauucaau

SEQ ID NO: 4017585 - RNA, 19 nt, Staphylococcus aureus subsp. aureus MW2
uauaucuuaaguacauaaa

SEQ ID NO: 4017586 - RNA, 14 nt, Staphylococcus aureus subsp. aureus MW2
uauaucuuuauaug

SEQ ID NO: 4017587 - RNA, 21 nt, Staphylococcus aureus subsp. aureus MW2
uauaucuuuauuuuuuaucau

SEQ ID NO: 4017588 - RNA, 14 nt, Staphylococcus aureus subsp. aureus MW2
uauaugaaaagaga

SEQ ID NO: 4017589 - RNA, 18 nt, Staphylococcus aureus subsp. aureus MW2
uauaugaaauauuuaucu

SEQ ID NO: 4017590 - RNA, 12 nt, Staphylococcus aureus subsp. aureus MW2
uauauggaauac

SEQ ID NO: 4017591 - RNA, 14 nt, Staphylococcus aureus subsp. aureus MW2
uauauggaauacua

SEQ ID NO: 4017592 - RNA, 15 nt, Staphylococcus aureus subsp. aureus MW2
uauauggcaucauca

SEQ ID NO: 4017593 - RNA, 19 nt, Staphylococcus aureus subsp. aureus MW2
uauauggcaucaucaccau

SEQ ID NO: 4017594 - RNA, 16 nt, Staphylococcus aureus subsp. aureus MW2
uauauguaacaaaugc

SEQ ID NO: 4017595 - RNA, 16 nt, Staphylococcus aureus subsp. aureus MW2
uauauguaauuagagu

SEQ ID NO: 4017596 - RNA, 22 nt, Staphylococcus aureus subsp. aureus MW2
uauauguaauuagaguagaaag

SEQ ID NO: 4017597 - RNA, 23 nt, Staphylococcus aureus subsp. aureus MW2
uauauguaggggagucuuauuuu

SEQ ID NO: 4017598 - RNA, 21 nt, Staphylococcus aureus subsp. aureus MW2
uauaugucucucuuucuuauu

SEQ ID NO: 4017599 - RNA, 17 nt, Staphylococcus aureus subsp. aureus MW2
uauauguguguugcuuu

SEQ ID NO: 4017600 - RNA, 20 nt, Staphylococcus aureus subsp. aureus MW2
uauauuaaaaaucaaaauaa

SEQ ID NO: 4017601 - RNA, 15 nt, Staphylococcus aureus subsp. aureus MW2
uauauuaaaguaaaa

SEQ ID NO: 4017602 - RNA, 19 nt, Staphylococcus aureus subsp. aureus MW2
uauauuaaauuuacaaaaa

SEQ ID NO: 4017603 - RNA, 20 nt, Staphylococcus aureus subsp. aureus MW2
uauauuaagacguuguaaug

SEQ ID NO: 4017604 - RNA, 15 nt, Staphylococcus aureus subsp. aureus MW2
uauauuaauaaucuu

SEQ ID NO: 4017605 - RNA, 16 nt, Staphylococcus aureus subsp. aureus MW2
uauauuaauauuugau

SEQ ID NO: 4017606 - RNA, 17 nt, Staphylococcus aureus subsp. aureus MW2
uauauuacccuccuauu

SEQ ID NO: 4017607 - RNA, 12 nt, Staphylococcus aureus subsp. aureus MW2
uauauuauaaaa

SEQ ID NO: 4017608 - RNA, 14 nt, Staphylococcus aureus subsp. aureus MW2
uauauuauaaaaau

SEQ ID NO: 4017609 - RNA, 16 nt, Staphylococcus aureus subsp. aureus MW2
uauauucaucucuuau

SEQ ID NO: 4017610 - RNA, 17 nt, Staphylococcus aureus subsp. aureus MW2
uauauucaucucuuaua

SEQ ID NO: 4017611 - RNA, 18 nt, Staphylococcus aureus subsp. aureus MW2
uauauuccacgcucacau

SEQ ID NO: 4017612 - RNA, 12 nt, Staphylococcus aureus subsp. aureus MW2
uauauuuaaacu

SEQ ID NO: 4017613 - RNA, 16 nt, Staphylococcus aureus subsp. aureus MW2
uauauuuauuuuugau

SEQ ID NO: 4017614 - RNA, 17 nt, Staphylococcus aureus subsp. aureus MW2
uauauuuauuuuugaua

SEQ ID NO: 4017615 - RNA, 11 nt, Staphylococcus aureus subsp. aureus MW2
uauauuuuaag

SEQ ID NO: 4017616 - RNA, 15 nt, Staphylococcus aureus subsp. aureus MW2
uauauuuuauuagau

SEQ ID NO: 4017617 - RNA, 16 nt, Staphylococcus aureus subsp. aureus MW2
uauauuuuguuaauaa

SEQ ID NO: 4017618 - RNA, 15 nt, Staphylococcus aureus subsp. aureus MW2
uauauuuuuauuaau

SEQ ID NO: 4017619 - RNA, 16 nt, Staphylococcus aureus subsp. aureus MW2
uauauuuuuuguacau

SEQ ID NO: 4017620 - RNA, 15 nt, Staphylococcus aureus subsp. aureus MW2
uaucaaaaaaacaaa

SEQ ID NO: 4017621 - RNA, 23 nt, Staphylococcus aureus subsp. aureus MW2
uaucaaaaaaacaaaaaauaauu

SEQ ID NO: 4017622 - RNA, 21 nt, Staphylococcus aureus subsp. aureus MW2
uaucaaaaccgcuauaaaauu

SEQ ID NO: 4017623 - RNA, 16 nt, Staphylococcus aureus subsp. aureus MW2
uaucaaaauauaaaau

SEQ ID NO: 4017624 - RNA, 17 nt, Staphylococcus aureus subsp. aureus MW2
uaucaaaauauaaaauc

SEQ ID NO: 4017625 - RNA, 22 nt, Staphylococcus aureus subsp. aureus MW2
uaucaaauagcccuuuauacaa

SEQ ID NO: 4017626 - RNA, 18 nt, Staphylococcus aureus subsp. aureus MW2
uaucaaauuaccauucau

SEQ ID NO: 4017627 - RNA, 14 nt, Staphylococcus aureus subsp. aureus MW2
uaucaacaaauuuu

SEQ ID NO: 4017628 - RNA, 14 nt, Staphylococcus aureus subsp. aureus MW2
uaucaacaauggaa

SEQ ID NO: 4017629 - RNA, 16 nt, Staphylococcus aureus subsp. aureus MW2
uaucaacauaauauuu

SEQ ID NO: 4017630 - RNA, 15 nt, Staphylococcus aureus subsp. aureus MW2
uaucaacauauuuau

SEQ ID NO: 4017631 - RNA, 15 nt, Staphylococcus aureus subsp. aureus MW2
uaucaacauuaauaa

SEQ ID NO: 4017632 - RNA, 16 nt, Staphylococcus aureus subsp. aureus MW2
uaucaacuugaaugua

SEQ ID NO: 4017633 - RNA, 19 nt, Staphylococcus aureus subsp. aureus MW2
uaucaagaacuuuaaaaau

SEQ ID NO: 4017634 - RNA, 22 nt, Staphylococcus aureus subsp. aureus MW2
uaucaagaauauaacgaauguu

SEQ ID NO: 4017635 - RNA, 16 nt, Staphylococcus aureus subsp. aureus MW2
uaucaagauguuugca

SEQ ID NO: 4017636 - RNA, 23 nt, Staphylococcus aureus subsp. aureus MW2
uaucaagauguuugcaacauauu

SEQ ID NO: 4017637 - RNA, 21 nt, Staphylococcus aureus subsp. aureus MW2
uaucaagggcuccuacuccau

SEQ ID NO: 4017638 - RNA, 15 nt, Staphylococcus aureus subsp. aureus MW2
uaucaauugaaugaa

SEQ ID NO: 4017639 - RNA, 19 nt, Staphylococcus aureus subsp. aureus MW2
uaucaauugaaugaaguaa

SEQ ID NO: 4017640 - RNA, 21 nt, Staphylococcus aureus subsp. aureus MW2
uaucaauuguugcaaaauacg

SEQ ID NO: 4017641 - RNA, 14 nt, Staphylococcus aureus subsp. aureus MW2
uaucaauuucuucc

SEQ ID NO: 4017642 - RNA, 13 nt, Staphylococcus aureus subsp. aureus MW2
uaucacaacagua

SEQ ID NO: 4017643 - RNA, 20 nt, Staphylococcus aureus subsp. aureus MW2
uaucacauauuaugauacgc

SEQ ID NO: 4017644 - RNA, 16 nt, Staphylococcus aureus subsp. aureus MW2
uaucaccauaaaaaua

SEQ ID NO: 4017645 - RNA, 15 nt, Staphylococcus aureus subsp. aureus MW2
uaucacuaucagcuu

SEQ ID NO: 4017646 - RNA, 16 nt, Staphylococcus aureus subsp. aureus MW2
uaucacugaaugcuaa

SEQ ID NO: 4017647 - RNA, 13 nt, Staphylococcus aureus subsp. aureus MW2
uaucacuuauuau

SEQ ID NO: 4017648 - RNA, 13 nt, Staphylococcus aureus subsp. aureus MW2
uaucagcuuuaau

SEQ ID NO: 4017649 - RNA, 14 nt, Staphylococcus aureus subsp. aureus MW2
uaucagugugauuu

SEQ ID NO: 4017650 - RNA, 18 nt, Staphylococcus aureus subsp. aureus MW2
uaucagugugauuuugga

SEQ ID NO: 4017651 - RNA, 17 nt, Staphylococcus aureus subsp. aureus MW2
uaucaguuagcuuauuu

SEQ ID NO: 4017652 - RNA, 17 nt, Staphylococcus aureus subsp. aureus MW2
uaucauaaauauaagau

SEQ ID NO: 4017653 - RNA, 12 nt, Staphylococcus aureus subsp. aureus MW2
uaucauaacaau

SEQ ID NO: 4017654 - RNA, 19 nt, Staphylococcus aureus subsp. aureus MW2
uaucauaacuuaacucuau

SEQ ID NO: 4017655 - RNA, 13 nt, Staphylococcus aureus subsp. aureus MW2
uaucauaauauug

SEQ ID NO: 4017656 - RNA, 22 nt, Staphylococcus aureus subsp. aureus MW2
uaucauaauauugaugaauaaa

SEQ ID NO: 4017657 - RNA, 13 nt, Staphylococcus aureus subsp. aureus MW2
uaucauacauauu

SEQ ID NO: 4017658 - RNA, 14 nt, Staphylococcus aureus subsp. aureus MW2
uaucauacauauuu

SEQ ID NO: 4017659 - RNA, 16 nt, Staphylococcus aureus subsp. aureus MW2
uaucauacauauuuau

SEQ ID NO: 4017660 - RNA, 22 nt, Staphylococcus aureus subsp. aureus MW2
uaucauauaaugguugaauaac

SEQ ID NO: 4017661 - RNA, 16 nt, Staphylococcus aureus subsp. aureus MW2
uaucauaugaacaauu

SEQ ID NO: 4017662 - RNA, 19 nt, Staphylococcus aureus subsp. aureus MW2
uaucauauucaaaauaacu

SEQ ID NO: 4017663 - RNA, 12 nt, Staphylococcus aureus subsp. aureus MW2
uaucauauuuga

SEQ ID NO: 4017664 - RNA, 13 nt, Staphylococcus aureus subsp. aureus MW2
uaucaucaaaauu

SEQ ID NO: 4017665 - RNA, 17 nt, Staphylococcus aureus subsp. aureus MW2
uaucaucaaaauuuaau

SEQ ID NO: 4017666 - RNA, 16 nt, Staphylococcus aureus subsp. aureus MW2
uaucaucccauugcau

SEQ ID NO: 4017667 - RNA, 21 nt, Staphylococcus aureus subsp. aureus MW2
uaucaucgucuccaacuuuaa

SEQ ID NO: 4017668 - RNA, 23 nt, Staphylococcus aureus subsp. aureus MW2
uaucaugcaaaacuaaucaaauu

SEQ ID NO: 4017669 - RNA, 19 nt, Staphylococcus aureus subsp. aureus MW2
uaucauuaaauugcuugaa

SEQ ID NO: 4017670 - RNA, 20 nt, Staphylococcus aureus subsp. aureus MW2
uaucauuacagauaauuauu

SEQ ID NO: 4017671 - RNA, 22 nt, Staphylococcus aureus subsp. aureus MW2
uaucauuaugcccgauaauucu

SEQ ID NO: 4017672 - RNA, 16 nt, Staphylococcus aureus subsp. aureus MW2
uaucauuuaaaauauu

SEQ ID NO: 4017673 - RNA, 16 nt, Staphylococcus aureus subsp. aureus MW2
uaucauuucaaauaag

SEQ ID NO: 4017674 - RNA, 21 nt, Staphylococcus aureus subsp. aureus MW2
uaucauuuggcguucaacauu

SEQ ID NO: 4017675 - RNA, 23 nt, Staphylococcus aureus subsp. aureus MW2
uaucauuuggcguucaacauuac

SEQ ID NO: 4017676 - RNA, 22 nt, Staphylococcus aureus subsp. aureus MW2
uaucauuuuuaauuuugacaua

SEQ ID NO: 4017677 - RNA, 20 nt, Staphylococcus aureus subsp. aureus MW2
uauccaaaauccugaaauua

SEQ ID NO: 4017678 - RNA, 13 nt, Staphylococcus aureus subsp. aureus MW2
uauccaaagacau

SEQ ID NO: 4017679 - RNA, 17 nt, Staphylococcus aureus subsp. aureus MW2
uauccaguuaauuauuu

SEQ ID NO: 4017680 - RNA, 14 nt, Staphylococcus aureus subsp. aureus MW2
uauccauuaugaug

SEQ ID NO: 4017681 - RNA, 20 nt, Staphylococcus aureus subsp. aureus MW2
uauccauucaauguuuaauu

SEQ ID NO: 4017682 - RNA, 16 nt, Staphylococcus aureus subsp. aureus MW2
uauccauucuuuuuca

SEQ ID NO: 4017683 - RNA, 23 nt, Staphylococcus aureus subsp. aureus MW2
uaucccuaacaugggguuuuauu

SEQ ID NO: 4017684 - RNA, 23 nt, Staphylococcus aureus subsp. aureus MW2
uauccgaaaauugcuaaaaaaau

SEQ ID NO: 4017685 - RNA, 19 nt, Staphylococcus aureus subsp. aureus MW2
uauccgauuuaaguugaua

SEQ ID NO: 4017686 - RNA, 24 nt, Staphylococcus aureus subsp. aureus MW2
uauccgcaucuuuugguuuaucug

SEQ ID NO: 4017687 - RNA, 18 nt, Staphylococcus aureus subsp. aureus MW2
uauccucaguauuuaaug

SEQ ID NO: 4017688 - RNA, 13 nt, Staphylococcus aureus subsp. aureus MW2
uauccugauuuaa

SEQ ID NO: 4017689 - RNA, 17 nt, Staphylococcus aureus subsp. aureus MW2
uauccugauuuaauguu

SEQ ID NO: 4017690 - RNA, 16 nt, Staphylococcus aureus subsp. aureus MW2
uauccuucucaucauu

SEQ ID NO: 4017691 - RNA, 14 nt, Staphylococcus aureus subsp. aureus MW2
uauccuuuuugacu

SEQ ID NO: 4017692 - RNA, 22 nt, Staphylococcus aureus subsp. aureus MW2
uaucgaauuagaucuaugguua

SEQ ID NO: 4017693 - RNA, 14 nt, Staphylococcus aureus subsp. aureus MW2
uaucgauaguucua

SEQ ID NO: 4017694 - RNA, 21 nt, Staphylococcus aureus subsp. aureus MW2
uaucgauaguucuauauaauu

SEQ ID NO: 4017695 - RNA, 19 nt, Staphylococcus aureus subsp. aureus MW2
uaucgauauagcauaaaau

SEQ ID NO: 4017696 - RNA, 14 nt, Staphylococcus aureus subsp. aureus MW2
uaucgauuaucuga

SEQ ID NO: 4017697 - RNA, 17 nt, Staphylococcus aureus subsp. aureus MW2
uaucgauucgauuauuu

SEQ ID NO: 4017698 - RNA, 18 nt, Staphylococcus aureus subsp. aureus MW2
uaucgccuaaaaauaaaa

SEQ ID NO: 4017699 - RNA, 18 nt, Staphylococcus aureus subsp. aureus MW2
uaucgccuggugcaggca

SEQ ID NO: 4017700 - RNA, 13 nt, Staphylococcus aureus subsp. aureus MW2
uaucguuguuuua

SEQ ID NO: 4017701 - RNA, 22 nt, Staphylococcus aureus subsp. aureus MW2
uaucguuuuacuuucaccauuu

SEQ ID NO: 4017702 - RNA, 17 nt, Staphylococcus aureus subsp. aureus MW2
uaucuaaagcuauaaaa

SEQ ID NO: 4017703 - RNA, 20 nt, Staphylococcus aureus subsp. aureus MW2
uaucuaacaaucguuuuaau

SEQ ID NO: 4017704 - RNA, 11 nt, Staphylococcus aureus subsp. aureus MW2
uaucuaagucg

SEQ ID NO: 4017705 - RNA, 13 nt, Staphylococcus aureus subsp. aureus MW2
uaucuaauucuuc

SEQ ID NO: 4017706 - RNA, 16 nt, Staphylococcus aureus subsp. aureus MW2
uaucuaauucuucuaa

SEQ ID NO: 4017707 - RNA, 23 nt, Staphylococcus aureus subsp. aureus MW2
uaucuacaugguuuucaccagac

SEQ ID NO: 4017708 - RNA, 22 nt, Staphylococcus aureus subsp. aureus MW2
uaucuacauuaaagaaaauauc

SEQ ID NO: 4017709 - RNA, 22 nt, Staphylococcus aureus subsp. aureus MW2
uaucuacgccuuggccuacuuu

SEQ ID NO: 4017710 - RNA, 16 nt, Staphylococcus aureus subsp. aureus MW2
uaucuagccugaaaua

SEQ ID NO: 4017711 - RNA, 17 nt, Staphylococcus aureus subsp. aureus MW2
uaucuaguguucucauu

SEQ ID NO: 4017712 - RNA, 23 nt, Staphylococcus aureus subsp. aureus MW2
uaucuaguguucucauuauaaug

SEQ ID NO: 4017713 - RNA, 18 nt, Staphylococcus aureus subsp. aureus MW2
uaucuauaaaaagaauau

SEQ ID NO: 4017714 - RNA, 24 nt, Staphylococcus aureus subsp. aureus MW2
uaucuauacaauuauggauaaaau

SEQ ID NO: 4017715 - RNA, 13 nt, Staphylococcus aureus subsp. aureus MW2
uaucuauaugcau

SEQ ID NO: 4017716 - RNA, 15 nt, Staphylococcus aureus subsp. aureus MW2
uaucuauaugcauau

SEQ ID NO: 4017717 - RNA, 18 nt, Staphylococcus aureus subsp. aureus MW2
uaucuauaugcauauauu

SEQ ID NO: 4017718 - RNA, 14 nt, Staphylococcus aureus subsp. aureus MW2
uaucuauguauagu

SEQ ID NO: 4017719 - RNA, 16 nt, Staphylococcus aureus subsp. aureus MW2
uaucuauuucuauaua

SEQ ID NO: 4017720 - RNA, 19 nt, Staphylococcus aureus subsp. aureus MW2
uaucuauuuuacucuuuuu

SEQ ID NO: 4017721 - RNA, 18 nt, Staphylococcus aureus subsp. aureus MW2
uaucucaaagauuccugu

SEQ ID NO: 4017722 - RNA, 14 nt, Staphylococcus aureus subsp. aureus MW2
uaucuccaauauuu

SEQ ID NO: 4017723 - RNA, 18 nt, Staphylococcus aureus subsp. aureus MW2
uaucuccgcuacaauuau

SEQ ID NO: 4017724 - RNA, 19 nt, Staphylococcus aureus subsp. aureus MW2
uaucucugaaaaacuucuu

SEQ ID NO: 4017725 - RNA, 20 nt, Staphylococcus aureus subsp. aureus MW2
uaucugcucuuuaucaccau

SEQ ID NO: 4017726 - RNA, 19 nt, Staphylococcus aureus subsp. aureus MW2
uaucuguaccguauuuuaa

SEQ ID NO: 4017727 - RNA, 17 nt, Staphylococcus aureus subsp. aureus MW2
uaucuguugucaucaug

SEQ ID NO: 4017728 - RNA, 14 nt, Staphylococcus aureus subsp. aureus MW2
uaucuuauauucuu

SEQ ID NO: 4017729 - RNA, 20 nt, Staphylococcus aureus subsp. aureus MW2
uaucuuauauuuaugauaau

SEQ ID NO: 4017730 - RNA, 21 nt, Staphylococcus aureus subsp. aureus MW2
uaucuuauauuuaugauaauu

SEQ ID NO: 4017731 - RNA, 15 nt, Staphylococcus aureus subsp. aureus MW2
uaucuucacucuuuu

SEQ ID NO: 4017732 - RNA, 22 nt, Staphylococcus aureus subsp. aureus MW2
uaucuucagauucccaaauagu

SEQ ID NO: 4017733 - RNA, 14 nt, Staphylococcus aureus subsp. aureus MW2
uaucuucaguuauu

SEQ ID NO: 4017734 - RNA, 19 nt, Staphylococcus aureus subsp. aureus MW2
uaucuugucauuugaacau

SEQ ID NO: 4017735 - RNA, 14 nt, Staphylococcus aureus subsp. aureus MW2
uaucuuguucuucu

SEQ ID NO: 4017736 - RNA, 11 nt, Staphylococcus aureus subsp. aureus MW2
uaucuuuaauu

SEQ ID NO: 4017737 - RNA, 14 nt, Staphylococcus aureus subsp. aureus MW2
uaucuuuagacaua

SEQ ID NO: 4017738 - RNA, 17 nt, Staphylococcus aureus subsp. aureus MW2
uaucuuuaguauuucau

SEQ ID NO: 4017739 - RNA, 16 nt, Staphylococcus aureus subsp. aureus MW2
uaucuuuaucauuauu

SEQ ID NO: 4017740 - RNA, 14 nt, Staphylococcus aureus subsp. aureus MW2
uaucuuucauaauu

SEQ ID NO: 4017741 - RNA, 14 nt, Staphylococcus aureus subsp. aureus MW2
uaucuuuuaauguu

SEQ ID NO: 4017742 - RNA, 17 nt, Staphylococcus aureus subsp. aureus MW2
uaucuuuuaauguuuua

SEQ ID NO: 4017743 - RNA, 14 nt, Staphylococcus aureus subsp. aureus MW2
uaucuuuugcuucg

SEQ ID NO: 4017744 - RNA, 16 nt, Staphylococcus aureus subsp. aureus MW2
uaucuuuuucuaaguu

SEQ ID NO: 4017745 - RNA, 14 nt, Staphylococcus aureus subsp. aureus MW2
uaugaaaagugaau

SEQ ID NO: 4017746 - RNA, 22 nt, Staphylococcus aureus subsp. aureus MW2
uaugaaauguucccuucaaagu

SEQ ID NO: 4017747 - RNA, 13 nt, Staphylococcus aureus subsp. aureus MW2
uaugaacucacaa

SEQ ID NO: 4017748 - RNA, 16 nt, Staphylococcus aureus subsp. aureus MW2
uaugaagugaaaucau

SEQ ID NO: 4017749 - RNA, 19 nt, Staphylococcus aureus subsp. aureus MW2
uaugaauaaauuguaauau

SEQ ID NO: 4017750 - RNA, 15 nt, Staphylococcus aureus subsp. aureus MW2
uaugaauaaccaucu

SEQ ID NO: 4017751 - RNA, 16 nt, Staphylococcus aureus subsp. aureus MW2
uaugaauaaugcaauu

SEQ ID NO: 4017752 - RNA, 22 nt, Staphylococcus aureus subsp. aureus MW2
uaugaauggcaaucuauauaaa

SEQ ID NO: 4017753 - RNA, 22 nt, Staphylococcus aureus subsp. aureus MW2
uaugaauggcauuuaauacuaa

SEQ ID NO: 4017754 - RNA, 17 nt, Staphylococcus aureus subsp. aureus MW2
uaugaauuauuaauaag

SEQ ID NO: 4017755 - RNA, 23 nt, Staphylococcus aureus subsp. aureus MW2
uaugaauuuagaugcauaaaaaa

SEQ ID NO: 4017756 - RNA, 22 nt, Staphylococcus aureus subsp. aureus MW2
uaugaauuuagcaucaaaaaua

SEQ ID NO: 4017757 - RNA, 14 nt, Staphylococcus aureus subsp. aureus MW2
uaugaccuuuaugu

SEQ ID NO: 4017758 - RNA, 15 nt, Staphylococcus aureus subsp. aureus MW2
uaugagagauagaaa

SEQ ID NO: 4017759 - RNA, 17 nt, Staphylococcus aureus subsp. aureus MW2
uaugagcuuaauaaauu

SEQ ID NO: 4017760 - RNA, 19 nt, Staphylococcus aureus subsp. aureus MW2
uaugagucuuuuugauuaa

SEQ ID NO: 4017761 - RNA, 23 nt, Staphylococcus aureus subsp. aureus MW2
uaugauaaauauuguguuuagga

SEQ ID NO: 4017762 - RNA, 22 nt, Staphylococcus aureus subsp. aureus MW2
uaugauaaccaaaccauuaaua

SEQ ID NO: 4017763 - RNA, 16 nt, Staphylococcus aureus subsp. aureus MW2
uaugauaaccauuaug

SEQ ID NO: 4017764 - RNA, 22 nt, Staphylococcus aureus subsp. aureus MW2
uaugauaaccauuaugauuaau

SEQ ID NO: 4017765 - RNA, 15 nt, Staphylococcus aureus subsp. aureus MW2
uaugauaauaagaau

SEQ ID NO: 4017766 - RNA, 19 nt, Staphylococcus aureus subsp. aureus MW2
uaugauacgcuuuuuaaaa

SEQ ID NO: 4017767 - RNA, 21 nt, Staphylococcus aureus subsp. aureus MW2
uaugauacgcuuuuuaaaaaa

SEQ ID NO: 4017768 - RNA, 22 nt, Staphylococcus aureus subsp. aureus MW2
uaugauacgcuuuuuaaaaaau

SEQ ID NO: 4017769 - RNA, 16 nt, Staphylococcus aureus subsp. aureus MW2
uaugauagaaaucgcc

SEQ ID NO: 4017770 - RNA, 22 nt, Staphylococcus aureus subsp. aureus MW2
uaugauagaauacuaaaagugu

SEQ ID NO: 4017771 - RNA, 23 nt, Staphylococcus aureus subsp. aureus MW2
uaugauagaauacuaaaaguguu

SEQ ID NO: 4017772 - RNA, 20 nt, Staphylococcus aureus subsp. aureus MW2
uaugauagugcuuuuuauuu

SEQ ID NO: 4017773 - RNA, 18 nt, Staphylococcus aureus subsp. aureus MW2
uaugauauauguaacaua

SEQ ID NO: 4017774 - RNA, 15 nt, Staphylococcus aureus subsp. aureus MW2
uaugauccuuuaaug

SEQ ID NO: 4017775 - RNA, 21 nt, Staphylococcus aureus subsp. aureus MW2
uaugaugaauuguuguacaug

SEQ ID NO: 4017776 - RNA, 17 nt, Staphylococcus aureus subsp. aureus MW2
uaugaugucauguauug

SEQ ID NO: 4017777 - RNA, 22 nt, Staphylococcus aureus subsp. aureus MW2
uaugaugucauguauuguccau

SEQ ID NO: 4017778 - RNA, 15 nt, Staphylococcus aureus subsp. aureus MW2
uaugauguuaaaaaa

SEQ ID NO: 4017779 - RNA, 17 nt, Staphylococcus aureus subsp. aureus MW2
uaugauguuaaaaaaua

SEQ ID NO: 4017780 - RNA, 16 nt, Staphylococcus aureus subsp. aureus MW2
uaugauuauuuuucuc

SEQ ID NO: 4017781 - RNA, 12 nt, Staphylococcus aureus subsp. aureus MW2
uaugauugaaug

SEQ ID NO: 4017782 - RNA, 19 nt, Staphylococcus aureus subsp. aureus MW2
uaugauugcuuauuuauuu

SEQ ID NO: 4017783 - RNA, 13 nt, Staphylococcus aureus subsp. aureus MW2
uaugauuugauau

SEQ ID NO: 4017784 - RNA, 18 nt, Staphylococcus aureus subsp. aureus MW2
uaugauuugauauuucaa

SEQ ID NO: 4017785 - RNA, 19 nt, Staphylococcus aureus subsp. aureus MW2
uaugauuugauauuucaaa

SEQ ID NO: 4017786 - RNA, 18 nt, Staphylococcus aureus subsp. aureus MW2
uaugauuugauuugggua

SEQ ID NO: 4017787 - RNA, 20 nt, Staphylococcus aureus subsp. aureus MW2
uaugcauaauaccaauugcu

SEQ ID NO: 4017788 - RNA, 16 nt, Staphylococcus aureus subsp. aureus MW2
uaugcauagcucuugc

SEQ ID NO: 4017789 - RNA, 19 nt, Staphylococcus aureus subsp. aureus MW2
uaugcauauaagauaauuu

SEQ ID NO: 4017790 - RNA, 15 nt, Staphylococcus aureus subsp. aureus MW2
uaugcauauguaaua

SEQ ID NO: 4017791 - RNA, 14 nt, Staphylococcus aureus subsp. aureus MW2
uaugccaaaguaau

SEQ ID NO: 4017792 - RNA, 15 nt, Staphylococcus aureus subsp. aureus MW2
uaugccauucauuaa

SEQ ID NO: 4017793 - RNA, 18 nt, Staphylococcus aureus subsp. aureus MW2
uaugccgccuaauaauaa

SEQ ID NO: 4017794 - RNA, 22 nt, Staphylococcus aureus subsp. aureus MW2
uaugccuuugauuuuacuugaa

SEQ ID NO: 4017795 - RNA, 21 nt, Staphylococcus aureus subsp. aureus MW2
uaugcgagggcuuucuuaauu

SEQ ID NO: 4017796 - RNA, 17 nt, Staphylococcus aureus subsp. aureus MW2
uaugcuagaaaguaaug

SEQ ID NO: 4017797 - RNA, 23 nt, Staphylococcus aureus subsp. aureus MW2
uaugcugcaagucucauaucuau

SEQ ID NO: 4017798 - RNA, 15 nt, Staphylococcus aureus subsp. aureus MW2
uaugcuguguaucau

SEQ ID NO: 4017799 - RNA, 22 nt, Staphylococcus aureus subsp. aureus MW2
uaugcuuuacuugcuuuuucaa

SEQ ID NO: 4017800 - RNA, 16 nt, Staphylococcus aureus subsp. aureus MW2
uaugcuuuuaauagug

SEQ ID NO: 4017801 - RNA, 16 nt, Staphylococcus aureus subsp. aureus MW2
uaugcuuuuuuuacaa

SEQ ID NO: 4017802 - RNA, 14 nt, Staphylococcus aureus subsp. aureus MW2
uauggaaauggugg

SEQ ID NO: 4017803 - RNA, 21 nt, Staphylococcus aureus subsp. aureus MW2
uauggcgcaauuuuuaacaaa

SEQ ID NO: 4017804 - RNA, 16 nt, Staphylococcus aureus subsp. aureus MW2
uaugguguggugugau

SEQ ID NO: 4017805 - RNA, 19 nt, Staphylococcus aureus subsp. aureus MW2
uaugguuacccuuuuucaa

SEQ ID NO: 4017806 - RNA, 14 nt, Staphylococcus aureus subsp. aureus MW2
uaugguuagaaaaa

SEQ ID NO: 4017807 - RNA, 15 nt, Staphylococcus aureus subsp. aureus MW2
uaugguuauggugug

SEQ ID NO: 4017808 - RNA, 21 nt, Staphylococcus aureus subsp. aureus MW2
uaugguuuaccuaguuuuacu

SEQ ID NO: 4017809 - RNA, 12 nt, Staphylococcus aureus subsp. aureus MW2
uauguaaaaaau

SEQ ID NO: 4017810 - RNA, 21 nt, Staphylococcus aureus subsp. aureus MW2
uauguaaaaagugguuaauaa

SEQ ID NO: 4017811 - RNA, 15 nt, Staphylococcus aureus subsp. aureus MW2
uauguaacaaaugcg

SEQ ID NO: 4017812 - RNA, 13 nt, Staphylococcus aureus subsp. aureus MW2
uauguacaaucau

SEQ ID NO: 4017813 - RNA, 20 nt, Staphylococcus aureus subsp. aureus MW2
uauguaccaaauuuauaauu

SEQ ID NO: 4017814 - RNA, 18 nt, Staphylococcus aureus subsp. aureus MW2
uaugucaucuucaauucu

SEQ ID NO: 4017815 - RNA, 22 nt, Staphylococcus aureus subsp. aureus MW2
uaugucauucuaguagcuagaa

SEQ ID NO: 4017816 - RNA, 20 nt, Staphylococcus aureus subsp. aureus MW2
uaugucuagacuuauuugaa

SEQ ID NO: 4017817 - RNA, 16 nt, Staphylococcus aureus subsp. aureus MW2
uaugucucucuuucuu

SEQ ID NO: 4017818 - RNA, 21 nt, Staphylococcus aureus subsp. aureus MW2
uaugucucucuuucuuauuca

SEQ ID NO: 4017819 - RNA, 20 nt, Staphylococcus aureus subsp. aureus MW2
uaugucuuaacaacaugauu

SEQ ID NO: 4017820 - RNA, 15 nt, Staphylococcus aureus subsp. aureus MW2
uaugucuugcucuau

SEQ ID NO: 4017821 - RNA, 17 nt, Staphylococcus aureus subsp. aureus MW2
uauguggcgcucuuaua

SEQ ID NO: 4017822 - RNA, 14 nt, Staphylococcus aureus subsp. aureus MW2
uaugugucuuccaa

SEQ ID NO: 4017823 - RNA, 15 nt, Staphylococcus aureus subsp. aureus MW2
uauguguuucuagcu

SEQ ID NO: 4017824 - RNA, 17 nt, Staphylococcus aureus subsp. aureus MW2
uauguuauaauuaagug

SEQ ID NO: 4017825 - RNA, 16 nt, Staphylococcus aureus subsp. aureus MW2
uauguucuuuuuuaau

SEQ ID NO: 4017826 - RNA, 15 nt, Staphylococcus aureus subsp. aureus MW2
uauguugcuuaucaa

SEQ ID NO: 4017827 - RNA, 22 nt, Staphylococcus aureus subsp. aureus MW2
uauguuggacugguacuacuau

SEQ ID NO: 4017828 - RNA, 19 nt, Staphylococcus aureus subsp. aureus MW2
uauguuguuuaaauuucaa

SEQ ID NO: 4017829 - RNA, 13 nt, Staphylococcus aureus subsp. aureus MW2
uauguuguuucua

SEQ ID NO: 4017830 - RNA, 16 nt, Staphylococcus aureus subsp. aureus MW2
uauguuguuucuaaug

SEQ ID NO: 4017831 - RNA, 15 nt, Staphylococcus aureus subsp. aureus MW2
uauguuuuauaauaa

SEQ ID NO: 4017832 - RNA, 13 nt, Staphylococcus aureus subsp. aureus MW2
uauguuuuaucaa

SEQ ID NO: 4017833 - RNA, 15 nt, Staphylococcus aureus subsp. aureus MW2
uauguuuuauuuucu

SEQ ID NO: 4017834 - RNA, 17 nt, Staphylococcus aureus subsp. aureus MW2
uauuaaaagguugaaau

SEQ ID NO: 4017835 - RNA, 17 nt, Staphylococcus aureus subsp. aureus MW2
uauuaaaauaaaccacg

SEQ ID NO: 4017836 - RNA, 19 nt, Staphylococcus aureus subsp. aureus MW2
uauuaaaauuaaauaauga

SEQ ID NO: 4017837 - RNA, 22 nt, Staphylococcus aureus subsp. aureus MW2
uauuaaacauugcuguaacccc

SEQ ID NO: 4017838 - RNA, 18 nt, Staphylococcus aureus subsp. aureus MW2
uauuaaacauuuuugauu

SEQ ID NO: 4017839 - RNA, 22 nt, Staphylococcus aureus subsp. aureus MW2
uauuaaacauuuuugauuuuaa

SEQ ID NO: 4017840 - RNA, 18 nt, Staphylococcus aureus subsp. aureus MW2
uauuaaacgcaauuaacc

SEQ ID NO: 4017841 - RNA, 19 nt, Staphylococcus aureus subsp. aureus MW2
uauuaaaguaaaauauacu

SEQ ID NO: 4017842 - RNA, 14 nt, Staphylococcus aureus subsp. aureus MW2
uauuaaauaugcac

SEQ ID NO: 4017843 - RNA, 14 nt, Staphylococcus aureus subsp. aureus MW2
uauuaaauuucuga

SEQ ID NO: 4017844 - RNA, 19 nt, Staphylococcus aureus subsp. aureus MW2
uauuaacaaaagugaaugu

SEQ ID NO: 4017845 - RNA, 13 nt, Staphylococcus aureus subsp. aureus MW2
uauuaacuuuaau

SEQ ID NO: 4017846 - RNA, 17 nt, Staphylococcus aureus subsp. aureus MW2
uauuaagacugauuaau

SEQ ID NO: 4017847 - RNA, 15 nt, Staphylococcus aureus subsp. aureus MW2
uauuaauagcaccau

SEQ ID NO: 4017848 - RNA, 12 nt, Staphylococcus aureus subsp. aureus MW2
uauuaauauauu

SEQ ID NO: 4017849 - RNA, 22 nt, Staphylococcus aureus subsp. aureus MW2
uauuaauaucauuauuaccuuu

SEQ ID NO: 4017850 - RNA, 14 nt, Staphylococcus aureus subsp. aureus MW2
uauuaauauuuuuu

SEQ ID NO: 4017851 - RNA, 17 nt, Staphylococcus aureus subsp. aureus MW2
uauuaaucaaauauuuu

SEQ ID NO: 4017852 - RNA, 20 nt, Staphylococcus aureus subsp. aureus MW2
uauuaauccacaaauaacac

SEQ ID NO: 4017853 - RNA, 20 nt, Staphylococcus aureus subsp. aureus MW2
uauuaauuacgucauaaaau

SEQ ID NO: 4017854 - RNA, 16 nt, Staphylococcus aureus subsp. aureus MW2
uauuaauuauuugaua

SEQ ID NO: 4017855 - RNA, 21 nt, Staphylococcus aureus subsp. aureus MW2
uauuaauuauuugauagaaau

SEQ ID NO: 4017856 - RNA, 23 nt, Staphylococcus aureus subsp. aureus MW2
uauuaauugaaaugauaaaaauc

SEQ ID NO: 4017857 - RNA, 12 nt, Staphylococcus aureus subsp. aureus MW2
uauuaauuuaaa

SEQ ID NO: 4017858 - RNA, 19 nt, Staphylococcus aureus subsp. aureus MW2
uauuaauuuauaauuucua

SEQ ID NO: 4017859 - RNA, 12 nt, Staphylococcus aureus subsp. aureus MW2
uauuaauuucau

SEQ ID NO: 4017860 - RNA, 16 nt, Staphylococcus aureus subsp. aureus MW2
uauuaauuucauugua

SEQ ID NO: 4017861 - RNA, 20 nt, Staphylococcus aureus subsp. aureus MW2
uauuaauuugaauaccuaca

SEQ ID NO: 4017862 - RNA, 17 nt, Staphylococcus aureus subsp. aureus MW2
uauuaauuugauaaaug

SEQ ID NO: 4017863 - RNA, 16 nt, Staphylococcus aureus subsp. aureus MW2
uauuaauuuuacguuu

SEQ ID NO: 4017864 - RNA, 14 nt, Staphylococcus aureus subsp. aureus MW2
uauuaauuuucuca

SEQ ID NO: 4017865 - RNA, 16 nt, Staphylococcus aureus subsp. aureus MW2
uauuaauuuucucaaa

SEQ ID NO: 4017866 - RNA, 13 nt, Staphylococcus aureus subsp. aureus MW2
uauuacaaaauuu

SEQ ID NO: 4017867 - RNA, 23 nt, Staphylococcus aureus subsp. aureus MW2
uauuacaaaauuuccacuuugau

SEQ ID NO: 4017868 - RNA, 17 nt, Staphylococcus aureus subsp. aureus MW2
uauuacaaccaacaauu

SEQ ID NO: 4017869 - RNA, 18 nt, Staphylococcus aureus subsp. aureus MW2
uauuacaaccaacaauug

SEQ ID NO: 4017870 - RNA, 13 nt, Staphylococcus aureus subsp. aureus MW2
uauuacauaauuu

SEQ ID NO: 4017871 - RNA, 17 nt, Staphylococcus aureus subsp. aureus MW2
uauuacuaaccuauuaa

SEQ ID NO: 4017872 - RNA, 21 nt, Staphylococcus aureus subsp. aureus MW2
uauuacuacauaauuuaucaa

SEQ ID NO: 4017873 - RNA, 15 nt, Staphylococcus aureus subsp. aureus MW2
uauuacuauaaaaaa

SEQ ID NO: 4017874 - RNA, 19 nt, Staphylococcus aureus subsp. aureus MW2
uauuacugauuguuaacga

SEQ ID NO: 4017875 - RNA, 15 nt, Staphylococcus aureus subsp. aureus MW2
uauuacuuauuucuu

SEQ ID NO: 4017876 - RNA, 21 nt, Staphylococcus aureus subsp. aureus MW2
uauuacuuauuucuuuucauu

SEQ ID NO: 4017877 - RNA, 19 nt, Staphylococcus aureus subsp. aureus MW2
uauuagccaauaaaauguc

SEQ ID NO: 4017878 - RNA, 14 nt, Staphylococcus aureus subsp. aureus MW2
uauuaguauucaaa

SEQ ID NO: 4017879 - RNA, 13 nt, Staphylococcus aureus subsp. aureus MW2
uauuauaaaaaga

SEQ ID NO: 4017880 - RNA, 16 nt, Staphylococcus aureus subsp. aureus MW2
uauuauaaaaagauau

SEQ ID NO: 4017881 - RNA, 13 nt, Staphylococcus aureus subsp. aureus MW2
uauuauaaaaaua

SEQ ID NO: 4017882 - RNA, 14 nt, Staphylococcus aureus subsp. aureus MW2
uauuauaaaaauag

SEQ ID NO: 4017883 - RNA, 16 nt, Staphylococcus aureus subsp. aureus MW2
uauuauaaaauagaag

SEQ ID NO: 4017884 - RNA, 18 nt, Staphylococcus aureus subsp. aureus MW2
uauuauaaaauagaagua

SEQ ID NO: 4017885 - RNA, 17 nt, Staphylococcus aureus subsp. aureus MW2
uauuauaauagagaaac

SEQ ID NO: 4017886 - RNA, 22 nt, Staphylococcus aureus subsp. aureus MW2
uauuauaauaucgacuuuucua

SEQ ID NO: 4017887 - RNA, 15 nt, Staphylococcus aureus subsp. aureus MW2
uauuauaauuguuca

SEQ ID NO: 4017888 - RNA, 15 nt, Staphylococcus aureus subsp. aureus MW2
uauuauaauuuuguu

SEQ ID NO: 4017889 - RNA, 20 nt, Staphylococcus aureus subsp. aureus MW2
uauuauagaaagcaaugucu

SEQ ID NO: 4017890 - RNA, 22 nt, Staphylococcus aureus subsp. aureus MW2
uauuauagggcuguuuuuuaau

SEQ ID NO: 4017891 - RNA, 14 nt, Staphylococcus aureus subsp. aureus MW2
uauuauauauauuc

SEQ ID NO: 4017892 - RNA, 14 nt, Staphylococcus aureus subsp. aureus MW2
uauuauauugaauu

SEQ ID NO: 4017893 - RNA, 19 nt, Staphylococcus aureus subsp. aureus MW2
uauuaucaaagaaauguau

SEQ ID NO: 4017894 - RNA, 15 nt, Staphylococcus aureus subsp. aureus MW2
uauuaucuaauucuu

SEQ ID NO: 4017895 - RNA, 20 nt, Staphylococcus aureus subsp. aureus MW2
uauuaucuauccauuugguu

SEQ ID NO: 4017896 - RNA, 16 nt, Staphylococcus aureus subsp. aureus MW2
uauuaugaauuauuaa

SEQ ID NO: 4017897 - RNA, 16 nt, Staphylococcus aureus subsp. aureus MW2
uauuaugccuuugauu

SEQ ID NO: 4017898 - RNA, 16 nt, Staphylococcus aureus subsp. aureus MW2
uauuaugcugaaacua

SEQ ID NO: 4017899 - RNA, 13 nt, Staphylococcus aureus subsp. aureus MW2
uauuauguaccaa

SEQ ID NO: 4017900 - RNA, 14 nt, Staphylococcus aureus subsp. aureus MW2
uauuauguuauaaa

SEQ ID NO: 4017901 - RNA, 15 nt, Staphylococcus aureus subsp. aureus MW2
uauuauguuauaaau

SEQ ID NO: 4017902 - RNA, 15 nt, Staphylococcus aureus subsp. aureus MW2
uauuauuaacuguac

SEQ ID NO: 4017903 - RNA, 19 nt, Staphylococcus aureus subsp. aureus MW2
uauuauuauaauuuuguuu

SEQ ID NO: 4017904 - RNA, 14 nt, Staphylococcus aureus subsp. aureus MW2
uauuauuaugugua

SEQ ID NO: 4017905 - RNA, 16 nt, Staphylococcus aureus subsp. aureus MW2
uauuauucguuucuuu

SEQ ID NO: 4017906 - RNA, 16 nt, Staphylococcus aureus subsp. aureus MW2
uauuauugugaaaucu

SEQ ID NO: 4017907 - RNA, 13 nt, Staphylococcus aureus subsp. aureus MW2
uauuauuuuacuu

SEQ ID NO: 4017908 - RNA, 18 nt, Staphylococcus aureus subsp. aureus MW2
uauuauuuugcuuuaauu

SEQ ID NO: 4017909 - RNA, 19 nt, Staphylococcus aureus subsp. aureus MW2
uauuauuuuguauuuuuca

SEQ ID NO: 4017910 - RNA, 16 nt, Staphylococcus aureus subsp. aureus MW2
uauucaaaguuuucau

SEQ ID NO: 4017911 - RNA, 17 nt, Staphylococcus aureus subsp. aureus MW2
uauucaaaguuuucauu

SEQ ID NO: 4017912 - RNA, 21 nt, Staphylococcus aureus subsp. aureus MW2
uauucaacagggguaaaacuu

SEQ ID NO: 4017913 - RNA, 23 nt, Staphylococcus aureus subsp. aureus MW2
uauucaacuaauuuaaagcauca

SEQ ID NO: 4017914 - RNA, 15 nt, Staphylococcus aureus subsp. aureus MW2
uauucaauaauucau

SEQ ID NO: 4017915 - RNA, 19 nt, Staphylococcus aureus subsp. aureus MW2
uauucaaugauuaguaaug

SEQ ID NO: 4017916 - RNA, 21 nt, Staphylococcus aureus subsp. aureus MW2
uauucagucaguaaaaauaca

SEQ ID NO: 4017917 - RNA, 19 nt, Staphylococcus aureus subsp. aureus MW2
uauucaguugguauaucga

SEQ ID NO: 4017918 - RNA, 21 nt, Staphylococcus aureus subsp. aureus MW2
uauucauaauaucgaugacuu

SEQ ID NO: 4017919 - RNA, 23 nt, Staphylococcus aureus subsp. aureus MW2
uauucauagaccuaugaauuuag

SEQ ID NO: 4017920 - RNA, 23 nt, Staphylococcus aureus subsp. aureus MW2
uauucauguucuuguaauccuag

SEQ ID NO: 4017921 - RNA, 16 nt, Staphylococcus aureus subsp. aureus MW2
uauucauuuuaaauuu

SEQ ID NO: 4017922 - RNA, 20 nt, Staphylococcus aureus subsp. aureus MW2
uauuccuaguucuauguaua

SEQ ID NO: 4017923 - RNA, 21 nt, Staphylococcus aureus subsp. aureus MW2
uauucgaaaaagguauucaaa

SEQ ID NO: 4017924 - RNA, 17 nt, Staphylococcus aureus subsp. aureus MW2
uauucgauaauauaacu

SEQ ID NO: 4017925 - RNA, 24 nt, Staphylococcus aureus subsp. aureus MW2
uauucgauaauauaacugcaugua

SEQ ID NO: 4017926 - RNA, 20 nt, Staphylococcus aureus subsp. aureus MW2
uauucgauacauaaaacauc

SEQ ID NO: 4017927 - RNA, 15 nt, Staphylococcus aureus subsp. aureus MW2
uauucgcuuacauua

SEQ ID NO: 4017928 - RNA, 14 nt, Staphylococcus aureus subsp. aureus MW2
uauucguauucaaa

SEQ ID NO: 4017929 - RNA, 16 nt, Staphylococcus aureus subsp. aureus MW2
uauucguuucuuuauu

SEQ ID NO: 4017930 - RNA, 16 nt, Staphylococcus aureus subsp. aureus MW2
uauucuaaaaaauuaa

SEQ ID NO: 4017931 - RNA, 22 nt, Staphylococcus aureus subsp. aureus MW2
uauucuaaaaaauuaaaaauuu

SEQ ID NO: 4017932 - RNA, 19 nt, Staphylococcus aureus subsp. aureus MW2
uauucuaacuuuguaugaa

SEQ ID NO: 4017933 - RNA, 14 nt, Staphylococcus aureus subsp. aureus MW2
uauucuaaguuaaa

SEQ ID NO: 4017934 - RNA, 18 nt, Staphylococcus aureus subsp. aureus MW2
uauucuaaucuaaauuca

SEQ ID NO: 4017935 - RNA, 17 nt, Staphylococcus aureus subsp. aureus MW2
uauucuaauugcacauu

SEQ ID NO: 4017936 - RNA, 12 nt, Staphylococcus aureus subsp. aureus MW2
uauucuauuuuu

SEQ ID NO: 4017937 - RNA, 16 nt, Staphylococcus aureus subsp. aureus MW2
uauucuauuuuucaau

SEQ ID NO: 4017938 - RNA, 21 nt, Staphylococcus aureus subsp. aureus MW2
uauucuauuuuucaauucgcu

SEQ ID NO: 4017939 - RNA, 22 nt, Staphylococcus aureus subsp. aureus MW2
uauucucugcuucuaaaacauc

SEQ ID NO: 4017940 - RNA, 18 nt, Staphylococcus aureus subsp. aureus MW2
uauucugaaaaauauuua

SEQ ID NO: 4017941 - RNA, 19 nt, Staphylococcus aureus subsp. aureus MW2
uauucugaaaaauauuuaa

SEQ ID NO: 4017942 - RNA, 20 nt, Staphylococcus aureus subsp. aureus MW2
uauucugcaccuguuuuaau

SEQ ID NO: 4017943 - RNA, 13 nt, Staphylococcus aureus subsp. aureus MW2
uauucuucauuua

SEQ ID NO: 4017944 - RNA, 21 nt, Staphylococcus aureus subsp. aureus MW2
uauucuucuaauucugaaauc

SEQ ID NO: 4017945 - RNA, 18 nt, Staphylococcus aureus subsp. aureus MW2
uauucuuuuaauagaucu

SEQ ID NO: 4017946 - RNA, 12 nt, Staphylococcus aureus subsp. aureus MW2
uauugaaacuaa

SEQ ID NO: 4017947 - RNA, 18 nt, Staphylococcus aureus subsp. aureus MW2
uauugaaacuaauaauuu

SEQ ID NO: 4017948 - RNA, 13 nt, Staphylococcus aureus subsp. aureus MW2
uauugaaagauau

SEQ ID NO: 4017949 - RNA, 18 nt, Staphylococcus aureus subsp. aureus MW2
uauugaaaguguaugcau

SEQ ID NO: 4017950 - RNA, 16 nt, Staphylococcus aureus subsp. aureus MW2
uauugaaauaauauaa

SEQ ID NO: 4017951 - RNA, 18 nt, Staphylococcus aureus subsp. aureus MW2
uauugaaaucgauacuaa

SEQ ID NO: 4017952 - RNA, 16 nt, Staphylococcus aureus subsp. aureus MW2
uauugaaaugagcuua

SEQ ID NO: 4017953 - RNA, 15 nt, Staphylococcus aureus subsp. aureus MW2
uauugaagaugcuuu

SEQ ID NO: 4017954 - RNA, 17 nt, Staphylococcus aureus subsp. aureus MW2
uauugaauaaaaaaaca

SEQ ID NO: 4017955 - RNA, 13 nt, Staphylococcus aureus subsp. aureus MW2
uauugaaugaagu

SEQ ID NO: 4017956 - RNA, 15 nt, Staphylococcus aureus subsp. aureus MW2
uauugagaauauuaa

SEQ ID NO: 4017957 - RNA, 14 nt, Staphylococcus aureus subsp. aureus MW2
uauugagaauauuu

SEQ ID NO: 4017958 - RNA, 13 nt, Staphylococcus aureus subsp. aureus MW2
uauugauauuaau

SEQ ID NO: 4017959 - RNA, 13 nt, Staphylococcus aureus subsp. aureus MW2
uauugauauucua

SEQ ID NO: 4017960 - RNA, 15 nt, Staphylococcus aureus subsp. aureus MW2
uauugauauucuaaa

SEQ ID NO: 4017961 - RNA, 13 nt, Staphylococcus aureus subsp. aureus MW2
uauugaugaucaa

SEQ ID NO: 4017962 - RNA, 22 nt, Staphylococcus aureus subsp. aureus MW2
uauugauucuagugaaauaccu

SEQ ID NO: 4017963 - RNA, 21 nt, Staphylococcus aureus subsp. aureus MW2
uauugauugugacuuguauca

SEQ ID NO: 4017964 - RNA, 23 nt, Staphylococcus aureus subsp. aureus MW2
uauugcaaaaauaauaugaauuu

SEQ ID NO: 4017965 - RNA, 23 nt, Staphylococcus aureus subsp. aureus MW2
uauugcagcaacgcgauugcuaa

SEQ ID NO: 4017966 - RNA, 21 nt, Staphylococcus aureus subsp. aureus MW2
uauugcaucauaauuuccuga

SEQ ID NO: 4017967 - RNA, 18 nt, Staphylococcus aureus subsp. aureus MW2
uauugcauguuuaaauau

SEQ ID NO: 4017968 - RNA, 14 nt, Staphylococcus aureus subsp. aureus MW2
uauugcauuguaua

SEQ ID NO: 4017969 - RNA, 24 nt, Staphylococcus aureus subsp. aureus MW2
uauugccuaacguguuugagauau

SEQ ID NO: 4017970 - RNA, 14 nt, Staphylococcus aureus subsp. aureus MW2
uauugcuuauuuuu

SEQ ID NO: 4017971 - RNA, 22 nt, Staphylococcus aureus subsp. aureus MW2
uauuggaauacucuuuaaucua

SEQ ID NO: 4017972 - RNA, 15 nt, Staphylococcus aureus subsp. aureus MW2
uauuggcauuagcuu

SEQ ID NO: 4017973 - RNA, 16 nt, Staphylococcus aureus subsp. aureus MW2
uauugggacuuauucc

SEQ ID NO: 4017974 - RNA, 16 nt, Staphylococcus aureus subsp. aureus MW2
uauuggguaauauuag

SEQ ID NO: 4017975 - RNA, 16 nt, Staphylococcus aureus subsp. aureus MW2
uauuggucauuacuaa

SEQ ID NO: 4017976 - RNA, 18 nt, Staphylococcus aureus subsp. aureus MW2
uauuggucauuacuaaaa

SEQ ID NO: 4017977 - RNA, 17 nt, Staphylococcus aureus subsp. aureus MW2
uauuguuuaugucuugc

SEQ ID NO: 4017978 - RNA, 14 nt, Staphylococcus aureus subsp. aureus MW2
uauuguuugaaaau

SEQ ID NO: 4017979 - RNA, 15 nt, Staphylococcus aureus subsp. aureus MW2
uauuguuuuauauuu

SEQ ID NO: 4017980 - RNA, 14 nt, Staphylococcus aureus subsp. aureus MW2
uauuguuuuuaaaa

SEQ ID NO: 4017981 - RNA, 14 nt, Staphylococcus aureus subsp. aureus MW2
uauuuaaaaauagc

SEQ ID NO: 4017982 - RNA, 15 nt, Staphylococcus aureus subsp. aureus MW2
uauuuaaaaauagcc

SEQ ID NO: 4017983 - RNA, 18 nt, Staphylococcus aureus subsp. aureus MW2
uauuuaaaacuuguaaau

SEQ ID NO: 4017984 - RNA, 23 nt, Staphylococcus aureus subsp. aureus MW2
uauuuaaaauauuauuuuuaagu

SEQ ID NO: 4017985 - RNA, 14 nt, Staphylococcus aureus subsp. aureus MW2
uauuuaaacgguaa

SEQ ID NO: 4017986 - RNA, 16 nt, Staphylococcus aureus subsp. aureus MW2
uauuuaaacuaguaau

SEQ ID NO: 4017987 - RNA, 22 nt, Staphylococcus aureus subsp. aureus MW2
uauuuaaacucauaauuuucua

SEQ ID NO: 4017988 - RNA, 19 nt, Staphylococcus aureus subsp. aureus MW2
uauuuaaacucucuaaaaa

SEQ ID NO: 4017989 - RNA, 23 nt, Staphylococcus aureus subsp. aureus MW2
uauuuaaaucaauauucucuuua

SEQ ID NO: 4017990 - RNA, 16 nt, Staphylococcus aureus subsp. aureus MW2
uauuuaaauuggaauc

SEQ ID NO: 4017991 - RNA, 18 nt, Staphylococcus aureus subsp. aureus MW2
uauuuaaucguaacauau

SEQ ID NO: 4017992 - RNA, 20 nt, Staphylococcus aureus subsp. aureus MW2
uauuuaaugugcauauugag

SEQ ID NO: 4017993 - RNA, 14 nt, Staphylococcus aureus subsp. aureus MW2
uauuuaauguuuua

SEQ ID NO: 4017994 - RNA, 14 nt, Staphylococcus aureus subsp. aureus MW2
uauuuaauuuuaau

SEQ ID NO: 4017995 - RNA, 16 nt, Staphylococcus aureus subsp. aureus MW2
uauuuaauuuugauau

SEQ ID NO: 4017996 - RNA, 22 nt, Staphylococcus aureus subsp. aureus MW2
uauuuacaauguuaucuugcuu

SEQ ID NO: 4017997 - RNA, 18 nt, Staphylococcus aureus subsp. aureus MW2
uauuuaccgucuuaugau

SEQ ID NO: 4017998 - RNA, 12 nt, Staphylococcus aureus subsp. aureus MW2
uauuuaccuucu

SEQ ID NO: 4017999 - RNA, 16 nt, Staphylococcus aureus subsp. aureus MW2
uauuuaccuucuucua

SEQ ID NO: 4018000 - RNA, 22 nt, Staphylococcus aureus subsp. aureus MW2
uauuuagaaaguuuuauuuaaa

SEQ ID NO: 4018001 - RNA, 14 nt, Staphylococcus aureus subsp. aureus MW2
uauuuagaauaaac

SEQ ID NO: 4018002 - RNA, 16 nt, Staphylococcus aureus subsp. aureus MW2
uauuuagaauaaacuu

SEQ ID NO: 4018003 - RNA, 15 nt, Staphylococcus aureus subsp. aureus MW2
uauuuagauaaaaaa

SEQ ID NO: 4018004 - RNA, 19 nt, Staphylococcus aureus subsp. aureus MW2
uauuuagauaaaaaauacu

SEQ ID NO: 4018005 - RNA, 14 nt, Staphylococcus aureus subsp. aureus MW2
uauuuagauucuuu

SEQ ID NO: 4018006 - RNA, 15 nt, Staphylococcus aureus subsp. aureus MW2
uauuuagauugguca

SEQ ID NO: 4018007 - RNA, 16 nt, Staphylococcus aureus subsp. aureus MW2
uauuuagauuuauaac

SEQ ID NO: 4018008 - RNA, 21 nt, Staphylococcus aureus subsp. aureus MW2
uauuuagcaucuuuaccauau

SEQ ID NO: 4018009 - RNA, 22 nt, Staphylococcus aureus subsp. aureus MW2
uauuuaggacgugccuuaacuu

SEQ ID NO: 4018010 - RNA, 17 nt, Staphylococcus aureus subsp. aureus MW2
uauuuaggaguauccug

SEQ ID NO: 4018011 - RNA, 14 nt, Staphylococcus aureus subsp. aureus MW2
uauuuauaaaauaa

SEQ ID NO: 4018012 - RNA, 18 nt, Staphylococcus aureus subsp. aureus MW2
uauuuauaaaauaaaaug

SEQ ID NO: 4018013 - RNA, 18 nt, Staphylococcus aureus subsp. aureus MW2
uauuuauaacuuuaaaaa

SEQ ID NO: 4018014 - RNA, 12 nt, Staphylococcus aureus subsp. aureus MW2
uauuuauaauuu

SEQ ID NO: 4018015 - RNA, 16 nt, Staphylococcus aureus subsp. aureus MW2
uauuuauacuaaauug

SEQ ID NO: 4018016 - RNA, 14 nt, Staphylococcus aureus subsp. aureus MW2
uauuuauauuaaau

SEQ ID NO: 4018017 - RNA, 17 nt, Staphylococcus aureus subsp. aureus MW2
uauuuauauuaaauacu

SEQ ID NO: 4018018 - RNA, 12 nt, Staphylococcus aureus subsp. aureus MW2
uauuuaucuuua

SEQ ID NO: 4018019 - RNA, 20 nt, Staphylococcus aureus subsp. aureus MW2
uauuuaugaguuugauguuu

SEQ ID NO: 4018020 - RNA, 19 nt, Staphylococcus aureus subsp. aureus MW2
uauuuauucuaaucuaaau

SEQ ID NO: 4018021 - RNA, 13 nt, Staphylococcus aureus subsp. aureus MW2
uauuuauuuugau

SEQ ID NO: 4018022 - RNA, 13 nt, Staphylococcus aureus subsp. aureus MW2
uauuucaaaugua

SEQ ID NO: 4018023 - RNA, 19 nt, Staphylococcus aureus subsp. aureus MW2
uauuucaacuuuuuaauaa

SEQ ID NO: 4018024 - RNA, 14 nt, Staphylococcus aureus subsp. aureus MW2
uauuucaauaauaa

SEQ ID NO: 4018025 - RNA, 15 nt, Staphylococcus aureus subsp. aureus MW2
uauuucaauacccua

SEQ ID NO: 4018026 - RNA, 14 nt, Staphylococcus aureus subsp. aureus MW2
uauuucagcuuauu

SEQ ID NO: 4018027 - RNA, 14 nt, Staphylococcus aureus subsp. aureus MW2
uauuucauauaugu

SEQ ID NO: 4018028 - RNA, 15 nt, Staphylococcus aureus subsp. aureus MW2
uauuucauauuuaau

SEQ ID NO: 4018029 - RNA, 15 nt, Staphylococcus aureus subsp. aureus MW2
uauuucauuagaaaa

SEQ ID NO: 4018030 - RNA, 16 nt, Staphylococcus aureus subsp. aureus MW2
uauuucccuaugaaau

SEQ ID NO: 4018031 - RNA, 16 nt, Staphylococcus aureus subsp. aureus MW2
uauuuccguuuuagaa

SEQ ID NO: 4018032 - RNA, 21 nt, Staphylococcus aureus subsp. aureus MW2
uauuucgccuuuuuuauuuuu

SEQ ID NO: 4018033 - RNA, 17 nt, Staphylococcus aureus subsp. aureus MW2
uauuucgucgucccacc

SEQ ID NO: 4018034 - RNA, 13 nt, Staphylococcus aureus subsp. aureus MW2
uauuucuaaauua

SEQ ID NO: 4018035 - RNA, 19 nt, Staphylococcus aureus subsp. aureus MW2
uauuucuauaucuauuuau

SEQ ID NO: 4018036 - RNA, 22 nt, Staphylococcus aureus subsp. aureus MW2
uauuucugaaaugauacauuau

SEQ ID NO: 4018037 - RNA, 15 nt, Staphylococcus aureus subsp. aureus MW2
uauuucuguuuuccu

SEQ ID NO: 4018038 - RNA, 18 nt, Staphylococcus aureus subsp. aureus MW2
uauuucuuucgaaaacag

SEQ ID NO: 4018039 - RNA, 21 nt, Staphylococcus aureus subsp. aureus MW2
uauuucuuuuugucauuaauc

SEQ ID NO: 4018040 - RNA, 16 nt, Staphylococcus aureus subsp. aureus MW2
uauuugaaaaaguguu

SEQ ID NO: 4018041 - RNA, 18 nt, Staphylococcus aureus subsp. aureus MW2
uauuugaaagcauuuaaa

SEQ ID NO: 4018042 - RNA, 21 nt, Staphylococcus aureus subsp. aureus MW2
uauuugaaagcauuuaaauau

SEQ ID NO: 4018043 - RNA, 22 nt, Staphylococcus aureus subsp. aureus MW2
uauuugaaagcauuuaaauaua

SEQ ID NO: 4018044 - RNA, 12 nt, Staphylococcus aureus subsp. aureus MW2
uauuugaaauaa

SEQ ID NO: 4018045 - RNA, 15 nt, Staphylococcus aureus subsp. aureus MW2
uauuugaaauaauau

SEQ ID NO: 4018046 - RNA, 16 nt, Staphylococcus aureus subsp. aureus MW2
uauuugauaaauaaaa

SEQ ID NO: 4018047 - RNA, 20 nt, Staphylococcus aureus subsp. aureus MW2
uauuugauagaaaucagcuu

SEQ ID NO: 4018048 - RNA, 15 nt, Staphylococcus aureus subsp. aureus MW2
uauuugauauuucau

SEQ ID NO: 4018049 - RNA, 20 nt, Staphylococcus aureus subsp. aureus MW2
uauuugauccauauauguaa

SEQ ID NO: 4018050 - RNA, 16 nt, Staphylococcus aureus subsp. aureus MW2
uauuugauuauguaaa

SEQ ID NO: 4018051 - RNA, 14 nt, Staphylococcus aureus subsp. aureus MW2
uauuugauucuuca

SEQ ID NO: 4018052 - RNA, 14 nt, Staphylococcus aureus subsp. aureus MW2
uauuugcccgacuu

SEQ ID NO: 4018053 - RNA, 18 nt, Staphylococcus aureus subsp. aureus MW2
uauuugccuuuugaauaa

SEQ ID NO: 4018054 - RNA, 19 nt, Staphylococcus aureus subsp. aureus MW2
uauuugcuagucauaauuu

SEQ ID NO: 4018055 - RNA, 21 nt, Staphylococcus aureus subsp. aureus MW2
uauuugcuuuuuguguaucug

SEQ ID NO: 4018056 - RNA, 21 nt, Staphylococcus aureus subsp. aureus MW2
uauuuggaugguaaguauaau

SEQ ID NO: 4018057 - RNA, 15 nt, Staphylococcus aureus subsp. aureus MW2
uauuuguaauuucag

SEQ ID NO: 4018058 - RNA, 14 nt, Staphylococcus aureus subsp. aureus MW2
uauuuguguuuuua

SEQ ID NO: 4018059 - RNA, 17 nt, Staphylococcus aureus subsp. aureus MW2
uauuuguuguuauauaa

SEQ ID NO: 4018060 - RNA, 10 nt, Staphylococcus aureus subsp. aureus MW2
uauuuuaaac

SEQ ID NO: 4018061 - RNA, 12 nt, Staphylococcus aureus subsp. aureus MW2
uauuuuaaacau

SEQ ID NO: 4018062 - RNA, 13 nt, Staphylococcus aureus subsp. aureus MW2
uauuuuaaacaug

SEQ ID NO: 4018063 - RNA, 21 nt, Staphylococcus aureus subsp. aureus MW2
uauuuuaaaccguuauauauu

SEQ ID NO: 4018064 - RNA, 22 nt, Staphylococcus aureus subsp. aureus MW2
uauuuuaaacguaucauuuaaa

SEQ ID NO: 4018065 - RNA, 23 nt, Staphylococcus aureus subsp. aureus MW2
uauuuuaaacguaucauuuaaaa

SEQ ID NO: 4018066 - RNA, 15 nt, Staphylococcus aureus subsp. aureus MW2
uauuuuaaauuuaau

SEQ ID NO: 4018067 - RNA, 18 nt, Staphylococcus aureus subsp. aureus MW2
uauuuuaauauugaaaug

SEQ ID NO: 4018068 - RNA, 22 nt, Staphylococcus aureus subsp. aureus MW2
uauuuuaaugggcgauaaaagu

SEQ ID NO: 4018069 - RNA, 18 nt, Staphylococcus aureus subsp. aureus MW2
uauuuuacgcuuuuucuu

SEQ ID NO: 4018070 - RNA, 16 nt, Staphylococcus aureus subsp. aureus MW2
uauuuuaguacuuaau

SEQ ID NO: 4018071 - RNA, 20 nt, Staphylococcus aureus subsp. aureus MW2
uauuuuauaagaauuuaaaa

SEQ ID NO: 4018072 - RNA, 14 nt, Staphylococcus aureus subsp. aureus MW2
uauuuuauaauaaa

SEQ ID NO: 4018073 - RNA, 17 nt, Staphylococcus aureus subsp. aureus MW2
uauuuuauaauaaauuu

SEQ ID NO: 4018074 - RNA, 23 nt, Staphylococcus aureus subsp. aureus MW2
uauuuuaucaagagguaaaucug

SEQ ID NO: 4018075 - RNA, 12 nt, Staphylococcus aureus subsp. aureus MW2
uauuuuaucugu

SEQ ID NO: 4018076 - RNA, 20 nt, Staphylococcus aureus subsp. aureus MW2
uauuuuaugacguaauuaau

SEQ ID NO: 4018077 - RNA, 14 nt, Staphylococcus aureus subsp. aureus MW2
uauuuuauuauaau

SEQ ID NO: 4018078 - RNA, 14 nt, Staphylococcus aureus subsp. aureus MW2
uauuuuauuuaaaa

SEQ ID NO: 4018079 - RNA, 19 nt, Staphylococcus aureus subsp. aureus MW2
uauuuucaauaaauuuuau

SEQ ID NO: 4018080 - RNA, 16 nt, Staphylococcus aureus subsp. aureus MW2
uauuuucaauuagaaa

SEQ ID NO: 4018081 - RNA, 15 nt, Staphylococcus aureus subsp. aureus MW2
uauuuucauuuuagu

SEQ ID NO: 4018082 - RNA, 18 nt, Staphylococcus aureus subsp. aureus MW2
uauuuucugccauaaaca

SEQ ID NO: 4018083 - RNA, 17 nt, Staphylococcus aureus subsp. aureus MW2
uauuuucugcuguaugg

SEQ ID NO: 4018084 - RNA, 12 nt, Staphylococcus aureus subsp. aureus MW2
uauuuucuuaga

SEQ ID NO: 4018085 - RNA, 13 nt, Staphylococcus aureus subsp. aureus MW2
uauuuucuugugu

SEQ ID NO: 4018086 - RNA, 20 nt, Staphylococcus aureus subsp. aureus MW2
uauuuucuuuuucuaaauaa

SEQ ID NO: 4018087 - RNA, 21 nt, Staphylococcus aureus subsp. aureus MW2
uauuuugcuugcuuacaauaa

SEQ ID NO: 4018088 - RNA, 21 nt, Staphylococcus aureus subsp. aureus MW2
uauuuugggaauuguauuaau

SEQ ID NO: 4018089 - RNA, 12 nt, Staphylococcus aureus subsp. aureus MW2
uauuuuguaguu

SEQ ID NO: 4018090 - RNA, 13 nt, Staphylococcus aureus subsp. aureus MW2
uauuuuguaguuc

SEQ ID NO: 4018091 - RNA, 14 nt, Staphylococcus aureus subsp. aureus MW2
uauuuuguauuuuu

SEQ ID NO: 4018092 - RNA, 15 nt, Staphylococcus aureus subsp. aureus MW2
uauuuuguuaauaag

SEQ ID NO: 4018093 - RNA, 12 nt, Staphylococcus aureus subsp. aureus MW2
uauuuuguuuua

SEQ ID NO: 4018094 - RNA, 16 nt, Staphylococcus aureus subsp. aureus MW2
uauuuuguuuuaaaaa

SEQ ID NO: 4018095 - RNA, 19 nt, Staphylococcus aureus subsp. aureus MW2
uauuuuguuuuaaaaaaca

SEQ ID NO: 4018096 - RNA, 23 nt, Staphylococcus aureus subsp. aureus MW2
uauuuuuaaucuucaucuaaaaa

SEQ ID NO: 4018097 - RNA, 14 nt, Staphylococcus aureus subsp. aureus MW2
uauuuuucaaauaa

SEQ ID NO: 4018098 - RNA, 20 nt, Staphylococcus aureus subsp. aureus MW2
uauuuuugacuguuaaacaa

SEQ ID NO: 4018099 - RNA, 18 nt, Staphylococcus aureus subsp. aureus MW2
uauuuuugucaucaugau

SEQ ID NO: 4018100 - RNA, 13 nt, Staphylococcus aureus subsp. aureus MW2
uauuuuuuaaaau

SEQ ID NO: 4018101 - RNA, 12 nt, Staphylococcus aureus subsp. aureus MW2
uauuuuuuaaug

SEQ ID NO: 4018102 - RNA, 15 nt, Staphylococcus aureus subsp. aureus MW2
uauuuuuuauggucu

SEQ ID NO: 4018103 - RNA, 16 nt, Staphylococcus aureus subsp. aureus MW2
uauuuuuuauguuuua

SEQ ID NO: 4018104 - RNA, 17 nt, Staphylococcus aureus subsp. aureus MW2
uauuuuuuauguuuuaa

SEQ ID NO: 4018105 - RNA, 13 nt, Staphylococcus aureus subsp. aureus MW2
uauuuuuucucua

SEQ ID NO: 4018106 - RNA, 19 nt, Staphylococcus aureus subsp. aureus MW2
uauuuuuugagcacuuaau

SEQ ID NO: 4018107 - RNA, 13 nt, Staphylococcus aureus subsp. aureus MW2
uauuuuuuuaaau

SEQ ID NO: 4018108 - RNA, 12 nt, Staphylococcus aureus subsp. aureus MW2
uauuuuuuuaau

SEQ ID NO: 4018109 - RNA, 17 nt, Staphylococcus aureus subsp. aureus MW2
uauuuuuuuaauaccau

SEQ ID NO: 4018110 - RNA, 14 nt, Staphylococcus aureus subsp. aureus MW2
uauuuuuuuacuuu

SEQ ID NO: 4018111 - RNA, 12 nt, Staphylococcus aureus subsp. aureus MW2
uauuuuuuucuu

SEQ ID NO: 4018112 - RNA, 14 nt, Staphylococcus aureus subsp. aureus MW2
uauuuuuuucuuca

SEQ ID NO: 4018113 - RNA, 18 nt, Staphylococcus aureus subsp. aureus MW2
ucaaaaaaacaaaaaaua

SEQ ID NO: 4018114 - RNA, 12 nt, Staphylococcus aureus subsp. aureus MW2
ucaaaaaaauau

SEQ ID NO: 4018115 - RNA, 11 nt, Staphylococcus aureus subsp. aureus MW2
ucaaaaaggaa

SEQ ID NO: 4018116 - RNA, 17 nt, Staphylococcus aureus subsp. aureus MW2
ucaaaaagucucauuau

SEQ ID NO: 4018117 - RNA, 23 nt, Staphylococcus aureus subsp. aureus MW2
ucaaaaauagcguaauuauuaua

SEQ ID NO: 4018118 - RNA, 12 nt, Staphylococcus aureus subsp. aureus MW2
ucaaaaaucaua

SEQ ID NO: 4018119 - RNA, 12 nt, Staphylococcus aureus subsp. aureus MW2
ucaaaaaugagc

SEQ ID NO: 4018120 - RNA, 19 nt, Staphylococcus aureus subsp. aureus MW2
ucaaaaauguuaucuagua

SEQ ID NO: 4018121 - RNA, 12 nt, Staphylococcus aureus subsp. aureus MW2
ucaaaaauuguu

SEQ ID NO: 4018122 - RNA, 18 nt, Staphylococcus aureus subsp. aureus MW2
ucaaaaauuguuaauaca

SEQ ID NO: 4018123 - RNA, 14 nt, Staphylococcus aureus subsp. aureus MW2
ucaaaacaauuuaa

SEQ ID NO: 4018124 - RNA, 16 nt, Staphylococcus aureus subsp. aureus MW2
ucaaaacaauuuaaaa

SEQ ID NO: 4018125 - RNA, 19 nt, Staphylococcus aureus subsp. aureus MW2
ucaaaacaauuuaaaaagc

SEQ ID NO: 4018126 - RNA, 21 nt, Staphylococcus aureus subsp. aureus MW2
ucaaaacaauuuaaaaagcag

SEQ ID NO: 4018127 - RNA, 17 nt, Staphylococcus aureus subsp. aureus MW2
ucaaaaccgcuauaaaa

SEQ ID NO: 4018128 - RNA, 16 nt, Staphylococcus aureus subsp. aureus MW2
ucaaaacguuuaauug

SEQ ID NO: 4018129 - RNA, 14 nt, Staphylococcus aureus subsp. aureus MW2
ucaaaagaaauugu

SEQ ID NO: 4018130 - RNA, 17 nt, Staphylococcus aureus subsp. aureus MW2
ucaaaaucuuacauuga

SEQ ID NO: 4018131 - RNA, 22 nt, Staphylococcus aureus subsp. aureus MW2
ucaaaaugccggucaaagcgaa

SEQ ID NO: 4018132 - RNA, 13 nt, Staphylococcus aureus subsp. aureus MW2
ucaaaauguuuaa

SEQ ID NO: 4018133 - RNA, 20 nt, Staphylococcus aureus subsp. aureus MW2
ucaaaauguuuaacaauaau

SEQ ID NO: 4018134 - RNA, 23 nt, Staphylococcus aureus subsp. aureus MW2
ucaaaauucugacuaacauuggu

SEQ ID NO: 4018135 - RNA, 12 nt, Staphylococcus aureus subsp. aureus MW2
ucaaaauuuaau

SEQ ID NO: 4018136 - RNA, 22 nt, Staphylococcus aureus subsp. aureus MW2
ucaaaauuuaauugcuguaaau

SEQ ID NO: 4018137 - RNA, 23 nt, Staphylococcus aureus subsp. aureus MW2
ucaaacaaaucuuuuaaauuuag

SEQ ID NO: 4018138 - RNA, 21 nt, Staphylococcus aureus subsp. aureus MW2
ucaaacaacaucacuuuaggg

SEQ ID NO: 4018139 - RNA, 23 nt, Staphylococcus aureus subsp. aureus MW2
ucaaacaggcuuagcuaauucau

SEQ ID NO: 4018140 - RNA, 18 nt, Staphylococcus aureus subsp. aureus MW2
ucaaacauauucauucua

SEQ ID NO: 4018141 - RNA, 14 nt, Staphylococcus aureus subsp. aureus MW2
ucaaaccuguuugg

SEQ ID NO: 4018142 - RNA, 23 nt, Staphylococcus aureus subsp. aureus MW2
ucaaaccuguuuggaaaaucccu

SEQ ID NO: 4018143 - RNA, 18 nt, Staphylococcus aureus subsp. aureus MW2
ucaaacgauuuucaaaac

SEQ ID NO: 4018144 - RNA, 21 nt, Staphylococcus aureus subsp. aureus MW2
ucaaacggcacuaauauuuaa

SEQ ID NO: 4018145 - RNA, 16 nt, Staphylococcus aureus subsp. aureus MW2
ucaaacuuaaaacuau

SEQ ID NO: 4018146 - RNA, 14 nt, Staphylococcus aureus subsp. aureus MW2
ucaaacuuaucgcc

SEQ ID NO: 4018147 - RNA, 13 nt, Staphylococcus aureus subsp. aureus MW2
ucaaacuuuucaa

SEQ ID NO: 4018148 - RNA, 15 nt, Staphylococcus aureus subsp. aureus MW2
ucaaacuuuucaaua

SEQ ID NO: 4018149 - RNA, 23 nt, Staphylococcus aureus subsp. aureus MW2
ucaaagauacaccaauauuuuuc

SEQ ID NO: 4018150 - RNA, 20 nt, Staphylococcus aureus subsp. aureus MW2
ucaaagauuuauaaauguuu

SEQ ID NO: 4018151 - RNA, 13 nt, Staphylococcus aureus subsp. aureus MW2
ucaaagcaucuaa

SEQ ID NO: 4018152 - RNA, 16 nt, Staphylococcus aureus subsp. aureus MW2
ucaaagcaucuaaucc

SEQ ID NO: 4018153 - RNA, 18 nt, Staphylococcus aureus subsp. aureus MW2
ucaaagcgauaaaguaug

SEQ ID NO: 4018154 - RNA, 14 nt, Staphylococcus aureus subsp. aureus MW2
ucaaagcugucaac

SEQ ID NO: 4018155 - RNA, 20 nt, Staphylococcus aureus subsp. aureus MW2
ucaaagcugucaacuugucu

SEQ ID NO: 4018156 - RNA, 22 nt, Staphylococcus aureus subsp. aureus MW2
ucaaagguuuacuauuaaagga

SEQ ID NO: 4018157 - RNA, 17 nt, Staphylococcus aureus subsp. aureus MW2
ucaaaguagacauugaa

SEQ ID NO: 4018158 - RNA, 22 nt, Staphylococcus aureus subsp. aureus MW2
ucaaaguaucuuuugcaccuuc

SEQ ID NO: 4018159 - RNA, 14 nt, Staphylococcus aureus subsp. aureus MW2
ucaaaguuuucauu

SEQ ID NO: 4018160 - RNA, 15 nt, Staphylococcus aureus subsp. aureus MW2
ucaaaguuuucauuu

SEQ ID NO: 4018161 - RNA, 19 nt, Staphylococcus aureus subsp. aureus MW2
ucaaaguuuucauuuaaca

SEQ ID NO: 4018162 - RNA, 17 nt, Staphylococcus aureus subsp. aureus MW2
ucaaauaaccuauuaau

SEQ ID NO: 4018163 - RNA, 14 nt, Staphylococcus aureus subsp. aureus MW2
ucaaauaauauaaa

SEQ ID NO: 4018164 - RNA, 16 nt, Staphylococcus aureus subsp. aureus MW2
ucaaauaauauaaaac

SEQ ID NO: 4018165 - RNA, 14 nt, Staphylococcus aureus subsp. aureus MW2
ucaaauaaugaaua

SEQ ID NO: 4018166 - RNA, 18 nt, Staphylococcus aureus subsp. aureus MW2
ucaaauaaugugaaaaau

SEQ ID NO: 4018167 - RNA, 22 nt, Staphylococcus aureus subsp. aureus MW2
ucaaauaaugugaaaaaucuuc

SEQ ID NO: 4018168 - RNA, 14 nt, Staphylococcus aureus subsp. aureus MW2
ucaaauauuaauuu

SEQ ID NO: 4018169 - RNA, 17 nt, Staphylococcus aureus subsp. aureus MW2
ucaaauauuaauuuaua

SEQ ID NO: 4018170 - RNA, 17 nt, Staphylococcus aureus subsp. aureus MW2
ucaaaugacauuuuaaa

SEQ ID NO: 4018171 - RNA, 22 nt, Staphylococcus aureus subsp. aureus MW2
ucaaaugacauuuuaaaucuaa

SEQ ID NO: 4018172 - RNA, 19 nt, Staphylococcus aureus subsp. aureus MW2
ucaaaugguacaguuaauu

SEQ ID NO: 4018173 - RNA, 15 nt, Staphylococcus aureus subsp. aureus MW2
ucaaauuaaaucacc

SEQ ID NO: 4018174 - RNA, 15 nt, Staphylococcus aureus subsp. aureus MW2
ucaaauuacuuauuc

SEQ ID NO: 4018175 - RNA, 16 nt, Staphylococcus aureus subsp. aureus MW2
ucaaauuacuuauuca

SEQ ID NO: 4018176 - RNA, 13 nt, Staphylococcus aureus subsp. aureus MW2
ucaaauuagauaa

SEQ ID NO: 4018177 - RNA, 18 nt, Staphylococcus aureus subsp. aureus MW2
ucaaauuagauaaaacaa

SEQ ID NO: 4018178 - RNA, 19 nt, Staphylococcus aureus subsp. aureus MW2
ucaaauucaaauuauaauu

SEQ ID NO: 4018179 - RNA, 20 nt, Staphylococcus aureus subsp. aureus MW2
ucaaauucaacgucaucaaa

SEQ ID NO: 4018180 - RNA, 19 nt, Staphylococcus aureus subsp. aureus MW2
ucaaauucucaauuaauuu

SEQ ID NO: 4018181 - RNA, 18 nt, Staphylococcus aureus subsp. aureus MW2
ucaaauugcguuguuuca

SEQ ID NO: 4018182 - RNA, 14 nt, Staphylococcus aureus subsp. aureus MW2
ucaaauugguuuuc

SEQ ID NO: 4018183 - RNA, 13 nt, Staphylococcus aureus subsp. aureus MW2
ucaaauuuuucga

SEQ ID NO: 4018184 - RNA, 22 nt, Staphylococcus aureus subsp. aureus MW2
ucaacaaaucuauaaauaucaa

SEQ ID NO: 4018185 - RNA, 18 nt, Staphylococcus aureus subsp. aureus MW2
ucaacaacgacuuucacu

SEQ ID NO: 4018186 - RNA, 19 nt, Staphylococcus aureus subsp. aureus MW2
ucaacaacgacuuucacua

SEQ ID NO: 4018187 - RNA, 18 nt, Staphylococcus aureus subsp. aureus MW2
ucaacaacugcgacaugu

SEQ ID NO: 4018188 - RNA, 14 nt, Staphylococcus aureus subsp. aureus MW2
ucaacaauauaaaa

SEQ ID NO: 4018189 - RNA, 16 nt, Staphylococcus aureus subsp. aureus MW2
ucaacaauauaaaagc

SEQ ID NO: 4018190 - RNA, 15 nt, Staphylococcus aureus subsp. aureus MW2
ucaacaauuucaaug

SEQ ID NO: 4018191 - RNA, 16 nt, Staphylococcus aureus subsp. aureus MW2
ucaacacgauagucau

SEQ ID NO: 4018192 - RNA, 15 nt, Staphylococcus aureus subsp. aureus MW2
ucaacacuuucuacu

SEQ ID NO: 4018193 - RNA, 18 nt, Staphylococcus aureus subsp. aureus MW2
ucaacagggguaaaacuu

SEQ ID NO: 4018194 - RNA, 14 nt, Staphylococcus aureus subsp. aureus MW2
ucaacaguuucuug

SEQ ID NO: 4018195 - RNA, 19 nt, Staphylococcus aureus subsp. aureus MW2
ucaacauaacaaagucgaa

SEQ ID NO: 4018196 - RNA, 17 nt, Staphylococcus aureus subsp. aureus MW2
ucaacaucaucuuuaau

SEQ ID NO: 4018197 - RNA, 19 nt, Staphylococcus aureus subsp. aureus MW2
ucaacaucaucuuuaauuu

SEQ ID NO: 4018198 - RNA, 21 nt, Staphylococcus aureus subsp. aureus MW2
ucaacaucaucuuuaauuuuc

SEQ ID NO: 4018199 - RNA, 16 nt, Staphylococcus aureus subsp. aureus MW2
ucaacaucaugaacuu

SEQ ID NO: 4018200 - RNA, 20 nt, Staphylococcus aureus subsp. aureus MW2
ucaacaucguauucuuuuaa

SEQ ID NO: 4018201 - RNA, 19 nt, Staphylococcus aureus subsp. aureus MW2
ucaacauuacaugcaccuu

SEQ ID NO: 4018202 - RNA, 18 nt, Staphylococcus aureus subsp. aureus MW2
ucaacauuacuaauugau

SEQ ID NO: 4018203 - RNA, 12 nt, Staphylococcus aureus subsp. aureus MW2
ucaaccauuugu

SEQ ID NO: 4018204 - RNA, 20 nt, Staphylococcus aureus subsp. aureus MW2
ucaaccauuuguucugcaga

SEQ ID NO: 4018205 - RNA, 17 nt, Staphylococcus aureus subsp. aureus MW2
ucaacccaucauguaca

SEQ ID NO: 4018206 - RNA, 14 nt, Staphylococcus aureus subsp. aureus MW2
ucaaccguuuuauu

SEQ ID NO: 4018207 - RNA, 17 nt, Staphylococcus aureus subsp. aureus MW2
ucaaccuguucuuuauu

SEQ ID NO: 4018208 - RNA, 22 nt, Staphylococcus aureus subsp. aureus MW2
ucaaccuuugcuaaaucaagac

SEQ ID NO: 4018209 - RNA, 17 nt, Staphylococcus aureus subsp. aureus MW2
ucaacgccauauuuauu

SEQ ID NO: 4018210 - RNA, 16 nt, Staphylococcus aureus subsp. aureus MW2
ucaacgggaacaucau

SEQ ID NO: 4018211 - RNA, 19 nt, Staphylococcus aureus subsp. aureus MW2
ucaacguauauaaguuaaa

SEQ ID NO: 4018212 - RNA, 16 nt, Staphylococcus aureus subsp. aureus MW2
ucaacgucaucugcuu

SEQ ID NO: 4018213 - RNA, 14 nt, Staphylococcus aureus subsp. aureus MW2
ucaacuaauaacuc

SEQ ID NO: 4018214 - RNA, 17 nt, Staphylococcus aureus subsp. aureus MW2
ucaacuaauaacucagu

SEQ ID NO: 4018215 - RNA, 19 nt, Staphylococcus aureus subsp. aureus MW2
ucaacuaaucguguauuau

SEQ ID NO: 4018216 - RNA, 21 nt, Staphylococcus aureus subsp. aureus MW2
ucaacuaauuuaaagcaucau

SEQ ID NO: 4018217 - RNA, 19 nt, Staphylococcus aureus subsp. aureus MW2
ucaacuacugcuaaaauaa

SEQ ID NO: 4018218 - RNA, 13 nt, Staphylococcus aureus subsp. aureus MW2
ucaacuacuucau

SEQ ID NO: 4018219 - RNA, 14 nt, Staphylococcus aureus subsp. aureus MW2
ucaacuuaaauauc

SEQ ID NO: 4018220 - RNA, 19 nt, Staphylococcus aureus subsp. aureus MW2
ucaacuuuaaucaaaaaga

SEQ ID NO: 4018221 - RNA, 15 nt, Staphylococcus aureus subsp. aureus MW2
ucaacuuuaguuguu

SEQ ID NO: 4018222 - RNA, 16 nt, Staphylococcus aureus subsp. aureus MW2
ucaacuuuaguuguua

SEQ ID NO: 4018223 - RNA, 22 nt, Staphylococcus aureus subsp. aureus MW2
ucaacuuuaguuguuaggggcu

SEQ ID NO: 4018224 - RNA, 14 nt, Staphylococcus aureus subsp. aureus MW2
ucaacuuucucuaa

SEQ ID NO: 4018225 - RNA, 10 nt, Staphylococcus aureus subsp. aureus MW2
ucaacuuuuc

SEQ ID NO: 4018226 - RNA, 16 nt, Staphylococcus aureus subsp. aureus MW2
ucaacuuuuuaauaau

SEQ ID NO: 4018227 - RNA, 18 nt, Staphylococcus aureus subsp. aureus MW2
ucaacuuuuuaauaauac

SEQ ID NO: 4018228 - RNA, 14 nt, Staphylococcus aureus subsp. aureus MW2
ucaacuuuuuuaac

SEQ ID NO: 4018229 - RNA, 15 nt, Staphylococcus aureus subsp. aureus MW2
ucaagaaauguuaaa

SEQ ID NO: 4018230 - RNA, 20 nt, Staphylococcus aureus subsp. aureus MW2
ucaagaaauguuaaauuaaa

SEQ ID NO: 4018231 - RNA, 14 nt, Staphylococcus aureus subsp. aureus MW2
ucaagaacuuuaaa

SEQ ID NO: 4018232 - RNA, 18 nt, Staphylococcus aureus subsp. aureus MW2
ucaagaacuuuaaaaauu

SEQ ID NO: 4018233 - RNA, 13 nt, Staphylococcus aureus subsp. aureus MW2
ucaagaauauaaa

SEQ ID NO: 4018234 - RNA, 19 nt, Staphylococcus aureus subsp. aureus MW2
ucaagaaugugaacaucua

SEQ ID NO: 4018235 - RNA, 22 nt, Staphylococcus aureus subsp. aureus MW2
ucaagacucccuuuuuaaaaua

SEQ ID NO: 4018236 - RNA, 16 nt, Staphylococcus aureus subsp. aureus MW2
ucaagagguaaaucug

SEQ ID NO: 4018237 - RNA, 19 nt, Staphylococcus aureus subsp. aureus MW2
ucaagauauccauuaugau

SEQ ID NO: 4018238 - RNA, 18 nt, Staphylococcus aureus subsp. aureus MW2
ucaagcaucauuuuucgu

SEQ ID NO: 4018239 - RNA, 14 nt, Staphylococcus aureus subsp. aureus MW2
ucaagcuuaauaag

SEQ ID NO: 4018240 - RNA, 22 nt, Staphylococcus aureus subsp. aureus MW2
ucaagcuuugcugcuuuuccau

SEQ ID NO: 4018241 - RNA, 17 nt, Staphylococcus aureus subsp. aureus MW2
ucaagguauacacaaau

SEQ ID NO: 4018242 - RNA, 14 nt, Staphylococcus aureus subsp. aureus MW2
ucaaguaaauguuu

SEQ ID NO: 4018243 - RNA, 12 nt, Staphylococcus aureus subsp. aureus MW2
ucaaguaacuca

SEQ ID NO: 4018244 - RNA, 16 nt, Staphylococcus aureus subsp. aureus MW2
ucaaguaaucauuuuu

SEQ ID NO: 4018245 - RNA, 20 nt, Staphylococcus aureus subsp. aureus MW2
ucaaguauauccgcaucuuu

SEQ ID NO: 4018246 - RNA, 19 nt, Staphylococcus aureus subsp. aureus MW2
ucaaguucaccguaaucuu

SEQ ID NO: 4018247 - RNA, 20 nt, Staphylococcus aureus subsp. aureus MW2
ucaaguucaccguaaucuuu

SEQ ID NO: 4018248 - RNA, 22 nt, Staphylococcus aureus subsp. aureus MW2
ucaaguuuacgaucauaaauau

SEQ ID NO: 4018249 - RNA, 21 nt, Staphylococcus aureus subsp. aureus MW2
ucaaguuuuggucaaguaaau

SEQ ID NO: 4018250 - RNA, 12 nt, Staphylococcus aureus subsp. aureus MW2
ucaauaaaaaug

SEQ ID NO: 4018251 - RNA, 15 nt, Staphylococcus aureus subsp. aureus MW2
ucaauaaaaauugaa

SEQ ID NO: 4018252 - RNA, 20 nt, Staphylococcus aureus subsp. aureus MW2
ucaauaaaaauugaauuaug

SEQ ID NO: 4018253 - RNA, 22 nt, Staphylococcus aureus subsp. aureus MW2
ucaauaaaaauugaauuaugau

SEQ ID NO: 4018254 - RNA, 13 nt, Staphylococcus aureus subsp. aureus MW2
ucaauaaauaaac

SEQ ID NO: 4018255 - RNA, 12 nt, Staphylococcus aureus subsp. aureus MW2
ucaauaaauugu

SEQ ID NO: 4018256 - RNA, 14 nt, Staphylococcus aureus subsp. aureus MW2
ucaauaaauuguuu

SEQ ID NO: 4018257 - RNA, 14 nt, Staphylococcus aureus subsp. aureus MW2
ucaauaacaccuuu

SEQ ID NO: 4018258 - RNA, 19 nt, Staphylococcus aureus subsp. aureus MW2
ucaauaacaccuuucauuu

SEQ ID NO: 4018259 - RNA, 16 nt, Staphylococcus aureus subsp. aureus MW2
ucaauaagauuuugcu

SEQ ID NO: 4018260 - RNA, 14 nt, Staphylococcus aureus subsp. aureus MW2
ucaauaccaacugu

SEQ ID NO: 4018261 - RNA, 20 nt, Staphylococcus aureus subsp. aureus MW2
ucaauaccauaauuaaauaa

SEQ ID NO: 4018262 - RNA, 15 nt, Staphylococcus aureus subsp. aureus MW2
ucaauagaugaaaau

SEQ ID NO: 4018263 - RNA, 15 nt, Staphylococcus aureus subsp. aureus MW2
ucaauaguuuauaau

SEQ ID NO: 4018264 - RNA, 17 nt, Staphylococcus aureus subsp. aureus MW2
ucaauaguuuauaauuu

SEQ ID NO: 4018265 - RNA, 16 nt, Staphylococcus aureus subsp. aureus MW2
ucaauaucacuaucag

SEQ ID NO: 4018266 - RNA, 16 nt, Staphylococcus aureus subsp. aureus MW2
ucaauaucauucaugu

SEQ ID NO: 4018267 - RNA, 14 nt, Staphylococcus aureus subsp. aureus MW2
ucaauaucuucuaa

SEQ ID NO: 4018268 - RNA, 24 nt, Staphylococcus aureus subsp. aureus MW2
ucaauaucuucuucuaaccacuuc

SEQ ID NO: 4018269 - RNA, 16 nt, Staphylococcus aureus subsp. aureus MW2
ucaauaugaaaccuuu

SEQ ID NO: 4018270 - RNA, 12 nt, Staphylococcus aureus subsp. aureus MW2
ucaauauuaaaa

SEQ ID NO: 4018271 - RNA, 22 nt, Staphylococcus aureus subsp. aureus MW2
ucaauauuacuuuaucucauug

SEQ ID NO: 4018272 - RNA, 18 nt, Staphylococcus aureus subsp. aureus MW2
ucaauauugucuucauua

SEQ ID NO: 4018273 - RNA, 13 nt, Staphylococcus aureus subsp. aureus MW2
ucaauauuuaaau

SEQ ID NO: 4018274 - RNA, 23 nt, Staphylococcus aureus subsp. aureus MW2
ucaaucaacgagucauaaauaua

SEQ ID NO: 4018275 - RNA, 17 nt, Staphylococcus aureus subsp. aureus MW2
ucaaucaucaagacauu

SEQ ID NO: 4018276 - RNA, 23 nt, Staphylococcus aureus subsp. aureus MW2
ucaauccaagcaaucuuaguaca

SEQ ID NO: 4018277 - RNA, 14 nt, Staphylococcus aureus subsp. aureus MW2
ucaauccaauuaaa

SEQ ID NO: 4018278 - RNA, 16 nt, Staphylococcus aureus subsp. aureus MW2
ucaauccaauuaaaua

SEQ ID NO: 4018279 - RNA, 21 nt, Staphylococcus aureus subsp. aureus MW2
ucaauccuaaauuauaaauag

SEQ ID NO: 4018280 - RNA, 21 nt, Staphylococcus aureus subsp. aureus MW2
ucaaucgcaucuguuaacuga

SEQ ID NO: 4018281 - RNA, 15 nt, Staphylococcus aureus subsp. aureus MW2
ucaaugaauucauuu

SEQ ID NO: 4018282 - RNA, 14 nt, Staphylococcus aureus subsp. aureus MW2
ucaaugaauuuacu

SEQ ID NO: 4018283 - RNA, 13 nt, Staphylococcus aureus subsp. aureus MW2
ucaaugacaucua

SEQ ID NO: 4018284 - RNA, 19 nt, Staphylococcus aureus subsp. aureus MW2
ucaaugacugagaaaaaua

SEQ ID NO: 4018285 - RNA, 17 nt, Staphylococcus aureus subsp. aureus MW2
ucaaugacuuaacaucu

SEQ ID NO: 4018286 - RNA, 18 nt, Staphylococcus aureus subsp. aureus MW2
ucaaugacuuaacaucuu

SEQ ID NO: 4018287 - RNA, 19 nt, Staphylococcus aureus subsp. aureus MW2
ucaaugauuugauaauauu

SEQ ID NO: 4018288 - RNA, 20 nt, Staphylococcus aureus subsp. aureus MW2
ucaaugauuugauaauauua

SEQ ID NO: 4018289 - RNA, 16 nt, Staphylococcus aureus subsp. aureus MW2
ucaaugauuuuuaaaa

SEQ ID NO: 4018290 - RNA, 15 nt, Staphylococcus aureus subsp. aureus MW2
ucaaugcauauucua

SEQ ID NO: 4018291 - RNA, 16 nt, Staphylococcus aureus subsp. aureus MW2
ucaaugcuuucaucuu

SEQ ID NO: 4018292 - RNA, 13 nt, Staphylococcus aureus subsp. aureus MW2
ucaauguaucaag

SEQ ID NO: 4018293 - RNA, 21 nt, Staphylococcus aureus subsp. aureus MW2
ucaaugugauuuucuuucaua

SEQ ID NO: 4018294 - RNA, 14 nt, Staphylococcus aureus subsp. aureus MW2
ucaauguuuaauuu

SEQ ID NO: 4018295 - RNA, 16 nt, Staphylococcus aureus subsp. aureus MW2
ucaauguuuaauuuuc

SEQ ID NO: 4018296 - RNA, 20 nt, Staphylococcus aureus subsp. aureus MW2
ucaauuaauuuaaaugcuua

SEQ ID NO: 4018297 - RNA, 14 nt, Staphylococcus aureus subsp. aureus MW2
ucaauuaauuuagu

SEQ ID NO: 4018298 - RNA, 23 nt, Staphylococcus aureus subsp. aureus MW2
ucaauuaauuuagucauuacaaa

SEQ ID NO: 4018299 - RNA, 15 nt, Staphylococcus aureus subsp. aureus MW2
ucaauuagaaaauuu

SEQ ID NO: 4018300 - RNA, 21 nt, Staphylococcus aureus subsp. aureus MW2
ucaauucacgagcugcuucaa

SEQ ID NO: 4018301 - RNA, 15 nt, Staphylococcus aureus subsp. aureus MW2
ucaauucgcucacau

SEQ ID NO: 4018302 - RNA, 15 nt, Staphylococcus aureus subsp. aureus MW2
ucaauuguaaaucuu

SEQ ID NO: 4018303 - RNA, 23 nt, Staphylococcus aureus subsp. aureus MW2
ucaauuguugcaaaauacgauuu

SEQ ID NO: 4018304 - RNA, 12 nt, Staphylococcus aureus subsp. aureus MW2
ucaauuuaaaua

SEQ ID NO: 4018305 - RNA, 18 nt, Staphylococcus aureus subsp. aureus MW2
ucaauuuaguauaaauaa

SEQ ID NO: 4018306 - RNA, 22 nt, Staphylococcus aureus subsp. aureus MW2
ucaauuuaguauaaauaaaaau

SEQ ID NO: 4018307 - RNA, 16 nt, Staphylococcus aureus subsp. aureus MW2
ucaauuuaguucacaa

SEQ ID NO: 4018308 - RNA, 14 nt, Staphylococcus aureus subsp. aureus MW2
ucaauuucaccuug

SEQ ID NO: 4018309 - RNA, 19 nt, Staphylococcus aureus subsp. aureus MW2
ucaauuuuaccagcaugaa

SEQ ID NO: 4018310 - RNA, 21 nt, Staphylococcus aureus subsp. aureus MW2
ucaauuuuuucaugauuuacu

SEQ ID NO: 4018311 - RNA, 22 nt, Staphylococcus aureus subsp. aureus MW2
ucacaaaauuaggcauucaucu

SEQ ID NO: 4018312 - RNA, 18 nt, Staphylococcus aureus subsp. aureus MW2
ucacaaauuugaauauac

SEQ ID NO: 4018313 - RNA, 15 nt, Staphylococcus aureus subsp. aureus MW2
ucacaacacauaaau

SEQ ID NO: 4018314 - RNA, 12 nt, Staphylococcus aureus subsp. aureus MW2
ucacaacagugc

SEQ ID NO: 4018315 - RNA, 15 nt, Staphylococcus aureus subsp. aureus MW2
ucacaaguucaggau

SEQ ID NO: 4018316 - RNA, 23 nt, Staphylococcus aureus subsp. aureus MW2
ucacaauacgaaaccaaaaauaa

SEQ ID NO: 4018317 - RNA, 16 nt, Staphylococcus aureus subsp. aureus MW2
ucacaaucauagauau

SEQ ID NO: 4018318 - RNA, 13 nt, Staphylococcus aureus subsp. aureus MW2
ucacaaugaccau

SEQ ID NO: 4018319 - RNA, 12 nt, Staphylococcus aureus subsp. aureus MW2
ucacaccugcaa

SEQ ID NO: 4018320 - RNA, 20 nt, Staphylococcus aureus subsp. aureus MW2
ucacaccugcaauguagcaa

SEQ ID NO: 4018321 - RNA, 23 nt, Staphylococcus aureus subsp. aureus MW2
ucacacgacauguagguaauugc

SEQ ID NO: 4018322 - RNA, 17 nt, Staphylococcus aureus subsp. aureus MW2
ucacagaaaauacauuu

SEQ ID NO: 4018323 - RNA, 15 nt, Staphylococcus aureus subsp. aureus MW2
ucacagcaauaauaa

SEQ ID NO: 4018324 - RNA, 24 nt, Staphylococcus aureus subsp. aureus MW2
ucacauacauuuugaaacaucuaa

SEQ ID NO: 4018325 - RNA, 16 nt, Staphylococcus aureus subsp. aureus MW2
ucacauagccucuuaa

SEQ ID NO: 4018326 - RNA, 23 nt, Staphylococcus aureus subsp. aureus MW2
ucacauagccucuuaaaauaccu

SEQ ID NO: 4018327 - RNA, 22 nt, Staphylococcus aureus subsp. aureus MW2
ucacaucacguugugcaauacc

SEQ ID NO: 4018328 - RNA, 13 nt, Staphylococcus aureus subsp. aureus MW2
ucacaucagugug

SEQ ID NO: 4018329 - RNA, 23 nt, Staphylococcus aureus subsp. aureus MW2
ucacaucuuuagcuauuuaaaau

SEQ ID NO: 4018330 - RNA, 12 nt, Staphylococcus aureus subsp. aureus MW2
ucacaugaauuu

SEQ ID NO: 4018331 - RNA, 18 nt, Staphylococcus aureus subsp. aureus MW2
ucacaugaauuuuaauau

SEQ ID NO: 4018332 - RNA, 22 nt, Staphylococcus aureus subsp. aureus MW2
ucacaugaauuuuaauauauuu

SEQ ID NO: 4018333 - RNA, 15 nt, Staphylococcus aureus subsp. aureus MW2
ucacaugugaaauaa

SEQ ID NO: 4018334 - RNA, 16 nt, Staphylococcus aureus subsp. aureus MW2
ucacaugugaaauaau

SEQ ID NO: 4018335 - RNA, 22 nt, Staphylococcus aureus subsp. aureus MW2
ucacauugucuacaaaguuaau

SEQ ID NO: 4018336 - RNA, 13 nt, Staphylococcus aureus subsp. aureus MW2
ucaccaacugaac

SEQ ID NO: 4018337 - RNA, 17 nt, Staphylococcus aureus subsp. aureus MW2
ucaccaacuuuuuuaac

SEQ ID NO: 4018338 - RNA, 16 nt, Staphylococcus aureus subsp. aureus MW2
ucaccagcucguuuuu

SEQ ID NO: 4018339 - RNA, 23 nt, Staphylococcus aureus subsp. aureus MW2
ucaccaguuugugguaaugauuu

SEQ ID NO: 4018340 - RNA, 14 nt, Staphylococcus aureus subsp. aureus MW2
ucaccauaaaaaua

SEQ ID NO: 4018341 - RNA, 17 nt, Staphylococcus aureus subsp. aureus MW2
ucaccauacuaaaacau

SEQ ID NO: 4018342 - RNA, 22 nt, Staphylococcus aureus subsp. aureus MW2
ucaccaucugcaacuaauauga

SEQ ID NO: 4018343 - RNA, 13 nt, Staphylococcus aureus subsp. aureus MW2
ucaccaucuuuaa

SEQ ID NO: 4018344 - RNA, 18 nt, Staphylococcus aureus subsp. aureus MW2
ucacccuucccuaucaua

SEQ ID NO: 4018345 - RNA, 19 nt, Staphylococcus aureus subsp. aureus MW2
ucaccguaaucuuuuaacu

SEQ ID NO: 4018346 - RNA, 22 nt, Staphylococcus aureus subsp. aureus MW2
ucaccguaugauggaaucauuu

SEQ ID NO: 4018347 - RNA, 14 nt, Staphylococcus aureus subsp. aureus MW2
ucaccuaaugcuuu

SEQ ID NO: 4018348 - RNA, 17 nt, Staphylococcus aureus subsp. aureus MW2
ucaccuacuacaaauuu

SEQ ID NO: 4018349 - RNA, 17 nt, Staphylococcus aureus subsp. aureus MW2
ucaccugaugaauagau

SEQ ID NO: 4018350 - RNA, 24 nt, Staphylococcus aureus subsp. aureus MW2
ucaccuguagacaauuguaguaau

SEQ ID NO: 4018351 - RNA, 14 nt, Staphylococcus aureus subsp. aureus MW2
ucaccuuuaggcaa

SEQ ID NO: 4018352 - RNA, 21 nt, Staphylococcus aureus subsp. aureus MW2
ucaccuuuaggcaaauaaccu

SEQ ID NO: 4018353 - RNA, 14 nt, Staphylococcus aureus subsp. aureus MW2
ucaccuuuuuuaac

SEQ ID NO: 4018354 - RNA, 15 nt, Staphylococcus aureus subsp. aureus MW2
ucaccuuuuuuaacu

SEQ ID NO: 4018355 - RNA, 18 nt, Staphylococcus aureus subsp. aureus MW2
ucaccuuuuuuaacuuua

SEQ ID NO: 4018356 - RNA, 21 nt, Staphylococcus aureus subsp. aureus MW2
ucaccuuuuuuaacuuuaaca

SEQ ID NO: 4018357 - RNA, 14 nt, Staphylococcus aureus subsp. aureus MW2
ucacgaauaucuua

SEQ ID NO: 4018358 - RNA, 22 nt, Staphylococcus aureus subsp. aureus MW2
ucacgauagauuuaucaccuuu

SEQ ID NO: 4018359 - RNA, 19 nt, Staphylococcus aureus subsp. aureus MW2
ucacgauauaacauuaaaa

SEQ ID NO: 4018360 - RNA, 17 nt, Staphylococcus aureus subsp. aureus MW2
ucacgauuaauaaaauu

SEQ ID NO: 4018361 - RNA, 15 nt, Staphylococcus aureus subsp. aureus MW2
ucacgauuuuuaaaa

SEQ ID NO: 4018362 - RNA, 18 nt, Staphylococcus aureus subsp. aureus MW2
ucacgauuuuuaaaaugc

SEQ ID NO: 4018363 - RNA, 20 nt, Staphylococcus aureus subsp. aureus MW2
ucacgauuuuuaaaaugcuu

SEQ ID NO: 4018364 - RNA, 17 nt, Staphylococcus aureus subsp. aureus MW2
ucacguaaugaaucaau

SEQ ID NO: 4018365 - RNA, 16 nt, Staphylococcus aureus subsp. aureus MW2
ucacgugguuucuuua

SEQ ID NO: 4018366 - RNA, 18 nt, Staphylococcus aureus subsp. aureus MW2
ucacguugugcaauaccu

SEQ ID NO: 4018367 - RNA, 17 nt, Staphylococcus aureus subsp. aureus MW2
ucacuaaaaauauauuu

SEQ ID NO: 4018368 - RNA, 12 nt, Staphylococcus aureus subsp. aureus MW2
ucacuaaaaauc

SEQ ID NO: 4018369 - RNA, 13 nt, Staphylococcus aureus subsp. aureus MW2
ucacuaaaguaaa

SEQ ID NO: 4018370 - RNA, 18 nt, Staphylococcus aureus subsp. aureus MW2
ucacuaaaguaaauaaca

SEQ ID NO: 4018371 - RNA, 14 nt, Staphylococcus aureus subsp. aureus MW2
ucacuaauauauuu

SEQ ID NO: 4018372 - RNA, 16 nt, Staphylococcus aureus subsp. aureus MW2
ucacuaaugcauaauu

SEQ ID NO: 4018373 - RNA, 18 nt, Staphylococcus aureus subsp. aureus MW2
ucacuagauaguuuauac

SEQ ID NO: 4018374 - RNA, 16 nt, Staphylococcus aureus subsp. aureus MW2
ucacuaggauguucau

SEQ ID NO: 4018375 - RNA, 19 nt, Staphylococcus aureus subsp. aureus MW2
ucacuaggauguucaucaa

SEQ ID NO: 4018376 - RNA, 16 nt, Staphylococcus aureus subsp. aureus MW2
ucacuaguguauacaa

SEQ ID NO: 4018377 - RNA, 13 nt, Staphylococcus aureus subsp. aureus MW2
ucacuaucagcuu

SEQ ID NO: 4018378 - RNA, 14 nt, Staphylococcus aureus subsp. aureus MW2
ucacuauuuuagcu

SEQ ID NO: 4018379 - RNA, 23 nt, Staphylococcus aureus subsp. aureus MW2
ucacuccucuauuuuaugauuug

SEQ ID NO: 4018380 - RNA, 14 nt, Staphylococcus aureus subsp. aureus MW2
ucacugaaugcuaa

SEQ ID NO: 4018381 - RNA, 20 nt, Staphylococcus aureus subsp. aureus MW2
ucacugcaaacacaguacaa

SEQ ID NO: 4018382 - RNA, 18 nt, Staphylococcus aureus subsp. aureus MW2
ucacugcaacacaggccg

SEQ ID NO: 4018383 - RNA, 20 nt, Staphylococcus aureus subsp. aureus MW2
ucacuggguguuuuuuucuu

SEQ ID NO: 4018384 - RNA, 23 nt, Staphylococcus aureus subsp. aureus MW2
ucacuggguguuuuuuucuuaug

SEQ ID NO: 4018385 - RNA, 15 nt, Staphylococcus aureus subsp. aureus MW2
ucacuguagauucaa

SEQ ID NO: 4018386 - RNA, 13 nt, Staphylococcus aureus subsp. aureus MW2
ucacuguuuuauu

SEQ ID NO: 4018387 - RNA, 16 nt, Staphylococcus aureus subsp. aureus MW2
ucacuguuuuauuaug

SEQ ID NO: 4018388 - RNA, 17 nt, Staphylococcus aureus subsp. aureus MW2
ucacuuaauaaauaauu

SEQ ID NO: 4018389 - RNA, 19 nt, Staphylococcus aureus subsp. aureus MW2
ucacuuaauaaauaauuuc

SEQ ID NO: 4018390 - RNA, 20 nt, Staphylococcus aureus subsp. aureus MW2
ucacuuacugugaaaauacc

SEQ ID NO: 4018391 - RNA, 14 nt, Staphylococcus aureus subsp. aureus MW2
ucacuucugaaaau

SEQ ID NO: 4018392 - RNA, 21 nt, Staphylococcus aureus subsp. aureus MW2
ucacuucuuaaaauaugauuu

SEQ ID NO: 4018393 - RNA, 20 nt, Staphylococcus aureus subsp. aureus MW2
ucacuuggauucaaaugaca

SEQ ID NO: 4018394 - RNA, 20 nt, Staphylococcus aureus subsp. aureus MW2
ucacuuggcgacauuuguaa

SEQ ID NO: 4018395 - RNA, 15 nt, Staphylococcus aureus subsp. aureus MW2
ucacuugguacaccu

SEQ ID NO: 4018396 - RNA, 15 nt, Staphylococcus aureus subsp. aureus MW2
ucacuuuaacuucuu

SEQ ID NO: 4018397 - RNA, 18 nt, Staphylococcus aureus subsp. aureus MW2
ucacuuuaacuucuuuug

SEQ ID NO: 4018398 - RNA, 14 nt, Staphylococcus aureus subsp. aureus MW2
ucagaaauuuaaua

SEQ ID NO: 4018399 - RNA, 20 nt, Staphylococcus aureus subsp. aureus MW2
ucagaaguuguuuagaaaag

SEQ ID NO: 4018400 - RNA, 16 nt, Staphylococcus aureus subsp. aureus MW2
ucagaaucaaguaauu

SEQ ID NO: 4018401 - RNA, 19 nt, Staphylococcus aureus subsp. aureus MW2
ucagaaugaacuucucuua

SEQ ID NO: 4018402 - RNA, 17 nt, Staphylococcus aureus subsp. aureus MW2
ucagaugaauaauguuu

SEQ ID NO: 4018403 - RNA, 23 nt, Staphylococcus aureus subsp. aureus MW2
ucagauucauaucuuucaauuaa

SEQ ID NO: 4018404 - RNA, 15 nt, Staphylococcus aureus subsp. aureus MW2
ucagauuuuauuaaa

SEQ ID NO: 4018405 - RNA, 20 nt, Staphylococcus aureus subsp. aureus MW2
ucagcaaaaagcccuauuau

SEQ ID NO: 4018406 - RNA, 20 nt, Staphylococcus aureus subsp. aureus MW2
ucagcaccgacaauuauaau

SEQ ID NO: 4018407 - RNA, 21 nt, Staphylococcus aureus subsp. aureus MW2
ucagcaccgccugaaauagcu

SEQ ID NO: 4018408 - RNA, 17 nt, Staphylococcus aureus subsp. aureus MW2
ucagcauacaauaaugu

SEQ ID NO: 4018409 - RNA, 19 nt, Staphylococcus aureus subsp. aureus MW2
ucagcauuaaucguauuuu

SEQ ID NO: 4018410 - RNA, 20 nt, Staphylococcus aureus subsp. aureus MW2
ucagcauugggacauaaaau

SEQ ID NO: 4018411 - RNA, 21 nt, Staphylococcus aureus subsp. aureus MW2
ucagcauugggacauaaaauu

SEQ ID NO: 4018412 - RNA, 14 nt, Staphylococcus aureus subsp. aureus MW2
ucagcauuuaaguu

SEQ ID NO: 4018413 - RNA, 14 nt, Staphylococcus aureus subsp. aureus MW2
ucagccacugucau

SEQ ID NO: 4018414 - RNA, 22 nt, Staphylococcus aureus subsp. aureus MW2
ucagccauaauaucuuuuaaug

SEQ ID NO: 4018415 - RNA, 19 nt, Staphylococcus aureus subsp. aureus MW2
ucagcguuaucuuuaagua

SEQ ID NO: 4018416 - RNA, 15 nt, Staphylococcus aureus subsp. aureus MW2
ucagcuaaguuaaau

SEQ ID NO: 4018417 - RNA, 13 nt, Staphylococcus aureus subsp. aureus MW2
ucagcuauaaaag

SEQ ID NO: 4018418 - RNA, 17 nt, Staphylococcus aureus subsp. aureus MW2
ucagcuuacaauaaugu

SEQ ID NO: 4018419 - RNA, 13 nt, Staphylococcus aureus subsp. aureus MW2
ucagcuuauuaag

SEQ ID NO: 4018420 - RNA, 16 nt, Staphylococcus aureus subsp. aureus MW2
ucagcuuuaauaauau

SEQ ID NO: 4018421 - RNA, 18 nt, Staphylococcus aureus subsp. aureus MW2
ucagcuuuggcgacauaa

SEQ ID NO: 4018422 - RNA, 16 nt, Staphylococcus aureus subsp. aureus MW2
ucagcuuuucaguuuu

SEQ ID NO: 4018423 - RNA, 13 nt, Staphylococcus aureus subsp. aureus MW2
ucagcuuuuucac

SEQ ID NO: 4018424 - RNA, 17 nt, Staphylococcus aureus subsp. aureus MW2
ucagcuuuuuuacauug

SEQ ID NO: 4018425 - RNA, 14 nt, Staphylococcus aureus subsp. aureus MW2
ucaggaauagaugu

SEQ ID NO: 4018426 - RNA, 17 nt, Staphylococcus aureus subsp. aureus MW2
ucaggcugggacauaaa

SEQ ID NO: 4018427 - RNA, 18 nt, Staphylococcus aureus subsp. aureus MW2
ucaggcuuuguuuuucac

SEQ ID NO: 4018428 - RNA, 14 nt, Staphylococcus aureus subsp. aureus MW2
ucagggaaaucauc

SEQ ID NO: 4018429 - RNA, 16 nt, Staphylococcus aureus subsp. aureus MW2
ucagggaaaucaucug

SEQ ID NO: 4018430 - RNA, 17 nt, Staphylococcus aureus subsp. aureus MW2
ucagggacaaaaauucu

SEQ ID NO: 4018431 - RNA, 19 nt, Staphylococcus aureus subsp. aureus MW2
ucaggggccccaacacaga

SEQ ID NO: 4018432 - RNA, 13 nt, Staphylococcus aureus subsp. aureus MW2
ucagguaauguuu

SEQ ID NO: 4018433 - RNA, 14 nt, Staphylococcus aureus subsp. aureus MW2
ucaguaacauguaa

SEQ ID NO: 4018434 - RNA, 16 nt, Staphylococcus aureus subsp. aureus MW2
ucaguaaucuuguuuu

SEQ ID NO: 4018435 - RNA, 17 nt, Staphylococcus aureus subsp. aureus MW2
ucaguacgaacaacuaa

SEQ ID NO: 4018436 - RNA, 23 nt, Staphylococcus aureus subsp. aureus MW2
ucaguacgguuauuuaauaaugc

SEQ ID NO: 4018437 - RNA, 16 nt, Staphylococcus aureus subsp. aureus MW2
ucaguauuuaauguuu

SEQ ID NO: 4018438 - RNA, 17 nt, Staphylococcus aureus subsp. aureus MW2
ucaguauuuaauguuuu

SEQ ID NO: 4018439 - RNA, 18 nt, Staphylococcus aureus subsp. aureus MW2
ucaguauuuaauguuuua

SEQ ID NO: 4018440 - RNA, 19 nt, Staphylococcus aureus subsp. aureus MW2
ucagucaacuacugucaau

SEQ ID NO: 4018441 - RNA, 15 nt, Staphylococcus aureus subsp. aureus MW2
ucagucaguaaaaau

SEQ ID NO: 4018442 - RNA, 16 nt, Staphylococcus aureus subsp. aureus MW2
ucagucaguaaaaaua

SEQ ID NO: 4018443 - RNA, 14 nt, Staphylococcus aureus subsp. aureus MW2
ucagucuucauguu

SEQ ID NO: 4018444 - RNA, 14 nt, Staphylococcus aureus subsp. aureus MW2
ucagugaagcuaga

SEQ ID NO: 4018445 - RNA, 13 nt, Staphylococcus aureus subsp. aureus MW2
ucagugcauuuuu

SEQ ID NO: 4018446 - RNA, 23 nt, Staphylococcus aureus subsp. aureus MW2
ucagugcauuuuuuauuuuacuu

SEQ ID NO: 4018447 - RNA, 13 nt, Staphylococcus aureus subsp. aureus MW2
ucaguuaaaucuu

SEQ ID NO: 4018448 - RNA, 14 nt, Staphylococcus aureus subsp. aureus MW2
ucaguuaaaucuuu

SEQ ID NO: 4018449 - RNA, 17 nt, Staphylococcus aureus subsp. aureus MW2
ucaguuagcuuauuuag

SEQ ID NO: 4018450 - RNA, 19 nt, Staphylococcus aureus subsp. aureus MW2
ucaguuagcuuauuuagaa

SEQ ID NO: 4018451 - RNA, 18 nt, Staphylococcus aureus subsp. aureus MW2
ucaguucaaacagaaauu

SEQ ID NO: 4018452 - RNA, 16 nt, Staphylococcus aureus subsp. aureus MW2
ucaguugagucaauuu

SEQ ID NO: 4018453 - RNA, 13 nt, Staphylococcus aureus subsp. aureus MW2
ucauaaaauuuaa

SEQ ID NO: 4018454 - RNA, 15 nt, Staphylococcus aureus subsp. aureus MW2
ucauaaaauuuaaaa

SEQ ID NO: 4018455 - RNA, 19 nt, Staphylococcus aureus subsp. aureus MW2
ucauaaacgaaaauacuca

SEQ ID NO: 4018456 - RNA, 15 nt, Staphylococcus aureus subsp. aureus MW2
ucauaaacucuuaua

SEQ ID NO: 4018457 - RNA, 15 nt, Staphylococcus aureus subsp. aureus MW2
ucauaaaguuuauuu

SEQ ID NO: 4018458 - RNA, 22 nt, Staphylococcus aureus subsp. aureus MW2
ucauaaaguuuauuuauguucg

SEQ ID NO: 4018459 - RNA, 12 nt, Staphylococcus aureus subsp. aureus MW2
ucauaaauauaa

SEQ ID NO: 4018460 - RNA, 15 nt, Staphylococcus aureus subsp. aureus MW2
ucauaaauauaaaau

SEQ ID NO: 4018461 - RNA, 16 nt, Staphylococcus aureus subsp. aureus MW2
ucauaaauauaaaaua

SEQ ID NO: 4018462 - RNA, 13 nt, Staphylococcus aureus subsp. aureus MW2
ucauaaauauuuu

SEQ ID NO: 4018463 - RNA, 15 nt, Staphylococcus aureus subsp. aureus MW2
ucauaaaucaugaaa

SEQ ID NO: 4018464 - RNA, 22 nt, Staphylococcus aureus subsp. aureus MW2
ucauaaaucaugaaauuaaaaa

SEQ ID NO: 4018465 - RNA, 14 nt, Staphylococcus aureus subsp. aureus MW2
ucauaaaugacuga

SEQ ID NO: 4018466 - RNA, 13 nt, Staphylococcus aureus subsp. aureus MW2
ucauaacaacauc

SEQ ID NO: 4018467 - RNA, 21 nt, Staphylococcus aureus subsp. aureus MW2
ucauaaccgcuucuuuuaagu

SEQ ID NO: 4018468 - RNA, 22 nt, Staphylococcus aureus subsp. aureus MW2
ucauaacgauuguugcaaugau

SEQ ID NO: 4018469 - RNA, 13 nt, Staphylococcus aureus subsp. aureus MW2
ucauaauaauuca

SEQ ID NO: 4018470 - RNA, 18 nt, Staphylococcus aureus subsp. aureus MW2
ucauaaucaagucugcau

SEQ ID NO: 4018471 - RNA, 21 nt, Staphylococcus aureus subsp. aureus MW2
ucauaaugugaugguucaaau

SEQ ID NO: 4018472 - RNA, 21 nt, Staphylococcus aureus subsp. aureus MW2
ucauaauuaaauagcuuuacu

SEQ ID NO: 4018473 - RNA, 13 nt, Staphylococcus aureus subsp. aureus MW2
ucauaauuccaua

SEQ ID NO: 4018474 - RNA, 22 nt, Staphylococcus aureus subsp. aureus MW2
ucauaauuuccugaugaggcua

SEQ ID NO: 4018475 - RNA, 16 nt, Staphylococcus aureus subsp. aureus MW2
ucauaauuuucuauua

SEQ ID NO: 4018476 - RNA, 18 nt, Staphylococcus aureus subsp. aureus MW2
ucauaccgaagaaacuaa

SEQ ID NO: 4018477 - RNA, 16 nt, Staphylococcus aureus subsp. aureus MW2
ucauaccuuuuaauuu

SEQ ID NO: 4018478 - RNA, 18 nt, Staphylococcus aureus subsp. aureus MW2
ucauacgagaaauuagaa

SEQ ID NO: 4018479 - RNA, 22 nt, Staphylococcus aureus subsp. aureus MW2
ucauacguucaaucgcaucugu

SEQ ID NO: 4018480 - RNA, 18 nt, Staphylococcus aureus subsp. aureus MW2
ucauagaccuaugaauuu

SEQ ID NO: 4018481 - RNA, 14 nt, Staphylococcus aureus subsp. aureus MW2
ucauagcauuaaga

SEQ ID NO: 4018482 - RNA, 11 nt, Staphylococcus aureus subsp. aureus MW2
ucauagccuau

SEQ ID NO: 4018483 - RNA, 22 nt, Staphylococcus aureus subsp. aureus MW2
ucauagucgguuauuacaaaau

SEQ ID NO: 4018484 - RNA, 14 nt, Staphylococcus aureus subsp. aureus MW2
ucauaguguuugua

SEQ ID NO: 4018485 - RNA, 15 nt, Staphylococcus aureus subsp. aureus MW2
ucauaguuauuaaau

SEQ ID NO: 4018486 - RNA, 18 nt, Staphylococcus aureus subsp. aureus MW2
ucauaguuauuaaaucuu

SEQ ID NO: 4018487 - RNA, 20 nt, Staphylococcus aureus subsp. aureus MW2
ucauaguucaaauugaacuu

SEQ ID NO: 4018488 - RNA, 18 nt, Staphylococcus aureus subsp. aureus MW2
ucauauaaguaagcguaa

SEQ ID NO: 4018489 - RNA, 15 nt, Staphylococcus aureus subsp. aureus MW2
ucauauaugauaaau

SEQ ID NO: 4018490 - RNA, 16 nt, Staphylococcus aureus subsp. aureus MW2
ucauauaugucucucu

SEQ ID NO: 4018491 - RNA, 16 nt, Staphylococcus aureus subsp. aureus MW2
ucauaucauaccaaaa

SEQ ID NO: 4018492 - RNA, 11 nt, Staphylococcus aureus subsp. aureus MW2
ucauaugcaua

SEQ ID NO: 4018493 - RNA, 20 nt, Staphylococcus aureus subsp. aureus MW2
ucauaugcaucaacagauac

SEQ ID NO: 4018494 - RNA, 17 nt, Staphylococcus aureus subsp. aureus MW2
ucauaugugccauaugu

SEQ ID NO: 4018495 - RNA, 14 nt, Staphylococcus aureus subsp. aureus MW2
ucauauucaaaaua

SEQ ID NO: 4018496 - RNA, 19 nt, Staphylococcus aureus subsp. aureus MW2
ucauauucaacuaguaaau

SEQ ID NO: 4018497 - RNA, 16 nt, Staphylococcus aureus subsp. aureus MW2
ucauauucacaucuuu

SEQ ID NO: 4018498 - RNA, 19 nt, Staphylococcus aureus subsp. aureus MW2
ucauauucgccuucuaaua

SEQ ID NO: 4018499 - RNA, 15 nt, Staphylococcus aureus subsp. aureus MW2
ucauauugcacauaa

SEQ ID NO: 4018500 - RNA, 19 nt, Staphylococcus aureus subsp. aureus MW2
ucauauugcacauaaacuu

SEQ ID NO: 4018501 - RNA, 20 nt, Staphylococcus aureus subsp. aureus MW2
ucauauugcacauaaacuuu

SEQ ID NO: 4018502 - RNA, 17 nt, Staphylococcus aureus subsp. aureus MW2
ucauauuugaauacuuu

SEQ ID NO: 4018503 - RNA, 20 nt, Staphylococcus aureus subsp. aureus MW2
ucauauuugaauacuuuauu

SEQ ID NO: 4018504 - RNA, 11 nt, Staphylococcus aureus subsp. aureus MW2
ucaucaaaauu

SEQ ID NO: 4018505 - RNA, 23 nt, Staphylococcus aureus subsp. aureus MW2
ucaucaacacacacaguuuauaa

SEQ ID NO: 4018506 - RNA, 14 nt, Staphylococcus aureus subsp. aureus MW2
ucaucaaguugaua

SEQ ID NO: 4018507 - RNA, 22 nt, Staphylococcus aureus subsp. aureus MW2
ucaucaauaaauauugauucua

SEQ ID NO: 4018508 - RNA, 12 nt, Staphylococcus aureus subsp. aureus MW2
ucaucaauaauu

SEQ ID NO: 4018509 - RNA, 13 nt, Staphylococcus aureus subsp. aureus MW2
ucaucaauuggca

SEQ ID NO: 4018510 - RNA, 14 nt, Staphylococcus aureus subsp. aureus MW2
ucaucaauuggcaa

SEQ ID NO: 4018511 - RNA, 18 nt, Staphylococcus aureus subsp. aureus MW2
ucaucacaaauaaggaau

SEQ ID NO: 4018512 - RNA, 13 nt, Staphylococcus aureus subsp. aureus MW2
ucaucauaaucaa

SEQ ID NO: 4018513 - RNA, 19 nt, Staphylococcus aureus subsp. aureus MW2
ucaucauaaucaagaauau

SEQ ID NO: 4018514 - RNA, 16 nt, Staphylococcus aureus subsp. aureus MW2
ucaucauauucgccuu

SEQ ID NO: 4018515 - RNA, 17 nt, Staphylococcus aureus subsp. aureus MW2
ucaucaugacuauuuuc

SEQ ID NO: 4018516 - RNA, 20 nt, Staphylococcus aureus subsp. aureus MW2
ucaucaugacuauuuuccau

SEQ ID NO: 4018517 - RNA, 20 nt, Staphylococcus aureus subsp. aureus MW2
ucaucaugauuacuaauaca

SEQ ID NO: 4018518 - RNA, 20 nt, Staphylococcus aureus subsp. aureus MW2
ucaucauggucaacuuuuuu

SEQ ID NO: 4018519 - RNA, 15 nt, Staphylococcus aureus subsp. aureus MW2
ucaucauuaaaucug

SEQ ID NO: 4018520 - RNA, 16 nt, Staphylococcus aureus subsp. aureus MW2
ucaucauuaaaucuga

SEQ ID NO: 4018521 - RNA, 20 nt, Staphylococcus aureus subsp. aureus MW2
ucaucauuaguuuuuaaaau

SEQ ID NO: 4018522 - RNA, 15 nt, Staphylococcus aureus subsp. aureus MW2
ucauccgccaauuaa

SEQ ID NO: 4018523 - RNA, 21 nt, Staphylococcus aureus subsp. aureus MW2
ucaucgaagauguuaaacugu

SEQ ID NO: 4018524 - RNA, 16 nt, Staphylococcus aureus subsp. aureus MW2
ucaucgcuaauacuuu

SEQ ID NO: 4018525 - RNA, 12 nt, Staphylococcus aureus subsp. aureus MW2
ucaucguauuuc

SEQ ID NO: 4018526 - RNA, 17 nt, Staphylococcus aureus subsp. aureus MW2
ucaucguccacgaaucu

SEQ ID NO: 4018527 - RNA, 16 nt, Staphylococcus aureus subsp. aureus MW2
ucaucguucauauauu

SEQ ID NO: 4018528 - RNA, 17 nt, Staphylococcus aureus subsp. aureus MW2
ucaucguucauauauuu

SEQ ID NO: 4018529 - RNA, 20 nt, Staphylococcus aureus subsp. aureus MW2
ucaucuaaaaagucuuuaau

SEQ ID NO: 4018530 - RNA, 12 nt, Staphylococcus aureus subsp. aureus MW2
ucaucuaaaauu

SEQ ID NO: 4018531 - RNA, 14 nt, Staphylococcus aureus subsp. aureus MW2
ucaucuacuuaaaa

SEQ ID NO: 4018532 - RNA, 16 nt, Staphylococcus aureus subsp. aureus MW2
ucaucuacuuaaaaua

SEQ ID NO: 4018533 - RNA, 23 nt, Staphylococcus aureus subsp. aureus MW2
ucaucuauuauuauguuauaaau

SEQ ID NO: 4018534 - RNA, 13 nt, Staphylococcus aureus subsp. aureus MW2
ucaucuauucaaa

SEQ ID NO: 4018535 - RNA, 12 nt, Staphylococcus aureus subsp. aureus MW2
ucaucuauuuaa

SEQ ID NO: 4018536 - RNA, 22 nt, Staphylococcus aureus subsp. aureus MW2
ucaucuauuuuuaacuaauaga

SEQ ID NO: 4018537 - RNA, 16 nt, Staphylococcus aureus subsp. aureus MW2
ucaucugcuuguaaua

SEQ ID NO: 4018538 - RNA, 21 nt, Staphylococcus aureus subsp. aureus MW2
ucaucuguugauaaugcuacu

SEQ ID NO: 4018539 - RNA, 19 nt, Staphylococcus aureus subsp. aureus MW2
ucaucuuaaugcuaugauu

SEQ ID NO: 4018540 - RNA, 20 nt, Staphylococcus aureus subsp. aureus MW2
ucaucuuagacgcuguuuua

SEQ ID NO: 4018541 - RNA, 18 nt, Staphylococcus aureus subsp. aureus MW2
ucaucuuaucaagaauau

SEQ ID NO: 4018542 - RNA, 19 nt, Staphylococcus aureus subsp. aureus MW2
ucaucuucugaauuuaaua

SEQ ID NO: 4018543 - RNA, 20 nt, Staphylococcus aureus subsp. aureus MW2
ucaucuucuucaaaacguuu

SEQ ID NO: 4018544 - RNA, 22 nt, Staphylococcus aureus subsp. aureus MW2
ucaucuugcaaguauuuucuua

SEQ ID NO: 4018545 - RNA, 23 nt, Staphylococcus aureus subsp. aureus MW2
ucaucuugcgccuuguucaauuc

SEQ ID NO: 4018546 - RNA, 14 nt, Staphylococcus aureus subsp. aureus MW2
ucaucuuuauuuac

SEQ ID NO: 4018547 - RNA, 18 nt, Staphylococcus aureus subsp. aureus MW2
ucaucuuucaaugcauau

SEQ ID NO: 4018548 - RNA, 22 nt, Staphylococcus aureus subsp. aureus MW2
ucaucuuucacaauuguauaau

SEQ ID NO: 4018549 - RNA, 21 nt, Staphylococcus aureus subsp. aureus MW2
ucaucuuuuucacuaaucauu

SEQ ID NO: 4018550 - RNA, 16 nt, Staphylococcus aureus subsp. aureus MW2
ucaucuuuuuuaucau

SEQ ID NO: 4018551 - RNA, 17 nt, Staphylococcus aureus subsp. aureus MW2
ucaucuuuuuuaucaug

SEQ ID NO: 4018552 - RNA, 17 nt, Staphylococcus aureus subsp. aureus MW2
ucaugaaauuaaaaaca

SEQ ID NO: 4018553 - RNA, 17 nt, Staphylococcus aureus subsp. aureus MW2
ucaugagcacaaacuaa

SEQ ID NO: 4018554 - RNA, 16 nt, Staphylococcus aureus subsp. aureus MW2
ucaugaugauaaauug

SEQ ID NO: 4018555 - RNA, 15 nt, Staphylococcus aureus subsp. aureus MW2
ucaugauuaauuaaa

SEQ ID NO: 4018556 - RNA, 22 nt, Staphylococcus aureus subsp. aureus MW2
ucaugcaaaacuaaucaaauua

SEQ ID NO: 4018557 - RNA, 13 nt, Staphylococcus aureus subsp. aureus MW2
ucaugcacuuuau

SEQ ID NO: 4018558 - RNA, 17 nt, Staphylococcus aureus subsp. aureus MW2
ucaugcacuuuauuaaa

SEQ ID NO: 4018559 - RNA, 13 nt, Staphylococcus aureus subsp. aureus MW2
ucaugccaaaaac

SEQ ID NO: 4018560 - RNA, 19 nt, Staphylococcus aureus subsp. aureus MW2
ucaugccaaaaacauuaac

SEQ ID NO: 4018561 - RNA, 13 nt, Staphylococcus aureus subsp. aureus MW2
ucaugccuucaug

SEQ ID NO: 4018562 - RNA, 13 nt, Staphylococcus aureus subsp. aureus MW2
ucaugccuucauu

SEQ ID NO: 4018563 - RNA, 20 nt, Staphylococcus aureus subsp. aureus MW2
ucauggucaacuuuuuuaac

SEQ ID NO: 4018564 - RNA, 18 nt, Staphylococcus aureus subsp. aureus MW2
ucauguaacguaaaaaug

SEQ ID NO: 4018565 - RNA, 17 nt, Staphylococcus aureus subsp. aureus MW2
ucauguauauggcauca

SEQ ID NO: 4018566 - RNA, 20 nt, Staphylococcus aureus subsp. aureus MW2
ucauguauauggcaucauca

SEQ ID NO: 4018567 - RNA, 18 nt, Staphylococcus aureus subsp. aureus MW2
ucaugucuagauuucaaa

SEQ ID NO: 4018568 - RNA, 22 nt, Staphylococcus aureus subsp. aureus MW2
ucaugugcaagcuuuuuaggaa

SEQ ID NO: 4018569 - RNA, 21 nt, Staphylococcus aureus subsp. aureus MW2
ucauguucuuaacaauaucau

SEQ ID NO: 4018570 - RNA, 16 nt, Staphylococcus aureus subsp. aureus MW2
ucauguuuaaaauaaa

SEQ ID NO: 4018571 - RNA, 13 nt, Staphylococcus aureus subsp. aureus MW2
ucauuaaauauuu

SEQ ID NO: 4018572 - RNA, 19 nt, Staphylococcus aureus subsp. aureus MW2
ucauuaaaucugauucauu

SEQ ID NO: 4018573 - RNA, 13 nt, Staphylococcus aureus subsp. aureus MW2
ucauuaacagucu

SEQ ID NO: 4018574 - RNA, 18 nt, Staphylococcus aureus subsp. aureus MW2
ucauuaacauaauaauaa

SEQ ID NO: 4018575 - RNA, 16 nt, Staphylococcus aureus subsp. aureus MW2
ucauuaaccuuacaua

SEQ ID NO: 4018576 - RNA, 24 nt, Staphylococcus aureus subsp. aureus MW2
ucauuaacuuucucaaauuagaua

SEQ ID NO: 4018577 - RNA, 15 nt, Staphylococcus aureus subsp. aureus MW2
ucauuaaguugaaaa

SEQ ID NO: 4018578 - RNA, 14 nt, Staphylococcus aureus subsp. aureus MW2
ucauuaauaaauug

SEQ ID NO: 4018579 - RNA, 14 nt, Staphylococcus aureus subsp. aureus MW2
ucauuaauaauuaa

SEQ ID NO: 4018580 - RNA, 12 nt, Staphylococcus aureus subsp. aureus MW2
ucauuaauacaa

SEQ ID NO: 4018581 - RNA, 16 nt, Staphylococcus aureus subsp. aureus MW2
ucauuaauuuuuucgu

SEQ ID NO: 4018582 - RNA, 15 nt, Staphylococcus aureus subsp. aureus MW2
ucauuacaaacauaa

SEQ ID NO: 4018583 - RNA, 18 nt, Staphylococcus aureus subsp. aureus MW2
ucauuagacuuucuuaau

SEQ ID NO: 4018584 - RNA, 16 nt, Staphylococcus aureus subsp. aureus MW2
ucauuagccaaaucuu

SEQ ID NO: 4018585 - RNA, 17 nt, Staphylococcus aureus subsp. aureus MW2
ucauuagcgaaaacuaa

SEQ ID NO: 4018586 - RNA, 20 nt, Staphylococcus aureus subsp. aureus MW2
ucauuagcgcaagagauaag

SEQ ID NO: 4018587 - RNA, 22 nt, Staphylococcus aureus subsp. aureus MW2
ucauuaguugccccuagcaaaa

SEQ ID NO: 4018588 - RNA, 19 nt, Staphylococcus aureus subsp. aureus MW2
ucauuauauaauucuucaa

SEQ ID NO: 4018589 - RNA, 11 nt, Staphylococcus aureus subsp. aureus MW2
ucauuaucauu

SEQ ID NO: 4018590 - RNA, 15 nt, Staphylococcus aureus subsp. aureus MW2
ucauuaucauuaagu

SEQ ID NO: 4018591 - RNA, 23 nt, Staphylococcus aureus subsp. aureus MW2
ucauuaugcccgauaauucuaac

SEQ ID NO: 4018592 - RNA, 22 nt, Staphylococcus aureus subsp. aureus MW2
ucauuauuaccuuugcuaaaua

SEQ ID NO: 4018593 - RNA, 12 nt, Staphylococcus aureus subsp. aureus MW2
ucauuauuuaaa

SEQ ID NO: 4018594 - RNA, 18 nt, Staphylococcus aureus subsp. aureus MW2
ucauuauuugauaaauaa

SEQ ID NO: 4018595 - RNA, 12 nt, Staphylococcus aureus subsp. aureus MW2
ucauucagucaa

SEQ ID NO: 4018596 - RNA, 22 nt, Staphylococcus aureus subsp. aureus MW2
ucauuccaaacacacuguugaa

SEQ ID NO: 4018597 - RNA, 14 nt, Staphylococcus aureus subsp. aureus MW2
ucauucuucaucgc

SEQ ID NO: 4018598 - RNA, 16 nt, Staphylococcus aureus subsp. aureus MW2
ucauucuuuaauauaa

SEQ ID NO: 4018599 - RNA, 15 nt, Staphylococcus aureus subsp. aureus MW2
ucauucuuuauagaa

SEQ ID NO: 4018600 - RNA, 15 nt, Staphylococcus aureus subsp. aureus MW2
ucauugaaaauauuu

SEQ ID NO: 4018601 - RNA, 16 nt, Staphylococcus aureus subsp. aureus MW2
ucauugaaaauauuuu

SEQ ID NO: 4018602 - RNA, 22 nt, Staphylococcus aureus subsp. aureus MW2
ucauugaaaauauuuuauuaua

SEQ ID NO: 4018603 - RNA, 14 nt, Staphylococcus aureus subsp. aureus MW2
ucauugaagaauau

SEQ ID NO: 4018604 - RNA, 19 nt, Staphylococcus aureus subsp. aureus MW2
ucauugaagaauauaaacu

SEQ ID NO: 4018605 - RNA, 16 nt, Staphylococcus aureus subsp. aureus MW2
ucauugcguaacauca

SEQ ID NO: 4018606 - RNA, 18 nt, Staphylococcus aureus subsp. aureus MW2
ucauugcuugguuugauu

SEQ ID NO: 4018607 - RNA, 14 nt, Staphylococcus aureus subsp. aureus MW2
ucauuguaacucaa

SEQ ID NO: 4018608 - RNA, 14 nt, Staphylococcus aureus subsp. aureus MW2
ucauuguauaaaaa

SEQ ID NO: 4018609 - RNA, 22 nt, Staphylococcus aureus subsp. aureus MW2
ucauuguguccauaaauauuaa

SEQ ID NO: 4018610 - RNA, 15 nt, Staphylococcus aureus subsp. aureus MW2
ucauuuaaaauauuu

SEQ ID NO: 4018611 - RNA, 14 nt, Staphylococcus aureus subsp. aureus MW2
ucauuuaauguucu

SEQ ID NO: 4018612 - RNA, 18 nt, Staphylococcus aureus subsp. aureus MW2
ucauuuaguuaaauacaa

SEQ ID NO: 4018613 - RNA, 15 nt, Staphylococcus aureus subsp. aureus MW2
ucauuuauaacauuu

SEQ ID NO: 4018614 - RNA, 19 nt, Staphylococcus aureus subsp. aureus MW2
ucauuucaauauuaaaaua

SEQ ID NO: 4018615 - RNA, 20 nt, Staphylococcus aureus subsp. aureus MW2
ucauuugaacaucauuuaau

SEQ ID NO: 4018616 - RNA, 18 nt, Staphylococcus aureus subsp. aureus MW2
ucauuugauuuaaaaagu

SEQ ID NO: 4018617 - RNA, 20 nt, Staphylococcus aureus subsp. aureus MW2
ucauuuggcguucaacauua

SEQ ID NO: 4018618 - RNA, 22 nt, Staphylococcus aureus subsp. aureus MW2
ucauuuguacaaucaaaggcuu

SEQ ID NO: 4018619 - RNA, 14 nt, Staphylococcus aureus subsp. aureus MW2
ucauuuguauagau

SEQ ID NO: 4018620 - RNA, 17 nt, Staphylococcus aureus subsp. aureus MW2
ucauuuguguaaaugaa

SEQ ID NO: 4018621 - RNA, 17 nt, Staphylococcus aureus subsp. aureus MW2
ucauuuguguuuuuaau

SEQ ID NO: 4018622 - RNA, 24 nt, Staphylococcus aureus subsp. aureus MW2
ucauuuguguuuuuaauguuugcu

SEQ ID NO: 4018623 - RNA, 15 nt, Staphylococcus aureus subsp. aureus MW2
ucauuuguuaacgau

SEQ ID NO: 4018624 - RNA, 22 nt, Staphylococcus aureus subsp. aureus MW2
ucauuuuauccaaaccaauuuu

SEQ ID NO: 4018625 - RNA, 18 nt, Staphylococcus aureus subsp. aureus MW2
ucauuuucaaauaacuga

SEQ ID NO: 4018626 - RNA, 17 nt, Staphylococcus aureus subsp. aureus MW2
ucauuuucuugauuuua

SEQ ID NO: 4018627 - RNA, 17 nt, Staphylococcus aureus subsp. aureus MW2
ucauuuuuaauuuugac

SEQ ID NO: 4018628 - RNA, 22 nt, Staphylococcus aureus subsp. aureus MW2
ucauuuuuaauuuugacauaaa

SEQ ID NO: 4018629 - RNA, 16 nt, Staphylococcus aureus subsp. aureus MW2
ucauuuuuauaaauuu

SEQ ID NO: 4018630 - RNA, 17 nt, Staphylococcus aureus subsp. aureus MW2
ucauuuuucguuguuca

SEQ ID NO: 4018631 - RNA, 12 nt, Staphylococcus aureus subsp. aureus MW2
ucauuuuucuuc

SEQ ID NO: 4018632 - RNA, 19 nt, Staphylococcus aureus subsp. aureus MW2
ucauuuuucuuccuaaaua

SEQ ID NO: 4018633 - RNA, 16 nt, Staphylococcus aureus subsp. aureus MW2
ucauuuuuucaauagu

SEQ ID NO: 4018634 - RNA, 17 nt, Staphylococcus aureus subsp. aureus MW2
ucauuuuuuuaauuauu

SEQ ID NO: 4018635 - RNA, 14 nt, Staphylococcus aureus subsp. aureus MW2
uccaaaacauuuug

SEQ ID NO: 4018636 - RNA, 19 nt, Staphylococcus aureus subsp. aureus MW2
uccaaaaccgaaaauaccu

SEQ ID NO: 4018637 - RNA, 12 nt, Staphylococcus aureus subsp. aureus MW2
uccaaagacaua

SEQ ID NO: 4018638 - RNA, 19 nt, Staphylococcus aureus subsp. aureus MW2
uccaaagcugaauuuuagu

SEQ ID NO: 4018639 - RNA, 15 nt, Staphylococcus aureus subsp. aureus MW2
uccaaaguaauauga

SEQ ID NO: 4018640 - RNA, 19 nt, Staphylococcus aureus subsp. aureus MW2
uccaaauucauuuguauua

SEQ ID NO: 4018641 - RNA, 17 nt, Staphylococcus aureus subsp. aureus MW2
uccaaauuggaaaucaa

SEQ ID NO: 4018642 - RNA, 18 nt, Staphylococcus aureus subsp. aureus MW2
uccaacacccauauaauu

SEQ ID NO: 4018643 - RNA, 13 nt, Staphylococcus aureus subsp. aureus MW2
uccaacuuuaaau

SEQ ID NO: 4018644 - RNA, 19 nt, Staphylococcus aureus subsp. aureus MW2
uccaagauuaugacaacau

SEQ ID NO: 4018645 - RNA, 18 nt, Staphylococcus aureus subsp. aureus MW2
uccaaggauguuauaaaa

SEQ ID NO: 4018646 - RNA, 19 nt, Staphylococcus aureus subsp. aureus MW2
uccaaggauguuauaaaau

SEQ ID NO: 4018647 - RNA, 19 nt, Staphylococcus aureus subsp. aureus MW2
uccaagucuaaaugcaaua

SEQ ID NO: 4018648 - RNA, 23 nt, Staphylococcus aureus subsp. aureus MW2
uccaauacuuuuuauauaauucg

SEQ ID NO: 4018649 - RNA, 22 nt, Staphylococcus aureus subsp. aureus MW2
uccaaucaucauuaaaucugau

SEQ ID NO: 4018650 - RNA, 22 nt, Staphylococcus aureus subsp. aureus MW2
uccaaucuauuuuaaacucauc

SEQ ID NO: 4018651 - RNA, 24 nt, Staphylococcus aureus subsp. aureus MW2
uccaaugaugaauuguaaaaguga

SEQ ID NO: 4018652 - RNA, 15 nt, Staphylococcus aureus subsp. aureus MW2
uccaaugcauaaaac

SEQ ID NO: 4018653 - RNA, 12 nt, Staphylococcus aureus subsp. aureus MW2
uccaauuuaaaa

SEQ ID NO: 4018654 - RNA, 17 nt, Staphylococcus aureus subsp. aureus MW2
uccaauuuaaaaugauu

SEQ ID NO: 4018655 - RNA, 19 nt, Staphylococcus aureus subsp. aureus MW2
uccaauuuauaaugauuaa

SEQ ID NO: 4018656 - RNA, 11 nt, Staphylococcus aureus subsp. aureus MW2
uccaauuucuc

SEQ ID NO: 4018657 - RNA, 13 nt, Staphylococcus aureus subsp. aureus MW2
uccacaauaagau

SEQ ID NO: 4018658 - RNA, 13 nt, Staphylococcus aureus subsp. aureus MW2
uccacacauuaag

SEQ ID NO: 4018659 - RNA, 13 nt, Staphylococcus aureus subsp. aureus MW2
uccacagaauuag

SEQ ID NO: 4018660 - RNA, 14 nt, Staphylococcus aureus subsp. aureus MW2
uccacagcaauuca

SEQ ID NO: 4018661 - RNA, 22 nt, Staphylococcus aureus subsp. aureus MW2
uccacagcuuguucaauacuuu

SEQ ID NO: 4018662 - RNA, 16 nt, Staphylococcus aureus subsp. aureus MW2
uccaccguuaaaauau

SEQ ID NO: 4018663 - RNA, 15 nt, Staphylococcus aureus subsp. aureus MW2
uccagacuccuaaau

SEQ ID NO: 4018664 - RNA, 14 nt, Staphylococcus aureus subsp. aureus MW2
uccaguauuaacug

SEQ ID NO: 4018665 - RNA, 14 nt, Staphylococcus aureus subsp. aureus MW2
uccaguuaauuauu

SEQ ID NO: 4018666 - RNA, 19 nt, Staphylococcus aureus subsp. aureus MW2
uccaguuaauuauuuagau

SEQ ID NO: 4018667 - RNA, 19 nt, Staphylococcus aureus subsp. aureus MW2
uccaguuuauaacugggau

SEQ ID NO: 4018668 - RNA, 21 nt, Staphylococcus aureus subsp. aureus MW2
uccaguuuucaauuuauuaac

SEQ ID NO: 4018669 - RNA, 23 nt, Staphylococcus aureus subsp. aureus MW2
uccaguuuucaauuuauuaacug

SEQ ID NO: 4018670 - RNA, 13 nt, Staphylococcus aureus subsp. aureus MW2
uccauaaauauua

SEQ ID NO: 4018671 - RNA, 21 nt, Staphylococcus aureus subsp. aureus MW2
uccauaaucuuuauuaauaaa

SEQ ID NO: 4018672 - RNA, 20 nt, Staphylococcus aureus subsp. aureus MW2
uccauacgaucuuuuucaau

SEQ ID NO: 4018673 - RNA, 21 nt, Staphylococcus aureus subsp. aureus MW2
uccauacuucuauuuuauaau

SEQ ID NO: 4018674 - RNA, 17 nt, Staphylococcus aureus subsp. aureus MW2
uccauagaaauuguagu

SEQ ID NO: 4018675 - RNA, 19 nt, Staphylococcus aureus subsp. aureus MW2
uccauauaaccuauuucau

SEQ ID NO: 4018676 - RNA, 21 nt, Staphylococcus aureus subsp. aureus MW2
uccauauaugaugauuuaagu

SEQ ID NO: 4018677 - RNA, 19 nt, Staphylococcus aureus subsp. aureus MW2
uccaucgcaacugauaauu

SEQ ID NO: 4018678 - RNA, 16 nt, Staphylococcus aureus subsp. aureus MW2
uccaucuacacccauu

SEQ ID NO: 4018679 - RNA, 17 nt, Staphylococcus aureus subsp. aureus MW2
uccaucucauacuauac

SEQ ID NO: 4018680 - RNA, 19 nt, Staphylococcus aureus subsp. aureus MW2
uccaucucauacuauacaa

SEQ ID NO: 4018681 - RNA, 14 nt, Staphylococcus aureus subsp. aureus MW2
uccaugaauaaguc

SEQ ID NO: 4018682 - RNA, 22 nt, Staphylococcus aureus subsp. aureus MW2
uccauggaauaaauuuauaacu

SEQ ID NO: 4018683 - RNA, 16 nt, Staphylococcus aureus subsp. aureus MW2
uccauggcuuaaauca

SEQ ID NO: 4018684 - RNA, 20 nt, Staphylococcus aureus subsp. aureus MW2
uccauuagcuaauucacuuu

SEQ ID NO: 4018685 - RNA, 17 nt, Staphylococcus aureus subsp. aureus MW2
uccauucaauguuuaau

SEQ ID NO: 4018686 - RNA, 22 nt, Staphylococcus aureus subsp. aureus MW2
uccauucaauguuuaauuuucu

SEQ ID NO: 4018687 - RNA, 19 nt, Staphylococcus aureus subsp. aureus MW2
uccauucuuuuucaaaaua

SEQ ID NO: 4018688 - RNA, 15 nt, Staphylococcus aureus subsp. aureus MW2
uccauuuaucaacaa

SEQ ID NO: 4018689 - RNA, 14 nt, Staphylococcus aureus subsp. aureus MW2
ucccaaccaugcuu

SEQ ID NO: 4018690 - RNA, 14 nt, Staphylococcus aureus subsp. aureus MW2
ucccaacuuaauaa

SEQ ID NO: 4018691 - RNA, 15 nt, Staphylococcus aureus subsp. aureus MW2
ucccaacuuaauaac

SEQ ID NO: 4018692 - RNA, 17 nt, Staphylococcus aureus subsp. aureus MW2
ucccaaugcuugaauuu

SEQ ID NO: 4018693 - RNA, 14 nt, Staphylococcus aureus subsp. aureus MW2
ucccaccccaacuu

SEQ ID NO: 4018694 - RNA, 17 nt, Staphylococcus aureus subsp. aureus MW2
ucccaccggacaaugua

SEQ ID NO: 4018695 - RNA, 15 nt, Staphylococcus aureus subsp. aureus MW2
ucccacgugccucau

SEQ ID NO: 4018696 - RNA, 19 nt, Staphylococcus aureus subsp. aureus MW2
ucccacgugccucauccuu

SEQ ID NO: 4018697 - RNA, 19 nt, Staphylococcus aureus subsp. aureus MW2
ucccauaaaagacagaaau

SEQ ID NO: 4018698 - RNA, 23 nt, Staphylococcus aureus subsp. aureus MW2
ucccauaaggaaccugucuuaau

SEQ ID NO: 4018699 - RNA, 20 nt, Staphylococcus aureus subsp. aureus MW2
ucccauaaugacuauaacac

SEQ ID NO: 4018700 - RNA, 21 nt, Staphylococcus aureus subsp. aureus MW2
ucccauaucgugcguuaaaua

SEQ ID NO: 4018701 - RNA, 22 nt, Staphylococcus aureus subsp. aureus MW2
ucccaucuuuuagguaauaauu

SEQ ID NO: 4018702 - RNA, 21 nt, Staphylococcus aureus subsp. aureus MW2
ucccauuaacacgaacugcau

SEQ ID NO: 4018703 - RNA, 23 nt, Staphylococcus aureus subsp. aureus MW2
ucccauuaacacgaacugcauag

SEQ ID NO: 4018704 - RNA, 15 nt, Staphylococcus aureus subsp. aureus MW2
ucccauuuuuaaaau

SEQ ID NO: 4018705 - RNA, 17 nt, Staphylococcus aureus subsp. aureus MW2
uccccaacuuaauacga

SEQ ID NO: 4018706 - RNA, 15 nt, Staphylococcus aureus subsp. aureus MW2
uccccaauuucucug

SEQ ID NO: 4018707 - RNA, 22 nt, Staphylococcus aureus subsp. aureus MW2
uccccacguuuugaacauguuu

SEQ ID NO: 4018708 - RNA, 16 nt, Staphylococcus aureus subsp. aureus MW2
uccccauuuauguguu

SEQ ID NO: 4018709 - RNA, 16 nt, Staphylococcus aureus subsp. aureus MW2
ucccuacugcaccgau

SEQ ID NO: 4018710 - RNA, 19 nt, Staphylococcus aureus subsp. aureus MW2
ucccuaggaaauaaaaaau

SEQ ID NO: 4018711 - RNA, 12 nt, Staphylococcus aureus subsp. aureus MW2
ucccuaugaaau

SEQ ID NO: 4018712 - RNA, 21 nt, Staphylococcus aureus subsp. aureus MW2
ucccucuaucaaauuaccauu

SEQ ID NO: 4018713 - RNA, 14 nt, Staphylococcus aureus subsp. aureus MW2
ucccuggaaaauga

SEQ ID NO: 4018714 - RNA, 17 nt, Staphylococcus aureus subsp. aureus MW2
ucccuuaaauacaauuu

SEQ ID NO: 4018715 - RNA, 20 nt, Staphylococcus aureus subsp. aureus MW2
ucccuuaaauacaauuucuu

SEQ ID NO: 4018716 - RNA, 11 nt, Staphylococcus aureus subsp. aureus MW2
ucccuuaauaa

SEQ ID NO: 4018717 - RNA, 12 nt, Staphylococcus aureus subsp. aureus MW2
ucccuuaauaau

SEQ ID NO: 4018718 - RNA, 19 nt, Staphylococcus aureus subsp. aureus MW2
ucccuucaacaguaauuuu

SEQ ID NO: 4018719 - RNA, 14 nt, Staphylococcus aureus subsp. aureus MW2
ucccuucaacauag

SEQ ID NO: 4018720 - RNA, 15 nt, Staphylococcus aureus subsp. aureus MW2
ucccuuuucaucaaa

SEQ ID NO: 4018721 - RNA, 21 nt, Staphylococcus aureus subsp. aureus MW2
ucccuuuucaucaaauucaaa

SEQ ID NO: 4018722 - RNA, 14 nt, Staphylococcus aureus subsp. aureus MW2
ucccuuuuuaaaau

SEQ ID NO: 4018723 - RNA, 20 nt, Staphylococcus aureus subsp. aureus MW2
uccgacuuuugauuuugaau

SEQ ID NO: 4018724 - RNA, 15 nt, Staphylococcus aureus subsp. aureus MW2
uccgauaucuuuuaa

SEQ ID NO: 4018725 - RNA, 20 nt, Staphylococcus aureus subsp. aureus MW2
uccgauuugauaaaaaauga

SEQ ID NO: 4018726 - RNA, 13 nt, Staphylococcus aureus subsp. aureus MW2
uccgcauaaauua

SEQ ID NO: 4018727 - RNA, 21 nt, Staphylococcus aureus subsp. aureus MW2
uccgccagcuucuauguuggg

SEQ ID NO: 4018728 - RNA, 17 nt, Staphylococcus aureus subsp. aureus MW2
uccgcuuguucaacuaa

SEQ ID NO: 4018729 - RNA, 16 nt, Staphylococcus aureus subsp. aureus MW2
uccgcuuuauuuuauc

SEQ ID NO: 4018730 - RNA, 14 nt, Staphylococcus aureus subsp. aureus MW2
uccggcugaaggga

SEQ ID NO: 4018731 - RNA, 23 nt, Staphylococcus aureus subsp. aureus MW2
uccguugaauuaacaauauuaaa

SEQ ID NO: 4018732 - RNA, 22 nt, Staphylococcus aureus subsp. aureus MW2
uccguuuuagaauuuaacauuu

SEQ ID NO: 4018733 - RNA, 21 nt, Staphylococcus aureus subsp. aureus MW2
uccuaaagguaacuuuuuaac

SEQ ID NO: 4018734 - RNA, 16 nt, Staphylococcus aureus subsp. aureus MW2
uccuaaauuauaaaua

SEQ ID NO: 4018735 - RNA, 14 nt, Staphylococcus aureus subsp. aureus MW2
uccuaaauuauugu

SEQ ID NO: 4018736 - RNA, 17 nt, Staphylococcus aureus subsp. aureus MW2
uccuaaguuaugacuaa

SEQ ID NO: 4018737 - RNA, 21 nt, Staphylococcus aureus subsp. aureus MW2
uccuaauguaauuauugcauc

SEQ ID NO: 4018738 - RNA, 18 nt, Staphylococcus aureus subsp. aureus MW2
uccuacuccauagaaauu

SEQ ID NO: 4018739 - RNA, 13 nt, Staphylococcus aureus subsp. aureus MW2
uccuacugcuguc

SEQ ID NO: 4018740 - RNA, 13 nt, Staphylococcus aureus subsp. aureus MW2
uccuacuuuucaa

SEQ ID NO: 4018741 - RNA, 18 nt, Staphylococcus aureus subsp. aureus MW2
uccuagacucuaaaaugu

SEQ ID NO: 4018742 - RNA, 18 nt, Staphylococcus aureus subsp. aureus MW2
uccuaggaaauacguggc

SEQ ID NO: 4018743 - RNA, 14 nt, Staphylococcus aureus subsp. aureus MW2
uccuaguucuaugu

SEQ ID NO: 4018744 - RNA, 15 nt, Staphylococcus aureus subsp. aureus MW2
uccuaucuguaccgu

SEQ ID NO: 4018745 - RNA, 21 nt, Staphylococcus aureus subsp. aureus MW2
uccuaugccaaauaacguuaa

SEQ ID NO: 4018746 - RNA, 16 nt, Staphylococcus aureus subsp. aureus MW2
uccuauuacuacauaa

SEQ ID NO: 4018747 - RNA, 17 nt, Staphylococcus aureus subsp. aureus MW2
uccuauuacuacauaau

SEQ ID NO: 4018748 - RNA, 19 nt, Staphylococcus aureus subsp. aureus MW2
uccuauuacuacauaauuu

SEQ ID NO: 4018749 - RNA, 16 nt, Staphylococcus aureus subsp. aureus MW2
uccucaacgggaacau

SEQ ID NO: 4018750 - RNA, 19 nt, Staphylococcus aureus subsp. aureus MW2
uccucaguauuuaauguuu

SEQ ID NO: 4018751 - RNA, 22 nt, Staphylococcus aureus subsp. aureus MW2
uccuccgccaucaauauuuaua

SEQ ID NO: 4018752 - RNA, 20 nt, Staphylococcus aureus subsp. aureus MW2
uccucuauuuuaugauuuga

SEQ ID NO: 4018753 - RNA, 16 nt, Staphylococcus aureus subsp. aureus MW2
uccugaaauuaacguc

SEQ ID NO: 4018754 - RNA, 17 nt, Staphylococcus aureus subsp. aureus MW2
uccugaagagaaaauuu

SEQ ID NO: 4018755 - RNA, 14 nt, Staphylococcus aureus subsp. aureus MW2
uccugauuccacua

SEQ ID NO: 4018756 - RNA, 18 nt, Staphylococcus aureus subsp. aureus MW2
uccugauuuaauguuaaa

SEQ ID NO: 4018757 - RNA, 20 nt, Staphylococcus aureus subsp. aureus MW2
uccugcuacaacuucuucuc

SEQ ID NO: 4018758 - RNA, 14 nt, Staphylococcus aureus subsp. aureus MW2
uccugcuuauuaau

SEQ ID NO: 4018759 - RNA, 16 nt, Staphylococcus aureus subsp. aureus MW2
uccugguauaauggac

SEQ ID NO: 4018760 - RNA, 17 nt, Staphylococcus aureus subsp. aureus MW2
uccuuaaacaaauaaau

SEQ ID NO: 4018761 - RNA, 20 nt, Staphylococcus aureus subsp. aureus MW2
uccuucaauguucaauucac

SEQ ID NO: 4018762 - RNA, 14 nt, Staphylococcus aureus subsp. aureus MW2
uccuucaucaauaa

SEQ ID NO: 4018763 - RNA, 14 nt, Staphylococcus aureus subsp. aureus MW2
uccuucucaucauu

SEQ ID NO: 4018764 - RNA, 14 nt, Staphylococcus aureus subsp. aureus MW2
uccuuuaaaucauu

SEQ ID NO: 4018765 - RNA, 17 nt, Staphylococcus aureus subsp. aureus MW2
uccuuuaccguguucag

SEQ ID NO: 4018766 - RNA, 22 nt, Staphylococcus aureus subsp. aureus MW2
uccuuuaccguguucaggugua

SEQ ID NO: 4018767 - RNA, 16 nt, Staphylococcus aureus subsp. aureus MW2
uccuuuauaaauaaac

SEQ ID NO: 4018768 - RNA, 19 nt, Staphylococcus aureus subsp. aureus MW2
uccuuuauaaauaaacaua

SEQ ID NO: 4018769 - RNA, 14 nt, Staphylococcus aureus subsp. aureus MW2
uccuuugauguuca

SEQ ID NO: 4018770 - RNA, 23 nt, Staphylococcus aureus subsp. aureus MW2
uccuuugauguucacuaaaugug

SEQ ID NO: 4018771 - RNA, 13 nt, Staphylococcus aureus subsp. aureus MW2
uccuuuguuugua

SEQ ID NO: 4018772 - RNA, 20 nt, Staphylococcus aureus subsp. aureus MW2
uccuuuugaauaauaaacuu

SEQ ID NO: 4018773 - RNA, 20 nt, Staphylococcus aureus subsp. aureus MW2
uccuuuuuauguacuacaua

SEQ ID NO: 4018774 - RNA, 13 nt, Staphylococcus aureus subsp. aureus MW2
uccuuuuugacuc

SEQ ID NO: 4018775 - RNA, 18 nt, Staphylococcus aureus subsp. aureus MW2
uccuuuuuuuaugucuuu

SEQ ID NO: 4018776 - RNA, 20 nt, Staphylococcus aureus subsp. aureus MW2
ucgaaaaacuguaaaucauc

SEQ ID NO: 4018777 - RNA, 23 nt, Staphylococcus aureus subsp. aureus MW2
ucgaaaagaaauucuacagacaa

SEQ ID NO: 4018778 - RNA, 23 nt, Staphylococcus aureus subsp. aureus MW2
ucgaaaagaaauucuacaggcaa

SEQ ID NO: 4018779 - RNA, 17 nt, Staphylococcus aureus subsp. aureus MW2
ucgaaaauaaaacaaau

SEQ ID NO: 4018780 - RNA, 19 nt, Staphylococcus aureus subsp. aureus MW2
ucgaaaauagcuauuaaaa

SEQ ID NO: 4018781 - RNA, 21 nt, Staphylococcus aureus subsp. aureus MW2
ucgaaaauagcuauuaaaaua

SEQ ID NO: 4018782 - RNA, 15 nt, Staphylococcus aureus subsp. aureus MW2
ucgaaagccaauuaa

SEQ ID NO: 4018783 - RNA, 18 nt, Staphylococcus aureus subsp. aureus MW2
ucgaaauauuuauucgcu

SEQ ID NO: 4018784 - RNA, 17 nt, Staphylococcus aureus subsp. aureus MW2
ucgaaaugccuucugua

SEQ ID NO: 4018785 - RNA, 20 nt, Staphylococcus aureus subsp. aureus MW2
ucgaacaaucggaagcauau

SEQ ID NO: 4018786 - RNA, 15 nt, Staphylococcus aureus subsp. aureus MW2
ucgaacagaaaaucg

SEQ ID NO: 4018787 - RNA, 21 nt, Staphylococcus aureus subsp. aureus MW2
ucgaacaugaaugauauugau

SEQ ID NO: 4018788 - RNA, 17 nt, Staphylococcus aureus subsp. aureus MW2
ucgaacgauauuuuaaa

SEQ ID NO: 4018789 - RNA, 22 nt, Staphylococcus aureus subsp. aureus MW2
ucgaacuaguacgaaaugcauu

SEQ ID NO: 4018790 - RNA, 15 nt, Staphylococcus aureus subsp. aureus MW2
ucgaacuaucaauau

SEQ ID NO: 4018791 - RNA, 22 nt, Staphylococcus aureus subsp. aureus MW2
ucgaauguauugcuauaagaac

SEQ ID NO: 4018792 - RNA, 19 nt, Staphylococcus aureus subsp. aureus MW2
ucgaauguuucaugaccaa

SEQ ID NO: 4018793 - RNA, 12 nt, Staphylococcus aureus subsp. aureus MW2
ucgaauuaaccc

SEQ ID NO: 4018794 - RNA, 13 nt, Staphylococcus aureus subsp. aureus MW2
ucgacaucuagau

SEQ ID NO: 4018795 - RNA, 19 nt, Staphylococcus aureus subsp. aureus MW2
ucgacaucuagaugaaauu

SEQ ID NO: 4018796 - RNA, 20 nt, Staphylococcus aureus subsp. aureus MW2
ucgacaucuagaugaaauug

SEQ ID NO: 4018797 - RNA, 14 nt, Staphylococcus aureus subsp. aureus MW2
ucgacuacaaguuu

SEQ ID NO: 4018798 - RNA, 19 nt, Staphylococcus aureus subsp. aureus MW2
ucgacuacaaguuuauaau

SEQ ID NO: 4018799 - RNA, 17 nt, Staphylococcus aureus subsp. aureus MW2
ucgaguagcccuauuuu

SEQ ID NO: 4018800 - RNA, 14 nt, Staphylococcus aureus subsp. aureus MW2
ucgaguuuguuucu

SEQ ID NO: 4018801 - RNA, 23 nt, Staphylococcus aureus subsp. aureus MW2
ucgaguuuguuucuaaauucuuu

SEQ ID NO: 4018802 - RNA, 12 nt, Staphylococcus aureus subsp. aureus MW2
ucgauaaaaugu

SEQ ID NO: 4018803 - RNA, 22 nt, Staphylococcus aureus subsp. aureus MW2
ucgauaaauguauuaaacauug

SEQ ID NO: 4018804 - RNA, 13 nt, Staphylococcus aureus subsp. aureus MW2
ucgauaaguuuuu

SEQ ID NO: 4018805 - RNA, 23 nt, Staphylococcus aureus subsp. aureus MW2
ucgauaaguuuuugaauaucuaa

SEQ ID NO: 4018806 - RNA, 19 nt, Staphylococcus aureus subsp. aureus MW2
ucgauaguucuauauaauu

SEQ ID NO: 4018807 - RNA, 21 nt, Staphylococcus aureus subsp. aureus MW2
ucgauauagcauaaaauuucu

SEQ ID NO: 4018808 - RNA, 20 nt, Staphylococcus aureus subsp. aureus MW2
ucgauauucuccaacucuaa

SEQ ID NO: 4018809 - RNA, 13 nt, Staphylococcus aureus subsp. aureus MW2
ucgauauuucuag

SEQ ID NO: 4018810 - RNA, 15 nt, Staphylococcus aureus subsp. aureus MW2
ucgauauuuguuucg

SEQ ID NO: 4018811 - RNA, 16 nt, Staphylococcus aureus subsp. aureus MW2
ucgaugacuuugucuu

SEQ ID NO: 4018812 - RNA, 16 nt, Staphylococcus aureus subsp. aureus MW2
ucgaugacuuuuuaau

SEQ ID NO: 4018813 - RNA, 19 nt, Staphylococcus aureus subsp. aureus MW2
ucgauuaauucuucuucag

SEQ ID NO: 4018814 - RNA, 15 nt, Staphylococcus aureus subsp. aureus MW2
ucgauuaauuuaauu

SEQ ID NO: 4018815 - RNA, 18 nt, Staphylococcus aureus subsp. aureus MW2
ucgauucauaaaauuuaa

SEQ ID NO: 4018816 - RNA, 15 nt, Staphylococcus aureus subsp. aureus MW2
ucgauucgauuauuu

SEQ ID NO: 4018817 - RNA, 18 nt, Staphylococcus aureus subsp. aureus MW2
ucgauucgugauuuggaa

SEQ ID NO: 4018818 - RNA, 22 nt, Staphylococcus aureus subsp. aureus MW2
ucgauugguuuaaaaagucaaa

SEQ ID NO: 4018819 - RNA, 22 nt, Staphylococcus aureus subsp. aureus MW2
ucgauuuagaagaacaauaauu

SEQ ID NO: 4018820 - RNA, 15 nt, Staphylococcus aureus subsp. aureus MW2
ucgauuuaucauuau

SEQ ID NO: 4018821 - RNA, 17 nt, Staphylococcus aureus subsp. aureus MW2
ucgauuuuggcacauaa

SEQ ID NO: 4018822 - RNA, 13 nt, Staphylococcus aureus subsp. aureus MW2
ucgauuuuuuaau

SEQ ID NO: 4018823 - RNA, 16 nt, Staphylococcus aureus subsp. aureus MW2
ucgcaaauuuccacag

SEQ ID NO: 4018824 - RNA, 23 nt, Staphylococcus aureus subsp. aureus MW2
ucgcaccgucaaacuuaaaacua

SEQ ID NO: 4018825 - RNA, 15 nt, Staphylococcus aureus subsp. aureus MW2
ucgcacuauaaaauu

SEQ ID NO: 4018826 - RNA, 15 nt, Staphylococcus aureus subsp. aureus MW2
ucgcagcuucuuuaa

SEQ ID NO: 4018827 - RNA, 16 nt, Staphylococcus aureus subsp. aureus MW2
ucgcauacuuuuucag

SEQ ID NO: 4018828 - RNA, 14 nt, Staphylococcus aureus subsp. aureus MW2
ucgcauauuuugau

SEQ ID NO: 4018829 - RNA, 19 nt, Staphylococcus aureus subsp. aureus MW2
ucgcaucuuuguuuucaaa

SEQ ID NO: 4018830 - RNA, 11 nt, Staphylococcus aureus subsp. aureus MW2
ucgccaauguu

SEQ ID NO: 4018831 - RNA, 20 nt, Staphylococcus aureus subsp. aureus MW2
ucgccauuguccaacugcuu

SEQ ID NO: 4018832 - RNA, 21 nt, Staphylococcus aureus subsp. aureus MW2
ucgcccuuuagccaaugcuuc

SEQ ID NO: 4018833 - RNA, 14 nt, Staphylococcus aureus subsp. aureus MW2
ucgccuacuauaaa

SEQ ID NO: 4018834 - RNA, 19 nt, Staphylococcus aureus subsp. aureus MW2
ucgccucaaaagcuguagu

SEQ ID NO: 4018835 - RNA, 19 nt, Staphylococcus aureus subsp. aureus MW2
ucgccuuuuuuauuuuucu

SEQ ID NO: 4018836 - RNA, 23 nt, Staphylococcus aureus subsp. aureus MW2
ucgccuuuuuuauuuuucuuuuu

SEQ ID NO: 4018837 - RNA, 14 nt, Staphylococcus aureus subsp. aureus MW2
ucgcgaaaacguug

SEQ ID NO: 4018838 - RNA, 15 nt, Staphylococcus aureus subsp. aureus MW2
ucgcgcaucaaaaau

SEQ ID NO: 4018839 - RNA, 14 nt, Staphylococcus aureus subsp. aureus MW2
ucgcucuagacauu

SEQ ID NO: 4018840 - RNA, 21 nt, Staphylococcus aureus subsp. aureus MW2
ucgcuugcaaagacucaauuu

SEQ ID NO: 4018841 - RNA, 11 nt, Staphylococcus aureus subsp. aureus MW2
ucgcuuuucua

SEQ ID NO: 4018842 - RNA, 10 nt, Staphylococcus aureus subsp. aureus MW2
ucggaaacau

SEQ ID NO: 4018843 - RNA, 11 nt, Staphylococcus aureus subsp. aureus MW2
ucggaaacaug

SEQ ID NO: 4018844 - RNA, 21 nt, Staphylococcus aureus subsp. aureus MW2
ucggacugauagaaaaaguuu

SEQ ID NO: 4018845 - RNA, 16 nt, Staphylococcus aureus subsp. aureus MW2
ucggauccaaucuaaa

SEQ ID NO: 4018846 - RNA, 18 nt, Staphylococcus aureus subsp. aureus MW2
ucggaugagaaauguuaa

SEQ ID NO: 4018847 - RNA, 16 nt, Staphylococcus aureus subsp. aureus MW2
ucggauuaucuguaau

SEQ ID NO: 4018848 - RNA, 16 nt, Staphylococcus aureus subsp. aureus MW2
ucggcacucaauuuaa

SEQ ID NO: 4018849 - RNA, 20 nt, Staphylococcus aureus subsp. aureus MW2
ucggcuuuggauuucuuuuu

SEQ ID NO: 4018850 - RNA, 14 nt, Staphylococcus aureus subsp. aureus MW2
ucggcuuuguaaaa

SEQ ID NO: 4018851 - RNA, 16 nt, Staphylococcus aureus subsp. aureus MW2
ucggcuuuguaaaauu

SEQ ID NO: 4018852 - RNA, 18 nt, Staphylococcus aureus subsp. aureus MW2
ucggggccccaacacaga

SEQ ID NO: 4018853 - RNA, 18 nt, Staphylococcus aureus subsp. aureus MW2
ucgguauaucuaaaugau

SEQ ID NO: 4018854 - RNA, 19 nt, Staphylococcus aureus subsp. aureus MW2
ucgguauucaauucuguga

SEQ ID NO: 4018855 - RNA, 16 nt, Staphylococcus aureus subsp. aureus MW2
ucgguuauuacaaaau

SEQ ID NO: 4018856 - RNA, 15 nt, Staphylococcus aureus subsp. aureus MW2
ucgguuuuauuuuug

SEQ ID NO: 4018857 - RNA, 23 nt, Staphylococcus aureus subsp. aureus MW2
ucgguuuuauuuuugucaucaug

SEQ ID NO: 4018858 - RNA, 18 nt, Staphylococcus aureus subsp. aureus MW2
ucguaaacacuauaaaag

SEQ ID NO: 4018859 - RNA, 15 nt, Staphylococcus aureus subsp. aureus MW2
ucguaacauuuaaaa

SEQ ID NO: 4018860 - RNA, 16 nt, Staphylococcus aureus subsp. aureus MW2
ucguaacauuuaaaaa

SEQ ID NO: 4018861 - RNA, 17 nt, Staphylococcus aureus subsp. aureus MW2
ucguaacauuuaaaaaa

SEQ ID NO: 4018862 - RNA, 18 nt, Staphylococcus aureus subsp. aureus MW2
ucguaacgaagauuuugu

SEQ ID NO: 4018863 - RNA, 14 nt, Staphylococcus aureus subsp. aureus MW2
ucguaaugaugaca

SEQ ID NO: 4018864 - RNA, 22 nt, Staphylococcus aureus subsp. aureus MW2
ucguaaugaugacaucaauauc

SEQ ID NO: 4018865 - RNA, 19 nt, Staphylococcus aureus subsp. aureus MW2
ucguaauguguuaauacuu

SEQ ID NO: 4018866 - RNA, 20 nt, Staphylococcus aureus subsp. aureus MW2
ucguaccugcucuuuccaca

SEQ ID NO: 4018867 - RNA, 13 nt, Staphylococcus aureus subsp. aureus MW2
ucguacuuucaaa

SEQ ID NO: 4018868 - RNA, 14 nt, Staphylococcus aureus subsp. aureus MW2
ucguacuuucaaau

SEQ ID NO: 4018869 - RNA, 21 nt, Staphylococcus aureus subsp. aureus MW2
ucguaguaaccuaauucuaag

SEQ ID NO: 4018870 - RNA, 14 nt, Staphylococcus aureus subsp. aureus MW2
ucguauaagaauca

SEQ ID NO: 4018871 - RNA, 21 nt, Staphylococcus aureus subsp. aureus MW2
ucguauauguaauuagaguag

SEQ ID NO: 4018872 - RNA, 16 nt, Staphylococcus aureus subsp. aureus MW2
ucguauucaaaguuuu

SEQ ID NO: 4018873 - RNA, 15 nt, Staphylococcus aureus subsp. aureus MW2
ucguauucuucaaua

SEQ ID NO: 4018874 - RNA, 15 nt, Staphylococcus aureus subsp. aureus MW2
ucguauucuuuuaau

SEQ ID NO: 4018875 - RNA, 13 nt, Staphylococcus aureus subsp. aureus MW2
ucguauuuuuaag

SEQ ID NO: 4018876 - RNA, 13 nt, Staphylococcus aureus subsp. aureus MW2
ucgucaaaaacag

SEQ ID NO: 4018877 - RNA, 22 nt, Staphylococcus aureus subsp. aureus MW2
ucgucaaacggcacuaauauuu

SEQ ID NO: 4018878 - RNA, 23 nt, Staphylococcus aureus subsp. aureus MW2
ucgucaaacggcacuaauauuua

SEQ ID NO: 4018879 - RNA, 13 nt, Staphylococcus aureus subsp. aureus MW2
ucgucauuaugug

SEQ ID NO: 4018880 - RNA, 20 nt, Staphylococcus aureus subsp. aureus MW2
ucgucccaccccaacuugca

SEQ ID NO: 4018881 - RNA, 14 nt, Staphylococcus aureus subsp. aureus MW2
ucgucgaaaugccu

SEQ ID NO: 4018882 - RNA, 19 nt, Staphylococcus aureus subsp. aureus MW2
ucgucuucaauuaaugauu

SEQ ID NO: 4018883 - RNA, 23 nt, Staphylococcus aureus subsp. aureus MW2
ucgucuucuuuuuguccccagcc

SEQ ID NO: 4018884 - RNA, 21 nt, Staphylococcus aureus subsp. aureus MW2
ucgucuuguaaacuucuuuuc

SEQ ID NO: 4018885 - RNA, 16 nt, Staphylococcus aureus subsp. aureus MW2
ucgugauagaaguuuu

SEQ ID NO: 4018886 - RNA, 19 nt, Staphylococcus aureus subsp. aureus MW2
ucgugauuuggaauacuuu

SEQ ID NO: 4018887 - RNA, 23 nt, Staphylococcus aureus subsp. aureus MW2
ucguguuaauaaccgaaauauug

SEQ ID NO: 4018888 - RNA, 15 nt, Staphylococcus aureus subsp. aureus MW2
ucguguuccaauuuu

SEQ ID NO: 4018889 - RNA, 17 nt, Staphylococcus aureus subsp. aureus MW2
ucguguuugaauguuuu

SEQ ID NO: 4018890 - RNA, 18 nt, Staphylococcus aureus subsp. aureus MW2
ucguuaaaacacccugcu

SEQ ID NO: 4018891 - RNA, 16 nt, Staphylococcus aureus subsp. aureus MW2
ucguuaaggaaagcuu

SEQ ID NO: 4018892 - RNA, 13 nt, Staphylococcus aureus subsp. aureus MW2
ucguuaauaaacc

SEQ ID NO: 4018893 - RNA, 14 nt, Staphylococcus aureus subsp. aureus MW2
ucguuaauuuccaa

SEQ ID NO: 4018894 - RNA, 22 nt, Staphylococcus aureus subsp. aureus MW2
ucguuauaaguacaaauaauac

SEQ ID NO: 4018895 - RNA, 21 nt, Staphylococcus aureus subsp. aureus MW2
ucguucauauauuuuguuaau

SEQ ID NO: 4018896 - RNA, 16 nt, Staphylococcus aureus subsp. aureus MW2
ucguucccauucuuug

SEQ ID NO: 4018897 - RNA, 11 nt, Staphylococcus aureus subsp. aureus MW2
ucguuccuuug

SEQ ID NO: 4018898 - RNA, 19 nt, Staphylococcus aureus subsp. aureus MW2
ucguuguacaguaauauuc

SEQ ID NO: 4018899 - RNA, 17 nt, Staphylococcus aureus subsp. aureus MW2
ucguuguucauaaucau

SEQ ID NO: 4018900 - RNA, 15 nt, Staphylococcus aureus subsp. aureus MW2
ucguuguugaaauua

SEQ ID NO: 4018901 - RNA, 15 nt, Staphylococcus aureus subsp. aureus MW2
ucguuuaaugggauu

SEQ ID NO: 4018902 - RNA, 14 nt, Staphylococcus aureus subsp. aureus MW2
ucguuuauuuuaaa

SEQ ID NO: 4018903 - RNA, 17 nt, Staphylococcus aureus subsp. aureus MW2
ucguuucuuuauuaaau

SEQ ID NO: 4018904 - RNA, 15 nt, Staphylococcus aureus subsp. aureus MW2
ucguuucuuuuauau

SEQ ID NO: 4018905 - RNA, 18 nt, Staphylococcus aureus subsp. aureus MW2
ucguuugaauuauuuaau

SEQ ID NO: 4018906 - RNA, 16 nt, Staphylococcus aureus subsp. aureus MW2
ucguuuuaauaaauug

SEQ ID NO: 4018907 - RNA, 21 nt, Staphylococcus aureus subsp. aureus MW2
ucguuuuauuaaugaagcugu

SEQ ID NO: 4018908 - RNA, 19 nt, Staphylococcus aureus subsp. aureus MW2
ucguuuucaacauaauauu

SEQ ID NO: 4018909 - RNA, 13 nt, Staphylococcus aureus subsp. aureus MW2
ucuaaaaaauuaa

SEQ ID NO: 4018910 - RNA, 18 nt, Staphylococcus aureus subsp. aureus MW2
ucuaaaaaauuaaaaauu

SEQ ID NO: 4018911 - RNA, 13 nt, Staphylococcus aureus subsp. aureus MW2
ucuaaaaacauaa

SEQ ID NO: 4018912 - RNA, 14 nt, Staphylococcus aureus subsp. aureus MW2
ucuaaaaacauaaa

SEQ ID NO: 4018913 - RNA, 19 nt, Staphylococcus aureus subsp. aureus MW2
ucuaaaaagcggacugaaa

SEQ ID NO: 4018914 - RNA, 16 nt, Staphylococcus aureus subsp. aureus MW2
ucuaaaaagucuuuaa

SEQ ID NO: 4018915 - RNA, 19 nt, Staphylococcus aureus subsp. aureus MW2
ucuaaaccuuuuuuaaguu

SEQ ID NO: 4018916 - RNA, 14 nt, Staphylococcus aureus subsp. aureus MW2
ucuaaagauuucag

SEQ ID NO: 4018917 - RNA, 18 nt, Staphylococcus aureus subsp. aureus MW2
ucuaaagcuauaaaaaau

SEQ ID NO: 4018918 - RNA, 16 nt, Staphylococcus aureus subsp. aureus MW2
ucuaaagcuuauuaaa

SEQ ID NO: 4018919 - RNA, 16 nt, Staphylococcus aureus subsp. aureus MW2
ucuaaagcuugaucaa

SEQ ID NO: 4018920 - RNA, 14 nt, Staphylococcus aureus subsp. aureus MW2
ucuaaauaaaauua

SEQ ID NO: 4018921 - RNA, 20 nt, Staphylococcus aureus subsp. aureus MW2
ucuaaauaaaauuaaaacag

SEQ ID NO: 4018922 - RNA, 17 nt, Staphylococcus aureus subsp. aureus MW2
ucuaaauaguuuuucau

SEQ ID NO: 4018923 - RNA, 16 nt, Staphylococcus aureus subsp. aureus MW2
ucuaaaucuauacuuu

SEQ ID NO: 4018924 - RNA, 22 nt, Staphylococcus aureus subsp. aureus MW2
ucuaaaugauggguaguuaaua

SEQ ID NO: 4018925 - RNA, 21 nt, Staphylococcus aureus subsp. aureus MW2
ucuaaaugguuaucuaaaauu

SEQ ID NO: 4018926 - RNA, 21 nt, Staphylococcus aureus subsp. aureus MW2
ucuaaauguaaaaucauuaau

SEQ ID NO: 4018927 - RNA, 18 nt, Staphylococcus aureus subsp. aureus MW2
ucuaaauuauuuauucau

SEQ ID NO: 4018928 - RNA, 23 nt, Staphylococcus aureus subsp. aureus MW2
ucuaacagggaacccaggugcau

SEQ ID NO: 4018929 - RNA, 14 nt, Staphylococcus aureus subsp. aureus MW2
ucuaacaguuaaua

SEQ ID NO: 4018930 - RNA, 14 nt, Staphylococcus aureus subsp. aureus MW2
ucuaaccacuucuu

SEQ ID NO: 4018931 - RNA, 12 nt, Staphylococcus aureus subsp. aureus MW2
ucuaaccaucuc

SEQ ID NO: 4018932 - RNA, 16 nt, Staphylococcus aureus subsp. aureus MW2
ucuaacgcaacugaaa

SEQ ID NO: 4018933 - RNA, 19 nt, Staphylococcus aureus subsp. aureus MW2
ucuaacggcguuuguuucu

SEQ ID NO: 4018934 - RNA, 15 nt, Staphylococcus aureus subsp. aureus MW2
ucuaacgguaaauaa

SEQ ID NO: 4018935 - RNA, 14 nt, Staphylococcus aureus subsp. aureus MW2
ucuaacugaauuaa

SEQ ID NO: 4018936 - RNA, 16 nt, Staphylococcus aureus subsp. aureus MW2
ucuaacuuaccaugau

SEQ ID NO: 4018937 - RNA, 17 nt, Staphylococcus aureus subsp. aureus MW2
ucuaacuuuaccaauau

SEQ ID NO: 4018938 - RNA, 13 nt, Staphylococcus aureus subsp. aureus MW2
ucuaagucuuuug

SEQ ID NO: 4018939 - RNA, 14 nt, Staphylococcus aureus subsp. aureus MW2
ucuaauaauuuaau

SEQ ID NO: 4018940 - RNA, 16 nt, Staphylococcus aureus subsp. aureus MW2
ucuaauaauuuaaugu

SEQ ID NO: 4018941 - RNA, 15 nt, Staphylococcus aureus subsp. aureus MW2
ucuaauacauacuga

SEQ ID NO: 4018942 - RNA, 18 nt, Staphylococcus aureus subsp. aureus MW2
ucuaauacuuucaaacaa

SEQ ID NO: 4018943 - RNA, 20 nt, Staphylococcus aureus subsp. aureus MW2
ucuaauacuuucaaacaaau

SEQ ID NO: 4018944 - RNA, 15 nt, Staphylococcus aureus subsp. aureus MW2
ucuaauacuuucacu

SEQ ID NO: 4018945 - RNA, 22 nt, Staphylococcus aureus subsp. aureus MW2
ucuaauacuuucacuuuuuaua

SEQ ID NO: 4018946 - RNA, 21 nt, Staphylococcus aureus subsp. aureus MW2
ucuaaucgacuuuuacaauca

SEQ ID NO: 4018947 - RNA, 17 nt, Staphylococcus aureus subsp. aureus MW2
ucuaaucuucacgcuua

SEQ ID NO: 4018948 - RNA, 19 nt, Staphylococcus aureus subsp. aureus MW2
ucuaaugcucauuaauggu

SEQ ID NO: 4018949 - RNA, 21 nt, Staphylococcus aureus subsp. aureus MW2
ucuaauucaaugauuuuuaaa

SEQ ID NO: 4018950 - RNA, 13 nt, Staphylococcus aureus subsp. aureus MW2
ucuaauucguaau

SEQ ID NO: 4018951 - RNA, 14 nt, Staphylococcus aureus subsp. aureus MW2
ucuaauucugaaau

SEQ ID NO: 4018952 - RNA, 12 nt, Staphylococcus aureus subsp. aureus MW2
ucuaauucuucu

SEQ ID NO: 4018953 - RNA, 15 nt, Staphylococcus aureus subsp. aureus MW2
ucuaauucuucuaau

SEQ ID NO: 4018954 - RNA, 15 nt, Staphylococcus aureus subsp. aureus MW2
ucuaauuguuguaau

SEQ ID NO: 4018955 - RNA, 19 nt, Staphylococcus aureus subsp. aureus MW2
ucuaauuguuguaauucuu

SEQ ID NO: 4018956 - RNA, 21 nt, Staphylococcus aureus subsp. aureus MW2
ucuaauuguuguaauucuuuu

SEQ ID NO: 4018957 - RNA, 21 nt, Staphylococcus aureus subsp. aureus MW2
ucuaauuucuuagauuuuaua

SEQ ID NO: 4018958 - RNA, 15 nt, Staphylococcus aureus subsp. aureus MW2
ucuaauuuuucuuua

SEQ ID NO: 4018959 - RNA, 16 nt, Staphylococcus aureus subsp. aureus MW2
ucuaauuuuucuuuaa

SEQ ID NO: 4018960 - RNA, 22 nt, Staphylococcus aureus subsp. aureus MW2
ucuacaaacaaugcaaguuggc

SEQ ID NO: 4018961 - RNA, 20 nt, Staphylococcus aureus subsp. aureus MW2
ucuacaacuucauuaguugc

SEQ ID NO: 4018962 - RNA, 16 nt, Staphylococcus aureus subsp. aureus MW2
ucuacaauauuaaaau

SEQ ID NO: 4018963 - RNA, 22 nt, Staphylococcus aureus subsp. aureus MW2
ucuacaauauuaaaauuaaaac

SEQ ID NO: 4018964 - RNA, 11 nt, Staphylococcus aureus subsp. aureus MW2
ucuacacccau

SEQ ID NO: 4018965 - RNA, 22 nt, Staphylococcus aureus subsp. aureus MW2
ucuacagacaaugcaaguuggg

SEQ ID NO: 4018966 - RNA, 20 nt, Staphylococcus aureus subsp. aureus MW2
ucuacagcgucaccuaaugc

SEQ ID NO: 4018967 - RNA, 18 nt, Staphylococcus aureus subsp. aureus MW2
ucuacaggcaaugcaagu

SEQ ID NO: 4018968 - RNA, 22 nt, Staphylococcus aureus subsp. aureus MW2
ucuacaggcaaugcaaguuggc

SEQ ID NO: 4018969 - RNA, 18 nt, Staphylococcus aureus subsp. aureus MW2
ucuacauaugaaaaaugu

SEQ ID NO: 4018970 - RNA, 21 nt, Staphylococcus aureus subsp. aureus MW2
ucuacauauuggcuugcuuca

SEQ ID NO: 4018971 - RNA, 23 nt, Staphylococcus aureus subsp. aureus MW2
ucuacaugaaucaacaauauaaa

SEQ ID NO: 4018972 - RNA, 22 nt, Staphylococcus aureus subsp. aureus MW2
ucuacccauaauuuaaaugaua

SEQ ID NO: 4018973 - RNA, 15 nt, Staphylococcus aureus subsp. aureus MW2
ucuacccuugcaaau

SEQ ID NO: 4018974 - RNA, 14 nt, Staphylococcus aureus subsp. aureus MW2
ucuacgaaguuaua

SEQ ID NO: 4018975 - RNA, 16 nt, Staphylococcus aureus subsp. aureus MW2
ucuacuaaauaacuau

SEQ ID NO: 4018976 - RNA, 17 nt, Staphylococcus aureus subsp. aureus MW2
ucuacuaaaucaaauug

SEQ ID NO: 4018977 - RNA, 14 nt, Staphylococcus aureus subsp. aureus MW2
ucuacuuaaaauaa

SEQ ID NO: 4018978 - RNA, 17 nt, Staphylococcus aureus subsp. aureus MW2
ucuacuuaguaauaaga

SEQ ID NO: 4018979 - RNA, 24 nt, Staphylococcus aureus subsp. aureus MW2
ucuagacuuauuugaaugcaaauc

SEQ ID NO: 4018980 - RNA, 15 nt, Staphylococcus aureus subsp. aureus MW2
ucuagagauaacuag

SEQ ID NO: 4018981 - RNA, 17 nt, Staphylococcus aureus subsp. aureus MW2
ucuagagauaacuagaa

SEQ ID NO: 4018982 - RNA, 13 nt, Staphylococcus aureus subsp. aureus MW2
ucuagaugaaauu

SEQ ID NO: 4018983 - RNA, 15 nt, Staphylococcus aureus subsp. aureus MW2
ucuagauuucaaauc

SEQ ID NO: 4018984 - RNA, 20 nt, Staphylococcus aureus subsp. aureus MW2
ucuagcguagcgaaaguauc

SEQ ID NO: 4018985 - RNA, 17 nt, Staphylococcus aureus subsp. aureus MW2
ucuagcugcuucugcug

SEQ ID NO: 4018986 - RNA, 17 nt, Staphylococcus aureus subsp. aureus MW2
ucuaguguucucauuau

SEQ ID NO: 4018987 - RNA, 19 nt, Staphylococcus aureus subsp. aureus MW2
ucuaguucgaacacacacu

SEQ ID NO: 4018988 - RNA, 15 nt, Staphylococcus aureus subsp. aureus MW2
ucuauaaaaagaaua

SEQ ID NO: 4018989 - RNA, 13 nt, Staphylococcus aureus subsp. aureus MW2
ucuauaaauacuu

SEQ ID NO: 4018990 - RNA, 14 nt, Staphylococcus aureus subsp. aureus MW2
ucuauaacaccaua

SEQ ID NO: 4018991 - RNA, 14 nt, Staphylococcus aureus subsp. aureus MW2
ucuauaaccuuaau

SEQ ID NO: 4018992 - RNA, 18 nt, Staphylococcus aureus subsp. aureus MW2
ucuauaagauuucucagu

SEQ ID NO: 4018993 - RNA, 23 nt, Staphylococcus aureus subsp. aureus MW2
ucuauaauaaaucggacugauag

SEQ ID NO: 4018994 - RNA, 14 nt, Staphylococcus aureus subsp. aureus MW2
ucuauaauauucaa

SEQ ID NO: 4018995 - RNA, 21 nt, Staphylococcus aureus subsp. aureus MW2
ucuauaauauucaauaauuca

SEQ ID NO: 4018996 - RNA, 15 nt, Staphylococcus aureus subsp. aureus MW2
ucuauaauuugugug

SEQ ID NO: 4018997 - RNA, 22 nt, Staphylococcus aureus subsp. aureus MW2
ucuauaccauuccaaaaauugu

SEQ ID NO: 4018998 - RNA, 23 nt, Staphylococcus aureus subsp. aureus MW2
ucuauaccauuccaaaaauugua

SEQ ID NO: 4018999 - RNA, 21 nt, Staphylococcus aureus subsp. aureus MW2
ucuauagcuagcaaucccauu

SEQ ID NO: 4019000 - RNA, 19 nt, Staphylococcus aureus subsp. aureus MW2
ucuauagucaucuguuaau

SEQ ID NO: 4019001 - RNA, 22 nt, Staphylococcus aureus subsp. aureus MW2
ucuauauaaaaacuguucauac

SEQ ID NO: 4019002 - RNA, 21 nt, Staphylococcus aureus subsp. aureus MW2
ucuauauaaaguugacaauac

SEQ ID NO: 4019003 - RNA, 16 nt, Staphylococcus aureus subsp. aureus MW2
ucuauauaauuuauuu

SEQ ID NO: 4019004 - RNA, 19 nt, Staphylococcus aureus subsp. aureus MW2
ucuauauaguaaaauaaau

SEQ ID NO: 4019005 - RNA, 13 nt, Staphylococcus aureus subsp. aureus MW2
ucuauauauauuu

SEQ ID NO: 4019006 - RNA, 16 nt, Staphylococcus aureus subsp. aureus MW2
ucuauauauauuuaaa

SEQ ID NO: 4019007 - RNA, 23 nt, Staphylococcus aureus subsp. aureus MW2
ucuauaucgucgauuucauuaau

SEQ ID NO: 4019008 - RNA, 15 nt, Staphylococcus aureus subsp. aureus MW2
ucuauaucuauuuau

SEQ ID NO: 4019009 - RNA, 12 nt, Staphylococcus aureus subsp. aureus MW2
ucuauaugcaua

SEQ ID NO: 4019010 - RNA, 19 nt, Staphylococcus aureus subsp. aureus MW2
ucuauauguccuaggaaau

SEQ ID NO: 4019011 - RNA, 16 nt, Staphylococcus aureus subsp. aureus MW2
ucuauauuaauagaaa

SEQ ID NO: 4019012 - RNA, 18 nt, Staphylococcus aureus subsp. aureus MW2
ucuauauuuaauuuugau

SEQ ID NO: 4019013 - RNA, 14 nt, Staphylococcus aureus subsp. aureus MW2
ucuauauuuuauua

SEQ ID NO: 4019014 - RNA, 21 nt, Staphylococcus aureus subsp. aureus MW2
ucuaucaaauuacuuauucaa

SEQ ID NO: 4019015 - RNA, 14 nt, Staphylococcus aureus subsp. aureus MW2
ucuaucaacgucac

SEQ ID NO: 4019016 - RNA, 14 nt, Staphylococcus aureus subsp. aureus MW2
ucuaucgccuaaaa

SEQ ID NO: 4019017 - RNA, 21 nt, Staphylococcus aureus subsp. aureus MW2
ucuaucgccuaaaaauaaaau

SEQ ID NO: 4019018 - RNA, 17 nt, Staphylococcus aureus subsp. aureus MW2
ucuaucgguaauuuuug

SEQ ID NO: 4019019 - RNA, 21 nt, Staphylococcus aureus subsp. aureus MW2
ucuaucguuguguauuguuug

SEQ ID NO: 4019020 - RNA, 17 nt, Staphylococcus aureus subsp. aureus MW2
ucuaucuauaaacguca

SEQ ID NO: 4019021 - RNA, 15 nt, Staphylococcus aureus subsp. aureus MW2
ucuaucuauuuuacu

SEQ ID NO: 4019022 - RNA, 14 nt, Staphylococcus aureus subsp. aureus MW2
ucuaugucaaauug

SEQ ID NO: 4019023 - RNA, 16 nt, Staphylococcus aureus subsp. aureus MW2
ucuaugucaaauugaa

SEQ ID NO: 4019024 - RNA, 19 nt, Staphylococcus aureus subsp. aureus MW2
ucuauuaaacauuuuugau

SEQ ID NO: 4019025 - RNA, 14 nt, Staphylococcus aureus subsp. aureus MW2
ucuauuaauuuucu

SEQ ID NO: 4019026 - RNA, 21 nt, Staphylococcus aureus subsp. aureus MW2
ucuauuagggggcauauuaau

SEQ ID NO: 4019027 - RNA, 16 nt, Staphylococcus aureus subsp. aureus MW2
ucuauuauuuuacuuu

SEQ ID NO: 4019028 - RNA, 18 nt, Staphylococcus aureus subsp. aureus MW2
ucuauuauuuuacuuugu

SEQ ID NO: 4019029 - RNA, 17 nt, Staphylococcus aureus subsp. aureus MW2
ucuauucaaaugauuuu

SEQ ID NO: 4019030 - RNA, 20 nt, Staphylococcus aureus subsp. aureus MW2
ucuauucaaaugauuuuagu

SEQ ID NO: 4019031 - RNA, 16 nt, Staphylococcus aureus subsp. aureus MW2
ucuauucgaaaaaggu

SEQ ID NO: 4019032 - RNA, 17 nt, Staphylococcus aureus subsp. aureus MW2
ucuauugcaauauaguu

SEQ ID NO: 4019033 - RNA, 17 nt, Staphylococcus aureus subsp. aureus MW2
ucuauuuaaacaagaaa

SEQ ID NO: 4019034 - RNA, 18 nt, Staphylococcus aureus subsp. aureus MW2
ucuauuuacggcauaauu

SEQ ID NO: 4019035 - RNA, 22 nt, Staphylococcus aureus subsp. aureus MW2
ucuauuucacucuacaauccua

SEQ ID NO: 4019036 - RNA, 14 nt, Staphylococcus aureus subsp. aureus MW2
ucuauuuuacucuu

SEQ ID NO: 4019037 - RNA, 22 nt, Staphylococcus aureus subsp. aureus MW2
ucuauuuuacucuuuuuaauau

SEQ ID NO: 4019038 - RNA, 12 nt, Staphylococcus aureus subsp. aureus MW2
ucuauuuuauga

SEQ ID NO: 4019039 - RNA, 19 nt, Staphylococcus aureus subsp. aureus MW2
ucuauuuuaugauuugauu

SEQ ID NO: 4019040 - RNA, 20 nt, Staphylococcus aureus subsp. aureus MW2
ucuauuuuaugauuugauuu

SEQ ID NO: 4019041 - RNA, 22 nt, Staphylococcus aureus subsp. aureus MW2
ucuauuuugcuugcuuacaaua

SEQ ID NO: 4019042 - RNA, 23 nt, Staphylococcus aureus subsp. aureus MW2
ucucaaacuaucuuauauuuaug

SEQ ID NO: 4019043 - RNA, 21 nt, Staphylococcus aureus subsp. aureus MW2
ucucaacaaaucuauaaauau

SEQ ID NO: 4019044 - RNA, 22 nt, Staphylococcus aureus subsp. aureus MW2
ucucaauccaauuaaauauuua

SEQ ID NO: 4019045 - RNA, 21 nt, Staphylococcus aureus subsp. aureus MW2
ucucagauucauaucuuucaa

SEQ ID NO: 4019046 - RNA, 21 nt, Staphylococcus aureus subsp. aureus MW2
ucucagcguauuuuaguacuu

SEQ ID NO: 4019047 - RNA, 13 nt, Staphylococcus aureus subsp. aureus MW2
ucucauaauaauu

SEQ ID NO: 4019048 - RNA, 17 nt, Staphylococcus aureus subsp. aureus MW2
ucucauagucaucuuag

SEQ ID NO: 4019049 - RNA, 19 nt, Staphylococcus aureus subsp. aureus MW2
ucucaucauuuucaauacu

SEQ ID NO: 4019050 - RNA, 19 nt, Staphylococcus aureus subsp. aureus MW2
ucucaucuacuauuuaauc

SEQ ID NO: 4019051 - RNA, 14 nt, Staphylococcus aureus subsp. aureus MW2
ucucaucuucuaaa

SEQ ID NO: 4019052 - RNA, 18 nt, Staphylococcus aureus subsp. aureus MW2
ucucaugccaaaaacauu

SEQ ID NO: 4019053 - RNA, 20 nt, Staphylococcus aureus subsp. aureus MW2
ucucaugccaaaaacauuaa

SEQ ID NO: 4019054 - RNA, 12 nt, Staphylococcus aureus subsp. aureus MW2
ucucauuaaccu

SEQ ID NO: 4019055 - RNA, 18 nt, Staphylococcus aureus subsp. aureus MW2
ucucauuaaccuuacaua

SEQ ID NO: 4019056 - RNA, 14 nt, Staphylococcus aureus subsp. aureus MW2
ucucauuauaauga

SEQ ID NO: 4019057 - RNA, 13 nt, Staphylococcus aureus subsp. aureus MW2
ucucauuaucacc

SEQ ID NO: 4019058 - RNA, 21 nt, Staphylococcus aureus subsp. aureus MW2
ucucauugaaaucgucuuacu

SEQ ID NO: 4019059 - RNA, 19 nt, Staphylococcus aureus subsp. aureus MW2
ucuccaacucuaacagcuu

SEQ ID NO: 4019060 - RNA, 14 nt, Staphylococcus aureus subsp. aureus MW2
ucuccaguuuucaa

SEQ ID NO: 4019061 - RNA, 19 nt, Staphylococcus aureus subsp. aureus MW2
ucuccauuagaacuaagau

SEQ ID NO: 4019062 - RNA, 22 nt, Staphylococcus aureus subsp. aureus MW2
ucucccuuaaauacaauuucuu

SEQ ID NO: 4019063 - RNA, 16 nt, Staphylococcus aureus subsp. aureus MW2
ucuccguauuuaccuu

SEQ ID NO: 4019064 - RNA, 22 nt, Staphylococcus aureus subsp. aureus MW2
ucuccuaaagguaacuuuuuaa

SEQ ID NO: 4019065 - RNA, 20 nt, Staphylococcus aureus subsp. aureus MW2
ucuccuugcucaugagcaca

SEQ ID NO: 4019066 - RNA, 16 nt, Staphylococcus aureus subsp. aureus MW2
ucuccuuuuguuucaa

SEQ ID NO: 4019067 - RNA, 15 nt, Staphylococcus aureus subsp. aureus MW2
ucucguguauacaac

SEQ ID NO: 4019068 - RNA, 23 nt, Staphylococcus aureus subsp. aureus MW2
ucucuaaaaagcggacugaaaga

SEQ ID NO: 4019069 - RNA, 17 nt, Staphylococcus aureus subsp. aureus MW2
ucucuaaaacuuuuuca

SEQ ID NO: 4019070 - RNA, 19 nt, Staphylococcus aureus subsp. aureus MW2
ucucuaaaacuuuuucaau

SEQ ID NO: 4019071 - RNA, 18 nt, Staphylococcus aureus subsp. aureus MW2
ucucuagugcuuugucuu

SEQ ID NO: 4019072 - RNA, 23 nt, Staphylococcus aureus subsp. aureus MW2
ucucuaucaguccgcuuuuucau

SEQ ID NO: 4019073 - RNA, 18 nt, Staphylococcus aureus subsp. aureus MW2
ucucuauuaauuuucuca

SEQ ID NO: 4019074 - RNA, 18 nt, Staphylococcus aureus subsp. aureus MW2
ucucuauuuauaacacuu

SEQ ID NO: 4019075 - RNA, 17 nt, Staphylococcus aureus subsp. aureus MW2
ucucugaaaaacuucuu

SEQ ID NO: 4019076 - RNA, 19 nt, Staphylococcus aureus subsp. aureus MW2
ucucugcuuuaauauaauu

SEQ ID NO: 4019077 - RNA, 23 nt, Staphylococcus aureus subsp. aureus MW2
ucucuguguuggggcccaucccc

SEQ ID NO: 4019078 - RNA, 15 nt, Staphylococcus aureus subsp. aureus MW2
ucucuuauuuuaaaa

SEQ ID NO: 4019079 - RNA, 18 nt, Staphylococcus aureus subsp. aureus MW2
ucucuuauuuuaaaauau

SEQ ID NO: 4019080 - RNA, 16 nt, Staphylococcus aureus subsp. aureus MW2
ucucuucugucuaaaa

SEQ ID NO: 4019081 - RNA, 18 nt, Staphylococcus aureus subsp. aureus MW2
ucucuuuacaccauugca

SEQ ID NO: 4019082 - RNA, 14 nt, Staphylococcus aureus subsp. aureus MW2
ucucuuuaccagua

SEQ ID NO: 4019083 - RNA, 15 nt, Staphylococcus aureus subsp. aureus MW2
ucucuuucuuauuca

SEQ ID NO: 4019084 - RNA, 14 nt, Staphylococcus aureus subsp. aureus MW2
ucucuuugaagggu

SEQ ID NO: 4019085 - RNA, 19 nt, Staphylococcus aureus subsp. aureus MW2
ucugaaaaaauuaauaauu

SEQ ID NO: 4019086 - RNA, 18 nt, Staphylococcus aureus subsp. aureus MW2
ucugaaacuuuaauacua

SEQ ID NO: 4019087 - RNA, 19 nt, Staphylococcus aureus subsp. aureus MW2
ucugaaaugauacauuauu

SEQ ID NO: 4019088 - RNA, 18 nt, Staphylococcus aureus subsp. aureus MW2
ucugaaguagauugauau

SEQ ID NO: 4019089 - RNA, 13 nt, Staphylococcus aureus subsp. aureus MW2
ucugaauuuaaua

SEQ ID NO: 4019090 - RNA, 13 nt, Staphylococcus aureus subsp. aureus MW2
ucugaauuuagga

SEQ ID NO: 4019091 - RNA, 22 nt, Staphylococcus aureus subsp. aureus MW2
ucugacauuucaucaauaauuu

SEQ ID NO: 4019092 - RNA, 18 nt, Staphylococcus aureus subsp. aureus MW2
ucugacuaacauugguac

SEQ ID NO: 4019093 - RNA, 14 nt, Staphylococcus aureus subsp. aureus MW2
ucugacuuuuaaaa

SEQ ID NO: 4019094 - RNA, 21 nt, Staphylococcus aureus subsp. aureus MW2
ucugauacaucaucgccagca

SEQ ID NO: 4019095 - RNA, 22 nt, Staphylococcus aureus subsp. aureus MW2
ucugauacuucaccaucuuuaa

SEQ ID NO: 4019096 - RNA, 23 nt, Staphylococcus aureus subsp. aureus MW2
ucugauuucacuucuaaaacuaa

SEQ ID NO: 4019097 - RNA, 13 nt, Staphylococcus aureus subsp. aureus MW2
ucugcaauuucau

SEQ ID NO: 4019098 - RNA, 18 nt, Staphylococcus aureus subsp. aureus MW2
ucugcaccuguuuuaauu

SEQ ID NO: 4019099 - RNA, 19 nt, Staphylococcus aureus subsp. aureus MW2
ucugcauagcgcucuggau

SEQ ID NO: 4019100 - RNA, 23 nt, Staphylococcus aureus subsp. aureus MW2
ucugcaugguuugcugguugcuu

SEQ ID NO: 4019101 - RNA, 15 nt, Staphylococcus aureus subsp. aureus MW2
ucugccguguuuugu

SEQ ID NO: 4019102 - RNA, 21 nt, Staphylococcus aureus subsp. aureus MW2
ucugcuaacucugaucuaaaa

SEQ ID NO: 4019103 - RNA, 14 nt, Staphylococcus aureus subsp. aureus MW2
ucugcuauuuuuuu

SEQ ID NO: 4019104 - RNA, 14 nt, Staphylococcus aureus subsp. aureus MW2
ucugcuucuaaaac

SEQ ID NO: 4019105 - RNA, 14 nt, Staphylococcus aureus subsp. aureus MW2
ucugcuucuuuuaa

SEQ ID NO: 4019106 - RNA, 16 nt, Staphylococcus aureus subsp. aureus MW2
ucuggaacaauaauca

SEQ ID NO: 4019107 - RNA, 21 nt, Staphylococcus aureus subsp. aureus MW2
ucuggaacaauaaucaauguu

SEQ ID NO: 4019108 - RNA, 15 nt, Staphylococcus aureus subsp. aureus MW2
ucuggaacuuuaaua

SEQ ID NO: 4019109 - RNA, 21 nt, Staphylococcus aureus subsp. aureus MW2
ucuguaaauuaucuaaagaaa

SEQ ID NO: 4019110 - RNA, 22 nt, Staphylococcus aureus subsp. aureus MW2
ucuguaaauuaucuaaagaaau

SEQ ID NO: 4019111 - RNA, 22 nt, Staphylococcus aureus subsp. aureus MW2
ucuguaauaugaaggcuuuuug

SEQ ID NO: 4019112 - RNA, 13 nt, Staphylococcus aureus subsp. aureus MW2
ucuguaauuaauc

SEQ ID NO: 4019113 - RNA, 18 nt, Staphylococcus aureus subsp. aureus MW2
ucuguaccguauuuuaau

SEQ ID NO: 4019114 - RNA, 19 nt, Staphylococcus aureus subsp. aureus MW2
ucuguacguuuuaaauaaa

SEQ ID NO: 4019115 - RNA, 12 nt, Staphylococcus aureus subsp. aureus MW2
ucuguacuucua

SEQ ID NO: 4019116 - RNA, 13 nt, Staphylococcus aureus subsp. aureus MW2
ucuguacuucuaa

SEQ ID NO: 4019117 - RNA, 19 nt, Staphylococcus aureus subsp. aureus MW2
ucuguagguuuaauguuua

SEQ ID NO: 4019118 - RNA, 17 nt, Staphylococcus aureus subsp. aureus MW2
ucuguauuauuauaauu

SEQ ID NO: 4019119 - RNA, 18 nt, Staphylococcus aureus subsp. aureus MW2
ucuguauuauuauaauuu

SEQ ID NO: 4019120 - RNA, 20 nt, Staphylococcus aureus subsp. aureus MW2
ucuguccgauaucuuuuaau

SEQ ID NO: 4019121 - RNA, 18 nt, Staphylococcus aureus subsp. aureus MW2
ucuguccgauuuuuaaug

SEQ ID NO: 4019122 - RNA, 21 nt, Staphylococcus aureus subsp. aureus MW2
ucugucggacuccuuuuacuu

SEQ ID NO: 4019123 - RNA, 20 nt, Staphylococcus aureus subsp. aureus MW2
ucugugaccaauagaauuca

SEQ ID NO: 4019124 - RNA, 18 nt, Staphylococcus aureus subsp. aureus MW2
ucuguuaacugaauuucg

SEQ ID NO: 4019125 - RNA, 15 nt, Staphylococcus aureus subsp. aureus MW2
ucuguuucaaagcug

SEQ ID NO: 4019126 - RNA, 18 nt, Staphylococcus aureus subsp. aureus MW2
ucuuaaacgcucuucuuc

SEQ ID NO: 4019127 - RNA, 17 nt, Staphylococcus aureus subsp. aureus MW2
ucuuaaaucaacaucau

SEQ ID NO: 4019128 - RNA, 14 nt, Staphylococcus aureus subsp. aureus MW2
ucuuaacaauauca

SEQ ID NO: 4019129 - RNA, 17 nt, Staphylococcus aureus subsp. aureus MW2
ucuuaacaauaucaucu

SEQ ID NO: 4019130 - RNA, 17 nt, Staphylococcus aureus subsp. aureus MW2
ucuuaacaauuuuaauu

SEQ ID NO: 4019131 - RNA, 13 nt, Staphylococcus aureus subsp. aureus MW2
ucuuaaguacaua

SEQ ID NO: 4019132 - RNA, 16 nt, Staphylococcus aureus subsp. aureus MW2
ucuuaaguacauaaau

SEQ ID NO: 4019133 - RNA, 19 nt, Staphylococcus aureus subsp. aureus MW2
ucuuaaucagcuauaaaag

SEQ ID NO: 4019134 - RNA, 17 nt, Staphylococcus aureus subsp. aureus MW2
ucuuaaucuaaaaauag

SEQ ID NO: 4019135 - RNA, 14 nt, Staphylococcus aureus subsp. aureus MW2
ucuuaauguacuuu

SEQ ID NO: 4019136 - RNA, 13 nt, Staphylococcus aureus subsp. aureus MW2
ucuuaauuaucau

SEQ ID NO: 4019137 - RNA, 24 nt, Staphylococcus aureus subsp. aureus MW2
ucuuaauucauuccaaacacacug

SEQ ID NO: 4019138 - RNA, 13 nt, Staphylococcus aureus subsp. aureus MW2
ucuuaauucuucu

SEQ ID NO: 4019139 - RNA, 17 nt, Staphylococcus aureus subsp. aureus MW2
ucuuaauugaauuaaau

SEQ ID NO: 4019140 - RNA, 14 nt, Staphylococcus aureus subsp. aureus MW2
ucuuaauuuaaaaa

SEQ ID NO: 4019141 - RNA, 15 nt, Staphylococcus aureus subsp. aureus MW2
ucuuacuacuuaauu

SEQ ID NO: 4019142 - RNA, 22 nt, Staphylococcus aureus subsp. aureus MW2
ucuuacuacuuaauuaauaauu

SEQ ID NO: 4019143 - RNA, 15 nt, Staphylococcus aureus subsp. aureus MW2
ucuuaggcaauguaa

SEQ ID NO: 4019144 - RNA, 18 nt, Staphylococcus aureus subsp. aureus MW2
ucuuagugaaucuucuaa

SEQ ID NO: 4019145 - RNA, 13 nt, Staphylococcus aureus subsp. aureus MW2
ucuuauaaaaauc

SEQ ID NO: 4019146 - RNA, 16 nt, Staphylococcus aureus subsp. aureus MW2
ucuuauauuuaugaua

SEQ ID NO: 4019147 - RNA, 14 nt, Staphylococcus aureus subsp. aureus MW2
ucuuaucaagaaua

SEQ ID NO: 4019148 - RNA, 23 nt, Staphylococcus aureus subsp. aureus MW2
ucuuaucgaaagaugauauauuc

SEQ ID NO: 4019149 - RNA, 23 nt, Staphylococcus aureus subsp. aureus MW2
ucuuaugauagagagcauaguuu

SEQ ID NO: 4019150 - RNA, 18 nt, Staphylococcus aureus subsp. aureus MW2
ucuuauuuguaauuucag

SEQ ID NO: 4019151 - RNA, 19 nt, Staphylococcus aureus subsp. aureus MW2
ucuuauuuguaauuucagc

SEQ ID NO: 4019152 - RNA, 15 nt, Staphylococcus aureus subsp. aureus MW2
ucuuauuuguuuaau

SEQ ID NO: 4019153 - RNA, 20 nt, Staphylococcus aureus subsp. aureus MW2
ucuuauuuuguuuuaaaaaa

SEQ ID NO: 4019154 - RNA, 14 nt, Staphylococcus aureus subsp. aureus MW2
ucuuauuuuuaugc

SEQ ID NO: 4019155 - RNA, 16 nt, Staphylococcus aureus subsp. aureus MW2
ucuucaacaauuucaa

SEQ ID NO: 4019156 - RNA, 22 nt, Staphylococcus aureus subsp. aureus MW2
ucuucaacaauuucaaugucug

SEQ ID NO: 4019157 - RNA, 20 nt, Staphylococcus aureus subsp. aureus MW2
ucuucaacauaacucaaaua

SEQ ID NO: 4019158 - RNA, 18 nt, Staphylococcus aureus subsp. aureus MW2
ucuucaauuaaugauuca

SEQ ID NO: 4019159 - RNA, 14 nt, Staphylococcus aureus subsp. aureus MW2
ucuucaauuuauuu

SEQ ID NO: 4019160 - RNA, 18 nt, Staphylococcus aureus subsp. aureus MW2
ucuucaauuucauuuuug

SEQ ID NO: 4019161 - RNA, 13 nt, Staphylococcus aureus subsp. aureus MW2
ucuucaauuuuac

SEQ ID NO: 4019162 - RNA, 19 nt, Staphylococcus aureus subsp. aureus MW2
ucuucacuaaaaauauauu

SEQ ID NO: 4019163 - RNA, 17 nt, Staphylococcus aureus subsp. aureus MW2
ucuucagaaccuugaau

SEQ ID NO: 4019164 - RNA, 17 nt, Staphylococcus aureus subsp. aureus MW2
ucuucaggugauucauu

SEQ ID NO: 4019165 - RNA, 16 nt, Staphylococcus aureus subsp. aureus MW2
ucuucagguguaguag

SEQ ID NO: 4019166 - RNA, 17 nt, Staphylococcus aureus subsp. aureus MW2
ucuucagguguuuuacc

SEQ ID NO: 4019167 - RNA, 19 nt, Staphylococcus aureus subsp. aureus MW2
ucuucagguguuuuaccuu

SEQ ID NO: 4019168 - RNA, 19 nt, Staphylococcus aureus subsp. aureus MW2
ucuucaguuaaaucuuuaa

SEQ ID NO: 4019169 - RNA, 13 nt, Staphylococcus aureus subsp. aureus MW2
ucuucaucauauu

SEQ ID NO: 4019170 - RNA, 19 nt, Staphylococcus aureus subsp. aureus MW2
ucuucaucaugacuauuuu

SEQ ID NO: 4019171 - RNA, 20 nt, Staphylococcus aureus subsp. aureus MW2
ucuucaucauuguaaaacaa

SEQ ID NO: 4019172 - RNA, 14 nt, Staphylococcus aureus subsp. aureus MW2
ucuucaucuaaaaa

SEQ ID NO: 4019173 - RNA, 12 nt, Staphylococcus aureus subsp. aureus MW2
ucuucaucuucu

SEQ ID NO: 4019174 - RNA, 16 nt, Staphylococcus aureus subsp. aureus MW2
ucuucaucuucuucaa

SEQ ID NO: 4019175 - RNA, 12 nt, Staphylococcus aureus subsp. aureus MW2
ucuucaucuuuu

SEQ ID NO: 4019176 - RNA, 18 nt, Staphylococcus aureus subsp. aureus MW2
ucuucaugucguuuucuu

SEQ ID NO: 4019177 - RNA, 19 nt, Staphylococcus aureus subsp. aureus MW2
ucuucaugucguuuucuua

SEQ ID NO: 4019178 - RNA, 16 nt, Staphylococcus aureus subsp. aureus MW2
ucuucauguucuuaua

SEQ ID NO: 4019179 - RNA, 19 nt, Staphylococcus aureus subsp. aureus MW2
ucuucauguucuuauaaaa

SEQ ID NO: 4019180 - RNA, 19 nt, Staphylococcus aureus subsp. aureus MW2
ucuucauuaacaucauguc

SEQ ID NO: 4019181 - RNA, 17 nt, Staphylococcus aureus subsp. aureus MW2
ucuucauuaucaauaga

SEQ ID NO: 4019182 - RNA, 14 nt, Staphylococcus aureus subsp. aureus MW2
ucuucauuuucauu

SEQ ID NO: 4019183 - RNA, 22 nt, Staphylococcus aureus subsp. aureus MW2
ucuuccaaucaacuucauauaa

SEQ ID NO: 4019184 - RNA, 23 nt, Staphylococcus aureus subsp. aureus MW2
ucuuccuccgccaucaauauuua

SEQ ID NO: 4019185 - RNA, 21 nt, Staphylococcus aureus subsp. aureus MW2
ucuucgcgaccguguuguuga

SEQ ID NO: 4019186 - RNA, 21 nt, Staphylococcus aureus subsp. aureus MW2
ucuucggcuuuguaaaauugu

SEQ ID NO: 4019187 - RNA, 15 nt, Staphylococcus aureus subsp. aureus MW2
ucuucgucaaauuca

SEQ ID NO: 4019188 - RNA, 16 nt, Staphylococcus aureus subsp. aureus MW2
ucuucuaaaucaauau

SEQ ID NO: 4019189 - RNA, 20 nt, Staphylococcus aureus subsp. aureus MW2
ucuucuaaguuauuacaacc

SEQ ID NO: 4019190 - RNA, 17 nt, Staphylococcus aureus subsp. aureus MW2
ucuucuaauucugaaau

SEQ ID NO: 4019191 - RNA, 20 nt, Staphylococcus aureus subsp. aureus MW2
ucuucuaauuuaguuuuaau

SEQ ID NO: 4019192 - RNA, 20 nt, Staphylococcus aureus subsp. aureus MW2
ucuucuaguaauucuucauc

SEQ ID NO: 4019193 - RNA, 22 nt, Staphylococcus aureus subsp. aureus MW2
ucuucuauuaaacauuuuugau

SEQ ID NO: 4019194 - RNA, 16 nt, Staphylococcus aureus subsp. aureus MW2
ucuucucgcauacugu

SEQ ID NO: 4019195 - RNA, 14 nt, Staphylococcus aureus subsp. aureus MW2
ucuucuucaucaua

SEQ ID NO: 4019196 - RNA, 19 nt, Staphylococcus aureus subsp. aureus MW2
ucuucuugauuguaaauaa

SEQ ID NO: 4019197 - RNA, 19 nt, Staphylococcus aureus subsp. aureus MW2
ucuucuuuuuguccccagc

SEQ ID NO: 4019198 - RNA, 19 nt, Staphylococcus aureus subsp. aureus MW2
ucuugaaauaaacauauca

SEQ ID NO: 4019199 - RNA, 16 nt, Staphylococcus aureus subsp. aureus MW2
ucuugauaaaauaaau

SEQ ID NO: 4019200 - RNA, 13 nt, Staphylococcus aureus subsp. aureus MW2
ucuugauauucau

SEQ ID NO: 4019201 - RNA, 15 nt, Staphylococcus aureus subsp. aureus MW2
ucuugaugaauuaaa

SEQ ID NO: 4019202 - RNA, 16 nt, Staphylococcus aureus subsp. aureus MW2
ucuugaugauauucau

SEQ ID NO: 4019203 - RNA, 23 nt, Staphylococcus aureus subsp. aureus MW2
ucuugauuggcacagucaaugac

SEQ ID NO: 4019204 - RNA, 16 nt, Staphylococcus aureus subsp. aureus MW2
ucuugcaauagcaaca

SEQ ID NO: 4019205 - RNA, 22 nt, Staphylococcus aureus subsp. aureus MW2
ucuugcauacgaauuaaaauaa

SEQ ID NO: 4019206 - RNA, 22 nt, Staphylococcus aureus subsp. aureus MW2
ucuugcgccuuguucaauucag

SEQ ID NO: 4019207 - RNA, 17 nt, Staphylococcus aureus subsp. aureus MW2
ucuuggauguuuucguu

SEQ ID NO: 4019208 - RNA, 22 nt, Staphylococcus aureus subsp. aureus MW2
ucuuggauguuuucguuugcaa

SEQ ID NO: 4019209 - RNA, 22 nt, Staphylococcus aureus subsp. aureus MW2
ucuugguauuuuuuaaaugcga

SEQ ID NO: 4019210 - RNA, 22 nt, Staphylococcus aureus subsp. aureus MW2
ucuugguucagcuuuacguucu

SEQ ID NO: 4019211 - RNA, 12 nt, Staphylococcus aureus subsp. aureus MW2
ucuuguaauguu

SEQ ID NO: 4019212 - RNA, 20 nt, Staphylococcus aureus subsp. aureus MW2
ucuugucauuucaaucauuu

SEQ ID NO: 4019213 - RNA, 22 nt, Staphylococcus aureus subsp. aureus MW2
ucuugucauuugaacaucauuu

SEQ ID NO: 4019214 - RNA, 18 nt, Staphylococcus aureus subsp. aureus MW2
ucuugugauaauucuuca

SEQ ID NO: 4019215 - RNA, 21 nt, Staphylococcus aureus subsp. aureus MW2
ucuuguucaaguaaucauuuu

SEQ ID NO: 4019216 - RNA, 16 nt, Staphylococcus aureus subsp. aureus MW2
ucuuguucuaauuguu

SEQ ID NO: 4019217 - RNA, 16 nt, Staphylococcus aureus subsp. aureus MW2
ucuuguuggauuuuaa

SEQ ID NO: 4019218 - RNA, 19 nt, Staphylococcus aureus subsp. aureus MW2
ucuuguuucaaacaaagcu

SEQ ID NO: 4019219 - RNA, 17 nt, Staphylococcus aureus subsp. aureus MW2
ucuuguuuucauuuaaa

SEQ ID NO: 4019220 - RNA, 20 nt, Staphylococcus aureus subsp. aureus MW2
ucuuuaaacucguaaauuuu

SEQ ID NO: 4019221 - RNA, 21 nt, Staphylococcus aureus subsp. aureus MW2
ucuuuaaagaaaauuucagua

SEQ ID NO: 4019222 - RNA, 18 nt, Staphylococcus aureus subsp. aureus MW2
ucuuuaaagcuaaauguu

SEQ ID NO: 4019223 - RNA, 17 nt, Staphylococcus aureus subsp. aureus MW2
ucuuuaaauauacuucu

SEQ ID NO: 4019224 - RNA, 23 nt, Staphylococcus aureus subsp. aureus MW2
ucuuuaacauuuauuuuuucucu

SEQ ID NO: 4019225 - RNA, 23 nt, Staphylococcus aureus subsp. aureus MW2
ucuuuaaccaaaauugaugacuu

SEQ ID NO: 4019226 - RNA, 17 nt, Staphylococcus aureus subsp. aureus MW2
ucuuuaacuuuaauuaa

SEQ ID NO: 4019227 - RNA, 16 nt, Staphylococcus aureus subsp. aureus MW2
ucuuuaagcuuaaaua

SEQ ID NO: 4019228 - RNA, 19 nt, Staphylococcus aureus subsp. aureus MW2
ucuuuaagcuuucuaucuu

SEQ ID NO: 4019229 - RNA, 17 nt, Staphylococcus aureus subsp. aureus MW2
ucuuuaauauaaauuuu

SEQ ID NO: 4019230 - RNA, 17 nt, Staphylococcus aureus subsp. aureus MW2
ucuuuaaucuaccaaua

SEQ ID NO: 4019231 - RNA, 18 nt, Staphylococcus aureus subsp. aureus MW2
ucuuuaaucuaccaauac

SEQ ID NO: 4019232 - RNA, 14 nt, Staphylococcus aureus subsp. aureus MW2
ucuuuaaugaaagc

SEQ ID NO: 4019233 - RNA, 16 nt, Staphylococcus aureus subsp. aureus MW2
ucuuuaauuaaaucuu

SEQ ID NO: 4019234 - RNA, 16 nt, Staphylococcus aureus subsp. aureus MW2
ucuuuaauuuauuuau

SEQ ID NO: 4019235 - RNA, 15 nt, Staphylococcus aureus subsp. aureus MW2
ucuuuacaacaguaa

SEQ ID NO: 4019236 - RNA, 14 nt, Staphylococcus aureus subsp. aureus MW2
ucuuuaccauucaa

SEQ ID NO: 4019237 - RNA, 21 nt, Staphylococcus aureus subsp. aureus MW2
ucuuuacgacguuuacguucu

SEQ ID NO: 4019238 - RNA, 16 nt, Staphylococcus aureus subsp. aureus MW2
ucuuuacggucgaauu

SEQ ID NO: 4019239 - RNA, 19 nt, Staphylococcus aureus subsp. aureus MW2
ucuuuacggucgaauuuuu

SEQ ID NO: 4019240 - RNA, 22 nt, Staphylococcus aureus subsp. aureus MW2
ucuuuacuaaaccucaacauua

SEQ ID NO: 4019241 - RNA, 16 nt, Staphylococcus aureus subsp. aureus MW2
ucuuuagaugagauuu

SEQ ID NO: 4019242 - RNA, 16 nt, Staphylococcus aureus subsp. aureus MW2
ucuuuagcuauuuaaa

SEQ ID NO: 4019243 - RNA, 18 nt, Staphylococcus aureus subsp. aureus MW2
ucuuuagcuauuuaaaau

SEQ ID NO: 4019244 - RNA, 15 nt, Staphylococcus aureus subsp. aureus MW2
ucuuuauaaaauugu

SEQ ID NO: 4019245 - RNA, 16 nt, Staphylococcus aureus subsp. aureus MW2
ucuuuauacacaaagu

SEQ ID NO: 4019246 - RNA, 17 nt, Staphylococcus aureus subsp. aureus MW2
ucuuuauacacaaagua

SEQ ID NO: 4019247 - RNA, 18 nt, Staphylococcus aureus subsp. aureus MW2
ucuuuauauauaaaauca

SEQ ID NO: 4019248 - RNA, 14 nt, Staphylococcus aureus subsp. aureus MW2
ucuuuauaugagaa

SEQ ID NO: 4019249 - RNA, 13 nt, Staphylococcus aureus subsp. aureus MW2
ucuuuauguuggg

SEQ ID NO: 4019250 - RNA, 13 nt, Staphylococcus aureus subsp. aureus MW2
ucuuuauuaauaa

SEQ ID NO: 4019251 - RNA, 16 nt, Staphylococcus aureus subsp. aureus MW2
ucuuuauuaauaaauu

SEQ ID NO: 4019252 - RNA, 15 nt, Staphylococcus aureus subsp. aureus MW2
ucuuuauuaugcuga

SEQ ID NO: 4019253 - RNA, 13 nt, Staphylococcus aureus subsp. aureus MW2
ucuuuauuuacaa

SEQ ID NO: 4019254 - RNA, 21 nt, Staphylococcus aureus subsp. aureus MW2
ucuuuauuugauucuucacca

SEQ ID NO: 4019255 - RNA, 16 nt, Staphylococcus aureus subsp. aureus MW2
ucuuuauuuuaaacau

SEQ ID NO: 4019256 - RNA, 18 nt, Staphylococcus aureus subsp. aureus MW2
ucuuuauuuuuuaucauu

SEQ ID NO: 4019257 - RNA, 14 nt, Staphylococcus aureus subsp. aureus MW2
ucuuucaaugcaua

SEQ ID NO: 4019258 - RNA, 15 nt, Staphylococcus aureus subsp. aureus MW2
ucuuucaauuaauuu

SEQ ID NO: 4019259 - RNA, 14 nt, Staphylococcus aureus subsp. aureus MW2
ucuuucauaaauug

SEQ ID NO: 4019260 - RNA, 23 nt, Staphylococcus aureus subsp. aureus MW2
ucuuuccacagcuuguucaauac

SEQ ID NO: 4019261 - RNA, 23 nt, Staphylococcus aureus subsp. aureus MW2
ucuuuccgccagucaucaucaug

SEQ ID NO: 4019262 - RNA, 18 nt, Staphylococcus aureus subsp. aureus MW2
ucuuuccucguauuuuau

SEQ ID NO: 4019263 - RNA, 14 nt, Staphylococcus aureus subsp. aureus MW2
ucuuucgucuugua

SEQ ID NO: 4019264 - RNA, 20 nt, Staphylococcus aureus subsp. aureus MW2
ucuuucuuuucugaauguau

SEQ ID NO: 4019265 - RNA, 22 nt, Staphylococcus aureus subsp. aureus MW2
ucuuugacauguguuaaaccaa

SEQ ID NO: 4019266 - RNA, 18 nt, Staphylococcus aureus subsp. aureus MW2
ucuuuggucuaaagcuua

SEQ ID NO: 4019267 - RNA, 15 nt, Staphylococcus aureus subsp. aureus MW2
ucuuuggugaaagua

SEQ ID NO: 4019268 - RNA, 14 nt, Staphylococcus aureus subsp. aureus MW2
ucuuuguaaauuuu

SEQ ID NO: 4019269 - RNA, 19 nt, Staphylococcus aureus subsp. aureus MW2
ucuuuguaaccuaaaaaca

SEQ ID NO: 4019270 - RNA, 17 nt, Staphylococcus aureus subsp. aureus MW2
ucuuuguauaccuauuc

SEQ ID NO: 4019271 - RNA, 13 nt, Staphylococcus aureus subsp. aureus MW2
ucuuuguauuuau

SEQ ID NO: 4019272 - RNA, 15 nt, Staphylococcus aureus subsp. aureus MW2
ucuuugucaucuuuu

SEQ ID NO: 4019273 - RNA, 19 nt, Staphylococcus aureus subsp. aureus MW2
ucuuugucaucuuuugucu

SEQ ID NO: 4019274 - RNA, 18 nt, Staphylococcus aureus subsp. aureus MW2
ucuuuguguuugcuuuuu

SEQ ID NO: 4019275 - RNA, 18 nt, Staphylococcus aureus subsp. aureus MW2
ucuuuguuuuuaauuuuu

SEQ ID NO: 4019276 - RNA, 12 nt, Staphylococcus aureus subsp. aureus MW2
ucuuuuaauucu

SEQ ID NO: 4019277 - RNA, 17 nt, Staphylococcus aureus subsp. aureus MW2
ucuuuuagaauucuaaa

SEQ ID NO: 4019278 - RNA, 13 nt, Staphylococcus aureus subsp. aureus MW2
ucuuuuauauuuu

SEQ ID NO: 4019279 - RNA, 17 nt, Staphylococcus aureus subsp. aureus MW2
ucuuuuauauuuuuauc

SEQ ID NO: 4019280 - RNA, 22 nt, Staphylococcus aureus subsp. aureus MW2
ucuuuuauggugggaagguaaa

SEQ ID NO: 4019281 - RNA, 15 nt, Staphylococcus aureus subsp. aureus MW2
ucuuuuauuuucaua

SEQ ID NO: 4019282 - RNA, 17 nt, Staphylococcus aureus subsp. aureus MW2
ucuuuucaaaaauaguc

SEQ ID NO: 4019283 - RNA, 15 nt, Staphylococcus aureus subsp. aureus MW2
ucuuuucauuaucau

SEQ ID NO: 4019284 - RNA, 19 nt, Staphylococcus aureus subsp. aureus MW2
ucuuuugauagcuaaugca

SEQ ID NO: 4019285 - RNA, 21 nt, Staphylococcus aureus subsp. aureus MW2
ucuuuuguuaugauauacgag

SEQ ID NO: 4019286 - RNA, 12 nt, Staphylococcus aureus subsp. aureus MW2
ucuuuuguuuua

SEQ ID NO: 4019287 - RNA, 13 nt, Staphylococcus aureus subsp. aureus MW2
ucuuuuguuuuca

SEQ ID NO: 4019288 - RNA, 15 nt, Staphylococcus aureus subsp. aureus MW2
ucuuuuguuuuuaua

SEQ ID NO: 4019289 - RNA, 14 nt, Staphylococcus aureus subsp. aureus MW2
ucuuuuuaauauuu

SEQ ID NO: 4019290 - RNA, 15 nt, Staphylococcus aureus subsp. aureus MW2
ucuuuuuauuuacuc

SEQ ID NO: 4019291 - RNA, 22 nt, Staphylococcus aureus subsp. aureus MW2
ucuuuuuauuuauaacuuuaaa

SEQ ID NO: 4019292 - RNA, 12 nt, Staphylococcus aureus subsp. aureus MW2
ucuuuuucacua

SEQ ID NO: 4019293 - RNA, 19 nt, Staphylococcus aureus subsp. aureus MW2
ucuuuuucagcuaauuguc

SEQ ID NO: 4019294 - RNA, 19 nt, Staphylococcus aureus subsp. aureus MW2
ucuuuuucccaugcuucua

SEQ ID NO: 4019295 - RNA, 13 nt, Staphylococcus aureus subsp. aureus MW2
ucuuuuucuaaau

SEQ ID NO: 4019296 - RNA, 15 nt, Staphylococcus aureus subsp. aureus MW2
ucuuuuucuaaauaa

SEQ ID NO: 4019297 - RNA, 17 nt, Staphylococcus aureus subsp. aureus MW2
ucuuuuucuaaauaaac

SEQ ID NO: 4019298 - RNA, 15 nt, Staphylococcus aureus subsp. aureus MW2
ucuuuuucuugcaua

SEQ ID NO: 4019299 - RNA, 21 nt, Staphylococcus aureus subsp. aureus MW2
ucuuuuugauaauguucccuu

SEQ ID NO: 4019300 - RNA, 18 nt, Staphylococcus aureus subsp. aureus MW2
ucuuuuugcguuuuuaaa

SEQ ID NO: 4019301 - RNA, 20 nt, Staphylococcus aureus subsp. aureus MW2
ucuuuuuguuguuuuaauuu

SEQ ID NO: 4019302 - RNA, 16 nt, Staphylococcus aureus subsp. aureus MW2
ucuuuuuuacauuuaa

SEQ ID NO: 4019303 - RNA, 16 nt, Staphylococcus aureus subsp. aureus MW2
ucuuuuuuacuaaaau

SEQ ID NO: 4019304 - RNA, 23 nt, Staphylococcus aureus subsp. aureus MW2
ucuuuuuuauagugguaaaaagu

SEQ ID NO: 4019305 - RNA, 12 nt, Staphylococcus aureus subsp. aureus MW2
ucuuuuuuauua

SEQ ID NO: 4019306 - RNA, 19 nt, Staphylococcus aureus subsp. aureus MW2
ucuuuuuuauuaaguauau

SEQ ID NO: 4019307 - RNA, 18 nt, Staphylococcus aureus subsp. aureus MW2
ucuuuuuucaauguuugc

SEQ ID NO: 4019308 - RNA, 18 nt, Staphylococcus aureus subsp. aureus MW2
ucuuuuuuguuauaucua

SEQ ID NO: 4019309 - RNA, 12 nt, Staphylococcus aureus subsp. aureus MW2
ucuuuuuuuaau

SEQ ID NO: 4019310 - RNA, 13 nt, Staphylococcus aureus subsp. aureus MW2
ucuuuuuuuaaug

SEQ ID NO: 4019311 - RNA, 16 nt, Staphylococcus aureus subsp. aureus MW2
ucuuuuuuuaugaaaa

SEQ ID NO: 4019312 - RNA, 18 nt, Staphylococcus aureus subsp. aureus MW2
ucuuuuuuuaugaaaaga

SEQ ID NO: 4019313 - RNA, 17 nt, Staphylococcus aureus subsp. aureus MW2
ugaaaaaaauuuucauu

SEQ ID NO: 4019314 - RNA, 23 nt, Staphylococcus aureus subsp. aureus MW2
ugaaaaaauaacuguaaaacauu

SEQ ID NO: 4019315 - RNA, 15 nt, Staphylococcus aureus subsp. aureus MW2
ugaaaaacuucuuaa

SEQ ID NO: 4019316 - RNA, 22 nt, Staphylococcus aureus subsp. aureus MW2
ugaaaaagaguuaauaaaauua

SEQ ID NO: 4019317 - RNA, 17 nt, Staphylococcus aureus subsp. aureus MW2
ugaaaaagcuaauucuu

SEQ ID NO: 4019318 - RNA, 23 nt, Staphylococcus aureus subsp. aureus MW2
ugaaaaauaucccggaauauuaa

SEQ ID NO: 4019319 - RNA, 14 nt, Staphylococcus aureus subsp. aureus MW2
ugaaaaauauuuaa

SEQ ID NO: 4019320 - RNA, 19 nt, Staphylococcus aureus subsp. aureus MW2
ugaaaaauauuuaaauaga

SEQ ID NO: 4019321 - RNA, 15 nt, Staphylococcus aureus subsp. aureus MW2
ugaaaaauuaaaaaa

SEQ ID NO: 4019322 - RNA, 15 nt, Staphylococcus aureus subsp. aureus MW2
ugaaaagaauaaguu

SEQ ID NO: 4019323 - RNA, 22 nt, Staphylococcus aureus subsp. aureus MW2
ugaaaagagauuuuuuugaaaa

SEQ ID NO: 4019324 - RNA, 17 nt, Staphylococcus aureus subsp. aureus MW2
ugaaaagguuagaugga

SEQ ID NO: 4019325 - RNA, 19 nt, Staphylococcus aureus subsp. aureus MW2
ugaaaauaaucgaacagaa

SEQ ID NO: 4019326 - RNA, 13 nt, Staphylococcus aureus subsp. aureus MW2
ugaaaauaaucuu

SEQ ID NO: 4019327 - RNA, 18 nt, Staphylococcus aureus subsp. aureus MW2
ugaaaauauuuuauuaua

SEQ ID NO: 4019328 - RNA, 17 nt, Staphylococcus aureus subsp. aureus MW2
ugaaaaucaguugcuuc

SEQ ID NO: 4019329 - RNA, 22 nt, Staphylococcus aureus subsp. aureus MW2
ugaaaaucaguugcuucauaaa

SEQ ID NO: 4019330 - RNA, 23 nt, Staphylococcus aureus subsp. aureus MW2
ugaaaaucuaauccugguauaau

SEQ ID NO: 4019331 - RNA, 16 nt, Staphylococcus aureus subsp. aureus MW2
ugaaaaucuuuaacuc

SEQ ID NO: 4019332 - RNA, 12 nt, Staphylococcus aureus subsp. aureus MW2
ugaaacauuuau

SEQ ID NO: 4019333 - RNA, 17 nt, Staphylococcus aureus subsp. aureus MW2
ugaaaccguauuauuag

SEQ ID NO: 4019334 - RNA, 22 nt, Staphylococcus aureus subsp. aureus MW2
ugaaaccuuugguucaaucauu

SEQ ID NO: 4019335 - RNA, 22 nt, Staphylococcus aureus subsp. aureus MW2
ugaaacugauuggacugauaau

SEQ ID NO: 4019336 - RNA, 13 nt, Staphylococcus aureus subsp. aureus MW2
ugaaacuguauca

SEQ ID NO: 4019337 - RNA, 17 nt, Staphylococcus aureus subsp. aureus MW2
ugaaacuguaucaacau

SEQ ID NO: 4019338 - RNA, 16 nt, Staphylococcus aureus subsp. aureus MW2
ugaaacuuuaauacua

SEQ ID NO: 4019339 - RNA, 13 nt, Staphylococcus aureus subsp. aureus MW2
ugaaagaaaaaac

SEQ ID NO: 4019340 - RNA, 20 nt, Staphylococcus aureus subsp. aureus MW2
ugaaagacugacuaauaaaa

SEQ ID NO: 4019341 - RNA, 14 nt, Staphylococcus aureus subsp. aureus MW2
ugaaagauacugcu

SEQ ID NO: 4019342 - RNA, 17 nt, Staphylococcus aureus subsp. aureus MW2
ugaaagcaccuaaaaua

SEQ ID NO: 4019343 - RNA, 18 nt, Staphylococcus aureus subsp. aureus MW2
ugaaagcaccuaaaauag

SEQ ID NO: 4019344 - RNA, 22 nt, Staphylococcus aureus subsp. aureus MW2
ugaaagcaccuaaaauagaaaa

SEQ ID NO: 4019345 - RNA, 14 nt, Staphylococcus aureus subsp. aureus MW2
ugaaaguuguuuaa

SEQ ID NO: 4019346 - RNA, 16 nt, Staphylococcus aureus subsp. aureus MW2
ugaaaguuguuuaacu

SEQ ID NO: 4019347 - RNA, 13 nt, Staphylococcus aureus subsp. aureus MW2
ugaaauaaacaua

SEQ ID NO: 4019348 - RNA, 19 nt, Staphylococcus aureus subsp. aureus MW2
ugaaauaauauaaaaacaa

SEQ ID NO: 4019349 - RNA, 14 nt, Staphylococcus aureus subsp. aureus MW2
ugaaauaauauuaa

SEQ ID NO: 4019350 - RNA, 12 nt, Staphylococcus aureus subsp. aureus MW2
ugaaauagcuuu

SEQ ID NO: 4019351 - RNA, 16 nt, Staphylococcus aureus subsp. aureus MW2
ugaaauauaccaacca

SEQ ID NO: 4019352 - RNA, 21 nt, Staphylococcus aureus subsp. aureus MW2
ugaaaucaguuuuugaauauu

SEQ ID NO: 4019353 - RNA, 19 nt, Staphylococcus aureus subsp. aureus MW2
ugaaaucuauugugauaua

SEQ ID NO: 4019354 - RNA, 15 nt, Staphylococcus aureus subsp. aureus MW2
ugaaaugagcuuaag

SEQ ID NO: 4019355 - RNA, 22 nt, Staphylococcus aureus subsp. aureus MW2
ugaaaugauacauuauuaaaua

SEQ ID NO: 4019356 - RNA, 20 nt, Staphylococcus aureus subsp. aureus MW2
ugaaauguuuauaauaauau

SEQ ID NO: 4019357 - RNA, 16 nt, Staphylococcus aureus subsp. aureus MW2
ugaaauuaaauucaaa

SEQ ID NO: 4019358 - RNA, 23 nt, Staphylococcus aureus subsp. aureus MW2
ugaaauuaacgucaacagcauaa

SEQ ID NO: 4019359 - RNA, 19 nt, Staphylococcus aureus subsp. aureus MW2
ugaaauuagaaaaauauga

SEQ ID NO: 4019360 - RNA, 19 nt, Staphylococcus aureus subsp. aureus MW2
ugaaauuagauuuuaugcu

SEQ ID NO: 4019361 - RNA, 20 nt, Staphylococcus aureus subsp. aureus MW2
ugaaauuauuauuuaaauuu

SEQ ID NO: 4019362 - RNA, 22 nt, Staphylococcus aureus subsp. aureus MW2
ugaaauucuuuuguaauugaaa

SEQ ID NO: 4019363 - RNA, 14 nt, Staphylococcus aureus subsp. aureus MW2
ugaaauuuauuaua

SEQ ID NO: 4019364 - RNA, 18 nt, Staphylococcus aureus subsp. aureus MW2
ugaaauuucauaaaguuu

SEQ ID NO: 4019365 - RNA, 21 nt, Staphylococcus aureus subsp. aureus MW2
ugaacaaaaauaaaaacuucu

SEQ ID NO: 4019366 - RNA, 19 nt, Staphylococcus aureus subsp. aureus MW2
ugaacaacaaauuuugauu

SEQ ID NO: 4019367 - RNA, 22 nt, Staphylococcus aureus subsp. aureus MW2
ugaacaacauugagauuaucuu

SEQ ID NO: 4019368 - RNA, 19 nt, Staphylococcus aureus subsp. aureus MW2
ugaacaaucagauaaguua

SEQ ID NO: 4019369 - RNA, 19 nt, Staphylococcus aureus subsp. aureus MW2
ugaacaauucuucaucaug

SEQ ID NO: 4019370 - RNA, 13 nt, Staphylococcus aureus subsp. aureus MW2
ugaacauaaaaaa

SEQ ID NO: 4019371 - RNA, 21 nt, Staphylococcus aureus subsp. aureus MW2
ugaacauaccugcauaugugu

SEQ ID NO: 4019372 - RNA, 17 nt, Staphylococcus aureus subsp. aureus MW2
ugaacaucauuuaauug

SEQ ID NO: 4019373 - RNA, 22 nt, Staphylococcus aureus subsp. aureus MW2
ugaacaucuaguuauuucauag

SEQ ID NO: 4019374 - RNA, 15 nt, Staphylococcus aureus subsp. aureus MW2
ugaacaugaaauuaa

SEQ ID NO: 4019375 - RNA, 16 nt, Staphylococcus aureus subsp. aureus MW2
ugaacaugaaauuaau

SEQ ID NO: 4019376 - RNA, 22 nt, Staphylococcus aureus subsp. aureus MW2
ugaaccaagaaugugaugauua

SEQ ID NO: 4019377 - RNA, 20 nt, Staphylococcus aureus subsp. aureus MW2
ugaaccagcuaaccaaauaa

SEQ ID NO: 4019378 - RNA, 15 nt, Staphylococcus aureus subsp. aureus MW2
ugaaccggaaauuaa

SEQ ID NO: 4019379 - RNA, 17 nt, Staphylococcus aureus subsp. aureus MW2
ugaacgaaagagaaaag

SEQ ID NO: 4019380 - RNA, 22 nt, Staphylococcus aureus subsp. aureus MW2
ugaacgaaagagaaaagcuaga

SEQ ID NO: 4019381 - RNA, 18 nt, Staphylococcus aureus subsp. aureus MW2
ugaacgaaucuauaacga

SEQ ID NO: 4019382 - RNA, 16 nt, Staphylococcus aureus subsp. aureus MW2
ugaacgagagagaaaa

SEQ ID NO: 4019383 - RNA, 20 nt, Staphylococcus aureus subsp. aureus MW2
ugaacgagagagaaaagcua

SEQ ID NO: 4019384 - RNA, 19 nt, Staphylococcus aureus subsp. aureus MW2
ugaacuaaaacaauaauaa

SEQ ID NO: 4019385 - RNA, 15 nt, Staphylococcus aureus subsp. aureus MW2
ugaacuucucuuagu

SEQ ID NO: 4019386 - RNA, 12 nt, Staphylococcus aureus subsp. aureus MW2
ugaacuucuuuu

SEQ ID NO: 4019387 - RNA, 19 nt, Staphylococcus aureus subsp. aureus MW2
ugaagaauacaaauauuaa

SEQ ID NO: 4019388 - RNA, 21 nt, Staphylococcus aureus subsp. aureus MW2
ugaagaauguuucauaugcau

SEQ ID NO: 4019389 - RNA, 22 nt, Staphylococcus aureus subsp. aureus MW2
ugaagagcuuuuaguaaauaau

SEQ ID NO: 4019390 - RNA, 23 nt, Staphylococcus aureus subsp. aureus MW2
ugaagagcuuuuaguaaauaauu

SEQ ID NO: 4019391 - RNA, 20 nt, Staphylococcus aureus subsp. aureus MW2
ugaagaggucuccaauacuu

SEQ ID NO: 4019392 - RNA, 19 nt, Staphylococcus aureus subsp. aureus MW2
ugaagaugcuuuaauuaaa

SEQ ID NO: 4019393 - RNA, 20 nt, Staphylococcus aureus subsp. aureus MW2
ugaagcauuaaguucaucau

SEQ ID NO: 4019394 - RNA, 21 nt, Staphylococcus aureus subsp. aureus MW2
ugaagcauuaaguucaucaug

SEQ ID NO: 4019395 - RNA, 23 nt, Staphylococcus aureus subsp. aureus MW2
ugaagcgcuuggauuuuuugguu

SEQ ID NO: 4019396 - RNA, 22 nt, Staphylococcus aureus subsp. aureus MW2
ugaagcguucgugauagaaguu

SEQ ID NO: 4019397 - RNA, 17 nt, Staphylococcus aureus subsp. aureus MW2
ugaaggccauuuuuauu

SEQ ID NO: 4019398 - RNA, 24 nt, Staphylococcus aureus subsp. aureus MW2
ugaaggccauuuuuauuuaacacu

SEQ ID NO: 4019399 - RNA, 17 nt, Staphylococcus aureus subsp. aureus MW2
ugaagggagcauuucau

SEQ ID NO: 4019400 - RNA, 18 nt, Staphylococcus aureus subsp. aureus MW2
ugaagggagcauuucauu

SEQ ID NO: 4019401 - RNA, 19 nt, Staphylococcus aureus subsp. aureus MW2
ugaagggagcauuucauua

SEQ ID NO: 4019402 - RNA, 14 nt, Staphylococcus aureus subsp. aureus MW2
ugaagguaauuuaa

SEQ ID NO: 4019403 - RNA, 17 nt, Staphylococcus aureus subsp. aureus MW2
ugaaguaaaaagcguaa

SEQ ID NO: 4019404 - RNA, 21 nt, Staphylococcus aureus subsp. aureus MW2
ugaaguaaugugcauugcuuu

SEQ ID NO: 4019405 - RNA, 13 nt, Staphylococcus aureus subsp. aureus MW2
ugaaguagauuga

SEQ ID NO: 4019406 - RNA, 20 nt, Staphylococcus aureus subsp. aureus MW2
ugaaguaugcacaucauuga

SEQ ID NO: 4019407 - RNA, 15 nt, Staphylococcus aureus subsp. aureus MW2
ugaaguauuuuccuu

SEQ ID NO: 4019408 - RNA, 23 nt, Staphylococcus aureus subsp. aureus MW2
ugaagucuguuuagaagaaacuu

SEQ ID NO: 4019409 - RNA, 19 nt, Staphylococcus aureus subsp. aureus MW2
ugaagucuuucaacaaaau

SEQ ID NO: 4019410 - RNA, 22 nt, Staphylococcus aureus subsp. aureus MW2
ugaagucuuucaacaaaaugcg

SEQ ID NO: 4019411 - RNA, 24 nt, Staphylococcus aureus subsp. aureus MW2
ugaagucuuucaacaaaaugcgua

SEQ ID NO: 4019412 - RNA, 17 nt, Staphylococcus aureus subsp. aureus MW2
ugaagugaaaaauuucu

SEQ ID NO: 4019413 - RNA, 22 nt, Staphylococcus aureus subsp. aureus MW2
ugaaguuaacuauaacaauagu

SEQ ID NO: 4019414 - RNA, 14 nt, Staphylococcus aureus subsp. aureus MW2
ugaaguuacuauau

SEQ ID NO: 4019415 - RNA, 13 nt, Staphylococcus aureus subsp. aureus MW2
ugaaguugaagcc

SEQ ID NO: 4019416 - RNA, 14 nt, Staphylococcus aureus subsp. aureus MW2
ugaaguuguauaaa

SEQ ID NO: 4019417 - RNA, 21 nt, Staphylococcus aureus subsp. aureus MW2
ugaaguuguauaaaaauguau

SEQ ID NO: 4019418 - RNA, 13 nt, Staphylococcus aureus subsp. aureus MW2
ugaaguuguuucu

SEQ ID NO: 4019419 - RNA, 23 nt, Staphylococcus aureus subsp. aureus MW2
ugaaguuuguuuacggauuuuuc

SEQ ID NO: 4019420 - RNA, 14 nt, Staphylococcus aureus subsp. aureus MW2
ugaauaaaauauau

SEQ ID NO: 4019421 - RNA, 14 nt, Staphylococcus aureus subsp. aureus MW2
ugaauaaauaacuu

SEQ ID NO: 4019422 - RNA, 13 nt, Staphylococcus aureus subsp. aureus MW2
ugaauaaauacaa

SEQ ID NO: 4019423 - RNA, 21 nt, Staphylococcus aureus subsp. aureus MW2
ugaauaaauacaauguuauua

SEQ ID NO: 4019424 - RNA, 12 nt, Staphylococcus aureus subsp. aureus MW2
ugaauaaauuga

SEQ ID NO: 4019425 - RNA, 21 nt, Staphylococcus aureus subsp. aureus MW2
ugaauaaauuuuauucuucag

SEQ ID NO: 4019426 - RNA, 14 nt, Staphylococcus aureus subsp. aureus MW2
ugaauaauaaacuu

SEQ ID NO: 4019427 - RNA, 22 nt, Staphylococcus aureus subsp. aureus MW2
ugaauaauaaacuuaaaagaga

SEQ ID NO: 4019428 - RNA, 14 nt, Staphylococcus aureus subsp. aureus MW2
ugaauaauggaugu

SEQ ID NO: 4019429 - RNA, 22 nt, Staphylococcus aureus subsp. aureus MW2
ugaauaauuacuaaaauaucaa

SEQ ID NO: 4019430 - RNA, 14 nt, Staphylococcus aureus subsp. aureus MW2
ugaauaauuccagu

SEQ ID NO: 4019431 - RNA, 16 nt, Staphylococcus aureus subsp. aureus MW2
ugaauaauugagaaaa

SEQ ID NO: 4019432 - RNA, 17 nt, Staphylococcus aureus subsp. aureus MW2
ugaauaauugagaaaaa

SEQ ID NO: 4019433 - RNA, 13 nt, Staphylococcus aureus subsp. aureus MW2
ugaauauaaaaaa

SEQ ID NO: 4019434 - RNA, 13 nt, Staphylococcus aureus subsp. aureus MW2
ugaauauaaugac

SEQ ID NO: 4019435 - RNA, 22 nt, Staphylococcus aureus subsp. aureus MW2
ugaauauacuuaauuuaaaucu

SEQ ID NO: 4019436 - RNA, 13 nt, Staphylococcus aureus subsp. aureus MW2
ugaauauagcugu

SEQ ID NO: 4019437 - RNA, 14 nt, Staphylococcus aureus subsp. aureus MW2
ugaauaucuaaugc

SEQ ID NO: 4019438 - RNA, 16 nt, Staphylococcus aureus subsp. aureus MW2
ugaauaugauauuaag

SEQ ID NO: 4019439 - RNA, 20 nt, Staphylococcus aureus subsp. aureus MW2
ugaauauggaaaauguauua

SEQ ID NO: 4019440 - RNA, 21 nt, Staphylococcus aureus subsp. aureus MW2
ugaauauggaaaauguauuau

SEQ ID NO: 4019441 - RNA, 15 nt, Staphylococcus aureus subsp. aureus MW2
ugaauauuuuucaau

SEQ ID NO: 4019442 - RNA, 19 nt, Staphylococcus aureus subsp. aureus MW2
ugaaucaaaucaauaucau

SEQ ID NO: 4019443 - RNA, 22 nt, Staphylococcus aureus subsp. aureus MW2
ugaaucaaaucaauaucauuca

SEQ ID NO: 4019444 - RNA, 16 nt, Staphylococcus aureus subsp. aureus MW2
ugaaucagaugauuua

SEQ ID NO: 4019445 - RNA, 14 nt, Staphylococcus aureus subsp. aureus MW2
ugaaucaguauaau

SEQ ID NO: 4019446 - RNA, 22 nt, Staphylococcus aureus subsp. aureus MW2
ugaaucgaagcccuuugauuua

SEQ ID NO: 4019447 - RNA, 20 nt, Staphylococcus aureus subsp. aureus MW2
ugaaucgauauaaugaaguu

SEQ ID NO: 4019448 - RNA, 11 nt, Staphylococcus aureus subsp. aureus MW2
ugaaucgcauu

SEQ ID NO: 4019449 - RNA, 14 nt, Staphylococcus aureus subsp. aureus MW2
ugaaucgcauuuaa

SEQ ID NO: 4019450 - RNA, 14 nt, Staphylococcus aureus subsp. aureus MW2
ugaaucuaaacuau

SEQ ID NO: 4019451 - RNA, 21 nt, Staphylococcus aureus subsp. aureus MW2
ugaaucuaaacuauaauaauu

SEQ ID NO: 4019452 - RNA, 23 nt, Staphylococcus aureus subsp. aureus MW2
ugaaucugcuaauuuauaaacaa

SEQ ID NO: 4019453 - RNA, 20 nt, Staphylococcus aureus subsp. aureus MW2
ugaaugaaccuuuacucaua

SEQ ID NO: 4019454 - RNA, 21 nt, Staphylococcus aureus subsp. aureus MW2
ugaaugaaguaauauauaaaa

SEQ ID NO: 4019455 - RNA, 14 nt, Staphylococcus aureus subsp. aureus MW2
ugaaugagugucau

SEQ ID NO: 4019456 - RNA, 14 nt, Staphylococcus aureus subsp. aureus MW2
ugaaugauauuaac

SEQ ID NO: 4019457 - RNA, 14 nt, Staphylococcus aureus subsp. aureus MW2
ugaaugaugcugcc

SEQ ID NO: 4019458 - RNA, 16 nt, Staphylococcus aureus subsp. aureus MW2
ugaaugauugcauuga

SEQ ID NO: 4019459 - RNA, 17 nt, Staphylococcus aureus subsp. aureus MW2
ugaaugauugcauugau

SEQ ID NO: 4019460 - RNA, 14 nt, Staphylococcus aureus subsp. aureus MW2
ugaauggcaaauau

SEQ ID NO: 4019461 - RNA, 22 nt, Staphylococcus aureus subsp. aureus MW2
ugaauggcaaucuauauaaaug

SEQ ID NO: 4019462 - RNA, 15 nt, Staphylococcus aureus subsp. aureus MW2
ugaauggcauuuaau

SEQ ID NO: 4019463 - RNA, 19 nt, Staphylococcus aureus subsp. aureus MW2
ugaaugggucauuaaauga

SEQ ID NO: 4019464 - RNA, 21 nt, Staphylococcus aureus subsp. aureus MW2
ugaauguuacucguaacaucu

SEQ ID NO: 4019465 - RNA, 23 nt, Staphylococcus aureus subsp. aureus MW2
ugaauguuacucguaacaucugu

SEQ ID NO: 4019466 - RNA, 20 nt, Staphylococcus aureus subsp. aureus MW2
ugaauguuuucuaaaucuaa

SEQ ID NO: 4019467 - RNA, 17 nt, Staphylococcus aureus subsp. aureus MW2
ugaauuaaagcaucgaa

SEQ ID NO: 4019468 - RNA, 18 nt, Staphylococcus aureus subsp. aureus MW2
ugaauuaaaucuuuauaa

SEQ ID NO: 4019469 - RNA, 12 nt, Staphylococcus aureus subsp. aureus MW2
ugaauuaacaau

SEQ ID NO: 4019470 - RNA, 14 nt, Staphylococcus aureus subsp. aureus MW2
ugaauuaagaaaag

SEQ ID NO: 4019471 - RNA, 13 nt, Staphylococcus aureus subsp. aureus MW2
ugaauuaauagcu

SEQ ID NO: 4019472 - RNA, 14 nt, Staphylococcus aureus subsp. aureus MW2
ugaauuaauaucca

SEQ ID NO: 4019473 - RNA, 15 nt, Staphylococcus aureus subsp. aureus MW2
ugaauuauuuaaaau

SEQ ID NO: 4019474 - RNA, 18 nt, Staphylococcus aureus subsp. aureus MW2
ugaauuauuuaaaaugcu

SEQ ID NO: 4019475 - RNA, 19 nt, Staphylococcus aureus subsp. aureus MW2
ugaauuauuuaaaaugcuu

SEQ ID NO: 4019476 - RNA, 18 nt, Staphylococcus aureus subsp. aureus MW2
ugaauugaaaaauuaaaa

SEQ ID NO: 4019477 - RNA, 16 nt, Staphylococcus aureus subsp. aureus MW2
ugaauugacugacuuc

SEQ ID NO: 4019478 - RNA, 18 nt, Staphylococcus aureus subsp. aureus MW2
ugaauugguugaucaauu

SEQ ID NO: 4019479 - RNA, 14 nt, Staphylococcus aureus subsp. aureus MW2
ugaauuuagaugca

SEQ ID NO: 4019480 - RNA, 17 nt, Staphylococcus aureus subsp. aureus MW2
ugaauuuagaugcauaa

SEQ ID NO: 4019481 - RNA, 14 nt, Staphylococcus aureus subsp. aureus MW2
ugaauuuagcauca

SEQ ID NO: 4019482 - RNA, 23 nt, Staphylococcus aureus subsp. aureus MW2
ugaauuuagcaucaaaaauaaaa

SEQ ID NO: 4019483 - RNA, 21 nt, Staphylococcus aureus subsp. aureus MW2
ugaauuuuaauauauuuggag

SEQ ID NO: 4019484 - RNA, 21 nt, Staphylococcus aureus subsp. aureus MW2
ugaauuuuauaaauuaaaugc

SEQ ID NO: 4019485 - RNA, 23 nt, Staphylococcus aureus subsp. aureus MW2
ugaauuuuauuagguaauacuuu

SEQ ID NO: 4019486 - RNA, 19 nt, Staphylococcus aureus subsp. aureus MW2
ugaauuuucagcaucuacu

SEQ ID NO: 4019487 - RNA, 17 nt, Staphylococcus aureus subsp. aureus MW2
ugaauuuucguucaauu

SEQ ID NO: 4019488 - RNA, 18 nt, Staphylococcus aureus subsp. aureus MW2
ugaauuuucguucaauuu

SEQ ID NO: 4019489 - RNA, 14 nt, Staphylococcus aureus subsp. aureus MW2
ugacaaauuaaaaa

SEQ ID NO: 4019490 - RNA, 14 nt, Staphylococcus aureus subsp. aureus MW2
ugacaaauuaucac

SEQ ID NO: 4019491 - RNA, 19 nt, Staphylococcus aureus subsp. aureus MW2
ugacaaguaugucaucuuc

SEQ ID NO: 4019492 - RNA, 22 nt, Staphylococcus aureus subsp. aureus MW2
ugacaaguugcugaauaaaaua

SEQ ID NO: 4019493 - RNA, 17 nt, Staphylococcus aureus subsp. aureus MW2
ugacaauuuaaauuaag

SEQ ID NO: 4019494 - RNA, 19 nt, Staphylococcus aureus subsp. aureus MW2
ugacacaaugauucaucag

SEQ ID NO: 4019495 - RNA, 20 nt, Staphylococcus aureus subsp. aureus MW2
ugacacaaugauucaucagu

SEQ ID NO: 4019496 - RNA, 17 nt, Staphylococcus aureus subsp. aureus MW2
ugacacacccaaauuua

SEQ ID NO: 4019497 - RNA, 23 nt, Staphylococcus aureus subsp. aureus MW2
ugacaguuuccauaaauaaaaug

SEQ ID NO: 4019498 - RNA, 13 nt, Staphylococcus aureus subsp. aureus MW2
ugacauaaaacuu

SEQ ID NO: 4019499 - RNA, 17 nt, Staphylococcus aureus subsp. aureus MW2
ugacauauuuuuuaaau

SEQ ID NO: 4019500 - RNA, 21 nt, Staphylococcus aureus subsp. aureus MW2
ugacauauuuuuuaaauuuaa

SEQ ID NO: 4019501 - RNA, 15 nt, Staphylococcus aureus subsp. aureus MW2
ugacaucguugcuuu

SEQ ID NO: 4019502 - RNA, 15 nt, Staphylococcus aureus subsp. aureus MW2
ugacaucuucguaug

SEQ ID NO: 4019503 - RNA, 15 nt, Staphylococcus aureus subsp. aureus MW2
ugacauggaaaauau

SEQ ID NO: 4019504 - RNA, 16 nt, Staphylococcus aureus subsp. aureus MW2
ugacauggaaaauaua

SEQ ID NO: 4019505 - RNA, 19 nt, Staphylococcus aureus subsp. aureus MW2
ugacauguguuaaaccaac

SEQ ID NO: 4019506 - RNA, 15 nt, Staphylococcus aureus subsp. aureus MW2
ugacauuuaaagauu

SEQ ID NO: 4019507 - RNA, 20 nt, Staphylococcus aureus subsp. aureus MW2
ugacauuucaucaauaauuu

SEQ ID NO: 4019508 - RNA, 16 nt, Staphylococcus aureus subsp. aureus MW2
ugacauuuuaaaucua

SEQ ID NO: 4019509 - RNA, 21 nt, Staphylococcus aureus subsp. aureus MW2
ugacauuuucaaguuuaaaau

SEQ ID NO: 4019510 - RNA, 19 nt, Staphylococcus aureus subsp. aureus MW2
ugaccaacagcuucaacac

SEQ ID NO: 4019511 - RNA, 23 nt, Staphylococcus aureus subsp. aureus MW2
ugaccaucuggcguuaaccauuu

SEQ ID NO: 4019512 - RNA, 17 nt, Staphylococcus aureus subsp. aureus MW2
ugaccauugucaugccu

SEQ ID NO: 4019513 - RNA, 15 nt, Staphylococcus aureus subsp. aureus MW2
ugaccgacaaagcuu

SEQ ID NO: 4019514 - RNA, 17 nt, Staphylococcus aureus subsp. aureus MW2
ugaccgacaaagcuugu

SEQ ID NO: 4019515 - RNA, 17 nt, Staphylococcus aureus subsp. aureus MW2
ugaccuuauauuuuauu

SEQ ID NO: 4019516 - RNA, 14 nt, Staphylococcus aureus subsp. aureus MW2
ugaccuucaguuuc

SEQ ID NO: 4019517 - RNA, 16 nt, Staphylococcus aureus subsp. aureus MW2
ugaccuucaguuucua

SEQ ID NO: 4019518 - RNA, 16 nt, Staphylococcus aureus subsp. aureus MW2
ugacgaaaagucagcu

SEQ ID NO: 4019519 - RNA, 18 nt, Staphylococcus aureus subsp. aureus MW2
ugacgaaaagucagcuua

SEQ ID NO: 4019520 - RNA, 21 nt, Staphylococcus aureus subsp. aureus MW2
ugacgaacgauagauucugau

SEQ ID NO: 4019521 - RNA, 13 nt, Staphylococcus aureus subsp. aureus MW2
ugacgaguagauu

SEQ ID NO: 4019522 - RNA, 17 nt, Staphylococcus aureus subsp. aureus MW2
ugacgauaaugaaauac

SEQ ID NO: 4019523 - RNA, 17 nt, Staphylococcus aureus subsp. aureus MW2
ugacgaucuucaugaac

SEQ ID NO: 4019524 - RNA, 16 nt, Staphylococcus aureus subsp. aureus MW2
ugacgcggguaauauu

SEQ ID NO: 4019525 - RNA, 18 nt, Staphylococcus aureus subsp. aureus MW2
ugacgcgugaauuaaaaa

SEQ ID NO: 4019526 - RNA, 15 nt, Staphylococcus aureus subsp. aureus MW2
ugacguaauuaauag

SEQ ID NO: 4019527 - RNA, 19 nt, Staphylococcus aureus subsp. aureus MW2
ugacguucugaucggcuuu

SEQ ID NO: 4019528 - RNA, 22 nt, Staphylococcus aureus subsp. aureus MW2
ugacuacucaauccuaaauuau

SEQ ID NO: 4019529 - RNA, 19 nt, Staphylococcus aureus subsp. aureus MW2
ugacuagaggauagacaac

SEQ ID NO: 4019530 - RNA, 16 nt, Staphylococcus aureus subsp. aureus MW2
ugacuagggguuuuua

SEQ ID NO: 4019531 - RNA, 18 nt, Staphylococcus aureus subsp. aureus MW2
ugacuagggguuuuuaau

SEQ ID NO: 4019532 - RNA, 16 nt, Staphylococcus aureus subsp. aureus MW2
ugacuaugaaacugga

SEQ ID NO: 4019533 - RNA, 23 nt, Staphylococcus aureus subsp. aureus MW2
ugacuauguuguuuaaauuucaa

SEQ ID NO: 4019534 - RNA, 12 nt, Staphylococcus aureus subsp. aureus MW2
ugacuauuuucc

SEQ ID NO: 4019535 - RNA, 18 nt, Staphylococcus aureus subsp. aureus MW2
ugacucaaagauauacuu

SEQ ID NO: 4019536 - RNA, 18 nt, Staphylococcus aureus subsp. aureus MW2
ugacugaacgaaaaugcg

SEQ ID NO: 4019537 - RNA, 12 nt, Staphylococcus aureus subsp. aureus MW2
ugacugaaugag

SEQ ID NO: 4019538 - RNA, 16 nt, Staphylococcus aureus subsp. aureus MW2
ugacugaauuaauauc

SEQ ID NO: 4019539 - RNA, 12 nt, Staphylococcus aureus subsp. aureus MW2
ugacugagaaaa

SEQ ID NO: 4019540 - RNA, 16 nt, Staphylococcus aureus subsp. aureus MW2
ugacugcaaauacgag

SEQ ID NO: 4019541 - RNA, 19 nt, Staphylococcus aureus subsp. aureus MW2
ugacugccugacauucauc

SEQ ID NO: 4019542 - RNA, 14 nt, Staphylococcus aureus subsp. aureus MW2
ugacuguuaaacaa

SEQ ID NO: 4019543 - RNA, 13 nt, Staphylococcus aureus subsp. aureus MW2
ugacuuaacaucu

SEQ ID NO: 4019544 - RNA, 16 nt, Staphylococcus aureus subsp. aureus MW2
ugacuuuaauugcucu

SEQ ID NO: 4019545 - RNA, 14 nt, Staphylococcus aureus subsp. aureus MW2
ugacuuuagcauuc

SEQ ID NO: 4019546 - RNA, 21 nt, Staphylococcus aureus subsp. aureus MW2
ugacuuuaucaauugaaugaa

SEQ ID NO: 4019547 - RNA, 14 nt, Staphylococcus aureus subsp. aureus MW2
ugacuuuauuucua

SEQ ID NO: 4019548 - RNA, 14 nt, Staphylococcus aureus subsp. aureus MW2
ugacuuuuaaaaaa

SEQ ID NO: 4019549 - RNA, 16 nt, Staphylococcus aureus subsp. aureus MW2
ugacuuuuaaaaaaca

SEQ ID NO: 4019550 - RNA, 13 nt, Staphylococcus aureus subsp. aureus MW2
ugacuuuuuaaua

SEQ ID NO: 4019551 - RNA, 21 nt, Staphylococcus aureus subsp. aureus MW2
ugagaaaaagguuaauauuaa

SEQ ID NO: 4019552 - RNA, 18 nt, Staphylococcus aureus subsp. aureus MW2
ugagaaaaauauuucuaa

SEQ ID NO: 4019553 - RNA, 20 nt, Staphylococcus aureus subsp. aureus MW2
ugagaaaaauauuucuaaua

SEQ ID NO: 4019554 - RNA, 20 nt, Staphylococcus aureus subsp. aureus MW2
ugagaaagguacguuguaau

SEQ ID NO: 4019555 - RNA, 16 nt, Staphylococcus aureus subsp. aureus MW2
ugagaaaguaaaaguu

SEQ ID NO: 4019556 - RNA, 18 nt, Staphylococcus aureus subsp. aureus MW2
ugagaaauguuaacgaua

SEQ ID NO: 4019557 - RNA, 19 nt, Staphylococcus aureus subsp. aureus MW2
ugagaauauuuauuguuuu

SEQ ID NO: 4019558 - RNA, 15 nt, Staphylococcus aureus subsp. aureus MW2
ugagaaucuuggaag

SEQ ID NO: 4019559 - RNA, 13 nt, Staphylococcus aureus subsp. aureus MW2
ugagacgcauugc

SEQ ID NO: 4019560 - RNA, 15 nt, Staphylococcus aureus subsp. aureus MW2
ugagacuauuauaau

SEQ ID NO: 4019561 - RNA, 16 nt, Staphylococcus aureus subsp. aureus MW2
ugagacuauuauaauu

SEQ ID NO: 4019562 - RNA, 12 nt, Staphylococcus aureus subsp. aureus MW2
ugagauaaaauc

SEQ ID NO: 4019563 - RNA, 16 nt, Staphylococcus aureus subsp. aureus MW2
ugagauaaaaucauau

SEQ ID NO: 4019564 - RNA, 23 nt, Staphylococcus aureus subsp. aureus MW2
ugagauaaaaucauaugucuuaa

SEQ ID NO: 4019565 - RNA, 17 nt, Staphylococcus aureus subsp. aureus MW2
ugagauauauuaauauu

SEQ ID NO: 4019566 - RNA, 17 nt, Staphylococcus aureus subsp. aureus MW2
ugagauaucuuauaaca

SEQ ID NO: 4019567 - RNA, 19 nt, Staphylococcus aureus subsp. aureus MW2
ugagauuaucuuuagacau

SEQ ID NO: 4019568 - RNA, 16 nt, Staphylococcus aureus subsp. aureus MW2
ugagauuauuuuuuua

SEQ ID NO: 4019569 - RNA, 22 nt, Staphylococcus aureus subsp. aureus MW2
ugagauuauuuuuuuaaaucua

SEQ ID NO: 4019570 - RNA, 23 nt, Staphylococcus aureus subsp. aureus MW2
ugagauuauuuuuuuaaaucuau

SEQ ID NO: 4019571 - RNA, 23 nt, Staphylococcus aureus subsp. aureus MW2
ugagcaacaaaagauguugcuag

SEQ ID NO: 4019572 - RNA, 15 nt, Staphylococcus aureus subsp. aureus MW2
ugagcacaaacuaaa

SEQ ID NO: 4019573 - RNA, 14 nt, Staphylococcus aureus subsp. aureus MW2
ugagcaucuugucu

SEQ ID NO: 4019574 - RNA, 16 nt, Staphylococcus aureus subsp. aureus MW2
ugagcaucuugucuag

SEQ ID NO: 4019575 - RNA, 15 nt, Staphylococcus aureus subsp. aureus MW2
ugagcguauuauuau

SEQ ID NO: 4019576 - RNA, 14 nt, Staphylococcus aureus subsp. aureus MW2
ugagcuauucauag

SEQ ID NO: 4019577 - RNA, 23 nt, Staphylococcus aureus subsp. aureus MW2
ugagcuguuacacuuuucuuauc

SEQ ID NO: 4019578 - RNA, 16 nt, Staphylococcus aureus subsp. aureus MW2
ugagcuuaauaaauug

SEQ ID NO: 4019579 - RNA, 17 nt, Staphylococcus aureus subsp. aureus MW2
ugagcuuaauaaauugu

SEQ ID NO: 4019580 - RNA, 16 nt, Staphylococcus aureus subsp. aureus MW2
ugagcuucuuuaaaua

SEQ ID NO: 4019581 - RNA, 22 nt, Staphylococcus aureus subsp. aureus MW2
ugagcuuuguuagcaucugcau

SEQ ID NO: 4019582 - RNA, 19 nt, Staphylococcus aureus subsp. aureus MW2
ugagcuuuguuugaaacaa

SEQ ID NO: 4019583 - RNA, 18 nt, Staphylococcus aureus subsp. aureus MW2
ugaggauacauaaaucua

SEQ ID NO: 4019584 - RNA, 18 nt, Staphylococcus aureus subsp. aureus MW2
ugaggcccauaaauuacu

SEQ ID NO: 4019585 - RNA, 20 nt, Staphylococcus aureus subsp. aureus MW2
ugaggcccauaaauuacuug

SEQ ID NO: 4019586 - RNA, 13 nt, Staphylococcus aureus subsp. aureus MW2
ugagggccccaac

SEQ ID NO: 4019587 - RNA, 14 nt, Staphylococcus aureus subsp. aureus MW2
ugagggccccaaca

SEQ ID NO: 4019588 - RNA, 19 nt, Staphylococcus aureus subsp. aureus MW2
ugagggccccaacacagaa

SEQ ID NO: 4019589 - RNA, 14 nt, Staphylococcus aureus subsp. aureus MW2
ugagguaaaacuac

SEQ ID NO: 4019590 - RNA, 11 nt, Staphylococcus aureus subsp. aureus MW2
ugaguacaaca

SEQ ID NO: 4019591 - RNA, 14 nt, Staphylococcus aureus subsp. aureus MW2
ugaguacaacauag

SEQ ID NO: 4019592 - RNA, 16 nt, Staphylococcus aureus subsp. aureus MW2
ugaguaggcucuuaau

SEQ ID NO: 4019593 - RNA, 16 nt, Staphylococcus aureus subsp. aureus MW2
ugaguauccaauacua

SEQ ID NO: 4019594 - RNA, 17 nt, Staphylococcus aureus subsp. aureus MW2
ugaguaugauagaaauc

SEQ ID NO: 4019595 - RNA, 13 nt, Staphylococcus aureus subsp. aureus MW2
ugaguauuacuug

SEQ ID NO: 4019596 - RNA, 22 nt, Staphylococcus aureus subsp. aureus MW2
ugaguauuugccuuuuuuauuu

SEQ ID NO: 4019597 - RNA, 16 nt, Staphylococcus aureus subsp. aureus MW2
ugagucaauuucuuua

SEQ ID NO: 4019598 - RNA, 21 nt, Staphylococcus aureus subsp. aureus MW2
ugagucuuggacauuguaaaa

SEQ ID NO: 4019599 - RNA, 23 nt, Staphylococcus aureus subsp. aureus MW2
ugagucuuggacauuguaaaaug

SEQ ID NO: 4019600 - RNA, 22 nt, Staphylococcus aureus subsp. aureus MW2
ugagucuuuuugauuaaaguug

SEQ ID NO: 4019601 - RNA, 21 nt, Staphylococcus aureus subsp. aureus MW2
ugagugucaugcuuaauuuau

SEQ ID NO: 4019602 - RNA, 22 nt, Staphylococcus aureus subsp. aureus MW2
ugaguguguccaucauuugugu

SEQ ID NO: 4019603 - RNA, 17 nt, Staphylococcus aureus subsp. aureus MW2
ugaguguuuaugaaagu

SEQ ID NO: 4019604 - RNA, 22 nt, Staphylococcus aureus subsp. aureus MW2
ugaguugaacaacuaugucaua

SEQ ID NO: 4019605 - RNA, 14 nt, Staphylococcus aureus subsp. aureus MW2
ugaguuggcaucag

SEQ ID NO: 4019606 - RNA, 23 nt, Staphylococcus aureus subsp. aureus MW2
ugaguuggcaucagacuaaaaug

SEQ ID NO: 4019607 - RNA, 12 nt, Staphylococcus aureus subsp. aureus MW2
ugaguuuaaaaa

SEQ ID NO: 4019608 - RNA, 13 nt, Staphylococcus aureus subsp. aureus MW2
ugaguuuaaaaau

SEQ ID NO: 4019609 - RNA, 14 nt, Staphylococcus aureus subsp. aureus MW2
ugaguuuaaaaaua

SEQ ID NO: 4019610 - RNA, 14 nt, Staphylococcus aureus subsp. aureus MW2
ugauaaaaaaugaa

SEQ ID NO: 4019611 - RNA, 21 nt, Staphylococcus aureus subsp. aureus MW2
ugauaacaaccuauuaauuga

SEQ ID NO: 4019612 - RNA, 20 nt, Staphylococcus aureus subsp. aureus MW2
ugauaacaauuuuaaaucuu

SEQ ID NO: 4019613 - RNA, 14 nt, Staphylococcus aureus subsp. aureus MW2
ugauaacgagcuaa

SEQ ID NO: 4019614 - RNA, 18 nt, Staphylococcus aureus subsp. aureus MW2
ugauaacgucauucuuua

SEQ ID NO: 4019615 - RNA, 19 nt, Staphylococcus aureus subsp. aureus MW2
ugauaacuauuuaauuauu

SEQ ID NO: 4019616 - RNA, 15 nt, Staphylococcus aureus subsp. aureus MW2
ugauaacuuguaaua

SEQ ID NO: 4019617 - RNA, 19 nt, Staphylococcus aureus subsp. aureus MW2
ugauaagaagugcuuauga

SEQ ID NO: 4019618 - RNA, 18 nt, Staphylococcus aureus subsp. aureus MW2
ugauaagucuugauggug

SEQ ID NO: 4019619 - RNA, 22 nt, Staphylococcus aureus subsp. aureus MW2
ugauaauacuguuuaaauaaaa

SEQ ID NO: 4019620 - RNA, 18 nt, Staphylococcus aureus subsp. aureus MW2
ugauaauauuauucuuua

SEQ ID NO: 4019621 - RNA, 15 nt, Staphylococcus aureus subsp. aureus MW2
ugauaauccaccaaa

SEQ ID NO: 4019622 - RNA, 21 nt, Staphylococcus aureus subsp. aureus MW2
ugauaauccaccaaauacagu

SEQ ID NO: 4019623 - RNA, 16 nt, Staphylococcus aureus subsp. aureus MW2
ugauaauguaaaauga

SEQ ID NO: 4019624 - RNA, 19 nt, Staphylococcus aureus subsp. aureus MW2
ugauaaugucuuacuuguc

SEQ ID NO: 4019625 - RNA, 16 nt, Staphylococcus aureus subsp. aureus MW2
ugauaauuaauuaaaa

SEQ ID NO: 4019626 - RNA, 14 nt, Staphylococcus aureus subsp. aureus MW2
ugauaauucuucaa

SEQ ID NO: 4019627 - RNA, 15 nt, Staphylococcus aureus subsp. aureus MW2
ugauaauuuaauaau

SEQ ID NO: 4019628 - RNA, 14 nt, Staphylococcus aureus subsp. aureus MW2
ugauaauuuuucuu

SEQ ID NO: 4019629 - RNA, 18 nt, Staphylococcus aureus subsp. aureus MW2
ugauacacguacaaaaua

SEQ ID NO: 4019630 - RNA, 20 nt, Staphylococcus aureus subsp. aureus MW2
ugauacagaaccaacaauaa

SEQ ID NO: 4019631 - RNA, 13 nt, Staphylococcus aureus subsp. aureus MW2
ugauacauuauua

SEQ ID NO: 4019632 - RNA, 14 nt, Staphylococcus aureus subsp. aureus MW2
ugauacauuauuaa

SEQ ID NO: 4019633 - RNA, 18 nt, Staphylococcus aureus subsp. aureus MW2
ugauacauuauuaaauag

SEQ ID NO: 4019634 - RNA, 20 nt, Staphylococcus aureus subsp. aureus MW2
ugauacauuauuaaauagau

SEQ ID NO: 4019635 - RNA, 16 nt, Staphylococcus aureus subsp. aureus MW2
ugauacccaauauuaa

SEQ ID NO: 4019636 - RNA, 20 nt, Staphylococcus aureus subsp. aureus MW2
ugauacccaauauuaaucca

SEQ ID NO: 4019637 - RNA, 17 nt, Staphylococcus aureus subsp. aureus MW2
ugauaccuuuaaaucua

SEQ ID NO: 4019638 - RNA, 21 nt, Staphylococcus aureus subsp. aureus MW2
ugauacgaugcgugaguugaa

SEQ ID NO: 4019639 - RNA, 17 nt, Staphylococcus aureus subsp. aureus MW2
ugauacgcacguauaua

SEQ ID NO: 4019640 - RNA, 19 nt, Staphylococcus aureus subsp. aureus MW2
ugauacgccuaaauauuua

SEQ ID NO: 4019641 - RNA, 15 nt, Staphylococcus aureus subsp. aureus MW2
ugauacgcuuuuuaa

SEQ ID NO: 4019642 - RNA, 16 nt, Staphylococcus aureus subsp. aureus MW2
ugauacgcuuuuuaaa

SEQ ID NO: 4019643 - RNA, 17 nt, Staphylococcus aureus subsp. aureus MW2
ugauacgcuuuuuaaaa

SEQ ID NO: 4019644 - RNA, 22 nt, Staphylococcus aureus subsp. aureus MW2
ugauacggaucauaaucauaaa

SEQ ID NO: 4019645 - RNA, 18 nt, Staphylococcus aureus subsp. aureus MW2
ugauacgugguuuuauuu

SEQ ID NO: 4019646 - RNA, 14 nt, Staphylococcus aureus subsp. aureus MW2
ugauacucaauaaa

SEQ ID NO: 4019647 - RNA, 17 nt, Staphylococcus aureus subsp. aureus MW2
ugauacuucaccaucuu

SEQ ID NO: 4019648 - RNA, 17 nt, Staphylococcus aureus subsp. aureus MW2
ugauagacuaauuaucu

SEQ ID NO: 4019649 - RNA, 23 nt, Staphylococcus aureus subsp. aureus MW2
ugauagagagcauaguuuucaua

SEQ ID NO: 4019650 - RNA, 14 nt, Staphylococcus aureus subsp. aureus MW2
ugauagauucaaaa

SEQ ID NO: 4019651 - RNA, 15 nt, Staphylococcus aureus subsp. aureus MW2
ugauagccaauauaa

SEQ ID NO: 4019652 - RNA, 21 nt, Staphylococcus aureus subsp. aureus MW2
ugauagccaauauaacaagcu

SEQ ID NO: 4019653 - RNA, 22 nt, Staphylococcus aureus subsp. aureus MW2
ugauagccaauauaacaagcua

SEQ ID NO: 4019654 - RNA, 15 nt, Staphylococcus aureus subsp. aureus MW2
ugauagcguaaauga

SEQ ID NO: 4019655 - RNA, 19 nt, Staphylococcus aureus subsp. aureus MW2
ugauagcguaaaugauggc

SEQ ID NO: 4019656 - RNA, 22 nt, Staphylococcus aureus subsp. aureus MW2
ugauagcuaaacauuuuauacu

SEQ ID NO: 4019657 - RNA, 15 nt, Staphylococcus aureus subsp. aureus MW2
ugauagcuaaugcau

SEQ ID NO: 4019658 - RNA, 16 nt, Staphylococcus aureus subsp. aureus MW2
ugauagcuaaugcauu

SEQ ID NO: 4019659 - RNA, 18 nt, Staphylococcus aureus subsp. aureus MW2
ugauagcuaaugcauuau

SEQ ID NO: 4019660 - RNA, 17 nt, Staphylococcus aureus subsp. aureus MW2
ugauauaaaaagugaaa

SEQ ID NO: 4019661 - RNA, 19 nt, Staphylococcus aureus subsp. aureus MW2
ugauauaaaaagugaaagu

SEQ ID NO: 4019662 - RNA, 16 nt, Staphylococcus aureus subsp. aureus MW2
ugauauaaacuacuaa

SEQ ID NO: 4019663 - RNA, 17 nt, Staphylococcus aureus subsp. aureus MW2
ugauauauaacaaguac

SEQ ID NO: 4019664 - RNA, 13 nt, Staphylococcus aureus subsp. aureus MW2
ugauauauaacca

SEQ ID NO: 4019665 - RNA, 22 nt, Staphylococcus aureus subsp. aureus MW2
ugauauauaaccauaguaacaa

SEQ ID NO: 4019666 - RNA, 17 nt, Staphylococcus aureus subsp. aureus MW2
ugauauauguaacauaa

SEQ ID NO: 4019667 - RNA, 15 nt, Staphylococcus aureus subsp. aureus MW2
ugauauauucaucuc

SEQ ID NO: 4019668 - RNA, 20 nt, Staphylococcus aureus subsp. aureus MW2
ugauaucaucugcaagugcu

SEQ ID NO: 4019669 - RNA, 22 nt, Staphylococcus aureus subsp. aureus MW2
ugauauccaaagcuugauuuaa

SEQ ID NO: 4019670 - RNA, 23 nt, Staphylococcus aureus subsp. aureus MW2
ugauaucgaaacgcuuugcagau

SEQ ID NO: 4019671 - RNA, 22 nt, Staphylococcus aureus subsp. aureus MW2
ugauaucuacagagaaucaauu

SEQ ID NO: 4019672 - RNA, 18 nt, Staphylococcus aureus subsp. aureus MW2
ugauaucugacauuucau

SEQ ID NO: 4019673 - RNA, 18 nt, Staphylococcus aureus subsp. aureus MW2
ugauaugugaaaaagcua

SEQ ID NO: 4019674 - RNA, 16 nt, Staphylococcus aureus subsp. aureus MW2
ugauauguuuccucuu

SEQ ID NO: 4019675 - RNA, 15 nt, Staphylococcus aureus subsp. aureus MW2
ugauauuaacuguac

SEQ ID NO: 4019676 - RNA, 17 nt, Staphylococcus aureus subsp. aureus MW2
ugauauuaacuguacca

SEQ ID NO: 4019677 - RNA, 14 nt, Staphylococcus aureus subsp. aureus MW2
ugauauuaauauau

SEQ ID NO: 4019678 - RNA, 15 nt, Staphylococcus aureus subsp. aureus MW2
ugauauuaggcuuaa

SEQ ID NO: 4019679 - RNA, 21 nt, Staphylococcus aureus subsp. aureus MW2
ugauauugaaaguguaugcau

SEQ ID NO: 4019680 - RNA, 13 nt, Staphylococcus aureus subsp. aureus MW2
ugauauugaucug

SEQ ID NO: 4019681 - RNA, 12 nt, Staphylococcus aureus subsp. aureus MW2
ugauauuuaccg

SEQ ID NO: 4019682 - RNA, 20 nt, Staphylococcus aureus subsp. aureus MW2
ugauauuuaccgucuuauga

SEQ ID NO: 4019683 - RNA, 23 nt, Staphylococcus aureus subsp. aureus MW2
ugauauuucgguuagucuuaauc

SEQ ID NO: 4019684 - RNA, 24 nt, Staphylococcus aureus subsp. aureus MW2
ugaucaaauugcguuguuucauua

SEQ ID NO: 4019685 - RNA, 12 nt, Staphylococcus aureus subsp. aureus MW2
ugaucaauaaga

SEQ ID NO: 4019686 - RNA, 19 nt, Staphylococcus aureus subsp. aureus MW2
ugaucaauaagauuuugcu

SEQ ID NO: 4019687 - RNA, 14 nt, Staphylococcus aureus subsp. aureus MW2
ugaucauaauucag

SEQ ID NO: 4019688 - RNA, 18 nt, Staphylococcus aureus subsp. aureus MW2
ugaucauuuacuuuagaa

SEQ ID NO: 4019689 - RNA, 17 nt, Staphylococcus aureus subsp. aureus MW2
ugauccgauuaauugaa

SEQ ID NO: 4019690 - RNA, 20 nt, Staphylococcus aureus subsp. aureus MW2
ugauccuggaaucgaaaaua

SEQ ID NO: 4019691 - RNA, 23 nt, Staphylococcus aureus subsp. aureus MW2
ugaucuaaaaccauagagcauuu

SEQ ID NO: 4019692 - RNA, 18 nt, Staphylococcus aureus subsp. aureus MW2
ugaucuuuaaauauacuu

SEQ ID NO: 4019693 - RNA, 24 nt, Staphylococcus aureus subsp. aureus MW2
ugaucuuuuuuauauucaacuuau

SEQ ID NO: 4019694 - RNA, 14 nt, Staphylococcus aureus subsp. aureus MW2
ugaugaaagacuga

SEQ ID NO: 4019695 - RNA, 20 nt, Staphylococcus aureus subsp. aureus MW2
ugaugaacauaccugcauau

SEQ ID NO: 4019696 - RNA, 17 nt, Staphylococcus aureus subsp. aureus MW2
ugaugaacuuaaugcuu

SEQ ID NO: 4019697 - RNA, 20 nt, Staphylococcus aureus subsp. aureus MW2
ugaugaauuguuguacaugu

SEQ ID NO: 4019698 - RNA, 12 nt, Staphylococcus aureus subsp. aureus MW2
ugaugacaucaa

SEQ ID NO: 4019699 - RNA, 15 nt, Staphylococcus aureus subsp. aureus MW2
ugaugagauaaaauc

SEQ ID NO: 4019700 - RNA, 15 nt, Staphylococcus aureus subsp. aureus MW2
ugaugauauucauau

SEQ ID NO: 4019701 - RNA, 19 nt, Staphylococcus aureus subsp. aureus MW2
ugaugcuugaauguuugaa

SEQ ID NO: 4019702 - RNA, 18 nt, Staphylococcus aureus subsp. aureus MW2
ugauggaaucauuuucuu

SEQ ID NO: 4019703 - RNA, 15 nt, Staphylococcus aureus subsp. aureus MW2
ugauggauauucaau

SEQ ID NO: 4019704 - RNA, 14 nt, Staphylococcus aureus subsp. aureus MW2
ugauggucagcaaa

SEQ ID NO: 4019705 - RNA, 16 nt, Staphylococcus aureus subsp. aureus MW2
ugaugguuuaucuuuu

SEQ ID NO: 4019706 - RNA, 18 nt, Staphylococcus aureus subsp. aureus MW2
ugaugguuuaucuuuuuc

SEQ ID NO: 4019707 - RNA, 15 nt, Staphylococcus aureus subsp. aureus MW2
ugauguaauucuguu

SEQ ID NO: 4019708 - RNA, 16 nt, Staphylococcus aureus subsp. aureus MW2
ugaugucauguauugu

SEQ ID NO: 4019709 - RNA, 17 nt, Staphylococcus aureus subsp. aureus MW2
ugaugucgaaaauagcu

SEQ ID NO: 4019710 - RNA, 13 nt, Staphylococcus aureus subsp. aureus MW2
ugaugugaaaauu

SEQ ID NO: 4019711 - RNA, 18 nt, Staphylococcus aureus subsp. aureus MW2
ugaugugccuuucuaaua

SEQ ID NO: 4019712 - RNA, 16 nt, Staphylococcus aureus subsp. aureus MW2
ugauguguugcauuac

SEQ ID NO: 4019713 - RNA, 13 nt, Staphylococcus aureus subsp. aureus MW2
ugauguuaaaaaa

SEQ ID NO: 4019714 - RNA, 20 nt, Staphylococcus aureus subsp. aureus MW2
ugauguucaauauuuucaug

SEQ ID NO: 4019715 - RNA, 12 nt, Staphylococcus aureus subsp. aureus MW2
ugauuaaaagug

SEQ ID NO: 4019716 - RNA, 17 nt, Staphylococcus aureus subsp. aureus MW2
ugauuaaaguguuucaa

SEQ ID NO: 4019717 - RNA, 22 nt, Staphylococcus aureus subsp. aureus MW2
ugauuaaauucuuuucaagaaa

SEQ ID NO: 4019718 - RNA, 17 nt, Staphylococcus aureus subsp. aureus MW2
ugauuaauccuauacgu

SEQ ID NO: 4019719 - RNA, 17 nt, Staphylococcus aureus subsp. aureus MW2
ugauuaauuauugagaa

SEQ ID NO: 4019720 - RNA, 13 nt, Staphylococcus aureus subsp. aureus MW2
ugauuacaacuua

SEQ ID NO: 4019721 - RNA, 16 nt, Staphylococcus aureus subsp. aureus MW2
ugauuacaacuuauuc

SEQ ID NO: 4019722 - RNA, 18 nt, Staphylococcus aureus subsp. aureus MW2
ugauuacaacuuauucuu

SEQ ID NO: 4019723 - RNA, 21 nt, Staphylococcus aureus subsp. aureus MW2
ugauuacaacuuauucuucac

SEQ ID NO: 4019724 - RNA, 18 nt, Staphylococcus aureus subsp. aureus MW2
ugauuacauucuauacuu

SEQ ID NO: 4019725 - RNA, 22 nt, Staphylococcus aureus subsp. aureus MW2
ugauuacauucuauacuuuuaa

SEQ ID NO: 4019726 - RNA, 22 nt, Staphylococcus aureus subsp. aureus MW2
ugauuacguugguuuaaaaauu

SEQ ID NO: 4019727 - RNA, 22 nt, Staphylococcus aureus subsp. aureus MW2
ugauuagcauaccuuuauuauu

SEQ ID NO: 4019728 - RNA, 22 nt, Staphylococcus aureus subsp. aureus MW2
ugauuagcgcaccaauuaucaa

SEQ ID NO: 4019729 - RNA, 23 nt, Staphylococcus aureus subsp. aureus MW2
ugauuaguuucugacuuuuaaaa

SEQ ID NO: 4019730 - RNA, 14 nt, Staphylococcus aureus subsp. aureus MW2
ugauuauauauauu

SEQ ID NO: 4019731 - RNA, 19 nt, Staphylococcus aureus subsp. aureus MW2
ugauuauauuuuucuucag

SEQ ID NO: 4019732 - RNA, 11 nt, Staphylococcus aureus subsp. aureus MW2
ugauuauuaca

SEQ ID NO: 4019733 - RNA, 19 nt, Staphylococcus aureus subsp. aureus MW2
ugauuauucguauucaaag

SEQ ID NO: 4019734 - RNA, 15 nt, Staphylococcus aureus subsp. aureus MW2
ugauuauucuucauu

SEQ ID NO: 4019735 - RNA, 18 nt, Staphylococcus aureus subsp. aureus MW2
ugauuauucuucauuuau

SEQ ID NO: 4019736 - RNA, 23 nt, Staphylococcus aureus subsp. aureus MW2
ugauuauucuuuaauuaaaucuu

SEQ ID NO: 4019737 - RNA, 12 nt, Staphylococcus aureus subsp. aureus MW2
ugauucaaauaa

SEQ ID NO: 4019738 - RNA, 22 nt, Staphylococcus aureus subsp. aureus MW2
ugauucaccagguuuuuuauuu

SEQ ID NO: 4019739 - RNA, 18 nt, Staphylococcus aureus subsp. aureus MW2
ugauucuaaauaaucgaa

SEQ ID NO: 4019740 - RNA, 14 nt, Staphylococcus aureus subsp. aureus MW2
ugauucuagugaaa

SEQ ID NO: 4019741 - RNA, 19 nt, Staphylococcus aureus subsp. aureus MW2
ugauucuauagcacugaaa

SEQ ID NO: 4019742 - RNA, 12 nt, Staphylococcus aureus subsp. aureus MW2
ugauugaacaau

SEQ ID NO: 4019743 - RNA, 14 nt, Staphylococcus aureus subsp. aureus MW2
ugauugauaugguu

SEQ ID NO: 4019744 - RNA, 17 nt, Staphylococcus aureus subsp. aureus MW2
ugauugauaugguuaga

SEQ ID NO: 4019745 - RNA, 17 nt, Staphylococcus aureus subsp. aureus MW2
ugauugcaaauuaucau

SEQ ID NO: 4019746 - RNA, 21 nt, Staphylococcus aureus subsp. aureus MW2
ugauugcauugauuucagcac

SEQ ID NO: 4019747 - RNA, 21 nt, Staphylococcus aureus subsp. aureus MW2
ugauugcucuaagcauucagu

SEQ ID NO: 4019748 - RNA, 21 nt, Staphylococcus aureus subsp. aureus MW2
ugauuggcagugaucuuuuuu

SEQ ID NO: 4019749 - RNA, 16 nt, Staphylococcus aureus subsp. aureus MW2
ugauuguaauaucuaa

SEQ ID NO: 4019750 - RNA, 15 nt, Staphylococcus aureus subsp. aureus MW2
ugauuguuaauacaa

SEQ ID NO: 4019751 - RNA, 17 nt, Staphylococcus aureus subsp. aureus MW2
ugauuuaaaaaaauuaa

SEQ ID NO: 4019752 - RNA, 19 nt, Staphylococcus aureus subsp. aureus MW2
ugauuuaaaauauaaauuu

SEQ ID NO: 4019753 - RNA, 14 nt, Staphylococcus aureus subsp. aureus MW2
ugauuuaaaauauu

SEQ ID NO: 4019754 - RNA, 16 nt, Staphylococcus aureus subsp. aureus MW2
ugauuuaaaugcuucu

SEQ ID NO: 4019755 - RNA, 22 nt, Staphylococcus aureus subsp. aureus MW2
ugauuuaagauuuaauaaagug

SEQ ID NO: 4019756 - RNA, 15 nt, Staphylococcus aureus subsp. aureus MW2
ugauuuaauaauauu

SEQ ID NO: 4019757 - RNA, 14 nt, Staphylococcus aureus subsp. aureus MW2
ugauuuaauguuaa

SEQ ID NO: 4019758 - RNA, 16 nt, Staphylococcus aureus subsp. aureus MW2
ugauuuaauuuuuaau

SEQ ID NO: 4019759 - RNA, 17 nt, Staphylococcus aureus subsp. aureus MW2
ugauuuaauuuuuaaug

SEQ ID NO: 4019760 - RNA, 17 nt, Staphylococcus aureus subsp. aureus MW2
ugauuuagcauacauua

SEQ ID NO: 4019761 - RNA, 12 nt, Staphylococcus aureus subsp. aureus MW2
ugauuucauuug

SEQ ID NO: 4019762 - RNA, 17 nt, Staphylococcus aureus subsp. aureus MW2
ugauuugauaauauuau

SEQ ID NO: 4019763 - RNA, 17 nt, Staphylococcus aureus subsp. aureus MW2
ugauuugauauuucaaa

SEQ ID NO: 4019764 - RNA, 21 nt, Staphylococcus aureus subsp. aureus MW2
ugauuugccaaaaguuauaua

SEQ ID NO: 4019765 - RNA, 20 nt, Staphylococcus aureus subsp. aureus MW2
ugauuuggguaauguuuuua

SEQ ID NO: 4019766 - RNA, 16 nt, Staphylococcus aureus subsp. aureus MW2
ugauuuguuacuucua

SEQ ID NO: 4019767 - RNA, 23 nt, Staphylococcus aureus subsp. aureus MW2
ugauuuguuacuucuaauaguaa

SEQ ID NO: 4019768 - RNA, 15 nt, Staphylococcus aureus subsp. aureus MW2
ugauuuuaauacuau

SEQ ID NO: 4019769 - RNA, 18 nt, Staphylococcus aureus subsp. aureus MW2
ugauuuuacuugaauaua

SEQ ID NO: 4019770 - RNA, 16 nt, Staphylococcus aureus subsp. aureus MW2
ugauuuucuaaagcuu

SEQ ID NO: 4019771 - RNA, 20 nt, Staphylococcus aureus subsp. aureus MW2
ugauuuucuuucauaaauug

SEQ ID NO: 4019772 - RNA, 18 nt, Staphylococcus aureus subsp. aureus MW2
ugauuuugcugccaaaaa

SEQ ID NO: 4019773 - RNA, 12 nt, Staphylococcus aureus subsp. aureus MW2
ugauuuugcuuu

SEQ ID NO: 4019774 - RNA, 15 nt, Staphylococcus aureus subsp. aureus MW2
ugauuuuuaaaaaua

SEQ ID NO: 4019775 - RNA, 24 nt, Staphylococcus aureus subsp. aureus MW2
ugauuuuucaucaauaucaaauuu

SEQ ID NO: 4019776 - RNA, 23 nt, Staphylococcus aureus subsp. aureus MW2
ugcaaaaaaauggggacauguuc

SEQ ID NO: 4019777 - RNA, 12 nt, Staphylococcus aureus subsp. aureus MW2
ugcaaaaauaau

SEQ ID NO: 4019778 - RNA, 20 nt, Staphylococcus aureus subsp. aureus MW2
ugcaaaaauaauaugaauuu

SEQ ID NO: 4019779 - RNA, 15 nt, Staphylococcus aureus subsp. aureus MW2
ugcaaaauguuacac

SEQ ID NO: 4019780 - RNA, 15 nt, Staphylococcus aureus subsp. aureus MW2
ugcaaacacaguaca

SEQ ID NO: 4019781 - RNA, 20 nt, Staphylococcus aureus subsp. aureus MW2
ugcaaacacaguacaaauaa

SEQ ID NO: 4019782 - RNA, 15 nt, Staphylococcus aureus subsp. aureus MW2
ugcaaacgauauguu

SEQ ID NO: 4019783 - RNA, 22 nt, Staphylococcus aureus subsp. aureus MW2
ugcaaauacgaguguuuuaauc

SEQ ID NO: 4019784 - RNA, 21 nt, Staphylococcus aureus subsp. aureus MW2
ugcaaauagcgauuuuaaaga

SEQ ID NO: 4019785 - RNA, 16 nt, Staphylococcus aureus subsp. aureus MW2
ugcaaaucaaauacau

SEQ ID NO: 4019786 - RNA, 20 nt, Staphylococcus aureus subsp. aureus MW2
ugcaaauuaucauuaaauug

SEQ ID NO: 4019787 - RNA, 14 nt, Staphylococcus aureus subsp. aureus MW2
ugcaacaauuugca

SEQ ID NO: 4019788 - RNA, 22 nt, Staphylococcus aureus subsp. aureus MW2
ugcaacagaaccgaaaauaauc

SEQ ID NO: 4019789 - RNA, 14 nt, Staphylococcus aureus subsp. aureus MW2
ugcaacauuuugag

SEQ ID NO: 4019790 - RNA, 20 nt, Staphylococcus aureus subsp. aureus MW2
ugcaacgaugcuacuuaaag

SEQ ID NO: 4019791 - RNA, 20 nt, Staphylococcus aureus subsp. aureus MW2
ugcaacgucccaacaacaua

SEQ ID NO: 4019792 - RNA, 19 nt, Staphylococcus aureus subsp. aureus MW2
ugcaacuaauaugauuggu

SEQ ID NO: 4019793 - RNA, 16 nt, Staphylococcus aureus subsp. aureus MW2
ugcaacuacgauaccg

SEQ ID NO: 4019794 - RNA, 15 nt, Staphylococcus aureus subsp. aureus MW2
ugcaacuuauaauau

SEQ ID NO: 4019795 - RNA, 16 nt, Staphylococcus aureus subsp. aureus MW2
ugcaacuuauaauauu

SEQ ID NO: 4019796 - RNA, 19 nt, Staphylococcus aureus subsp. aureus MW2
ugcaaguaauuuaauaggu

SEQ ID NO: 4019797 - RNA, 12 nt, Staphylococcus aureus subsp. aureus MW2
ugcaaguauuuu

SEQ ID NO: 4019798 - RNA, 20 nt, Staphylococcus aureus subsp. aureus MW2
ugcaaguccaaauaauaucu

SEQ ID NO: 4019799 - RNA, 19 nt, Staphylococcus aureus subsp. aureus MW2
ugcaaguuggcggggcccc

SEQ ID NO: 4019800 - RNA, 22 nt, Staphylococcus aureus subsp. aureus MW2
ugcaaguuggcggggccccaac

SEQ ID NO: 4019801 - RNA, 12 nt, Staphylococcus aureus subsp. aureus MW2
ugcaaguugggg

SEQ ID NO: 4019802 - RNA, 16 nt, Staphylococcus aureus subsp. aureus MW2
ugcaaguugggguggg

SEQ ID NO: 4019803 - RNA, 23 nt, Staphylococcus aureus subsp. aureus MW2
ugcaauaacaccaauugaauauu

SEQ ID NO: 4019804 - RNA, 14 nt, Staphylococcus aureus subsp. aureus MW2
ugcaauaauaaaua

SEQ ID NO: 4019805 - RNA, 22 nt, Staphylococcus aureus subsp. aureus MW2
ugcaauaauaaauaggaugaaa

SEQ ID NO: 4019806 - RNA, 14 nt, Staphylococcus aureus subsp. aureus MW2
ugcaauaauuacua

SEQ ID NO: 4019807 - RNA, 16 nt, Staphylococcus aureus subsp. aureus MW2
ugcaauaauucaucuu

SEQ ID NO: 4019808 - RNA, 23 nt, Staphylococcus aureus subsp. aureus MW2
ugcaauaccuccccaacuuaaua

SEQ ID NO: 4019809 - RNA, 16 nt, Staphylococcus aureus subsp. aureus MW2
ugcaauagcuauaacu

SEQ ID NO: 4019810 - RNA, 17 nt, Staphylococcus aureus subsp. aureus MW2
ugcaauaggaugaaacu

SEQ ID NO: 4019811 - RNA, 13 nt, Staphylococcus aureus subsp. aureus MW2
ugcaauauuauau

SEQ ID NO: 4019812 - RNA, 15 nt, Staphylococcus aureus subsp. aureus MW2
ugcaaucguauguaa

SEQ ID NO: 4019813 - RNA, 15 nt, Staphylococcus aureus subsp. aureus MW2
ugcaaucguugaaaa

SEQ ID NO: 4019814 - RNA, 14 nt, Staphylococcus aureus subsp. aureus MW2
ugcaauugccuuau

SEQ ID NO: 4019815 - RNA, 20 nt, Staphylococcus aureus subsp. aureus MW2
ugcaauugccuuaucagcau

SEQ ID NO: 4019816 - RNA, 17 nt, Staphylococcus aureus subsp. aureus MW2
ugcaauuucauaguguu

SEQ ID NO: 4019817 - RNA, 18 nt, Staphylococcus aureus subsp. aureus MW2
ugcaauuuguaauacaag

SEQ ID NO: 4019818 - RNA, 16 nt, Staphylococcus aureus subsp. aureus MW2
ugcaauuuuuuaugua

SEQ ID NO: 4019819 - RNA, 19 nt, Staphylococcus aureus subsp. aureus MW2
ugcaauuuuuuauguauua

SEQ ID NO: 4019820 - RNA, 15 nt, Staphylococcus aureus subsp. aureus MW2
ugcacaaauugcaau

SEQ ID NO: 4019821 - RNA, 12 nt, Staphylococcus aureus subsp. aureus MW2
ugcacaacaguc

SEQ ID NO: 4019822 - RNA, 21 nt, Staphylococcus aureus subsp. aureus MW2
ugcacauaaaaaaugugaccu

SEQ ID NO: 4019823 - RNA, 20 nt, Staphylococcus aureus subsp. aureus MW2
ugcaccuggucguacuuuca

SEQ ID NO: 4019824 - RNA, 21 nt, Staphylococcus aureus subsp. aureus MW2
ugcaccuggucguacuuucaa

SEQ ID NO: 4019825 - RNA, 18 nt, Staphylococcus aureus subsp. aureus MW2
ugcacgaaugguucuucc

SEQ ID NO: 4019826 - RNA, 16 nt, Staphylococcus aureus subsp. aureus MW2
ugcacuaccaucagua

SEQ ID NO: 4019827 - RNA, 13 nt, Staphylococcus aureus subsp. aureus MW2
ugcacuuuauuaa

SEQ ID NO: 4019828 - RNA, 19 nt, Staphylococcus aureus subsp. aureus MW2
ugcacuuuuuauacauuaa

SEQ ID NO: 4019829 - RNA, 20 nt, Staphylococcus aureus subsp. aureus MW2
ugcagauaauugaaaaucua

SEQ ID NO: 4019830 - RNA, 15 nt, Staphylococcus aureus subsp. aureus MW2
ugcagauuagguuac

SEQ ID NO: 4019831 - RNA, 23 nt, Staphylococcus aureus subsp. aureus MW2
ugcagcaacugcauuacgcuguc

SEQ ID NO: 4019832 - RNA, 21 nt, Staphylococcus aureus subsp. aureus MW2
ugcagucauuugauuuaaaaa

SEQ ID NO: 4019833 - RNA, 19 nt, Staphylococcus aureus subsp. aureus MW2
ugcaguuuuaauuaaacug

SEQ ID NO: 4019834 - RNA, 13 nt, Staphylococcus aureus subsp. aureus MW2
ugcauaaaaaaag

SEQ ID NO: 4019835 - RNA, 20 nt, Staphylococcus aureus subsp. aureus MW2
ugcauaaccaaguaauucuu

SEQ ID NO: 4019836 - RNA, 19 nt, Staphylococcus aureus subsp. aureus MW2
ugcauaacgcacugcauua

SEQ ID NO: 4019837 - RNA, 14 nt, Staphylococcus aureus subsp. aureus MW2
ugcauaaucaauuu

SEQ ID NO: 4019838 - RNA, 22 nt, Staphylococcus aureus subsp. aureus MW2
ugcauaauuaggauuaacauaa

SEQ ID NO: 4019839 - RNA, 13 nt, Staphylococcus aureus subsp. aureus MW2
ugcauacauaucu

SEQ ID NO: 4019840 - RNA, 19 nt, Staphylococcus aureus subsp. aureus MW2
ugcauacgaauuaaaauaa

SEQ ID NO: 4019841 - RNA, 23 nt, Staphylococcus aureus subsp. aureus MW2
ugcauagcgcucuggauuuuucu

SEQ ID NO: 4019842 - RNA, 23 nt, Staphylococcus aureus subsp. aureus MW2
ugcauagguaaccuuaaauauag

SEQ ID NO: 4019843 - RNA, 15 nt, Staphylococcus aureus subsp. aureus MW2
ugcauauucaucaua

SEQ ID NO: 4019844 - RNA, 13 nt, Staphylococcus aureus subsp. aureus MW2
ugcaucacagaua

SEQ ID NO: 4019845 - RNA, 17 nt, Staphylococcus aureus subsp. aureus MW2
ugcaucaguuaauaauu

SEQ ID NO: 4019846 - RNA, 19 nt, Staphylococcus aureus subsp. aureus MW2
ugcaucauaauuuccugau

SEQ ID NO: 4019847 - RNA, 15 nt, Staphylococcus aureus subsp. aureus MW2
ugcaucccgaaaguu

SEQ ID NO: 4019848 - RNA, 22 nt, Staphylococcus aureus subsp. aureus MW2
ugcaucccgaaaguuagacuaa

SEQ ID NO: 4019849 - RNA, 14 nt, Staphylococcus aureus subsp. aureus MW2
ugcaucuuuugguu

SEQ ID NO: 4019850 - RNA, 22 nt, Staphylococcus aureus subsp. aureus MW2
ugcaugaaaauuaaaaaaugcu

SEQ ID NO: 4019851 - RNA, 16 nt, Staphylococcus aureus subsp. aureus MW2
ugcaugacgauaauga

SEQ ID NO: 4019852 - RNA, 19 nt, Staphylococcus aureus subsp. aureus MW2
ugcaugagacuuauucaac

SEQ ID NO: 4019853 - RNA, 13 nt, Staphylococcus aureus subsp. aureus MW2
ugcaugaugaacu

SEQ ID NO: 4019854 - RNA, 16 nt, Staphylococcus aureus subsp. aureus MW2
ugcaugaugaacuuaa

SEQ ID NO: 4019855 - RNA, 20 nt, Staphylococcus aureus subsp. aureus MW2
ugcaugaugaacuuaaugcu

SEQ ID NO: 4019856 - RNA, 19 nt, Staphylococcus aureus subsp. aureus MW2
ugcaugcgcaaaagcgcag

SEQ ID NO: 4019857 - RNA, 24 nt, Staphylococcus aureus subsp. aureus MW2
ugcauguccugaauguucgaagau

SEQ ID NO: 4019858 - RNA, 15 nt, Staphylococcus aureus subsp. aureus MW2
ugcaugugaaauuaa

SEQ ID NO: 4019859 - RNA, 12 nt, Staphylococcus aureus subsp. aureus MW2
ugcauuaauuuc

SEQ ID NO: 4019860 - RNA, 20 nt, Staphylococcus aureus subsp. aureus MW2
ugcauuaauuucaugugcaa

SEQ ID NO: 4019861 - RNA, 14 nt, Staphylococcus aureus subsp. aureus MW2
ugcauuacgcuguc

SEQ ID NO: 4019862 - RNA, 18 nt, Staphylococcus aureus subsp. aureus MW2
ugcauuacuacuuuauaa

SEQ ID NO: 4019863 - RNA, 22 nt, Staphylococcus aureus subsp. aureus MW2
ugcauuacuacuuuauaaauau

SEQ ID NO: 4019864 - RNA, 23 nt, Staphylococcus aureus subsp. aureus MW2
ugcauuacuacuuuauaaauauc

SEQ ID NO: 4019865 - RNA, 17 nt, Staphylococcus aureus subsp. aureus MW2
ugcauuacuaucuucau

SEQ ID NO: 4019866 - RNA, 20 nt, Staphylococcus aureus subsp. aureus MW2
ugcauuacuaucuucaucau

SEQ ID NO: 4019867 - RNA, 12 nt, Staphylococcus aureus subsp. aureus MW2
ugcauuauuaua

SEQ ID NO: 4019868 - RNA, 23 nt, Staphylococcus aureus subsp. aureus MW2
ugcauugcacuugucucaaauua

SEQ ID NO: 4019869 - RNA, 17 nt, Staphylococcus aureus subsp. aureus MW2
ugcauugccuguagaau

SEQ ID NO: 4019870 - RNA, 22 nt, Staphylococcus aureus subsp. aureus MW2
ugcauugcuuuuguuaauauug

SEQ ID NO: 4019871 - RNA, 17 nt, Staphylococcus aureus subsp. aureus MW2
ugcauugucuguagaaa

SEQ ID NO: 4019872 - RNA, 16 nt, Staphylococcus aureus subsp. aureus MW2
ugcauuuagaugauuc

SEQ ID NO: 4019873 - RNA, 19 nt, Staphylococcus aureus subsp. aureus MW2
ugcauuuagaugauucuua

SEQ ID NO: 4019874 - RNA, 15 nt, Staphylococcus aureus subsp. aureus MW2
ugccaaaaacauuaa

SEQ ID NO: 4019875 - RNA, 16 nt, Staphylococcus aureus subsp. aureus MW2
ugccaaaaaguauuca

SEQ ID NO: 4019876 - RNA, 18 nt, Staphylococcus aureus subsp. aureus MW2
ugccaaaaugguuaaaau

SEQ ID NO: 4019877 - RNA, 17 nt, Staphylococcus aureus subsp. aureus MW2
ugccaauauaacauuua

SEQ ID NO: 4019878 - RNA, 17 nt, Staphylococcus aureus subsp. aureus MW2
ugccaauggaaguuuuu

SEQ ID NO: 4019879 - RNA, 16 nt, Staphylococcus aureus subsp. aureus MW2
ugccaauuaauucuuu

SEQ ID NO: 4019880 - RNA, 17 nt, Staphylococcus aureus subsp. aureus MW2
ugccaauuaauucuuug

SEQ ID NO: 4019881 - RNA, 21 nt, Staphylococcus aureus subsp. aureus MW2
ugccaccguggaauuuaccau

SEQ ID NO: 4019882 - RNA, 18 nt, Staphylococcus aureus subsp. aureus MW2
ugccauacccauauuaaa

SEQ ID NO: 4019883 - RNA, 23 nt, Staphylococcus aureus subsp. aureus MW2
ugccaucaauuucgacuccauua

SEQ ID NO: 4019884 - RNA, 18 nt, Staphylococcus aureus subsp. aureus MW2
ugccaucaggcuuuauug

SEQ ID NO: 4019885 - RNA, 20 nt, Staphylococcus aureus subsp. aureus MW2
ugccauguuggcaauuguuu

SEQ ID NO: 4019886 - RNA, 13 nt, Staphylococcus aureus subsp. aureus MW2
ugccauucauuaa

SEQ ID NO: 4019887 - RNA, 19 nt, Staphylococcus aureus subsp. aureus MW2
ugccauuguuauccaaaac

SEQ ID NO: 4019888 - RNA, 15 nt, Staphylococcus aureus subsp. aureus MW2
ugcccucauaaauca

SEQ ID NO: 4019889 - RNA, 15 nt, Staphylococcus aureus subsp. aureus MW2
ugcccuuauauuuuu

SEQ ID NO: 4019890 - RNA, 21 nt, Staphylococcus aureus subsp. aureus MW2
ugccgaaauuguucuaauaca

SEQ ID NO: 4019891 - RNA, 18 nt, Staphylococcus aureus subsp. aureus MW2
ugccggcuuuuucuuuug

SEQ ID NO: 4019892 - RNA, 23 nt, Staphylococcus aureus subsp. aureus MW2
ugccguaucuauaaaaagaauau

SEQ ID NO: 4019893 - RNA, 16 nt, Staphylococcus aureus subsp. aureus MW2
ugccguccauuuccau

SEQ ID NO: 4019894 - RNA, 17 nt, Staphylococcus aureus subsp. aureus MW2
ugccguuauuuucaaua

SEQ ID NO: 4019895 - RNA, 21 nt, Staphylococcus aureus subsp. aureus MW2
ugccuaauuuguaaccccauu

SEQ ID NO: 4019896 - RNA, 13 nt, Staphylococcus aureus subsp. aureus MW2
ugccuaauuuugu

SEQ ID NO: 4019897 - RNA, 21 nt, Staphylococcus aureus subsp. aureus MW2
ugccuauuuuuuuauguuaua

SEQ ID NO: 4019898 - RNA, 20 nt, Staphylococcus aureus subsp. aureus MW2
ugccucaguuagaagaugau

SEQ ID NO: 4019899 - RNA, 20 nt, Staphylococcus aureus subsp. aureus MW2
ugccucugcaacgccuuuau

SEQ ID NO: 4019900 - RNA, 19 nt, Staphylococcus aureus subsp. aureus MW2
ugccuggcaacguucuacu

SEQ ID NO: 4019901 - RNA, 16 nt, Staphylococcus aureus subsp. aureus MW2
ugccuugucuauugua

SEQ ID NO: 4019902 - RNA, 13 nt, Staphylococcus aureus subsp. aureus MW2
ugccuuuaaagca

SEQ ID NO: 4019903 - RNA, 23 nt, Staphylococcus aureus subsp. aureus MW2
ugccuuuaccgugaauauaauga

SEQ ID NO: 4019904 - RNA, 15 nt, Staphylococcus aureus subsp. aureus MW2
ugccuuucuaauauu

SEQ ID NO: 4019905 - RNA, 16 nt, Staphylococcus aureus subsp. aureus MW2
ugccuuuugaauaauu

SEQ ID NO: 4019906 - RNA, 22 nt, Staphylococcus aureus subsp. aureus MW2
ugcgaaaccuuucgauaaacua

SEQ ID NO: 4019907 - RNA, 15 nt, Staphylococcus aureus subsp. aureus MW2
ugcgaaaugcauuac

SEQ ID NO: 4019908 - RNA, 15 nt, Staphylococcus aureus subsp. aureus MW2
ugcgacauguccaua

SEQ ID NO: 4019909 - RNA, 18 nt, Staphylococcus aureus subsp. aureus MW2
ugcgauaagcaaaaauuc

SEQ ID NO: 4019910 - RNA, 23 nt, Staphylococcus aureus subsp. aureus MW2
ugcgauuucuucugcuaacucug

SEQ ID NO: 4019911 - RNA, 23 nt, Staphylococcus aureus subsp. aureus MW2
ugcgccaguuucuaauaaugcau

SEQ ID NO: 4019912 - RNA, 16 nt, Staphylococcus aureus subsp. aureus MW2
ugcgcucuuuucuugu

SEQ ID NO: 4019913 - RNA, 16 nt, Staphylococcus aureus subsp. aureus MW2
ugcgcuuauuuuacua

SEQ ID NO: 4019914 - RNA, 12 nt, Staphylococcus aureus subsp. aureus MW2
ugcgcuuccaau

SEQ ID NO: 4019915 - RNA, 17 nt, Staphylococcus aureus subsp. aureus MW2
ugcgcuuguaacaagcu

SEQ ID NO: 4019916 - RNA, 18 nt, Staphylococcus aureus subsp. aureus MW2
ugcgcuuguaacaagcuu

SEQ ID NO: 4019917 - RNA, 21 nt, Staphylococcus aureus subsp. aureus MW2
ugcguaagguauuucauugau

SEQ ID NO: 4019918 - RNA, 14 nt, Staphylococcus aureus subsp. aureus MW2
ugcgucguuuauua

SEQ ID NO: 4019919 - RNA, 15 nt, Staphylococcus aureus subsp. aureus MW2
ugcgugaauguuacu

SEQ ID NO: 4019920 - RNA, 21 nt, Staphylococcus aureus subsp. aureus MW2
ugcguuuuaagacuuuaaaau

SEQ ID NO: 4019921 - RNA, 13 nt, Staphylococcus aureus subsp. aureus MW2
ugcguuuuuaaau

SEQ ID NO: 4019922 - RNA, 23 nt, Staphylococcus aureus subsp. aureus MW2
ugcuaaaaaaauuaaaauguuaa

SEQ ID NO: 4019923 - RNA, 17 nt, Staphylococcus aureus subsp. aureus MW2
ugcuaaaaaauuugcau

SEQ ID NO: 4019924 - RNA, 22 nt, Staphylococcus aureus subsp. aureus MW2
ugcuaaaaaauuugcaugaaaa

SEQ ID NO: 4019925 - RNA, 14 nt, Staphylococcus aureus subsp. aureus MW2
ugcuaaaucaucuu

SEQ ID NO: 4019926 - RNA, 18 nt, Staphylococcus aureus subsp. aureus MW2
ugcuaauauuuauagcau

SEQ ID NO: 4019927 - RNA, 20 nt, Staphylococcus aureus subsp. aureus MW2
ugcuaaucuucucauaaaau

SEQ ID NO: 4019928 - RNA, 16 nt, Staphylococcus aureus subsp. aureus MW2
ugcuaauuuaacugcg

SEQ ID NO: 4019929 - RNA, 20 nt, Staphylococcus aureus subsp. aureus MW2
ugcuacagcacgagacaaua

SEQ ID NO: 4019930 - RNA, 18 nt, Staphylococcus aureus subsp. aureus MW2
ugcuacccaccuuucuuu

SEQ ID NO: 4019931 - RNA, 19 nt, Staphylococcus aureus subsp. aureus MW2
ugcuagcuuucuuuuucau

SEQ ID NO: 4019932 - RNA, 13 nt, Staphylococcus aureus subsp. aureus MW2
ugcuagugcucuu

SEQ ID NO: 4019933 - RNA, 17 nt, Staphylococcus aureus subsp. aureus MW2
ugcuaugauguguuaca

SEQ ID NO: 4019934 - RNA, 14 nt, Staphylococcus aureus subsp. aureus MW2
ugcuauguauuuuu

SEQ ID NO: 4019935 - RNA, 12 nt, Staphylococcus aureus subsp. aureus MW2
ugcuauguuuug

SEQ ID NO: 4019936 - RNA, 19 nt, Staphylococcus aureus subsp. aureus MW2
ugcuauuuuugacuguuaa

SEQ ID NO: 4019937 - RNA, 16 nt, Staphylococcus aureus subsp. aureus MW2
ugcuauuuuuuuaaua

SEQ ID NO: 4019938 - RNA, 14 nt, Staphylococcus aureus subsp. aureus MW2
ugcucaucuucuaa

SEQ ID NO: 4019939 - RNA, 20 nt, Staphylococcus aureus subsp. aureus MW2
ugcucauuuuuuuaauuauu

SEQ ID NO: 4019940 - RNA, 22 nt, Staphylococcus aureus subsp. aureus MW2
ugcucuaaacuucuauuaauaa

SEQ ID NO: 4019941 - RNA, 13 nt, Staphylococcus aureus subsp. aureus MW2
ugcucuaagcauu

SEQ ID NO: 4019942 - RNA, 17 nt, Staphylococcus aureus subsp. aureus MW2
ugcucuaauucaaugau

SEQ ID NO: 4019943 - RNA, 15 nt, Staphylococcus aureus subsp. aureus MW2
ugcucuauauaucca

SEQ ID NO: 4019944 - RNA, 20 nt, Staphylococcus aureus subsp. aureus MW2
ugcucuauuuacggcauaau

SEQ ID NO: 4019945 - RNA, 17 nt, Staphylococcus aureus subsp. aureus MW2
ugcucuuuauauauaaa

SEQ ID NO: 4019946 - RNA, 23 nt, Staphylococcus aureus subsp. aureus MW2
ugcucuuuuucccaugcuucuau

SEQ ID NO: 4019947 - RNA, 17 nt, Staphylococcus aureus subsp. aureus MW2
ugcugaaugaagcauuu

SEQ ID NO: 4019948 - RNA, 17 nt, Staphylococcus aureus subsp. aureus MW2
ugcugauaauuuuucuu

SEQ ID NO: 4019949 - RNA, 23 nt, Staphylococcus aureus subsp. aureus MW2
ugcugauaauuuuucuucuuuuu

SEQ ID NO: 4019950 - RNA, 18 nt, Staphylococcus aureus subsp. aureus MW2
ugcugccaaaaaguauuc

SEQ ID NO: 4019951 - RNA, 22 nt, Staphylococcus aureus subsp. aureus MW2
ugcugccaucaggcuuuauugu

SEQ ID NO: 4019952 - RNA, 23 nt, Staphylococcus aureus subsp. aureus MW2
ugcugccggugcagauaauugaa

SEQ ID NO: 4019953 - RNA, 18 nt, Staphylococcus aureus subsp. aureus MW2
ugcugcuguacaauuucg

SEQ ID NO: 4019954 - RNA, 15 nt, Staphylococcus aureus subsp. aureus MW2
ugcugcuuuuccauu

SEQ ID NO: 4019955 - RNA, 14 nt, Staphylococcus aureus subsp. aureus MW2
ugcuggcuuaguaa

SEQ ID NO: 4019956 - RNA, 18 nt, Staphylococcus aureus subsp. aureus MW2
ugcugguugcuucuuauc

SEQ ID NO: 4019957 - RNA, 16 nt, Staphylococcus aureus subsp. aureus MW2
ugcuguaaccccuugu

SEQ ID NO: 4019958 - RNA, 23 nt, Staphylococcus aureus subsp. aureus MW2
ugcuguacguuuaauaccuauga

SEQ ID NO: 4019959 - RNA, 19 nt, Staphylococcus aureus subsp. aureus MW2
ugcuguauauauauguaaa

SEQ ID NO: 4019960 - RNA, 12 nt, Staphylococcus aureus subsp. aureus MW2
ugcuguaucuuc

SEQ ID NO: 4019961 - RNA, 19 nt, Staphylococcus aureus subsp. aureus MW2
ugcugucaaacaacaauca

SEQ ID NO: 4019962 - RNA, 13 nt, Staphylococcus aureus subsp. aureus MW2
ugcuguucuuuuu

SEQ ID NO: 4019963 - RNA, 16 nt, Staphylococcus aureus subsp. aureus MW2
ugcuguucuuuuuauu

SEQ ID NO: 4019964 - RNA, 19 nt, Staphylococcus aureus subsp. aureus MW2
ugcuguugcaauaaaauca

SEQ ID NO: 4019965 - RNA, 15 nt, Staphylococcus aureus subsp. aureus MW2
ugcuguuuuauucaa

SEQ ID NO: 4019966 - RNA, 16 nt, Staphylococcus aureus subsp. aureus MW2
ugcuguuuuauucaau

SEQ ID NO: 4019967 - RNA, 13 nt, Staphylococcus aureus subsp. aureus MW2
ugcuguuuuuauu

SEQ ID NO: 4019968 - RNA, 18 nt, Staphylococcus aureus subsp. aureus MW2
ugcuguuuuuauuauaau

SEQ ID NO: 4019969 - RNA, 17 nt, Staphylococcus aureus subsp. aureus MW2
ugcuuaauuuauguguu

SEQ ID NO: 4019970 - RNA, 18 nt, Staphylococcus aureus subsp. aureus MW2
ugcuuaguacacguguau

SEQ ID NO: 4019971 - RNA, 15 nt, Staphylococcus aureus subsp. aureus MW2
ugcuuaucaacagcu

SEQ ID NO: 4019972 - RNA, 18 nt, Staphylococcus aureus subsp. aureus MW2
ugcuuaugaaugaaauca

SEQ ID NO: 4019973 - RNA, 20 nt, Staphylococcus aureus subsp. aureus MW2
ugcuuaugaaugaaaucagc

SEQ ID NO: 4019974 - RNA, 21 nt, Staphylococcus aureus subsp. aureus MW2
ugcuuaugaaugaaaucagca

SEQ ID NO: 4019975 - RNA, 16 nt, Staphylococcus aureus subsp. aureus MW2
ugcuuauguuuuuaac

SEQ ID NO: 4019976 - RNA, 18 nt, Staphylococcus aureus subsp. aureus MW2
ugcuucaaauguaacauu

SEQ ID NO: 4019977 - RNA, 22 nt, Staphylococcus aureus subsp. aureus MW2
ugcuucaaauguaacauuaaaa

SEQ ID NO: 4019978 - RNA, 13 nt, Staphylococcus aureus subsp. aureus MW2
ugcuucacuaaaa

SEQ ID NO: 4019979 - RNA, 15 nt, Staphylococcus aureus subsp. aureus MW2
ugcuucauaaauguu

SEQ ID NO: 4019980 - RNA, 19 nt, Staphylococcus aureus subsp. aureus MW2
ugcuucauaaauguuagau

SEQ ID NO: 4019981 - RNA, 23 nt, Staphylococcus aureus subsp. aureus MW2
ugcuucauauggacguaacuguu

SEQ ID NO: 4019982 - RNA, 17 nt, Staphylococcus aureus subsp. aureus MW2
ugcuucauuauauaauu

SEQ ID NO: 4019983 - RNA, 24 nt, Staphylococcus aureus subsp. aureus MW2
ugcuucuacccuugcaaauauauc

SEQ ID NO: 4019984 - RNA, 13 nt, Staphylococcus aureus subsp. aureus MW2
ugcuucucuuuga

SEQ ID NO: 4019985 - RNA, 13 nt, Staphylococcus aureus subsp. aureus MW2
ugcuucugcugua

SEQ ID NO: 4019986 - RNA, 17 nt, Staphylococcus aureus subsp. aureus MW2
ugcuucugguucuucaa

SEQ ID NO: 4019987 - RNA, 18 nt, Staphylococcus aureus subsp. aureus MW2
ugcuucugguucuucaau

SEQ ID NO: 4019988 - RNA, 12 nt, Staphylococcus aureus subsp. aureus MW2
ugcuucuuauca

SEQ ID NO: 4019989 - RNA, 14 nt, Staphylococcus aureus subsp. aureus MW2
ugcuucuuuccucu

SEQ ID NO: 4019990 - RNA, 15 nt, Staphylococcus aureus subsp. aureus MW2
ugcuucuuuuaagua

SEQ ID NO: 4019991 - RNA, 21 nt, Staphylococcus aureus subsp. aureus MW2
ugcuugaaauuauuauuuaaa

SEQ ID NO: 4019992 - RNA, 20 nt, Staphylococcus aureus subsp. aureus MW2
ugcuugaauuuuauuaggua

SEQ ID NO: 4019993 - RNA, 17 nt, Staphylococcus aureus subsp. aureus MW2
ugcuugaccuucaguuu

SEQ ID NO: 4019994 - RNA, 19 nt, Staphylococcus aureus subsp. aureus MW2
ugcuugauaagaagugcuu

SEQ ID NO: 4019995 - RNA, 21 nt, Staphylococcus aureus subsp. aureus MW2
ugcuugauaagaagugcuuau

SEQ ID NO: 4019996 - RNA, 17 nt, Staphylococcus aureus subsp. aureus MW2
ugcuugaucuugcuuau

SEQ ID NO: 4019997 - RNA, 20 nt, Staphylococcus aureus subsp. aureus MW2
ugcuuggauaauugcauuac

SEQ ID NO: 4019998 - RNA, 13 nt, Staphylococcus aureus subsp. aureus MW2
ugcuuuaacugua

SEQ ID NO: 4019999 - RNA, 14 nt, Staphylococcus aureus subsp. aureus MW2
ugcuuuaacuguac

SEQ ID NO: 4020000 - RNA, 13 nt, Staphylococcus aureus subsp. aureus MW2
ugcuuuaauauaa

SEQ ID NO: 4020001 - RNA, 23 nt, Staphylococcus aureus subsp. aureus MW2
ugcuuuaauuugauuaaauucuu

SEQ ID NO: 4020002 - RNA, 22 nt, Staphylococcus aureus subsp. aureus MW2
ugcuuuagagauuguaagaauu

SEQ ID NO: 4020003 - RNA, 17 nt, Staphylococcus aureus subsp. aureus MW2
ugcuuuagcucuuuuuu

SEQ ID NO: 4020004 - RNA, 19 nt, Staphylococcus aureus subsp. aureus MW2
ugcuuuaucgaauucuucu

SEQ ID NO: 4020005 - RNA, 14 nt, Staphylococcus aureus subsp. aureus MW2
ugcuuucgcauuau

SEQ ID NO: 4020006 - RNA, 19 nt, Staphylococcus aureus subsp. aureus MW2
ugcuuugcauacauaucuu

SEQ ID NO: 4020007 - RNA, 16 nt, Staphylococcus aureus subsp. aureus MW2
ugcuuuuaauaguguu

SEQ ID NO: 4020008 - RNA, 15 nt, Staphylococcus aureus subsp. aureus MW2
ugcuuuuauagauuu

SEQ ID NO: 4020009 - RNA, 17 nt, Staphylococcus aureus subsp. aureus MW2
ugcuuuuauuuuuaaug

SEQ ID NO: 4020010 - RNA, 18 nt, Staphylococcus aureus subsp. aureus MW2
ugcuuuucauuuaauguu

SEQ ID NO: 4020011 - RNA, 13 nt, Staphylococcus aureus subsp. aureus MW2
ugcuuuucgcuuu

SEQ ID NO: 4020012 - RNA, 16 nt, Staphylococcus aureus subsp. aureus MW2
ugcuuuuguuaauauu

SEQ ID NO: 4020013 - RNA, 17 nt, Staphylococcus aureus subsp. aureus MW2
ugcuuuuguuaauauug

SEQ ID NO: 4020014 - RNA, 14 nt, Staphylococcus aureus subsp. aureus MW2
ugcuuuuuagcaua

SEQ ID NO: 4020015 - RNA, 17 nt, Staphylococcus aureus subsp. aureus MW2
ugcuuuuucauaaauau

SEQ ID NO: 4020016 - RNA, 20 nt, Staphylococcus aureus subsp. aureus MW2
ugcuuuuuguguaucuguaa

SEQ ID NO: 4020017 - RNA, 13 nt, Staphylococcus aureus subsp. aureus MW2
ugcuuuuuuaaau

SEQ ID NO: 4020018 - RNA, 21 nt, Staphylococcus aureus subsp. aureus MW2
ugcuuuuuuaaauuuaauuuc

SEQ ID NO: 4020019 - RNA, 13 nt, Staphylococcus aureus subsp. aureus MW2
ugcuuuuuuaaga

SEQ ID NO: 4020020 - RNA, 13 nt, Staphylococcus aureus subsp. aureus MW2
ugcuuuuuuagaa

SEQ ID NO: 4020021 - RNA, 18 nt, Staphylococcus aureus subsp. aureus MW2
ugcuuuuuuauucuaaua

SEQ ID NO: 4020022 - RNA, 15 nt, Staphylococcus aureus subsp. aureus MW2
ugcuuuuuuuacaau

SEQ ID NO: 4020023 - RNA, 18 nt, Staphylococcus aureus subsp. aureus MW2
uggaaaaggucaaaaaau

SEQ ID NO: 4020024 - RNA, 12 nt, Staphylococcus aureus subsp. aureus MW2
uggaaaaucccu

SEQ ID NO: 4020025 - RNA, 22 nt, Staphylococcus aureus subsp. aureus MW2
uggaaaguaauaaguaauaauu

SEQ ID NO: 4020026 - RNA, 19 nt, Staphylococcus aureus subsp. aureus MW2
uggaaaguugguuuuauua

SEQ ID NO: 4020027 - RNA, 13 nt, Staphylococcus aureus subsp. aureus MW2
uggaaauuuauua

SEQ ID NO: 4020028 - RNA, 14 nt, Staphylococcus aureus subsp. aureus MW2
uggaaauuuauuau

SEQ ID NO: 4020029 - RNA, 22 nt, Staphylococcus aureus subsp. aureus MW2
uggaaauuuauuauaaaauaga

SEQ ID NO: 4020030 - RNA, 23 nt, Staphylococcus aureus subsp. aureus MW2
uggaaauuuauuauaaaauagaa

SEQ ID NO: 4020031 - RNA, 17 nt, Staphylococcus aureus subsp. aureus MW2
uggaacaauaaucaaug

SEQ ID NO: 4020032 - RNA, 19 nt, Staphylococcus aureus subsp. aureus MW2
uggaacauuaaguucuuag

SEQ ID NO: 4020033 - RNA, 20 nt, Staphylococcus aureus subsp. aureus MW2
uggaagaaugccuuuuauuu

SEQ ID NO: 4020034 - RNA, 18 nt, Staphylococcus aureus subsp. aureus MW2
uggaaguauauguuacuc

SEQ ID NO: 4020035 - RNA, 17 nt, Staphylococcus aureus subsp. aureus MW2
uggaaguguuuuaaguu

SEQ ID NO: 4020036 - RNA, 14 nt, Staphylococcus aureus subsp. aureus MW2
uggaauaaauuuau

SEQ ID NO: 4020037 - RNA, 15 nt, Staphylococcus aureus subsp. aureus MW2
uggaauaaauuuaua

SEQ ID NO: 4020038 - RNA, 20 nt, Staphylococcus aureus subsp. aureus MW2
uggaauacucuuuaaucuac

SEQ ID NO: 4020039 - RNA, 23 nt, Staphylococcus aureus subsp. aureus MW2
uggaauacucuuuaaucuaccaa

SEQ ID NO: 4020040 - RNA, 15 nt, Staphylococcus aureus subsp. aureus MW2
uggaauacuuuucuu

SEQ ID NO: 4020041 - RNA, 22 nt, Staphylococcus aureus subsp. aureus MW2
uggaaucauuuucuugauuuua

SEQ ID NO: 4020042 - RNA, 22 nt, Staphylococcus aureus subsp. aureus MW2
uggaaugauacgccuaaauauu

SEQ ID NO: 4020043 - RNA, 21 nt, Staphylococcus aureus subsp. aureus MW2
uggaaugguauagauuuuaua

SEQ ID NO: 4020044 - RNA, 14 nt, Staphylococcus aureus subsp. aureus MW2
uggaauuucauaua

SEQ ID NO: 4020045 - RNA, 19 nt, Staphylococcus aureus subsp. aureus MW2
uggacauuguaaaaugcuc

SEQ ID NO: 4020046 - RNA, 20 nt, Staphylococcus aureus subsp. aureus MW2
uggaccucuugaaaaaguua

SEQ ID NO: 4020047 - RNA, 19 nt, Staphylococcus aureus subsp. aureus MW2
uggacgcggguucaaaucc

SEQ ID NO: 4020048 - RNA, 17 nt, Staphylococcus aureus subsp. aureus MW2
uggacuaacgucauuau

SEQ ID NO: 4020049 - RNA, 22 nt, Staphylococcus aureus subsp. aureus MW2
uggacuaauaauuguccaugcc

SEQ ID NO: 4020050 - RNA, 19 nt, Staphylococcus aureus subsp. aureus MW2
uggacuccaucgcaacuga

SEQ ID NO: 4020051 - RNA, 14 nt, Staphylococcus aureus subsp. aureus MW2
uggacuucuaucuu

SEQ ID NO: 4020052 - RNA, 17 nt, Staphylococcus aureus subsp. aureus MW2
uggacuucuaucuucac

SEQ ID NO: 4020053 - RNA, 22 nt, Staphylococcus aureus subsp. aureus MW2
uggagauucucgguuuuuucgg

SEQ ID NO: 4020054 - RNA, 22 nt, Staphylococcus aureus subsp. aureus MW2
uggagcaacgauaccaaauaua

SEQ ID NO: 4020055 - RNA, 19 nt, Staphylococcus aureus subsp. aureus MW2
uggagccucuuguucuccg

SEQ ID NO: 4020056 - RNA, 18 nt, Staphylococcus aureus subsp. aureus MW2
uggagguccauaaucuuu

SEQ ID NO: 4020057 - RNA, 16 nt, Staphylococcus aureus subsp. aureus MW2
uggauaaauaaagauu

SEQ ID NO: 4020058 - RNA, 14 nt, Staphylococcus aureus subsp. aureus MW2
uggauaauccuuuu

SEQ ID NO: 4020059 - RNA, 15 nt, Staphylococcus aureus subsp. aureus MW2
uggauaauccuuuuu

SEQ ID NO: 4020060 - RNA, 17 nt, Staphylococcus aureus subsp. aureus MW2
uggauaauccuuuuuua

SEQ ID NO: 4020061 - RNA, 24 nt, Staphylococcus aureus subsp. aureus MW2
uggauagguaacuaaaaugucuuu

SEQ ID NO: 4020062 - RNA, 21 nt, Staphylococcus aureus subsp. aureus MW2
uggauaugcguauauguauaa

SEQ ID NO: 4020063 - RNA, 16 nt, Staphylococcus aureus subsp. aureus MW2
uggaucacgauaaugu

SEQ ID NO: 4020064 - RNA, 13 nt, Staphylococcus aureus subsp. aureus MW2
uggaucuguuaca

SEQ ID NO: 4020065 - RNA, 22 nt, Staphylococcus aureus subsp. aureus MW2
uggaugaauccuuuaccguguu

SEQ ID NO: 4020066 - RNA, 18 nt, Staphylococcus aureus subsp. aureus MW2
uggaugucaugucuagau

SEQ ID NO: 4020067 - RNA, 24 nt, Staphylococcus aureus subsp. aureus MW2
uggauuaaauacgccaaauacuag

SEQ ID NO: 4020068 - RNA, 17 nt, Staphylococcus aureus subsp. aureus MW2
uggauuaccguuaaaaa

SEQ ID NO: 4020069 - RNA, 17 nt, Staphylococcus aureus subsp. aureus MW2
uggauucaaaugacauu

SEQ ID NO: 4020070 - RNA, 22 nt, Staphylococcus aureus subsp. aureus MW2
uggauucaaaugacauuuuaaa

SEQ ID NO: 4020071 - RNA, 16 nt, Staphylococcus aureus subsp. aureus MW2
uggauuucuuuuuaaa

SEQ ID NO: 4020072 - RNA, 15 nt, Staphylococcus aureus subsp. aureus MW2
uggauuuuaauuauu

SEQ ID NO: 4020073 - RNA, 20 nt, Staphylococcus aureus subsp. aureus MW2
uggauuuuauuuucaaaugu

SEQ ID NO: 4020074 - RNA, 13 nt, Staphylococcus aureus subsp. aureus MW2
uggauuuuucuua

SEQ ID NO: 4020075 - RNA, 20 nt, Staphylococcus aureus subsp. aureus MW2
uggauuuuucuuauaaaaau

SEQ ID NO: 4020076 - RNA, 14 nt, Staphylococcus aureus subsp. aureus MW2
uggauuuuuuggau

SEQ ID NO: 4020077 - RNA, 14 nt, Staphylococcus aureus subsp. aureus MW2
uggcaaaucaaaca

SEQ ID NO: 4020078 - RNA, 20 nt, Staphylococcus aureus subsp. aureus MW2
uggcaauauacuuuuuaaau

SEQ ID NO: 4020079 - RNA, 14 nt, Staphylococcus aureus subsp. aureus MW2
uggcacaaaugcua

SEQ ID NO: 4020080 - RNA, 16 nt, Staphylococcus aureus subsp. aureus MW2
uggcacaaaugcuaca

SEQ ID NO: 4020081 - RNA, 23 nt, Staphylococcus aureus subsp. aureus MW2
uggcaccacauacauaucuuuug

SEQ ID NO: 4020082 - RNA, 11 nt, Staphylococcus aureus subsp. aureus MW2
uggcaccagua

SEQ ID NO: 4020083 - RNA, 15 nt, Staphylococcus aureus subsp. aureus MW2
uggcacugcaaucag

SEQ ID NO: 4020084 - RNA, 14 nt, Staphylococcus aureus subsp. aureus MW2
uggcaguucugaaa

SEQ ID NO: 4020085 - RNA, 16 nt, Staphylococcus aureus subsp. aureus MW2
uggcauaaccuguaau

SEQ ID NO: 4020086 - RNA, 18 nt, Staphylococcus aureus subsp. aureus MW2
uggcauaaccuguuuuua

SEQ ID NO: 4020087 - RNA, 13 nt, Staphylococcus aureus subsp. aureus MW2
uggcauaauaaua

SEQ ID NO: 4020088 - RNA, 19 nt, Staphylococcus aureus subsp. aureus MW2
uggcauaucgauaaaugua

SEQ ID NO: 4020089 - RNA, 23 nt, Staphylococcus aureus subsp. aureus MW2
uggccaaacaaccugugauaaaa

SEQ ID NO: 4020090 - RNA, 19 nt, Staphylococcus aureus subsp. aureus MW2
uggccaaccaccauaugcu

SEQ ID NO: 4020091 - RNA, 18 nt, Staphylococcus aureus subsp. aureus MW2
uggccuacuuuuucaaua

SEQ ID NO: 4020092 - RNA, 13 nt, Staphylococcus aureus subsp. aureus MW2
uggccuuuuaaac

SEQ ID NO: 4020093 - RNA, 14 nt, Staphylococcus aureus subsp. aureus MW2
uggccuuuuaaaca

SEQ ID NO: 4020094 - RNA, 15 nt, Staphylococcus aureus subsp. aureus MW2
uggccuuuuaaacaa

SEQ ID NO: 4020095 - RNA, 14 nt, Staphylococcus aureus subsp. aureus MW2
uggcgaggccccaa

SEQ ID NO: 4020096 - RNA, 18 nt, Staphylococcus aureus subsp. aureus MW2
uggcggaaagucagcuua

SEQ ID NO: 4020097 - RNA, 18 nt, Staphylococcus aureus subsp. aureus MW2
uggcggggcccaaacaua

SEQ ID NO: 4020098 - RNA, 21 nt, Staphylococcus aureus subsp. aureus MW2
uggcggggccccaacaaagaa

SEQ ID NO: 4020099 - RNA, 18 nt, Staphylococcus aureus subsp. aureus MW2
uggcuacuugaauaccuu

SEQ ID NO: 4020100 - RNA, 15 nt, Staphylococcus aureus subsp. aureus MW2
uggcucuuuuuauuu

SEQ ID NO: 4020101 - RNA, 21 nt, Staphylococcus aureus subsp. aureus MW2
uggcuuagguuuaauuuuaaa

SEQ ID NO: 4020102 - RNA, 19 nt, Staphylococcus aureus subsp. aureus MW2
uggcuugaaguuguuucuc

SEQ ID NO: 4020103 - RNA, 21 nt, Staphylococcus aureus subsp. aureus MW2
uggcuuuuuaauuguuuaaua

SEQ ID NO: 4020104 - RNA, 21 nt, Staphylococcus aureus subsp. aureus MW2
uggcuuuuuauaccaauaauu

SEQ ID NO: 4020105 - RNA, 14 nt, Staphylococcus aureus subsp. aureus MW2
uggcuuuuuuaauu

SEQ ID NO: 4020106 - RNA, 18 nt, Staphylococcus aureus subsp. aureus MW2
uggcuuuuuuauuuuaua

SEQ ID NO: 4020107 - RNA, 19 nt, Staphylococcus aureus subsp. aureus MW2
uggcuuuuuuuauggugug

SEQ ID NO: 4020108 - RNA, 17 nt, Staphylococcus aureus subsp. aureus MW2
ugggaauuguauuagca

SEQ ID NO: 4020109 - RNA, 18 nt, Staphylococcus aureus subsp. aureus MW2
ugggacagaaaacaaagc

SEQ ID NO: 4020110 - RNA, 17 nt, Staphylococcus aureus subsp. aureus MW2
ugggauaauuuguauua

SEQ ID NO: 4020111 - RNA, 19 nt, Staphylococcus aureus subsp. aureus MW2
ugggauaauuuguauuaua

SEQ ID NO: 4020112 - RNA, 20 nt, Staphylococcus aureus subsp. aureus MW2
ugggauuuuuucguuuuaau

SEQ ID NO: 4020113 - RNA, 21 nt, Staphylococcus aureus subsp. aureus MW2
ugggcauuacagguagaugua

SEQ ID NO: 4020114 - RNA, 16 nt, Staphylococcus aureus subsp. aureus MW2
ugggccccaacacaga

SEQ ID NO: 4020115 - RNA, 17 nt, Staphylococcus aureus subsp. aureus MW2
ugggccccaacacagag

SEQ ID NO: 4020116 - RNA, 12 nt, Staphylococcus aureus subsp. aureus MW2
ugggcugacauu

SEQ ID NO: 4020117 - RNA, 18 nt, Staphylococcus aureus subsp. aureus MW2
uggggagccaauuucuac

SEQ ID NO: 4020118 - RNA, 23 nt, Staphylococcus aureus subsp. aureus MW2
uggggugagggccccaacacaga

SEQ ID NO: 4020119 - RNA, 18 nt, Staphylococcus aureus subsp. aureus MW2
uggguaagguuuuacaau

SEQ ID NO: 4020120 - RNA, 12 nt, Staphylococcus aureus subsp. aureus MW2
uggguaaucuuu

SEQ ID NO: 4020121 - RNA, 15 nt, Staphylococcus aureus subsp. aureus MW2
uggguaauguuuuua

SEQ ID NO: 4020122 - RNA, 12 nt, Staphylococcus aureus subsp. aureus MW2
ugggucuuuauc

SEQ ID NO: 4020123 - RNA, 20 nt, Staphylococcus aureus subsp. aureus MW2
uggguguuuuuuuuauuaau

SEQ ID NO: 4020124 - RNA, 18 nt, Staphylococcus aureus subsp. aureus MW2
ugguaaaaaaauaacguu

SEQ ID NO: 4020125 - RNA, 15 nt, Staphylococcus aureus subsp. aureus MW2
ugguaaaaaguuuaa

SEQ ID NO: 4020126 - RNA, 15 nt, Staphylococcus aureus subsp. aureus MW2
ugguaacguucuacu

SEQ ID NO: 4020127 - RNA, 19 nt, Staphylococcus aureus subsp. aureus MW2
ugguaagcuuagaaacgaa

SEQ ID NO: 4020128 - RNA, 15 nt, Staphylococcus aureus subsp. aureus MW2
ugguaauuuaacaac

SEQ ID NO: 4020129 - RNA, 15 nt, Staphylococcus aureus subsp. aureus MW2
ugguacauaaagcuu

SEQ ID NO: 4020130 - RNA, 23 nt, Staphylococcus aureus subsp. aureus MW2
ugguacauaaagcuuugacauau

SEQ ID NO: 4020131 - RNA, 15 nt, Staphylococcus aureus subsp. aureus MW2
ugguagagauagcau

SEQ ID NO: 4020132 - RNA, 13 nt, Staphylococcus aureus subsp. aureus MW2
ugguagcauuuua

SEQ ID NO: 4020133 - RNA, 16 nt, Staphylococcus aureus subsp. aureus MW2
ugguagcauuuuagau

SEQ ID NO: 4020134 - RNA, 17 nt, Staphylococcus aureus subsp. aureus MW2
ugguagcauuuuagauu

SEQ ID NO: 4020135 - RNA, 15 nt, Staphylococcus aureus subsp. aureus MW2
ugguauaacaauuuu

SEQ ID NO: 4020136 - RNA, 17 nt, Staphylococcus aureus subsp. aureus MW2
ugguauaucgaaaggua

SEQ ID NO: 4020137 - RNA, 20 nt, Staphylococcus aureus subsp. aureus MW2
ugguaugacugcaaauacga

SEQ ID NO: 4020138 - RNA, 13 nt, Staphylococcus aureus subsp. aureus MW2
ugguauuauucuu

SEQ ID NO: 4020139 - RNA, 18 nt, Staphylococcus aureus subsp. aureus MW2
ugguauucgcaucauucc

SEQ ID NO: 4020140 - RNA, 18 nt, Staphylococcus aureus subsp. aureus MW2
ugguauugauuauucuuu

SEQ ID NO: 4020141 - RNA, 14 nt, Staphylococcus aureus subsp. aureus MW2
ugguauuuuuuaaa

SEQ ID NO: 4020142 - RNA, 16 nt, Staphylococcus aureus subsp. aureus MW2
uggucaacuuuuuuaa

SEQ ID NO: 4020143 - RNA, 20 nt, Staphylococcus aureus subsp. aureus MW2
uggucuaaagcuuauuaaau

SEQ ID NO: 4020144 - RNA, 20 nt, Staphylococcus aureus subsp. aureus MW2
uggucuuuuaauuaaaagug

SEQ ID NO: 4020145 - RNA, 21 nt, Staphylococcus aureus subsp. aureus MW2
uggugacacugcuuuuaaauc

SEQ ID NO: 4020146 - RNA, 16 nt, Staphylococcus aureus subsp. aureus MW2
uggugagaaauugaau

SEQ ID NO: 4020147 - RNA, 15 nt, Staphylococcus aureus subsp. aureus MW2
uggugcccaaguuuc

SEQ ID NO: 4020148 - RNA, 23 nt, Staphylococcus aureus subsp. aureus MW2
uggugcccaaguuucauggggcu

SEQ ID NO: 4020149 - RNA, 17 nt, Staphylococcus aureus subsp. aureus MW2
uggugcuauuaauuuga

SEQ ID NO: 4020150 - RNA, 15 nt, Staphylococcus aureus subsp. aureus MW2
ugguggaugucaugu

SEQ ID NO: 4020151 - RNA, 20 nt, Staphylococcus aureus subsp. aureus MW2
uggugugccggcuuuuucuu

SEQ ID NO: 4020152 - RNA, 19 nt, Staphylococcus aureus subsp. aureus MW2
ugguuaacaucuucaugua

SEQ ID NO: 4020153 - RNA, 14 nt, Staphylococcus aureus subsp. aureus MW2
ugguuaucuaaaau

SEQ ID NO: 4020154 - RNA, 21 nt, Staphylococcus aureus subsp. aureus MW2
ugguuauuuccguuuuagaau

SEQ ID NO: 4020155 - RNA, 14 nt, Staphylococcus aureus subsp. aureus MW2
ugguucaaaaauca

SEQ ID NO: 4020156 - RNA, 16 nt, Staphylococcus aureus subsp. aureus MW2
ugguucaaaaaucaua

SEQ ID NO: 4020157 - RNA, 13 nt, Staphylococcus aureus subsp. aureus MW2
ugguucaaauauc

SEQ ID NO: 4020158 - RNA, 15 nt, Staphylococcus aureus subsp. aureus MW2
ugguucaaauaucau

SEQ ID NO: 4020159 - RNA, 16 nt, Staphylococcus aureus subsp. aureus MW2
ugguucaucaaacaac

SEQ ID NO: 4020160 - RNA, 11 nt, Staphylococcus aureus subsp. aureus MW2
ugguucccaau

SEQ ID NO: 4020161 - RNA, 17 nt, Staphylococcus aureus subsp. aureus MW2
ugguucugauguuuuau

SEQ ID NO: 4020162 - RNA, 18 nt, Staphylococcus aureus subsp. aureus MW2
ugguucugauguuuuaua

SEQ ID NO: 4020163 - RNA, 19 nt, Staphylococcus aureus subsp. aureus MW2
ugguucugauguuuuauaa

SEQ ID NO: 4020164 - RNA, 21 nt, Staphylococcus aureus subsp. aureus MW2
ugguucuucacuaaaaauaua

SEQ ID NO: 4020165 - RNA, 19 nt, Staphylococcus aureus subsp. aureus MW2
ugguugauucgauaugaau

SEQ ID NO: 4020166 - RNA, 20 nt, Staphylococcus aureus subsp. aureus MW2
ugguuuaaugagcuuuucua

SEQ ID NO: 4020167 - RNA, 22 nt, Staphylococcus aureus subsp. aureus MW2
ugguuuaauugcaaaugcucua

SEQ ID NO: 4020168 - RNA, 19 nt, Staphylococcus aureus subsp. aureus MW2
ugguuuaccuaguuuuacu

SEQ ID NO: 4020169 - RNA, 19 nt, Staphylococcus aureus subsp. aureus MW2
ugguuuaucagcuuuaaua

SEQ ID NO: 4020170 - RNA, 14 nt, Staphylococcus aureus subsp. aureus MW2
ugguuuauuuuaau

SEQ ID NO: 4020171 - RNA, 17 nt, Staphylococcus aureus subsp. aureus MW2
ugguuucaaaaucaauu

SEQ ID NO: 4020172 - RNA, 18 nt, Staphylococcus aureus subsp. aureus MW2
ugguuucauaaacugaau

SEQ ID NO: 4020173 - RNA, 17 nt, Staphylococcus aureus subsp. aureus MW2
ugguuuggauaaaauga

SEQ ID NO: 4020174 - RNA, 23 nt, Staphylococcus aureus subsp. aureus MW2
ugguuuuauuugauuauucuuca

SEQ ID NO: 4020175 - RNA, 23 nt, Staphylococcus aureus subsp. aureus MW2
uguaaaaaagcugauuucuauua

SEQ ID NO: 4020176 - RNA, 16 nt, Staphylococcus aureus subsp. aureus MW2
uguaaaaaauaucuug

SEQ ID NO: 4020177 - RNA, 16 nt, Staphylococcus aureus subsp. aureus MW2
uguaaaaacguucaau

SEQ ID NO: 4020178 - RNA, 23 nt, Staphylococcus aureus subsp. aureus MW2
uguaaaaugaugauuuaaagcaa

SEQ ID NO: 4020179 - RNA, 21 nt, Staphylococcus aureus subsp. aureus MW2
uguaaaccagcuaaaccaucu

SEQ ID NO: 4020180 - RNA, 17 nt, Staphylococcus aureus subsp. aureus MW2
uguaaagccaccuaaau

SEQ ID NO: 4020181 - RNA, 21 nt, Staphylococcus aureus subsp. aureus MW2
uguaaagcuaauuuuuuauuu

SEQ ID NO: 4020182 - RNA, 20 nt, Staphylococcus aureus subsp. aureus MW2
uguaaagcuuuaguuaaaua

SEQ ID NO: 4020183 - RNA, 13 nt, Staphylococcus aureus subsp. aureus MW2
uguaaaguugaua

SEQ ID NO: 4020184 - RNA, 21 nt, Staphylococcus aureus subsp. aureus MW2
uguaaauaaaaauuauauaaa

SEQ ID NO: 4020185 - RNA, 14 nt, Staphylococcus aureus subsp. aureus MW2
uguaaauauaguaa

SEQ ID NO: 4020186 - RNA, 17 nt, Staphylococcus aureus subsp. aureus MW2
uguaaaucacgauuuuc

SEQ ID NO: 4020187 - RNA, 18 nt, Staphylococcus aureus subsp. aureus MW2
uguaaauccuccauuuaa

SEQ ID NO: 4020188 - RNA, 15 nt, Staphylococcus aureus subsp. aureus MW2
uguaaaugaaagcac

SEQ ID NO: 4020189 - RNA, 23 nt, Staphylococcus aureus subsp. aureus MW2
uguaaaugaaagcaccuaaaaua

SEQ ID NO: 4020190 - RNA, 14 nt, Staphylococcus aureus subsp. aureus MW2
uguaaauuacaaaa

SEQ ID NO: 4020191 - RNA, 20 nt, Staphylococcus aureus subsp. aureus MW2
uguaacaaaauacccugcuu

SEQ ID NO: 4020192 - RNA, 18 nt, Staphylococcus aureus subsp. aureus MW2
uguaacacacuuauaauc

SEQ ID NO: 4020193 - RNA, 21 nt, Staphylococcus aureus subsp. aureus MW2
uguaacagugugaaauaauaa

SEQ ID NO: 4020194 - RNA, 22 nt, Staphylococcus aureus subsp. aureus MW2
uguaacauaaagcuguuuauug

SEQ ID NO: 4020195 - RNA, 14 nt, Staphylococcus aureus subsp. aureus MW2
uguaaccaccugau

SEQ ID NO: 4020196 - RNA, 16 nt, Staphylococcus aureus subsp. aureus MW2
uguaaccuaaaaacaa

SEQ ID NO: 4020197 - RNA, 21 nt, Staphylococcus aureus subsp. aureus MW2
uguaacgugaggcccauaaau

SEQ ID NO: 4020198 - RNA, 13 nt, Staphylococcus aureus subsp. aureus MW2
uguaacguucuua

SEQ ID NO: 4020199 - RNA, 18 nt, Staphylococcus aureus subsp. aureus MW2
uguaacucaauaugaaac

SEQ ID NO: 4020200 - RNA, 21 nt, Staphylococcus aureus subsp. aureus MW2
uguaacucuauccaaagacau

SEQ ID NO: 4020201 - RNA, 18 nt, Staphylococcus aureus subsp. aureus MW2
uguaacuugucuuuuuua

SEQ ID NO: 4020202 - RNA, 19 nt, Staphylococcus aureus subsp. aureus MW2
uguaagcuaucguaaacaa

SEQ ID NO: 4020203 - RNA, 20 nt, Staphylococcus aureus subsp. aureus MW2
uguaagucgcucuagacauu

SEQ ID NO: 4020204 - RNA, 18 nt, Staphylococcus aureus subsp. aureus MW2
uguaauaaagaauaaaca

SEQ ID NO: 4020205 - RNA, 12 nt, Staphylococcus aureus subsp. aureus MW2
uguaauaaagca

SEQ ID NO: 4020206 - RNA, 16 nt, Staphylococcus aureus subsp. aureus MW2
uguaauaauaaucuuu

SEQ ID NO: 4020207 - RNA, 18 nt, Staphylococcus aureus subsp. aureus MW2
uguaauaauaucaccuuu

SEQ ID NO: 4020208 - RNA, 22 nt, Staphylococcus aureus subsp. aureus MW2
uguaauaauaucaccuuuuuua

SEQ ID NO: 4020209 - RNA, 15 nt, Staphylococcus aureus subsp. aureus MW2
uguaauacaucuaau

SEQ ID NO: 4020210 - RNA, 19 nt, Staphylococcus aureus subsp. aureus MW2
uguaauacaugacauucau

SEQ ID NO: 4020211 - RNA, 21 nt, Staphylococcus aureus subsp. aureus MW2
uguaauaccaauuuuuagcau

SEQ ID NO: 4020212 - RNA, 22 nt, Staphylococcus aureus subsp. aureus MW2
uguaauaccuuuacuuucauua

SEQ ID NO: 4020213 - RNA, 19 nt, Staphylococcus aureus subsp. aureus MW2
uguaauauaacaaguauaa

SEQ ID NO: 4020214 - RNA, 19 nt, Staphylococcus aureus subsp. aureus MW2
uguaauauauuaauauuga

SEQ ID NO: 4020215 - RNA, 17 nt, Staphylococcus aureus subsp. aureus MW2
uguaauaucuaaagauu

SEQ ID NO: 4020216 - RNA, 21 nt, Staphylococcus aureus subsp. aureus MW2
uguaaucacuucugaaaauaa

SEQ ID NO: 4020217 - RNA, 16 nt, Staphylococcus aureus subsp. aureus MW2
uguaauccuugagcuc

SEQ ID NO: 4020218 - RNA, 22 nt, Staphylococcus aureus subsp. aureus MW2
uguaaugaguaggcucuuaaug

SEQ ID NO: 4020219 - RNA, 18 nt, Staphylococcus aureus subsp. aureus MW2
uguaaugcacuaccauca

SEQ ID NO: 4020220 - RNA, 21 nt, Staphylococcus aureus subsp. aureus MW2
uguaaugcacuaccaucagua

SEQ ID NO: 4020221 - RNA, 15 nt, Staphylococcus aureus subsp. aureus MW2
uguaaugcuuaaaaa

SEQ ID NO: 4020222 - RNA, 18 nt, Staphylococcus aureus subsp. aureus MW2
uguaaugcuuaaaaacaa

SEQ ID NO: 4020223 - RNA, 23 nt, Staphylococcus aureus subsp. aureus MW2
uguaaugucucuuuucacgaaua

SEQ ID NO: 4020224 - RNA, 20 nt, Staphylococcus aureus subsp. aureus MW2
uguaauuaauacaucaauau

SEQ ID NO: 4020225 - RNA, 13 nt, Staphylococcus aureus subsp. aureus MW2
uguaauuaggauu

SEQ ID NO: 4020226 - RNA, 18 nt, Staphylococcus aureus subsp. aureus MW2
uguaauuauugcaucaua

SEQ ID NO: 4020227 - RNA, 20 nt, Staphylococcus aureus subsp. aureus MW2
uguaauuauugcaucauaau

SEQ ID NO: 4020228 - RNA, 22 nt, Staphylococcus aureus subsp. aureus MW2
uguaauucuuguaaaucauagu

SEQ ID NO: 4020229 - RNA, 15 nt, Staphylococcus aureus subsp. aureus MW2
uguaauugaaaugau

SEQ ID NO: 4020230 - RNA, 17 nt, Staphylococcus aureus subsp. aureus MW2
uguacaaucauuaguca

SEQ ID NO: 4020231 - RNA, 22 nt, Staphylococcus aureus subsp. aureus MW2
uguacacuaucguuuuuauuau

SEQ ID NO: 4020232 - RNA, 14 nt, Staphylococcus aureus subsp. aureus MW2
uguacauaaaaaua

SEQ ID NO: 4020233 - RNA, 15 nt, Staphylococcus aureus subsp. aureus MW2
uguacauaaaaauaa

SEQ ID NO: 4020234 - RNA, 14 nt, Staphylococcus aureus subsp. aureus MW2
uguacauaugugua

SEQ ID NO: 4020235 - RNA, 14 nt, Staphylococcus aureus subsp. aureus MW2
uguacaucauuaaa

SEQ ID NO: 4020236 - RNA, 17 nt, Staphylococcus aureus subsp. aureus MW2
uguacaucauuaaauau

SEQ ID NO: 4020237 - RNA, 16 nt, Staphylococcus aureus subsp. aureus MW2
uguacauugguuuuua

SEQ ID NO: 4020238 - RNA, 16 nt, Staphylococcus aureus subsp. aureus MW2
uguacauuguaaauau

SEQ ID NO: 4020239 - RNA, 13 nt, Staphylococcus aureus subsp. aureus MW2
uguaccaaauuug

SEQ ID NO: 4020240 - RNA, 14 nt, Staphylococcus aureus subsp. aureus MW2
uguaccaucaauaa

SEQ ID NO: 4020241 - RNA, 16 nt, Staphylococcus aureus subsp. aureus MW2
uguaccgaauccuuca

SEQ ID NO: 4020242 - RNA, 16 nt, Staphylococcus aureus subsp. aureus MW2
uguaccuuuuuauuga

SEQ ID NO: 4020243 - RNA, 15 nt, Staphylococcus aureus subsp. aureus MW2
uguacguuuuuuuaa

SEQ ID NO: 4020244 - RNA, 16 nt, Staphylococcus aureus subsp. aureus MW2
uguacguuuuuuuaaa

SEQ ID NO: 4020245 - RNA, 16 nt, Staphylococcus aureus subsp. aureus MW2
uguacuacuugauucu

SEQ ID NO: 4020246 - RNA, 19 nt, Staphylococcus aureus subsp. aureus MW2
uguacuuaaaccuaacaua

SEQ ID NO: 4020247 - RNA, 20 nt, Staphylococcus aureus subsp. aureus MW2
uguacuuaaaccuaacauaa

SEQ ID NO: 4020248 - RNA, 22 nt, Staphylococcus aureus subsp. aureus MW2
uguacuuaaaccuaacauaacu

SEQ ID NO: 4020249 - RNA, 15 nt, Staphylococcus aureus subsp. aureus MW2
uguacuucuuugguc

SEQ ID NO: 4020250 - RNA, 12 nt, Staphylococcus aureus subsp. aureus MW2
uguagagaugug

SEQ ID NO: 4020251 - RNA, 22 nt, Staphylococcus aureus subsp. aureus MW2
uguaguaguuccguugaauuaa

SEQ ID NO: 4020252 - RNA, 18 nt, Staphylococcus aureus subsp. aureus MW2
uguaguuaagauaccuuu

SEQ ID NO: 4020253 - RNA, 22 nt, Staphylococcus aureus subsp. aureus MW2
uguauaaaaaccaguuugauua

SEQ ID NO: 4020254 - RNA, 14 nt, Staphylococcus aureus subsp. aureus MW2
uguauaaaaaugua

SEQ ID NO: 4020255 - RNA, 17 nt, Staphylococcus aureus subsp. aureus MW2
uguauaaaaauguauua

SEQ ID NO: 4020256 - RNA, 16 nt, Staphylococcus aureus subsp. aureus MW2
uguauaaaacagaauu

SEQ ID NO: 4020257 - RNA, 15 nt, Staphylococcus aureus subsp. aureus MW2
uguauaacgcuuugu

SEQ ID NO: 4020258 - RNA, 14 nt, Staphylococcus aureus subsp. aureus MW2
uguauaauacauga

SEQ ID NO: 4020259 - RNA, 16 nt, Staphylococcus aureus subsp. aureus MW2
uguauaccuauuccua

SEQ ID NO: 4020260 - RNA, 17 nt, Staphylococcus aureus subsp. aureus MW2
uguauaccuauuccuau

SEQ ID NO: 4020261 - RNA, 17 nt, Staphylococcus aureus subsp. aureus MW2
uguauagauuguauuua

SEQ ID NO: 4020262 - RNA, 20 nt, Staphylococcus aureus subsp. aureus MW2
uguauagauuguauuuaaua

SEQ ID NO: 4020263 - RNA, 20 nt, Staphylococcus aureus subsp. aureus MW2
uguauagcuggcuuuuuaau

SEQ ID NO: 4020264 - RNA, 20 nt, Staphylococcus aureus subsp. aureus MW2
uguauaguaacgcauaugau

SEQ ID NO: 4020265 - RNA, 22 nt, Staphylococcus aureus subsp. aureus MW2
uguauauccauucuuuuucaaa

SEQ ID NO: 4020266 - RNA, 15 nt, Staphylococcus aureus subsp. aureus MW2
uguauaucuguauaa

SEQ ID NO: 4020267 - RNA, 20 nt, Staphylococcus aureus subsp. aureus MW2
uguauaugaauuuuauaaau

SEQ ID NO: 4020268 - RNA, 15 nt, Staphylococcus aureus subsp. aureus MW2
uguauauggcauuaa

SEQ ID NO: 4020269 - RNA, 13 nt, Staphylococcus aureus subsp. aureus MW2
uguaucaaagucu

SEQ ID NO: 4020270 - RNA, 19 nt, Staphylococcus aureus subsp. aureus MW2
uguaucaaggucaacaaug

SEQ ID NO: 4020271 - RNA, 22 nt, Staphylococcus aureus subsp. aureus MW2
uguaucaucauaaucaagaaua

SEQ ID NO: 4020272 - RNA, 21 nt, Staphylococcus aureus subsp. aureus MW2
uguaucucugaaaaacuucuu

SEQ ID NO: 4020273 - RNA, 20 nt, Staphylococcus aureus subsp. aureus MW2
uguaucuuugauaacuugua

SEQ ID NO: 4020274 - RNA, 18 nt, Staphylococcus aureus subsp. aureus MW2
uguaugagucuuuuugau

SEQ ID NO: 4020275 - RNA, 19 nt, Staphylococcus aureus subsp. aureus MW2
uguaugagucuuuuugauu

SEQ ID NO: 4020276 - RNA, 21 nt, Staphylococcus aureus subsp. aureus MW2
uguaugagucuuuuugauuaa

SEQ ID NO: 4020277 - RNA, 20 nt, Staphylococcus aureus subsp. aureus MW2
uguaugauaaccauuaugau

SEQ ID NO: 4020278 - RNA, 12 nt, Staphylococcus aureus subsp. aureus MW2
uguaugcauaua

SEQ ID NO: 4020279 - RNA, 22 nt, Staphylococcus aureus subsp. aureus MW2
uguauggaaaguugguuuuauu

SEQ ID NO: 4020280 - RNA, 21 nt, Staphylococcus aureus subsp. aureus MW2
uguaugggauaauuuguauua

SEQ ID NO: 4020281 - RNA, 21 nt, Staphylococcus aureus subsp. aureus MW2
uguauguaagcagacuaaaag

SEQ ID NO: 4020282 - RNA, 15 nt, Staphylococcus aureus subsp. aureus MW2
uguauguugaaagug

SEQ ID NO: 4020283 - RNA, 19 nt, Staphylococcus aureus subsp. aureus MW2
uguauuaaucaaauauuuu

SEQ ID NO: 4020284 - RNA, 13 nt, Staphylococcus aureus subsp. aureus MW2
uguauuauuauua

SEQ ID NO: 4020285 - RNA, 23 nt, Staphylococcus aureus subsp. aureus MW2
uguauuauucucucauuuguaua

SEQ ID NO: 4020286 - RNA, 21 nt, Staphylococcus aureus subsp. aureus MW2
uguauuauugaaacuaauaau

SEQ ID NO: 4020287 - RNA, 17 nt, Staphylococcus aureus subsp. aureus MW2
uguauucagucaguaaa

SEQ ID NO: 4020288 - RNA, 18 nt, Staphylococcus aureus subsp. aureus MW2
uguauucauuuuaaauuu

SEQ ID NO: 4020289 - RNA, 21 nt, Staphylococcus aureus subsp. aureus MW2
uguauucgcuuacauuaugaa

SEQ ID NO: 4020290 - RNA, 17 nt, Staphylococcus aureus subsp. aureus MW2
uguauucugaaacuuua

SEQ ID NO: 4020291 - RNA, 19 nt, Staphylococcus aureus subsp. aureus MW2
uguauucugaaacuuuaau

SEQ ID NO: 4020292 - RNA, 16 nt, Staphylococcus aureus subsp. aureus MW2
uguauucuuagauauu

SEQ ID NO: 4020293 - RNA, 18 nt, Staphylococcus aureus subsp. aureus MW2
uguauucuucuaauucug

SEQ ID NO: 4020294 - RNA, 19 nt, Staphylococcus aureus subsp. aureus MW2
uguauucuuggcguauuuu

SEQ ID NO: 4020295 - RNA, 17 nt, Staphylococcus aureus subsp. aureus MW2
uguauuguauuuuaaug

SEQ ID NO: 4020296 - RNA, 19 nt, Staphylococcus aureus subsp. aureus MW2
uguauuguuuguuuuuaua

SEQ ID NO: 4020297 - RNA, 12 nt, Staphylococcus aureus subsp. aureus MW2
uguauuuaaaau

SEQ ID NO: 4020298 - RNA, 14 nt, Staphylococcus aureus subsp. aureus MW2
uguauuuaauaagu

SEQ ID NO: 4020299 - RNA, 12 nt, Staphylococcus aureus subsp. aureus MW2
uguauuuauuac

SEQ ID NO: 4020300 - RNA, 18 nt, Staphylococcus aureus subsp. aureus MW2
uguauuuauuuuuuuaaa

SEQ ID NO: 4020301 - RNA, 20 nt, Staphylococcus aureus subsp. aureus MW2
uguauuuuagcgucauuuuu

SEQ ID NO: 4020302 - RNA, 21 nt, Staphylococcus aureus subsp. aureus MW2
uguauuuuagcgucauuuuua

SEQ ID NO: 4020303 - RNA, 13 nt, Staphylococcus aureus subsp. aureus MW2
uguauuuuuauuu

SEQ ID NO: 4020304 - RNA, 14 nt, Staphylococcus aureus subsp. aureus MW2
uguauuuuucaaau

SEQ ID NO: 4020305 - RNA, 12 nt, Staphylococcus aureus subsp. aureus MW2
uguauuuuucau

SEQ ID NO: 4020306 - RNA, 13 nt, Staphylococcus aureus subsp. aureus MW2
uguauuuuucuua

SEQ ID NO: 4020307 - RNA, 22 nt, Staphylococcus aureus subsp. aureus MW2
ugucaauaaauuguuuacuaua

SEQ ID NO: 4020308 - RNA, 20 nt, Staphylococcus aureus subsp. aureus MW2
ugucacuaauggauaugaua

SEQ ID NO: 4020309 - RNA, 13 nt, Staphylococcus aureus subsp. aureus MW2
ugucauaauccau

SEQ ID NO: 4020310 - RNA, 11 nt, Staphylococcus aureus subsp. aureus MW2
ugucauaccuu

SEQ ID NO: 4020311 - RNA, 17 nt, Staphylococcus aureus subsp. aureus MW2
ugucauaccuuuuaauu

SEQ ID NO: 4020312 - RNA, 19 nt, Staphylococcus aureus subsp. aureus MW2
ugucauaguauacauaauu

SEQ ID NO: 4020313 - RNA, 20 nt, Staphylococcus aureus subsp. aureus MW2
ugucauaguauacauaauuc

SEQ ID NO: 4020314 - RNA, 15 nt, Staphylococcus aureus subsp. aureus MW2
ugucaucauguucua

SEQ ID NO: 4020315 - RNA, 18 nt, Staphylococcus aureus subsp. aureus MW2
ugucaucauguucuaaug

SEQ ID NO: 4020316 - RNA, 16 nt, Staphylococcus aureus subsp. aureus MW2
ugucaucgcuuuaauu

SEQ ID NO: 4020317 - RNA, 13 nt, Staphylococcus aureus subsp. aureus MW2
ugucaucuuuaua

SEQ ID NO: 4020318 - RNA, 14 nt, Staphylococcus aureus subsp. aureus MW2
ugucaucuuuauac

SEQ ID NO: 4020319 - RNA, 20 nt, Staphylococcus aureus subsp. aureus MW2
ugucaugaaguaauuucucu

SEQ ID NO: 4020320 - RNA, 20 nt, Staphylococcus aureus subsp. aureus MW2
ugucaugaauuuucaucauu

SEQ ID NO: 4020321 - RNA, 20 nt, Staphylococcus aureus subsp. aureus MW2
ugucaugucuagauuucaaa

SEQ ID NO: 4020322 - RNA, 20 nt, Staphylococcus aureus subsp. aureus MW2
ugucauguguucaaauaacg

SEQ ID NO: 4020323 - RNA, 17 nt, Staphylococcus aureus subsp. aureus MW2
ugucauucuucaucgca

SEQ ID NO: 4020324 - RNA, 15 nt, Staphylococcus aureus subsp. aureus MW2
ugucauuucaaucau

SEQ ID NO: 4020325 - RNA, 18 nt, Staphylococcus aureus subsp. aureus MW2
uguccaaauaaauauaaa

SEQ ID NO: 4020326 - RNA, 17 nt, Staphylococcus aureus subsp. aureus MW2
uguccacuauauccuuu

SEQ ID NO: 4020327 - RNA, 16 nt, Staphylococcus aureus subsp. aureus MW2
uguccauaguaaucga

SEQ ID NO: 4020328 - RNA, 17 nt, Staphylococcus aureus subsp. aureus MW2
uguccguucgcaucuuu

SEQ ID NO: 4020329 - RNA, 21 nt, Staphylococcus aureus subsp. aureus MW2
uguccuaacgcuaauuuuacu

SEQ ID NO: 4020330 - RNA, 22 nt, Staphylococcus aureus subsp. aureus MW2
uguccuaacgcuaauuuuacuc

SEQ ID NO: 4020331 - RNA, 16 nt, Staphylococcus aureus subsp. aureus MW2
uguccuagacucuaaa

SEQ ID NO: 4020332 - RNA, 18 nt, Staphylococcus aureus subsp. aureus MW2
uguccucuaaaacauguu

SEQ ID NO: 4020333 - RNA, 14 nt, Staphylococcus aureus subsp. aureus MW2
uguccuuuuuauuu

SEQ ID NO: 4020334 - RNA, 23 nt, Staphylococcus aureus subsp. aureus MW2
ugucgaaaauagcuauuaaaaua

SEQ ID NO: 4020335 - RNA, 22 nt, Staphylococcus aureus subsp. aureus MW2
ugucgaaucaaaguaucuuuug

SEQ ID NO: 4020336 - RNA, 21 nt, Staphylococcus aureus subsp. aureus MW2
ugucgcaaauuuccacagcaa

SEQ ID NO: 4020337 - RNA, 15 nt, Staphylococcus aureus subsp. aureus MW2
ugucguauucuucaa

SEQ ID NO: 4020338 - RNA, 19 nt, Staphylococcus aureus subsp. aureus MW2
ugucguuguacaucauuaa

SEQ ID NO: 4020339 - RNA, 18 nt, Staphylococcus aureus subsp. aureus MW2
ugucuaaaaacauaaaaa

SEQ ID NO: 4020340 - RNA, 14 nt, Staphylococcus aureus subsp. aureus MW2
ugucuaaucgacuu

SEQ ID NO: 4020341 - RNA, 20 nt, Staphylococcus aureus subsp. aureus MW2
ugucuaaucgacuuuuacaa

SEQ ID NO: 4020342 - RNA, 21 nt, Staphylococcus aureus subsp. aureus MW2
ugucuaaucgacuuuuacaau

SEQ ID NO: 4020343 - RNA, 16 nt, Staphylococcus aureus subsp. aureus MW2
ugucuagauuucaaau

SEQ ID NO: 4020344 - RNA, 21 nt, Staphylococcus aureus subsp. aureus MW2
ugucuaguucgauuuuuuaau

SEQ ID NO: 4020345 - RNA, 14 nt, Staphylococcus aureus subsp. aureus MW2
ugucuauuguaaaa

SEQ ID NO: 4020346 - RNA, 23 nt, Staphylococcus aureus subsp. aureus MW2
ugucucaauaauguuacgcugug

SEQ ID NO: 4020347 - RNA, 19 nt, Staphylococcus aureus subsp. aureus MW2
ugucuuccaaucaacuuca

SEQ ID NO: 4020348 - RNA, 17 nt, Staphylococcus aureus subsp. aureus MW2
ugucuucgucaucaaca

SEQ ID NO: 4020349 - RNA, 17 nt, Staphylococcus aureus subsp. aureus MW2
ugucuuuuauauuuuua

SEQ ID NO: 4020350 - RNA, 17 nt, Staphylococcus aureus subsp. aureus MW2
ugucuuuuguuaugaua

SEQ ID NO: 4020351 - RNA, 14 nt, Staphylococcus aureus subsp. aureus MW2
ugucuuuuuuaaag

SEQ ID NO: 4020352 - RNA, 20 nt, Staphylococcus aureus subsp. aureus MW2
ugucuuuuuuaaagaggcag

SEQ ID NO: 4020353 - RNA, 19 nt, Staphylococcus aureus subsp. aureus MW2
ugugaaaaagcuaauucuu

SEQ ID NO: 4020354 - RNA, 13 nt, Staphylococcus aureus subsp. aureus MW2
ugugaaaauacca

SEQ ID NO: 4020355 - RNA, 22 nt, Staphylococcus aureus subsp. aureus MW2
ugugaaagaccguauuuuuuua

SEQ ID NO: 4020356 - RNA, 19 nt, Staphylococcus aureus subsp. aureus MW2
ugugaauaugcuuuuaaua

SEQ ID NO: 4020357 - RNA, 15 nt, Staphylococcus aureus subsp. aureus MW2
ugugacaauuuaaau

SEQ ID NO: 4020358 - RNA, 12 nt, Staphylococcus aureus subsp. aureus MW2
ugugacauacca

SEQ ID NO: 4020359 - RNA, 23 nt, Staphylococcus aureus subsp. aureus MW2
ugugacucggggaauuuuuaugc

SEQ ID NO: 4020360 - RNA, 15 nt, Staphylococcus aureus subsp. aureus MW2
ugugauacuuucuaa

SEQ ID NO: 4020361 - RNA, 17 nt, Staphylococcus aureus subsp. aureus MW2
ugugauacuuucuaaga

SEQ ID NO: 4020362 - RNA, 15 nt, Staphylococcus aureus subsp. aureus MW2
ugugauauauaacca

SEQ ID NO: 4020363 - RNA, 14 nt, Staphylococcus aureus subsp. aureus MW2
ugugauuaugcaua

SEQ ID NO: 4020364 - RNA, 15 nt, Staphylococcus aureus subsp. aureus MW2
ugugauuuuuugaua

SEQ ID NO: 4020365 - RNA, 14 nt, Staphylococcus aureus subsp. aureus MW2
ugugcaaaaguuug

SEQ ID NO: 4020366 - RNA, 19 nt, Staphylococcus aureus subsp. aureus MW2
ugugcaacgguuugaaaaa

SEQ ID NO: 4020367 - RNA, 23 nt, Staphylococcus aureus subsp. aureus MW2
ugugcaaguuggcggggccccaa

SEQ ID NO: 4020368 - RNA, 15 nt, Staphylococcus aureus subsp. aureus MW2
ugugcaauaccuguu

SEQ ID NO: 4020369 - RNA, 13 nt, Staphylococcus aureus subsp. aureus MW2
ugugcaucauuua

SEQ ID NO: 4020370 - RNA, 15 nt, Staphylococcus aureus subsp. aureus MW2
ugugcaugagacuua

SEQ ID NO: 4020371 - RNA, 18 nt, Staphylococcus aureus subsp. aureus MW2
ugugcauugcuuuuguua

SEQ ID NO: 4020372 - RNA, 18 nt, Staphylococcus aureus subsp. aureus MW2
ugugccggcuuuuucuuu

SEQ ID NO: 4020373 - RNA, 20 nt, Staphylococcus aureus subsp. aureus MW2
ugugccuuugcuuuuuauuu

SEQ ID NO: 4020374 - RNA, 13 nt, Staphylococcus aureus subsp. aureus MW2
ugugcuuaagaac

SEQ ID NO: 4020375 - RNA, 23 nt, Staphylococcus aureus subsp. aureus MW2
ugugcuuuucgcuuuucuaauuu

SEQ ID NO: 4020376 - RNA, 13 nt, Staphylococcus aureus subsp. aureus MW2
ugugcuuuuucau

SEQ ID NO: 4020377 - RNA, 21 nt, Staphylococcus aureus subsp. aureus MW2
ugugcuuuuucauaaauauuu

SEQ ID NO: 4020378 - RNA, 15 nt, Staphylococcus aureus subsp. aureus MW2
uguggacaaacugau

SEQ ID NO: 4020379 - RNA, 21 nt, Staphylococcus aureus subsp. aureus MW2
uguggacaaacugauuuuuua

SEQ ID NO: 4020380 - RNA, 17 nt, Staphylococcus aureus subsp. aureus MW2
uguggcggugguauggu

SEQ ID NO: 4020381 - RNA, 18 nt, Staphylococcus aureus subsp. aureus MW2
ugugggccccaacaaaga

SEQ ID NO: 4020382 - RNA, 16 nt, Staphylococcus aureus subsp. aureus MW2
ugugggcguucugcua

SEQ ID NO: 4020383 - RNA, 22 nt, Staphylococcus aureus subsp. aureus MW2
ugugguaaagggggcucucauu

SEQ ID NO: 4020384 - RNA, 22 nt, Staphylococcus aureus subsp. aureus MW2
ugugguaugacugcaaauacga

SEQ ID NO: 4020385 - RNA, 14 nt, Staphylococcus aureus subsp. aureus MW2
uguguaaaugaauu

SEQ ID NO: 4020386 - RNA, 12 nt, Staphylococcus aureus subsp. aureus MW2
uguguaacauua

SEQ ID NO: 4020387 - RNA, 19 nt, Staphylococcus aureus subsp. aureus MW2
uguguaccuuuuuauugau

SEQ ID NO: 4020388 - RNA, 15 nt, Staphylococcus aureus subsp. aureus MW2
uguguaugagucuuu

SEQ ID NO: 4020389 - RNA, 21 nt, Staphylococcus aureus subsp. aureus MW2
uguguaugguuuuguacauau

SEQ ID NO: 4020390 - RNA, 18 nt, Staphylococcus aureus subsp. aureus MW2
uguguauuuauuuuuuua

SEQ ID NO: 4020391 - RNA, 15 nt, Staphylococcus aureus subsp. aureus MW2
uguguauuuuuauug

SEQ ID NO: 4020392 - RNA, 18 nt, Staphylococcus aureus subsp. aureus MW2
ugugucaaacaggcuuag

SEQ ID NO: 4020393 - RNA, 22 nt, Staphylococcus aureus subsp. aureus MW2
ugugucauaauccauucuucuu

SEQ ID NO: 4020394 - RNA, 20 nt, Staphylococcus aureus subsp. aureus MW2
uguguccauaaauauuaaau

SEQ ID NO: 4020395 - RNA, 14 nt, Staphylococcus aureus subsp. aureus MW2
uguguuaaaauaua

SEQ ID NO: 4020396 - RNA, 22 nt, Staphylococcus aureus subsp. aureus MW2
uguguuaauacuucauauccuu

SEQ ID NO: 4020397 - RNA, 17 nt, Staphylococcus aureus subsp. aureus MW2
uguguuacacaugcauc

SEQ ID NO: 4020398 - RNA, 13 nt, Staphylococcus aureus subsp. aureus MW2
uguguugcaauug

SEQ ID NO: 4020399 - RNA, 16 nt, Staphylococcus aureus subsp. aureus MW2
uguguuggggcccauc

SEQ ID NO: 4020400 - RNA, 17 nt, Staphylococcus aureus subsp. aureus MW2
uguguuggugcuauuaa

SEQ ID NO: 4020401 - RNA, 21 nt, Staphylococcus aureus subsp. aureus MW2
uguguuuaggaggaauaccca

SEQ ID NO: 4020402 - RNA, 13 nt, Staphylococcus aureus subsp. aureus MW2
uguguuucuuuua

SEQ ID NO: 4020403 - RNA, 16 nt, Staphylococcus aureus subsp. aureus MW2
uguguuucuuuuauuu

SEQ ID NO: 4020404 - RNA, 12 nt, Staphylococcus aureus subsp. aureus MW2
uguguuugcuuu

SEQ ID NO: 4020405 - RNA, 17 nt, Staphylococcus aureus subsp. aureus MW2
uguguuugcuuuuauuu

SEQ ID NO: 4020406 - RNA, 11 nt, Staphylococcus aureus subsp. aureus MW2
uguguuuucaa

SEQ ID NO: 4020407 - RNA, 18 nt, Staphylococcus aureus subsp. aureus MW2
uguguuuucaacaguuuu

SEQ ID NO: 4020408 - RNA, 14 nt, Staphylococcus aureus subsp. aureus MW2
uguguuuuuauuaa

SEQ ID NO: 4020409 - RNA, 13 nt, Staphylococcus aureus subsp. aureus MW2
uguuaaaaaauua

SEQ ID NO: 4020410 - RNA, 14 nt, Staphylococcus aureus subsp. aureus MW2
uguuaaaaaauuaa

SEQ ID NO: 4020411 - RNA, 16 nt, Staphylococcus aureus subsp. aureus MW2
uguuaaauucuaaaac

SEQ ID NO: 4020412 - RNA, 21 nt, Staphylococcus aureus subsp. aureus MW2
uguuaagcccucauuuuuaua

SEQ ID NO: 4020413 - RNA, 20 nt, Staphylococcus aureus subsp. aureus MW2
uguuaaucaaaauucugacu

SEQ ID NO: 4020414 - RNA, 16 nt, Staphylococcus aureus subsp. aureus MW2
uguuaaugucuucaua

SEQ ID NO: 4020415 - RNA, 18 nt, Staphylococcus aureus subsp. aureus MW2
uguuaauuucaacauuac

SEQ ID NO: 4020416 - RNA, 15 nt, Staphylococcus aureus subsp. aureus MW2
uguuacacuuuucuu

SEQ ID NO: 4020417 - RNA, 16 nt, Staphylococcus aureus subsp. aureus MW2
uguuacacuuuucuua

SEQ ID NO: 4020418 - RNA, 22 nt, Staphylococcus aureus subsp. aureus MW2
uguuacauauugcauuuagacu

SEQ ID NO: 4020419 - RNA, 23 nt, Staphylococcus aureus subsp. aureus MW2
uguuacuaguuuguaauaauuaa

SEQ ID NO: 4020420 - RNA, 17 nt, Staphylococcus aureus subsp. aureus MW2
uguuacucuuagguaua

SEQ ID NO: 4020421 - RNA, 22 nt, Staphylococcus aureus subsp. aureus MW2
uguuacuuucacauuuucaaau

SEQ ID NO: 4020422 - RNA, 13 nt, Staphylococcus aureus subsp. aureus MW2
uguuagauuucaa

SEQ ID NO: 4020423 - RNA, 20 nt, Staphylococcus aureus subsp. aureus MW2
uguuaggagagauguauaaa

SEQ ID NO: 4020424 - RNA, 16 nt, Staphylococcus aureus subsp. aureus MW2
uguuaggggcuuuuau

SEQ ID NO: 4020425 - RNA, 17 nt, Staphylococcus aureus subsp. aureus MW2
uguuauaacccuaauuc

SEQ ID NO: 4020426 - RNA, 20 nt, Staphylococcus aureus subsp. aureus MW2
uguuauaacccuaauucuuu

SEQ ID NO: 4020427 - RNA, 16 nt, Staphylococcus aureus subsp. aureus MW2
uguuauauaaagaggc

SEQ ID NO: 4020428 - RNA, 13 nt, Staphylococcus aureus subsp. aureus MW2
uguuauauuauga

SEQ ID NO: 4020429 - RNA, 14 nt, Staphylococcus aureus subsp. aureus MW2
uguuauauuaugaa

SEQ ID NO: 4020430 - RNA, 20 nt, Staphylococcus aureus subsp. aureus MW2
uguuauauuaugaacaugaa

SEQ ID NO: 4020431 - RNA, 15 nt, Staphylococcus aureus subsp. aureus MW2
uguuaucuugcuuau

SEQ ID NO: 4020432 - RNA, 15 nt, Staphylococcus aureus subsp. aureus MW2
uguuauguaugaaag

SEQ ID NO: 4020433 - RNA, 14 nt, Staphylococcus aureus subsp. aureus MW2
uguuauuaaacgca

SEQ ID NO: 4020434 - RNA, 24 nt, Staphylococcus aureus subsp. aureus MW2
uguuauuagauacuucuuuagcaa

SEQ ID NO: 4020435 - RNA, 22 nt, Staphylococcus aureus subsp. aureus MW2
uguuauuaucguaaaaaaacgu

SEQ ID NO: 4020436 - RNA, 13 nt, Staphylococcus aureus subsp. aureus MW2
uguuauugaauga

SEQ ID NO: 4020437 - RNA, 13 nt, Staphylococcus aureus subsp. aureus MW2
uguuauugcuuau

SEQ ID NO: 4020438 - RNA, 22 nt, Staphylococcus aureus subsp. aureus MW2
uguucaaauaacgcaaugucuu

SEQ ID NO: 4020439 - RNA, 17 nt, Staphylococcus aureus subsp. aureus MW2
uguucaacuaaauuuuc

SEQ ID NO: 4020440 - RNA, 23 nt, Staphylococcus aureus subsp. aureus MW2
uguucaaugauuugauaauauua

SEQ ID NO: 4020441 - RNA, 14 nt, Staphylococcus aureus subsp. aureus MW2
uguucacuaaaugu

SEQ ID NO: 4020442 - RNA, 20 nt, Staphylococcus aureus subsp. aureus MW2
uguucagguguaucuuugau

SEQ ID NO: 4020443 - RNA, 16 nt, Staphylococcus aureus subsp. aureus MW2
uguucauguuuaaaau

SEQ ID NO: 4020444 - RNA, 16 nt, Staphylococcus aureus subsp. aureus MW2
uguucauuggcaauau

SEQ ID NO: 4020445 - RNA, 18 nt, Staphylococcus aureus subsp. aureus MW2
uguuccaaucuuuuuaau

SEQ ID NO: 4020446 - RNA, 21 nt, Staphylococcus aureus subsp. aureus MW2
uguuccauggaauaaauuuau

SEQ ID NO: 4020447 - RNA, 17 nt, Staphylococcus aureus subsp. aureus MW2
uguucccauuuuuaaaa

SEQ ID NO: 4020448 - RNA, 18 nt, Staphylococcus aureus subsp. aureus MW2
uguuccgcuacaaaacau

SEQ ID NO: 4020449 - RNA, 21 nt, Staphylococcus aureus subsp. aureus MW2
uguuccgcuacaaaacauauu

SEQ ID NO: 4020450 - RNA, 20 nt, Staphylococcus aureus subsp. aureus MW2
uguuccuccaccaccugcaa

SEQ ID NO: 4020451 - RNA, 22 nt, Staphylococcus aureus subsp. aureus MW2
uguuccugcuacaacuucuucu

SEQ ID NO: 4020452 - RNA, 17 nt, Staphylococcus aureus subsp. aureus MW2
uguucgggaauuuuuua

SEQ ID NO: 4020453 - RNA, 16 nt, Staphylococcus aureus subsp. aureus MW2
uguucuaauuguugua

SEQ ID NO: 4020454 - RNA, 15 nt, Staphylococcus aureus subsp. aureus MW2
uguucucauuauaau

SEQ ID NO: 4020455 - RNA, 18 nt, Staphylococcus aureus subsp. aureus MW2
uguucucauuauaaugau

SEQ ID NO: 4020456 - RNA, 14 nt, Staphylococcus aureus subsp. aureus MW2
uguucucuauuuau

SEQ ID NO: 4020457 - RNA, 15 nt, Staphylococcus aureus subsp. aureus MW2
uguucucuauuuaua

SEQ ID NO: 4020458 - RNA, 23 nt, Staphylococcus aureus subsp. aureus MW2
uguucucuauuuauaacacuucg

SEQ ID NO: 4020459 - RNA, 18 nt, Staphylococcus aureus subsp. aureus MW2
uguucugcuuuuucuuua

SEQ ID NO: 4020460 - RNA, 20 nt, Staphylococcus aureus subsp. aureus MW2
uguucuuaacaauaucaucu

SEQ ID NO: 4020461 - RNA, 22 nt, Staphylococcus aureus subsp. aureus MW2
uguucuuaacaauaucaucuaa

SEQ ID NO: 4020462 - RNA, 19 nt, Staphylococcus aureus subsp. aureus MW2
uguucuugaaaacaauaaa

SEQ ID NO: 4020463 - RNA, 22 nt, Staphylococcus aureus subsp. aureus MW2
uguucuugaaaacaauaaauuu

SEQ ID NO: 4020464 - RNA, 16 nt, Staphylococcus aureus subsp. aureus MW2
uguucuuguaauccua

SEQ ID NO: 4020465 - RNA, 18 nt, Staphylococcus aureus subsp. aureus MW2
uguucuuucuuucuuuuc

SEQ ID NO: 4020466 - RNA, 19 nt, Staphylococcus aureus subsp. aureus MW2
uguugaaaaguauaugaau

SEQ ID NO: 4020467 - RNA, 19 nt, Staphylococcus aureus subsp. aureus MW2
uguugaaaaugacuaccug

SEQ ID NO: 4020468 - RNA, 22 nt, Staphylococcus aureus subsp. aureus MW2
uguugaaacuguaucaacauau

SEQ ID NO: 4020469 - RNA, 18 nt, Staphylococcus aureus subsp. aureus MW2
uguugaauaauuaauguu

SEQ ID NO: 4020470 - RNA, 14 nt, Staphylococcus aureus subsp. aureus MW2
uguugaauauacua

SEQ ID NO: 4020471 - RNA, 19 nt, Staphylococcus aureus subsp. aureus MW2
uguugacauuugaccaagu

SEQ ID NO: 4020472 - RNA, 22 nt, Staphylococcus aureus subsp. aureus MW2
uguugacauuugaccaaguaug

SEQ ID NO: 4020473 - RNA, 18 nt, Staphylococcus aureus subsp. aureus MW2
uguugaccaccugauaau

SEQ ID NO: 4020474 - RNA, 14 nt, Staphylococcus aureus subsp. aureus MW2
uguugagaaacuuu

SEQ ID NO: 4020475 - RNA, 14 nt, Staphylococcus aureus subsp. aureus MW2
uguugauaaaaagg

SEQ ID NO: 4020476 - RNA, 23 nt, Staphylococcus aureus subsp. aureus MW2
uguugauaaugcuacuauuaaau

SEQ ID NO: 4020477 - RNA, 14 nt, Staphylococcus aureus subsp. aureus MW2
uguugauuuaaaau

SEQ ID NO: 4020478 - RNA, 15 nt, Staphylococcus aureus subsp. aureus MW2
uguugcaaaauuaag

SEQ ID NO: 4020479 - RNA, 16 nt, Staphylococcus aureus subsp. aureus MW2
uguugcauccccagcc

SEQ ID NO: 4020480 - RNA, 15 nt, Staphylococcus aureus subsp. aureus MW2
uguugcauuagauca

SEQ ID NO: 4020481 - RNA, 19 nt, Staphylococcus aureus subsp. aureus MW2
uguugcccgcuuauugcau

SEQ ID NO: 4020482 - RNA, 18 nt, Staphylococcus aureus subsp. aureus MW2
uguuggaauaccuuuuuc

SEQ ID NO: 4020483 - RNA, 20 nt, Staphylococcus aureus subsp. aureus MW2
uguuggaauaccuuuuucua

SEQ ID NO: 4020484 - RNA, 16 nt, Staphylococcus aureus subsp. aureus MW2
uguuggcuuuuugagu

SEQ ID NO: 4020485 - RNA, 20 nt, Staphylococcus aureus subsp. aureus MW2
uguuggugaguguuucauaa

SEQ ID NO: 4020486 - RNA, 15 nt, Staphylococcus aureus subsp. aureus MW2
uguugguuuuuaaaa

SEQ ID NO: 4020487 - RNA, 17 nt, Staphylococcus aureus subsp. aureus MW2
uguuguacauguauugg

SEQ ID NO: 4020488 - RNA, 21 nt, Staphylococcus aureus subsp. aureus MW2
uguugucguuucuagcaacug

SEQ ID NO: 4020489 - RNA, 22 nt, Staphylococcus aureus subsp. aureus MW2
uguugugcuuuucgcuuuucua

SEQ ID NO: 4020490 - RNA, 20 nt, Staphylococcus aureus subsp. aureus MW2
uguuguuaacgguuaauaag

SEQ ID NO: 4020491 - RNA, 20 nt, Staphylococcus aureus subsp. aureus MW2
uguuguugcccgcuuauugc

SEQ ID NO: 4020492 - RNA, 22 nt, Staphylococcus aureus subsp. aureus MW2
uguuguugcccgcuuauugcau

SEQ ID NO: 4020493 - RNA, 13 nt, Staphylococcus aureus subsp. aureus MW2
uguuguuuuugau

SEQ ID NO: 4020494 - RNA, 16 nt, Staphylococcus aureus subsp. aureus MW2
uguuuaaaaaacuacu

SEQ ID NO: 4020495 - RNA, 15 nt, Staphylococcus aureus subsp. aureus MW2
uguuuaaacauguac

SEQ ID NO: 4020496 - RNA, 16 nt, Staphylococcus aureus subsp. aureus MW2
uguuuaaacauguaca

SEQ ID NO: 4020497 - RNA, 13 nt, Staphylococcus aureus subsp. aureus MW2
uguuuaaaugcua

SEQ ID NO: 4020498 - RNA, 14 nt, Staphylococcus aureus subsp. aureus MW2
uguuuaaauuucaa

SEQ ID NO: 4020499 - RNA, 11 nt, Staphylococcus aureus subsp. aureus MW2
uguuuaacaau

SEQ ID NO: 4020500 - RNA, 15 nt, Staphylococcus aureus subsp. aureus MW2
uguuuaacaauaaua

SEQ ID NO: 4020501 - RNA, 21 nt, Staphylococcus aureus subsp. aureus MW2
uguuuaauuugauuaaauuca

SEQ ID NO: 4020502 - RNA, 21 nt, Staphylococcus aureus subsp. aureus MW2
uguuuaccuaaaucuuuaaau

SEQ ID NO: 4020503 - RNA, 22 nt, Staphylococcus aureus subsp. aureus MW2
uguuuacgccauaagaaaauac

SEQ ID NO: 4020504 - RNA, 20 nt, Staphylococcus aureus subsp. aureus MW2
uguuuacggauuuuucucau

SEQ ID NO: 4020505 - RNA, 17 nt, Staphylococcus aureus subsp. aureus MW2
uguuuacugucaucuuu

SEQ ID NO: 4020506 - RNA, 20 nt, Staphylococcus aureus subsp. aureus MW2
uguuuacugucaucuuuaua

SEQ ID NO: 4020507 - RNA, 20 nt, Staphylococcus aureus subsp. aureus MW2
uguuuaguauggaauaaaug

SEQ ID NO: 4020508 - RNA, 13 nt, Staphylococcus aureus subsp. aureus MW2
uguuuauaauaau

SEQ ID NO: 4020509 - RNA, 18 nt, Staphylococcus aureus subsp. aureus MW2
uguuuauaauaauauuga

SEQ ID NO: 4020510 - RNA, 12 nt, Staphylococcus aureus subsp. aureus MW2
uguuuauaucuu

SEQ ID NO: 4020511 - RNA, 17 nt, Staphylococcus aureus subsp. aureus MW2
uguuuauaucuuuuaua

SEQ ID NO: 4020512 - RNA, 15 nt, Staphylococcus aureus subsp. aureus MW2
uguuuauauugcaaa

SEQ ID NO: 4020513 - RNA, 19 nt, Staphylococcus aureus subsp. aureus MW2
uguuuaucuccuaaaggua

SEQ ID NO: 4020514 - RNA, 18 nt, Staphylococcus aureus subsp. aureus MW2
uguuuaugacaaaguucu

SEQ ID NO: 4020515 - RNA, 15 nt, Staphylococcus aureus subsp. aureus MW2
uguuuauuauagaaa

SEQ ID NO: 4020516 - RNA, 14 nt, Staphylococcus aureus subsp. aureus MW2
uguuuauuuagaau

SEQ ID NO: 4020517 - RNA, 19 nt, Staphylococcus aureus subsp. aureus MW2
uguuuauuuagaauaaacu

SEQ ID NO: 4020518 - RNA, 15 nt, Staphylococcus aureus subsp. aureus MW2
uguuuauuuuuaauc

SEQ ID NO: 4020519 - RNA, 19 nt, Staphylococcus aureus subsp. aureus MW2
uguuucaaaauaauuuuau

SEQ ID NO: 4020520 - RNA, 13 nt, Staphylococcus aureus subsp. aureus MW2
uguuucaaacaaa

SEQ ID NO: 4020521 - RNA, 23 nt, Staphylococcus aureus subsp. aureus MW2
uguuucaacauauuauauauauu

SEQ ID NO: 4020522 - RNA, 17 nt, Staphylococcus aureus subsp. aureus MW2
uguuucaauucaauugc

SEQ ID NO: 4020523 - RNA, 12 nt, Staphylococcus aureus subsp. aureus MW2
uguuucagcuug

SEQ ID NO: 4020524 - RNA, 21 nt, Staphylococcus aureus subsp. aureus MW2
uguuucagcuuguccauagua

SEQ ID NO: 4020525 - RNA, 19 nt, Staphylococcus aureus subsp. aureus MW2
uguuucauaugcaucaaca

SEQ ID NO: 4020526 - RNA, 14 nt, Staphylococcus aureus subsp. aureus MW2
uguuucuaaugcuc

SEQ ID NO: 4020527 - RNA, 16 nt, Staphylococcus aureus subsp. aureus MW2
uguuucuaaugcucau

SEQ ID NO: 4020528 - RNA, 23 nt, Staphylococcus aureus subsp. aureus MW2
uguuucuauauuaauaaucuucu

SEQ ID NO: 4020529 - RNA, 14 nt, Staphylococcus aureus subsp. aureus MW2
uguuucuuguucua

SEQ ID NO: 4020530 - RNA, 18 nt, Staphylococcus aureus subsp. aureus MW2
uguuucuuuuauuuucau

SEQ ID NO: 4020531 - RNA, 20 nt, Staphylococcus aureus subsp. aureus MW2
uguuugaagugaaaaauuuc

SEQ ID NO: 4020532 - RNA, 22 nt, Staphylococcus aureus subsp. aureus MW2
uguuugaagugaaaaauuucuc

SEQ ID NO: 4020533 - RNA, 18 nt, Staphylococcus aureus subsp. aureus MW2
uguuugaauggcaaauau

SEQ ID NO: 4020534 - RNA, 14 nt, Staphylococcus aureus subsp. aureus MW2
uguuugagauauau

SEQ ID NO: 4020535 - RNA, 19 nt, Staphylococcus aureus subsp. aureus MW2
uguuugagauauauuaaua

SEQ ID NO: 4020536 - RNA, 21 nt, Staphylococcus aureus subsp. aureus MW2
uguuugagauauauuaauauu

SEQ ID NO: 4020537 - RNA, 17 nt, Staphylococcus aureus subsp. aureus MW2
uguuugcaacauauuuu

SEQ ID NO: 4020538 - RNA, 22 nt, Staphylococcus aureus subsp. aureus MW2
uguuugcccugcuguuuuauuc

SEQ ID NO: 4020539 - RNA, 15 nt, Staphylococcus aureus subsp. aureus MW2
uguuuggaugaacaa

SEQ ID NO: 4020540 - RNA, 16 nt, Staphylococcus aureus subsp. aureus MW2
uguuuggcauaauaau

SEQ ID NO: 4020541 - RNA, 19 nt, Staphylococcus aureus subsp. aureus MW2
uguuuguaaaucaaguguu

SEQ ID NO: 4020542 - RNA, 16 nt, Staphylococcus aureus subsp. aureus MW2
uguuuguaagucgcuc

SEQ ID NO: 4020543 - RNA, 24 nt, Staphylococcus aureus subsp. aureus MW2
uguuuguaaugucgaucuaacaau

SEQ ID NO: 4020544 - RNA, 11 nt, Staphylococcus aureus subsp. aureus MW2
uguuuguauuc

SEQ ID NO: 4020545 - RNA, 14 nt, Staphylococcus aureus subsp. aureus MW2
uguuuguuuuuaua

SEQ ID NO: 4020546 - RNA, 12 nt, Staphylococcus aureus subsp. aureus MW2
uguuuuaaaaaa

SEQ ID NO: 4020547 - RNA, 18 nt, Staphylococcus aureus subsp. aureus MW2
uguuuuaaauuuuaugaa

SEQ ID NO: 4020548 - RNA, 14 nt, Staphylococcus aureus subsp. aureus MW2
uguuuuauagcauu

SEQ ID NO: 4020549 - RNA, 14 nt, Staphylococcus aureus subsp. aureus MW2
uguuuuaucaauau

SEQ ID NO: 4020550 - RNA, 13 nt, Staphylococcus aureus subsp. aureus MW2
uguuuuauucaau

SEQ ID NO: 4020551 - RNA, 10 nt, Staphylococcus aureus subsp. aureus MW2
uguuuucacu

SEQ ID NO: 4020552 - RNA, 16 nt, Staphylococcus aureus subsp. aureus MW2
uguuuuccuuuugaau

SEQ ID NO: 4020553 - RNA, 17 nt, Staphylococcus aureus subsp. aureus MW2
uguuuuccuuuugaaua

SEQ ID NO: 4020554 - RNA, 21 nt, Staphylococcus aureus subsp. aureus MW2
uguuuugagagauuauuuaaa

SEQ ID NO: 4020555 - RNA, 20 nt, Staphylococcus aureus subsp. aureus MW2
uguuuugcgguuuuuuugau

SEQ ID NO: 4020556 - RNA, 20 nt, Staphylococcus aureus subsp. aureus MW2
uguuuuggaaaaauuguggc

SEQ ID NO: 4020557 - RNA, 21 nt, Staphylococcus aureus subsp. aureus MW2
uguuuuuaaaugcuuuaaaua

SEQ ID NO: 4020558 - RNA, 19 nt, Staphylococcus aureus subsp. aureus MW2
uguuuuuaacagcuuuuuc

SEQ ID NO: 4020559 - RNA, 21 nt, Staphylococcus aureus subsp. aureus MW2
uguuuuuaacagcuuuuucua

SEQ ID NO: 4020560 - RNA, 18 nt, Staphylococcus aureus subsp. aureus MW2
uguuuuucaucauuaaaa

SEQ ID NO: 4020561 - RNA, 13 nt, Staphylococcus aureus subsp. aureus MW2
uguuuuuuaagua

SEQ ID NO: 4020562 - RNA, 12 nt, Staphylococcus aureus subsp. aureus MW2
uguuuuuuucuu

SEQ ID NO: 4020563 - RNA, 15 nt, Staphylococcus aureus subsp. aureus MW2
uguuuuuuuuauuaa

SEQ ID NO: 4020564 - RNA, 17 nt, Staphylococcus aureus subsp. aureus MW2
uguuuuuuuuauuaauu

SEQ ID NO: 4020565 - RNA, 22 nt, Staphylococcus aureus subsp. aureus MW2
uguuuuuuuuauuaauuuaaaa

SEQ ID NO: 4020566 - RNA, 21 nt, Staphylococcus aureus subsp. aureus MW2
uuaaaaaacaauaaaauuacu

SEQ ID NO: 4020567 - RNA, 15 nt, Staphylococcus aureus subsp. aureus MW2
uuaaaaaacagugua

SEQ ID NO: 4020568 - RNA, 12 nt, Staphylococcus aureus subsp. aureus MW2
uuaaaaaauaug

SEQ ID NO: 4020569 - RNA, 19 nt, Staphylococcus aureus subsp. aureus MW2
uuaaaaaauauguauguuu

SEQ ID NO: 4020570 - RNA, 16 nt, Staphylococcus aureus subsp. aureus MW2
uuaaaaaauuuaaaua

SEQ ID NO: 4020571 - RNA, 19 nt, Staphylococcus aureus subsp. aureus MW2
uuaaaaacaauauugacuu

SEQ ID NO: 4020572 - RNA, 23 nt, Staphylococcus aureus subsp. aureus MW2
uuaaaaagguacuaauguuaauc

SEQ ID NO: 4020573 - RNA, 16 nt, Staphylococcus aureus subsp. aureus MW2
uuaaaaagucaaagag

SEQ ID NO: 4020574 - RNA, 17 nt, Staphylococcus aureus subsp. aureus MW2
uuaaaaauacagcuaca

SEQ ID NO: 4020575 - RNA, 18 nt, Staphylococcus aureus subsp. aureus MW2
uuaaaaauagccuucaaa

SEQ ID NO: 4020576 - RNA, 22 nt, Staphylococcus aureus subsp. aureus MW2
uuaaaaauaguaaagugaaaua

SEQ ID NO: 4020577 - RNA, 14 nt, Staphylococcus aureus subsp. aureus MW2
uuaaaaauaguucu

SEQ ID NO: 4020578 - RNA, 16 nt, Staphylococcus aureus subsp. aureus MW2
uuaaaaauauguguua

SEQ ID NO: 4020579 - RNA, 15 nt, Staphylococcus aureus subsp. aureus MW2
uuaaaaaucaaagag

SEQ ID NO: 4020580 - RNA, 16 nt, Staphylococcus aureus subsp. aureus MW2
uuaaaaaucuacauau

SEQ ID NO: 4020581 - RNA, 19 nt, Staphylococcus aureus subsp. aureus MW2
uuaaaaauugcaaugcuau

SEQ ID NO: 4020582 - RNA, 19 nt, Staphylococcus aureus subsp. aureus MW2
uuaaaacaaugauuaaaau

SEQ ID NO: 4020583 - RNA, 12 nt, Staphylococcus aureus subsp. aureus MW2
uuaaaacaucau

SEQ ID NO: 4020584 - RNA, 17 nt, Staphylococcus aureus subsp. aureus MW2
uuaaaacuauaaccuau

SEQ ID NO: 4020585 - RNA, 13 nt, Staphylococcus aureus subsp. aureus MW2
uuaaaacuauaau

SEQ ID NO: 4020586 - RNA, 20 nt, Staphylococcus aureus subsp. aureus MW2
uuaaaagaggggaacaaugg

SEQ ID NO: 4020587 - RNA, 15 nt, Staphylococcus aureus subsp. aureus MW2
uuaaaagauaaauaa

SEQ ID NO: 4020588 - RNA, 18 nt, Staphylococcus aureus subsp. aureus MW2
uuaaaaggcgaaacauua

SEQ ID NO: 4020589 - RNA, 21 nt, Staphylococcus aureus subsp. aureus MW2
uuaaaagugcaaguccaaaua

SEQ ID NO: 4020590 - RNA, 16 nt, Staphylococcus aureus subsp. aureus MW2
uuaaaauaaagaaaac

SEQ ID NO: 4020591 - RNA, 18 nt, Staphylococcus aureus subsp. aureus MW2
uuaaaauaccaaauauga

SEQ ID NO: 4020592 - RNA, 12 nt, Staphylococcus aureus subsp. aureus MW2
uuaaaauaccug

SEQ ID NO: 4020593 - RNA, 22 nt, Staphylococcus aureus subsp. aureus MW2
uuaaaauauaaauuucuucaua

SEQ ID NO: 4020594 - RNA, 15 nt, Staphylococcus aureus subsp. aureus MW2
uuaaaauauauuugu

SEQ ID NO: 4020595 - RNA, 21 nt, Staphylococcus aureus subsp. aureus MW2
uuaaaauaugauuuaaaauau

SEQ ID NO: 4020596 - RNA, 15 nt, Staphylococcus aureus subsp. aureus MW2
uuaaaauauuaauca

SEQ ID NO: 4020597 - RNA, 15 nt, Staphylococcus aureus subsp. aureus MW2
uuaaaaucaaccuuu

SEQ ID NO: 4020598 - RNA, 21 nt, Staphylococcus aureus subsp. aureus MW2
uuaaaaucucauaauaauuca

SEQ ID NO: 4020599 - RNA, 21 nt, Staphylococcus aureus subsp. aureus MW2
uuaaaaucuugaugauauuca

SEQ ID NO: 4020600 - RNA, 20 nt, Staphylococcus aureus subsp. aureus MW2
uuaaaaugauaucugacauu

SEQ ID NO: 4020601 - RNA, 21 nt, Staphylococcus aureus subsp. aureus MW2
uuaaaaugauuguuuuaagug

SEQ ID NO: 4020602 - RNA, 18 nt, Staphylococcus aureus subsp. aureus MW2
uuaaaaugcuuuuuugaa

SEQ ID NO: 4020603 - RNA, 13 nt, Staphylococcus aureus subsp. aureus MW2
uuaaaauguguuu

SEQ ID NO: 4020604 - RNA, 18 nt, Staphylococcus aureus subsp. aureus MW2
uuaaaauuaaaccuacaa

SEQ ID NO: 4020605 - RNA, 22 nt, Staphylococcus aureus subsp. aureus MW2
uuaaaauuguauagaaugugua

SEQ ID NO: 4020606 - RNA, 14 nt, Staphylococcus aureus subsp. aureus MW2
uuaaaauuuaaaua

SEQ ID NO: 4020607 - RNA, 20 nt, Staphylococcus aureus subsp. aureus MW2
uuaaacaaaacuuaaaauau

SEQ ID NO: 4020608 - RNA, 12 nt, Staphylococcus aureus subsp. aureus MW2
uuaaacaaauaa

SEQ ID NO: 4020609 - RNA, 16 nt, Staphylococcus aureus subsp. aureus MW2
uuaaacaaauaaaaaa

SEQ ID NO: 4020610 - RNA, 15 nt, Staphylococcus aureus subsp. aureus MW2
uuaaacaagcaucau

SEQ ID NO: 4020611 - RNA, 16 nt, Staphylococcus aureus subsp. aureus MW2
uuaaacaagcaucaug

SEQ ID NO: 4020612 - RNA, 19 nt, Staphylococcus aureus subsp. aureus MW2
uuaaacaaguugauaacua

SEQ ID NO: 4020613 - RNA, 22 nt, Staphylococcus aureus subsp. aureus MW2
uuaaacaaguugauaacuauuu

SEQ ID NO: 4020614 - RNA, 15 nt, Staphylococcus aureus subsp. aureus MW2
uuaaacaguuuaauu

SEQ ID NO: 4020615 - RNA, 13 nt, Staphylococcus aureus subsp. aureus MW2
uuaaacauaacau

SEQ ID NO: 4020616 - RNA, 22 nt, Staphylococcus aureus subsp. aureus MW2
uuaaacauaacaugaccuaaua

SEQ ID NO: 4020617 - RNA, 21 nt, Staphylococcus aureus subsp. aureus MW2
uuaaacauccaauuauguuua

SEQ ID NO: 4020618 - RNA, 13 nt, Staphylococcus aureus subsp. aureus MW2
uuaaacaugaaca

SEQ ID NO: 4020619 - RNA, 19 nt, Staphylococcus aureus subsp. aureus MW2
uuaaacaugaacaaucaga

SEQ ID NO: 4020620 - RNA, 23 nt, Staphylococcus aureus subsp. aureus MW2
uuaaaccgcacuucuauauuaau

SEQ ID NO: 4020621 - RNA, 18 nt, Staphylococcus aureus subsp. aureus MW2
uuaaaccguauagucauu

SEQ ID NO: 4020622 - RNA, 14 nt, Staphylococcus aureus subsp. aureus MW2
uuaaaccuuaauaa

SEQ ID NO: 4020623 - RNA, 14 nt, Staphylococcus aureus subsp. aureus MW2
uuaaacgcaauuaa

SEQ ID NO: 4020624 - RNA, 17 nt, Staphylococcus aureus subsp. aureus MW2
uuaaacuacgaauucuc

SEQ ID NO: 4020625 - RNA, 17 nt, Staphylococcus aureus subsp. aureus MW2
uuaaacucauaauuuuc

SEQ ID NO: 4020626 - RNA, 16 nt, Staphylococcus aureus subsp. aureus MW2
uuaaacucucuaaaaa

SEQ ID NO: 4020627 - RNA, 13 nt, Staphylococcus aureus subsp. aureus MW2
uuaaacugcgaac

SEQ ID NO: 4020628 - RNA, 13 nt, Staphylococcus aureus subsp. aureus MW2
uuaaacuguaaac

SEQ ID NO: 4020629 - RNA, 21 nt, Staphylococcus aureus subsp. aureus MW2
uuaaacuguccagcuuaauuu

SEQ ID NO: 4020630 - RNA, 12 nt, Staphylococcus aureus subsp. aureus MW2
uuaaacuuauua

SEQ ID NO: 4020631 - RNA, 14 nt, Staphylococcus aureus subsp. aureus MW2
uuaaacuuauuaau

SEQ ID NO: 4020632 - RNA, 16 nt, Staphylococcus aureus subsp. aureus MW2
uuaaacuuuaugaaaa

SEQ ID NO: 4020633 - RNA, 18 nt, Staphylococcus aureus subsp. aureus MW2
uuaaagaaaauuucagua

SEQ ID NO: 4020634 - RNA, 18 nt, Staphylococcus aureus subsp. aureus MW2
uuaaagacagguuacuuu

SEQ ID NO: 4020635 - RNA, 23 nt, Staphylococcus aureus subsp. aureus MW2
uuaaagaggcaguaucucaaaua

SEQ ID NO: 4020636 - RNA, 19 nt, Staphylococcus aureus subsp. aureus MW2
uuaaagauguugaaaagua

SEQ ID NO: 4020637 - RNA, 14 nt, Staphylococcus aureus subsp. aureus MW2
uuaaagauuaaaau

SEQ ID NO: 4020638 - RNA, 15 nt, Staphylococcus aureus subsp. aureus MW2
uuaaagauuaaaaua

SEQ ID NO: 4020639 - RNA, 13 nt, Staphylococcus aureus subsp. aureus MW2
uuaaagcaucaua

SEQ ID NO: 4020640 - RNA, 22 nt, Staphylococcus aureus subsp. aureus MW2
uuaaagcuaauaaugccauuaa

SEQ ID NO: 4020641 - RNA, 21 nt, Staphylococcus aureus subsp. aureus MW2
uuaaagcuuuucuugaaauaa

SEQ ID NO: 4020642 - RNA, 14 nt, Staphylococcus aureus subsp. aureus MW2
uuaaaggaaaucaa

SEQ ID NO: 4020643 - RNA, 15 nt, Staphylococcus aureus subsp. aureus MW2
uuaaaggcauaauaa

SEQ ID NO: 4020644 - RNA, 21 nt, Staphylococcus aureus subsp. aureus MW2
uuaaaggucuuaaucauugcu

SEQ ID NO: 4020645 - RNA, 14 nt, Staphylococcus aureus subsp. aureus MW2
uuaaagucaguaua

SEQ ID NO: 4020646 - RNA, 14 nt, Staphylococcus aureus subsp. aureus MW2
uuaaagucuucauc

SEQ ID NO: 4020647 - RNA, 16 nt, Staphylococcus aureus subsp. aureus MW2
uuaaaguugauuuugc

SEQ ID NO: 4020648 - RNA, 17 nt, Staphylococcus aureus subsp. aureus MW2
uuaaaguuuuguucaau

SEQ ID NO: 4020649 - RNA, 13 nt, Staphylococcus aureus subsp. aureus MW2
uuaaauaaaaaua

SEQ ID NO: 4020650 - RNA, 15 nt, Staphylococcus aureus subsp. aureus MW2
uuaaauaagcuacua

SEQ ID NO: 4020651 - RNA, 14 nt, Staphylococcus aureus subsp. aureus MW2
uuaaauaaugauaa

SEQ ID NO: 4020652 - RNA, 16 nt, Staphylococcus aureus subsp. aureus MW2
uuaaauacgccaaaua

SEQ ID NO: 4020653 - RNA, 14 nt, Staphylococcus aureus subsp. aureus MW2
uuaaauacuauaua

SEQ ID NO: 4020654 - RNA, 17 nt, Staphylococcus aureus subsp. aureus MW2
uuaaauacuugcucuaa

SEQ ID NO: 4020655 - RNA, 15 nt, Staphylococcus aureus subsp. aureus MW2
uuaaauauaaccuaa

SEQ ID NO: 4020656 - RNA, 18 nt, Staphylococcus aureus subsp. aureus MW2
uuaaauauacuucuauua

SEQ ID NO: 4020657 - RNA, 21 nt, Staphylococcus aureus subsp. aureus MW2
uuaaauauacuuuuauagaaa

SEQ ID NO: 4020658 - RNA, 23 nt, Staphylococcus aureus subsp. aureus MW2
uuaaauauacuuuuauagaaaau

SEQ ID NO: 4020659 - RNA, 14 nt, Staphylococcus aureus subsp. aureus MW2
uuaaauauauauua

SEQ ID NO: 4020660 - RNA, 14 nt, Staphylococcus aureus subsp. aureus MW2
uuaaauaucaugca

SEQ ID NO: 4020661 - RNA, 20 nt, Staphylococcus aureus subsp. aureus MW2
uuaaauaucaugcaaaacua

SEQ ID NO: 4020662 - RNA, 13 nt, Staphylococcus aureus subsp. aureus MW2
uuaaauaugaaua

SEQ ID NO: 4020663 - RNA, 15 nt, Staphylococcus aureus subsp. aureus MW2
uuaaauauucuuauc

SEQ ID NO: 4020664 - RNA, 19 nt, Staphylococcus aureus subsp. aureus MW2
uuaaauauugauauaaaaa

SEQ ID NO: 4020665 - RNA, 23 nt, Staphylococcus aureus subsp. aureus MW2
uuaaaucaaaugguacaguuaau

SEQ ID NO: 4020666 - RNA, 14 nt, Staphylococcus aureus subsp. aureus MW2
uuaaaucaacauca

SEQ ID NO: 4020667 - RNA, 16 nt, Staphylococcus aureus subsp. aureus MW2
uuaaaucauuauuuua

SEQ ID NO: 4020668 - RNA, 13 nt, Staphylococcus aureus subsp. aureus MW2
uuaaaucauugcg

SEQ ID NO: 4020669 - RNA, 21 nt, Staphylococcus aureus subsp. aureus MW2
uuaaaucauugcguaacauca

SEQ ID NO: 4020670 - RNA, 20 nt, Staphylococcus aureus subsp. aureus MW2
uuaaaucguauauuaaauuu

SEQ ID NO: 4020671 - RNA, 23 nt, Staphylococcus aureus subsp. aureus MW2
uuaaaucguauauuaaauuuaca

SEQ ID NO: 4020672 - RNA, 17 nt, Staphylococcus aureus subsp. aureus MW2
uuaaaucuaauuauuca

SEQ ID NO: 4020673 - RNA, 19 nt, Staphylococcus aureus subsp. aureus MW2
uuaaaucugauucauuaaa

SEQ ID NO: 4020674 - RNA, 22 nt, Staphylococcus aureus subsp. aureus MW2
uuaaaucugcuugugugucauu

SEQ ID NO: 4020675 - RNA, 12 nt, Staphylococcus aureus subsp. aureus MW2
uuaaaucuucaa

SEQ ID NO: 4020676 - RNA, 13 nt, Staphylococcus aureus subsp. aureus MW2
uuaaaucuucuag

SEQ ID NO: 4020677 - RNA, 21 nt, Staphylococcus aureus subsp. aureus MW2
uuaaaucuucuaguaauucuu

SEQ ID NO: 4020678 - RNA, 20 nt, Staphylococcus aureus subsp. aureus MW2
uuaaaucuuuauaaaauugu

SEQ ID NO: 4020679 - RNA, 14 nt, Staphylococcus aureus subsp. aureus MW2
uuaaaucuuuuacu

SEQ ID NO: 4020680 - RNA, 23 nt, Staphylococcus aureus subsp. aureus MW2
uuaaaucuuuuacuaaaugaauu

SEQ ID NO: 4020681 - RNA, 22 nt, Staphylococcus aureus subsp. aureus MW2
uuaaaugacauggaaaauauau

SEQ ID NO: 4020682 - RNA, 14 nt, Staphylococcus aureus subsp. aureus MW2
uuaaaugcaauaca

SEQ ID NO: 4020683 - RNA, 21 nt, Staphylococcus aureus subsp. aureus MW2
uuaaaugcccaccauguacau

SEQ ID NO: 4020684 - RNA, 16 nt, Staphylococcus aureus subsp. aureus MW2
uuaaaugcuuuaaaua

SEQ ID NO: 4020685 - RNA, 18 nt, Staphylococcus aureus subsp. aureus MW2
uuaaaugcuuuaaauauu

SEQ ID NO: 4020686 - RNA, 19 nt, Staphylococcus aureus subsp. aureus MW2
uuaaaugcuuuaaauauug

SEQ ID NO: 4020687 - RNA, 12 nt, Staphylococcus aureus subsp. aureus MW2
uuaaaugcuuuc

SEQ ID NO: 4020688 - RNA, 22 nt, Staphylococcus aureus subsp. aureus MW2
uuaaauguacauuguaaauaua

SEQ ID NO: 4020689 - RNA, 15 nt, Staphylococcus aureus subsp. aureus MW2
uuaaauuauauguuu

SEQ ID NO: 4020690 - RNA, 21 nt, Staphylococcus aureus subsp. aureus MW2
uuaaauuauauguuuuuauua

SEQ ID NO: 4020691 - RNA, 21 nt, Staphylococcus aureus subsp. aureus MW2
uuaaauucaucuuaucaagaa

SEQ ID NO: 4020692 - RNA, 18 nt, Staphylococcus aureus subsp. aureus MW2
uuaaauucggaaaauauc

SEQ ID NO: 4020693 - RNA, 19 nt, Staphylococcus aureus subsp. aureus MW2
uuaaauucggaaaauauca

SEQ ID NO: 4020694 - RNA, 13 nt, Staphylococcus aureus subsp. aureus MW2
uuaaauucuaaaa

SEQ ID NO: 4020695 - RNA, 18 nt, Staphylococcus aureus subsp. aureus MW2
uuaaauucuuauaaaaua

SEQ ID NO: 4020696 - RNA, 19 nt, Staphylococcus aureus subsp. aureus MW2
uuaaauucuuauaaaauaa

SEQ ID NO: 4020697 - RNA, 21 nt, Staphylococcus aureus subsp. aureus MW2
uuaaauucuuauaaaauaaaa

SEQ ID NO: 4020698 - RNA, 12 nt, Staphylococcus aureus subsp. aureus MW2
uuaaauugaaau

SEQ ID NO: 4020699 - RNA, 15 nt, Staphylococcus aureus subsp. aureus MW2
uuaaauugaaauguu

SEQ ID NO: 4020700 - RNA, 21 nt, Staphylococcus aureus subsp. aureus MW2
uuaaauugcuugaaauuauua

SEQ ID NO: 4020701 - RNA, 13 nt, Staphylococcus aureus subsp. aureus MW2
uuaaauuuaauuu

SEQ ID NO: 4020702 - RNA, 16 nt, Staphylococcus aureus subsp. aureus MW2
uuaaauuuaauuucga

SEQ ID NO: 4020703 - RNA, 18 nt, Staphylococcus aureus subsp. aureus MW2
uuaaauuuaauuuuauuu

SEQ ID NO: 4020704 - RNA, 12 nt, Staphylococcus aureus subsp. aureus MW2
uuaaauuucaaa

SEQ ID NO: 4020705 - RNA, 17 nt, Staphylococcus aureus subsp. aureus MW2
uuaaauuucaaauauaa

SEQ ID NO: 4020706 - RNA, 13 nt, Staphylococcus aureus subsp. aureus MW2
uuaaauuuucauc

SEQ ID NO: 4020707 - RNA, 19 nt, Staphylococcus aureus subsp. aureus MW2
uuaaauuuucaucauaauc

SEQ ID NO: 4020708 - RNA, 16 nt, Staphylococcus aureus subsp. aureus MW2
uuaaauuuuuuaauau

SEQ ID NO: 4020709 - RNA, 15 nt, Staphylococcus aureus subsp. aureus MW2
uuaacaaauuaaaaa

SEQ ID NO: 4020710 - RNA, 14 nt, Staphylococcus aureus subsp. aureus MW2
uuaacaacaaauau

SEQ ID NO: 4020711 - RNA, 15 nt, Staphylococcus aureus subsp. aureus MW2
uuaacaauauauaau

SEQ ID NO: 4020712 - RNA, 13 nt, Staphylococcus aureus subsp. aureus MW2
uuaacaauaucau

SEQ ID NO: 4020713 - RNA, 14 nt, Staphylococcus aureus subsp. aureus MW2
uuaacaauauuaaa

SEQ ID NO: 4020714 - RNA, 20 nt, Staphylococcus aureus subsp. aureus MW2
uuaacaaugcgauuaaacuc

SEQ ID NO: 4020715 - RNA, 14 nt, Staphylococcus aureus subsp. aureus MW2
uuaacaauuuuaau

SEQ ID NO: 4020716 - RNA, 19 nt, Staphylococcus aureus subsp. aureus MW2
uuaacaauuuuaucugaau

SEQ ID NO: 4020717 - RNA, 20 nt, Staphylococcus aureus subsp. aureus MW2
uuaacaauuuuaucugaauc

SEQ ID NO: 4020718 - RNA, 22 nt, Staphylococcus aureus subsp. aureus MW2
uuaacaauuuuaucugaaucug

SEQ ID NO: 4020719 - RNA, 21 nt, Staphylococcus aureus subsp. aureus MW2
uuaacaccagauaucauaaua

SEQ ID NO: 4020720 - RNA, 14 nt, Staphylococcus aureus subsp. aureus MW2
uuaacauaaaauga

SEQ ID NO: 4020721 - RNA, 22 nt, Staphylococcus aureus subsp. aureus MW2
uuaacaucaugucgaaucaaag

SEQ ID NO: 4020722 - RNA, 12 nt, Staphylococcus aureus subsp. aureus MW2
uuaacaucauuu

SEQ ID NO: 4020723 - RNA, 13 nt, Staphylococcus aureus subsp. aureus MW2
uuaacaucugaau

SEQ ID NO: 4020724 - RNA, 23 nt, Staphylococcus aureus subsp. aureus MW2
uuaacaucuucauguaugaagua

SEQ ID NO: 4020725 - RNA, 16 nt, Staphylococcus aureus subsp. aureus MW2
uuaacauguauuuagu

SEQ ID NO: 4020726 - RNA, 23 nt, Staphylococcus aureus subsp. aureus MW2
uuaacauguauuuaguaucauaa

SEQ ID NO: 4020727 - RNA, 20 nt, Staphylococcus aureus subsp. aureus MW2
uuaacauuuauuuuuucucu

SEQ ID NO: 4020728 - RNA, 18 nt, Staphylococcus aureus subsp. aureus MW2
uuaacauuugucauaaua

SEQ ID NO: 4020729 - RNA, 12 nt, Staphylococcus aureus subsp. aureus MW2
uuaaccaacaug

SEQ ID NO: 4020730 - RNA, 19 nt, Staphylococcus aureus subsp. aureus MW2
uuaaccacuccuuaaacaa

SEQ ID NO: 4020731 - RNA, 17 nt, Staphylococcus aureus subsp. aureus MW2
uuaaccauuuaaaaauu

SEQ ID NO: 4020732 - RNA, 16 nt, Staphylococcus aureus subsp. aureus MW2
uuaaccauuucauuuc

SEQ ID NO: 4020733 - RNA, 18 nt, Staphylococcus aureus subsp. aureus MW2
uuaaccccuucaaaauuu

SEQ ID NO: 4020734 - RNA, 16 nt, Staphylococcus aureus subsp. aureus MW2
uuaacccuucuccaaa

SEQ ID NO: 4020735 - RNA, 21 nt, Staphylococcus aureus subsp. aureus MW2
uuaacccuucuccaaaaauaa

SEQ ID NO: 4020736 - RNA, 18 nt, Staphylococcus aureus subsp. aureus MW2
uuaaccuugauuuaauuu

SEQ ID NO: 4020737 - RNA, 15 nt, Staphylococcus aureus subsp. aureus MW2
uuaacgauuaauaua

SEQ ID NO: 4020738 - RNA, 14 nt, Staphylococcus aureus subsp. aureus MW2
uuaacgcaaaaaua

SEQ ID NO: 4020739 - RNA, 17 nt, Staphylococcus aureus subsp. aureus MW2
uuaacgcaaaaauacuc

SEQ ID NO: 4020740 - RNA, 20 nt, Staphylococcus aureus subsp. aureus MW2
uuaacgcuuauacuauauaa

SEQ ID NO: 4020741 - RNA, 12 nt, Staphylococcus aureus subsp. aureus MW2
uuaacuaaacca

SEQ ID NO: 4020742 - RNA, 15 nt, Staphylococcus aureus subsp. aureus MW2
uuaacuaauagacug

SEQ ID NO: 4020743 - RNA, 16 nt, Staphylococcus aureus subsp. aureus MW2
uuaacucuaucuauuu

SEQ ID NO: 4020744 - RNA, 17 nt, Staphylococcus aureus subsp. aureus MW2
uuaacucuugaaacaca

SEQ ID NO: 4020745 - RNA, 18 nt, Staphylococcus aureus subsp. aureus MW2
uuaacugggcaacuuuuu

SEQ ID NO: 4020746 - RNA, 22 nt, Staphylococcus aureus subsp. aureus MW2
uuaacugguugauaaauaaacu

SEQ ID NO: 4020747 - RNA, 23 nt, Staphylococcus aureus subsp. aureus MW2
uuaacugguugauaaauaaacuc

SEQ ID NO: 4020748 - RNA, 22 nt, Staphylococcus aureus subsp. aureus MW2
uuaacuguacgauucaauuuaa

SEQ ID NO: 4020749 - RNA, 19 nt, Staphylococcus aureus subsp. aureus MW2
uuaacuguuuauccauaua

SEQ ID NO: 4020750 - RNA, 17 nt, Staphylococcus aureus subsp. aureus MW2
uuaacuucauaauauau

SEQ ID NO: 4020751 - RNA, 15 nt, Staphylococcus aureus subsp. aureus MW2
uuaacuugaaauguu

SEQ ID NO: 4020752 - RNA, 14 nt, Staphylococcus aureus subsp. aureus MW2
uuaacuuuaacauc

SEQ ID NO: 4020753 - RNA, 14 nt, Staphylococcus aureus subsp. aureus MW2
uuaacuuucucaaa

SEQ ID NO: 4020754 - RNA, 21 nt, Staphylococcus aureus subsp. aureus MW2
uuaacuuuuuugugauuauua

SEQ ID NO: 4020755 - RNA, 17 nt, Staphylococcus aureus subsp. aureus MW2
uuaagaaacgucuuaau

SEQ ID NO: 4020756 - RNA, 16 nt, Staphylococcus aureus subsp. aureus MW2
uuaagaaaucaacaac

SEQ ID NO: 4020757 - RNA, 13 nt, Staphylococcus aureus subsp. aureus MW2
uuaagaaguuaaa

SEQ ID NO: 4020758 - RNA, 22 nt, Staphylococcus aureus subsp. aureus MW2
uuaagccagcagguuucacaaa

SEQ ID NO: 4020759 - RNA, 13 nt, Staphylococcus aureus subsp. aureus MW2
uuaagcccuuccc

SEQ ID NO: 4020760 - RNA, 19 nt, Staphylococcus aureus subsp. aureus MW2
uuaagccugauguaccacu

SEQ ID NO: 4020761 - RNA, 22 nt, Staphylococcus aureus subsp. aureus MW2
uuaagcucauuucaauauuaaa

SEQ ID NO: 4020762 - RNA, 20 nt, Staphylococcus aureus subsp. aureus MW2
uuaagcuuacgacauacuug

SEQ ID NO: 4020763 - RNA, 13 nt, Staphylococcus aureus subsp. aureus MW2
uuaagcuuuaauc

SEQ ID NO: 4020764 - RNA, 15 nt, Staphylococcus aureus subsp. aureus MW2
uuaagcuuucuaucu

SEQ ID NO: 4020765 - RNA, 18 nt, Staphylococcus aureus subsp. aureus MW2
uuaaguacaacaguugca

SEQ ID NO: 4020766 - RNA, 19 nt, Staphylococcus aureus subsp. aureus MW2
uuaaguagaugauuagugu

SEQ ID NO: 4020767 - RNA, 12 nt, Staphylococcus aureus subsp. aureus MW2
uuaagucaucaa

SEQ ID NO: 4020768 - RNA, 22 nt, Staphylococcus aureus subsp. aureus MW2
uuaagucgccuaacuuuuauua

SEQ ID NO: 4020769 - RNA, 18 nt, Staphylococcus aureus subsp. aureus MW2
uuaagugaguuuuauuua

SEQ ID NO: 4020770 - RNA, 19 nt, Staphylococcus aureus subsp. aureus MW2
uuaagugaugaccaauauu

SEQ ID NO: 4020771 - RNA, 23 nt, Staphylococcus aureus subsp. aureus MW2
uuaagugaugaccaauauucugg

SEQ ID NO: 4020772 - RNA, 19 nt, Staphylococcus aureus subsp. aureus MW2
uuaaguuaucuaaaccuuu

SEQ ID NO: 4020773 - RNA, 13 nt, Staphylococcus aureus subsp. aureus MW2
uuaauaaaacugc

SEQ ID NO: 4020774 - RNA, 19 nt, Staphylococcus aureus subsp. aureus MW2
uuaauaaacgcuucauagu

SEQ ID NO: 4020775 - RNA, 20 nt, Staphylococcus aureus subsp. aureus MW2
uuaauaaauuguaugaauaa

SEQ ID NO: 4020776 - RNA, 13 nt, Staphylococcus aureus subsp. aureus MW2
uuaauaaauuuaa

SEQ ID NO: 4020777 - RNA, 14 nt, Staphylococcus aureus subsp. aureus MW2
uuaauaacaaaauu

SEQ ID NO: 4020778 - RNA, 20 nt, Staphylococcus aureus subsp. aureus MW2
uuaauaacaaaauuaaauau

SEQ ID NO: 4020779 - RNA, 14 nt, Staphylococcus aureus subsp. aureus MW2
uuaauaacagaguu

SEQ ID NO: 4020780 - RNA, 22 nt, Staphylococcus aureus subsp. aureus MW2
uuaauaacauccccaaaaauag

SEQ ID NO: 4020781 - RNA, 19 nt, Staphylococcus aureus subsp. aureus MW2
uuaauaacccauuuucaaa

SEQ ID NO: 4020782 - RNA, 23 nt, Staphylococcus aureus subsp. aureus MW2
uuaauaaccuuuaaaacaucauu

SEQ ID NO: 4020783 - RNA, 19 nt, Staphylococcus aureus subsp. aureus MW2
uuaauaagcuaauauuuau

SEQ ID NO: 4020784 - RNA, 19 nt, Staphylococcus aureus subsp. aureus MW2
uuaauaauacauucauuaa

SEQ ID NO: 4020785 - RNA, 17 nt, Staphylococcus aureus subsp. aureus MW2
uuaauaaugaauucuau

SEQ ID NO: 4020786 - RNA, 18 nt, Staphylococcus aureus subsp. aureus MW2
uuaauaauuaaacaaaac

SEQ ID NO: 4020787 - RNA, 21 nt, Staphylococcus aureus subsp. aureus MW2
uuaauaauuaaacaaaacuua

SEQ ID NO: 4020788 - RNA, 15 nt, Staphylococcus aureus subsp. aureus MW2
uuaauacaucaauau

SEQ ID NO: 4020789 - RNA, 21 nt, Staphylococcus aureus subsp. aureus MW2
uuaauacuaauuuuguacaua

SEQ ID NO: 4020790 - RNA, 20 nt, Staphylococcus aureus subsp. aureus MW2
uuaauacuaccguuuuuaua

SEQ ID NO: 4020791 - RNA, 22 nt, Staphylococcus aureus subsp. aureus MW2
uuaauacuaccguuuuuauaua

SEQ ID NO: 4020792 - RNA, 20 nt, Staphylococcus aureus subsp. aureus MW2
uuaauacuauaguaagaaaa

SEQ ID NO: 4020793 - RNA, 16 nt, Staphylococcus aureus subsp. aureus MW2
uuaauagaaagugcgg

SEQ ID NO: 4020794 - RNA, 17 nt, Staphylococcus aureus subsp. aureus MW2
uuaauagagaaaaaaua

SEQ ID NO: 4020795 - RNA, 23 nt, Staphylococcus aureus subsp. aureus MW2
uuaauagagaaaaaauaaauguu

SEQ ID NO: 4020796 - RNA, 22 nt, Staphylococcus aureus subsp. aureus MW2
uuaauagagacauuuuaucuga

SEQ ID NO: 4020797 - RNA, 22 nt, Staphylococcus aureus subsp. aureus MW2
uuaauagagguauaauuaaaug

SEQ ID NO: 4020798 - RNA, 13 nt, Staphylococcus aureus subsp. aureus MW2
uuaauagaucuuu

SEQ ID NO: 4020799 - RNA, 19 nt, Staphylococcus aureus subsp. aureus MW2
uuaauaggauuauuaucaa

SEQ ID NO: 4020800 - RNA, 17 nt, Staphylococcus aureus subsp. aureus MW2
uuaauaguguuauauug

SEQ ID NO: 4020801 - RNA, 14 nt, Staphylococcus aureus subsp. aureus MW2
uuaauaguuuuaua

SEQ ID NO: 4020802 - RNA, 13 nt, Staphylococcus aureus subsp. aureus MW2
uuaauauaaauau

SEQ ID NO: 4020803 - RNA, 15 nt, Staphylococcus aureus subsp. aureus MW2
uuaauauaaauauca

SEQ ID NO: 4020804 - RNA, 13 nt, Staphylococcus aureus subsp. aureus MW2
uuaauauaaauuu

SEQ ID NO: 4020805 - RNA, 13 nt, Staphylococcus aureus subsp. aureus MW2
uuaauauaaguau

SEQ ID NO: 4020806 - RNA, 16 nt, Staphylococcus aureus subsp. aureus MW2
uuaauauaauuaauuu

SEQ ID NO: 4020807 - RNA, 23 nt, Staphylococcus aureus subsp. aureus MW2
uuaauauaauuacaaguuacauu

SEQ ID NO: 4020808 - RNA, 21 nt, Staphylococcus aureus subsp. aureus MW2
uuaauauacgagacauuucuu

SEQ ID NO: 4020809 - RNA, 13 nt, Staphylococcus aureus subsp. aureus MW2
uuaauauauuuau

SEQ ID NO: 4020810 - RNA, 15 nt, Staphylococcus aureus subsp. aureus MW2
uuaauauauuuauuu

SEQ ID NO: 4020811 - RNA, 13 nt, Staphylococcus aureus subsp. aureus MW2
uuaauauauuugg

SEQ ID NO: 4020812 - RNA, 17 nt, Staphylococcus aureus subsp. aureus MW2
uuaauaucacgaucuuu

SEQ ID NO: 4020813 - RNA, 19 nt, Staphylococcus aureus subsp. aureus MW2
uuaauaucacgaucuuuaa

SEQ ID NO: 4020814 - RNA, 12 nt, Staphylococcus aureus subsp. aureus MW2
uuaauauccaaa

SEQ ID NO: 4020815 - RNA, 14 nt, Staphylococcus aureus subsp. aureus MW2
uuaauauugaauaa

SEQ ID NO: 4020816 - RNA, 12 nt, Staphylococcus aureus subsp. aureus MW2
uuaauauuuauu

SEQ ID NO: 4020817 - RNA, 21 nt, Staphylococcus aureus subsp. aureus MW2
uuaauauuuauuaccuuaugg

SEQ ID NO: 4020818 - RNA, 18 nt, Staphylococcus aureus subsp. aureus MW2
uuaauauuugauuauucg

SEQ ID NO: 4020819 - RNA, 12 nt, Staphylococcus aureus subsp. aureus MW2
uuaauauuuucu

SEQ ID NO: 4020820 - RNA, 16 nt, Staphylococcus aureus subsp. aureus MW2
uuaauauuuuuuucaa

SEQ ID NO: 4020821 - RNA, 14 nt, Staphylococcus aureus subsp. aureus MW2
uuaaucaaauauuu

SEQ ID NO: 4020822 - RNA, 23 nt, Staphylococcus aureus subsp. aureus MW2
uuaaucaaauauuuuauuacauc

SEQ ID NO: 4020823 - RNA, 23 nt, Staphylococcus aureus subsp. aureus MW2
uuaaucaacguauauaaguuaaa

SEQ ID NO: 4020824 - RNA, 16 nt, Staphylococcus aureus subsp. aureus MW2
uuaaucaauuuaauua

SEQ ID NO: 4020825 - RNA, 18 nt, Staphylococcus aureus subsp. aureus MW2
uuaauccucauuaugaga

SEQ ID NO: 4020826 - RNA, 18 nt, Staphylococcus aureus subsp. aureus MW2
uuaaucgcucuaaauagu

SEQ ID NO: 4020827 - RNA, 19 nt, Staphylococcus aureus subsp. aureus MW2
uuaaucggaucauuauuua

SEQ ID NO: 4020828 - RNA, 14 nt, Staphylococcus aureus subsp. aureus MW2
uuaaucguaacaua

SEQ ID NO: 4020829 - RNA, 22 nt, Staphylococcus aureus subsp. aureus MW2
uuaaucguauuagccaauaaaa

SEQ ID NO: 4020830 - RNA, 14 nt, Staphylococcus aureus subsp. aureus MW2
uuaaucuauauaua

SEQ ID NO: 4020831 - RNA, 14 nt, Staphylococcus aureus subsp. aureus MW2
uuaaucuguaugua

SEQ ID NO: 4020832 - RNA, 20 nt, Staphylococcus aureus subsp. aureus MW2
uuaaucuguauguaagcaga

SEQ ID NO: 4020833 - RNA, 14 nt, Staphylococcus aureus subsp. aureus MW2
uuaaucuuaauauu

SEQ ID NO: 4020834 - RNA, 18 nt, Staphylococcus aureus subsp. aureus MW2
uuaaucuucaucuaaaaa

SEQ ID NO: 4020835 - RNA, 14 nt, Staphylococcus aureus subsp. aureus MW2
uuaaugaacgaauu

SEQ ID NO: 4020836 - RNA, 14 nt, Staphylococcus aureus subsp. aureus MW2
uuaaugaaguaaga

SEQ ID NO: 4020837 - RNA, 21 nt, Staphylococcus aureus subsp. aureus MW2
uuaaugacuaugcaaaugaaa

SEQ ID NO: 4020838 - RNA, 22 nt, Staphylococcus aureus subsp. aureus MW2
uuaaugacuucuuuauauuuau

SEQ ID NO: 4020839 - RNA, 21 nt, Staphylococcus aureus subsp. aureus MW2
uuaaugccauuguuauccaaa

SEQ ID NO: 4020840 - RNA, 20 nt, Staphylococcus aureus subsp. aureus MW2
uuaaugcuucaaauguaaca

SEQ ID NO: 4020841 - RNA, 19 nt, Staphylococcus aureus subsp. aureus MW2
uuaauggcaacuaagauga

SEQ ID NO: 4020842 - RNA, 18 nt, Staphylococcus aureus subsp. aureus MW2
uuaauguacuuuucuguc

SEQ ID NO: 4020843 - RNA, 16 nt, Staphylococcus aureus subsp. aureus MW2
uuaaugucuaaaaaug

SEQ ID NO: 4020844 - RNA, 11 nt, Staphylococcus aureus subsp. aureus MW2
uuaauguguaa

SEQ ID NO: 4020845 - RNA, 15 nt, Staphylococcus aureus subsp. aureus MW2
uuaauguguaaauuu

SEQ ID NO: 4020846 - RNA, 16 nt, Staphylococcus aureus subsp. aureus MW2
uuaauguuauaaauca

SEQ ID NO: 4020847 - RNA, 22 nt, Staphylococcus aureus subsp. aureus MW2
uuaauguuauaacccuaauucu

SEQ ID NO: 4020848 - RNA, 14 nt, Staphylococcus aureus subsp. aureus MW2
uuaauguucucgug

SEQ ID NO: 4020849 - RNA, 12 nt, Staphylococcus aureus subsp. aureus MW2
uuaauuaaacug

SEQ ID NO: 4020850 - RNA, 13 nt, Staphylococcus aureus subsp. aureus MW2
uuaauuaaagauu

SEQ ID NO: 4020851 - RNA, 23 nt, Staphylococcus aureus subsp. aureus MW2
uuaauuaaagcaucuucaauauu

SEQ ID NO: 4020852 - RNA, 15 nt, Staphylococcus aureus subsp. aureus MW2
uuaauuaauaauuua

SEQ ID NO: 4020853 - RNA, 14 nt, Staphylococcus aureus subsp. aureus MW2
uuaauuaauuauca

SEQ ID NO: 4020854 - RNA, 22 nt, Staphylococcus aureus subsp. aureus MW2
uuaauuacagcgugauucaucu

SEQ ID NO: 4020855 - RNA, 15 nt, Staphylococcus aureus subsp. aureus MW2
uuaauuacauguugg

SEQ ID NO: 4020856 - RNA, 19 nt, Staphylococcus aureus subsp. aureus MW2
uuaauuacuguaaauauga

SEQ ID NO: 4020857 - RNA, 16 nt, Staphylococcus aureus subsp. aureus MW2
uuaauuaucauaaaua

SEQ ID NO: 4020858 - RNA, 19 nt, Staphylococcus aureus subsp. aureus MW2
uuaauuaucauaaauauaa

SEQ ID NO: 4020859 - RNA, 12 nt, Staphylococcus aureus subsp. aureus MW2
uuaauuaucauu

SEQ ID NO: 4020860 - RNA, 21 nt, Staphylococcus aureus subsp. aureus MW2
uuaauuauguauuuuuauuua

SEQ ID NO: 4020861 - RNA, 22 nt, Staphylococcus aureus subsp. aureus MW2
uuaauuauugagaauauuuauu

SEQ ID NO: 4020862 - RNA, 15 nt, Staphylococcus aureus subsp. aureus MW2
uuaauuauuuagauu

SEQ ID NO: 4020863 - RNA, 14 nt, Staphylococcus aureus subsp. aureus MW2
uuaauuauuucccu

SEQ ID NO: 4020864 - RNA, 14 nt, Staphylococcus aureus subsp. aureus MW2
uuaauuauuugaua

SEQ ID NO: 4020865 - RNA, 21 nt, Staphylococcus aureus subsp. aureus MW2
uuaauucaggauggaaugaua

SEQ ID NO: 4020866 - RNA, 22 nt, Staphylococcus aureus subsp. aureus MW2
uuaauucaggauggaaugauac

SEQ ID NO: 4020867 - RNA, 15 nt, Staphylococcus aureus subsp. aureus MW2
uuaauucauuccaaa

SEQ ID NO: 4020868 - RNA, 18 nt, Staphylococcus aureus subsp. aureus MW2
uuaauucguguuugcaua

SEQ ID NO: 4020869 - RNA, 13 nt, Staphylococcus aureus subsp. aureus MW2
uuaauucuuaauc

SEQ ID NO: 4020870 - RNA, 16 nt, Staphylococcus aureus subsp. aureus MW2
uuaauucuuugaaaac

SEQ ID NO: 4020871 - RNA, 14 nt, Staphylococcus aureus subsp. aureus MW2
uuaauugaaaauaa

SEQ ID NO: 4020872 - RNA, 20 nt, Staphylococcus aureus subsp. aureus MW2
uuaauugcagguaaacggaa

SEQ ID NO: 4020873 - RNA, 17 nt, Staphylococcus aureus subsp. aureus MW2
uuaauugguuucacauu

SEQ ID NO: 4020874 - RNA, 15 nt, Staphylococcus aureus subsp. aureus MW2
uuaauuguuuaauaa

SEQ ID NO: 4020875 - RNA, 17 nt, Staphylococcus aureus subsp. aureus MW2
uuaauuuaauugaagua

SEQ ID NO: 4020876 - RNA, 21 nt, Staphylococcus aureus subsp. aureus MW2
uuaauuuaguucgauaacaca

SEQ ID NO: 4020877 - RNA, 15 nt, Staphylococcus aureus subsp. aureus MW2
uuaauuucaacauua

SEQ ID NO: 4020878 - RNA, 16 nt, Staphylococcus aureus subsp. aureus MW2
uuaauuucacuuuaac

SEQ ID NO: 4020879 - RNA, 13 nt, Staphylococcus aureus subsp. aureus MW2
uuaauuucuggua

SEQ ID NO: 4020880 - RNA, 18 nt, Staphylococcus aureus subsp. aureus MW2
uuaauuuguauuuaaaau

SEQ ID NO: 4020881 - RNA, 20 nt, Staphylococcus aureus subsp. aureus MW2
uuaauuuguauuuaaaauca

SEQ ID NO: 4020882 - RNA, 18 nt, Staphylococcus aureus subsp. aureus MW2
uuaauuuguuuuaaauac

SEQ ID NO: 4020883 - RNA, 15 nt, Staphylococcus aureus subsp. aureus MW2
uuaauuuuauuauua

SEQ ID NO: 4020884 - RNA, 14 nt, Staphylococcus aureus subsp. aureus MW2
uuaauuuuauuuua

SEQ ID NO: 4020885 - RNA, 14 nt, Staphylococcus aureus subsp. aureus MW2
uuaauuuucucaaa

SEQ ID NO: 4020886 - RNA, 19 nt, Staphylococcus aureus subsp. aureus MW2
uuaauuuugauauuuuuca

SEQ ID NO: 4020887 - RNA, 20 nt, Staphylococcus aureus subsp. aureus MW2
uuaauuuuucauuaauacaa

SEQ ID NO: 4020888 - RNA, 14 nt, Staphylococcus aureus subsp. aureus MW2
uuaauuuuuuauua

SEQ ID NO: 4020889 - RNA, 19 nt, Staphylococcus aureus subsp. aureus MW2
uuacaaaaucaccuuuuuu

SEQ ID NO: 4020890 - RNA, 16 nt, Staphylococcus aureus subsp. aureus MW2
uuacaaacuucacauu

SEQ ID NO: 4020891 - RNA, 19 nt, Staphylococcus aureus subsp. aureus MW2
uuacaaacuucacauuaug

SEQ ID NO: 4020892 - RNA, 21 nt, Staphylococcus aureus subsp. aureus MW2
uuacaaaucaugacauaaaac

SEQ ID NO: 4020893 - RNA, 22 nt, Staphylococcus aureus subsp. aureus MW2
uuacaaaugaagguguugaaaa

SEQ ID NO: 4020894 - RNA, 13 nt, Staphylococcus aureus subsp. aureus MW2
uuacaacguccac

SEQ ID NO: 4020895 - RNA, 14 nt, Staphylococcus aureus subsp. aureus MW2
uuacaacuuauucu

SEQ ID NO: 4020896 - RNA, 16 nt, Staphylococcus aureus subsp. aureus MW2
uuacaagaacaugaua

SEQ ID NO: 4020897 - RNA, 12 nt, Staphylococcus aureus subsp. aureus MW2
uuacaaguuguu

SEQ ID NO: 4020898 - RNA, 11 nt, Staphylococcus aureus subsp. aureus MW2
uuacaauaaug

SEQ ID NO: 4020899 - RNA, 16 nt, Staphylococcus aureus subsp. aureus MW2
uuacaauaaugugcaa

SEQ ID NO: 4020900 - RNA, 20 nt, Staphylococcus aureus subsp. aureus MW2
uuacaauaaugugcaaguug

SEQ ID NO: 4020901 - RNA, 19 nt, Staphylococcus aureus subsp. aureus MW2
uuacaaucaucacacauaa

SEQ ID NO: 4020902 - RNA, 20 nt, Staphylococcus aureus subsp. aureus MW2
uuacaaugcgcaaugaaaac

SEQ ID NO: 4020903 - RNA, 16 nt, Staphylococcus aureus subsp. aureus MW2
uuacacaaauuaaaac

SEQ ID NO: 4020904 - RNA, 22 nt, Staphylococcus aureus subsp. aureus MW2
uuacacccuuuaaauuuaacuc

SEQ ID NO: 4020905 - RNA, 18 nt, Staphylococcus aureus subsp. aureus MW2
uuacaccugcaacacuag

SEQ ID NO: 4020906 - RNA, 23 nt, Staphylococcus aureus subsp. aureus MW2
uuacacuaaaaccuauuccuaau

SEQ ID NO: 4020907 - RNA, 13 nt, Staphylococcus aureus subsp. aureus MW2
uuacagauuucug

SEQ ID NO: 4020908 - RNA, 22 nt, Staphylococcus aureus subsp. aureus MW2
uuacaggagcgagccauuauua

SEQ ID NO: 4020909 - RNA, 20 nt, Staphylococcus aureus subsp. aureus MW2
uuacagguuuuaaaauuaaa

SEQ ID NO: 4020910 - RNA, 18 nt, Staphylococcus aureus subsp. aureus MW2
uuacauauacgacauuuu

SEQ ID NO: 4020911 - RNA, 17 nt, Staphylococcus aureus subsp. aureus MW2
uuacaucgacaauuuuc

SEQ ID NO: 4020912 - RNA, 22 nt, Staphylococcus aureus subsp. aureus MW2
uuacaucuuuaagcucuuaauc

SEQ ID NO: 4020913 - RNA, 21 nt, Staphylococcus aureus subsp. aureus MW2
uuacaugcaccuuuacaacau

SEQ ID NO: 4020914 - RNA, 22 nt, Staphylococcus aureus subsp. aureus MW2
uuacaugcaccuuuacaacaua

SEQ ID NO: 4020915 - RNA, 20 nt, Staphylococcus aureus subsp. aureus MW2
uuacauguuacugaugaaca

SEQ ID NO: 4020916 - RNA, 12 nt, Staphylococcus aureus subsp. aureus MW2
uuacauguuggc

SEQ ID NO: 4020917 - RNA, 14 nt, Staphylococcus aureus subsp. aureus MW2
uuacauuaugaaca

SEQ ID NO: 4020918 - RNA, 21 nt, Staphylococcus aureus subsp. aureus MW2
uuacauucuauacuuuuaauu

SEQ ID NO: 4020919 - RNA, 22 nt, Staphylococcus aureus subsp. aureus MW2
uuacauugccuaagaacuuaau

SEQ ID NO: 4020920 - RNA, 14 nt, Staphylococcus aureus subsp. aureus MW2
uuacauuuaacauu

SEQ ID NO: 4020921 - RNA, 16 nt, Staphylococcus aureus subsp. aureus MW2
uuacauuuaacauuuc

SEQ ID NO: 4020922 - RNA, 12 nt, Staphylococcus aureus subsp. aureus MW2
uuacauuuaugg

SEQ ID NO: 4020923 - RNA, 20 nt, Staphylococcus aureus subsp. aureus MW2
uuacauuuggcguaaugaua

SEQ ID NO: 4020924 - RNA, 11 nt, Staphylococcus aureus subsp. aureus MW2
uuaccaaaauu

SEQ ID NO: 4020925 - RNA, 14 nt, Staphylococcus aureus subsp. aureus MW2
uuaccaguaacagc

SEQ ID NO: 4020926 - RNA, 17 nt, Staphylococcus aureus subsp. aureus MW2
uuaccaguaacagcuaa

SEQ ID NO: 4020927 - RNA, 14 nt, Staphylococcus aureus subsp. aureus MW2
uuaccaguaucauu

SEQ ID NO: 4020928 - RNA, 12 nt, Staphylococcus aureus subsp. aureus MW2
uuaccaucuuua

SEQ ID NO: 4020929 - RNA, 12 nt, Staphylococcus aureus subsp. aureus MW2
uuacccaaaaaa

SEQ ID NO: 4020930 - RNA, 20 nt, Staphylococcus aureus subsp. aureus MW2
uuacccacaucuuuuuaaaa

SEQ ID NO: 4020931 - RNA, 21 nt, Staphylococcus aureus subsp. aureus MW2
uuaccguguucagguguaucu

SEQ ID NO: 4020932 - RNA, 18 nt, Staphylococcus aureus subsp. aureus MW2
uuaccuguuucuauauua

SEQ ID NO: 4020933 - RNA, 13 nt, Staphylococcus aureus subsp. aureus MW2
uuaccuuuaauua

SEQ ID NO: 4020934 - RNA, 15 nt, Staphylococcus aureus subsp. aureus MW2
uuaccuuuaauuaca

SEQ ID NO: 4020935 - RNA, 15 nt, Staphylococcus aureus subsp. aureus MW2
uuacgaucauaaaua

SEQ ID NO: 4020936 - RNA, 18 nt, Staphylococcus aureus subsp. aureus MW2
uuacgaucauaaauauuu

SEQ ID NO: 4020937 - RNA, 20 nt, Staphylococcus aureus subsp. aureus MW2
uuacgauugggcaacuuuug

SEQ ID NO: 4020938 - RNA, 15 nt, Staphylococcus aureus subsp. aureus MW2
uuacgcuuacuuaua

SEQ ID NO: 4020939 - RNA, 12 nt, Staphylococcus aureus subsp. aureus MW2
uuacuaaaacaa

SEQ ID NO: 4020940 - RNA, 20 nt, Staphylococcus aureus subsp. aureus MW2
uuacuaaaugaauugcuugu

SEQ ID NO: 4020941 - RNA, 15 nt, Staphylococcus aureus subsp. aureus MW2
uuacuaccuauuaau

SEQ ID NO: 4020942 - RNA, 15 nt, Staphylococcus aureus subsp. aureus MW2
uuacuacucauuauu

SEQ ID NO: 4020943 - RNA, 16 nt, Staphylococcus aureus subsp. aureus MW2
uuacuacucauuauua

SEQ ID NO: 4020944 - RNA, 15 nt, Staphylococcus aureus subsp. aureus MW2
uuacuacuuaauuaa

SEQ ID NO: 4020945 - RNA, 16 nt, Staphylococcus aureus subsp. aureus MW2
uuacuacuuaauuaau

SEQ ID NO: 4020946 - RNA, 16 nt, Staphylococcus aureus subsp. aureus MW2
uuacuaguuuguaaua

SEQ ID NO: 4020947 - RNA, 22 nt, Staphylococcus aureus subsp. aureus MW2
uuacuauauucaaugauuagua

SEQ ID NO: 4020948 - RNA, 18 nt, Staphylococcus aureus subsp. aureus MW2
uuacuauggcauuauugc

SEQ ID NO: 4020949 - RNA, 15 nt, Staphylococcus aureus subsp. aureus MW2
uuacuauuaaaggaa

SEQ ID NO: 4020950 - RNA, 21 nt, Staphylococcus aureus subsp. aureus MW2
uuacucguauauaccuugaug

SEQ ID NO: 4020951 - RNA, 14 nt, Staphylococcus aureus subsp. aureus MW2
uuacugaugaacau

SEQ ID NO: 4020952 - RNA, 14 nt, Staphylococcus aureus subsp. aureus MW2
uuacuguaguacua

SEQ ID NO: 4020953 - RNA, 14 nt, Staphylococcus aureus subsp. aureus MW2
uuacugucaucuuu

SEQ ID NO: 4020954 - RNA, 22 nt, Staphylococcus aureus subsp. aureus MW2
uuacuuauauuuuaaugaccua

SEQ ID NO: 4020955 - RNA, 13 nt, Staphylococcus aureus subsp. aureus MW2
uuacuuauucaaa

SEQ ID NO: 4020956 - RNA, 11 nt, Staphylococcus aureus subsp. aureus MW2
uuacuucaguu

SEQ ID NO: 4020957 - RNA, 13 nt, Staphylococcus aureus subsp. aureus MW2
uuacuucaguuug

SEQ ID NO: 4020958 - RNA, 21 nt, Staphylococcus aureus subsp. aureus MW2
uuacuuccgacugcaccucca

SEQ ID NO: 4020959 - RNA, 18 nt, Staphylococcus aureus subsp. aureus MW2
uuacuucuaauaguaaug

SEQ ID NO: 4020960 - RNA, 13 nt, Staphylococcus aureus subsp. aureus MW2
uuacuucuccaug

SEQ ID NO: 4020961 - RNA, 22 nt, Staphylococcus aureus subsp. aureus MW2
uuacuugcuuuuucaaauaaua

SEQ ID NO: 4020962 - RNA, 13 nt, Staphylococcus aureus subsp. aureus MW2
uuacuuuuuuaau

SEQ ID NO: 4020963 - RNA, 16 nt, Staphylococcus aureus subsp. aureus MW2
uuacuuuuuuaaugua

SEQ ID NO: 4020964 - RNA, 14 nt, Staphylococcus aureus subsp. aureus MW2
uuagaaaaauauga

SEQ ID NO: 4020965 - RNA, 19 nt, Staphylococcus aureus subsp. aureus MW2
uuagaaaaguaaguaaaau

SEQ ID NO: 4020966 - RNA, 21 nt, Staphylococcus aureus subsp. aureus MW2
uuagaaaguuuuauuuaaauu

SEQ ID NO: 4020967 - RNA, 22 nt, Staphylococcus aureus subsp. aureus MW2
uuagaacaguuagaaacagaau

SEQ ID NO: 4020968 - RNA, 12 nt, Staphylococcus aureus subsp. aureus MW2
uuagaaccauca

SEQ ID NO: 4020969 - RNA, 23 nt, Staphylococcus aureus subsp. aureus MW2
uuagaaccaucauuuauauggaa

SEQ ID NO: 4020970 - RNA, 19 nt, Staphylococcus aureus subsp. aureus MW2
uuagaacuucucuuugaac

SEQ ID NO: 4020971 - RNA, 13 nt, Staphylococcus aureus subsp. aureus MW2
uuagaagaaacuu

SEQ ID NO: 4020972 - RNA, 23 nt, Staphylococcus aureus subsp. aureus MW2
uuagaagaacaauaauugaugaa

SEQ ID NO: 4020973 - RNA, 23 nt, Staphylococcus aureus subsp. aureus MW2
uuagaagaugauuauucucuuua

SEQ ID NO: 4020974 - RNA, 19 nt, Staphylococcus aureus subsp. aureus MW2
uuagaauuaguacuugaaa

SEQ ID NO: 4020975 - RNA, 14 nt, Staphylococcus aureus subsp. aureus MW2
uuagaauucuaaau

SEQ ID NO: 4020976 - RNA, 15 nt, Staphylococcus aureus subsp. aureus MW2
uuagaauuuaacauu

SEQ ID NO: 4020977 - RNA, 19 nt, Staphylococcus aureus subsp. aureus MW2
uuagaccccuaauuaaaau

SEQ ID NO: 4020978 - RNA, 18 nt, Staphylococcus aureus subsp. aureus MW2
uuagacgcuguuuuaaau

SEQ ID NO: 4020979 - RNA, 16 nt, Staphylococcus aureus subsp. aureus MW2
uuagacuaaaaaacua

SEQ ID NO: 4020980 - RNA, 18 nt, Staphylococcus aureus subsp. aureus MW2
uuagagauuguaagaauu

SEQ ID NO: 4020981 - RNA, 15 nt, Staphylococcus aureus subsp. aureus MW2
uuagauaaaacaaaa

SEQ ID NO: 4020982 - RNA, 21 nt, Staphylococcus aureus subsp. aureus MW2
uuagauaaauuaauaugaaca

SEQ ID NO: 4020983 - RNA, 15 nt, Staphylococcus aureus subsp. aureus MW2
uuagauaauaaggaa

SEQ ID NO: 4020984 - RNA, 17 nt, Staphylococcus aureus subsp. aureus MW2
uuagauauaauaaaaac

SEQ ID NO: 4020985 - RNA, 21 nt, Staphylococcus aureus subsp. aureus MW2
uuagauauauuugaaagguaa

SEQ ID NO: 4020986 - RNA, 15 nt, Staphylococcus aureus subsp. aureus MW2
uuagauaucuuaauc

SEQ ID NO: 4020987 - RNA, 21 nt, Staphylococcus aureus subsp. aureus MW2
uuagaugugcgugguuuauuu

SEQ ID NO: 4020988 - RNA, 17 nt, Staphylococcus aureus subsp. aureus MW2
uuagauucacuguauaa

SEQ ID NO: 4020989 - RNA, 14 nt, Staphylococcus aureus subsp. aureus MW2
uuagauucuuuucu

SEQ ID NO: 4020990 - RNA, 14 nt, Staphylococcus aureus subsp. aureus MW2
uuagauugacuaag

SEQ ID NO: 4020991 - RNA, 21 nt, Staphylococcus aureus subsp. aureus MW2
uuagauugacuaaguuuguuu

SEQ ID NO: 4020992 - RNA, 17 nt, Staphylococcus aureus subsp. aureus MW2
uuagauuguauguuaua

SEQ ID NO: 4020993 - RNA, 12 nt, Staphylococcus aureus subsp. aureus MW2
uuagauuucaaa

SEQ ID NO: 4020994 - RNA, 18 nt, Staphylococcus aureus subsp. aureus MW2
uuagauuuuauauaaaaa

SEQ ID NO: 4020995 - RNA, 18 nt, Staphylococcus aureus subsp. aureus MW2
uuagcaaaacgcauuuca

SEQ ID NO: 4020996 - RNA, 13 nt, Staphylococcus aureus subsp. aureus MW2
uuagcaaaugguc

SEQ ID NO: 4020997 - RNA, 14 nt, Staphylococcus aureus subsp. aureus MW2
uuagcauacauuaa

SEQ ID NO: 4020998 - RNA, 19 nt, Staphylococcus aureus subsp. aureus MW2
uuagcauaccuuuauuauu

SEQ ID NO: 4020999 - RNA, 18 nt, Staphylococcus aureus subsp. aureus MW2
uuagcaugacuguaagua

SEQ ID NO: 4021000 - RNA, 19 nt, Staphylococcus aureus subsp. aureus MW2
uuagcauuaaauuccaugu

SEQ ID NO: 4021001 - RNA, 23 nt, Staphylococcus aureus subsp. aureus MW2
uuagccccagcaaauacuucaag

SEQ ID NO: 4021002 - RNA, 15 nt, Staphylococcus aureus subsp. aureus MW2
uuagcgucauuuuua

SEQ ID NO: 4021003 - RNA, 23 nt, Staphylococcus aureus subsp. aureus MW2
uuagcuaagccuguuugacacau

SEQ ID NO: 4021004 - RNA, 23 nt, Staphylococcus aureus subsp. aureus MW2
uuagcuuuuguaaagcuuuaguu

SEQ ID NO: 4021005 - RNA, 19 nt, Staphylococcus aureus subsp. aureus MW2
uuaggaaaacuucaauaau

SEQ ID NO: 4021006 - RNA, 19 nt, Staphylococcus aureus subsp. aureus MW2
uuaggaaucgucauauuaa

SEQ ID NO: 4021007 - RNA, 22 nt, Staphylococcus aureus subsp. aureus MW2
uuaggaaucgucauauuaauau

SEQ ID NO: 4021008 - RNA, 15 nt, Staphylococcus aureus subsp. aureus MW2
uuaggaaugauagau

SEQ ID NO: 4021009 - RNA, 20 nt, Staphylococcus aureus subsp. aureus MW2
uuaggaaugauagauuuagg

SEQ ID NO: 4021010 - RNA, 13 nt, Staphylococcus aureus subsp. aureus MW2
uuaggacauugau

SEQ ID NO: 4021011 - RNA, 20 nt, Staphylococcus aureus subsp. aureus MW2
uuaggauccaauuuauaaug

SEQ ID NO: 4021012 - RNA, 22 nt, Staphylococcus aureus subsp. aureus MW2
uuaggauguucagcuaacucuu

SEQ ID NO: 4021013 - RNA, 17 nt, Staphylococcus aureus subsp. aureus MW2
uuaggauucgauugguu

SEQ ID NO: 4021014 - RNA, 17 nt, Staphylococcus aureus subsp. aureus MW2
uuaggcuuaaauauaau

SEQ ID NO: 4021015 - RNA, 21 nt, Staphylococcus aureus subsp. aureus MW2
uuaggcuuauuaacuuuuccu

SEQ ID NO: 4021016 - RNA, 13 nt, Staphylococcus aureus subsp. aureus MW2
uuagguaaaaauu

SEQ ID NO: 4021017 - RNA, 19 nt, Staphylococcus aureus subsp. aureus MW2
uuaggucuacgaucaaaau

SEQ ID NO: 4021018 - RNA, 20 nt, Staphylococcus aureus subsp. aureus MW2
uuagguggagauuuaacaau

SEQ ID NO: 4021019 - RNA, 17 nt, Staphylococcus aureus subsp. aureus MW2
uuagguugauuucugcu

SEQ ID NO: 4021020 - RNA, 13 nt, Staphylococcus aureus subsp. aureus MW2
uuaguaaauauag

SEQ ID NO: 4021021 - RNA, 19 nt, Staphylococcus aureus subsp. aureus MW2
uuaguaaggaauauuuccc

SEQ ID NO: 4021022 - RNA, 18 nt, Staphylococcus aureus subsp. aureus MW2
uuaguaaguuguacuucu

SEQ ID NO: 4021023 - RNA, 12 nt, Staphylococcus aureus subsp. aureus MW2
uuaguaauaaca

SEQ ID NO: 4021024 - RNA, 15 nt, Staphylococcus aureus subsp. aureus MW2
uuaguaauaacaucu

SEQ ID NO: 4021025 - RNA, 15 nt, Staphylococcus aureus subsp. aureus MW2
uuaguaauuuuacaa

SEQ ID NO: 4021026 - RNA, 17 nt, Staphylococcus aureus subsp. aureus MW2
uuaguacacguguauug

SEQ ID NO: 4021027 - RNA, 18 nt, Staphylococcus aureus subsp. aureus MW2
uuaguacacguguauugu

SEQ ID NO: 4021028 - RNA, 21 nt, Staphylococcus aureus subsp. aureus MW2
uuaguacggcugcuuuaacug

SEQ ID NO: 4021029 - RNA, 22 nt, Staphylococcus aureus subsp. aureus MW2
uuaguacuaaaccgauuaauau

SEQ ID NO: 4021030 - RNA, 16 nt, Staphylococcus aureus subsp. aureus MW2
uuaguacuuaauacua

SEQ ID NO: 4021031 - RNA, 19 nt, Staphylococcus aureus subsp. aureus MW2
uuaguacuuaauacuaauu

SEQ ID NO: 4021032 - RNA, 20 nt, Staphylococcus aureus subsp. aureus MW2
uuaguaguuuauaucaaaaa

SEQ ID NO: 4021033 - RNA, 18 nt, Staphylococcus aureus subsp. aureus MW2
uuaguauaaauaaaaaua

SEQ ID NO: 4021034 - RNA, 13 nt, Staphylococcus aureus subsp. aureus MW2
uuaguaugacuua

SEQ ID NO: 4021035 - RNA, 16 nt, Staphylococcus aureus subsp. aureus MW2
uuaguauggaauaaau

SEQ ID NO: 4021036 - RNA, 19 nt, Staphylococcus aureus subsp. aureus MW2
uuaguauggaauaaauggu

SEQ ID NO: 4021037 - RNA, 15 nt, Staphylococcus aureus subsp. aureus MW2
uuaguauuucaucau

SEQ ID NO: 4021038 - RNA, 22 nt, Staphylococcus aureus subsp. aureus MW2
uuagucauugaaaauauuuuau

SEQ ID NO: 4021039 - RNA, 23 nt, Staphylococcus aureus subsp. aureus MW2
uuagugacaaguaugucaucuuc

SEQ ID NO: 4021040 - RNA, 15 nt, Staphylococcus aureus subsp. aureus MW2
uuaguguagaaaaua

SEQ ID NO: 4021041 - RNA, 15 nt, Staphylococcus aureus subsp. aureus MW2
uuaguuauacuacua

SEQ ID NO: 4021042 - RNA, 19 nt, Staphylococcus aureus subsp. aureus MW2
uuaguucacaugaauuuua

SEQ ID NO: 4021043 - RNA, 23 nt, Staphylococcus aureus subsp. aureus MW2
uuaguugccccuagcaaaaauac

SEQ ID NO: 4021044 - RNA, 16 nt, Staphylococcus aureus subsp. aureus MW2
uuaguuugacaucuau

SEQ ID NO: 4021045 - RNA, 12 nt, Staphylococcus aureus subsp. aureus MW2
uuauaaaaaacg

SEQ ID NO: 4021046 - RNA, 14 nt, Staphylococcus aureus subsp. aureus MW2
uuauaaaaagagau

SEQ ID NO: 4021047 - RNA, 21 nt, Staphylococcus aureus subsp. aureus MW2
uuauaaaaagauauaagaaaa

SEQ ID NO: 4021048 - RNA, 17 nt, Staphylococcus aureus subsp. aureus MW2
uuauaaaaguguaaugu

SEQ ID NO: 4021049 - RNA, 17 nt, Staphylococcus aureus subsp. aureus MW2
uuauaaaaugaauaauu

SEQ ID NO: 4021050 - RNA, 22 nt, Staphylococcus aureus subsp. aureus MW2
uuauaaagacaccuucaauauc

SEQ ID NO: 4021051 - RNA, 23 nt, Staphylococcus aureus subsp. aureus MW2
uuauaaauaaacauaaaaauauu

SEQ ID NO: 4021052 - RNA, 14 nt, Staphylococcus aureus subsp. aureus MW2
uuauaaauaucuuu

SEQ ID NO: 4021053 - RNA, 21 nt, Staphylococcus aureus subsp. aureus MW2
uuauaaaugaauuauuuaaaa

SEQ ID NO: 4021054 - RNA, 14 nt, Staphylococcus aureus subsp. aureus MW2
uuauaaaugauuaa

SEQ ID NO: 4021055 - RNA, 18 nt, Staphylococcus aureus subsp. aureus MW2
uuauaaaugauuaaagug

SEQ ID NO: 4021056 - RNA, 12 nt, Staphylococcus aureus subsp. aureus MW2
uuauaaauuucg

SEQ ID NO: 4021057 - RNA, 23 nt, Staphylococcus aureus subsp. aureus MW2
uuauaaauuucgauuaauugaau

SEQ ID NO: 4021058 - RNA, 17 nt, Staphylococcus aureus subsp. aureus MW2
uuauaacauccccuucu

SEQ ID NO: 4021059 - RNA, 23 nt, Staphylococcus aureus subsp. aureus MW2
uuauaacuaaagaacuauguuca

SEQ ID NO: 4021060 - RNA, 19 nt, Staphylococcus aureus subsp. aureus MW2
uuauaaguuaaaaauguaa

SEQ ID NO: 4021061 - RNA, 22 nt, Staphylococcus aureus subsp. aureus MW2
uuauaaguuaaaaauguaaaua

SEQ ID NO: 4021062 - RNA, 14 nt, Staphylococcus aureus subsp. aureus MW2
uuauaaguugcaua

SEQ ID NO: 4021063 - RNA, 15 nt, Staphylococcus aureus subsp. aureus MW2
uuauaauagagaaac

SEQ ID NO: 4021064 - RNA, 17 nt, Staphylococcus aureus subsp. aureus MW2
uuauaauauuaaauugc

SEQ ID NO: 4021065 - RNA, 16 nt, Staphylococcus aureus subsp. aureus MW2
uuauaaugauuaaaaa

SEQ ID NO: 4021066 - RNA, 14 nt, Staphylococcus aureus subsp. aureus MW2
uuauaauuguaaug

SEQ ID NO: 4021067 - RNA, 13 nt, Staphylococcus aureus subsp. aureus MW2
uuauaauuguuca

SEQ ID NO: 4021068 - RNA, 12 nt, Staphylococcus aureus subsp. aureus MW2
uuauaauuuaau

SEQ ID NO: 4021069 - RNA, 23 nt, Staphylococcus aureus subsp. aureus MW2
uuauaauuucaguaggacacaua

SEQ ID NO: 4021070 - RNA, 15 nt, Staphylococcus aureus subsp. aureus MW2
uuauacagugaaucu

SEQ ID NO: 4021071 - RNA, 19 nt, Staphylococcus aureus subsp. aureus MW2
uuauacauguacauuauca

SEQ ID NO: 4021072 - RNA, 14 nt, Staphylococcus aureus subsp. aureus MW2
uuauaccaauaauu

SEQ ID NO: 4021073 - RNA, 19 nt, Staphylococcus aureus subsp. aureus MW2
uuauacuaaauugagaagu

SEQ ID NO: 4021074 - RNA, 22 nt, Staphylococcus aureus subsp. aureus MW2
uuauacuauaaauaaaaauaua

SEQ ID NO: 4021075 - RNA, 16 nt, Staphylococcus aureus subsp. aureus MW2
uuauagaaagcaaugu

SEQ ID NO: 4021076 - RNA, 21 nt, Staphylococcus aureus subsp. aureus MW2
uuauagaugacuguagaaaac

SEQ ID NO: 4021077 - RNA, 18 nt, Staphylococcus aureus subsp. aureus MW2
uuauagcaaauugauuaa

SEQ ID NO: 4021078 - RNA, 22 nt, Staphylococcus aureus subsp. aureus MW2
uuauagcaaauugauuaaauaa

SEQ ID NO: 4021079 - RNA, 17 nt, Staphylococcus aureus subsp. aureus MW2
uuauagcauuucuuuau

SEQ ID NO: 4021080 - RNA, 13 nt, Staphylococcus aureus subsp. aureus MW2
uuauagccuucau

SEQ ID NO: 4021081 - RNA, 16 nt, Staphylococcus aureus subsp. aureus MW2
uuauagguauaagaau

SEQ ID NO: 4021082 - RNA, 22 nt, Staphylococcus aureus subsp. aureus MW2
uuauagugguaaaaaguuuaaa

SEQ ID NO: 4021083 - RNA, 14 nt, Staphylococcus aureus subsp. aureus MW2
uuauauaaaaagaa

SEQ ID NO: 4021084 - RNA, 14 nt, Staphylococcus aureus subsp. aureus MW2
uuauauauaaaauc

SEQ ID NO: 4021085 - RNA, 14 nt, Staphylococcus aureus subsp. aureus MW2
uuauauauauuaaa

SEQ ID NO: 4021086 - RNA, 17 nt, Staphylococcus aureus subsp. aureus MW2
uuauauauauuaaagua

SEQ ID NO: 4021087 - RNA, 13 nt, Staphylococcus aureus subsp. aureus MW2
uuauaucaaaaaa

SEQ ID NO: 4021088 - RNA, 22 nt, Staphylococcus aureus subsp. aureus MW2
uuauaucaaaaaauauguuuaa

SEQ ID NO: 4021089 - RNA, 13 nt, Staphylococcus aureus subsp. aureus MW2
uuauaucaaaauc

SEQ ID NO: 4021090 - RNA, 15 nt, Staphylococcus aureus subsp. aureus MW2
uuauaucauaacuua

SEQ ID NO: 4021091 - RNA, 22 nt, Staphylococcus aureus subsp. aureus MW2
uuauaucuuuuauacauguaca

SEQ ID NO: 4021092 - RNA, 20 nt, Staphylococcus aureus subsp. aureus MW2
uuauaugaagcguuuuuauu

SEQ ID NO: 4021093 - RNA, 12 nt, Staphylococcus aureus subsp. aureus MW2
uuauauuaucau

SEQ ID NO: 4021094 - RNA, 14 nt, Staphylococcus aureus subsp. aureus MW2
uuauauuaugaaca

SEQ ID NO: 4021095 - RNA, 15 nt, Staphylococcus aureus subsp. aureus MW2
uuauauugcaaaaau

SEQ ID NO: 4021096 - RNA, 16 nt, Staphylococcus aureus subsp. aureus MW2
uuauauugcaaaaaua

SEQ ID NO: 4021097 - RNA, 17 nt, Staphylococcus aureus subsp. aureus MW2
uuauauugcaaaaauaa

SEQ ID NO: 4021098 - RNA, 14 nt, Staphylococcus aureus subsp. aureus MW2
uuauauuguauuuu

SEQ ID NO: 4021099 - RNA, 18 nt, Staphylococcus aureus subsp. aureus MW2
uuauauuguauuuuauuu

SEQ ID NO: 4021100 - RNA, 14 nt, Staphylococcus aureus subsp. aureus MW2
uuauauuuaaacuc

SEQ ID NO: 4021101 - RNA, 18 nt, Staphylococcus aureus subsp. aureus MW2
uuauauuuaaaugcuuuc

SEQ ID NO: 4021102 - RNA, 23 nt, Staphylococcus aureus subsp. aureus MW2
uuauauuuaaaugcuuucaaaua

SEQ ID NO: 4021103 - RNA, 18 nt, Staphylococcus aureus subsp. aureus MW2
uuauauuuuauuuaaaaa

SEQ ID NO: 4021104 - RNA, 15 nt, Staphylococcus aureus subsp. aureus MW2
uuaucaacaaauuua

SEQ ID NO: 4021105 - RNA, 13 nt, Staphylococcus aureus subsp. aureus MW2
uuaucaacaacaa

SEQ ID NO: 4021106 - RNA, 20 nt, Staphylococcus aureus subsp. aureus MW2
uuaucaacgauuuugucuuu

SEQ ID NO: 4021107 - RNA, 19 nt, Staphylococcus aureus subsp. aureus MW2
uuaucaagagguaaaucug

SEQ ID NO: 4021108 - RNA, 20 nt, Staphylococcus aureus subsp. aureus MW2
uuaucaauuucuauuucacu

SEQ ID NO: 4021109 - RNA, 19 nt, Staphylococcus aureus subsp. aureus MW2
uuaucacaacaguauuaau

SEQ ID NO: 4021110 - RNA, 21 nt, Staphylococcus aureus subsp. aureus MW2
uuaucaucgucuccaacuuua

SEQ ID NO: 4021111 - RNA, 14 nt, Staphylococcus aureus subsp. aureus MW2
uuaucaucuauuca

SEQ ID NO: 4021112 - RNA, 12 nt, Staphylococcus aureus subsp. aureus MW2
uuaucauuauuc

SEQ ID NO: 4021113 - RNA, 13 nt, Staphylococcus aureus subsp. aureus MW2
uuaucauuauucg

SEQ ID NO: 4021114 - RNA, 16 nt, Staphylococcus aureus subsp. aureus MW2
uuaucauuauucgcau

SEQ ID NO: 4021115 - RNA, 13 nt, Staphylococcus aureus subsp. aureus MW2
uuaucauuauuua

SEQ ID NO: 4021116 - RNA, 15 nt, Staphylococcus aureus subsp. aureus MW2
uuaucauuauuuaau

SEQ ID NO: 4021117 - RNA, 20 nt, Staphylococcus aureus subsp. aureus MW2
uuaucauuuuuaauuuugac

SEQ ID NO: 4021118 - RNA, 18 nt, Staphylococcus aureus subsp. aureus MW2
uuauccaaaacauuuugu

SEQ ID NO: 4021119 - RNA, 21 nt, Staphylococcus aureus subsp. aureus MW2
uuauccaaggauguuauaaaa

SEQ ID NO: 4021120 - RNA, 18 nt, Staphylococcus aureus subsp. aureus MW2
uuaucgaucgguauuuuc

SEQ ID NO: 4021121 - RNA, 16 nt, Staphylococcus aureus subsp. aureus MW2
uuaucguaaaaaaacg

SEQ ID NO: 4021122 - RNA, 17 nt, Staphylococcus aureus subsp. aureus MW2
uuaucguaaaaaaacgu

SEQ ID NO: 4021123 - RNA, 13 nt, Staphylococcus aureus subsp. aureus MW2
uuaucguaaucuu

SEQ ID NO: 4021124 - RNA, 15 nt, Staphylococcus aureus subsp. aureus MW2
uuaucuaaacauuuu

SEQ ID NO: 4021125 - RNA, 22 nt, Staphylococcus aureus subsp. aureus MW2
uuaucuacaguuuuaugaauau

SEQ ID NO: 4021126 - RNA, 14 nt, Staphylococcus aureus subsp. aureus MW2
uuaucuauauauga

SEQ ID NO: 4021127 - RNA, 17 nt, Staphylococcus aureus subsp. aureus MW2
uuaucuauauaugaaga

SEQ ID NO: 4021128 - RNA, 16 nt, Staphylococcus aureus subsp. aureus MW2
uuaucugaaaauauca

SEQ ID NO: 4021129 - RNA, 23 nt, Staphylococcus aureus subsp. aureus MW2
uuaucugaaucugcuaauuuaua

SEQ ID NO: 4021130 - RNA, 18 nt, Staphylococcus aureus subsp. aureus MW2
uuaucugacauuguugcu

SEQ ID NO: 4021131 - RNA, 17 nt, Staphylococcus aureus subsp. aureus MW2
uuaucugaccaguauac

SEQ ID NO: 4021132 - RNA, 16 nt, Staphylococcus aureus subsp. aureus MW2
uuaucugcgaaaugca

SEQ ID NO: 4021133 - RNA, 15 nt, Staphylococcus aureus subsp. aureus MW2
uuaucuguaauuaau

SEQ ID NO: 4021134 - RNA, 16 nt, Staphylococcus aureus subsp. aureus MW2
uuaugaaagugaauug

SEQ ID NO: 4021135 - RNA, 18 nt, Staphylococcus aureus subsp. aureus MW2
uuaugacugcuuuuuauu

SEQ ID NO: 4021136 - RNA, 13 nt, Staphylococcus aureus subsp. aureus MW2
uuaugaucaauaa

SEQ ID NO: 4021137 - RNA, 15 nt, Staphylococcus aureus subsp. aureus MW2
uuaugcaaaauuaau

SEQ ID NO: 4021138 - RNA, 19 nt, Staphylococcus aureus subsp. aureus MW2
uuaugcauauguaauacaa

SEQ ID NO: 4021139 - RNA, 21 nt, Staphylococcus aureus subsp. aureus MW2
uuaugcauauguaauacaaaa

SEQ ID NO: 4021140 - RNA, 23 nt, Staphylococcus aureus subsp. aureus MW2
uuaugccaacacguuuuaagcca

SEQ ID NO: 4021141 - RNA, 22 nt, Staphylococcus aureus subsp. aureus MW2
uuaugcucaucuacuuaaaaua

SEQ ID NO: 4021142 - RNA, 13 nt, Staphylococcus aureus subsp. aureus MW2
uuauggauuuauu

SEQ ID NO: 4021143 - RNA, 22 nt, Staphylococcus aureus subsp. aureus MW2
uuauggcagauccauaaggauu

SEQ ID NO: 4021144 - RNA, 17 nt, Staphylococcus aureus subsp. aureus MW2
uuaugggauguauuuuu

SEQ ID NO: 4021145 - RNA, 22 nt, Staphylococcus aureus subsp. aureus MW2
uuauggugcuaaaaaauuugca

SEQ ID NO: 4021146 - RNA, 14 nt, Staphylococcus aureus subsp. aureus MW2
uuauguaaaaaaua

SEQ ID NO: 4021147 - RNA, 23 nt, Staphylococcus aureus subsp. aureus MW2
uuauguauuuuuauuuauacuaa

SEQ ID NO: 4021148 - RNA, 15 nt, Staphylococcus aureus subsp. aureus MW2
uuaugucccaaugcu

SEQ ID NO: 4021149 - RNA, 23 nt, Staphylococcus aureus subsp. aureus MW2
uuaugucuuaggcgcuacaaugu

SEQ ID NO: 4021150 - RNA, 17 nt, Staphylococcus aureus subsp. aureus MW2
uuauguucgauuauucu

SEQ ID NO: 4021151 - RNA, 16 nt, Staphylococcus aureus subsp. aureus MW2
uuauguuuaaacauuu

SEQ ID NO: 4021152 - RNA, 13 nt, Staphylococcus aureus subsp. aureus MW2
uuauuaaaucuuu

SEQ ID NO: 4021153 - RNA, 20 nt, Staphylococcus aureus subsp. aureus MW2
uuauuaaaucuuuuacuaaa

SEQ ID NO: 4021154 - RNA, 12 nt, Staphylococcus aureus subsp. aureus MW2
uuauuaaauuca

SEQ ID NO: 4021155 - RNA, 17 nt, Staphylococcus aureus subsp. aureus MW2
uuauuaacaaaagugaa

SEQ ID NO: 4021156 - RNA, 19 nt, Staphylococcus aureus subsp. aureus MW2
uuauuaacgcaaaaauacu

SEQ ID NO: 4021157 - RNA, 13 nt, Staphylococcus aureus subsp. aureus MW2
uuauuaacucaug

SEQ ID NO: 4021158 - RNA, 18 nt, Staphylococcus aureus subsp. aureus MW2
uuauuaacuuuaauauaa

SEQ ID NO: 4021159 - RNA, 23 nt, Staphylococcus aureus subsp. aureus MW2
uuauuaauaaauucucuuggaua

SEQ ID NO: 4021160 - RNA, 21 nt, Staphylococcus aureus subsp. aureus MW2
uuauuaauuaaaaaauuccua

SEQ ID NO: 4021161 - RNA, 22 nt, Staphylococcus aureus subsp. aureus MW2
uuauuaauuaaaaaauuccuag

SEQ ID NO: 4021162 - RNA, 12 nt, Staphylococcus aureus subsp. aureus MW2
uuauuaauuccu

SEQ ID NO: 4021163 - RNA, 15 nt, Staphylococcus aureus subsp. aureus MW2
uuauuaauuuaaaaa

SEQ ID NO: 4021164 - RNA, 23 nt, Staphylococcus aureus subsp. aureus MW2
uuauuacaaaauuuccacuuuga

SEQ ID NO: 4021165 - RNA, 18 nt, Staphylococcus aureus subsp. aureus MW2
uuauuacauaauuuaucu

SEQ ID NO: 4021166 - RNA, 23 nt, Staphylococcus aureus subsp. aureus MW2
uuauuacaucgacaauuuucgau

SEQ ID NO: 4021167 - RNA, 21 nt, Staphylococcus aureus subsp. aureus MW2
uuauuaccauaaauuuauaua

SEQ ID NO: 4021168 - RNA, 16 nt, Staphylococcus aureus subsp. aureus MW2
uuauuaggauucaaua

SEQ ID NO: 4021169 - RNA, 17 nt, Staphylococcus aureus subsp. aureus MW2
uuauuaggauucaauaa

SEQ ID NO: 4021170 - RNA, 22 nt, Staphylococcus aureus subsp. aureus MW2
uuauuaguauucaaaaaaauau

SEQ ID NO: 4021171 - RNA, 12 nt, Staphylococcus aureus subsp. aureus MW2
uuauuauaaaau

SEQ ID NO: 4021172 - RNA, 17 nt, Staphylococcus aureus subsp. aureus MW2
uuauuaucuuuaaauua

SEQ ID NO: 4021173 - RNA, 14 nt, Staphylococcus aureus subsp. aureus MW2
uuauuaugaauuau

SEQ ID NO: 4021174 - RNA, 20 nt, Staphylococcus aureus subsp. aureus MW2
uuauuaugaauuauuaauaa

SEQ ID NO: 4021175 - RNA, 22 nt, Staphylococcus aureus subsp. aureus MW2
uuauuauugucaucauguucua

SEQ ID NO: 4021176 - RNA, 12 nt, Staphylococcus aureus subsp. aureus MW2
uuauuauuuauc

SEQ ID NO: 4021177 - RNA, 16 nt, Staphylococcus aureus subsp. aureus MW2
uuauuauuuuguauuu

SEQ ID NO: 4021178 - RNA, 14 nt, Staphylococcus aureus subsp. aureus MW2
uuauucaaaucaua

SEQ ID NO: 4021179 - RNA, 17 nt, Staphylococcus aureus subsp. aureus MW2
uuauucaauugauuaca

SEQ ID NO: 4021180 - RNA, 14 nt, Staphylococcus aureus subsp. aureus MW2
uuauuccacauuau

SEQ ID NO: 4021181 - RNA, 23 nt, Staphylococcus aureus subsp. aureus MW2
uuauuccgaacauguuucuagau

SEQ ID NO: 4021182 - RNA, 15 nt, Staphylococcus aureus subsp. aureus MW2
uuauucguuaacaau

SEQ ID NO: 4021183 - RNA, 14 nt, Staphylococcus aureus subsp. aureus MW2
uuauucguuucuuu

SEQ ID NO: 4021184 - RNA, 17 nt, Staphylococcus aureus subsp. aureus MW2
uuauucugaaaaauauu

SEQ ID NO: 4021185 - RNA, 20 nt, Staphylococcus aureus subsp. aureus MW2
uuauugaaaacaaaaaagag

SEQ ID NO: 4021186 - RNA, 13 nt, Staphylococcus aureus subsp. aureus MW2
uuauugaaacuaa

SEQ ID NO: 4021187 - RNA, 21 nt, Staphylococcus aureus subsp. aureus MW2
uuauugacauucacauuauuu

SEQ ID NO: 4021188 - RNA, 22 nt, Staphylococcus aureus subsp. aureus MW2
uuauugacauucacauuauuua

SEQ ID NO: 4021189 - RNA, 18 nt, Staphylococcus aureus subsp. aureus MW2
uuauugauauuaauauau

SEQ ID NO: 4021190 - RNA, 17 nt, Staphylococcus aureus subsp. aureus MW2
uuauugcauuguauaug

SEQ ID NO: 4021191 - RNA, 24 nt, Staphylococcus aureus subsp. aureus MW2
uuauugccuaacguguuugagaua

SEQ ID NO: 4021192 - RNA, 15 nt, Staphylococcus aureus subsp. aureus MW2
uuauuggguaauauu

SEQ ID NO: 4021193 - RNA, 20 nt, Staphylococcus aureus subsp. aureus MW2
uuauuggguaauauuaguca

SEQ ID NO: 4021194 - RNA, 15 nt, Staphylococcus aureus subsp. aureus MW2
uuauuguaaccugac

SEQ ID NO: 4021195 - RNA, 22 nt, Staphylococcus aureus subsp. aureus MW2
uuauugucaucauguucuaaug

SEQ ID NO: 4021196 - RNA, 17 nt, Staphylococcus aureus subsp. aureus MW2
uuauuguuccaaucuuu

SEQ ID NO: 4021197 - RNA, 14 nt, Staphylococcus aureus subsp. aureus MW2
uuauuguuuuuaaa

SEQ ID NO: 4021198 - RNA, 17 nt, Staphylococcus aureus subsp. aureus MW2
uuauuguuuuuaaaauc

SEQ ID NO: 4021199 - RNA, 15 nt, Staphylococcus aureus subsp. aureus MW2
uuauuuaaaaauagc

SEQ ID NO: 4021200 - RNA, 22 nt, Staphylococcus aureus subsp. aureus MW2
uuauuuaaaacuuguaaauuua

SEQ ID NO: 4021201 - RNA, 13 nt, Staphylococcus aureus subsp. aureus MW2
uuauuuaaaaugc

SEQ ID NO: 4021202 - RNA, 14 nt, Staphylococcus aureus subsp. aureus MW2
uuauuuaaaaugcu

SEQ ID NO: 4021203 - RNA, 18 nt, Staphylococcus aureus subsp. aureus MW2
uuauuuauacuaaauuga

SEQ ID NO: 4021204 - RNA, 16 nt, Staphylococcus aureus subsp. aureus MW2
uuauuuauucagcauu

SEQ ID NO: 4021205 - RNA, 12 nt, Staphylococcus aureus subsp. aureus MW2
uuauuucagcuu

SEQ ID NO: 4021206 - RNA, 23 nt, Staphylococcus aureus subsp. aureus MW2
uuauuuccuguuacuuucacauu

SEQ ID NO: 4021207 - RNA, 20 nt, Staphylococcus aureus subsp. aureus MW2
uuauuucgccuuuuuuauuu

SEQ ID NO: 4021208 - RNA, 19 nt, Staphylococcus aureus subsp. aureus MW2
uuauuugauaaauaaaauu

SEQ ID NO: 4021209 - RNA, 15 nt, Staphylococcus aureus subsp. aureus MW2
uuauuugauuauucu

SEQ ID NO: 4021210 - RNA, 21 nt, Staphylococcus aureus subsp. aureus MW2
uuauuuggaugguaaguauaa

SEQ ID NO: 4021211 - RNA, 20 nt, Staphylococcus aureus subsp. aureus MW2
uuauuuggguaacauuagca

SEQ ID NO: 4021212 - RNA, 15 nt, Staphylococcus aureus subsp. aureus MW2
uuauuuguaauuuca

SEQ ID NO: 4021213 - RNA, 15 nt, Staphylococcus aureus subsp. aureus MW2
uuauuuuaaaauauu

SEQ ID NO: 4021214 - RNA, 20 nt, Staphylococcus aureus subsp. aureus MW2
uuauuuuaaaauauuaauca

SEQ ID NO: 4021215 - RNA, 13 nt, Staphylococcus aureus subsp. aureus MW2
uuauuuuaaauuu

SEQ ID NO: 4021216 - RNA, 13 nt, Staphylococcus aureus subsp. aureus MW2
uuauuuuaucauc

SEQ ID NO: 4021217 - RNA, 21 nt, Staphylococcus aureus subsp. aureus MW2
uuauuuuaucaucuauucaaa

SEQ ID NO: 4021218 - RNA, 12 nt, Staphylococcus aureus subsp. aureus MW2
uuauuuucaaua

SEQ ID NO: 4021219 - RNA, 13 nt, Staphylococcus aureus subsp. aureus MW2
uuauuuucaauaa

SEQ ID NO: 4021220 - RNA, 17 nt, Staphylococcus aureus subsp. aureus MW2
uuauuuucaauaaauuu

SEQ ID NO: 4021221 - RNA, 23 nt, Staphylococcus aureus subsp. aureus MW2
uuauuuucauauaaauagcuucu

SEQ ID NO: 4021222 - RNA, 22 nt, Staphylococcus aureus subsp. aureus MW2
uuauuuucgacuaguuuggaga

SEQ ID NO: 4021223 - RNA, 23 nt, Staphylococcus aureus subsp. aureus MW2
uuauuuucucgauacaaaggguu

SEQ ID NO: 4021224 - RNA, 21 nt, Staphylococcus aureus subsp. aureus MW2
uuauuuucuuuggugaaagua

SEQ ID NO: 4021225 - RNA, 17 nt, Staphylococcus aureus subsp. aureus MW2
uuauuuugauagacuaa

SEQ ID NO: 4021226 - RNA, 16 nt, Staphylococcus aureus subsp. aureus MW2
uuauuuuuaaauauga

SEQ ID NO: 4021227 - RNA, 16 nt, Staphylococcus aureus subsp. aureus MW2
uuauuuuuauagauaa

SEQ ID NO: 4021228 - RNA, 14 nt, Staphylococcus aureus subsp. aureus MW2
uuauuuuucucaua

SEQ ID NO: 4021229 - RNA, 20 nt, Staphylococcus aureus subsp. aureus MW2
uuauuuuuugucuaugucaa

SEQ ID NO: 4021230 - RNA, 13 nt, Staphylococcus aureus subsp. aureus MW2
uuauuuuuuuaaa

SEQ ID NO: 4021231 - RNA, 21 nt, Staphylococcus aureus subsp. aureus MW2
uuauuuuuuuaaaucuauaua

SEQ ID NO: 4021232 - RNA, 17 nt, Staphylococcus aureus subsp. aureus MW2
uuauuuuuuucuuucuu

SEQ ID NO: 4021233 - RNA, 14 nt, Staphylococcus aureus subsp. aureus MW2
uucaaaaaaauauu

SEQ ID NO: 4021234 - RNA, 15 nt, Staphylococcus aureus subsp. aureus MW2
uucaaaaaaauauuu

SEQ ID NO: 4021235 - RNA, 22 nt, Staphylococcus aureus subsp. aureus MW2
uucaaaaagucucauuaucacc

SEQ ID NO: 4021236 - RNA, 16 nt, Staphylococcus aureus subsp. aureus MW2
uucaaaaaucauacca

SEQ ID NO: 4021237 - RNA, 19 nt, Staphylococcus aureus subsp. aureus MW2
uucaaaaaucauaccacgg

SEQ ID NO: 4021238 - RNA, 20 nt, Staphylococcus aureus subsp. aureus MW2
uucaaaacguuuaauugcag

SEQ ID NO: 4021239 - RNA, 14 nt, Staphylococcus aureus subsp. aureus MW2
uucaaaaucaaauu

SEQ ID NO: 4021240 - RNA, 12 nt, Staphylococcus aureus subsp. aureus MW2
uucaaagcgaua

SEQ ID NO: 4021241 - RNA, 18 nt, Staphylococcus aureus subsp. aureus MW2
uucaaagcgauaaaguau

SEQ ID NO: 4021242 - RNA, 17 nt, Staphylococcus aureus subsp. aureus MW2
uucaaagcugucaacuu

SEQ ID NO: 4021243 - RNA, 19 nt, Staphylococcus aureus subsp. aureus MW2
uucaaagcugucaacuugu

SEQ ID NO: 4021244 - RNA, 15 nt, Staphylococcus aureus subsp. aureus MW2
uucaaaguagacauu

SEQ ID NO: 4021245 - RNA, 19 nt, Staphylococcus aureus subsp. aureus MW2
uucaaauaaacacaucuau

SEQ ID NO: 4021246 - RNA, 21 nt, Staphylococcus aureus subsp. aureus MW2
uucaaauaaaucaaacuuuuc

SEQ ID NO: 4021247 - RNA, 15 nt, Staphylococcus aureus subsp. aureus MW2
uucaaauaauauaaa

SEQ ID NO: 4021248 - RNA, 16 nt, Staphylococcus aureus subsp. aureus MW2
uucaaauaauauaaaa

SEQ ID NO: 4021249 - RNA, 19 nt, Staphylococcus aureus subsp. aureus MW2
uucaaaucuggcacuuaag

SEQ ID NO: 4021250 - RNA, 21 nt, Staphylococcus aureus subsp. aureus MW2
uucaaaugcuuaauaaaauca

SEQ ID NO: 4021251 - RNA, 19 nt, Staphylococcus aureus subsp. aureus MW2
uucaaauguaguuaagaua

SEQ ID NO: 4021252 - RNA, 20 nt, Staphylococcus aureus subsp. aureus MW2
uucaaaugugaaagucaucc

SEQ ID NO: 4021253 - RNA, 21 nt, Staphylococcus aureus subsp. aureus MW2
uucaaauguugacuacucaau

SEQ ID NO: 4021254 - RNA, 21 nt, Staphylococcus aureus subsp. aureus MW2
uucaaauguuuacugucaucu

SEQ ID NO: 4021255 - RNA, 18 nt, Staphylococcus aureus subsp. aureus MW2
uucaaauugaacuucuuu

SEQ ID NO: 4021256 - RNA, 14 nt, Staphylococcus aureus subsp. aureus MW2
uucaacaaaaugcg

SEQ ID NO: 4021257 - RNA, 22 nt, Staphylococcus aureus subsp. aureus MW2
uucaacaauuucaaugucugca

SEQ ID NO: 4021258 - RNA, 18 nt, Staphylococcus aureus subsp. aureus MW2
uucaacauaacucaaaua

SEQ ID NO: 4021259 - RNA, 14 nt, Staphylococcus aureus subsp. aureus MW2
uucaacauauuaua

SEQ ID NO: 4021260 - RNA, 16 nt, Staphylococcus aureus subsp. aureus MW2
uucaacgucaucugcu

SEQ ID NO: 4021261 - RNA, 16 nt, Staphylococcus aureus subsp. aureus MW2
uucaacuaauaacuca

SEQ ID NO: 4021262 - RNA, 15 nt, Staphylococcus aureus subsp. aureus MW2
uucaacuacuucauc

SEQ ID NO: 4021263 - RNA, 19 nt, Staphylococcus aureus subsp. aureus MW2
uucaacuuguuuccuacac

SEQ ID NO: 4021264 - RNA, 16 nt, Staphylococcus aureus subsp. aureus MW2
uucaacuuuuuaauaa

SEQ ID NO: 4021265 - RNA, 14 nt, Staphylococcus aureus subsp. aureus MW2
uucaagaccaaaua

SEQ ID NO: 4021266 - RNA, 14 nt, Staphylococcus aureus subsp. aureus MW2
uucaagcuuaauaa

SEQ ID NO: 4021267 - RNA, 21 nt, Staphylococcus aureus subsp. aureus MW2
uucaaguauauccgcaucuuu

SEQ ID NO: 4021268 - RNA, 22 nt, Staphylococcus aureus subsp. aureus MW2
uucaagugccauuuuuaaauua

SEQ ID NO: 4021269 - RNA, 15 nt, Staphylococcus aureus subsp. aureus MW2
uucaaguuuaaaaua

SEQ ID NO: 4021270 - RNA, 19 nt, Staphylococcus aureus subsp. aureus MW2
uucaauaaaaaugguauuc

SEQ ID NO: 4021271 - RNA, 12 nt, Staphylococcus aureus subsp. aureus MW2
uucaauaauuca

SEQ ID NO: 4021272 - RNA, 19 nt, Staphylococcus aureus subsp. aureus MW2
uucaauaauucaucaaguu

SEQ ID NO: 4021273 - RNA, 23 nt, Staphylococcus aureus subsp. aureus MW2
uucaauacuucuuguucgauaau

SEQ ID NO: 4021274 - RNA, 19 nt, Staphylococcus aureus subsp. aureus MW2
uucaauaguaccaugcucu

SEQ ID NO: 4021275 - RNA, 14 nt, Staphylococcus aureus subsp. aureus MW2
uucaauauuaaaau

SEQ ID NO: 4021276 - RNA, 21 nt, Staphylococcus aureus subsp. aureus MW2
uucaauauuacuuuaucucau

SEQ ID NO: 4021277 - RNA, 22 nt, Staphylococcus aureus subsp. aureus MW2
uucaaucaacgagucauaaaua

SEQ ID NO: 4021278 - RNA, 12 nt, Staphylococcus aureus subsp. aureus MW2
uucaaucauuca

SEQ ID NO: 4021279 - RNA, 15 nt, Staphylococcus aureus subsp. aureus MW2
uucaaucauuugugu

SEQ ID NO: 4021280 - RNA, 22 nt, Staphylococcus aureus subsp. aureus MW2
uucaauccaagcaaucuuagua

SEQ ID NO: 4021281 - RNA, 13 nt, Staphylococcus aureus subsp. aureus MW2
uucaaucgucaca

SEQ ID NO: 4021282 - RNA, 16 nt, Staphylococcus aureus subsp. aureus MW2
uucaaucgucacauca

SEQ ID NO: 4021283 - RNA, 15 nt, Staphylococcus aureus subsp. aureus MW2
uucaaucguuucuuc

SEQ ID NO: 4021284 - RNA, 19 nt, Staphylococcus aureus subsp. aureus MW2
uucaaugaauucauuuuau

SEQ ID NO: 4021285 - RNA, 18 nt, Staphylococcus aureus subsp. aureus MW2
uucaaugauuuuuaaaaa

SEQ ID NO: 4021286 - RNA, 19 nt, Staphylococcus aureus subsp. aureus MW2
uucaaugauuuuuaaaaau

SEQ ID NO: 4021287 - RNA, 19 nt, Staphylococcus aureus subsp. aureus MW2
uucaauguaauuuucacuu

SEQ ID NO: 4021288 - RNA, 18 nt, Staphylococcus aureus subsp. aureus MW2
uucaaugucuacuuugaa

SEQ ID NO: 4021289 - RNA, 22 nt, Staphylococcus aureus subsp. aureus MW2
uucaaugucugcaucagaucua

SEQ ID NO: 4021290 - RNA, 18 nt, Staphylococcus aureus subsp. aureus MW2
uucaauguuuaauuuucu

SEQ ID NO: 4021291 - RNA, 21 nt, Staphylococcus aureus subsp. aureus MW2
uucaauguuuaauuuucuaaa

SEQ ID NO: 4021292 - RNA, 11 nt, Staphylococcus aureus subsp. aureus MW2
uucaauguuug

SEQ ID NO: 4021293 - RNA, 22 nt, Staphylococcus aureus subsp. aureus MW2
uucaauuaaguacuucaaagca

SEQ ID NO: 4021294 - RNA, 17 nt, Staphylococcus aureus subsp. aureus MW2
uucaauuagaaaauuuc

SEQ ID NO: 4021295 - RNA, 21 nt, Staphylococcus aureus subsp. aureus MW2
uucaauucgcucacaugugaa

SEQ ID NO: 4021296 - RNA, 15 nt, Staphylococcus aureus subsp. aureus MW2
uucaauucuuacacc

SEQ ID NO: 4021297 - RNA, 23 nt, Staphylococcus aureus subsp. aureus MW2
uucaauugacauuaaugauagca

SEQ ID NO: 4021298 - RNA, 20 nt, Staphylococcus aureus subsp. aureus MW2
uucaauugucguuuaauaau

SEQ ID NO: 4021299 - RNA, 15 nt, Staphylococcus aureus subsp. aureus MW2
uucaauugucucaau

SEQ ID NO: 4021300 - RNA, 19 nt, Staphylococcus aureus subsp. aureus MW2
uucaauugucucaauaaug

SEQ ID NO: 4021301 - RNA, 21 nt, Staphylococcus aureus subsp. aureus MW2
uucaauuuaauguauugagaa

SEQ ID NO: 4021302 - RNA, 12 nt, Staphylococcus aureus subsp. aureus MW2
uucaauuuaugu

SEQ ID NO: 4021303 - RNA, 13 nt, Staphylococcus aureus subsp. aureus MW2
uucaauuuauuaa

SEQ ID NO: 4021304 - RNA, 13 nt, Staphylococcus aureus subsp. aureus MW2
uucaauuuuacca

SEQ ID NO: 4021305 - RNA, 20 nt, Staphylococcus aureus subsp. aureus MW2
uucaauuuuaccagcaugaa

SEQ ID NO: 4021306 - RNA, 15 nt, Staphylococcus aureus subsp. aureus MW2
uucacauagccucuu

SEQ ID NO: 4021307 - RNA, 23 nt, Staphylococcus aureus subsp. aureus MW2
uucacauagccucuuaaaauacc

SEQ ID NO: 4021308 - RNA, 18 nt, Staphylococcus aureus subsp. aureus MW2
uucacaucuuuagcuauu

SEQ ID NO: 4021309 - RNA, 22 nt, Staphylococcus aureus subsp. aureus MW2
uucacaugaauuuuaauauauu

SEQ ID NO: 4021310 - RNA, 13 nt, Staphylococcus aureus subsp. aureus MW2
uucacauuuaucc

SEQ ID NO: 4021311 - RNA, 18 nt, Staphylococcus aureus subsp. aureus MW2
uucacauuuauccuuuaa

SEQ ID NO: 4021312 - RNA, 14 nt, Staphylococcus aureus subsp. aureus MW2
uucaccaacuuuuu

SEQ ID NO: 4021313 - RNA, 13 nt, Staphylococcus aureus subsp. aureus MW2
uucaccuaaucuu

SEQ ID NO: 4021314 - RNA, 24 nt, Staphylococcus aureus subsp. aureus MW2
uucacgauuucuuuaugauaauaa

SEQ ID NO: 4021315 - RNA, 16 nt, Staphylococcus aureus subsp. aureus MW2
uucacguaaugaauca

SEQ ID NO: 4021316 - RNA, 20 nt, Staphylococcus aureus subsp. aureus MW2
uucacuaaaaauauauuuca

SEQ ID NO: 4021317 - RNA, 18 nt, Staphylococcus aureus subsp. aureus MW2
uucacuaaauucaauaau

SEQ ID NO: 4021318 - RNA, 14 nt, Staphylococcus aureus subsp. aureus MW2
uucacucuguaaua

SEQ ID NO: 4021319 - RNA, 16 nt, Staphylococcus aureus subsp. aureus MW2
uucacuguauaaauaa

SEQ ID NO: 4021320 - RNA, 12 nt, Staphylococcus aureus subsp. aureus MW2
uucacuguuuua

SEQ ID NO: 4021321 - RNA, 13 nt, Staphylococcus aureus subsp. aureus MW2
uucacuguuuuau

SEQ ID NO: 4021322 - RNA, 23 nt, Staphylococcus aureus subsp. aureus MW2
uucacuucgccaagccaucuuuc

SEQ ID NO: 4021323 - RNA, 16 nt, Staphylococcus aureus subsp. aureus MW2
uucacuuuaacuucuu

SEQ ID NO: 4021324 - RNA, 16 nt, Staphylococcus aureus subsp. aureus MW2
uucacuuuuuauauca

SEQ ID NO: 4021325 - RNA, 23 nt, Staphylococcus aureus subsp. aureus MW2
uucagaugaauaauguuuccauu

SEQ ID NO: 4021326 - RNA, 13 nt, Staphylococcus aureus subsp. aureus MW2
uucagaugcuaca

SEQ ID NO: 4021327 - RNA, 16 nt, Staphylococcus aureus subsp. aureus MW2
uucagauuuguauuuu

SEQ ID NO: 4021328 - RNA, 22 nt, Staphylococcus aureus subsp. aureus MW2
uucagcgauaacguacaaugua

SEQ ID NO: 4021329 - RNA, 22 nt, Staphylococcus aureus subsp. aureus MW2
uucagcuaauucgucuacauau

SEQ ID NO: 4021330 - RNA, 19 nt, Staphylococcus aureus subsp. aureus MW2
uucagcuucuaaguaauau

SEQ ID NO: 4021331 - RNA, 22 nt, Staphylococcus aureus subsp. aureus MW2
uucaggaucacgugguuucuuu

SEQ ID NO: 4021332 - RNA, 16 nt, Staphylococcus aureus subsp. aureus MW2
uucagggucaacauca

SEQ ID NO: 4021333 - RNA, 19 nt, Staphylococcus aureus subsp. aureus MW2
uucaguaacguacugugua

SEQ ID NO: 4021334 - RNA, 22 nt, Staphylococcus aureus subsp. aureus MW2
uucaguacgguuauuuaauaau

SEQ ID NO: 4021335 - RNA, 21 nt, Staphylococcus aureus subsp. aureus MW2
uucaguauauuuuaacaauga

SEQ ID NO: 4021336 - RNA, 14 nt, Staphylococcus aureus subsp. aureus MW2
uucaguuaaaccuu

SEQ ID NO: 4021337 - RNA, 17 nt, Staphylococcus aureus subsp. aureus MW2
uucaguuuguuggucuu

SEQ ID NO: 4021338 - RNA, 16 nt, Staphylococcus aureus subsp. aureus MW2
uucauaaaauuuaaaa

SEQ ID NO: 4021339 - RNA, 19 nt, Staphylococcus aureus subsp. aureus MW2
uucauaaaauuuaaaacaa

SEQ ID NO: 4021340 - RNA, 12 nt, Staphylococcus aureus subsp. aureus MW2
uucauaaagcgg

SEQ ID NO: 4021341 - RNA, 18 nt, Staphylococcus aureus subsp. aureus MW2
uucauaaaugacugaauu

SEQ ID NO: 4021342 - RNA, 20 nt, Staphylococcus aureus subsp. aureus MW2
uucauaaaugacugaauuaa

SEQ ID NO: 4021343 - RNA, 14 nt, Staphylococcus aureus subsp. aureus MW2
uucauaaauuguuu

SEQ ID NO: 4021344 - RNA, 23 nt, Staphylococcus aureus subsp. aureus MW2
uucauaaauuguuuuacaugauu

SEQ ID NO: 4021345 - RNA, 11 nt, Staphylococcus aureus subsp. aureus MW2
uucauaacaac

SEQ ID NO: 4021346 - RNA, 21 nt, Staphylococcus aureus subsp. aureus MW2
uucauaacaacaucaaaaccc

SEQ ID NO: 4021347 - RNA, 14 nt, Staphylococcus aureus subsp. aureus MW2
uucauaagaaaaau

SEQ ID NO: 4021348 - RNA, 19 nt, Staphylococcus aureus subsp. aureus MW2
uucauaaucucuuuacacc

SEQ ID NO: 4021349 - RNA, 14 nt, Staphylococcus aureus subsp. aureus MW2
uucauaaugaucaa

SEQ ID NO: 4021350 - RNA, 16 nt, Staphylococcus aureus subsp. aureus MW2
uucauaaugaucaagu

SEQ ID NO: 4021351 - RNA, 17 nt, Staphylococcus aureus subsp. aureus MW2
uucauacacugcacauc

SEQ ID NO: 4021352 - RNA, 19 nt, Staphylococcus aureus subsp. aureus MW2
uucauacacuuuaacauaa

SEQ ID NO: 4021353 - RNA, 15 nt, Staphylococcus aureus subsp. aureus MW2
uucauacauaacaca

SEQ ID NO: 4021354 - RNA, 15 nt, Staphylococcus aureus subsp. aureus MW2
uucauagaaauuguc

SEQ ID NO: 4021355 - RNA, 18 nt, Staphylococcus aureus subsp. aureus MW2
uucauaguguuuguaaug

SEQ ID NO: 4021356 - RNA, 23 nt, Staphylococcus aureus subsp. aureus MW2
uucauauaauuuuaauauuaugu

SEQ ID NO: 4021357 - RNA, 20 nt, Staphylococcus aureus subsp. aureus MW2
uucauauauuuuguuaauaa

SEQ ID NO: 4021358 - RNA, 14 nt, Staphylococcus aureus subsp. aureus MW2
uucauaucuuucaa

SEQ ID NO: 4021359 - RNA, 16 nt, Staphylococcus aureus subsp. aureus MW2
uucauauggugaacug

SEQ ID NO: 4021360 - RNA, 13 nt, Staphylococcus aureus subsp. aureus MW2
uucauauuaacug

SEQ ID NO: 4021361 - RNA, 14 nt, Staphylococcus aureus subsp. aureus MW2
uucauauuaacugu

SEQ ID NO: 4021362 - RNA, 13 nt, Staphylococcus aureus subsp. aureus MW2
uucauauuuaaug

SEQ ID NO: 4021363 - RNA, 15 nt, Staphylococcus aureus subsp. aureus MW2
uucaucaaacaacau

SEQ ID NO: 4021364 - RNA, 17 nt, Staphylococcus aureus subsp. aureus MW2
uucaucaaacaacauca

SEQ ID NO: 4021365 - RNA, 19 nt, Staphylococcus aureus subsp. aureus MW2
uucaucaaacaacaucacu

SEQ ID NO: 4021366 - RNA, 15 nt, Staphylococcus aureus subsp. aureus MW2
uucaucaauaacuau

SEQ ID NO: 4021367 - RNA, 18 nt, Staphylococcus aureus subsp. aureus MW2
uucaucauaaucuacugc

SEQ ID NO: 4021368 - RNA, 11 nt, Staphylococcus aureus subsp. aureus MW2
uucaucaugca

SEQ ID NO: 4021369 - RNA, 14 nt, Staphylococcus aureus subsp. aureus MW2
uucaucauuaaaau

SEQ ID NO: 4021370 - RNA, 16 nt, Staphylococcus aureus subsp. aureus MW2
uucaucauuaaaauca

SEQ ID NO: 4021371 - RNA, 18 nt, Staphylococcus aureus subsp. aureus MW2
uucaucguucauauauuu

SEQ ID NO: 4021372 - RNA, 19 nt, Staphylococcus aureus subsp. aureus MW2
uucaucguuuacuacauca

SEQ ID NO: 4021373 - RNA, 13 nt, Staphylococcus aureus subsp. aureus MW2
uucaucuaaauga

SEQ ID NO: 4021374 - RNA, 19 nt, Staphylococcus aureus subsp. aureus MW2
uucaucucuuauaaguuca

SEQ ID NO: 4021375 - RNA, 15 nt, Staphylococcus aureus subsp. aureus MW2
uucaucuguccgacu

SEQ ID NO: 4021376 - RNA, 20 nt, Staphylococcus aureus subsp. aureus MW2
uucaucuucaaacagacuua

SEQ ID NO: 4021377 - RNA, 16 nt, Staphylococcus aureus subsp. aureus MW2
uucaucuucuucaaaa

SEQ ID NO: 4021378 - RNA, 18 nt, Staphylococcus aureus subsp. aureus MW2
uucaucuuuuuuaucaug

SEQ ID NO: 4021379 - RNA, 19 nt, Staphylococcus aureus subsp. aureus MW2
uucaucuuuuuuaucaugu

SEQ ID NO: 4021380 - RNA, 14 nt, Staphylococcus aureus subsp. aureus MW2
uucaugaauaauua

SEQ ID NO: 4021381 - RNA, 18 nt, Staphylococcus aureus subsp. aureus MW2
uucaugaugcgaaaccuu

SEQ ID NO: 4021382 - RNA, 15 nt, Staphylococcus aureus subsp. aureus MW2
uucaugauuuacuaa

SEQ ID NO: 4021383 - RNA, 16 nt, Staphylococcus aureus subsp. aureus MW2
uucauguacgaaaauu

SEQ ID NO: 4021384 - RNA, 16 nt, Staphylococcus aureus subsp. aureus MW2
uucauguaugaaguaa

SEQ ID NO: 4021385 - RNA, 17 nt, Staphylococcus aureus subsp. aureus MW2
uucaugucguuuucuua

SEQ ID NO: 4021386 - RNA, 22 nt, Staphylococcus aureus subsp. aureus MW2
uucaugugcaagugguaaaaau

SEQ ID NO: 4021387 - RNA, 19 nt, Staphylococcus aureus subsp. aureus MW2
uucaugugucauaauccau

SEQ ID NO: 4021388 - RNA, 21 nt, Staphylococcus aureus subsp. aureus MW2
uucauguucuuaacaauauca

SEQ ID NO: 4021389 - RNA, 13 nt, Staphylococcus aureus subsp. aureus MW2
uucauguuuaaaa

SEQ ID NO: 4021390 - RNA, 16 nt, Staphylococcus aureus subsp. aureus MW2
uucauuaacagucuuu

SEQ ID NO: 4021391 - RNA, 13 nt, Staphylococcus aureus subsp. aureus MW2
uucauuaacauca

SEQ ID NO: 4021392 - RNA, 14 nt, Staphylococcus aureus subsp. aureus MW2
uucauuaauacaag

SEQ ID NO: 4021393 - RNA, 17 nt, Staphylococcus aureus subsp. aureus MW2
uucauuaauuuuuucgu

SEQ ID NO: 4021394 - RNA, 15 nt, Staphylococcus aureus subsp. aureus MW2
uucauuacaaacaua

SEQ ID NO: 4021395 - RNA, 16 nt, Staphylococcus aureus subsp. aureus MW2
uucauuacaaacauaa

SEQ ID NO: 4021396 - RNA, 23 nt, Staphylococcus aureus subsp. aureus MW2
uucauuacaaacauaaucauaau

SEQ ID NO: 4021397 - RNA, 16 nt, Staphylococcus aureus subsp. aureus MW2
uucauuacaguauuug

SEQ ID NO: 4021398 - RNA, 18 nt, Staphylococcus aureus subsp. aureus MW2
uucauuagccaaaucuuu

SEQ ID NO: 4021399 - RNA, 19 nt, Staphylococcus aureus subsp. aureus MW2
uucauuaguugcauaauca

SEQ ID NO: 4021400 - RNA, 17 nt, Staphylococcus aureus subsp. aureus MW2
uucauuaguuuaugucu

SEQ ID NO: 4021401 - RNA, 22 nt, Staphylococcus aureus subsp. aureus MW2
uucauuauagucuuaaacauaa

SEQ ID NO: 4021402 - RNA, 16 nt, Staphylococcus aureus subsp. aureus MW2
uucauuauauaauucu

SEQ ID NO: 4021403 - RNA, 23 nt, Staphylococcus aureus subsp. aureus MW2
uucauugaagaauauaaacuauu

SEQ ID NO: 4021404 - RNA, 17 nt, Staphylococcus aureus subsp. aureus MW2
uucauugcguaagguau

SEQ ID NO: 4021405 - RNA, 14 nt, Staphylococcus aureus subsp. aureus MW2
uucauuguaaauuu

SEQ ID NO: 4021406 - RNA, 14 nt, Staphylococcus aureus subsp. aureus MW2
uucauuguaacuca

SEQ ID NO: 4021407 - RNA, 16 nt, Staphylococcus aureus subsp. aureus MW2
uucauuguuaaacauu

SEQ ID NO: 4021408 - RNA, 16 nt, Staphylococcus aureus subsp. aureus MW2
uucauuugaaauaguu

SEQ ID NO: 4021409 - RNA, 19 nt, Staphylococcus aureus subsp. aureus MW2
uucauuuguauuaauuuga

SEQ ID NO: 4021410 - RNA, 16 nt, Staphylococcus aureus subsp. aureus MW2
uucauuuuaaauuuaa

SEQ ID NO: 4021411 - RNA, 20 nt, Staphylococcus aureus subsp. aureus MW2
uucauuuugguacaaaaaau

SEQ ID NO: 4021412 - RNA, 13 nt, Staphylococcus aureus subsp. aureus MW2
uucauuuuuucaa

SEQ ID NO: 4021413 - RNA, 20 nt, Staphylococcus aureus subsp. aureus MW2
uucauuuuuucaaugucuac

SEQ ID NO: 4021414 - RNA, 16 nt, Staphylococcus aureus subsp. aureus MW2
uuccaaaaauuguaaa

SEQ ID NO: 4021415 - RNA, 15 nt, Staphylococcus aureus subsp. aureus MW2
uuccaaacacacugu

SEQ ID NO: 4021416 - RNA, 21 nt, Staphylococcus aureus subsp. aureus MW2
uuccaaacacacuguugaaaa

SEQ ID NO: 4021417 - RNA, 21 nt, Staphylococcus aureus subsp. aureus MW2
uuccaaauuggaaaucaacuu

SEQ ID NO: 4021418 - RNA, 16 nt, Staphylococcus aureus subsp. aureus MW2
uuccaacaacuaagau

SEQ ID NO: 4021419 - RNA, 16 nt, Staphylococcus aureus subsp. aureus MW2
uuccaacacccauaua

SEQ ID NO: 4021420 - RNA, 16 nt, Staphylococcus aureus subsp. aureus MW2
uuccaaguuaaugcac

SEQ ID NO: 4021421 - RNA, 17 nt, Staphylococcus aureus subsp. aureus MW2
uuccaaucaacuucaua

SEQ ID NO: 4021422 - RNA, 18 nt, Staphylococcus aureus subsp. aureus MW2
uuccaaucaacuucauau

SEQ ID NO: 4021423 - RNA, 16 nt, Staphylococcus aureus subsp. aureus MW2
uuccaauuuaaaauga

SEQ ID NO: 4021424 - RNA, 23 nt, Staphylococcus aureus subsp. aureus MW2
uuccacaacaaucacgauuaaug

SEQ ID NO: 4021425 - RNA, 16 nt, Staphylococcus aureus subsp. aureus MW2
uuccaguccauuuuuu

SEQ ID NO: 4021426 - RNA, 19 nt, Staphylococcus aureus subsp. aureus MW2
uuccauaaauaaaaugcua

SEQ ID NO: 4021427 - RNA, 15 nt, Staphylococcus aureus subsp. aureus MW2
uuccaucacaucaua

SEQ ID NO: 4021428 - RNA, 13 nt, Staphylococcus aureus subsp. aureus MW2
uuccaugaauaag

SEQ ID NO: 4021429 - RNA, 22 nt, Staphylococcus aureus subsp. aureus MW2
uuccauucaucuggagacgaac

SEQ ID NO: 4021430 - RNA, 23 nt, Staphylococcus aureus subsp. aureus MW2
uuccauuucaaaugccucugcaa

SEQ ID NO: 4021431 - RNA, 22 nt, Staphylococcus aureus subsp. aureus MW2
uuccauuucgauaccuaaaaua

SEQ ID NO: 4021432 - RNA, 22 nt, Staphylococcus aureus subsp. aureus MW2
uucccaucuuuuagguaauaau

SEQ ID NO: 4021433 - RNA, 12 nt, Staphylococcus aureus subsp. aureus MW2
uucccuacugcu

SEQ ID NO: 4021434 - RNA, 15 nt, Staphylococcus aureus subsp. aureus MW2
uucccuaugaaauaa

SEQ ID NO: 4021435 - RNA, 17 nt, Staphylococcus aureus subsp. aureus MW2
uucccuggaaaaugauu

SEQ ID NO: 4021436 - RNA, 15 nt, Staphylococcus aureus subsp. aureus MW2
uucccuuuucaucaa

SEQ ID NO: 4021437 - RNA, 22 nt, Staphylococcus aureus subsp. aureus MW2
uuccgcacaagcaucuauaaua

SEQ ID NO: 4021438 - RNA, 18 nt, Staphylococcus aureus subsp. aureus MW2
uuccguugaauuaacaau

SEQ ID NO: 4021439 - RNA, 19 nt, Staphylococcus aureus subsp. aureus MW2
uuccuaauggucgugcuug

SEQ ID NO: 4021440 - RNA, 23 nt, Staphylococcus aureus subsp. aureus MW2
uuccuacacuguuuuauaaauga

SEQ ID NO: 4021441 - RNA, 22 nt, Staphylococcus aureus subsp. aureus MW2
uuccuagcuuuuaugucuaguu

SEQ ID NO: 4021442 - RNA, 18 nt, Staphylococcus aureus subsp. aureus MW2
uuccuaguucuauguaua

SEQ ID NO: 4021443 - RNA, 16 nt, Staphylococcus aureus subsp. aureus MW2
uuccuauuaggaucca

SEQ ID NO: 4021444 - RNA, 19 nt, Staphylococcus aureus subsp. aureus MW2
uuccucaacgggaacauca

SEQ ID NO: 4021445 - RNA, 17 nt, Staphylococcus aureus subsp. aureus MW2
uuccugaaacaaugauu

SEQ ID NO: 4021446 - RNA, 15 nt, Staphylococcus aureus subsp. aureus MW2
uuccugcuacaacuu

SEQ ID NO: 4021447 - RNA, 17 nt, Staphylococcus aureus subsp. aureus MW2
uuccuucagucuucaug

SEQ ID NO: 4021448 - RNA, 22 nt, Staphylococcus aureus subsp. aureus MW2
uuccuucauugaagaauauaaa

SEQ ID NO: 4021449 - RNA, 15 nt, Staphylococcus aureus subsp. aureus MW2
uuccuuguuggucug

SEQ ID NO: 4021450 - RNA, 19 nt, Staphylococcus aureus subsp. aureus MW2
uuccuuucaauaauaaauc

SEQ ID NO: 4021451 - RNA, 19 nt, Staphylococcus aureus subsp. aureus MW2
uuccuuuugaauaauaaac

SEQ ID NO: 4021452 - RNA, 21 nt, Staphylococcus aureus subsp. aureus MW2
uuccuuuugaauaauaaacuu

SEQ ID NO: 4021453 - RNA, 15 nt, Staphylococcus aureus subsp. aureus MW2
uucgaaaagaaauuc

SEQ ID NO: 4021454 - RNA, 14 nt, Staphylococcus aureus subsp. aureus MW2
uucgaaauagguau

SEQ ID NO: 4021455 - RNA, 16 nt, Staphylococcus aureus subsp. aureus MW2
uucgaacguuugaaaa

SEQ ID NO: 4021456 - RNA, 17 nt, Staphylococcus aureus subsp. aureus MW2
uucgaagucauaugcau

SEQ ID NO: 4021457 - RNA, 21 nt, Staphylococcus aureus subsp. aureus MW2
uucgacuaguuuggagaauuu

SEQ ID NO: 4021458 - RNA, 19 nt, Staphylococcus aureus subsp. aureus MW2
uucgauaauauaacugcau

SEQ ID NO: 4021459 - RNA, 14 nt, Staphylococcus aureus subsp. aureus MW2
uucgauauuuguuu

SEQ ID NO: 4021460 - RNA, 19 nt, Staphylococcus aureus subsp. aureus MW2
uucgaugcauauucaucau

SEQ ID NO: 4021461 - RNA, 12 nt, Staphylococcus aureus subsp. aureus MW2
uucgauggcugc

SEQ ID NO: 4021462 - RNA, 16 nt, Staphylococcus aureus subsp. aureus MW2
uucgauuauucuuaau

SEQ ID NO: 4021463 - RNA, 15 nt, Staphylococcus aureus subsp. aureus MW2
uucgauucauaaaau

SEQ ID NO: 4021464 - RNA, 18 nt, Staphylococcus aureus subsp. aureus MW2
uucgauugguuuaaaaag

SEQ ID NO: 4021465 - RNA, 16 nt, Staphylococcus aureus subsp. aureus MW2
uucgcagcuuuauaau

SEQ ID NO: 4021466 - RNA, 14 nt, Staphylococcus aureus subsp. aureus MW2
uucgccuucuaaua

SEQ ID NO: 4021467 - RNA, 19 nt, Staphylococcus aureus subsp. aureus MW2
uucgcugcuacaccaccug

SEQ ID NO: 4021468 - RNA, 14 nt, Staphylococcus aureus subsp. aureus MW2
uucgcuuuucuaau

SEQ ID NO: 4021469 - RNA, 16 nt, Staphylococcus aureus subsp. aureus MW2
uucgcuuuucuaauuu

SEQ ID NO: 4021470 - RNA, 20 nt, Staphylococcus aureus subsp. aureus MW2
uucgcuuuucuaauuuuucu

SEQ ID NO: 4021471 - RNA, 23 nt, Staphylococcus aureus subsp. aureus MW2
uucggaaaauaucacuaauauau

SEQ ID NO: 4021472 - RNA, 15 nt, Staphylococcus aureus subsp. aureus MW2
uucggcuuuccuaau

SEQ ID NO: 4021473 - RNA, 16 nt, Staphylococcus aureus subsp. aureus MW2
uucguaacauuuaaaa

SEQ ID NO: 4021474 - RNA, 17 nt, Staphylococcus aureus subsp. aureus MW2
uucguaacauuuaaaaa

SEQ ID NO: 4021475 - RNA, 17 nt, Staphylococcus aureus subsp. aureus MW2
uucguaauguguuaaua

SEQ ID NO: 4021476 - RNA, 19 nt, Staphylococcus aureus subsp. aureus MW2
uucguagcaugacauuaag

SEQ ID NO: 4021477 - RNA, 11 nt, Staphylococcus aureus subsp. aureus MW2
uucguaugagu

SEQ ID NO: 4021478 - RNA, 17 nt, Staphylococcus aureus subsp. aureus MW2
uucgucuguauccucag

SEQ ID NO: 4021479 - RNA, 15 nt, Staphylococcus aureus subsp. aureus MW2
uucguguuaauaacc

SEQ ID NO: 4021480 - RNA, 15 nt, Staphylococcus aureus subsp. aureus MW2
uucguguuccaauuu

SEQ ID NO: 4021481 - RNA, 16 nt, Staphylococcus aureus subsp. aureus MW2
uucguuaacucuaucu

SEQ ID NO: 4021482 - RNA, 17 nt, Staphylococcus aureus subsp. aureus MW2
uucguugauuaacauua

SEQ ID NO: 4021483 - RNA, 16 nt, Staphylococcus aureus subsp. aureus MW2
uucguuucuuuauuaa

SEQ ID NO: 4021484 - RNA, 15 nt, Staphylococcus aureus subsp. aureus MW2
uucguuugaauuauu

SEQ ID NO: 4021485 - RNA, 19 nt, Staphylococcus aureus subsp. aureus MW2
uucguuuuaauaaauuguu

SEQ ID NO: 4021486 - RNA, 13 nt, Staphylococcus aureus subsp. aureus MW2
uucguuuuauuaa

SEQ ID NO: 4021487 - RNA, 19 nt, Staphylococcus aureus subsp. aureus MW2
uucuaaaaaauuaaaaauu

SEQ ID NO: 4021488 - RNA, 19 nt, Staphylococcus aureus subsp. aureus MW2
uucuaaaauagaucgaacu

SEQ ID NO: 4021489 - RNA, 23 nt, Staphylococcus aureus subsp. aureus MW2
uucuaaaaucguuccaauacucg

SEQ ID NO: 4021490 - RNA, 15 nt, Staphylococcus aureus subsp. aureus MW2
uucuaaaauuaacca

SEQ ID NO: 4021491 - RNA, 23 nt, Staphylococcus aureus subsp. aureus MW2
uucuaaagcgauuuccaucauuu

SEQ ID NO: 4021492 - RNA, 12 nt, Staphylococcus aureus subsp. aureus MW2
uucuaaauaaac

SEQ ID NO: 4021493 - RNA, 13 nt, Staphylococcus aureus subsp. aureus MW2
uucuaaccacuuc

SEQ ID NO: 4021494 - RNA, 22 nt, Staphylococcus aureus subsp. aureus MW2
uucuaacuugaacagauucacc

SEQ ID NO: 4021495 - RNA, 22 nt, Staphylococcus aureus subsp. aureus MW2
uucuaagucuuuugaaguuugu

SEQ ID NO: 4021496 - RNA, 19 nt, Staphylococcus aureus subsp. aureus MW2
uucuaauacaccaaaucca

SEQ ID NO: 4021497 - RNA, 16 nt, Staphylococcus aureus subsp. aureus MW2
uucuaaugcuaauuua

SEQ ID NO: 4021498 - RNA, 17 nt, Staphylococcus aureus subsp. aureus MW2
uucuaaugcuaauuuaa

SEQ ID NO: 4021499 - RNA, 20 nt, Staphylococcus aureus subsp. aureus MW2
uucuaaugcuaauuuaacug

SEQ ID NO: 4021500 - RNA, 13 nt, Staphylococcus aureus subsp. aureus MW2
uucuaauuguuuu

SEQ ID NO: 4021501 - RNA, 22 nt, Staphylococcus aureus subsp. aureus MW2
uucuaauuuaguuuuaauauaa

SEQ ID NO: 4021502 - RNA, 13 nt, Staphylococcus aureus subsp. aureus MW2
uucuaauuugcaa

SEQ ID NO: 4021503 - RNA, 14 nt, Staphylococcus aureus subsp. aureus MW2
uucuaauuuuucuu

SEQ ID NO: 4021504 - RNA, 19 nt, Staphylococcus aureus subsp. aureus MW2
uucuacagacaaugcaagu

SEQ ID NO: 4021505 - RNA, 21 nt, Staphylococcus aureus subsp. aureus MW2
uucuacagacaaugcaaguug

SEQ ID NO: 4021506 - RNA, 20 nt, Staphylococcus aureus subsp. aureus MW2
uucuacaggcaaugcaaguu

SEQ ID NO: 4021507 - RNA, 21 nt, Staphylococcus aureus subsp. aureus MW2
uucuacaggcaaugcaaguug

SEQ ID NO: 4021508 - RNA, 23 nt, Staphylococcus aureus subsp. aureus MW2
uucuacaguuggagguccauaau

SEQ ID NO: 4021509 - RNA, 21 nt, Staphylococcus aureus subsp. aureus MW2
uucuacccauaauuuaaauga

SEQ ID NO: 4021510 - RNA, 18 nt, Staphylococcus aureus subsp. aureus MW2
uucuacuuaguaauaaga

SEQ ID NO: 4021511 - RNA, 22 nt, Staphylococcus aureus subsp. aureus MW2
uucuagcaacugaucauuuuca

SEQ ID NO: 4021512 - RNA, 14 nt, Staphylococcus aureus subsp. aureus MW2
uucuagugaaauac

SEQ ID NO: 4021513 - RNA, 16 nt, Staphylococcus aureus subsp. aureus MW2
uucuaguuuaacauua

SEQ ID NO: 4021514 - RNA, 23 nt, Staphylococcus aureus subsp. aureus MW2
uucuauacaaugaauuucuaauu

SEQ ID NO: 4021515 - RNA, 20 nt, Staphylococcus aureus subsp. aureus MW2
uucuauacauuccaaaguac

SEQ ID NO: 4021516 - RNA, 16 nt, Staphylococcus aureus subsp. aureus MW2
uucuauacuuuuaauu

SEQ ID NO: 4021517 - RNA, 20 nt, Staphylococcus aureus subsp. aureus MW2
uucuauacuuuuaauuguau

SEQ ID NO: 4021518 - RNA, 21 nt, Staphylococcus aureus subsp. aureus MW2
uucuauagcacugaaaucuag

SEQ ID NO: 4021519 - RNA, 17 nt, Staphylococcus aureus subsp. aureus MW2
uucuauauaauuuauuu

SEQ ID NO: 4021520 - RNA, 12 nt, Staphylococcus aureus subsp. aureus MW2
uucuauauuaau

SEQ ID NO: 4021521 - RNA, 14 nt, Staphylococcus aureus subsp. aureus MW2
uucuauauuaauaa

SEQ ID NO: 4021522 - RNA, 23 nt, Staphylococcus aureus subsp. aureus MW2
uucuaucacacgcauacaggaaa

SEQ ID NO: 4021523 - RNA, 18 nt, Staphylococcus aureus subsp. aureus MW2
uucuaucugaguaugaua

SEQ ID NO: 4021524 - RNA, 21 nt, Staphylococcus aureus subsp. aureus MW2
uucuaucugaguaugauagaa

SEQ ID NO: 4021525 - RNA, 17 nt, Staphylococcus aureus subsp. aureus MW2
uucuauggcacaaauga

SEQ ID NO: 4021526 - RNA, 18 nt, Staphylococcus aureus subsp. aureus MW2
uucuauguauaauacaug

SEQ ID NO: 4021527 - RNA, 13 nt, Staphylococcus aureus subsp. aureus MW2
uucuauucgaaaa

SEQ ID NO: 4021528 - RNA, 16 nt, Staphylococcus aureus subsp. aureus MW2
uucuauucgaaaaagg

SEQ ID NO: 4021529 - RNA, 23 nt, Staphylococcus aureus subsp. aureus MW2
uucuauuuaaacaagaaaacuaa

SEQ ID NO: 4021530 - RNA, 18 nt, Staphylococcus aureus subsp. aureus MW2
uucuauuuuauaauaaau

SEQ ID NO: 4021531 - RNA, 17 nt, Staphylococcus aureus subsp. aureus MW2
uucucaaauuagauaaa

SEQ ID NO: 4021532 - RNA, 23 nt, Staphylococcus aureus subsp. aureus MW2
uucucaacaaaucuauaaauauc

SEQ ID NO: 4021533 - RNA, 16 nt, Staphylococcus aureus subsp. aureus MW2
uucucaauuaauuuag

SEQ ID NO: 4021534 - RNA, 12 nt, Staphylococcus aureus subsp. aureus MW2
uucucaccagcu

SEQ ID NO: 4021535 - RNA, 17 nt, Staphylococcus aureus subsp. aureus MW2
uucucacugcuguucuu

SEQ ID NO: 4021536 - RNA, 13 nt, Staphylococcus aureus subsp. aureus MW2
uucucauuauaau

SEQ ID NO: 4021537 - RNA, 15 nt, Staphylococcus aureus subsp. aureus MW2
uucucccuuaaauac

SEQ ID NO: 4021538 - RNA, 14 nt, Staphylococcus aureus subsp. aureus MW2
uucucggcaagugc

SEQ ID NO: 4021539 - RNA, 20 nt, Staphylococcus aureus subsp. aureus MW2
uucucuaucaguaugaaguu

SEQ ID NO: 4021540 - RNA, 21 nt, Staphylococcus aureus subsp. aureus MW2
uucucugcuucuaaaacauca

SEQ ID NO: 4021541 - RNA, 13 nt, Staphylococcus aureus subsp. aureus MW2
uucucuuaaauau

SEQ ID NO: 4021542 - RNA, 18 nt, Staphylococcus aureus subsp. aureus MW2
uucucuuugaacgaaaga

SEQ ID NO: 4021543 - RNA, 24 nt, Staphylococcus aureus subsp. aureus MW2
uucucuuugaacgaaagagaaaag

SEQ ID NO: 4021544 - RNA, 18 nt, Staphylococcus aureus subsp. aureus MW2
uucucuuugaacgagaga

SEQ ID NO: 4021545 - RNA, 24 nt, Staphylococcus aureus subsp. aureus MW2
uucucuuugaacgagagagaaaag

SEQ ID NO: 4021546 - RNA, 20 nt, Staphylococcus aureus subsp. aureus MW2
uucugaaacuuuaauacuac

SEQ ID NO: 4021547 - RNA, 21 nt, Staphylococcus aureus subsp. aureus MW2
uucugaaaugauacauuauua

SEQ ID NO: 4021548 - RNA, 23 nt, Staphylococcus aureus subsp. aureus MW2
uucugaaaugauacauuauuaaa

SEQ ID NO: 4021549 - RNA, 23 nt, Staphylococcus aureus subsp. aureus MW2
uucugaauuuaggaaugaauaaa

SEQ ID NO: 4021550 - RNA, 15 nt, Staphylococcus aureus subsp. aureus MW2
uucugauuauguuca

SEQ ID NO: 4021551 - RNA, 21 nt, Staphylococcus aureus subsp. aureus MW2
uucugcaaaauguuacacaaa

SEQ ID NO: 4021552 - RNA, 21 nt, Staphylococcus aureus subsp. aureus MW2
uucugcggauuaucuaacuca

SEQ ID NO: 4021553 - RNA, 20 nt, Staphylococcus aureus subsp. aureus MW2
uucugcuguauggaaaguug

SEQ ID NO: 4021554 - RNA, 20 nt, Staphylococcus aureus subsp. aureus MW2
uucugcuucgugguuaguaa

SEQ ID NO: 4021555 - RNA, 16 nt, Staphylococcus aureus subsp. aureus MW2
uucugguucuucacua

SEQ ID NO: 4021556 - RNA, 16 nt, Staphylococcus aureus subsp. aureus MW2
uucuguaauaauauca

SEQ ID NO: 4021557 - RNA, 19 nt, Staphylococcus aureus subsp. aureus MW2
uucuguacguuuuaaauaa

SEQ ID NO: 4021558 - RNA, 17 nt, Staphylococcus aureus subsp. aureus MW2
uucuguccaaaaagguu

SEQ ID NO: 4021559 - RNA, 13 nt, Staphylococcus aureus subsp. aureus MW2
uucugucuguaaa

SEQ ID NO: 4021560 - RNA, 21 nt, Staphylococcus aureus subsp. aureus MW2
uucuguuccacaacaaucacg

SEQ ID NO: 4021561 - RNA, 17 nt, Staphylococcus aureus subsp. aureus MW2
uucuuaaaaagcagcag

SEQ ID NO: 4021562 - RNA, 20 nt, Staphylococcus aureus subsp. aureus MW2
uucuuaaacgcucuucuucu

SEQ ID NO: 4021563 - RNA, 16 nt, Staphylococcus aureus subsp. aureus MW2
uucuuaaaucaacauc

SEQ ID NO: 4021564 - RNA, 18 nt, Staphylococcus aureus subsp. aureus MW2
uucuuaacauaaaaugag

SEQ ID NO: 4021565 - RNA, 18 nt, Staphylococcus aureus subsp. aureus MW2
uucuuaauugaaaauaau

SEQ ID NO: 4021566 - RNA, 15 nt, Staphylococcus aureus subsp. aureus MW2
uucuuaauuuaaaaa

SEQ ID NO: 4021567 - RNA, 11 nt, Staphylococcus aureus subsp. aureus MW2
uucuuauaaaa

SEQ ID NO: 4021568 - RNA, 14 nt, Staphylococcus aureus subsp. aureus MW2
uucuuauaaaauaa

SEQ ID NO: 4021569 - RNA, 13 nt, Staphylococcus aureus subsp. aureus MW2
uucuuaucaguuu

SEQ ID NO: 4021570 - RNA, 24 nt, Staphylococcus aureus subsp. aureus MW2
uucuuaugcggucuaaaugcucua

SEQ ID NO: 4021571 - RNA, 13 nt, Staphylococcus aureus subsp. aureus MW2
uucuuauucaaau

SEQ ID NO: 4021572 - RNA, 21 nt, Staphylococcus aureus subsp. aureus MW2
uucuucaacaauuucaauguc

SEQ ID NO: 4021573 - RNA, 23 nt, Staphylococcus aureus subsp. aureus MW2
uucuucaacaauuucaaugucug

SEQ ID NO: 4021574 - RNA, 13 nt, Staphylococcus aureus subsp. aureus MW2
uucuucaauuguc

SEQ ID NO: 4021575 - RNA, 18 nt, Staphylococcus aureus subsp. aureus MW2
uucuucacuaaaaauaua

SEQ ID NO: 4021576 - RNA, 18 nt, Staphylococcus aureus subsp. aureus MW2
uucuucacugcuguuuuu

SEQ ID NO: 4021577 - RNA, 17 nt, Staphylococcus aureus subsp. aureus MW2
uucuucagguguuuuac

SEQ ID NO: 4021578 - RNA, 15 nt, Staphylococcus aureus subsp. aureus MW2
uucuucauaguucaa

SEQ ID NO: 4021579 - RNA, 12 nt, Staphylococcus aureus subsp. aureus MW2
uucuucaucuuu

SEQ ID NO: 4021580 - RNA, 22 nt, Staphylococcus aureus subsp. aureus MW2
uucuuccaacacccauauaauu

SEQ ID NO: 4021581 - RNA, 17 nt, Staphylococcus aureus subsp. aureus MW2
uucuucgcauuguuucu

SEQ ID NO: 4021582 - RNA, 16 nt, Staphylococcus aureus subsp. aureus MW2
uucuucuaauucugaa

SEQ ID NO: 4021583 - RNA, 12 nt, Staphylococcus aureus subsp. aureus MW2
uucuucugcuaa

SEQ ID NO: 4021584 - RNA, 13 nt, Staphylococcus aureus subsp. aureus MW2
uucuucuucagga

SEQ ID NO: 4021585 - RNA, 13 nt, Staphylococcus aureus subsp. aureus MW2
uucuucuucagua

SEQ ID NO: 4021586 - RNA, 14 nt, Staphylococcus aureus subsp. aureus MW2
uucuucuuuuuuau

SEQ ID NO: 4021587 - RNA, 23 nt, Staphylococcus aureus subsp. aureus MW2
uucuugaaauaaacauaucauca

SEQ ID NO: 4021588 - RNA, 12 nt, Staphylococcus aureus subsp. aureus MW2
uucuugaauaaa

SEQ ID NO: 4021589 - RNA, 19 nt, Staphylococcus aureus subsp. aureus MW2
uucuugagcuguuacacuu

SEQ ID NO: 4021590 - RNA, 14 nt, Staphylococcus aureus subsp. aureus MW2
uucuugauuguaaa

SEQ ID NO: 4021591 - RNA, 18 nt, Staphylococcus aureus subsp. aureus MW2
uucuugauuuuaggugcc

SEQ ID NO: 4021592 - RNA, 22 nt, Staphylococcus aureus subsp. aureus MW2
uucuuggucugcuguaucauca

SEQ ID NO: 4021593 - RNA, 13 nt, Staphylococcus aureus subsp. aureus MW2
uucuuguucuaaa

SEQ ID NO: 4021594 - RNA, 21 nt, Staphylococcus aureus subsp. aureus MW2
uucuuguuuagggaaucccau

SEQ ID NO: 4021595 - RNA, 13 nt, Staphylococcus aureus subsp. aureus MW2
uucuuuaagcuuu

SEQ ID NO: 4021596 - RNA, 21 nt, Staphylococcus aureus subsp. aureus MW2
uucuuuaauauaaauuuugaa

SEQ ID NO: 4021597 - RNA, 23 nt, Staphylococcus aureus subsp. aureus MW2
uucuuuaauuaaaucuucaagug

SEQ ID NO: 4021598 - RNA, 19 nt, Staphylococcus aureus subsp. aureus MW2
uucuuuaucauaucuauau

SEQ ID NO: 4021599 - RNA, 20 nt, Staphylococcus aureus subsp. aureus MW2
uucuuuauuagaaugaaacc

SEQ ID NO: 4021600 - RNA, 24 nt, Staphylococcus aureus subsp. aureus MW2
uucuuucaggcuuuguuuuucacu

SEQ ID NO: 4021601 - RNA, 12 nt, Staphylococcus aureus subsp. aureus MW2
uucuuucauaaa

SEQ ID NO: 4021602 - RNA, 12 nt, Staphylococcus aureus subsp. aureus MW2
uucuuucuaaaa

SEQ ID NO: 4021603 - RNA, 16 nt, Staphylococcus aureus subsp. aureus MW2
uucuuucuaaaauaac

SEQ ID NO: 4021604 - RNA, 22 nt, Staphylococcus aureus subsp. aureus MW2
uucuuuguguuugcuuuuuacu

SEQ ID NO: 4021605 - RNA, 17 nt, Staphylococcus aureus subsp. aureus MW2
uucuuuuauaucgcuuu

SEQ ID NO: 4021606 - RNA, 13 nt, Staphylococcus aureus subsp. aureus MW2
uucuuuuguaauu

SEQ ID NO: 4021607 - RNA, 14 nt, Staphylococcus aureus subsp. aureus MW2
uucuuuuguuuuac

SEQ ID NO: 4021608 - RNA, 15 nt, Staphylococcus aureus subsp. aureus MW2
uucuuuuguuuuuau

SEQ ID NO: 4021609 - RNA, 11 nt, Staphylococcus aureus subsp. aureus MW2
uucuuuuuaaa

SEQ ID NO: 4021610 - RNA, 15 nt, Staphylococcus aureus subsp. aureus MW2
uucuuuuuuaauaag

SEQ ID NO: 4021611 - RNA, 13 nt, Staphylococcus aureus subsp. aureus MW2
uucuuuuuuacau

SEQ ID NO: 4021612 - RNA, 17 nt, Staphylococcus aureus subsp. aureus MW2
uucuuuuuuuguuacca

SEQ ID NO: 4021613 - RNA, 20 nt, Staphylococcus aureus subsp. aureus MW2
uugaaaaaccaaguuuugca

SEQ ID NO: 4021614 - RNA, 16 nt, Staphylococcus aureus subsp. aureus MW2
uugaaaaauuaaaaaa

SEQ ID NO: 4021615 - RNA, 16 nt, Staphylococcus aureus subsp. aureus MW2
uugaaaagauaaacaa

SEQ ID NO: 4021616 - RNA, 17 nt, Staphylococcus aureus subsp. aureus MW2
uugaaaaucuaauccug

SEQ ID NO: 4021617 - RNA, 19 nt, Staphylococcus aureus subsp. aureus MW2
uugaaacuaauaauuugua

SEQ ID NO: 4021618 - RNA, 20 nt, Staphylococcus aureus subsp. aureus MW2
uugaaaggaauguuuaaaaa

SEQ ID NO: 4021619 - RNA, 21 nt, Staphylococcus aureus subsp. aureus MW2
uugaaaggaauguuuaaaaaa

SEQ ID NO: 4021620 - RNA, 22 nt, Staphylococcus aureus subsp. aureus MW2
uugaaaggaauguuuaaaaaac

SEQ ID NO: 4021621 - RNA, 14 nt, Staphylococcus aureus subsp. aureus MW2
uugaaaugauaaaa

SEQ ID NO: 4021622 - RNA, 18 nt, Staphylococcus aureus subsp. aureus MW2
uugaaauguuuauaauaa

SEQ ID NO: 4021623 - RNA, 15 nt, Staphylococcus aureus subsp. aureus MW2
uugaaauguuuauca

SEQ ID NO: 4021624 - RNA, 20 nt, Staphylococcus aureus subsp. aureus MW2
uugaaauuauuauuuaaauu

SEQ ID NO: 4021625 - RNA, 17 nt, Staphylococcus aureus subsp. aureus MW2
uugaaauuuauuauaau

SEQ ID NO: 4021626 - RNA, 17 nt, Staphylococcus aureus subsp. aureus MW2
uugaacaacaucuuuug

SEQ ID NO: 4021627 - RNA, 15 nt, Staphylococcus aureus subsp. aureus MW2
uugaacaauucuuca

SEQ ID NO: 4021628 - RNA, 13 nt, Staphylococcus aureus subsp. aureus MW2
uugaacauagucu

SEQ ID NO: 4021629 - RNA, 21 nt, Staphylococcus aureus subsp. aureus MW2
uugaaccggaaauuaaaucua

SEQ ID NO: 4021630 - RNA, 16 nt, Staphylococcus aureus subsp. aureus MW2
uugaacgaaagagaaa

SEQ ID NO: 4021631 - RNA, 20 nt, Staphylococcus aureus subsp. aureus MW2
uugaacgaaagagaaaagcu

SEQ ID NO: 4021632 - RNA, 20 nt, Staphylococcus aureus subsp. aureus MW2
uugaacgagagagaaaagcu

SEQ ID NO: 4021633 - RNA, 15 nt, Staphylococcus aureus subsp. aureus MW2
uugaacgauaacaau

SEQ ID NO: 4021634 - RNA, 13 nt, Staphylococcus aureus subsp. aureus MW2
uugaacuucuuuu

SEQ ID NO: 4021635 - RNA, 23 nt, Staphylococcus aureus subsp. aureus MW2
uugaagaaggaugaguuuaaaaa

SEQ ID NO: 4021636 - RNA, 19 nt, Staphylococcus aureus subsp. aureus MW2
uugaagaauaaaaaaguug

SEQ ID NO: 4021637 - RNA, 22 nt, Staphylococcus aureus subsp. aureus MW2
uugaagaauguuucauaugcau

SEQ ID NO: 4021638 - RNA, 18 nt, Staphylococcus aureus subsp. aureus MW2
uugaagaccuucuaaaau

SEQ ID NO: 4021639 - RNA, 17 nt, Staphylococcus aureus subsp. aureus MW2
uugaagcuaauucauau

SEQ ID NO: 4021640 - RNA, 22 nt, Staphylococcus aureus subsp. aureus MW2
uugaagugaguuuaucuacauu

SEQ ID NO: 4021641 - RNA, 21 nt, Staphylococcus aureus subsp. aureus MW2
uugaaguuacuauauuuauua

SEQ ID NO: 4021642 - RNA, 12 nt, Staphylococcus aureus subsp. aureus MW2
uugaaguuguuu

SEQ ID NO: 4021643 - RNA, 16 nt, Staphylococcus aureus subsp. aureus MW2
uugaaguuguuucucc

SEQ ID NO: 4021644 - RNA, 13 nt, Staphylococcus aureus subsp. aureus MW2
uugaauaaaaaaa

SEQ ID NO: 4021645 - RNA, 21 nt, Staphylococcus aureus subsp. aureus MW2
uugaauaauaaacuuaaaaga

SEQ ID NO: 4021646 - RNA, 19 nt, Staphylococcus aureus subsp. aureus MW2
uugaauaauauauuuagga

SEQ ID NO: 4021647 - RNA, 13 nt, Staphylococcus aureus subsp. aureus MW2
uugaauaauucuu

SEQ ID NO: 4021648 - RNA, 17 nt, Staphylococcus aureus subsp. aureus MW2
uugaauaccuuuuauua

SEQ ID NO: 4021649 - RNA, 15 nt, Staphylococcus aureus subsp. aureus MW2
uugaauacuuuauuu

SEQ ID NO: 4021650 - RNA, 19 nt, Staphylococcus aureus subsp. aureus MW2
uugaauacuuuauuugaua

SEQ ID NO: 4021651 - RNA, 21 nt, Staphylococcus aureus subsp. aureus MW2
uugaauagugagcguauuauu

SEQ ID NO: 4021652 - RNA, 14 nt, Staphylococcus aureus subsp. aureus MW2
uugaauauaaaaaa

SEQ ID NO: 4021653 - RNA, 16 nt, Staphylococcus aureus subsp. aureus MW2
uugaauauacuuaauu

SEQ ID NO: 4021654 - RNA, 16 nt, Staphylococcus aureus subsp. aureus MW2
uugaauauuugcuuuu

SEQ ID NO: 4021655 - RNA, 17 nt, Staphylococcus aureus subsp. aureus MW2
uugaaucaguauaauca

SEQ ID NO: 4021656 - RNA, 20 nt, Staphylococcus aureus subsp. aureus MW2
uugaaucauacgaauuugug

SEQ ID NO: 4021657 - RNA, 15 nt, Staphylococcus aureus subsp. aureus MW2
uugaaucuuguugaa

SEQ ID NO: 4021658 - RNA, 17 nt, Staphylococcus aureus subsp. aureus MW2
uugaaucuuguugaacu

SEQ ID NO: 4021659 - RNA, 23 nt, Staphylococcus aureus subsp. aureus MW2
uugaaugaaguaauauauaaaag

SEQ ID NO: 4021660 - RNA, 20 nt, Staphylococcus aureus subsp. aureus MW2
uugaauggcucguuuuuuua

SEQ ID NO: 4021661 - RNA, 17 nt, Staphylococcus aureus subsp. aureus MW2
uugaaugguauaauucc

SEQ ID NO: 4021662 - RNA, 14 nt, Staphylococcus aureus subsp. aureus MW2
uugaauguuucucc

SEQ ID NO: 4021663 - RNA, 23 nt, Staphylococcus aureus subsp. aureus MW2
uugaauugacuuacauuuuaaua

SEQ ID NO: 4021664 - RNA, 22 nt, Staphylococcus aureus subsp. aureus MW2
uugaauugauuauaaugauugu

SEQ ID NO: 4021665 - RNA, 13 nt, Staphylococcus aureus subsp. aureus MW2
uugaauuuuauua

SEQ ID NO: 4021666 - RNA, 16 nt, Staphylococcus aureus subsp. aureus MW2
uugaauuuuauuaggu

SEQ ID NO: 4021667 - RNA, 13 nt, Staphylococcus aureus subsp. aureus MW2
uugacaauacaaa

SEQ ID NO: 4021668 - RNA, 21 nt, Staphylococcus aureus subsp. aureus MW2
uugacauaccagguuauagaa

SEQ ID NO: 4021669 - RNA, 22 nt, Staphylococcus aureus subsp. aureus MW2
uugacauaccagguuauagaau

SEQ ID NO: 4021670 - RNA, 18 nt, Staphylococcus aureus subsp. aureus MW2
uugacauguguuaaacca

SEQ ID NO: 4021671 - RNA, 14 nt, Staphylococcus aureus subsp. aureus MW2
uugacauuugacca

SEQ ID NO: 4021672 - RNA, 14 nt, Staphylococcus aureus subsp. aureus MW2
uugacccccuguau

SEQ ID NO: 4021673 - RNA, 21 nt, Staphylococcus aureus subsp. aureus MW2
uugaccgccuaugauauaugu

SEQ ID NO: 4021674 - RNA, 14 nt, Staphylococcus aureus subsp. aureus MW2
uugacguucugauc

SEQ ID NO: 4021675 - RNA, 20 nt, Staphylococcus aureus subsp. aureus MW2
uugacuaaguuuguuuucuu

SEQ ID NO: 4021676 - RNA, 20 nt, Staphylococcus aureus subsp. aureus MW2
uugacucaaagauauacuua

SEQ ID NO: 4021677 - RNA, 14 nt, Staphylococcus aureus subsp. aureus MW2
uugagaauauuaag

SEQ ID NO: 4021678 - RNA, 14 nt, Staphylococcus aureus subsp. aureus MW2
uugagacaaaaaau

SEQ ID NO: 4021679 - RNA, 18 nt, Staphylococcus aureus subsp. aureus MW2
uugagacaaaaaaugaag

SEQ ID NO: 4021680 - RNA, 18 nt, Staphylococcus aureus subsp. aureus MW2
uugagagauuauuuaaaa

SEQ ID NO: 4021681 - RNA, 19 nt, Staphylococcus aureus subsp. aureus MW2
uugagccaaaaauaaacca

SEQ ID NO: 4021682 - RNA, 23 nt, Staphylococcus aureus subsp. aureus MW2
uugaggaccacggucuugauauu

SEQ ID NO: 4021683 - RNA, 20 nt, Staphylococcus aureus subsp. aureus MW2
uugaguacuaaucaauacua

SEQ ID NO: 4021684 - RNA, 21 nt, Staphylococcus aureus subsp. aureus MW2
uugaguacuaaucaauacuaa

SEQ ID NO: 4021685 - RNA, 17 nt, Staphylococcus aureus subsp. aureus MW2
uugaguccauucgacuc

SEQ ID NO: 4021686 - RNA, 18 nt, Staphylococcus aureus subsp. aureus MW2
uugaguugaaaauaaucg

SEQ ID NO: 4021687 - RNA, 19 nt, Staphylococcus aureus subsp. aureus MW2
uugauaaaaaaugaauguu

SEQ ID NO: 4021688 - RNA, 21 nt, Staphylococcus aureus subsp. aureus MW2
uugauaaaaaaugaauguuaa

SEQ ID NO: 4021689 - RNA, 14 nt, Staphylococcus aureus subsp. aureus MW2
uugauaaaauaaau

SEQ ID NO: 4021690 - RNA, 13 nt, Staphylococcus aureus subsp. aureus MW2
uugauaaaauaau

SEQ ID NO: 4021691 - RNA, 15 nt, Staphylococcus aureus subsp. aureus MW2
uugauaagaagugcu

SEQ ID NO: 4021692 - RNA, 21 nt, Staphylococcus aureus subsp. aureus MW2
uugauaaguagaaaauaugac

SEQ ID NO: 4021693 - RNA, 13 nt, Staphylococcus aureus subsp. aureus MW2
uugauaagucuug

SEQ ID NO: 4021694 - RNA, 23 nt, Staphylococcus aureus subsp. aureus MW2
uugauaaugcuacuauuaaauaa

SEQ ID NO: 4021695 - RNA, 15 nt, Staphylococcus aureus subsp. aureus MW2
uugauagacuaauua

SEQ ID NO: 4021696 - RNA, 15 nt, Staphylococcus aureus subsp. aureus MW2
uugauagauagaaau

SEQ ID NO: 4021697 - RNA, 20 nt, Staphylococcus aureus subsp. aureus MW2
uugauagcaccguaacauau

SEQ ID NO: 4021698 - RNA, 15 nt, Staphylococcus aureus subsp. aureus MW2
uugauagcuaaugca

SEQ ID NO: 4021699 - RNA, 17 nt, Staphylococcus aureus subsp. aureus MW2
uugauaguaauaguuaa

SEQ ID NO: 4021700 - RNA, 11 nt, Staphylococcus aureus subsp. aureus MW2
uugauagucac

SEQ ID NO: 4021701 - RNA, 22 nt, Staphylococcus aureus subsp. aureus MW2
uugauagugguagccaauauca

SEQ ID NO: 4021702 - RNA, 13 nt, Staphylococcus aureus subsp. aureus MW2
uugauauaaaaag

SEQ ID NO: 4021703 - RNA, 18 nt, Staphylococcus aureus subsp. aureus MW2
uugauauauauuuugcaa

SEQ ID NO: 4021704 - RNA, 21 nt, Staphylococcus aureus subsp. aureus MW2
uugauaucgaaacgcuuugca

SEQ ID NO: 4021705 - RNA, 17 nt, Staphylococcus aureus subsp. aureus MW2
uugauaugguuagaaaa

SEQ ID NO: 4021706 - RNA, 18 nt, Staphylococcus aureus subsp. aureus MW2
uugauaugguuagaaaaa

SEQ ID NO: 4021707 - RNA, 22 nt, Staphylococcus aureus subsp. aureus MW2
uugauaugguuagaaaaaaauc

SEQ ID NO: 4021708 - RNA, 20 nt, Staphylococcus aureus subsp. aureus MW2
uugauauguuuccucuuuaa

SEQ ID NO: 4021709 - RNA, 16 nt, Staphylococcus aureus subsp. aureus MW2
uugauauucuaaaaaa

SEQ ID NO: 4021710 - RNA, 17 nt, Staphylococcus aureus subsp. aureus MW2
uugauauuuuucacgua

SEQ ID NO: 4021711 - RNA, 11 nt, Staphylococcus aureus subsp. aureus MW2
uugaucaaccu

SEQ ID NO: 4021712 - RNA, 14 nt, Staphylococcus aureus subsp. aureus MW2
uugaucauaauuca

SEQ ID NO: 4021713 - RNA, 18 nt, Staphylococcus aureus subsp. aureus MW2
uugaucaugagauaaacg

SEQ ID NO: 4021714 - RNA, 24 nt, Staphylococcus aureus subsp. aureus MW2
uugaucuaaaguacucaaguaauc

SEQ ID NO: 4021715 - RNA, 16 nt, Staphylococcus aureus subsp. aureus MW2
uugaucugauuucacu

SEQ ID NO: 4021716 - RNA, 13 nt, Staphylococcus aureus subsp. aureus MW2
uugaucugugcuu

SEQ ID NO: 4021717 - RNA, 13 nt, Staphylococcus aureus subsp. aureus MW2
uugaucuuuuaua

SEQ ID NO: 4021718 - RNA, 15 nt, Staphylococcus aureus subsp. aureus MW2
uugauggauauucaa

SEQ ID NO: 4021719 - RNA, 16 nt, Staphylococcus aureus subsp. aureus MW2
uugauggauauucaau

SEQ ID NO: 4021720 - RNA, 22 nt, Staphylococcus aureus subsp. aureus MW2
uugauggcaacuaaaauuugua

SEQ ID NO: 4021721 - RNA, 14 nt, Staphylococcus aureus subsp. aureus MW2
uugauguguugcau

SEQ ID NO: 4021722 - RNA, 18 nt, Staphylococcus aureus subsp. aureus MW2
uugauguucuugaaaaca

SEQ ID NO: 4021723 - RNA, 14 nt, Staphylococcus aureus subsp. aureus MW2
uugauuaaaagugu

SEQ ID NO: 4021724 - RNA, 15 nt, Staphylococcus aureus subsp. aureus MW2
uugauuaaaaguguu

SEQ ID NO: 4021725 - RNA, 12 nt, Staphylococcus aureus subsp. aureus MW2
uugauuaaaauc

SEQ ID NO: 4021726 - RNA, 18 nt, Staphylococcus aureus subsp. aureus MW2
uugauuaacacaauccuu

SEQ ID NO: 4021727 - RNA, 17 nt, Staphylococcus aureus subsp. aureus MW2
uugauuagcauaccuuu

SEQ ID NO: 4021728 - RNA, 18 nt, Staphylococcus aureus subsp. aureus MW2
uugauuaucauaugaaca

SEQ ID NO: 4021729 - RNA, 18 nt, Staphylococcus aureus subsp. aureus MW2
uugauuauucuuuaauua

SEQ ID NO: 4021730 - RNA, 15 nt, Staphylococcus aureus subsp. aureus MW2
uugauucuacagcgu

SEQ ID NO: 4021731 - RNA, 18 nt, Staphylococcus aureus subsp. aureus MW2
uugauucuagugaaauac

SEQ ID NO: 4021732 - RNA, 13 nt, Staphylococcus aureus subsp. aureus MW2
uugauugaauaug

SEQ ID NO: 4021733 - RNA, 16 nt, Staphylococcus aureus subsp. aureus MW2
uugauuguaauaauaa

SEQ ID NO: 4021734 - RNA, 17 nt, Staphylococcus aureus subsp. aureus MW2
uugauuguauuuuucaa

SEQ ID NO: 4021735 - RNA, 16 nt, Staphylococcus aureus subsp. aureus MW2
uugauuuaaaauauua

SEQ ID NO: 4021736 - RNA, 16 nt, Staphylococcus aureus subsp. aureus MW2
uugauuuaacaaccuc

SEQ ID NO: 4021737 - RNA, 17 nt, Staphylococcus aureus subsp. aureus MW2
uugauuuaacugggcaa

SEQ ID NO: 4021738 - RNA, 15 nt, Staphylococcus aureus subsp. aureus MW2
uugauuuacgugcau

SEQ ID NO: 4021739 - RNA, 13 nt, Staphylococcus aureus subsp. aureus MW2
uugauuucauuug

SEQ ID NO: 4021740 - RNA, 19 nt, Staphylococcus aureus subsp. aureus MW2
uugauuuggguaauguuuu

SEQ ID NO: 4021741 - RNA, 14 nt, Staphylococcus aureus subsp. aureus MW2
uugauuuucuaaag

SEQ ID NO: 4021742 - RNA, 18 nt, Staphylococcus aureus subsp. aureus MW2
uugauuuuuugaaauguu

SEQ ID NO: 4021743 - RNA, 14 nt, Staphylococcus aureus subsp. aureus MW2
uugcaaaauacgau

SEQ ID NO: 4021744 - RNA, 13 nt, Staphylococcus aureus subsp. aureus MW2
uugcaaaauuuug

SEQ ID NO: 4021745 - RNA, 21 nt, Staphylococcus aureus subsp. aureus MW2
uugcaaaauuuugcaaaaaaa

SEQ ID NO: 4021746 - RNA, 21 nt, Staphylococcus aureus subsp. aureus MW2
uugcaaauauaucaucucuau

SEQ ID NO: 4021747 - RNA, 15 nt, Staphylococcus aureus subsp. aureus MW2
uugcaaauuaucauu

SEQ ID NO: 4021748 - RNA, 19 nt, Staphylococcus aureus subsp. aureus MW2
uugcaaauuaucauuaaau

SEQ ID NO: 4021749 - RNA, 20 nt, Staphylococcus aureus subsp. aureus MW2
uugcaaauuaucauuaaauu

SEQ ID NO: 4021750 - RNA, 13 nt, Staphylococcus aureus subsp. aureus MW2
uugcaaguauuuu

SEQ ID NO: 4021751 - RNA, 18 nt, Staphylococcus aureus subsp. aureus MW2
uugcaauaauucaucuug

SEQ ID NO: 4021752 - RNA, 16 nt, Staphylococcus aureus subsp. aureus MW2
uugcaaucguauguaa

SEQ ID NO: 4021753 - RNA, 19 nt, Staphylococcus aureus subsp. aureus MW2
uugcaaugcauauugugcc

SEQ ID NO: 4021754 - RNA, 19 nt, Staphylococcus aureus subsp. aureus MW2
uugcaauuuuuuauguauu

SEQ ID NO: 4021755 - RNA, 12 nt, Staphylococcus aureus subsp. aureus MW2
uugcacauuauu

SEQ ID NO: 4021756 - RNA, 18 nt, Staphylococcus aureus subsp. aureus MW2
uugcacgucuuguaucaa

SEQ ID NO: 4021757 - RNA, 21 nt, Staphylococcus aureus subsp. aureus MW2
uugcauaaucaauuucaccuu

SEQ ID NO: 4021758 - RNA, 19 nt, Staphylococcus aureus subsp. aureus MW2
uugcauacguaaaugguaa

SEQ ID NO: 4021759 - RNA, 17 nt, Staphylococcus aureus subsp. aureus MW2
uugcaucacuuguugcu

SEQ ID NO: 4021760 - RNA, 12 nt, Staphylococcus aureus subsp. aureus MW2
uugcaucauaau

SEQ ID NO: 4021761 - RNA, 16 nt, Staphylococcus aureus subsp. aureus MW2
uugcaugaaaauuaaa

SEQ ID NO: 4021762 - RNA, 23 nt, Staphylococcus aureus subsp. aureus MW2
uugcaugaaaauuaaaaaaugcu

SEQ ID NO: 4021763 - RNA, 19 nt, Staphylococcus aureus subsp. aureus MW2
uugcaugacagcaaauuuu

SEQ ID NO: 4021764 - RNA, 14 nt, Staphylococcus aureus subsp. aureus MW2
uugcaugucuuaaa

SEQ ID NO: 4021765 - RNA, 21 nt, Staphylococcus aureus subsp. aureus MW2
uugcauuagaucauacauuag

SEQ ID NO: 4021766 - RNA, 18 nt, Staphylococcus aureus subsp. aureus MW2
uugcauugccuguagaau

SEQ ID NO: 4021767 - RNA, 17 nt, Staphylococcus aureus subsp. aureus MW2
uugcauuguauaugugu

SEQ ID NO: 4021768 - RNA, 17 nt, Staphylococcus aureus subsp. aureus MW2
uugccauucauacacua

SEQ ID NO: 4021769 - RNA, 15 nt, Staphylococcus aureus subsp. aureus MW2
uugcccaugucauga

SEQ ID NO: 4021770 - RNA, 21 nt, Staphylococcus aureus subsp. aureus MW2
uugccuggcaacguucuacuc

SEQ ID NO: 4021771 - RNA, 21 nt, Staphylococcus aureus subsp. aureus MW2
uugccugguaacguucuacuc

SEQ ID NO: 4021772 - RNA, 13 nt, Staphylococcus aureus subsp. aureus MW2
uugccuguagaau

SEQ ID NO: 4021773 - RNA, 18 nt, Staphylococcus aureus subsp. aureus MW2
uugccuguagaauuucuu

SEQ ID NO: 4021774 - RNA, 14 nt, Staphylococcus aureus subsp. aureus MW2
uugccuuucauuuu

SEQ ID NO: 4021775 - RNA, 20 nt, Staphylococcus aureus subsp. aureus MW2
uugcgaauaccguuucuauu

SEQ ID NO: 4021776 - RNA, 21 nt, Staphylococcus aureus subsp. aureus MW2
uugcgauauacgaauccucau

SEQ ID NO: 4021777 - RNA, 16 nt, Staphylococcus aureus subsp. aureus MW2
uugcgguuggcucuuu

SEQ ID NO: 4021778 - RNA, 17 nt, Staphylococcus aureus subsp. aureus MW2
uugcguuuaauaacauu

SEQ ID NO: 4021779 - RNA, 14 nt, Staphylococcus aureus subsp. aureus MW2
uugcuaaaaaaauu

SEQ ID NO: 4021780 - RNA, 18 nt, Staphylococcus aureus subsp. aureus MW2
uugcuaaaaaaauuaaaa

SEQ ID NO: 4021781 - RNA, 21 nt, Staphylococcus aureus subsp. aureus MW2
uugcuaaaaaaauuaaaaugu

SEQ ID NO: 4021782 - RNA, 22 nt, Staphylococcus aureus subsp. aureus MW2
uugcuaaaaaaauuaaaauguu

SEQ ID NO: 4021783 - RNA, 20 nt, Staphylococcus aureus subsp. aureus MW2
uugcuaaaguguagccaaau

SEQ ID NO: 4021784 - RNA, 21 nt, Staphylococcus aureus subsp. aureus MW2
uugcuaaugcuaguaacuuau

SEQ ID NO: 4021785 - RNA, 16 nt, Staphylococcus aureus subsp. aureus MW2
uugcuauauuaguaua

SEQ ID NO: 4021786 - RNA, 22 nt, Staphylococcus aureus subsp. aureus MW2
uugcucaccuuuagacaauauu

SEQ ID NO: 4021787 - RNA, 19 nt, Staphylococcus aureus subsp. aureus MW2
uugcucgcgcucuucuuca

SEQ ID NO: 4021788 - RNA, 15 nt, Staphylococcus aureus subsp. aureus MW2
uugcucuuuaacaau

SEQ ID NO: 4021789 - RNA, 18 nt, Staphylococcus aureus subsp. aureus MW2
uugcugccaaaaaguauu

SEQ ID NO: 4021790 - RNA, 21 nt, Staphylococcus aureus subsp. aureus MW2
uugcugcuguacaauuucgcu

SEQ ID NO: 4021791 - RNA, 15 nt, Staphylococcus aureus subsp. aureus MW2
uugcugcuuuuccau

SEQ ID NO: 4021792 - RNA, 23 nt, Staphylococcus aureus subsp. aureus MW2
uugcugggcuaccgauugucaau

SEQ ID NO: 4021793 - RNA, 12 nt, Staphylococcus aureus subsp. aureus MW2
uugcuguaaaua

SEQ ID NO: 4021794 - RNA, 17 nt, Staphylococcus aureus subsp. aureus MW2
uugcuguccaucgucau

SEQ ID NO: 4021795 - RNA, 19 nt, Staphylococcus aureus subsp. aureus MW2
uugcuguuuaguuaaugua

SEQ ID NO: 4021796 - RNA, 22 nt, Staphylococcus aureus subsp. aureus MW2
uugcuuaaaccuuaauaaugaa

SEQ ID NO: 4021797 - RNA, 19 nt, Staphylococcus aureus subsp. aureus MW2
uugcuuauuuuuguauucu

SEQ ID NO: 4021798 - RNA, 18 nt, Staphylococcus aureus subsp. aureus MW2
uugcuucauuauauaauu

SEQ ID NO: 4021799 - RNA, 13 nt, Staphylococcus aureus subsp. aureus MW2
uugcuugaaauua

SEQ ID NO: 4021800 - RNA, 14 nt, Staphylococcus aureus subsp. aureus MW2
uugcuugcuuacaa

SEQ ID NO: 4021801 - RNA, 14 nt, Staphylococcus aureus subsp. aureus MW2
uugcuuuaauuuga

SEQ ID NO: 4021802 - RNA, 21 nt, Staphylococcus aureus subsp. aureus MW2
uugcuuuaauuugauuaaauu

SEQ ID NO: 4021803 - RNA, 20 nt, Staphylococcus aureus subsp. aureus MW2
uugcuuuuauuuuuaauguu

SEQ ID NO: 4021804 - RNA, 13 nt, Staphylococcus aureus subsp. aureus MW2
uugcuuuuuacua

SEQ ID NO: 4021805 - RNA, 18 nt, Staphylococcus aureus subsp. aureus MW2
uugcuuuuuacuauguaa

SEQ ID NO: 4021806 - RNA, 21 nt, Staphylococcus aureus subsp. aureus MW2
uugcuuuuucaaauaauauaa

SEQ ID NO: 4021807 - RNA, 14 nt, Staphylococcus aureus subsp. aureus MW2
uuggaaaaauaaau

SEQ ID NO: 4021808 - RNA, 14 nt, Staphylococcus aureus subsp. aureus MW2
uuggaaaaucccug

SEQ ID NO: 4021809 - RNA, 18 nt, Staphylococcus aureus subsp. aureus MW2
uuggaaauuuauuauaaa

SEQ ID NO: 4021810 - RNA, 18 nt, Staphylococcus aureus subsp. aureus MW2
uuggaacauauucauaau

SEQ ID NO: 4021811 - RNA, 12 nt, Staphylococcus aureus subsp. aureus MW2
uuggaagucugc

SEQ ID NO: 4021812 - RNA, 14 nt, Staphylococcus aureus subsp. aureus MW2
uuggaauagauguu

SEQ ID NO: 4021813 - RNA, 14 nt, Staphylococcus aureus subsp. aureus MW2
uuggaaucaucuuu

SEQ ID NO: 4021814 - RNA, 16 nt, Staphylococcus aureus subsp. aureus MW2
uuggaaucccaaugcu

SEQ ID NO: 4021815 - RNA, 21 nt, Staphylococcus aureus subsp. aureus MW2
uuggaaugguauagauuuuau

SEQ ID NO: 4021816 - RNA, 22 nt, Staphylococcus aureus subsp. aureus MW2
uuggacaaauucuaugagaaua

SEQ ID NO: 4021817 - RNA, 14 nt, Staphylococcus aureus subsp. aureus MW2
uuggauaaaaugau

SEQ ID NO: 4021818 - RNA, 21 nt, Staphylococcus aureus subsp. aureus MW2
uuggauagguaacuaaaaugu

SEQ ID NO: 4021819 - RNA, 22 nt, Staphylococcus aureus subsp. aureus MW2
uuggauaugcguauauguauaa

SEQ ID NO: 4021820 - RNA, 17 nt, Staphylococcus aureus subsp. aureus MW2
uuggauucaaaugacau

SEQ ID NO: 4021821 - RNA, 17 nt, Staphylococcus aureus subsp. aureus MW2
uuggcacauaaaucaau

SEQ ID NO: 4021822 - RNA, 23 nt, Staphylococcus aureus subsp. aureus MW2
uuggcagacguaucaucaaaauu

SEQ ID NO: 4021823 - RNA, 17 nt, Staphylococcus aureus subsp. aureus MW2
uuggcauaaccuguuuu

SEQ ID NO: 4021824 - RNA, 21 nt, Staphylococcus aureus subsp. aureus MW2
uuggcggggccccaacacaga

SEQ ID NO: 4021825 - RNA, 18 nt, Staphylococcus aureus subsp. aureus MW2
uuggcguauuuuuuguuc

SEQ ID NO: 4021826 - RNA, 14 nt, Staphylococcus aureus subsp. aureus MW2
uugggcaacuuuug

SEQ ID NO: 4021827 - RNA, 17 nt, Staphylococcus aureus subsp. aureus MW2
uuggggaugggccccaa

SEQ ID NO: 4021828 - RNA, 23 nt, Staphylococcus aureus subsp. aureus MW2
uuggggaugggccccaacacaga

SEQ ID NO: 4021829 - RNA, 20 nt, Staphylococcus aureus subsp. aureus MW2
uuggggccccgacuauuuuu

SEQ ID NO: 4021830 - RNA, 17 nt, Staphylococcus aureus subsp. aureus MW2
uugggguauagaaaaag

SEQ ID NO: 4021831 - RNA, 18 nt, Staphylococcus aureus subsp. aureus MW2
uuggggugagggccccaa

SEQ ID NO: 4021832 - RNA, 19 nt, Staphylococcus aureus subsp. aureus MW2
uuggguaagguuuuacaau

SEQ ID NO: 4021833 - RNA, 20 nt, Staphylococcus aureus subsp. aureus MW2
uugguaaaaaucucaaaauu

SEQ ID NO: 4021834 - RNA, 18 nt, Staphylococcus aureus subsp. aureus MW2
uugguaauugaucuaaau

SEQ ID NO: 4021835 - RNA, 14 nt, Staphylococcus aureus subsp. aureus MW2
uugguaggcauuuu

SEQ ID NO: 4021836 - RNA, 13 nt, Staphylococcus aureus subsp. aureus MW2
uugguauuauucu

SEQ ID NO: 4021837 - RNA, 12 nt, Staphylococcus aureus subsp. aureus MW2
uugguauuuauc

SEQ ID NO: 4021838 - RNA, 16 nt, Staphylococcus aureus subsp. aureus MW2
uuggucaaguaaaugu

SEQ ID NO: 4021839 - RNA, 16 nt, Staphylococcus aureus subsp. aureus MW2
uuggucaaguuuuggu

SEQ ID NO: 4021840 - RNA, 19 nt, Staphylococcus aureus subsp. aureus MW2
uuggucaccuacagauaaa

SEQ ID NO: 4021841 - RNA, 22 nt, Staphylococcus aureus subsp. aureus MW2
uuggucaccuacagauaaagcu

SEQ ID NO: 4021842 - RNA, 19 nt, Staphylococcus aureus subsp. aureus MW2
uuggucuaucguuuuagcu

SEQ ID NO: 4021843 - RNA, 19 nt, Staphylococcus aureus subsp. aureus MW2
uuggugaguguuucauaau

SEQ ID NO: 4021844 - RNA, 23 nt, Staphylococcus aureus subsp. aureus MW2
uuggugccgaaauuguucuaaua

SEQ ID NO: 4021845 - RNA, 23 nt, Staphylococcus aureus subsp. aureus MW2
uugguggaugucaugucuagauu

SEQ ID NO: 4021846 - RNA, 21 nt, Staphylococcus aureus subsp. aureus MW2
uugguuaauacguuuaauaau

SEQ ID NO: 4021847 - RNA, 14 nt, Staphylococcus aureus subsp. aureus MW2
uugguuacuuagua

SEQ ID NO: 4021848 - RNA, 17 nt, Staphylococcus aureus subsp. aureus MW2
uugguuuagacaaccag

SEQ ID NO: 4021849 - RNA, 18 nt, Staphylococcus aureus subsp. aureus MW2
uugguuuggauaaaauga

SEQ ID NO: 4021850 - RNA, 22 nt, Staphylococcus aureus subsp. aureus MW2
uuguaaaauuuucguguuaaua

SEQ ID NO: 4021851 - RNA, 20 nt, Staphylococcus aureus subsp. aureus MW2
uuguaaauaaaacuaucuac

SEQ ID NO: 4021852 - RNA, 21 nt, Staphylococcus aureus subsp. aureus MW2
uuguaacaagcuuuuuucaau

SEQ ID NO: 4021853 - RNA, 18 nt, Staphylococcus aureus subsp. aureus MW2
uuguaaccccauuuuaaa

SEQ ID NO: 4021854 - RNA, 21 nt, Staphylococcus aureus subsp. aureus MW2
uuguaagcucaugaaucagau

SEQ ID NO: 4021855 - RNA, 17 nt, Staphylococcus aureus subsp. aureus MW2
uuguaauucuuguaaau

SEQ ID NO: 4021856 - RNA, 16 nt, Staphylococcus aureus subsp. aureus MW2
uuguaauugaaaugau

SEQ ID NO: 4021857 - RNA, 18 nt, Staphylococcus aureus subsp. aureus MW2
uuguacaucauuaaauau

SEQ ID NO: 4021858 - RNA, 19 nt, Staphylococcus aureus subsp. aureus MW2
uuguacaucauuaaauauu

SEQ ID NO: 4021859 - RNA, 18 nt, Staphylococcus aureus subsp. aureus MW2
uuguacauuauuaauauc

SEQ ID NO: 4021860 - RNA, 23 nt, Staphylococcus aureus subsp. aureus MW2
uuguacgauaacuacacuuaaua

SEQ ID NO: 4021861 - RNA, 21 nt, Staphylococcus aureus subsp. aureus MW2
uuguacgcuucaauuauuuca

SEQ ID NO: 4021862 - RNA, 11 nt, Staphylococcus aureus subsp. aureus MW2
uuguacuucuu

SEQ ID NO: 4021863 - RNA, 16 nt, Staphylococcus aureus subsp. aureus MW2
uuguacuucuuugguc

SEQ ID NO: 4021864 - RNA, 23 nt, Staphylococcus aureus subsp. aureus MW2
uuguagaauuucuuuucgaaauu

SEQ ID NO: 4021865 - RNA, 16 nt, Staphylococcus aureus subsp. aureus MW2
uuguagccuucaacua

SEQ ID NO: 4021866 - RNA, 23 nt, Staphylococcus aureus subsp. aureus MW2
uuguagggaguauuguuuuauau

SEQ ID NO: 4021867 - RNA, 15 nt, Staphylococcus aureus subsp. aureus MW2
uuguaguauuuuuug

SEQ ID NO: 4021868 - RNA, 19 nt, Staphylococcus aureus subsp. aureus MW2
uuguauaaaaauguauuaa

SEQ ID NO: 4021869 - RNA, 20 nt, Staphylococcus aureus subsp. aureus MW2
uuguauaaaaauguauuaaa

SEQ ID NO: 4021870 - RNA, 22 nt, Staphylococcus aureus subsp. aureus MW2
uuguauaaaaauguauuaaaua

SEQ ID NO: 4021871 - RNA, 12 nt, Staphylococcus aureus subsp. aureus MW2
uuguauaacuaa

SEQ ID NO: 4021872 - RNA, 19 nt, Staphylococcus aureus subsp. aureus MW2
uuguauaccuauuccuauu

SEQ ID NO: 4021873 - RNA, 18 nt, Staphylococcus aureus subsp. aureus MW2
uuguauagaauguguaug

SEQ ID NO: 4021874 - RNA, 22 nt, Staphylococcus aureus subsp. aureus MW2
uuguauagauuguauuuaauaa

SEQ ID NO: 4021875 - RNA, 20 nt, Staphylococcus aureus subsp. aureus MW2
uuguauuauuauuauguuaa

SEQ ID NO: 4021876 - RNA, 22 nt, Staphylococcus aureus subsp. aureus MW2
uuguauuguuuguagaaauuag

SEQ ID NO: 4021877 - RNA, 13 nt, Staphylococcus aureus subsp. aureus MW2
uuguauuuuucaa

SEQ ID NO: 4021878 - RNA, 15 nt, Staphylococcus aureus subsp. aureus MW2
uuguauuuuucaaau

SEQ ID NO: 4021879 - RNA, 22 nt, Staphylococcus aureus subsp. aureus MW2
uugucacaggcugggacauaaa

SEQ ID NO: 4021880 - RNA, 22 nt, Staphylococcus aureus subsp. aureus MW2
uugucaguaacuuugucuguau

SEQ ID NO: 4021881 - RNA, 20 nt, Staphylococcus aureus subsp. aureus MW2
uugucaguuuuuuuauaagc

SEQ ID NO: 4021882 - RNA, 13 nt, Staphylococcus aureus subsp. aureus MW2
uugucaugccuuc

SEQ ID NO: 4021883 - RNA, 19 nt, Staphylococcus aureus subsp. aureus MW2
uugucauuugaacaucauu

SEQ ID NO: 4021884 - RNA, 18 nt, Staphylococcus aureus subsp. aureus MW2
uugucauuuugaugaagu

SEQ ID NO: 4021885 - RNA, 17 nt, Staphylococcus aureus subsp. aureus MW2
uuguccaugccuuaugu

SEQ ID NO: 4021886 - RNA, 19 nt, Staphylococcus aureus subsp. aureus MW2
uuguccguucgcaucuuug

SEQ ID NO: 4021887 - RNA, 20 nt, Staphylococcus aureus subsp. aureus MW2
uuguccuaacgcuaauuuua

SEQ ID NO: 4021888 - RNA, 16 nt, Staphylococcus aureus subsp. aureus MW2
uugucucaauaauguu

SEQ ID NO: 4021889 - RNA, 13 nt, Staphylococcus aureus subsp. aureus MW2
uugucuguagaaa

SEQ ID NO: 4021890 - RNA, 20 nt, Staphylococcus aureus subsp. aureus MW2
uugucuuacuaauuaaagca

SEQ ID NO: 4021891 - RNA, 20 nt, Staphylococcus aureus subsp. aureus MW2
uugucuucauuaacaucaug

SEQ ID NO: 4021892 - RNA, 13 nt, Staphylococcus aureus subsp. aureus MW2
uugucuucucaac

SEQ ID NO: 4021893 - RNA, 13 nt, Staphylococcus aureus subsp. aureus MW2
uugucuuugaaug

SEQ ID NO: 4021894 - RNA, 15 nt, Staphylococcus aureus subsp. aureus MW2
uugucuuuuauauuu

SEQ ID NO: 4021895 - RNA, 18 nt, Staphylococcus aureus subsp. aureus MW2
uugugaaguaaugugcau

SEQ ID NO: 4021896 - RNA, 18 nt, Staphylococcus aureus subsp. aureus MW2
uugugaauuuauuuugua

SEQ ID NO: 4021897 - RNA, 14 nt, Staphylococcus aureus subsp. aureus MW2
uugugacaauuuaa

SEQ ID NO: 4021898 - RNA, 15 nt, Staphylococcus aureus subsp. aureus MW2
uugugaguucauaau

SEQ ID NO: 4021899 - RNA, 20 nt, Staphylococcus aureus subsp. aureus MW2
uugugcugucaaacaacaau

SEQ ID NO: 4021900 - RNA, 14 nt, Staphylococcus aureus subsp. aureus MW2
uugugcuuuuucau

SEQ ID NO: 4021901 - RNA, 12 nt, Staphylococcus aureus subsp. aureus MW2
uuguguaauaaa

SEQ ID NO: 4021902 - RNA, 18 nt, Staphylococcus aureus subsp. aureus MW2
uuguguaucguuuuacuu

SEQ ID NO: 4021903 - RNA, 19 nt, Staphylococcus aureus subsp. aureus MW2
uuguguaucuguaacauaa

SEQ ID NO: 4021904 - RNA, 12 nt, Staphylococcus aureus subsp. aureus MW2
uuguguauuuau

SEQ ID NO: 4021905 - RNA, 13 nt, Staphylococcus aureus subsp. aureus MW2
uuguguuauguau

SEQ ID NO: 4021906 - RNA, 22 nt, Staphylococcus aureus subsp. aureus MW2
uuguuaacgguuaauaagcuaa

SEQ ID NO: 4021907 - RNA, 16 nt, Staphylococcus aureus subsp. aureus MW2
uuguuaagcagcuugc

SEQ ID NO: 4021908 - RNA, 15 nt, Staphylococcus aureus subsp. aureus MW2
uuguuaauacaacca

SEQ ID NO: 4021909 - RNA, 22 nt, Staphylococcus aureus subsp. aureus MW2
uuguuaauucaacggaacuacu

SEQ ID NO: 4021910 - RNA, 13 nt, Staphylococcus aureus subsp. aureus MW2
uuguuaauuucaa

SEQ ID NO: 4021911 - RNA, 17 nt, Staphylococcus aureus subsp. aureus MW2
uuguuaccaaacaauac

SEQ ID NO: 4021912 - RNA, 22 nt, Staphylococcus aureus subsp. aureus MW2
uuguuaccaaacaauacauaau

SEQ ID NO: 4021913 - RNA, 13 nt, Staphylococcus aureus subsp. aureus MW2
uuguuagcaucug

SEQ ID NO: 4021914 - RNA, 21 nt, Staphylococcus aureus subsp. aureus MW2
uuguuauacauauauucuaau

SEQ ID NO: 4021915 - RNA, 22 nt, Staphylococcus aureus subsp. aureus MW2
uuguuauacauauauucuaauu

SEQ ID NO: 4021916 - RNA, 23 nt, Staphylococcus aureus subsp. aureus MW2
uuguuauacauauauucuaauug

SEQ ID NO: 4021917 - RNA, 19 nt, Staphylococcus aureus subsp. aureus MW2
uuguuaucguucaauguua

SEQ ID NO: 4021918 - RNA, 17 nt, Staphylococcus aureus subsp. aureus MW2
uuguucaaguaaucauu

SEQ ID NO: 4021919 - RNA, 12 nt, Staphylococcus aureus subsp. aureus MW2
uuguucagauuu

SEQ ID NO: 4021920 - RNA, 14 nt, Staphylococcus aureus subsp. aureus MW2
uuguucauguuuaa

SEQ ID NO: 4021921 - RNA, 20 nt, Staphylococcus aureus subsp. aureus MW2
uuguucccauuuuuaaaauu

SEQ ID NO: 4021922 - RNA, 22 nt, Staphylococcus aureus subsp. aureus MW2
uuguucuccgaucaugccuuca

SEQ ID NO: 4021923 - RNA, 20 nt, Staphylococcus aureus subsp. aureus MW2
uuguucuucgucguuuaaug

SEQ ID NO: 4021924 - RNA, 19 nt, Staphylococcus aureus subsp. aureus MW2
uuguugaauaauuaauguu

SEQ ID NO: 4021925 - RNA, 13 nt, Staphylococcus aureus subsp. aureus MW2
uuguugauuuaaa

SEQ ID NO: 4021926 - RNA, 14 nt, Staphylococcus aureus subsp. aureus MW2
uuguugcaaugauu

SEQ ID NO: 4021927 - RNA, 15 nt, Staphylococcus aureus subsp. aureus MW2
uuguuggggccccgc

SEQ ID NO: 4021928 - RNA, 16 nt, Staphylococcus aureus subsp. aureus MW2
uuguuuacagaugcgu

SEQ ID NO: 4021929 - RNA, 17 nt, Staphylococcus aureus subsp. aureus MW2
uuguuuaccuaaaucuu

SEQ ID NO: 4021930 - RNA, 23 nt, Staphylococcus aureus subsp. aureus MW2
uuguuuagcgucguguauucaga

SEQ ID NO: 4021931 - RNA, 15 nt, Staphylococcus aureus subsp. aureus MW2
uuguuucauuaucaa

SEQ ID NO: 4021932 - RNA, 15 nt, Staphylococcus aureus subsp. aureus MW2
uuguuuccuacacug

SEQ ID NO: 4021933 - RNA, 13 nt, Staphylococcus aureus subsp. aureus MW2
uuguuucuaaauu

SEQ ID NO: 4021934 - RNA, 14 nt, Staphylococcus aureus subsp. aureus MW2
uuguuucuaaugcu

SEQ ID NO: 4021935 - RNA, 21 nt, Staphylococcus aureus subsp. aureus MW2
uuguuugaagugaaaaauuuc

SEQ ID NO: 4021936 - RNA, 12 nt, Staphylococcus aureus subsp. aureus MW2
uuguuuucacug

SEQ ID NO: 4021937 - RNA, 16 nt, Staphylococcus aureus subsp. aureus MW2
uuguuuuccaauaaua

SEQ ID NO: 4021938 - RNA, 20 nt, Staphylococcus aureus subsp. aureus MW2
uuguuuugaauguuucuccu

SEQ ID NO: 4021939 - RNA, 16 nt, Staphylococcus aureus subsp. aureus MW2
uuguuuuuaaaaucuc

SEQ ID NO: 4021940 - RNA, 21 nt, Staphylococcus aureus subsp. aureus MW2
uuguuuuucacuguuaaaguc

SEQ ID NO: 4021941 - RNA, 12 nt, Staphylococcus aureus subsp. aureus MW2
uuuaaaaaacaa

SEQ ID NO: 4021942 - RNA, 23 nt, Staphylococcus aureus subsp. aureus MW2
uuuaaaaaacauaccugcauauu

SEQ ID NO: 4021943 - RNA, 11 nt, Staphylococcus aureus subsp. aureus MW2
uuuaaaaaacu

SEQ ID NO: 4021944 - RNA, 21 nt, Staphylococcus aureus subsp. aureus MW2
uuuaaaaauaaaaaaccaaua

SEQ ID NO: 4021945 - RNA, 21 nt, Staphylococcus aureus subsp. aureus MW2
uuuaaaaauagccuucaaaau

SEQ ID NO: 4021946 - RNA, 20 nt, Staphylococcus aureus subsp. aureus MW2
uuuaaaaauaguaaagugaa

SEQ ID NO: 4021947 - RNA, 16 nt, Staphylococcus aureus subsp. aureus MW2
uuuaaaaauucauaau

SEQ ID NO: 4021948 - RNA, 15 nt, Staphylococcus aureus subsp. aureus MW2
uuuaaaacaaugauu

SEQ ID NO: 4021949 - RNA, 22 nt, Staphylococcus aureus subsp. aureus MW2
uuuaaaacaucauucacaaguu

SEQ ID NO: 4021950 - RNA, 9 nt, Staphylococcus aureus subsp. aureus MW2
uuuaaaagu

SEQ ID NO: 4021951 - RNA, 15 nt, Staphylococcus aureus subsp. aureus MW2
uuuaaaauaaagaaa

SEQ ID NO: 4021952 - RNA, 14 nt, Staphylococcus aureus subsp. aureus MW2
uuuaaaauaauaga

SEQ ID NO: 4021953 - RNA, 13 nt, Staphylococcus aureus subsp. aureus MW2
uuuaaaauauuaa

SEQ ID NO: 4021954 - RNA, 14 nt, Staphylococcus aureus subsp. aureus MW2
uuuaaaauauuaau

SEQ ID NO: 4021955 - RNA, 14 nt, Staphylococcus aureus subsp. aureus MW2
uuuaaacaaaaaua

SEQ ID NO: 4021956 - RNA, 18 nt, Staphylococcus aureus subsp. aureus MW2
uuuaaacaagaaaacuaa

SEQ ID NO: 4021957 - RNA, 23 nt, Staphylococcus aureus subsp. aureus MW2
uuuaaacaagcaucaugaaauua

SEQ ID NO: 4021958 - RNA, 13 nt, Staphylococcus aureus subsp. aureus MW2
uuuaaacgcucau

SEQ ID NO: 4021959 - RNA, 16 nt, Staphylococcus aureus subsp. aureus MW2
uuuaaacgguaacaaa

SEQ ID NO: 4021960 - RNA, 21 nt, Staphylococcus aureus subsp. aureus MW2
uuuaaacguacauuuuuauga

SEQ ID NO: 4021961 - RNA, 13 nt, Staphylococcus aureus subsp. aureus MW2
uuuaaacucauaa

SEQ ID NO: 4021962 - RNA, 20 nt, Staphylococcus aureus subsp. aureus MW2
uuuaaacucauaauuuucua

SEQ ID NO: 4021963 - RNA, 22 nt, Staphylococcus aureus subsp. aureus MW2
uuuaaacucauaauuuucuauu

SEQ ID NO: 4021964 - RNA, 15 nt, Staphylococcus aureus subsp. aureus MW2
uuuaaagaaaaguuu

SEQ ID NO: 4021965 - RNA, 18 nt, Staphylococcus aureus subsp. aureus MW2
uuuaaagcaucauauaca

SEQ ID NO: 4021966 - RNA, 16 nt, Staphylococcus aureus subsp. aureus MW2
uuuaaagcuaaauguu

SEQ ID NO: 4021967 - RNA, 18 nt, Staphylococcus aureus subsp. aureus MW2
uuuaaauaaaugacuuca

SEQ ID NO: 4021968 - RNA, 23 nt, Staphylococcus aureus subsp. aureus MW2
uuuaaauaauaauucauaaaugc

SEQ ID NO: 4021969 - RNA, 22 nt, Staphylococcus aureus subsp. aureus MW2
uuuaaaucaaagaguaaaguua

SEQ ID NO: 4021970 - RNA, 14 nt, Staphylococcus aureus subsp. aureus MW2
uuuaaaucaauauu

SEQ ID NO: 4021971 - RNA, 17 nt, Staphylococcus aureus subsp. aureus MW2
uuuaaaucauuaagaaa

SEQ ID NO: 4021972 - RNA, 15 nt, Staphylococcus aureus subsp. aureus MW2
uuuaaaucauugcgu

SEQ ID NO: 4021973 - RNA, 16 nt, Staphylococcus aureus subsp. aureus MW2
uuuaaaucuauauaaa

SEQ ID NO: 4021974 - RNA, 20 nt, Staphylococcus aureus subsp. aureus MW2
uuuaaaucuguacuucuaau

SEQ ID NO: 4021975 - RNA, 19 nt, Staphylococcus aureus subsp. aureus MW2
uuuaaaucuuguucuaauu

SEQ ID NO: 4021976 - RNA, 18 nt, Staphylococcus aureus subsp. aureus MW2
uuuaaaucuuuuagcuuu

SEQ ID NO: 4021977 - RNA, 19 nt, Staphylococcus aureus subsp. aureus MW2
uuuaaaucuuuuagcuuuu

SEQ ID NO: 4021978 - RNA, 19 nt, Staphylococcus aureus subsp. aureus MW2
uuuaaaugauuucacuuca

SEQ ID NO: 4021979 - RNA, 18 nt, Staphylococcus aureus subsp. aureus MW2
uuuaaaugcgaaguauaa

SEQ ID NO: 4021980 - RNA, 15 nt, Staphylococcus aureus subsp. aureus MW2
uuuaaaugcuuuaaa

SEQ ID NO: 4021981 - RNA, 15 nt, Staphylococcus aureus subsp. aureus MW2
uuuaaauuaaaauaa

SEQ ID NO: 4021982 - RNA, 14 nt, Staphylococcus aureus subsp. aureus MW2
uuuaaauuaacuuu

SEQ ID NO: 4021983 - RNA, 16 nt, Staphylococcus aureus subsp. aureus MW2
uuuaaauuacaauuaa

SEQ ID NO: 4021984 - RNA, 18 nt, Staphylococcus aureus subsp. aureus MW2
uuuaaauuacaauuaauu

SEQ ID NO: 4021985 - RNA, 23 nt, Staphylococcus aureus subsp. aureus MW2
uuuaaauugacuuuaauugcucu

SEQ ID NO: 4021986 - RNA, 22 nt, Staphylococcus aureus subsp. aureus MW2
uuuaaauuggaaucccaaugcu

SEQ ID NO: 4021987 - RNA, 23 nt, Staphylococcus aureus subsp. aureus MW2
uuuaaauuuaacucaacuuaaau

SEQ ID NO: 4021988 - RNA, 13 nt, Staphylococcus aureus subsp. aureus MW2
uuuaaauuuaaga

SEQ ID NO: 4021989 - RNA, 14 nt, Staphylococcus aureus subsp. aureus MW2
uuuaaauuuaagaa

SEQ ID NO: 4021990 - RNA, 15 nt, Staphylococcus aureus subsp. aureus MW2
uuuaaauuuucauca

SEQ ID NO: 4021991 - RNA, 14 nt, Staphylococcus aureus subsp. aureus MW2
uuuaacaaaauaua

SEQ ID NO: 4021992 - RNA, 14 nt, Staphylococcus aureus subsp. aureus MW2
uuuaacaacacuac

SEQ ID NO: 4021993 - RNA, 22 nt, Staphylococcus aureus subsp. aureus MW2
uuuaacaacuguucuaaaauua

SEQ ID NO: 4021994 - RNA, 24 nt, Staphylococcus aureus subsp. aureus MW2
uuuaacaagauaacuagcaaaugc

SEQ ID NO: 4021995 - RNA, 18 nt, Staphylococcus aureus subsp. aureus MW2
uuuaacaagugaugaaaa

SEQ ID NO: 4021996 - RNA, 22 nt, Staphylococcus aureus subsp. aureus MW2
uuuaacaagugaugaaaaagag

SEQ ID NO: 4021997 - RNA, 14 nt, Staphylococcus aureus subsp. aureus MW2
uuuaacaauauaua

SEQ ID NO: 4021998 - RNA, 15 nt, Staphylococcus aureus subsp. aureus MW2
uuuaacaauauauaa

SEQ ID NO: 4021999 - RNA, 19 nt, Staphylococcus aureus subsp. aureus MW2
uuuaacaauuuuaucugaa

SEQ ID NO: 4022000 - RNA, 16 nt, Staphylococcus aureus subsp. aureus MW2
uuuaacacuucaguua

SEQ ID NO: 4022001 - RNA, 19 nt, Staphylococcus aureus subsp. aureus MW2
uuuaacagcgugaauauaa

SEQ ID NO: 4022002 - RNA, 23 nt, Staphylococcus aureus subsp. aureus MW2
uuuaacauauagauaucuguaua

SEQ ID NO: 4022003 - RNA, 15 nt, Staphylococcus aureus subsp. aureus MW2
uuuaacgaaaauuaa

SEQ ID NO: 4022004 - RNA, 18 nt, Staphylococcus aureus subsp. aureus MW2
uuuaacguuauucauuug

SEQ ID NO: 4022005 - RNA, 17 nt, Staphylococcus aureus subsp. aureus MW2
uuuaacugggcaacuuu

SEQ ID NO: 4022006 - RNA, 19 nt, Staphylococcus aureus subsp. aureus MW2
uuuaacugggcaacuuuuu

SEQ ID NO: 4022007 - RNA, 17 nt, Staphylococcus aureus subsp. aureus MW2
uuuaacuucuuuuguuu

SEQ ID NO: 4022008 - RNA, 23 nt, Staphylococcus aureus subsp. aureus MW2
uuuaacuuuaauuaaagcaucuu

SEQ ID NO: 4022009 - RNA, 18 nt, Staphylococcus aureus subsp. aureus MW2
uuuaagaagucgaauuca

SEQ ID NO: 4022010 - RNA, 18 nt, Staphylococcus aureus subsp. aureus MW2
uuuaagacuauaaugaau

SEQ ID NO: 4022011 - RNA, 18 nt, Staphylococcus aureus subsp. aureus MW2
uuuaagauagguuuauuu

SEQ ID NO: 4022012 - RNA, 14 nt, Staphylococcus aureus subsp. aureus MW2
uuuaagaucaauau

SEQ ID NO: 4022013 - RNA, 13 nt, Staphylococcus aureus subsp. aureus MW2
uuuaagcugcucg

SEQ ID NO: 4022014 - RNA, 15 nt, Staphylococcus aureus subsp. aureus MW2
uuuaagcuuaucaac

SEQ ID NO: 4022015 - RNA, 20 nt, Staphylococcus aureus subsp. aureus MW2
uuuaaguaauucauuugcuu

SEQ ID NO: 4022016 - RNA, 19 nt, Staphylococcus aureus subsp. aureus MW2
uuuaagugaugaccaauau

SEQ ID NO: 4022017 - RNA, 14 nt, Staphylococcus aureus subsp. aureus MW2
uuuaaguuuauaau

SEQ ID NO: 4022018 - RNA, 19 nt, Staphylococcus aureus subsp. aureus MW2
uuuaaguuuauaaucaguu

SEQ ID NO: 4022019 - RNA, 17 nt, Staphylococcus aureus subsp. aureus MW2
uuuaauaaaaucaucuu

SEQ ID NO: 4022020 - RNA, 18 nt, Staphylococcus aureus subsp. aureus MW2
uuuaauaaacaccaauau

SEQ ID NO: 4022021 - RNA, 21 nt, Staphylococcus aureus subsp. aureus MW2
uuuaauaaacaccaauauuuc

SEQ ID NO: 4022022 - RNA, 23 nt, Staphylococcus aureus subsp. aureus MW2
uuuaauaaacaccaauauuucug

SEQ ID NO: 4022023 - RNA, 16 nt, Staphylococcus aureus subsp. aureus MW2
uuuaauaaaucguguu

SEQ ID NO: 4022024 - RNA, 17 nt, Staphylococcus aureus subsp. aureus MW2
uuuaauaacaaaauuaa

SEQ ID NO: 4022025 - RNA, 19 nt, Staphylococcus aureus subsp. aureus MW2
uuuaauaaccuuuaaaaca

SEQ ID NO: 4022026 - RNA, 21 nt, Staphylococcus aureus subsp. aureus MW2
uuuaauaaccuuuaaaacauc

SEQ ID NO: 4022027 - RNA, 14 nt, Staphylococcus aureus subsp. aureus MW2
uuuaauaauacauu

SEQ ID NO: 4022028 - RNA, 21 nt, Staphylococcus aureus subsp. aureus MW2
uuuaauaauguaucauuucag

SEQ ID NO: 4022029 - RNA, 14 nt, Staphylococcus aureus subsp. aureus MW2
uuuaauagcuuguu

SEQ ID NO: 4022030 - RNA, 19 nt, Staphylococcus aureus subsp. aureus MW2
uuuaauagguucuucuuuc

SEQ ID NO: 4022031 - RNA, 12 nt, Staphylococcus aureus subsp. aureus MW2
uuuaauauauuu

SEQ ID NO: 4022032 - RNA, 21 nt, Staphylococcus aureus subsp. aureus MW2
uuuaauauugaaaugagcuua

SEQ ID NO: 4022033 - RNA, 15 nt, Staphylococcus aureus subsp. aureus MW2
uuuaauauuuucuua

SEQ ID NO: 4022034 - RNA, 16 nt, Staphylococcus aureus subsp. aureus MW2
uuuaauauuuuuauca

SEQ ID NO: 4022035 - RNA, 18 nt, Staphylococcus aureus subsp. aureus MW2
uuuaauauuuuuaucauc

SEQ ID NO: 4022036 - RNA, 14 nt, Staphylococcus aureus subsp. aureus MW2
uuuaauauuuuuuu

SEQ ID NO: 4022037 - RNA, 16 nt, Staphylococcus aureus subsp. aureus MW2
uuuaauauuuuuuuca

SEQ ID NO: 4022038 - RNA, 14 nt, Staphylococcus aureus subsp. aureus MW2
uuuaaucacaucuu

SEQ ID NO: 4022039 - RNA, 13 nt, Staphylococcus aureus subsp. aureus MW2
uuuaaucauuguu

SEQ ID NO: 4022040 - RNA, 20 nt, Staphylococcus aureus subsp. aureus MW2
uuuaaucauuguuuuaaauu

SEQ ID NO: 4022041 - RNA, 21 nt, Staphylococcus aureus subsp. aureus MW2
uuuaaucguauuagccaauaa

SEQ ID NO: 4022042 - RNA, 18 nt, Staphylococcus aureus subsp. aureus MW2
uuuaaucuuauucgcacc

SEQ ID NO: 4022043 - RNA, 20 nt, Staphylococcus aureus subsp. aureus MW2
uuuaaugauuuuucaucaau

SEQ ID NO: 4022044 - RNA, 17 nt, Staphylococcus aureus subsp. aureus MW2
uuuaaugggauuucuac

SEQ ID NO: 4022045 - RNA, 17 nt, Staphylococcus aureus subsp. aureus MW2
uuuaauguuaaacaaua

SEQ ID NO: 4022046 - RNA, 11 nt, Staphylococcus aureus subsp. aureus MW2
uuuaauguuau

SEQ ID NO: 4022047 - RNA, 14 nt, Staphylococcus aureus subsp. aureus MW2
uuuaauguuucaaa

SEQ ID NO: 4022048 - RNA, 14 nt, Staphylococcus aureus subsp. aureus MW2
uuuaauguuugcuu

SEQ ID NO: 4022049 - RNA, 13 nt, Staphylococcus aureus subsp. aureus MW2
uuuaauuaaagca

SEQ ID NO: 4022050 - RNA, 14 nt, Staphylococcus aureus subsp. aureus MW2
uuuaauuaaaguua

SEQ ID NO: 4022051 - RNA, 17 nt, Staphylococcus aureus subsp. aureus MW2
uuuaauuaauuaucaua

SEQ ID NO: 4022052 - RNA, 21 nt, Staphylococcus aureus subsp. aureus MW2
uuuaauuaauuaucauaaaua

SEQ ID NO: 4022053 - RNA, 15 nt, Staphylococcus aureus subsp. aureus MW2
uuuaauuauuucccu

SEQ ID NO: 4022054 - RNA, 21 nt, Staphylococcus aureus subsp. aureus MW2
uuuaauuauuucccuggaaaa

SEQ ID NO: 4022055 - RNA, 14 nt, Staphylococcus aureus subsp. aureus MW2
uuuaauuccaaaga

SEQ ID NO: 4022056 - RNA, 21 nt, Staphylococcus aureus subsp. aureus MW2
uuuaauuccaaagaaagcuaa

SEQ ID NO: 4022057 - RNA, 17 nt, Staphylococcus aureus subsp. aureus MW2
uuuaauugggucuuuau

SEQ ID NO: 4022058 - RNA, 21 nt, Staphylococcus aureus subsp. aureus MW2
uuuaauugguuucacauuguc

SEQ ID NO: 4022059 - RNA, 13 nt, Staphylococcus aureus subsp. aureus MW2
uuuaauuguuuaa

SEQ ID NO: 4022060 - RNA, 18 nt, Staphylococcus aureus subsp. aureus MW2
uuuaauuuaguacucaau

SEQ ID NO: 4022061 - RNA, 21 nt, Staphylococcus aureus subsp. aureus MW2
uuuaauuuaguuauaauuucu

SEQ ID NO: 4022062 - RNA, 14 nt, Staphylococcus aureus subsp. aureus MW2
uuuaauuucacuuu

SEQ ID NO: 4022063 - RNA, 21 nt, Staphylococcus aureus subsp. aureus MW2
uuuaauuuucuaaagauauaa

SEQ ID NO: 4022064 - RNA, 19 nt, Staphylococcus aureus subsp. aureus MW2
uuuaauuuugacauaaaaa

SEQ ID NO: 4022065 - RNA, 20 nt, Staphylococcus aureus subsp. aureus MW2
uuuacaaaaacuauuuuuua

SEQ ID NO: 4022066 - RNA, 17 nt, Staphylococcus aureus subsp. aureus MW2
uuuacaaacuucacauu

SEQ ID NO: 4022067 - RNA, 22 nt, Staphylococcus aureus subsp. aureus MW2
uuuacaaucaucacacauaaau

SEQ ID NO: 4022068 - RNA, 19 nt, Staphylococcus aureus subsp. aureus MW2
uuuacaauccuaaaauacu

SEQ ID NO: 4022069 - RNA, 22 nt, Staphylococcus aureus subsp. aureus MW2
uuuacaauccuaaaauacuguu

SEQ ID NO: 4022070 - RNA, 14 nt, Staphylococcus aureus subsp. aureus MW2
uuuacaauuuuugg

SEQ ID NO: 4022071 - RNA, 19 nt, Staphylococcus aureus subsp. aureus MW2
uuuacacgucuaauuuuaa

SEQ ID NO: 4022072 - RNA, 19 nt, Staphylococcus aureus subsp. aureus MW2
uuuacagaacguucauaua

SEQ ID NO: 4022073 - RNA, 18 nt, Staphylococcus aureus subsp. aureus MW2
uuuacauauugugguaaa

SEQ ID NO: 4022074 - RNA, 23 nt, Staphylococcus aureus subsp. aureus MW2
uuuacauggcuuagguuuaauuu

SEQ ID NO: 4022075 - RNA, 14 nt, Staphylococcus aureus subsp. aureus MW2
uuuacauucguuua

SEQ ID NO: 4022076 - RNA, 17 nt, Staphylococcus aureus subsp. aureus MW2
uuuaccaauaucaugca

SEQ ID NO: 4022077 - RNA, 12 nt, Staphylococcus aureus subsp. aureus MW2
uuuaccacuuau

SEQ ID NO: 4022078 - RNA, 16 nt, Staphylococcus aureus subsp. aureus MW2
uuuaccgugaauauaa

SEQ ID NO: 4022079 - RNA, 20 nt, Staphylococcus aureus subsp. aureus MW2
uuuaccucuugauaaaauaa

SEQ ID NO: 4022080 - RNA, 15 nt, Staphylococcus aureus subsp. aureus MW2
uuuacgcuuacuuau

SEQ ID NO: 4022081 - RNA, 17 nt, Staphylococcus aureus subsp. aureus MW2
uuuacggauuuuucuca

SEQ ID NO: 4022082 - RNA, 21 nt, Staphylococcus aureus subsp. aureus MW2
uuuacggggugcuuuuuaugu

SEQ ID NO: 4022083 - RNA, 16 nt, Staphylococcus aureus subsp. aureus MW2
uuuacguucugauuca

SEQ ID NO: 4022084 - RNA, 14 nt, Staphylococcus aureus subsp. aureus MW2
uuuacuaaaugaau

SEQ ID NO: 4022085 - RNA, 21 nt, Staphylococcus aureus subsp. aureus MW2
uuuacuacaucauaaacgaaa

SEQ ID NO: 4022086 - RNA, 22 nt, Staphylococcus aureus subsp. aureus MW2
uuuacuaggaauauaaaacugu

SEQ ID NO: 4022087 - RNA, 17 nt, Staphylococcus aureus subsp. aureus MW2
uuuacuauauucaauga

SEQ ID NO: 4022088 - RNA, 14 nt, Staphylococcus aureus subsp. aureus MW2
uuuacucuaaagga

SEQ ID NO: 4022089 - RNA, 16 nt, Staphylococcus aureus subsp. aureus MW2
uuuacucuacacucaa

SEQ ID NO: 4022090 - RNA, 17 nt, Staphylococcus aureus subsp. aureus MW2
uuuacuuacuuuucuaa

SEQ ID NO: 4022091 - RNA, 13 nt, Staphylococcus aureus subsp. aureus MW2
uuuacuucauaag

SEQ ID NO: 4022092 - RNA, 14 nt, Staphylococcus aureus subsp. aureus MW2
uuuacuuuguaauu

SEQ ID NO: 4022093 - RNA, 18 nt, Staphylococcus aureus subsp. aureus MW2
uuuagaaaaggauuauag

SEQ ID NO: 4022094 - RNA, 18 nt, Staphylococcus aureus subsp. aureus MW2
uuuagaaagaauacaguu

SEQ ID NO: 4022095 - RNA, 14 nt, Staphylococcus aureus subsp. aureus MW2
uuuagacauaaaaa

SEQ ID NO: 4022096 - RNA, 19 nt, Staphylococcus aureus subsp. aureus MW2
uuuagacuuuauuuuucca

SEQ ID NO: 4022097 - RNA, 22 nt, Staphylococcus aureus subsp. aureus MW2
uuuagagauuguaagaauuaau

SEQ ID NO: 4022098 - RNA, 19 nt, Staphylococcus aureus subsp. aureus MW2
uuuagagccccuuacaacu

SEQ ID NO: 4022099 - RNA, 19 nt, Staphylococcus aureus subsp. aureus MW2
uuuagauaaaaaauacuaa

SEQ ID NO: 4022100 - RNA, 17 nt, Staphylococcus aureus subsp. aureus MW2
uuuagauucuuuucuga

SEQ ID NO: 4022101 - RNA, 22 nt, Staphylococcus aureus subsp. aureus MW2
uuuagcauacauuaagcuaugc

SEQ ID NO: 4022102 - RNA, 17 nt, Staphylococcus aureus subsp. aureus MW2
uuuagcgucauuuuuaa

SEQ ID NO: 4022103 - RNA, 19 nt, Staphylococcus aureus subsp. aureus MW2
uuuagcuauuuaaaauuau

SEQ ID NO: 4022104 - RNA, 22 nt, Staphylococcus aureus subsp. aureus MW2
uuuaggaaugaauaaagcuaac

SEQ ID NO: 4022105 - RNA, 19 nt, Staphylococcus aureus subsp. aureus MW2
uuuaguacauauguuguuu

SEQ ID NO: 4022106 - RNA, 15 nt, Staphylococcus aureus subsp. aureus MW2
uuuaguauaaauaaa

SEQ ID NO: 4022107 - RNA, 21 nt, Staphylococcus aureus subsp. aureus MW2
uuuaguaucuauacaauuaug

SEQ ID NO: 4022108 - RNA, 18 nt, Staphylococcus aureus subsp. aureus MW2
uuuaguaucucauuuuuu

SEQ ID NO: 4022109 - RNA, 21 nt, Staphylococcus aureus subsp. aureus MW2
uuuaguauguuuuauuuucuu

SEQ ID NO: 4022110 - RNA, 19 nt, Staphylococcus aureus subsp. aureus MW2
uuuagucauuacaaaucau

SEQ ID NO: 4022111 - RNA, 15 nt, Staphylococcus aureus subsp. aureus MW2
uuuagugaaaauacc

SEQ ID NO: 4022112 - RNA, 14 nt, Staphylococcus aureus subsp. aureus MW2
uuuagugacaaaca

SEQ ID NO: 4022113 - RNA, 14 nt, Staphylococcus aureus subsp. aureus MW2
uuuaguuaaaguga

SEQ ID NO: 4022114 - RNA, 13 nt, Staphylococcus aureus subsp. aureus MW2
uuuaguuaaauag

SEQ ID NO: 4022115 - RNA, 15 nt, Staphylococcus aureus subsp. aureus MW2
uuuaguuaaauagua

SEQ ID NO: 4022116 - RNA, 22 nt, Staphylococcus aureus subsp. aureus MW2
uuuaguuagcccuauucaacua

SEQ ID NO: 4022117 - RNA, 17 nt, Staphylococcus aureus subsp. aureus MW2
uuuaguucacaauuucg

SEQ ID NO: 4022118 - RNA, 21 nt, Staphylococcus aureus subsp. aureus MW2
uuuaguucacaauuucguguu

SEQ ID NO: 4022119 - RNA, 21 nt, Staphylococcus aureus subsp. aureus MW2
uuuaguucacaugaauuuuaa

SEQ ID NO: 4022120 - RNA, 13 nt, Staphylococcus aureus subsp. aureus MW2
uuuauaaaaagag

SEQ ID NO: 4022121 - RNA, 15 nt, Staphylococcus aureus subsp. aureus MW2
uuuauaaaaaguuau

SEQ ID NO: 4022122 - RNA, 14 nt, Staphylococcus aureus subsp. aureus MW2
uuuauaaaauugua

SEQ ID NO: 4022123 - RNA, 13 nt, Staphylococcus aureus subsp. aureus MW2
uuuauaaacaauu

SEQ ID NO: 4022124 - RNA, 16 nt, Staphylococcus aureus subsp. aureus MW2
uuuauaaauaaacaua

SEQ ID NO: 4022125 - RNA, 20 nt, Staphylococcus aureus subsp. aureus MW2
uuuauaaauaaacauaaaaa

SEQ ID NO: 4022126 - RNA, 23 nt, Staphylococcus aureus subsp. aureus MW2
uuuauaaaugaauuauuuaaaau

SEQ ID NO: 4022127 - RNA, 15 nt, Staphylococcus aureus subsp. aureus MW2
uuuauaaauuaaaug

SEQ ID NO: 4022128 - RNA, 21 nt, Staphylococcus aureus subsp. aureus MW2
uuuauaaauuaaaugcaauac

SEQ ID NO: 4022129 - RNA, 12 nt, Staphylococcus aureus subsp. aureus MW2
uuuauaaguauu

SEQ ID NO: 4022130 - RNA, 15 nt, Staphylococcus aureus subsp. aureus MW2
uuuauaauaaauguc

SEQ ID NO: 4022131 - RNA, 21 nt, Staphylococcus aureus subsp. aureus MW2
uuuauaauaaccuacauuaau

SEQ ID NO: 4022132 - RNA, 16 nt, Staphylococcus aureus subsp. aureus MW2
uuuauaauucuaaguc

SEQ ID NO: 4022133 - RNA, 16 nt, Staphylococcus aureus subsp. aureus MW2
uuuauaauuggaauaa

SEQ ID NO: 4022134 - RNA, 12 nt, Staphylococcus aureus subsp. aureus MW2
uuuauaauuucu

SEQ ID NO: 4022135 - RNA, 16 nt, Staphylococcus aureus subsp. aureus MW2
uuuauaauuucuaaau

SEQ ID NO: 4022136 - RNA, 19 nt, Staphylococcus aureus subsp. aureus MW2
uuuauaauuucuaaaucua

SEQ ID NO: 4022137 - RNA, 17 nt, Staphylococcus aureus subsp. aureus MW2
uuuauacaauuuuuugg

SEQ ID NO: 4022138 - RNA, 22 nt, Staphylococcus aureus subsp. aureus MW2
uuuauacagugaaucuaaacua

SEQ ID NO: 4022139 - RNA, 18 nt, Staphylococcus aureus subsp. aureus MW2
uuuauacauguacauuau

SEQ ID NO: 4022140 - RNA, 16 nt, Staphylococcus aureus subsp. aureus MW2
uuuauacauuaacgau

SEQ ID NO: 4022141 - RNA, 13 nt, Staphylococcus aureus subsp. aureus MW2
uuuauacuuaaua

SEQ ID NO: 4022142 - RNA, 18 nt, Staphylococcus aureus subsp. aureus MW2
uuuauagauuuuaauaaa

SEQ ID NO: 4022143 - RNA, 21 nt, Staphylococcus aureus subsp. aureus MW2
uuuauagccgccuuuuaacau

SEQ ID NO: 4022144 - RNA, 17 nt, Staphylococcus aureus subsp. aureus MW2
uuuauauauagaaauaa

SEQ ID NO: 4022145 - RNA, 19 nt, Staphylococcus aureus subsp. aureus MW2
uuuauauuccauuucaaau

SEQ ID NO: 4022146 - RNA, 18 nt, Staphylococcus aureus subsp. aureus MW2
uuuauauuuaaacucucu

SEQ ID NO: 4022147 - RNA, 14 nt, Staphylococcus aureus subsp. aureus MW2
uuuauauuuaucag

SEQ ID NO: 4022148 - RNA, 16 nt, Staphylococcus aureus subsp. aureus MW2
uuuauauuuauuuuau

SEQ ID NO: 4022149 - RNA, 15 nt, Staphylococcus aureus subsp. aureus MW2
uuuauauuuuaagau

SEQ ID NO: 4022150 - RNA, 16 nt, Staphylococcus aureus subsp. aureus MW2
uuuauauuuuaagaua

SEQ ID NO: 4022151 - RNA, 23 nt, Staphylococcus aureus subsp. aureus MW2
uuuauauuuuaguucacaugaau

SEQ ID NO: 4022152 - RNA, 13 nt, Staphylococcus aureus subsp. aureus MW2
uuuauauuuuuau

SEQ ID NO: 4022153 - RNA, 16 nt, Staphylococcus aureus subsp. aureus MW2
uuuaucaacaaauuuu

SEQ ID NO: 4022154 - RNA, 12 nt, Staphylococcus aureus subsp. aureus MW2
uuuaucaauauu

SEQ ID NO: 4022155 - RNA, 14 nt, Staphylococcus aureus subsp. aureus MW2
uuuaucaauuucua

SEQ ID NO: 4022156 - RNA, 15 nt, Staphylococcus aureus subsp. aureus MW2
uuuaucaauuucuau

SEQ ID NO: 4022157 - RNA, 18 nt, Staphylococcus aureus subsp. aureus MW2
uuuaucaccauaaaaaua

SEQ ID NO: 4022158 - RNA, 22 nt, Staphylococcus aureus subsp. aureus MW2
uuuaucaguuagcuuauuuaga

SEQ ID NO: 4022159 - RNA, 13 nt, Staphylococcus aureus subsp. aureus MW2
uuuaucauaacaa

SEQ ID NO: 4022160 - RNA, 14 nt, Staphylococcus aureus subsp. aureus MW2
uuuaucaugucuga

SEQ ID NO: 4022161 - RNA, 13 nt, Staphylococcus aureus subsp. aureus MW2
uuuaucauuauuu

SEQ ID NO: 4022162 - RNA, 17 nt, Staphylococcus aureus subsp. aureus MW2
uuuaucauuauuugaua

SEQ ID NO: 4022163 - RNA, 19 nt, Staphylococcus aureus subsp. aureus MW2
uuuauccaaaccaauuuua

SEQ ID NO: 4022164 - RNA, 22 nt, Staphylococcus aureus subsp. aureus MW2
uuuauccaagucuaaaugcaau

SEQ ID NO: 4022165 - RNA, 18 nt, Staphylococcus aureus subsp. aureus MW2
uuuauccgucgaauauaa

SEQ ID NO: 4022166 - RNA, 18 nt, Staphylococcus aureus subsp. aureus MW2
uuuaucgaucgguauuuu

SEQ ID NO: 4022167 - RNA, 22 nt, Staphylococcus aureus subsp. aureus MW2
uuuaucuacaguuuuaugaaua

SEQ ID NO: 4022168 - RNA, 19 nt, Staphylococcus aureus subsp. aureus MW2
uuuaucuacauuaaagaaa

SEQ ID NO: 4022169 - RNA, 15 nt, Staphylococcus aureus subsp. aureus MW2
uuuaucuaguuguuu

SEQ ID NO: 4022170 - RNA, 15 nt, Staphylococcus aureus subsp. aureus MW2
uuuaucuauuucuau

SEQ ID NO: 4022171 - RNA, 17 nt, Staphylococcus aureus subsp. aureus MW2
uuuaucugaaaauauca

SEQ ID NO: 4022172 - RNA, 12 nt, Staphylococcus aureus subsp. aureus MW2
uuuaucuguauc

SEQ ID NO: 4022173 - RNA, 16 nt, Staphylococcus aureus subsp. aureus MW2
uuuaugacaaaguucu

SEQ ID NO: 4022174 - RNA, 20 nt, Staphylococcus aureus subsp. aureus MW2
uuuaugacaaaguucugcaa

SEQ ID NO: 4022175 - RNA, 22 nt, Staphylococcus aureus subsp. aureus MW2
uuuaugagcuucuuuaaauaca

SEQ ID NO: 4022176 - RNA, 20 nt, Staphylococcus aureus subsp. aureus MW2
uuuaugauaauaagaauauu

SEQ ID NO: 4022177 - RNA, 21 nt, Staphylococcus aureus subsp. aureus MW2
uuuauggucuugaguacuaau

SEQ ID NO: 4022178 - RNA, 13 nt, Staphylococcus aureus subsp. aureus MW2
uuuaugguguggu

SEQ ID NO: 4022179 - RNA, 22 nt, Staphylococcus aureus subsp. aureus MW2
uuuauguauaucuuuauuuuuu

SEQ ID NO: 4022180 - RNA, 19 nt, Staphylococcus aureus subsp. aureus MW2
uuuaugugguuuugauuaa

SEQ ID NO: 4022181 - RNA, 17 nt, Staphylococcus aureus subsp. aureus MW2
uuuauguuuuaauuucu

SEQ ID NO: 4022182 - RNA, 18 nt, Staphylococcus aureus subsp. aureus MW2
uuuauguuuuaauuucuu

SEQ ID NO: 4022183 - RNA, 12 nt, Staphylococcus aureus subsp. aureus MW2
uuuauuaaauaa

SEQ ID NO: 4022184 - RNA, 21 nt, Staphylococcus aureus subsp. aureus MW2
uuuauuaaaucguauauuaaa

SEQ ID NO: 4022185 - RNA, 16 nt, Staphylococcus aureus subsp. aureus MW2
uuuauuaaguauaucu

SEQ ID NO: 4022186 - RNA, 18 nt, Staphylococcus aureus subsp. aureus MW2
uuuauuaauaaauucucu

SEQ ID NO: 4022187 - RNA, 16 nt, Staphylococcus aureus subsp. aureus MW2
uuuauuaauucugauu

SEQ ID NO: 4022188 - RNA, 14 nt, Staphylococcus aureus subsp. aureus MW2
uuuauuagaaugaa

SEQ ID NO: 4022189 - RNA, 24 nt, Staphylococcus aureus subsp. aureus MW2
uuuauuagcuagcaugagcgcaua

SEQ ID NO: 4022190 - RNA, 19 nt, Staphylococcus aureus subsp. aureus MW2
uuuauuaguauucaaaaaa

SEQ ID NO: 4022191 - RNA, 15 nt, Staphylococcus aureus subsp. aureus MW2
uuuauuauaaaauag

SEQ ID NO: 4022192 - RNA, 12 nt, Staphylococcus aureus subsp. aureus MW2
uuuauuaucagu

SEQ ID NO: 4022193 - RNA, 15 nt, Staphylococcus aureus subsp. aureus MW2
uuuauucaaaucaua

SEQ ID NO: 4022194 - RNA, 16 nt, Staphylococcus aureus subsp. aureus MW2
uuuauucuaaguuaaa

SEQ ID NO: 4022195 - RNA, 14 nt, Staphylococcus aureus subsp. aureus MW2
uuuauucuucaguu

SEQ ID NO: 4022196 - RNA, 12 nt, Staphylococcus aureus subsp. aureus MW2
uuuauuucuaua

SEQ ID NO: 4022197 - RNA, 16 nt, Staphylococcus aureus subsp. aureus MW2
uuuauuuuaaauuuaa

SEQ ID NO: 4022198 - RNA, 16 nt, Staphylococcus aureus subsp. aureus MW2
uuuauuuuaauauuuu

SEQ ID NO: 4022199 - RNA, 13 nt, Staphylococcus aureus subsp. aureus MW2
uuuauuuugauua

SEQ ID NO: 4022200 - RNA, 21 nt, Staphylococcus aureus subsp. aureus MW2
uuuauuuuugaaaaaaauuuu

SEQ ID NO: 4022201 - RNA, 11 nt, Staphylococcus aureus subsp. aureus MW2
uuuauuuuugg

SEQ ID NO: 4022202 - RNA, 23 nt, Staphylococcus aureus subsp. aureus MW2
uuucaaaaaaagcugauuucuau

SEQ ID NO: 4022203 - RNA, 18 nt, Staphylococcus aureus subsp. aureus MW2
uuucaaaaaggaauucua

SEQ ID NO: 4022204 - RNA, 23 nt, Staphylococcus aureus subsp. aureus MW2
uuucaaaaaggaauucuacagaa

SEQ ID NO: 4022205 - RNA, 23 nt, Staphylococcus aureus subsp. aureus MW2
uuucaaaaauuguuaaucccguu

SEQ ID NO: 4022206 - RNA, 24 nt, Staphylococcus aureus subsp. aureus MW2
uuucaaaacuagcaguaauauguu

SEQ ID NO: 4022207 - RNA, 17 nt, Staphylococcus aureus subsp. aureus MW2
uuucaaagauacaccaa

SEQ ID NO: 4022208 - RNA, 20 nt, Staphylococcus aureus subsp. aureus MW2
uuucaaagauacaccaauau

SEQ ID NO: 4022209 - RNA, 15 nt, Staphylococcus aureus subsp. aureus MW2
uuucaacauaauauu

SEQ ID NO: 4022210 - RNA, 13 nt, Staphylococcus aureus subsp. aureus MW2
uuucaacauuacu

SEQ ID NO: 4022211 - RNA, 15 nt, Staphylococcus aureus subsp. aureus MW2
uuucaacauuuuuua

SEQ ID NO: 4022212 - RNA, 17 nt, Staphylococcus aureus subsp. aureus MW2
uuucaaguuuaaaauac

SEQ ID NO: 4022213 - RNA, 19 nt, Staphylococcus aureus subsp. aureus MW2
uuucaaguuuaaaauacga

SEQ ID NO: 4022214 - RNA, 13 nt, Staphylococcus aureus subsp. aureus MW2
uuucaauaaauuu

SEQ ID NO: 4022215 - RNA, 18 nt, Staphylococcus aureus subsp. aureus MW2
uuucaaugcauauucuau

SEQ ID NO: 4022216 - RNA, 12 nt, Staphylococcus aureus subsp. aureus MW2
uuucaauugcac

SEQ ID NO: 4022217 - RNA, 20 nt, Staphylococcus aureus subsp. aureus MW2
uuucaauugcaugucuuaaa

SEQ ID NO: 4022218 - RNA, 17 nt, Staphylococcus aureus subsp. aureus MW2
uuucacaaauucuuuua

SEQ ID NO: 4022219 - RNA, 15 nt, Staphylococcus aureus subsp. aureus MW2
uuucacaauuguaua

SEQ ID NO: 4022220 - RNA, 16 nt, Staphylococcus aureus subsp. aureus MW2
uuucacauugucuaca

SEQ ID NO: 4022221 - RNA, 21 nt, Staphylococcus aureus subsp. aureus MW2
uuucacgaauaucuuaaagaa

SEQ ID NO: 4022222 - RNA, 18 nt, Staphylococcus aureus subsp. aureus MW2
uuucacuuuaacuucuuu

SEQ ID NO: 4022223 - RNA, 22 nt, Staphylococcus aureus subsp. aureus MW2
uuucagacuguggacaaacuga

SEQ ID NO: 4022224 - RNA, 16 nt, Staphylococcus aureus subsp. aureus MW2
uuucagcaguugcaca

SEQ ID NO: 4022225 - RNA, 21 nt, Staphylococcus aureus subsp. aureus MW2
uuucagcaucgggaucuaauu

SEQ ID NO: 4022226 - RNA, 19 nt, Staphylococcus aureus subsp. aureus MW2
uuucagcgauaacguacaa

SEQ ID NO: 4022227 - RNA, 19 nt, Staphylococcus aureus subsp. aureus MW2
uuucaggcuuuguuuuuca

SEQ ID NO: 4022228 - RNA, 15 nt, Staphylococcus aureus subsp. aureus MW2
uuucaguauacucau

SEQ ID NO: 4022229 - RNA, 17 nt, Staphylococcus aureus subsp. aureus MW2
uuucauaaacucuuaua

SEQ ID NO: 4022230 - RNA, 22 nt, Staphylococcus aureus subsp. aureus MW2
uuucauaguuauuaaaucuuuu

SEQ ID NO: 4022231 - RNA, 19 nt, Staphylococcus aureus subsp. aureus MW2
uuucauauaaauagcuucu

SEQ ID NO: 4022232 - RNA, 19 nt, Staphylococcus aureus subsp. aureus MW2
uuucauaugcaucaacaga

SEQ ID NO: 4022233 - RNA, 16 nt, Staphylococcus aureus subsp. aureus MW2
uuucauauggugaacu

SEQ ID NO: 4022234 - RNA, 19 nt, Staphylococcus aureus subsp. aureus MW2
uuucauauucacaucuuua

SEQ ID NO: 4022235 - RNA, 16 nt, Staphylococcus aureus subsp. aureus MW2
uuucaucaaauucaaa

SEQ ID NO: 4022236 - RNA, 21 nt, Staphylococcus aureus subsp. aureus MW2
uuucaucaaauucucauucau

SEQ ID NO: 4022237 - RNA, 13 nt, Staphylococcus aureus subsp. aureus MW2
uuucaucaauauc

SEQ ID NO: 4022238 - RNA, 20 nt, Staphylococcus aureus subsp. aureus MW2
uuucaucauuaaaccgugag

SEQ ID NO: 4022239 - RNA, 15 nt, Staphylococcus aureus subsp. aureus MW2
uuucaucauuaguuu

SEQ ID NO: 4022240 - RNA, 19 nt, Staphylococcus aureus subsp. aureus MW2
uuucaucgaagauguuaaa

SEQ ID NO: 4022241 - RNA, 16 nt, Staphylococcus aureus subsp. aureus MW2
uuucaucguucauaua

SEQ ID NO: 4022242 - RNA, 11 nt, Staphylococcus aureus subsp. aureus MW2
uuucaucuuuc

SEQ ID NO: 4022243 - RNA, 18 nt, Staphylococcus aureus subsp. aureus MW2
uuucaucuuucaaaugcu

SEQ ID NO: 4022244 - RNA, 14 nt, Staphylococcus aureus subsp. aureus MW2
uuucaucuuuuuca

SEQ ID NO: 4022245 - RNA, 21 nt, Staphylococcus aureus subsp. aureus MW2
uuucaucuuuuucacuaauca

SEQ ID NO: 4022246 - RNA, 15 nt, Staphylococcus aureus subsp. aureus MW2
uuucaugauuuacua

SEQ ID NO: 4022247 - RNA, 16 nt, Staphylococcus aureus subsp. aureus MW2
uuucaugugcauuuug

SEQ ID NO: 4022248 - RNA, 21 nt, Staphylococcus aureus subsp. aureus MW2
uuucaugugucauaauccauu

SEQ ID NO: 4022249 - RNA, 15 nt, Staphylococcus aureus subsp. aureus MW2
uuucauuaauuuuuu

SEQ ID NO: 4022250 - RNA, 22 nt, Staphylococcus aureus subsp. aureus MW2
uuucauuaucaacuuuauaacc

SEQ ID NO: 4022251 - RNA, 22 nt, Staphylococcus aureus subsp. aureus MW2
uuucauuggauagguaacuaaa

SEQ ID NO: 4022252 - RNA, 21 nt, Staphylococcus aureus subsp. aureus MW2
uuucauuuaacccuucuccaa

SEQ ID NO: 4022253 - RNA, 13 nt, Staphylococcus aureus subsp. aureus MW2
uuucauuuuuuca

SEQ ID NO: 4022254 - RNA, 14 nt, Staphylococcus aureus subsp. aureus MW2
uuuccaacuucuuu

SEQ ID NO: 4022255 - RNA, 13 nt, Staphylococcus aureus subsp. aureus MW2
uuuccaauaucuu

SEQ ID NO: 4022256 - RNA, 15 nt, Staphylococcus aureus subsp. aureus MW2
uuuccaauaucuucu

SEQ ID NO: 4022257 - RNA, 12 nt, Staphylococcus aureus subsp. aureus MW2
uuuccaauccau

SEQ ID NO: 4022258 - RNA, 13 nt, Staphylococcus aureus subsp. aureus MW2
uuuccaauccauu

SEQ ID NO: 4022259 - RNA, 22 nt, Staphylococcus aureus subsp. aureus MW2
uuuccacagcaauucacuuaua

SEQ ID NO: 4022260 - RNA, 18 nt, Staphylococcus aureus subsp. aureus MW2
uuuccaguccauuuuuua

SEQ ID NO: 4022261 - RNA, 19 nt, Staphylococcus aureus subsp. aureus MW2
uuuccauaaauaaaaugcu

SEQ ID NO: 4022262 - RNA, 13 nt, Staphylococcus aureus subsp. aureus MW2
uuuccaugaauaa

SEQ ID NO: 4022263 - RNA, 15 nt, Staphylococcus aureus subsp. aureus MW2
uuuccauuaugauua

SEQ ID NO: 4022264 - RNA, 23 nt, Staphylococcus aureus subsp. aureus MW2
uuucccuacugcuugugugaaau

SEQ ID NO: 4022265 - RNA, 16 nt, Staphylococcus aureus subsp. aureus MW2
uuuccgaauaaagguc

SEQ ID NO: 4022266 - RNA, 16 nt, Staphylococcus aureus subsp. aureus MW2
uuuccgccagcuucua

SEQ ID NO: 4022267 - RNA, 16 nt, Staphylococcus aureus subsp. aureus MW2
uuuccgccagcuucuu

SEQ ID NO: 4022268 - RNA, 18 nt, Staphylococcus aureus subsp. aureus MW2
uuuccuacacuguuuuau

SEQ ID NO: 4022269 - RNA, 11 nt, Staphylococcus aureus subsp. aureus MW2
uuuccucuuua

SEQ ID NO: 4022270 - RNA, 23 nt, Staphylococcus aureus subsp. aureus MW2
uuuccuuggacucagugcuaugu

SEQ ID NO: 4022271 - RNA, 22 nt, Staphylococcus aureus subsp. aureus MW2
uuucgaaaagaaauucuacagg

SEQ ID NO: 4022272 - RNA, 18 nt, Staphylococcus aureus subsp. aureus MW2
uuucgaacguuugaaaaa

SEQ ID NO: 4022273 - RNA, 18 nt, Staphylococcus aureus subsp. aureus MW2
uuucgauaccuaaaauac

SEQ ID NO: 4022274 - RNA, 18 nt, Staphylococcus aureus subsp. aureus MW2
uuucggacgauugaacau

SEQ ID NO: 4022275 - RNA, 19 nt, Staphylococcus aureus subsp. aureus MW2
uuucguaacauuuaaaaaa

SEQ ID NO: 4022276 - RNA, 19 nt, Staphylococcus aureus subsp. aureus MW2
uuucguguuccaauuuuau

SEQ ID NO: 4022277 - RNA, 20 nt, Staphylococcus aureus subsp. aureus MW2
uuucguuagacucacuucuu

SEQ ID NO: 4022278 - RNA, 23 nt, Staphylococcus aureus subsp. aureus MW2
uuucguuagacucacuucuuaaa

SEQ ID NO: 4022279 - RNA, 20 nt, Staphylococcus aureus subsp. aureus MW2
uuucuaaaucuaacuggaaa

SEQ ID NO: 4022280 - RNA, 19 nt, Staphylococcus aureus subsp. aureus MW2
uuucuaaauucuuuuuguu

SEQ ID NO: 4022281 - RNA, 15 nt, Staphylococcus aureus subsp. aureus MW2
uuucuaauuuuucuu

SEQ ID NO: 4022282 - RNA, 23 nt, Staphylococcus aureus subsp. aureus MW2
uuucuacacagcuaaacgcaaua

SEQ ID NO: 4022283 - RNA, 21 nt, Staphylococcus aureus subsp. aureus MW2
uuucuacaccuacaacuguug

SEQ ID NO: 4022284 - RNA, 19 nt, Staphylococcus aureus subsp. aureus MW2
uuucuacagacaaugcaag

SEQ ID NO: 4022285 - RNA, 21 nt, Staphylococcus aureus subsp. aureus MW2
uuucuacucuaauuacauaua

SEQ ID NO: 4022286 - RNA, 12 nt, Staphylococcus aureus subsp. aureus MW2
uuucuagcaugu

SEQ ID NO: 4022287 - RNA, 22 nt, Staphylococcus aureus subsp. aureus MW2
uuucuagcuuguuuguuacaua

SEQ ID NO: 4022288 - RNA, 15 nt, Staphylococcus aureus subsp. aureus MW2
uuucuagcuuuaauu

SEQ ID NO: 4022289 - RNA, 17 nt, Staphylococcus aureus subsp. aureus MW2
uuucuaggccacuaaga

SEQ ID NO: 4022290 - RNA, 22 nt, Staphylococcus aureus subsp. aureus MW2
uuucuaggccacuaagaccaug

SEQ ID NO: 4022291 - RNA, 18 nt, Staphylococcus aureus subsp. aureus MW2
uuucuauacaaugaauuu

SEQ ID NO: 4022292 - RNA, 21 nt, Staphylococcus aureus subsp. aureus MW2
uuucuauacaaugaauuucua

SEQ ID NO: 4022293 - RNA, 14 nt, Staphylococcus aureus subsp. aureus MW2
uuucuaucaaaaaa

SEQ ID NO: 4022294 - RNA, 22 nt, Staphylococcus aureus subsp. aureus MW2
uuucuaucaaaaaaacaaaaaa

SEQ ID NO: 4022295 - RNA, 14 nt, Staphylococcus aureus subsp. aureus MW2
uuucuaucaaauaa

SEQ ID NO: 4022296 - RNA, 15 nt, Staphylococcus aureus subsp. aureus MW2
uuucucaaacuaucu

SEQ ID NO: 4022297 - RNA, 22 nt, Staphylococcus aureus subsp. aureus MW2
uuucucaaauuagauaaaacaa

SEQ ID NO: 4022298 - RNA, 14 nt, Staphylococcus aureus subsp. aureus MW2
uuucucacugcugu

SEQ ID NO: 4022299 - RNA, 15 nt, Staphylococcus aureus subsp. aureus MW2
uuucugaaaugauac

SEQ ID NO: 4022300 - RNA, 22 nt, Staphylococcus aureus subsp. aureus MW2
uuucugacuuuuaaaaaacaua

SEQ ID NO: 4022301 - RNA, 22 nt, Staphylococcus aureus subsp. aureus MW2
uuucugaucgacuaauuuuucu

SEQ ID NO: 4022302 - RNA, 16 nt, Staphylococcus aureus subsp. aureus MW2
uuucugcaaaauguua

SEQ ID NO: 4022303 - RNA, 14 nt, Staphylococcus aureus subsp. aureus MW2
uuucugguaaaaaa

SEQ ID NO: 4022304 - RNA, 19 nt, Staphylococcus aureus subsp. aureus MW2
uuucugguaaaaaaauaac

SEQ ID NO: 4022305 - RNA, 18 nt, Staphylococcus aureus subsp. aureus MW2
uuucuggucacuaaugca

SEQ ID NO: 4022306 - RNA, 19 nt, Staphylococcus aureus subsp. aureus MW2
uuucuguaccaaauuugug

SEQ ID NO: 4022307 - RNA, 20 nt, Staphylococcus aureus subsp. aureus MW2
uuucugucccacucccauug

SEQ ID NO: 4022308 - RNA, 14 nt, Staphylococcus aureus subsp. aureus MW2
uuucugugaccaau

SEQ ID NO: 4022309 - RNA, 14 nt, Staphylococcus aureus subsp. aureus MW2
uuucuuaacauaaa

SEQ ID NO: 4022310 - RNA, 18 nt, Staphylococcus aureus subsp. aureus MW2
uuucuuaguuugacaucu

SEQ ID NO: 4022311 - RNA, 12 nt, Staphylococcus aureus subsp. aureus MW2
uuucuuaugaua

SEQ ID NO: 4022312 - RNA, 16 nt, Staphylococcus aureus subsp. aureus MW2
uuucuuauuuguaauu

SEQ ID NO: 4022313 - RNA, 15 nt, Staphylococcus aureus subsp. aureus MW2
uuucuucaauugucu

SEQ ID NO: 4022314 - RNA, 12 nt, Staphylococcus aureus subsp. aureus MW2
uuucuucauuuu

SEQ ID NO: 4022315 - RNA, 12 nt, Staphylococcus aureus subsp. aureus MW2
uuucuucugcua

SEQ ID NO: 4022316 - RNA, 11 nt, Staphylococcus aureus subsp. aureus MW2
uuucuucuucu

SEQ ID NO: 4022317 - RNA, 13 nt, Staphylococcus aureus subsp. aureus MW2
uuucuugaaauaa

SEQ ID NO: 4022318 - RNA, 15 nt, Staphylococcus aureus subsp. aureus MW2
uuucuugaucuaaug

SEQ ID NO: 4022319 - RNA, 17 nt, Staphylococcus aureus subsp. aureus MW2
uuucuuguguauuuuua

SEQ ID NO: 4022320 - RNA, 17 nt, Staphylococcus aureus subsp. aureus MW2
uuucuuguucuaaaaaa

SEQ ID NO: 4022321 - RNA, 17 nt, Staphylococcus aureus subsp. aureus MW2
uuucuuuguguuugcuu

SEQ ID NO: 4022322 - RNA, 20 nt, Staphylococcus aureus subsp. aureus MW2
uuucuuuuuugcuguauaua

SEQ ID NO: 4022323 - RNA, 22 nt, Staphylococcus aureus subsp. aureus MW2
uuucuuuuuuuauggauuucuu

SEQ ID NO: 4022324 - RNA, 17 nt, Staphylococcus aureus subsp. aureus MW2
uuugaaaugguaucuaa

SEQ ID NO: 4022325 - RNA, 23 nt, Staphylococcus aureus subsp. aureus MW2
uuugaacaacaucuuuuguuguu

SEQ ID NO: 4022326 - RNA, 17 nt, Staphylococcus aureus subsp. aureus MW2
uuugaagaauguuucau

SEQ ID NO: 4022327 - RNA, 21 nt, Staphylococcus aureus subsp. aureus MW2
uuugaaguuacuauauuuauu

SEQ ID NO: 4022328 - RNA, 23 nt, Staphylococcus aureus subsp. aureus MW2
uuugaauaauaaacuuaaaagag

SEQ ID NO: 4022329 - RNA, 16 nt, Staphylococcus aureus subsp. aureus MW2
uuugaauauacuuaau

SEQ ID NO: 4022330 - RNA, 16 nt, Staphylococcus aureus subsp. aureus MW2
uuugaauauuugcuuu

SEQ ID NO: 4022331 - RNA, 12 nt, Staphylococcus aureus subsp. aureus MW2
uuugaaugcaaa

SEQ ID NO: 4022332 - RNA, 22 nt, Staphylococcus aureus subsp. aureus MW2
uuugaaugcaaaucaaauacau

SEQ ID NO: 4022333 - RNA, 15 nt, Staphylococcus aureus subsp. aureus MW2
uuugaauugacuuac

SEQ ID NO: 4022334 - RNA, 12 nt, Staphylococcus aureus subsp. aureus MW2
uuugaauuggga

SEQ ID NO: 4022335 - RNA, 14 nt, Staphylococcus aureus subsp. aureus MW2
uuugaauuuuauuu

SEQ ID NO: 4022336 - RNA, 19 nt, Staphylococcus aureus subsp. aureus MW2
uuugaauuuucguucaauu

SEQ ID NO: 4022337 - RNA, 17 nt, Staphylococcus aureus subsp. aureus MW2
uuugacacauuauugaa

SEQ ID NO: 4022338 - RNA, 19 nt, Staphylococcus aureus subsp. aureus MW2
uuugacacauuauugaagu

SEQ ID NO: 4022339 - RNA, 12 nt, Staphylococcus aureus subsp. aureus MW2
uuugacauauca

SEQ ID NO: 4022340 - RNA, 13 nt, Staphylococcus aureus subsp. aureus MW2
uuugacauaucau

SEQ ID NO: 4022341 - RNA, 19 nt, Staphylococcus aureus subsp. aureus MW2
uuugacauauuuuuuaaau

SEQ ID NO: 4022342 - RNA, 22 nt, Staphylococcus aureus subsp. aureus MW2
uuugagaaaauaucauuucugu

SEQ ID NO: 4022343 - RNA, 18 nt, Staphylococcus aureus subsp. aureus MW2
uuugagcuaaccacauca

SEQ ID NO: 4022344 - RNA, 17 nt, Staphylococcus aureus subsp. aureus MW2
uuugaguauccaauacu

SEQ ID NO: 4022345 - RNA, 18 nt, Staphylococcus aureus subsp. aureus MW2
uuugaguauccaauacua

SEQ ID NO: 4022346 - RNA, 17 nt, Staphylococcus aureus subsp. aureus MW2
uuugauaaauaaaauuu

SEQ ID NO: 4022347 - RNA, 19 nt, Staphylococcus aureus subsp. aureus MW2
uuugauaacaauuuuaaau

SEQ ID NO: 4022348 - RNA, 14 nt, Staphylococcus aureus subsp. aureus MW2
uuugauaaucgaau

SEQ ID NO: 4022349 - RNA, 14 nt, Staphylococcus aureus subsp. aureus MW2
uuugauaaugauag

SEQ ID NO: 4022350 - RNA, 15 nt, Staphylococcus aureus subsp. aureus MW2
uuugauagaaaucag

SEQ ID NO: 4022351 - RNA, 22 nt, Staphylococcus aureus subsp. aureus MW2
uuugauagaugauacauucuau

SEQ ID NO: 4022352 - RNA, 23 nt, Staphylococcus aureus subsp. aureus MW2
uuugauauaaaaagugaaaguau

SEQ ID NO: 4022353 - RNA, 21 nt, Staphylococcus aureus subsp. aureus MW2
uuugauccauauauguaacaa

SEQ ID NO: 4022354 - RNA, 24 nt, Staphylococcus aureus subsp. aureus MW2
uuugaugaucauuaguguagaaaa

SEQ ID NO: 4022355 - RNA, 16 nt, Staphylococcus aureus subsp. aureus MW2
uuugauguucacuaaa

SEQ ID NO: 4022356 - RNA, 18 nt, Staphylococcus aureus subsp. aureus MW2
uuugauguucuugaaaac

SEQ ID NO: 4022357 - RNA, 19 nt, Staphylococcus aureus subsp. aureus MW2
uuugauguuuaacuaaacc

SEQ ID NO: 4022358 - RNA, 14 nt, Staphylococcus aureus subsp. aureus MW2
uuugauuaaauuaa

SEQ ID NO: 4022359 - RNA, 13 nt, Staphylococcus aureus subsp. aureus MW2
uuugauuauguaa

SEQ ID NO: 4022360 - RNA, 21 nt, Staphylococcus aureus subsp. aureus MW2
uuugauuuaauaauauuugcu

SEQ ID NO: 4022361 - RNA, 15 nt, Staphylococcus aureus subsp. aureus MW2
uuugauuuauauuuu

SEQ ID NO: 4022362 - RNA, 17 nt, Staphylococcus aureus subsp. aureus MW2
uuugauuuuacuugaau

SEQ ID NO: 4022363 - RNA, 13 nt, Staphylococcus aureus subsp. aureus MW2
uuugauuuugaau

SEQ ID NO: 4022364 - RNA, 19 nt, Staphylococcus aureus subsp. aureus MW2
uuugcaacauauuuucaca

SEQ ID NO: 4022365 - RNA, 21 nt, Staphylococcus aureus subsp. aureus MW2
uuugcaacauauuuucacaau

SEQ ID NO: 4022366 - RNA, 14 nt, Staphylococcus aureus subsp. aureus MW2
uuugcaaucaucug

SEQ ID NO: 4022367 - RNA, 17 nt, Staphylococcus aureus subsp. aureus MW2
uuugcaauuuuuuaugu

SEQ ID NO: 4022368 - RNA, 20 nt, Staphylococcus aureus subsp. aureus MW2
uuugcaauuuuuuauguauu

SEQ ID NO: 4022369 - RNA, 17 nt, Staphylococcus aureus subsp. aureus MW2
uuugcagauugauauaa

SEQ ID NO: 4022370 - RNA, 23 nt, Staphylococcus aureus subsp. aureus MW2
uuugcauaccuauaaacauaucu

SEQ ID NO: 4022371 - RNA, 15 nt, Staphylococcus aureus subsp. aureus MW2
uuugcaucacagaua

SEQ ID NO: 4022372 - RNA, 16 nt, Staphylococcus aureus subsp. aureus MW2
uuugcaucacuuguug

SEQ ID NO: 4022373 - RNA, 14 nt, Staphylococcus aureus subsp. aureus MW2
uuugccaaaaguua

SEQ ID NO: 4022374 - RNA, 23 nt, Staphylococcus aureus subsp. aureus MW2
uuugccuaaaguauuaucuaauu

SEQ ID NO: 4022375 - RNA, 18 nt, Staphylococcus aureus subsp. aureus MW2
uuugcuaaccaucauaaa

SEQ ID NO: 4022376 - RNA, 22 nt, Staphylococcus aureus subsp. aureus MW2
uuugcugaaugaagcauuuuau

SEQ ID NO: 4022377 - RNA, 22 nt, Staphylococcus aureus subsp. aureus MW2
uuugcugcuuuuccauuaugau

SEQ ID NO: 4022378 - RNA, 20 nt, Staphylococcus aureus subsp. aureus MW2
uuugcugguugcuucuuauc

SEQ ID NO: 4022379 - RNA, 17 nt, Staphylococcus aureus subsp. aureus MW2
uuuggaaaccguuuaga

SEQ ID NO: 4022380 - RNA, 18 nt, Staphylococcus aureus subsp. aureus MW2
uuuggaauacuuuucuuc

SEQ ID NO: 4022381 - RNA, 24 nt, Staphylococcus aureus subsp. aureus MW2
uuuggcacauaaaucaauguacua

SEQ ID NO: 4022382 - RNA, 20 nt, Staphylococcus aureus subsp. aureus MW2
uuugguaagcuaauuucuaa

SEQ ID NO: 4022383 - RNA, 22 nt, Staphylococcus aureus subsp. aureus MW2
uuugguucaaucauucacuuca

SEQ ID NO: 4022384 - RNA, 16 nt, Staphylococcus aureus subsp. aureus MW2
uuugguucuucuaucu

SEQ ID NO: 4022385 - RNA, 20 nt, Staphylococcus aureus subsp. aureus MW2
uuuguaaccccauuuuaaag

SEQ ID NO: 4022386 - RNA, 22 nt, Staphylococcus aureus subsp. aureus MW2
uuuguaaccccauuuuaaaguc

SEQ ID NO: 4022387 - RNA, 15 nt, Staphylococcus aureus subsp. aureus MW2
uuuguaaccuaaaaa

SEQ ID NO: 4022388 - RNA, 18 nt, Staphylococcus aureus subsp. aureus MW2
uuuguaaccuaaaaacaa

SEQ ID NO: 4022389 - RNA, 20 nt, Staphylococcus aureus subsp. aureus MW2
uuuguaagcucaugaaucag

SEQ ID NO: 4022390 - RNA, 13 nt, Staphylococcus aureus subsp. aureus MW2
uuuguaauuagga

SEQ ID NO: 4022391 - RNA, 22 nt, Staphylococcus aureus subsp. aureus MW2
uuuguaauucuuguaaaucaua

SEQ ID NO: 4022392 - RNA, 13 nt, Staphylococcus aureus subsp. aureus MW2
uuuguacauaaaa

SEQ ID NO: 4022393 - RNA, 14 nt, Staphylococcus aureus subsp. aureus MW2
uuuguacauaaaaa

SEQ ID NO: 4022394 - RNA, 16 nt, Staphylococcus aureus subsp. aureus MW2
uuuguaccaucaauaa

SEQ ID NO: 4022395 - RNA, 22 nt, Staphylococcus aureus subsp. aureus MW2
uuuguacuuuucuuuuuacuug

SEQ ID NO: 4022396 - RNA, 14 nt, Staphylococcus aureus subsp. aureus MW2
uuuguagaauuucu

SEQ ID NO: 4022397 - RNA, 17 nt, Staphylococcus aureus subsp. aureus MW2
uuuguauaccuauuccu

SEQ ID NO: 4022398 - RNA, 19 nt, Staphylococcus aureus subsp. aureus MW2
uuuguauaccuauuccuau

SEQ ID NO: 4022399 - RNA, 16 nt, Staphylococcus aureus subsp. aureus MW2
uuuguaugauaaccau

SEQ ID NO: 4022400 - RNA, 17 nt, Staphylococcus aureus subsp. aureus MW2
uuuguaugauaaccauu

SEQ ID NO: 4022401 - RNA, 16 nt, Staphylococcus aureus subsp. aureus MW2
uuuguauuaauuugaa

SEQ ID NO: 4022402 - RNA, 14 nt, Staphylococcus aureus subsp. aureus MW2
uuuguauuagcauc

SEQ ID NO: 4022403 - RNA, 17 nt, Staphylococcus aureus subsp. aureus MW2
uuuguauugacaucuuc

SEQ ID NO: 4022404 - RNA, 16 nt, Staphylococcus aureus subsp. aureus MW2
uuuguauuuuucaaau

SEQ ID NO: 4022405 - RNA, 21 nt, Staphylococcus aureus subsp. aureus MW2
uuugucacucuuuaaaucaaa

SEQ ID NO: 4022406 - RNA, 17 nt, Staphylococcus aureus subsp. aureus MW2
uuugucaguaacuuugu

SEQ ID NO: 4022407 - RNA, 23 nt, Staphylococcus aureus subsp. aureus MW2
uuuguccaacauguaacaaaaua

SEQ ID NO: 4022408 - RNA, 15 nt, Staphylococcus aureus subsp. aureus MW2
uuugucucucaacau

SEQ ID NO: 4022409 - RNA, 14 nt, Staphylococcus aureus subsp. aureus MW2
uuugugggcguucu

SEQ ID NO: 4022410 - RNA, 16 nt, Staphylococcus aureus subsp. aureus MW2
uuuguguaucuguaac

SEQ ID NO: 4022411 - RNA, 18 nt, Staphylococcus aureus subsp. aureus MW2
uuuguguuugcuuuuauu

SEQ ID NO: 4022412 - RNA, 12 nt, Staphylococcus aureus subsp. aureus MW2
uuuguuaaaaaa

SEQ ID NO: 4022413 - RNA, 21 nt, Staphylococcus aureus subsp. aureus MW2
uuuguuaccaaacaauacaua

SEQ ID NO: 4022414 - RNA, 14 nt, Staphylococcus aureus subsp. aureus MW2
uuuguuacuucuaa

SEQ ID NO: 4022415 - RNA, 15 nt, Staphylococcus aureus subsp. aureus MW2
uuuguuacuucuaau

SEQ ID NO: 4022416 - RNA, 16 nt, Staphylococcus aureus subsp. aureus MW2
uuuguugcucagugca

SEQ ID NO: 4022417 - RNA, 15 nt, Staphylococcus aureus subsp. aureus MW2
uuuguugguguuuag

SEQ ID NO: 4022418 - RNA, 21 nt, Staphylococcus aureus subsp. aureus MW2
uuuguugguguuuagucuuuu

SEQ ID NO: 4022419 - RNA, 19 nt, Staphylococcus aureus subsp. aureus MW2
uuuguuguuuuaauuucac

SEQ ID NO: 4022420 - RNA, 23 nt, Staphylococcus aureus subsp. aureus MW2
uuuguuuacggauuuuucucauu

SEQ ID NO: 4022421 - RNA, 12 nt, Staphylococcus aureus subsp. aureus MW2
uuuguuuguaag

SEQ ID NO: 4022422 - RNA, 12 nt, Staphylococcus aureus subsp. aureus MW2
uuuguuuuaaaa

SEQ ID NO: 4022423 - RNA, 14 nt, Staphylococcus aureus subsp. aureus MW2
uuuguuuuaaaaaa

SEQ ID NO: 4022424 - RNA, 12 nt, Staphylococcus aureus subsp. aureus MW2
uuuguuuuaaau

SEQ ID NO: 4022425 - RNA, 14 nt, Staphylococcus aureus subsp. aureus MW2
uuuguuuucacugu

SEQ ID NO: 4022426 - RNA, 13 nt, Staphylococcus aureus subsp. aureus MW2
uuuguuuugaaug

SEQ ID NO: 4022427 - RNA, 21 nt, Staphylococcus aureus subsp. aureus MW2
uuuuaaaaaacauaccugcau

SEQ ID NO: 4022428 - RNA, 17 nt, Staphylococcus aureus subsp. aureus MW2
uuuuaaaaaauuuaaau

SEQ ID NO: 4022429 - RNA, 19 nt, Staphylococcus aureus subsp. aureus MW2
uuuuaaaaaauuuaaauaa

SEQ ID NO: 4022430 - RNA, 16 nt, Staphylococcus aureus subsp. aureus MW2
uuuuaaaaauacagcu

SEQ ID NO: 4022431 - RNA, 15 nt, Staphylococcus aureus subsp. aureus MW2
uuuuaaaaauucaua

SEQ ID NO: 4022432 - RNA, 12 nt, Staphylococcus aureus subsp. aureus MW2
uuuuaaaauacg

SEQ ID NO: 4022433 - RNA, 21 nt, Staphylococcus aureus subsp. aureus MW2
uuuuaaaaucucauaauaauu

SEQ ID NO: 4022434 - RNA, 19 nt, Staphylococcus aureus subsp. aureus MW2
uuuuaaacguacauuuuua

SEQ ID NO: 4022435 - RNA, 16 nt, Staphylococcus aureus subsp. aureus MW2
uuuuaaagaaaaguuu

SEQ ID NO: 4022436 - RNA, 20 nt, Staphylococcus aureus subsp. aureus MW2
uuuuaaaggaccacuuagau

SEQ ID NO: 4022437 - RNA, 12 nt, Staphylococcus aureus subsp. aureus MW2
uuuuaaaguaac

SEQ ID NO: 4022438 - RNA, 23 nt, Staphylococcus aureus subsp. aureus MW2
uuuuaaauaaucgaaaauuucag

SEQ ID NO: 4022439 - RNA, 17 nt, Staphylococcus aureus subsp. aureus MW2
uuuuaaaucuauauaaa

SEQ ID NO: 4022440 - RNA, 13 nt, Staphylococcus aureus subsp. aureus MW2
uuuuaaauuacua

SEQ ID NO: 4022441 - RNA, 22 nt, Staphylococcus aureus subsp. aureus MW2
uuuuaaauuacuauauuuaaau

SEQ ID NO: 4022442 - RNA, 12 nt, Staphylococcus aureus subsp. aureus MW2
uuuuaaauucuu

SEQ ID NO: 4022443 - RNA, 17 nt, Staphylococcus aureus subsp. aureus MW2
uuuuaaauuuaauuucg

SEQ ID NO: 4022444 - RNA, 19 nt, Staphylococcus aureus subsp. aureus MW2
uuuuaacaaugaaccaucc

SEQ ID NO: 4022445 - RNA, 20 nt, Staphylococcus aureus subsp. aureus MW2
uuuuaacagcgugaauauaa

SEQ ID NO: 4022446 - RNA, 15 nt, Staphylococcus aureus subsp. aureus MW2
uuuuaacagcugcag

SEQ ID NO: 4022447 - RNA, 19 nt, Staphylococcus aureus subsp. aureus MW2
uuuuaacgaagccuaauuu

SEQ ID NO: 4022448 - RNA, 20 nt, Staphylococcus aureus subsp. aureus MW2
uuuuaacugguugauaaaua

SEQ ID NO: 4022449 - RNA, 23 nt, Staphylococcus aureus subsp. aureus MW2
uuuuaacuuuaacaucugaaucu

SEQ ID NO: 4022450 - RNA, 17 nt, Staphylococcus aureus subsp. aureus MW2
uuuuaagacuuuaaaau

SEQ ID NO: 4022451 - RNA, 23 nt, Staphylococcus aureus subsp. aureus MW2
uuuuaaguuguugauuuaaaaua

SEQ ID NO: 4022452 - RNA, 21 nt, Staphylococcus aureus subsp. aureus MW2
uuuuaauauauuuauuuuuga

SEQ ID NO: 4022453 - RNA, 14 nt, Staphylococcus aureus subsp. aureus MW2
uuuuaauauuuuuu

SEQ ID NO: 4022454 - RNA, 14 nt, Staphylococcus aureus subsp. aureus MW2
uuuuaaucuguaug

SEQ ID NO: 4022455 - RNA, 21 nt, Staphylococcus aureus subsp. aureus MW2
uuuuaaugaaucuguagucau

SEQ ID NO: 4022456 - RNA, 12 nt, Staphylococcus aureus subsp. aureus MW2
uuuuaaugauuu

SEQ ID NO: 4022457 - RNA, 16 nt, Staphylococcus aureus subsp. aureus MW2
uuuuaauguuauaaau

SEQ ID NO: 4022458 - RNA, 19 nt, Staphylococcus aureus subsp. aureus MW2
uuuuaauuaauuaucauaa

SEQ ID NO: 4022459 - RNA, 18 nt, Staphylococcus aureus subsp. aureus MW2
uuuuaauuuguauuuaaa

SEQ ID NO: 4022460 - RNA, 21 nt, Staphylococcus aureus subsp. aureus MW2
uuuuaauuuugacauaaaaaa

SEQ ID NO: 4022461 - RNA, 13 nt, Staphylococcus aureus subsp. aureus MW2
uuuuacaaaguga

SEQ ID NO: 4022462 - RNA, 15 nt, Staphylococcus aureus subsp. aureus MW2
uuuuacaaagugauu

SEQ ID NO: 4022463 - RNA, 19 nt, Staphylococcus aureus subsp. aureus MW2
uuuuacaagcuuuauaaaa

SEQ ID NO: 4022464 - RNA, 16 nt, Staphylococcus aureus subsp. aureus MW2
uuuuacaaguuguuca

SEQ ID NO: 4022465 - RNA, 20 nt, Staphylococcus aureus subsp. aureus MW2
uuuuacaaucaucacacaua

SEQ ID NO: 4022466 - RNA, 17 nt, Staphylococcus aureus subsp. aureus MW2
uuuuaccuuuaauuaca

SEQ ID NO: 4022467 - RNA, 21 nt, Staphylococcus aureus subsp. aureus MW2
uuuuacuaggaauauaaaacu

SEQ ID NO: 4022468 - RNA, 17 nt, Staphylococcus aureus subsp. aureus MW2
uuuuagaauuuaacauu

SEQ ID NO: 4022469 - RNA, 20 nt, Staphylococcus aureus subsp. aureus MW2
uuuuagacauaaaaaaagag

SEQ ID NO: 4022470 - RNA, 19 nt, Staphylococcus aureus subsp. aureus MW2
uuuuagccccagcaaauac

SEQ ID NO: 4022471 - RNA, 21 nt, Staphylococcus aureus subsp. aureus MW2
uuuuagccccagcaaauacuu

SEQ ID NO: 4022472 - RNA, 15 nt, Staphylococcus aureus subsp. aureus MW2
uuuuagcuagacauu

SEQ ID NO: 4022473 - RNA, 15 nt, Staphylococcus aureus subsp. aureus MW2
uuuuagcuauagaaa

SEQ ID NO: 4022474 - RNA, 20 nt, Staphylococcus aureus subsp. aureus MW2
uuuuagcucuuguucaagua

SEQ ID NO: 4022475 - RNA, 18 nt, Staphylococcus aureus subsp. aureus MW2
uuuuagguaauaauucag

SEQ ID NO: 4022476 - RNA, 11 nt, Staphylococcus aureus subsp. aureus MW2
uuuuagguuua

SEQ ID NO: 4022477 - RNA, 16 nt, Staphylococcus aureus subsp. aureus MW2
uuuuaguaauuuuaca

SEQ ID NO: 4022478 - RNA, 21 nt, Staphylococcus aureus subsp. aureus MW2
uuuuagugacaaacauuuguu

SEQ ID NO: 4022479 - RNA, 21 nt, Staphylococcus aureus subsp. aureus MW2
uuuuauaaaaaguuauuuaag

SEQ ID NO: 4022480 - RNA, 14 nt, Staphylococcus aureus subsp. aureus MW2
uuuuauaaauuuug

SEQ ID NO: 4022481 - RNA, 14 nt, Staphylococcus aureus subsp. aureus MW2
uuuuauacauuaac

SEQ ID NO: 4022482 - RNA, 22 nt, Staphylococcus aureus subsp. aureus MW2
uuuuauagcaaauugauuaaau

SEQ ID NO: 4022483 - RNA, 13 nt, Staphylococcus aureus subsp. aureus MW2
uuuuauaguaaua

SEQ ID NO: 4022484 - RNA, 23 nt, Staphylococcus aureus subsp. aureus MW2
uuuuauaguaauagcuauauuuu

SEQ ID NO: 4022485 - RNA, 14 nt, Staphylococcus aureus subsp. aureus MW2
uuuuauauauccug

SEQ ID NO: 4022486 - RNA, 18 nt, Staphylococcus aureus subsp. aureus MW2
uuuuauaugcaacuuaua

SEQ ID NO: 4022487 - RNA, 14 nt, Staphylococcus aureus subsp. aureus MW2
uuuuauauuuauuu

SEQ ID NO: 4022488 - RNA, 21 nt, Staphylococcus aureus subsp. aureus MW2
uuuuaucuaucgguaauuuuu

SEQ ID NO: 4022489 - RNA, 18 nt, Staphylococcus aureus subsp. aureus MW2
uuuuaucugaaaauauca

SEQ ID NO: 4022490 - RNA, 13 nt, Staphylococcus aureus subsp. aureus MW2
uuuuaucugaauc

SEQ ID NO: 4022491 - RNA, 14 nt, Staphylococcus aureus subsp. aureus MW2
uuuuaugaaaagaa

SEQ ID NO: 4022492 - RNA, 14 nt, Staphylococcus aureus subsp. aureus MW2
uuuuaugaauauca

SEQ ID NO: 4022493 - RNA, 18 nt, Staphylococcus aureus subsp. aureus MW2
uuuuaugacguaauuaau

SEQ ID NO: 4022494 - RNA, 20 nt, Staphylococcus aureus subsp. aureus MW2
uuuuaugagcuucuuuaaau

SEQ ID NO: 4022495 - RNA, 24 nt, Staphylococcus aureus subsp. aureus MW2
uuuuaugcauuauagaugacugua

SEQ ID NO: 4022496 - RNA, 21 nt, Staphylococcus aureus subsp. aureus MW2
uuuuauggugcuaaaaaauuu

SEQ ID NO: 4022497 - RNA, 18 nt, Staphylococcus aureus subsp. aureus MW2
uuuuaugguuuaauuuag

SEQ ID NO: 4022498 - RNA, 22 nt, Staphylococcus aureus subsp. aureus MW2
uuuuaugucuuuuuuuguaaau

SEQ ID NO: 4022499 - RNA, 18 nt, Staphylococcus aureus subsp. aureus MW2
uuuuauguuuaaacauuu

SEQ ID NO: 4022500 - RNA, 15 nt, Staphylococcus aureus subsp. aureus MW2
uuuuauguuuuaauu

SEQ ID NO: 4022501 - RNA, 23 nt, Staphylococcus aureus subsp. aureus MW2
uuuuauuaaaucguauauuaaau

SEQ ID NO: 4022502 - RNA, 14 nt, Staphylococcus aureus subsp. aureus MW2
uuuuauuaaugaag

SEQ ID NO: 4022503 - RNA, 22 nt, Staphylococcus aureus subsp. aureus MW2
uuuuauuaucaguccaaucagu

SEQ ID NO: 4022504 - RNA, 19 nt, Staphylococcus aureus subsp. aureus MW2
uuuuauuaucuuuguaaau

SEQ ID NO: 4022505 - RNA, 20 nt, Staphylococcus aureus subsp. aureus MW2
uuuuauuauugucaucaugu

SEQ ID NO: 4022506 - RNA, 20 nt, Staphylococcus aureus subsp. aureus MW2
uuuuauucuaauacaaaccu

SEQ ID NO: 4022507 - RNA, 16 nt, Staphylococcus aureus subsp. aureus MW2
uuuuauuguuuuggcu

SEQ ID NO: 4022508 - RNA, 14 nt, Staphylococcus aureus subsp. aureus MW2
uuuuauuuaaauua

SEQ ID NO: 4022509 - RNA, 11 nt, Staphylococcus aureus subsp. aureus MW2
uuuuauuuauc

SEQ ID NO: 4022510 - RNA, 18 nt, Staphylococcus aureus subsp. aureus MW2
uuuuauuugauuauucuu

SEQ ID NO: 4022511 - RNA, 16 nt, Staphylococcus aureus subsp. aureus MW2
uuuuauuuuauuuuuu

SEQ ID NO: 4022512 - RNA, 14 nt, Staphylococcus aureus subsp. aureus MW2
uuuuauuuucaaau

SEQ ID NO: 4022513 - RNA, 23 nt, Staphylococcus aureus subsp. aureus MW2
uuuuauuuugugcuuuuuuguuu

SEQ ID NO: 4022514 - RNA, 23 nt, Staphylococcus aureus subsp. aureus MW2
uuuucaaaaauuguuaaucccgu

SEQ ID NO: 4022515 - RNA, 20 nt, Staphylococcus aureus subsp. aureus MW2
uuuucaaacauauucauucu

SEQ ID NO: 4022516 - RNA, 14 nt, Staphylococcus aureus subsp. aureus MW2
uuuucaaagauaca

SEQ ID NO: 4022517 - RNA, 16 nt, Staphylococcus aureus subsp. aureus MW2
uuuucaaauguguaaa

SEQ ID NO: 4022518 - RNA, 14 nt, Staphylococcus aureus subsp. aureus MW2
uuuucaaauuucua

SEQ ID NO: 4022519 - RNA, 18 nt, Staphylococcus aureus subsp. aureus MW2
uuuucaacaguuuuaaag

SEQ ID NO: 4022520 - RNA, 19 nt, Staphylococcus aureus subsp. aureus MW2
uuuucaacauaauauuucu

SEQ ID NO: 4022521 - RNA, 22 nt, Staphylococcus aureus subsp. aureus MW2
uuuucaagaccaaauauuuuau

SEQ ID NO: 4022522 - RNA, 15 nt, Staphylococcus aureus subsp. aureus MW2
uuuucaauaaauuuu

SEQ ID NO: 4022523 - RNA, 22 nt, Staphylococcus aureus subsp. aureus MW2
uuuucaauucgcucacauguga

SEQ ID NO: 4022524 - RNA, 17 nt, Staphylococcus aureus subsp. aureus MW2
uuuucacgauuuuuaaa

SEQ ID NO: 4022525 - RNA, 17 nt, Staphylococcus aureus subsp. aureus MW2
uuuucacuaaucauuuu

SEQ ID NO: 4022526 - RNA, 19 nt, Staphylococcus aureus subsp. aureus MW2
uuuucagcaucuacuaaau

SEQ ID NO: 4022527 - RNA, 15 nt, Staphylococcus aureus subsp. aureus MW2
uuuucauaaauauuu

SEQ ID NO: 4022528 - RNA, 21 nt, Staphylococcus aureus subsp. aureus MW2
uuuucauagaacaaaauguag

SEQ ID NO: 4022529 - RNA, 13 nt, Staphylococcus aureus subsp. aureus MW2
uuuuccaauaaua

SEQ ID NO: 4022530 - RNA, 19 nt, Staphylococcus aureus subsp. aureus MW2
uuuuccaguccauuuuuua

SEQ ID NO: 4022531 - RNA, 19 nt, Staphylococcus aureus subsp. aureus MW2
uuuucgaugcauauucauc

SEQ ID NO: 4022532 - RNA, 21 nt, Staphylococcus aureus subsp. aureus MW2
uuuucgaugcauauucaucau

SEQ ID NO: 4022533 - RNA, 15 nt, Staphylococcus aureus subsp. aureus MW2
uuuucgauuaauucu

SEQ ID NO: 4022534 - RNA, 18 nt, Staphylococcus aureus subsp. aureus MW2
uuuucgauuaauucuucu

SEQ ID NO: 4022535 - RNA, 21 nt, Staphylococcus aureus subsp. aureus MW2
uuuucgcaaaauuuauuucgu

SEQ ID NO: 4022536 - RNA, 22 nt, Staphylococcus aureus subsp. aureus MW2
uuuucgccaaaaacuuuauauu

SEQ ID NO: 4022537 - RNA, 20 nt, Staphylococcus aureus subsp. aureus MW2
uuuucguagccguuuuugaa

SEQ ID NO: 4022538 - RNA, 13 nt, Staphylococcus aureus subsp. aureus MW2
uuuucguuuuaau

SEQ ID NO: 4022539 - RNA, 13 nt, Staphylococcus aureus subsp. aureus MW2
uuuucuauggcac

SEQ ID NO: 4022540 - RNA, 14 nt, Staphylococcus aureus subsp. aureus MW2
uuuucuauggcaca

SEQ ID NO: 4022541 - RNA, 17 nt, Staphylococcus aureus subsp. aureus MW2
uuuucuccaacgucaua

SEQ ID NO: 4022542 - RNA, 14 nt, Staphylococcus aureus subsp. aureus MW2
uuuucucuauuaau

SEQ ID NO: 4022543 - RNA, 17 nt, Staphylococcus aureus subsp. aureus MW2
uuuucugccauaaacau

SEQ ID NO: 4022544 - RNA, 20 nt, Staphylococcus aureus subsp. aureus MW2
uuuucuuaguuugacaucua

SEQ ID NO: 4022545 - RNA, 17 nt, Staphylococcus aureus subsp. aureus MW2
uuuucuuauaaaaaucu

SEQ ID NO: 4022546 - RNA, 18 nt, Staphylococcus aureus subsp. aureus MW2
uuuucuugaaauaaacau

SEQ ID NO: 4022547 - RNA, 18 nt, Staphylococcus aureus subsp. aureus MW2
uuuucuugguuugagaau

SEQ ID NO: 4022548 - RNA, 20 nt, Staphylococcus aureus subsp. aureus MW2
uuuucuuuaucuauaugcau

SEQ ID NO: 4022549 - RNA, 21 nt, Staphylococcus aureus subsp. aureus MW2
uuuugaauaauaaacuuaaaa

SEQ ID NO: 4022550 - RNA, 12 nt, Staphylococcus aureus subsp. aureus MW2
uuuugaauauuu

SEQ ID NO: 4022551 - RNA, 13 nt, Staphylococcus aureus subsp. aureus MW2
uuuugacuauucu

SEQ ID NO: 4022552 - RNA, 20 nt, Staphylococcus aureus subsp. aureus MW2
uuuugacuguuaaacaaggu

SEQ ID NO: 4022553 - RNA, 18 nt, Staphylococcus aureus subsp. aureus MW2
uuuugagacaaaaaauga

SEQ ID NO: 4022554 - RNA, 18 nt, Staphylococcus aureus subsp. aureus MW2
uuuugaguccauucgacu

SEQ ID NO: 4022555 - RNA, 18 nt, Staphylococcus aureus subsp. aureus MW2
uuuugauacguaaacacu

SEQ ID NO: 4022556 - RNA, 23 nt, Staphylococcus aureus subsp. aureus MW2
uuuugauauaaaaagugaaagua

SEQ ID NO: 4022557 - RNA, 16 nt, Staphylococcus aureus subsp. aureus MW2
uuuugaucuaaaguac

SEQ ID NO: 4022558 - RNA, 16 nt, Staphylococcus aureus subsp. aureus MW2
uuuugauggucagcaa

SEQ ID NO: 4022559 - RNA, 9 nt, Staphylococcus aureus subsp. aureus MW2
uuuugauug

SEQ ID NO: 4022560 - RNA, 20 nt, Staphylococcus aureus subsp. aureus MW2
uuuugauuguuuaaacaugu

SEQ ID NO: 4022561 - RNA, 14 nt, Staphylococcus aureus subsp. aureus MW2
uuuugcaaaaaaau

SEQ ID NO: 4022562 - RNA, 12 nt, Staphylococcus aureus subsp. aureus MW2
uuuugcaccuuc

SEQ ID NO: 4022563 - RNA, 14 nt, Staphylococcus aureus subsp. aureus MW2
uuuugcacuaaugg

SEQ ID NO: 4022564 - RNA, 14 nt, Staphylococcus aureus subsp. aureus MW2
uuuugcaucacaga

SEQ ID NO: 4022565 - RNA, 22 nt, Staphylococcus aureus subsp. aureus MW2
uuuugcaucacagauaaugcau

SEQ ID NO: 4022566 - RNA, 21 nt, Staphylococcus aureus subsp. aureus MW2
uuuugcccaugucaugaauuu

SEQ ID NO: 4022567 - RNA, 23 nt, Staphylococcus aureus subsp. aureus MW2
uuuugcccuuauauuuuuuacaa

SEQ ID NO: 4022568 - RNA, 16 nt, Staphylococcus aureus subsp. aureus MW2
uuuugcgaaaauauca

SEQ ID NO: 4022569 - RNA, 18 nt, Staphylococcus aureus subsp. aureus MW2
uuuugcguuuuuaaauaa

SEQ ID NO: 4022570 - RNA, 18 nt, Staphylococcus aureus subsp. aureus MW2
uuuuggaacauauucaua

SEQ ID NO: 4022571 - RNA, 21 nt, Staphylococcus aureus subsp. aureus MW2
uuuugggaauuguauuaauca

SEQ ID NO: 4022572 - RNA, 20 nt, Staphylococcus aureus subsp. aureus MW2
uuuuggucaaguaaauguuu

SEQ ID NO: 4022573 - RNA, 13 nt, Staphylococcus aureus subsp. aureus MW2
uuuugguuguucu

SEQ ID NO: 4022574 - RNA, 23 nt, Staphylococcus aureus subsp. aureus MW2
uuuuguaauugaaaugauagaug

SEQ ID NO: 4022575 - RNA, 17 nt, Staphylococcus aureus subsp. aureus MW2
uuuuguacauuauuaau

SEQ ID NO: 4022576 - RNA, 17 nt, Staphylococcus aureus subsp. aureus MW2
uuuuguaucucugaaaa

SEQ ID NO: 4022577 - RNA, 13 nt, Staphylococcus aureus subsp. aureus MW2
uuuugugauuuuu

SEQ ID NO: 4022578 - RNA, 19 nt, Staphylococcus aureus subsp. aureus MW2
uuuugugggcguucugcua

SEQ ID NO: 4022579 - RNA, 23 nt, Staphylococcus aureus subsp. aureus MW2
uuuuguguauuuauuuuuuuaaa

SEQ ID NO: 4022580 - RNA, 15 nt, Staphylococcus aureus subsp. aureus MW2
uuuuguuaauuuuuu

SEQ ID NO: 4022581 - RNA, 14 nt, Staphylococcus aureus subsp. aureus MW2
uuuuguuauugaau

SEQ ID NO: 4022582 - RNA, 18 nt, Staphylococcus aureus subsp. aureus MW2
uuuuguugcucagugcau

SEQ ID NO: 4022583 - RNA, 17 nt, Staphylococcus aureus subsp. aureus MW2
uuuuguugguuuuuaaa

SEQ ID NO: 4022584 - RNA, 16 nt, Staphylococcus aureus subsp. aureus MW2
uuuuguuucaaauuuu

SEQ ID NO: 4022585 - RNA, 12 nt, Staphylococcus aureus subsp. aureus MW2
uuuuguuuugcu

SEQ ID NO: 4022586 - RNA, 16 nt, Staphylococcus aureus subsp. aureus MW2
uuuuuaaaauuaucaa

SEQ ID NO: 4022587 - RNA, 14 nt, Staphylococcus aureus subsp. aureus MW2
uuuuuaaaucuaca

SEQ ID NO: 4022588 - RNA, 17 nt, Staphylococcus aureus subsp. aureus MW2
uuuuuaaaugauuuaau

SEQ ID NO: 4022589 - RNA, 21 nt, Staphylococcus aureus subsp. aureus MW2
uuuuuaaaugauuuaauaaac

SEQ ID NO: 4022590 - RNA, 12 nt, Staphylococcus aureus subsp. aureus MW2
uuuuuaacaaaa

SEQ ID NO: 4022591 - RNA, 18 nt, Staphylococcus aureus subsp. aureus MW2
uuuuuaacagcuuuuucu

SEQ ID NO: 4022592 - RNA, 14 nt, Staphylococcus aureus subsp. aureus MW2
uuuuuaauaaugca

SEQ ID NO: 4022593 - RNA, 12 nt, Staphylococcus aureus subsp. aureus MW2
uuuuuaauaauu

SEQ ID NO: 4022594 - RNA, 21 nt, Staphylococcus aureus subsp. aureus MW2
uuuuuaauauacgagacauuu

SEQ ID NO: 4022595 - RNA, 18 nt, Staphylococcus aureus subsp. aureus MW2
uuuuuaauguauucuucu

SEQ ID NO: 4022596 - RNA, 12 nt, Staphylococcus aureus subsp. aureus MW2
uuuuuaauguua

SEQ ID NO: 4022597 - RNA, 16 nt, Staphylococcus aureus subsp. aureus MW2
uuuuuaauuauuuccc

SEQ ID NO: 4022598 - RNA, 17 nt, Staphylococcus aureus subsp. aureus MW2
uuuuuaauuuuaucucc

SEQ ID NO: 4022599 - RNA, 15 nt, Staphylococcus aureus subsp. aureus MW2
uuuuuaauuuugaca

SEQ ID NO: 4022600 - RNA, 19 nt, Staphylococcus aureus subsp. aureus MW2
uuuuuagguuauauuuaaa

SEQ ID NO: 4022601 - RNA, 15 nt, Staphylococcus aureus subsp. aureus MW2
uuuuuaguuaaagua

SEQ ID NO: 4022602 - RNA, 22 nt, Staphylococcus aureus subsp. aureus MW2
uuuuuaguuagaaaguauuuau

SEQ ID NO: 4022603 - RNA, 11 nt, Staphylococcus aureus subsp. aureus MW2
uuuuuauauug

SEQ ID NO: 4022604 - RNA, 15 nt, Staphylococcus aureus subsp. aureus MW2
uuuuuaucaucuucu

SEQ ID NO: 4022605 - RNA, 20 nt, Staphylococcus aureus subsp. aureus MW2
uuuuuaucuguagaaacacu

SEQ ID NO: 4022606 - RNA, 12 nt, Staphylococcus aureus subsp. aureus MW2
uuuuuaugauuc

SEQ ID NO: 4022607 - RNA, 23 nt, Staphylococcus aureus subsp. aureus MW2
uuuuuauuaaucuguaaugcacu

SEQ ID NO: 4022608 - RNA, 17 nt, Staphylococcus aureus subsp. aureus MW2
uuuuuauuaguauucaa

SEQ ID NO: 4022609 - RNA, 12 nt, Staphylococcus aureus subsp. aureus MW2
uuuuuauuauaa

SEQ ID NO: 4022610 - RNA, 15 nt, Staphylococcus aureus subsp. aureus MW2
uuuuuauuauacacu

SEQ ID NO: 4022611 - RNA, 13 nt, Staphylococcus aureus subsp. aureus MW2
uuuuuauuuacuc

SEQ ID NO: 4022612 - RNA, 13 nt, Staphylococcus aureus subsp. aureus MW2
uuuuucaaauaaa

SEQ ID NO: 4022613 - RNA, 14 nt, Staphylococcus aureus subsp. aureus MW2
uuuuucaaauaaua

SEQ ID NO: 4022614 - RNA, 17 nt, Staphylococcus aureus subsp. aureus MW2
uuuuucaaauaauauaa

SEQ ID NO: 4022615 - RNA, 19 nt, Staphylococcus aureus subsp. aureus MW2
uuuuucaacuaauaacuca

SEQ ID NO: 4022616 - RNA, 14 nt, Staphylococcus aureus subsp. aureus MW2
uuuuucaaugucua

SEQ ID NO: 4022617 - RNA, 19 nt, Staphylococcus aureus subsp. aureus MW2
uuuuucaauuaaauguuua

SEQ ID NO: 4022618 - RNA, 22 nt, Staphylococcus aureus subsp. aureus MW2
uuuuucauaaauauuuaaaaua

SEQ ID NO: 4022619 - RNA, 20 nt, Staphylococcus aureus subsp. aureus MW2
uuuuucauaauuaauaacau

SEQ ID NO: 4022620 - RNA, 16 nt, Staphylococcus aureus subsp. aureus MW2
uuuuucaucauuaaaa

SEQ ID NO: 4022621 - RNA, 13 nt, Staphylococcus aureus subsp. aureus MW2
uuuuucgcauuaa

SEQ ID NO: 4022622 - RNA, 14 nt, Staphylococcus aureus subsp. aureus MW2
uuuuucuaaauaaa

SEQ ID NO: 4022623 - RNA, 14 nt, Staphylococcus aureus subsp. aureus MW2
uuuuucuacaccua

SEQ ID NO: 4022624 - RNA, 14 nt, Staphylococcus aureus subsp. aureus MW2
uuuuucuuuaagcu

SEQ ID NO: 4022625 - RNA, 14 nt, Staphylococcus aureus subsp. aureus MW2
uuuuucuuuuguuu

SEQ ID NO: 4022626 - RNA, 22 nt, Staphylococcus aureus subsp. aureus MW2
uuuuugaaaugguaucuaaaug

SEQ ID NO: 4022627 - RNA, 20 nt, Staphylococcus aureus subsp. aureus MW2
uuuuugaaauuucgacaucu

SEQ ID NO: 4022628 - RNA, 16 nt, Staphylococcus aureus subsp. aureus MW2
uuuuugaauaucuaau

SEQ ID NO: 4022629 - RNA, 21 nt, Staphylococcus aureus subsp. aureus MW2
uuuuugauaguaauaguuaac

SEQ ID NO: 4022630 - RNA, 20 nt, Staphylococcus aureus subsp. aureus MW2
uuuuugauauaaacuacuaa

SEQ ID NO: 4022631 - RNA, 14 nt, Staphylococcus aureus subsp. aureus MW2
uuuuugauuuuaau

SEQ ID NO: 4022632 - RNA, 14 nt, Staphylococcus aureus subsp. aureus MW2
uuuuugguagcauu

SEQ ID NO: 4022633 - RNA, 21 nt, Staphylococcus aureus subsp. aureus MW2
uuuuuguccccagcccuuuuc

SEQ ID NO: 4022634 - RNA, 14 nt, Staphylococcus aureus subsp. aureus MW2
uuuuuguugcaauu

SEQ ID NO: 4022635 - RNA, 19 nt, Staphylococcus aureus subsp. aureus MW2
uuuuuuaacuuuaacaauu

SEQ ID NO: 4022636 - RNA, 11 nt, Staphylococcus aureus subsp. aureus MW2
uuuuuuaauuu

SEQ ID NO: 4022637 - RNA, 16 nt, Staphylococcus aureus subsp. aureus MW2
uuuuuuacauucguuu

SEQ ID NO: 4022638 - RNA, 21 nt, Staphylococcus aureus subsp. aureus MW2
uuuuuuaugcacaaaaaaauc

SEQ ID NO: 4022639 - RNA, 10 nt, Staphylococcus aureus subsp. aureus MW2
uuuuuuguua

SEQ ID NO: 4022640 - RNA, 23 nt, Staphylococcus aureus subsp. aureus MW2
uuuuuuguugguuuuuaaaagua

SEQ ID NO: 4022641 - RNA, 13 nt, Staphylococcus aureus subsp. aureus MW2
aaaaaaauauuua

SEQ ID NO: 4022642 - RNA, 15 nt, Staphylococcus aureus subsp. aureus MW2
aaaaaaauauuuaca

SEQ ID NO: 4022643 - RNA, 13 nt, Staphylococcus aureus subsp. aureus MW2
aaaaaaauuuuca

SEQ ID NO: 4022644 - RNA, 19 nt, Staphylococcus aureus subsp. aureus MW2
aaaaaacaaauguuuuaag

SEQ ID NO: 4022645 - RNA, 14 nt, Staphylococcus aureus subsp. aureus MW2
aaaaaacaguguag

SEQ ID NO: 4022646 - RNA, 10 nt, Staphylococcus aureus subsp. aureus MW2
aaaaaagcca

SEQ ID NO: 4022647 - RNA, 10 nt, Staphylococcus aureus subsp. aureus MW2
aaaaaaggaa

SEQ ID NO: 4022648 - RNA, 11 nt, Staphylococcus aureus subsp. aureus MW2
aaaaaaggaaa

SEQ ID NO: 4022649 - RNA, 15 nt, Staphylococcus aureus subsp. aureus MW2
aaaaaagugguuuaa

SEQ ID NO: 4022650 - RNA, 17 nt, Staphylococcus aureus subsp. aureus MW2
aaaaaaguugauuaaaa

SEQ ID NO: 4022651 - RNA, 13 nt, Staphylococcus aureus subsp. aureus MW2
aaaaaauaaaugu

SEQ ID NO: 4022652 - RNA, 18 nt, Staphylococcus aureus subsp. aureus MW2
aaaaaauaaauguuaaag

SEQ ID NO: 4022653 - RNA, 21 nt, Staphylococcus aureus subsp. aureus MW2
aaaaaauaaauguuaaagauu

SEQ ID NO: 4022654 - RNA, 12 nt, Staphylococcus aureus subsp. aureus MW2
aaaaaauaauag

SEQ ID NO: 4022655 - RNA, 12 nt, Staphylococcus aureus subsp. aureus MW2
aaaaaauaaugc

SEQ ID NO: 4022656 - RNA, 16 nt, Staphylococcus aureus subsp. aureus MW2
aaaaaaucgaacaaau

SEQ ID NO: 4022657 - RNA, 13 nt, Staphylococcus aureus subsp. aureus MW2
aaaaaaucgaauu

SEQ ID NO: 4022658 - RNA, 14 nt, Staphylococcus aureus subsp. aureus MW2
aaaaaaugaauguu

SEQ ID NO: 4022659 - RNA, 13 nt, Staphylococcus aureus subsp. aureus MW2
aaaaaauuaaaau

SEQ ID NO: 4022660 - RNA, 16 nt, Staphylococcus aureus subsp. aureus MW2
aaaaaauuaaaauguu

SEQ ID NO: 4022661 - RNA, 13 nt, Staphylococcus aureus subsp. aureus MW2
aaaaaauuguaua

SEQ ID NO: 4022662 - RNA, 12 nt, Staphylococcus aureus subsp. aureus MW2
aaaaaauuuaaa

SEQ ID NO: 4022663 - RNA, 13 nt, Staphylococcus aureus subsp. aureus MW2
aaaaaauuuaaau

SEQ ID NO: 4022664 - RNA, 15 nt, Staphylococcus aureus subsp. aureus MW2
aaaaaauuuucauuu

SEQ ID NO: 4022665 - RNA, 13 nt, Staphylococcus aureus subsp. aureus MW2
aaaaacaaaaaau

SEQ ID NO: 4022666 - RNA, 15 nt, Staphylococcus aureus subsp. aureus MW2
aaaaacaaauguuuu

SEQ ID NO: 4022667 - RNA, 14 nt, Staphylococcus aureus subsp. aureus MW2
aaaaacaauaaaau

SEQ ID NO: 4022668 - RNA, 18 nt, Staphylococcus aureus subsp. aureus MW2
aaaaacaauaaaauuacu

SEQ ID NO: 4022669 - RNA, 12 nt, Staphylococcus aureus subsp. aureus MW2
aaaaacagcagu

SEQ ID NO: 4022670 - RNA, 16 nt, Staphylococcus aureus subsp. aureus MW2
aaaaacagcaguaaga

SEQ ID NO: 4022671 - RNA, 14 nt, Staphylococcus aureus subsp. aureus MW2
aaaaacauaaaaau

SEQ ID NO: 4022672 - RNA, 17 nt, Staphylococcus aureus subsp. aureus MW2
aaaaacaucgauugaua

SEQ ID NO: 4022673 - RNA, 18 nt, Staphylococcus aureus subsp. aureus MW2
aaaaacaucgauugauaa

SEQ ID NO: 4022674 - RNA, 20 nt, Staphylococcus aureus subsp. aureus MW2
aaaaacaucuacaucaaauu

SEQ ID NO: 4022675 - RNA, 21 nt, Staphylococcus aureus subsp. aureus MW2
aaaaaccgaacaucugaaaaa

SEQ ID NO: 4022676 - RNA, 15 nt, Staphylococcus aureus subsp. aureus MW2
aaaaacgcuuuuaaa

SEQ ID NO: 4022677 - RNA, 23 nt, Staphylococcus aureus subsp. aureus MW2
aaaaacgguacagauaagaauau

SEQ ID NO: 4022678 - RNA, 19 nt, Staphylococcus aureus subsp. aureus MW2
aaaaacuguaaaucaucau

SEQ ID NO: 4022679 - RNA, 16 nt, Staphylococcus aureus subsp. aureus MW2
aaaaacuugugaauuu

SEQ ID NO: 4022680 - RNA, 19 nt, Staphylococcus aureus subsp. aureus MW2
aaaaagaguuaauaaaauu

SEQ ID NO: 4022681 - RNA, 16 nt, Staphylococcus aureus subsp. aureus MW2
aaaaagcaguaagaga

SEQ ID NO: 4022682 - RNA, 20 nt, Staphylococcus aureus subsp. aureus MW2
aaaaagcaguaaguugauuu

SEQ ID NO: 4022683 - RNA, 18 nt, Staphylococcus aureus subsp. aureus MW2
aaaaagcgccaauacaga

SEQ ID NO: 4022684 - RNA, 16 nt, Staphylococcus aureus subsp. aureus MW2
aaaaagcuaauucuua

SEQ ID NO: 4022685 - RNA, 19 nt, Staphylococcus aureus subsp. aureus MW2
aaaaagcugauuucuauca

SEQ ID NO: 4022686 - RNA, 14 nt, Staphylococcus aureus subsp. aureus MW2
aaaacuaaucaaau

SEQ ID NO: 4022687 - RNA, 13 nt, Staphylococcus aureus subsp. aureus MW2
aaaacuaaugaua

SEQ ID NO: 4022688 - RNA, 14 nt, Staphylococcus aureus subsp. aureus MW2
aaaacuacauuugg

SEQ ID NO: 4022689 - RNA, 16 nt, Staphylococcus aureus subsp. aureus MW2
aaaacuacauuugguu

SEQ ID NO: 4022690 - RNA, 16 nt, Staphylococcus aureus subsp. aureus MW2
aaaacuacuucaucug

SEQ ID NO: 4022691 - RNA, 16 nt, Staphylococcus aureus subsp. aureus MW2
aaaacuauaauaaaga

SEQ ID NO: 4022692 - RNA, 16 nt, Staphylococcus aureus subsp. aureus MW2
aaaacuaucugauuaa

SEQ ID NO: 4022693 - RNA, 22 nt, Staphylococcus aureus subsp. aureus MW2
aaaacucaaaccuguuuggaaa

SEQ ID NO: 4022694 - RNA, 16 nt, Staphylococcus aureus subsp. aureus MW2
aaaacugaaguaaaaa

SEQ ID NO: 4022695 - RNA, 14 nt, Staphylococcus aureus subsp. aureus MW2
aaaacuuaaaauau

SEQ ID NO: 4022696 - RNA, 23 nt, Staphylococcus aureus subsp. aureus MW2
aaaacuuccugcuuuuuuuauaa

SEQ ID NO: 4022697 - RNA, 17 nt, Staphylococcus aureus subsp. aureus MW2
aaaacuugugaauuuuc

SEQ ID NO: 4022698 - RNA, 18 nt, Staphylococcus aureus subsp. aureus MW2
aaaagaauuauucaagua

SEQ ID NO: 4022699 - RNA, 13 nt, Staphylococcus aureus subsp. aureus MW2
aaaagacaaucuc

SEQ ID NO: 4022700 - RNA, 14 nt, Staphylococcus aureus subsp. aureus MW2
aaaagacagaaauu

SEQ ID NO: 4022701 - RNA, 20 nt, Staphylococcus aureus subsp. aureus MW2
aaaagacuacaaguuauuau

SEQ ID NO: 4022702 - RNA, 12 nt, Staphylococcus aureus subsp. aureus MW2
aaaagagaccuu

SEQ ID NO: 4022703 - RNA, 20 nt, Staphylococcus aureus subsp. aureus MW2
aaaagagggaccuuacuacu

SEQ ID NO: 4022704 - RNA, 16 nt, Staphylococcus aureus subsp. aureus MW2
aaaagaguuaauaaaa

SEQ ID NO: 4022705 - RNA, 17 nt, Staphylococcus aureus subsp. aureus MW2
aaaagauauaaacauuu

SEQ ID NO: 4022706 - RNA, 22 nt, Staphylococcus aureus subsp. aureus MW2
aaaagauccugccauuaaacga

SEQ ID NO: 4022707 - RNA, 17 nt, Staphylococcus aureus subsp. aureus MW2
aaaagauucggaaaaua

SEQ ID NO: 4022708 - RNA, 16 nt, Staphylococcus aureus subsp. aureus MW2
aaaagcagcaguaaga

SEQ ID NO: 4022709 - RNA, 17 nt, Staphylococcus aureus subsp. aureus MW2
aaaagcaggcaagcuau

SEQ ID NO: 4022710 - RNA, 19 nt, Staphylococcus aureus subsp. aureus MW2
aaaagcccccuuuucacaa

SEQ ID NO: 4022711 - RNA, 17 nt, Staphylococcus aureus subsp. aureus MW2
aaaagcggacugaaaga

SEQ ID NO: 4022712 - RNA, 14 nt, Staphylococcus aureus subsp. aureus MW2
aaaagcuaaagagu

SEQ ID NO: 4022713 - RNA, 20 nt, Staphylococcus aureus subsp. aureus MW2
aaaaggaagaacagcacauu

SEQ ID NO: 4022714 - RNA, 16 nt, Staphylococcus aureus subsp. aureus MW2
aaaaggcucauuuguu

SEQ ID NO: 4022715 - RNA, 13 nt, Staphylococcus aureus subsp. aureus MW2
aaaagggcaaaaa

SEQ ID NO: 4022716 - RNA, 15 nt, Staphylococcus aureus subsp. aureus MW2
aaaaggucaaaaaau

SEQ ID NO: 4022717 - RNA, 22 nt, Staphylococcus aureus subsp. aureus MW2
aaaaggucuauguacaaucauu

SEQ ID NO: 4022718 - RNA, 23 nt, Staphylococcus aureus subsp. aureus MW2
aaaaggugugggcuuuauuauca

SEQ ID NO: 4022719 - RNA, 16 nt, Staphylococcus aureus subsp. aureus MW2
aaaagguuagauggau

SEQ ID NO: 4022720 - RNA, 17 nt, Staphylococcus aureus subsp. aureus MW2
aaaagguuagauggauu

SEQ ID NO: 4022721 - RNA, 14 nt, Staphylococcus aureus subsp. aureus MW2
aaaaguaaguaaaa

SEQ ID NO: 4022722 - RNA, 15 nt, Staphylococcus aureus subsp. aureus MW2
aaaaguaaguaaaau

SEQ ID NO: 4022723 - RNA, 17 nt, Staphylococcus aureus subsp. aureus MW2
aaaaguaaguaaaauaa

SEQ ID NO: 4022724 - RNA, 17 nt, Staphylococcus aureus subsp. aureus MW2
aaaaguaauuaaauacu

SEQ ID NO: 4022725 - RNA, 22 nt, Staphylococcus aureus subsp. aureus MW2
aaaaguacuuuaaaauuguaua

SEQ ID NO: 4022726 - RNA, 14 nt, Staphylococcus aureus subsp. aureus MW2
aaaaguauaugaau

SEQ ID NO: 4022727 - RNA, 21 nt, Staphylococcus aureus subsp. aureus MW2
aaaaguauugccguuauuuuc

SEQ ID NO: 4022728 - RNA, 23 nt, Staphylococcus aureus subsp. aureus MW2
aaaaguauugccguuauuuucaa

SEQ ID NO: 4022729 - RNA, 16 nt, Staphylococcus aureus subsp. aureus MW2
aaaagucgauaaauau

SEQ ID NO: 4022730 - RNA, 14 nt, Staphylococcus aureus subsp. aureus MW2
aaaagucgucaaaa

SEQ ID NO: 4022731 - RNA, 20 nt, Staphylococcus aureus subsp. aureus MW2
aaaagugaauaauugagaaa

SEQ ID NO: 4022732 - RNA, 18 nt, Staphylococcus aureus subsp. aureus MW2
aaaaguggccuuuuaaac

SEQ ID NO: 4022733 - RNA, 23 nt, Staphylococcus aureus subsp. aureus MW2
aaaaguggucguuuauuuuaaau

SEQ ID NO: 4022734 - RNA, 23 nt, Staphylococcus aureus subsp. aureus MW2
aaaagugguuaauaacagaguug

SEQ ID NO: 4022735 - RNA, 16 nt, Staphylococcus aureus subsp. aureus MW2
aaaagugguuguuccc

SEQ ID NO: 4022736 - RNA, 14 nt, Staphylococcus aureus subsp. aureus MW2
aaaagugguuuaau

SEQ ID NO: 4022737 - RNA, 13 nt, Staphylococcus aureus subsp. aureus MW2
aaaaguguaaugu

SEQ ID NO: 4022738 - RNA, 19 nt, Staphylococcus aureus subsp. aureus MW2
aaaaguguugacuuuauca

SEQ ID NO: 4022739 - RNA, 20 nt, Staphylococcus aureus subsp. aureus MW2
aaaaguuaggcgacuuaacu

SEQ ID NO: 4022740 - RNA, 13 nt, Staphylococcus aureus subsp. aureus MW2
aaaaguuuaaagu

SEQ ID NO: 4022741 - RNA, 20 nt, Staphylococcus aureus subsp. aureus MW2
aaaaguuuaggucaguccau

SEQ ID NO: 4022742 - RNA, 12 nt, Staphylococcus aureus subsp. aureus MW2
aaaauaaaaacc

SEQ ID NO: 4022743 - RNA, 13 nt, Staphylococcus aureus subsp. aureus MW2
aaaauaaaaacuu

SEQ ID NO: 4022744 - RNA, 15 nt, Staphylococcus aureus subsp. aureus MW2
aaaauaaaaaugccg

SEQ ID NO: 4022745 - RNA, 17 nt, Staphylococcus aureus subsp. aureus MW2
aaaauaaaaugcaaaga

SEQ ID NO: 4022746 - RNA, 14 nt, Staphylococcus aureus subsp. aureus MW2
aaaauaaauacaau

SEQ ID NO: 4022747 - RNA, 23 nt, Staphylococcus aureus subsp. aureus MW2
aaaauaaaucauacgagaaauua

SEQ ID NO: 4022748 - RNA, 23 nt, Staphylococcus aureus subsp. aureus MW2
aaaauaacauguuuguggcaccu

SEQ ID NO: 4022749 - RNA, 14 nt, Staphylococcus aureus subsp. aureus MW2
aaaauaaccauuca

SEQ ID NO: 4022750 - RNA, 16 nt, Staphylococcus aureus subsp. aureus MW2
aaaauaaccauucacu

SEQ ID NO: 4022751 - RNA, 19 nt, Staphylococcus aureus subsp. aureus MW2
aaaauaaccgcuuaauucu

SEQ ID NO: 4022752 - RNA, 17 nt, Staphylococcus aureus subsp. aureus MW2
aaaauaacuaagugaau

SEQ ID NO: 4022753 - RNA, 16 nt, Staphylococcus aureus subsp. aureus MW2
aaaauaauagauaaua

SEQ ID NO: 4022754 - RNA, 13 nt, Staphylococcus aureus subsp. aureus MW2
aaaauaaugauac

SEQ ID NO: 4022755 - RNA, 21 nt, Staphylococcus aureus subsp. aureus MW2
aaaauaauuaaacuuuaugaa

SEQ ID NO: 4022756 - RNA, 16 nt, Staphylococcus aureus subsp. aureus MW2
aaaauaauuaaauaaa

SEQ ID NO: 4022757 - RNA, 13 nt, Staphylococcus aureus subsp. aureus MW2
aaaauaauuuuau

SEQ ID NO: 4022758 - RNA, 19 nt, Staphylococcus aureus subsp. aureus MW2
aaaauacauaauuaacuuu

SEQ ID NO: 4022759 - RNA, 18 nt, Staphylococcus aureus subsp. aureus MW2
aaaauaccaacugcaaau

SEQ ID NO: 4022760 - RNA, 21 nt, Staphylococcus aureus subsp. aureus MW2
aaaauaccaacugcaaauaca

SEQ ID NO: 4022761 - RNA, 16 nt, Staphylococcus aureus subsp. aureus MW2
aaaauaccugcaauga

SEQ ID NO: 4022762 - RNA, 20 nt, Staphylococcus aureus subsp. aureus MW2
aaaauaccugcaaugaugau

SEQ ID NO: 4022763 - RNA, 16 nt, Staphylococcus aureus subsp. aureus MW2
aaaauacgauuuguuc

SEQ ID NO: 4022764 - RNA, 21 nt, Staphylococcus aureus subsp. aureus MW2
aaaauacuaagauuagcuaug

SEQ ID NO: 4022765 - RNA, 15 nt, Staphylococcus aureus subsp. aureus MW2
aaaauacuauacuga

SEQ ID NO: 4022766 - RNA, 18 nt, Staphylococcus aureus subsp. aureus MW2
aaaauacuguuuucauuu

SEQ ID NO: 4022767 - RNA, 14 nt, Staphylococcus aureus subsp. aureus MW2
aaaauagaaaaauu

SEQ ID NO: 4022768 - RNA, 19 nt, Staphylococcus aureus subsp. aureus MW2
aaaauagaaaaauuucaaa

SEQ ID NO: 4022769 - RNA, 15 nt, Staphylococcus aureus subsp. aureus MW2
aaaauagauugaaaa

SEQ ID NO: 4022770 - RNA, 22 nt, Staphylococcus aureus subsp. aureus MW2
aaaauagauugaaaaaauaacu

SEQ ID NO: 4022771 - RNA, 21 nt, Staphylococcus aureus subsp. aureus MW2
aaaauagcguaauuauuauaa

SEQ ID NO: 4022772 - RNA, 15 nt, Staphylococcus aureus subsp. aureus MW2
aaaauagcuauuaaa

SEQ ID NO: 4022773 - RNA, 16 nt, Staphylococcus aureus subsp. aureus MW2
aaaauagcuauuaaaa

SEQ ID NO: 4022774 - RNA, 20 nt, Staphylococcus aureus subsp. aureus MW2
aaaauagcuauuaaaauaga

SEQ ID NO: 4022775 - RNA, 14 nt, Staphylococcus aureus subsp. aureus MW2
aaaauuuguaauuu

SEQ ID NO: 4022776 - RNA, 13 nt, Staphylococcus aureus subsp. aureus MW2
aaaauuuucauuu

SEQ ID NO: 4022777 - RNA, 23 nt, Staphylococcus aureus subsp. aureus MW2
aaaauuuucuugguuugagaauc

SEQ ID NO: 4022778 - RNA, 14 nt, Staphylococcus aureus subsp. aureus MW2
aaaauuuugaagaa

SEQ ID NO: 4022779 - RNA, 14 nt, Staphylococcus aureus subsp. aureus MW2
aaaauuuugcaaaa

SEQ ID NO: 4022780 - RNA, 17 nt, Staphylococcus aureus subsp. aureus MW2
aaaauuuugcaaaaaaa

SEQ ID NO: 4022781 - RNA, 18 nt, Staphylococcus aureus subsp. aureus MW2
aaaauuuugcaaaaaaau

SEQ ID NO: 4022782 - RNA, 16 nt, Staphylococcus aureus subsp. aureus MW2
aaaauuuuuaaaaaaa

SEQ ID NO: 4022783 - RNA, 19 nt, Staphylococcus aureus subsp. aureus MW2
aaaauuuuuaaaaaaauaa

SEQ ID NO: 4022784 - RNA, 22 nt, Staphylococcus aureus subsp. aureus MW2
aaacaaaaaaccgaacaucuga

SEQ ID NO: 4022785 - RNA, 13 nt, Staphylococcus aureus subsp. aureus MW2
aaacaaaaaauaa

SEQ ID NO: 4022786 - RNA, 14 nt, Staphylococcus aureus subsp. aureus MW2
aaacaaaaaauaau

SEQ ID NO: 4022787 - RNA, 15 nt, Staphylococcus aureus subsp. aureus MW2
aaacaaaaaauaauu

SEQ ID NO: 4022788 - RNA, 13 nt, Staphylococcus aureus subsp. aureus MW2
aaacaaaaaauau

SEQ ID NO: 4022789 - RNA, 13 nt, Staphylococcus aureus subsp. aureus MW2
aaacaaaaauaag

SEQ ID NO: 4022790 - RNA, 14 nt, Staphylococcus aureus subsp. aureus MW2
aaacaaaacaaaaa

SEQ ID NO: 4022791 - RNA, 18 nt, Staphylococcus aureus subsp. aureus MW2
aaacaaaacuuaaaauau

SEQ ID NO: 4022792 - RNA, 14 nt, Staphylococcus aureus subsp. aureus MW2
aaacaaaagaaagu

SEQ ID NO: 4022793 - RNA, 13 nt, Staphylococcus aureus subsp. aureus MW2
aaacaaauaaaug

SEQ ID NO: 4022794 - RNA, 14 nt, Staphylococcus aureus subsp. aureus MW2
aaacaaauaaaugu

SEQ ID NO: 4022795 - RNA, 21 nt, Staphylococcus aureus subsp. aureus MW2
aaacaaauguuuuaaguuguu

SEQ ID NO: 4022796 - RNA, 13 nt, Staphylococcus aureus subsp. aureus MW2
aaacaaauuacac

SEQ ID NO: 4022797 - RNA, 21 nt, Staphylococcus aureus subsp. aureus MW2
aaacaacaaucaaauuacaaa

SEQ ID NO: 4022798 - RNA, 13 nt, Staphylococcus aureus subsp. aureus MW2
aaacaacaucacu

SEQ ID NO: 4022799 - RNA, 15 nt, Staphylococcus aureus subsp. aureus MW2
aaacaacaucgauuu

SEQ ID NO: 4022800 - RNA, 20 nt, Staphylococcus aureus subsp. aureus MW2
aaacaacuucugaaacgccu

SEQ ID NO: 4022801 - RNA, 14 nt, Staphylococcus aureus subsp. aureus MW2
aaacaagaauaaau

SEQ ID NO: 4022802 - RNA, 18 nt, Staphylococcus aureus subsp. aureus MW2
aaacaagaauaaauccca

SEQ ID NO: 4022803 - RNA, 19 nt, Staphylococcus aureus subsp. aureus MW2
aaacaagaauaaaucccau

SEQ ID NO: 4022804 - RNA, 15 nt, Staphylococcus aureus subsp. aureus MW2
aaacaagauuccuaa

SEQ ID NO: 4022805 - RNA, 22 nt, Staphylococcus aureus subsp. aureus MW2
aaacaagauuccuaaagaauau

SEQ ID NO: 4022806 - RNA, 19 nt, Staphylococcus aureus subsp. aureus MW2
aaacaagccuuaaaauauu

SEQ ID NO: 4022807 - RNA, 20 nt, Staphylococcus aureus subsp. aureus MW2
aaacaagcuagaaacacaua

SEQ ID NO: 4022808 - RNA, 20 nt, Staphylococcus aureus subsp. aureus MW2
aaacaauaaaaaaccaagug

SEQ ID NO: 4022809 - RNA, 13 nt, Staphylococcus aureus subsp. aureus MW2
aaacaauaauuua

SEQ ID NO: 4022810 - RNA, 17 nt, Staphylococcus aureus subsp. aureus MW2
aaacaaugauuacuuua

SEQ ID NO: 4022811 - RNA, 13 nt, Staphylococcus aureus subsp. aureus MW2
aaacaauuuaaaa

SEQ ID NO: 4022812 - RNA, 16 nt, Staphylococcus aureus subsp. aureus MW2
aaacacaaauaaaagc

SEQ ID NO: 4022813 - RNA, 15 nt, Staphylococcus aureus subsp. aureus MW2
aaacacaaggaauau

SEQ ID NO: 4022814 - RNA, 19 nt, Staphylococcus aureus subsp. aureus MW2
aaacacagacguuuuugaa

SEQ ID NO: 4022815 - RNA, 14 nt, Staphylococcus aureus subsp. aureus MW2
aaacacaguacaaa

SEQ ID NO: 4022816 - RNA, 18 nt, Staphylococcus aureus subsp. aureus MW2
aaacacaguacaaauaac

SEQ ID NO: 4022817 - RNA, 22 nt, Staphylococcus aureus subsp. aureus MW2
aaacacaguacaaauaacaaac

SEQ ID NO: 4022818 - RNA, 16 nt, Staphylococcus aureus subsp. aureus MW2
aaacacauaugcaggu

SEQ ID NO: 4022819 - RNA, 15 nt, Staphylococcus aureus subsp. aureus MW2
aaacacccaauaauu

SEQ ID NO: 4022820 - RNA, 17 nt, Staphylococcus aureus subsp. aureus MW2
aaacacccacaauugug

SEQ ID NO: 4022821 - RNA, 17 nt, Staphylococcus aureus subsp. aureus MW2
aaacacccugcuuauca

SEQ ID NO: 4022822 - RNA, 19 nt, Staphylococcus aureus subsp. aureus MW2
aaacacccugcuuaucauu

SEQ ID NO: 4022823 - RNA, 21 nt, Staphylococcus aureus subsp. aureus MW2
aaacaccuuucgcgacuucau

SEQ ID NO: 4022824 - RNA, 18 nt, Staphylococcus aureus subsp. aureus MW2
aaacacucaaaauguuua

SEQ ID NO: 4022825 - RNA, 22 nt, Staphylococcus aureus subsp. aureus MW2
aaacagaaauugcgaauuguua

SEQ ID NO: 4022826 - RNA, 18 nt, Staphylococcus aureus subsp. aureus MW2
aaacagcaaauaaaauca

SEQ ID NO: 4022827 - RNA, 16 nt, Staphylococcus aureus subsp. aureus MW2
aaacagcaguaagaua

SEQ ID NO: 4022828 - RNA, 17 nt, Staphylococcus aureus subsp. aureus MW2
aaacagcaguaagauau

SEQ ID NO: 4022829 - RNA, 13 nt, Staphylococcus aureus subsp. aureus MW2
aaacaguguagca

SEQ ID NO: 4022830 - RNA, 20 nt, Staphylococcus aureus subsp. aureus MW2
aaacauaaauacaaaaauau

SEQ ID NO: 4022831 - RNA, 14 nt, Staphylococcus aureus subsp. aureus MW2
aaacauaacaugac

SEQ ID NO: 4022832 - RNA, 15 nt, Staphylococcus aureus subsp. aureus MW2
aaacauaaucauaau

SEQ ID NO: 4022833 - RNA, 13 nt, Staphylococcus aureus subsp. aureus MW2
aaacauaaucauu

SEQ ID NO: 4022834 - RNA, 17 nt, Staphylococcus aureus subsp. aureus MW2
aaacauagagaauuuca

SEQ ID NO: 4022835 - RNA, 18 nt, Staphylococcus aureus subsp. aureus MW2
aaacauagagaauuucaa

SEQ ID NO: 4022836 - RNA, 14 nt, Staphylococcus aureus subsp. aureus MW2
aaacauaucaucau

SEQ ID NO: 4022837 - RNA, 13 nt, Staphylococcus aureus subsp. aureus MW2
aaacauaucuucu

SEQ ID NO: 4022838 - RNA, 15 nt, Staphylococcus aureus subsp. aureus MW2
aaacauauucauucu

SEQ ID NO: 4022839 - RNA, 19 nt, Staphylococcus aureus subsp. aureus MW2
aaacaucuucuucaucaua

SEQ ID NO: 4022840 - RNA, 15 nt, Staphylococcus aureus subsp. aureus MW2
aaacaugaacaauca

SEQ ID NO: 4022841 - RNA, 21 nt, Staphylococcus aureus subsp. aureus MW2
aaacaugcuuggacauauacu

SEQ ID NO: 4022842 - RNA, 20 nt, Staphylococcus aureus subsp. aureus MW2
aaacaugggcaaucacuccu

SEQ ID NO: 4022843 - RNA, 21 nt, Staphylococcus aureus subsp. aureus MW2
aaacauguacaauuuuuaaaa

SEQ ID NO: 4022844 - RNA, 14 nt, Staphylococcus aureus subsp. aureus MW2
aaacauuaaaauaa

SEQ ID NO: 4022845 - RNA, 16 nt, Staphylococcus aureus subsp. aureus MW2
aaacauuaaaauaauu

SEQ ID NO: 4022846 - RNA, 18 nt, Staphylococcus aureus subsp. aureus MW2
aaacauuaaaauaauuaa

SEQ ID NO: 4022847 - RNA, 17 nt, Staphylococcus aureus subsp. aureus MW2
aaacauuaaucuauaua

SEQ ID NO: 4022848 - RNA, 23 nt, Staphylococcus aureus subsp. aureus MW2
aaacauuaaucuauauaaaaacu

SEQ ID NO: 4022849 - RNA, 22 nt, Staphylococcus aureus subsp. aureus MW2
aaacauuacccuuuaaucucau

SEQ ID NO: 4022850 - RNA, 23 nt, Staphylococcus aureus subsp. aureus MW2
aaacauuacccuuuaaucucaug

SEQ ID NO: 4022851 - RNA, 20 nt, Staphylococcus aureus subsp. aureus MW2
aaacauucccuuaauaauaa

SEQ ID NO: 4022852 - RNA, 21 nt, Staphylococcus aureus subsp. aureus MW2
aaacauucccuuaauaauaag

SEQ ID NO: 4022853 - RNA, 12 nt, Staphylococcus aureus subsp. aureus MW2
aaacauuuagau

SEQ ID NO: 4022854 - RNA, 16 nt, Staphylococcus aureus subsp. aureus MW2
aaacauuuauauagau

SEQ ID NO: 4022855 - RNA, 23 nt, Staphylococcus aureus subsp. aureus MW2
aaacauuuauauagauugccauu

SEQ ID NO: 4022856 - RNA, 13 nt, Staphylococcus aureus subsp. aureus MW2
aaacauuuuauac

SEQ ID NO: 4022857 - RNA, 21 nt, Staphylococcus aureus subsp. aureus MW2
aaacauuuugugacuuuguuc

SEQ ID NO: 4022858 - RNA, 23 nt, Staphylococcus aureus subsp. aureus MW2
aaacauuuugugacuuuguucau

SEQ ID NO: 4022859 - RNA, 16 nt, Staphylococcus aureus subsp. aureus MW2
aaacauuuuuagaauc

SEQ ID NO: 4022860 - RNA, 14 nt, Staphylococcus aureus subsp. aureus MW2
aaaccaaaaauaau

SEQ ID NO: 4022861 - RNA, 20 nt, Staphylococcus aureus subsp. aureus MW2
aaaccaaaauacugagucau

SEQ ID NO: 4022862 - RNA, 17 nt, Staphylococcus aureus subsp. aureus MW2
aaaccaaugauuguuaa

SEQ ID NO: 4022863 - RNA, 15 nt, Staphylococcus aureus subsp. aureus MW2
aaaccaauuuuaacu

SEQ ID NO: 4022864 - RNA, 19 nt, Staphylococcus aureus subsp. aureus MW2
aaagauacaccaauauuuu

SEQ ID NO: 4022865 - RNA, 12 nt, Staphylococcus aureus subsp. aureus MW2
aaagauacugcu

SEQ ID NO: 4022866 - RNA, 13 nt, Staphylococcus aureus subsp. aureus MW2
aaagauauacuua

SEQ ID NO: 4022867 - RNA, 14 nt, Staphylococcus aureus subsp. aureus MW2
aaagauauguuuau

SEQ ID NO: 4022868 - RNA, 14 nt, Staphylococcus aureus subsp. aureus MW2
aaagauauuucugu

SEQ ID NO: 4022869 - RNA, 20 nt, Staphylococcus aureus subsp. aureus MW2
aaagaucguuuucaacauaa

SEQ ID NO: 4022870 - RNA, 14 nt, Staphylococcus aureus subsp. aureus MW2
aaagaugaaaaucu

SEQ ID NO: 4022871 - RNA, 21 nt, Staphylococcus aureus subsp. aureus MW2
aaagaugaaaaucuuuaacuc

SEQ ID NO: 4022872 - RNA, 17 nt, Staphylococcus aureus subsp. aureus MW2
aaagaugauauauucau

SEQ ID NO: 4022873 - RNA, 23 nt, Staphylococcus aureus subsp. aureus MW2
aaagaugguuuuguuuugcucuu

SEQ ID NO: 4022874 - RNA, 13 nt, Staphylococcus aureus subsp. aureus MW2
aaagauguugaaa

SEQ ID NO: 4022875 - RNA, 18 nt, Staphylococcus aureus subsp. aureus MW2
aaagauguugaaaaguau

SEQ ID NO: 4022876 - RNA, 12 nt, Staphylococcus aureus subsp. aureus MW2
aaagauuauuau

SEQ ID NO: 4022877 - RNA, 18 nt, Staphylococcus aureus subsp. aureus MW2
aaagauuauuauuacaau

SEQ ID NO: 4022878 - RNA, 18 nt, Staphylococcus aureus subsp. aureus MW2
aaagauuauugaaauuug

SEQ ID NO: 4022879 - RNA, 23 nt, Staphylococcus aureus subsp. aureus MW2
aaagauucggaaaauaugauaac

SEQ ID NO: 4022880 - RNA, 14 nt, Staphylococcus aureus subsp. aureus MW2
aaagcaaugucuug

SEQ ID NO: 4022881 - RNA, 16 nt, Staphylococcus aureus subsp. aureus MW2
aaagcaccuaaaauag

SEQ ID NO: 4022882 - RNA, 22 nt, Staphylococcus aureus subsp. aureus MW2
aaagcacuagccguuauuuuuu

SEQ ID NO: 4022883 - RNA, 16 nt, Staphylococcus aureus subsp. aureus MW2
aaagcacuauuuuuau

SEQ ID NO: 4022884 - RNA, 18 nt, Staphylococcus aureus subsp. aureus MW2
aaagcacuauuuuuauaa

SEQ ID NO: 4022885 - RNA, 19 nt, Staphylococcus aureus subsp. aureus MW2
aaagcaucuucaauauuua

SEQ ID NO: 4022886 - RNA, 22 nt, Staphylococcus aureus subsp. aureus MW2
aaagcaucuucaauauuuaaau

SEQ ID NO: 4022887 - RNA, 23 nt, Staphylococcus aureus subsp. aureus MW2
aaagcaucuucaauauuuaaauu

SEQ ID NO: 4022888 - RNA, 12 nt, Staphylococcus aureus subsp. aureus MW2
aaagcaucuuua

SEQ ID NO: 4022889 - RNA, 18 nt, Staphylococcus aureus subsp. aureus MW2
aaagccaucuaggucacu

SEQ ID NO: 4022890 - RNA, 14 nt, Staphylococcus aureus subsp. aureus MW2
aaagcgccaauaca

SEQ ID NO: 4022891 - RNA, 16 nt, Staphylococcus aureus subsp. aureus MW2
aaagcggacugaaaga

SEQ ID NO: 4022892 - RNA, 22 nt, Staphylococcus aureus subsp. aureus MW2
aaagcggguuggcgagaauuca

SEQ ID NO: 4022893 - RNA, 15 nt, Staphylococcus aureus subsp. aureus MW2
aaagcguaaggaauu

SEQ ID NO: 4022894 - RNA, 15 nt, Staphylococcus aureus subsp. aureus MW2
aaagcgucuuuuuau

SEQ ID NO: 4022895 - RNA, 20 nt, Staphylococcus aureus subsp. aureus MW2
aaagcgucuuuuuauacuug

SEQ ID NO: 4022896 - RNA, 16 nt, Staphylococcus aureus subsp. aureus MW2
aaagcgugguucccaa

SEQ ID NO: 4022897 - RNA, 14 nt, Staphylococcus aureus subsp. aureus MW2
aaagcuaaugcaag

SEQ ID NO: 4022898 - RNA, 16 nt, Staphylococcus aureus subsp. aureus MW2
aaagcuagaaguucuu

SEQ ID NO: 4022899 - RNA, 13 nt, Staphylococcus aureus subsp. aureus MW2
aaagcuauaaaaa

SEQ ID NO: 4022900 - RNA, 18 nt, Staphylococcus aureus subsp. aureus MW2
aaagcuauaaaaaaucuu

SEQ ID NO: 4022901 - RNA, 23 nt, Staphylococcus aureus subsp. aureus MW2
aaagcuauaaaaaaucuuuugau

SEQ ID NO: 4022902 - RNA, 19 nt, Staphylococcus aureus subsp. aureus MW2
aaagcuauguaugagucaa

SEQ ID NO: 4022903 - RNA, 16 nt, Staphylococcus aureus subsp. aureus MW2
aaagcugauuucuauu

SEQ ID NO: 4022904 - RNA, 15 nt, Staphylococcus aureus subsp. aureus MW2
aaagcugauuuuuca

SEQ ID NO: 4022905 - RNA, 23 nt, Staphylococcus aureus subsp. aureus MW2
aaagcuggggaagaccauuuuau

SEQ ID NO: 4022906 - RNA, 20 nt, Staphylococcus aureus subsp. aureus MW2
aaagcuguaguuucaacuuu

SEQ ID NO: 4022907 - RNA, 15 nt, Staphylococcus aureus subsp. aureus MW2
aaagcugucaacuug

SEQ ID NO: 4022908 - RNA, 16 nt, Staphylococcus aureus subsp. aureus MW2
aaagcuuauuaaauca

SEQ ID NO: 4022909 - RNA, 15 nt, Staphylococcus aureus subsp. aureus MW2
aaagcuucauauuua

SEQ ID NO: 4022910 - RNA, 20 nt, Staphylococcus aureus subsp. aureus MW2
aaagcuucgucaaugacuaa

SEQ ID NO: 4022911 - RNA, 21 nt, Staphylococcus aureus subsp. aureus MW2
aaagcuugauuuaacaaccuc

SEQ ID NO: 4022912 - RNA, 15 nt, Staphylococcus aureus subsp. aureus MW2
aaagcuuguaaucau

SEQ ID NO: 4022913 - RNA, 11 nt, Staphylococcus aureus subsp. aureus MW2
aaagcuuuaac

SEQ ID NO: 4022914 - RNA, 17 nt, Staphylococcus aureus subsp. aureus MW2
aaagcuuuaguuaaaua

SEQ ID NO: 4022915 - RNA, 16 nt, Staphylococcus aureus subsp. aureus MW2
aaagcuuuaugugguu

SEQ ID NO: 4022916 - RNA, 16 nt, Staphylococcus aureus subsp. aureus MW2
aaagcuuuuuugcuuu

SEQ ID NO: 4022917 - RNA, 15 nt, Staphylococcus aureus subsp. aureus MW2
aaaggaauguuuaaa

SEQ ID NO: 4022918 - RNA, 20 nt, Staphylococcus aureus subsp. aureus MW2
aaaggaauguuuaaaaaacu

SEQ ID NO: 4022919 - RNA, 16 nt, Staphylococcus aureus subsp. aureus MW2
aaaggaccacuuagau

SEQ ID NO: 4022920 - RNA, 15 nt, Staphylococcus aureus subsp. aureus MW2
aaaggauauugaaaa

SEQ ID NO: 4022921 - RNA, 23 nt, Staphylococcus aureus subsp. aureus MW2
aaaggaugaugugaauguuuugu

SEQ ID NO: 4022922 - RNA, 18 nt, Staphylococcus aureus subsp. aureus MW2
aaaggaugugacaaauac

SEQ ID NO: 4022923 - RNA, 15 nt, Staphylococcus aureus subsp. aureus MW2
aaaggcauucuucca

SEQ ID NO: 4022924 - RNA, 18 nt, Staphylococcus aureus subsp. aureus MW2
aaaggcguuagcuuacuu

SEQ ID NO: 4022925 - RNA, 17 nt, Staphylococcus aureus subsp. aureus MW2
aaaggcuagcuaaaauu

SEQ ID NO: 4022926 - RNA, 19 nt, Staphylococcus aureus subsp. aureus MW2
aaaggcuagcuaaaauuug

SEQ ID NO: 4022927 - RNA, 18 nt, Staphylococcus aureus subsp. aureus MW2
aaaggcucauuuguuaaa

SEQ ID NO: 4022928 - RNA, 23 nt, Staphylococcus aureus subsp. aureus MW2
aaagggcaacacucggaaacaug

SEQ ID NO: 4022929 - RNA, 18 nt, Staphylococcus aureus subsp. aureus MW2
aaagggcgaaauggauuc

SEQ ID NO: 4022930 - RNA, 17 nt, Staphylococcus aureus subsp. aureus MW2
aaagggcuauuugauac

SEQ ID NO: 4022931 - RNA, 14 nt, Staphylococcus aureus subsp. aureus MW2
aaaggguuauuaac

SEQ ID NO: 4022932 - RNA, 21 nt, Staphylococcus aureus subsp. aureus MW2
aaaggguuauuaacuuuaaua

SEQ ID NO: 4022933 - RNA, 16 nt, Staphylococcus aureus subsp. aureus MW2
aaagguaacuuuuuaa

SEQ ID NO: 4022934 - RNA, 18 nt, Staphylococcus aureus subsp. aureus MW2
aaagguaacuuuuuaacu

SEQ ID NO: 4022935 - RNA, 19 nt, Staphylococcus aureus subsp. aureus MW2
aaagguauucaaauaaaca

SEQ ID NO: 4022936 - RNA, 18 nt, Staphylococcus aureus subsp. aureus MW2
aaagguauucuauuuuuc

SEQ ID NO: 4022937 - RNA, 23 nt, Staphylococcus aureus subsp. aureus MW2
aaaggucuauauauauuuaaauc

SEQ ID NO: 4022938 - RNA, 23 nt, Staphylococcus aureus subsp. aureus MW2
aaaggucuauguacaaucauuag

SEQ ID NO: 4022939 - RNA, 23 nt, Staphylococcus aureus subsp. aureus MW2
aaagguuguuuuucaucauuaaa

SEQ ID NO: 4022940 - RNA, 13 nt, Staphylococcus aureus subsp. aureus MW2
aaaguaaguaaaa

SEQ ID NO: 4022941 - RNA, 15 nt, Staphylococcus aureus subsp. aureus MW2
aaaguaaguaaaaua

SEQ ID NO: 4022942 - RNA, 16 nt, Staphylococcus aureus subsp. aureus MW2
aaaguaaguaaaauaa

SEQ ID NO: 4022943 - RNA, 22 nt, Staphylococcus aureus subsp. aureus MW2
aaaguaauaauggcaauuaaaa

SEQ ID NO: 4022944 - RNA, 22 nt, Staphylococcus aureus subsp. aureus MW2
aaaguaauaugagugaaaguuu

SEQ ID NO: 4022945 - RNA, 13 nt, Staphylococcus aureus subsp. aureus MW2
aaaguaaucaguu

SEQ ID NO: 4022946 - RNA, 14 nt, Staphylococcus aureus subsp. aureus MW2
aaaguaaugcuuua

SEQ ID NO: 4022947 - RNA, 14 nt, Staphylococcus aureus subsp. aureus MW2
aaaguaauuaaaua

SEQ ID NO: 4022948 - RNA, 17 nt, Staphylococcus aureus subsp. aureus MW2
aaaguaauuaaauacuu

SEQ ID NO: 4022949 - RNA, 19 nt, Staphylococcus aureus subsp. aureus MW2
aaaguacaaguugaucaaa

SEQ ID NO: 4022950 - RNA, 23 nt, Staphylococcus aureus subsp. aureus MW2
aaaguacaaguugaucaaaaaug

SEQ ID NO: 4022951 - RNA, 19 nt, Staphylococcus aureus subsp. aureus MW2
aaaguaccgguuuuucaua

SEQ ID NO: 4022952 - RNA, 12 nt, Staphylococcus aureus subsp. aureus MW2
aaauaauuuaau

SEQ ID NO: 4022953 - RNA, 14 nt, Staphylococcus aureus subsp. aureus MW2
aaauaauuuaauuu

SEQ ID NO: 4022954 - RNA, 17 nt, Staphylococcus aureus subsp. aureus MW2
aaauaauuuaauuuuuu

SEQ ID NO: 4022955 - RNA, 17 nt, Staphylococcus aureus subsp. aureus MW2
aaauaauuuagaaauau

SEQ ID NO: 4022956 - RNA, 19 nt, Staphylococcus aureus subsp. aureus MW2
aaauacaaagccuuaauau

SEQ ID NO: 4022957 - RNA, 17 nt, Staphylococcus aureus subsp. aureus MW2
aaauacaauuucuucau

SEQ ID NO: 4022958 - RNA, 20 nt, Staphylococcus aureus subsp. aureus MW2
aaauacaauuucuucauuuu

SEQ ID NO: 4022959 - RNA, 16 nt, Staphylococcus aureus subsp. aureus MW2
aaauacauaauaaaaa

SEQ ID NO: 4022960 - RNA, 14 nt, Staphylococcus aureus subsp. aureus MW2
aaauacauaauuaa

SEQ ID NO: 4022961 - RNA, 20 nt, Staphylococcus aureus subsp. aureus MW2
aaauacaucaacaucgaauu

SEQ ID NO: 4022962 - RNA, 19 nt, Staphylococcus aureus subsp. aureus MW2
aaauacauccauacuucua

SEQ ID NO: 4022963 - RNA, 22 nt, Staphylococcus aureus subsp. aureus MW2
aaauacaugugggauaucuucu

SEQ ID NO: 4022964 - RNA, 18 nt, Staphylococcus aureus subsp. aureus MW2
aaauaccaacugcaaaua

SEQ ID NO: 4022965 - RNA, 21 nt, Staphylococcus aureus subsp. aureus MW2
aaauaccaacugcaaauacac

SEQ ID NO: 4022966 - RNA, 17 nt, Staphylococcus aureus subsp. aureus MW2
aaauaccgucuucucua

SEQ ID NO: 4022967 - RNA, 15 nt, Staphylococcus aureus subsp. aureus MW2
aaauaccugcaauga

SEQ ID NO: 4022968 - RNA, 19 nt, Staphylococcus aureus subsp. aureus MW2
aaauacgacaccaacauau

SEQ ID NO: 4022969 - RNA, 19 nt, Staphylococcus aureus subsp. aureus MW2
aaauacguggcucuaaaaa

SEQ ID NO: 4022970 - RNA, 15 nt, Staphylococcus aureus subsp. aureus MW2
aaauacuaacaauua

SEQ ID NO: 4022971 - RNA, 17 nt, Staphylococcus aureus subsp. aureus MW2
aaauacuaguaauaaua

SEQ ID NO: 4022972 - RNA, 14 nt, Staphylococcus aureus subsp. aureus MW2
aaauacuauacuga

SEQ ID NO: 4022973 - RNA, 15 nt, Staphylococcus aureus subsp. aureus MW2
aaauacuauacugau

SEQ ID NO: 4022974 - RNA, 18 nt, Staphylococcus aureus subsp. aureus MW2
aaauacuauauauaauga

SEQ ID NO: 4022975 - RNA, 16 nt, Staphylococcus aureus subsp. aureus MW2
aaauacucauuauugu

SEQ ID NO: 4022976 - RNA, 19 nt, Staphylococcus aureus subsp. aureus MW2
aaauacucccuucaacaua

SEQ ID NO: 4022977 - RNA, 18 nt, Staphylococcus aureus subsp. aureus MW2
aaauacuguuuucauuug

SEQ ID NO: 4022978 - RNA, 20 nt, Staphylococcus aureus subsp. aureus MW2
aaauacuguuuucauuuguu

SEQ ID NO: 4022979 - RNA, 22 nt, Staphylococcus aureus subsp. aureus MW2
aaauacuguuuucauuuguuaa

SEQ ID NO: 4022980 - RNA, 17 nt, Staphylococcus aureus subsp. aureus MW2
aaauacuugaauguaag

SEQ ID NO: 4022981 - RNA, 14 nt, Staphylococcus aureus subsp. aureus MW2
aaauacuuuugcau

SEQ ID NO: 4022982 - RNA, 15 nt, Staphylococcus aureus subsp. aureus MW2
aaauagaaaaaacaa

SEQ ID NO: 4022983 - RNA, 17 nt, Staphylococcus aureus subsp. aureus MW2
aaauagaaacagcagua

SEQ ID NO: 4022984 - RNA, 18 nt, Staphylococcus aureus subsp. aureus MW2
aaauagacaccaaaaaca

SEQ ID NO: 4022985 - RNA, 13 nt, Staphylococcus aureus subsp. aureus MW2
aaauagaucgaac

SEQ ID NO: 4022986 - RNA, 16 nt, Staphylococcus aureus subsp. aureus MW2
aaauagaugagaaagu

SEQ ID NO: 4022987 - RNA, 14 nt, Staphylococcus aureus subsp. aureus MW2
aaauagauugaaaa

SEQ ID NO: 4022988 - RNA, 12 nt, Staphylococcus aureus subsp. aureus MW2
aaauagcaacac

SEQ ID NO: 4022989 - RNA, 16 nt, Staphylococcus aureus subsp. aureus MW2
aaauagccauaucaua

SEQ ID NO: 4022990 - RNA, 15 nt, Staphylococcus aureus subsp. aureus MW2
aaauagcgauuuuaa

SEQ ID NO: 4022991 - RNA, 16 nt, Staphylococcus aureus subsp. aureus MW2
aaauagcgauuuuaaa

SEQ ID NO: 4022992 - RNA, 21 nt, Staphylococcus aureus subsp. aureus MW2
aaauagcgauuuuaaagaaaa

SEQ ID NO: 4022993 - RNA, 16 nt, Staphylococcus aureus subsp. aureus MW2
aaauagcguaauuauu

SEQ ID NO: 4022994 - RNA, 16 nt, Staphylococcus aureus subsp. aureus MW2
aaauagcuauuaaaau

SEQ ID NO: 4022995 - RNA, 22 nt, Staphylococcus aureus subsp. aureus MW2
aaauagcugcaaucguugaaaa

SEQ ID NO: 4022996 - RNA, 14 nt, Staphylococcus aureus subsp. aureus MW2
aaauaggucacuuu

SEQ ID NO: 4022997 - RNA, 17 nt, Staphylococcus aureus subsp. aureus MW2
aaauaggucacuuuuaa

SEQ ID NO: 4022998 - RNA, 20 nt, Staphylococcus aureus subsp. aureus MW2
aaauaggucacuuuuaaucu

SEQ ID NO: 4022999 - RNA, 22 nt, Staphylococcus aureus subsp. aureus MW2
aaauaggugcuuguaaaauuuu

SEQ ID NO: 4023000 - RNA, 18 nt, Staphylococcus aureus subsp. aureus MW2
aaauagucggggccccaa

SEQ ID NO: 4023001 - RNA, 16 nt, Staphylococcus aureus subsp. aureus MW2
aaauagugaaauuaua

SEQ ID NO: 4023002 - RNA, 13 nt, Staphylococcus aureus subsp. aureus MW2
aaauaguuaagau

SEQ ID NO: 4023003 - RNA, 18 nt, Staphylococcus aureus subsp. aureus MW2
aaauaguuaagauuuuaa

SEQ ID NO: 4023004 - RNA, 19 nt, Staphylococcus aureus subsp. aureus MW2
aaauaguucaaaauacuca

SEQ ID NO: 4023005 - RNA, 20 nt, Staphylococcus aureus subsp. aureus MW2
aaauaguucaaauggacuaa

SEQ ID NO: 4023006 - RNA, 20 nt, Staphylococcus aureus subsp. aureus MW2
aaauaguucuuuaaauuaua

SEQ ID NO: 4023007 - RNA, 23 nt, Staphylococcus aureus subsp. aureus MW2
aaauaguuuuucauauucacauc

SEQ ID NO: 4023008 - RNA, 19 nt, Staphylococcus aureus subsp. aureus MW2
aaauauaaaauccuaagca

SEQ ID NO: 4023009 - RNA, 19 nt, Staphylococcus aureus subsp. aureus MW2
aaauauaauagaaauaauc

SEQ ID NO: 4023010 - RNA, 20 nt, Staphylococcus aureus subsp. aureus MW2
aaauauaauagaaauaauca

SEQ ID NO: 4023011 - RNA, 15 nt, Staphylococcus aureus subsp. aureus MW2
aaauauaccaaccaa

SEQ ID NO: 4023012 - RNA, 17 nt, Staphylococcus aureus subsp. aureus MW2
aaauauaccaaccaaaa

SEQ ID NO: 4023013 - RNA, 18 nt, Staphylococcus aureus subsp. aureus MW2
aaauauacuaaauuugaa

SEQ ID NO: 4023014 - RNA, 21 nt, Staphylococcus aureus subsp. aureus MW2
aaauauacuucuauuaaauga

SEQ ID NO: 4023015 - RNA, 20 nt, Staphylococcus aureus subsp. aureus MW2
aaauauagcuauuagaauuu

SEQ ID NO: 4023016 - RNA, 17 nt, Staphylococcus aureus subsp. aureus MW2
aaauauaguaauaaaag

SEQ ID NO: 4023017 - RNA, 18 nt, Staphylococcus aureus subsp. aureus MW2
aaauauaguaauaaaagu

SEQ ID NO: 4023018 - RNA, 14 nt, Staphylococcus aureus subsp. aureus MW2
aaauauauauuacc

SEQ ID NO: 4023019 - RNA, 18 nt, Staphylococcus aureus subsp. aureus MW2
aaauauaucuagccugaa

SEQ ID NO: 4023020 - RNA, 19 nt, Staphylococcus aureus subsp. aureus MW2
aaauauaucuagccugaaa

SEQ ID NO: 4023021 - RNA, 13 nt, Staphylococcus aureus subsp. aureus MW2
aaauauauuauaa

SEQ ID NO: 4023022 - RNA, 12 nt, Staphylococcus aureus subsp. aureus MW2
aaauaucacuaa

SEQ ID NO: 4023023 - RNA, 15 nt, Staphylococcus aureus subsp. aureus MW2
aaauaucaugcaaaa

SEQ ID NO: 4023024 - RNA, 19 nt, Staphylococcus aureus subsp. aureus MW2
aaauaucaugcaaaacuaa

SEQ ID NO: 4023025 - RNA, 20 nt, Staphylococcus aureus subsp. aureus MW2
aaauaucgacaaauuaaaaa

SEQ ID NO: 4023026 - RNA, 17 nt, Staphylococcus aureus subsp. aureus MW2
aaauaucuaaacaauuc

SEQ ID NO: 4023027 - RNA, 16 nt, Staphylococcus aureus subsp. aureus MW2
aaauaucuuuuucuaa

SEQ ID NO: 4023028 - RNA, 18 nt, Staphylococcus aureus subsp. aureus MW2
aaauaucuuuuuguuuau

SEQ ID NO: 4023029 - RNA, 12 nt, Staphylococcus aureus subsp. aureus MW2
aaauaugaaaag

SEQ ID NO: 4023030 - RNA, 14 nt, Staphylococcus aureus subsp. aureus MW2
aaauaugaaaagag

SEQ ID NO: 4023031 - RNA, 18 nt, Staphylococcus aureus subsp. aureus MW2
aaauaugaauaaugcaau

SEQ ID NO: 4023032 - RNA, 15 nt, Staphylococcus aureus subsp. aureus MW2
aaauaugacacauac

SEQ ID NO: 4023033 - RNA, 16 nt, Staphylococcus aureus subsp. aureus MW2
aaauaugcacuuuuua

SEQ ID NO: 4023034 - RNA, 21 nt, Staphylococcus aureus subsp. aureus MW2
aaauaugcuuuaggugaguua

SEQ ID NO: 4023035 - RNA, 15 nt, Staphylococcus aureus subsp. aureus MW2
aaauauggauuuuga

SEQ ID NO: 4023036 - RNA, 21 nt, Staphylococcus aureus subsp. aureus MW2
aaauauguauguuuuaucaau

SEQ ID NO: 4023037 - RNA, 13 nt, Staphylococcus aureus subsp. aureus MW2
aaauauguuuaau

SEQ ID NO: 4023038 - RNA, 18 nt, Staphylococcus aureus subsp. aureus MW2
aaauauuaauauaaaaua

SEQ ID NO: 4023039 - RNA, 13 nt, Staphylococcus aureus subsp. aureus MW2
aaauauuaaucaa

SEQ ID NO: 4023040 - RNA, 16 nt, Staphylococcus aureus subsp. aureus MW2
aaauauuaauuuauaa

SEQ ID NO: 4023041 - RNA, 13 nt, Staphylococcus aureus subsp. aureus MW2
aaaugaaccauuu

SEQ ID NO: 4023042 - RNA, 18 nt, Staphylococcus aureus subsp. aureus MW2
aaaugaagguguugaaaa

SEQ ID NO: 4023043 - RNA, 21 nt, Staphylococcus aureus subsp. aureus MW2
aaaugaagucuuucaacaaaa

SEQ ID NO: 4023044 - RNA, 22 nt, Staphylococcus aureus subsp. aureus MW2
aaaugaagucuuucaacaaaau

SEQ ID NO: 4023045 - RNA, 13 nt, Staphylococcus aureus subsp. aureus MW2
aaaugaauaauua

SEQ ID NO: 4023046 - RNA, 19 nt, Staphylococcus aureus subsp. aureus MW2
aaaugaaugaagacgaaua

SEQ ID NO: 4023047 - RNA, 14 nt, Staphylococcus aureus subsp. aureus MW2
aaaugaauuauuua

SEQ ID NO: 4023048 - RNA, 21 nt, Staphylococcus aureus subsp. aureus MW2
aaaugaauuauuuaaaaugcu

SEQ ID NO: 4023049 - RNA, 15 nt, Staphylococcus aureus subsp. aureus MW2
aaaugaauugcuugu

SEQ ID NO: 4023050 - RNA, 21 nt, Staphylococcus aureus subsp. aureus MW2
aaaugacauggaaaauauauu

SEQ ID NO: 4023051 - RNA, 16 nt, Staphylococcus aureus subsp. aureus MW2
aaaugacuaccuguug

SEQ ID NO: 4023052 - RNA, 21 nt, Staphylococcus aureus subsp. aureus MW2
aaaugacugaauuaauaucca

SEQ ID NO: 4023053 - RNA, 21 nt, Staphylococcus aureus subsp. aureus MW2
aaaugagcugaacuuucuuua

SEQ ID NO: 4023054 - RNA, 12 nt, Staphylococcus aureus subsp. aureus MW2
aaaugauaagaa

SEQ ID NO: 4023055 - RNA, 15 nt, Staphylococcus aureus subsp. aureus MW2
aaaugauacauuauu

SEQ ID NO: 4023056 - RNA, 20 nt, Staphylococcus aureus subsp. aureus MW2
aaaugauagggcauugagau

SEQ ID NO: 4023057 - RNA, 13 nt, Staphylococcus aureus subsp. aureus MW2
aaaugauaucuau

SEQ ID NO: 4023058 - RNA, 19 nt, Staphylococcus aureus subsp. aureus MW2
aaaugaugcaguaaaacca

SEQ ID NO: 4023059 - RNA, 20 nt, Staphylococcus aureus subsp. aureus MW2
aaaugauguaacguuucuuu

SEQ ID NO: 4023060 - RNA, 13 nt, Staphylococcus aureus subsp. aureus MW2
aaaugauuaauaa

SEQ ID NO: 4023061 - RNA, 18 nt, Staphylococcus aureus subsp. aureus MW2
aaaugauuguuuuaagug

SEQ ID NO: 4023062 - RNA, 14 nt, Staphylococcus aureus subsp. aureus MW2
aaaugauuucacuu

SEQ ID NO: 4023063 - RNA, 15 nt, Staphylococcus aureus subsp. aureus MW2
aaaugauuucacuuc

SEQ ID NO: 4023064 - RNA, 18 nt, Staphylococcus aureus subsp. aureus MW2
aaaugcaaagacuaaaaa

SEQ ID NO: 4023065 - RNA, 22 nt, Staphylococcus aureus subsp. aureus MW2
aaaugcaauacaccuauuacac

SEQ ID NO: 4023066 - RNA, 13 nt, Staphylococcus aureus subsp. aureus MW2
aaaugcaauaugu

SEQ ID NO: 4023067 - RNA, 14 nt, Staphylococcus aureus subsp. aureus MW2
aaaugcaauuuuuc

SEQ ID NO: 4023068 - RNA, 21 nt, Staphylococcus aureus subsp. aureus MW2
aaaugcaauuuuucacuuaua

SEQ ID NO: 4023069 - RNA, 19 nt, Staphylococcus aureus subsp. aureus MW2
aaaugcacuagcaacaucu

SEQ ID NO: 4023070 - RNA, 19 nt, Staphylococcus aureus subsp. aureus MW2
aaaugcagcuguauaacca

SEQ ID NO: 4023071 - RNA, 15 nt, Staphylococcus aureus subsp. aureus MW2
aaaugcauaauauau

SEQ ID NO: 4023072 - RNA, 16 nt, Staphylococcus aureus subsp. aureus MW2
aaaugcauaauauauu

SEQ ID NO: 4023073 - RNA, 13 nt, Staphylococcus aureus subsp. aureus MW2
aaaugcauuacua

SEQ ID NO: 4023074 - RNA, 21 nt, Staphylococcus aureus subsp. aureus MW2
aaaugccucugcaacgccuuu

SEQ ID NO: 4023075 - RNA, 20 nt, Staphylococcus aureus subsp. aureus MW2
aaaugcgcuuccaauuuaaa

SEQ ID NO: 4023076 - RNA, 17 nt, Staphylococcus aureus subsp. aureus MW2
aaaugcuacaauuuccu

SEQ ID NO: 4023077 - RNA, 15 nt, Staphylococcus aureus subsp. aureus MW2
aaaugcuacaucaau

SEQ ID NO: 4023078 - RNA, 20 nt, Staphylococcus aureus subsp. aureus MW2
aaaugcuuaagaaauuuuuu

SEQ ID NO: 4023079 - RNA, 20 nt, Staphylococcus aureus subsp. aureus MW2
aaaugcuuaauaaaaucaaa

SEQ ID NO: 4023080 - RNA, 10 nt, Staphylococcus aureus subsp. aureus MW2
aaaugcuucu

SEQ ID NO: 4023081 - RNA, 12 nt, Staphylococcus aureus subsp. aureus MW2
aaaugcuuuaaa

SEQ ID NO: 4023082 - RNA, 10 nt, Staphylococcus aureus subsp. aureus MW2
aaaugcuuuc

SEQ ID NO: 4023083 - RNA, 16 nt, Staphylococcus aureus subsp. aureus MW2
aaaugcuuuuuugaaa

SEQ ID NO: 4023084 - RNA, 23 nt, Staphylococcus aureus subsp. aureus MW2
aaauggcaucuggcaaauugccu

SEQ ID NO: 4023085 - RNA, 17 nt, Staphylococcus aureus subsp. aureus MW2
aaauguaaaaucauuaa

SEQ ID NO: 4023086 - RNA, 23 nt, Staphylococcus aureus subsp. aureus MW2
aaauguaaaaucauuaauaauua

SEQ ID NO: 4023087 - RNA, 19 nt, Staphylococcus aureus subsp. aureus MW2
aaauguaaauaaaaauuau

SEQ ID NO: 4023088 - RNA, 15 nt, Staphylococcus aureus subsp. aureus MW2
aaauguaacauuaaa

SEQ ID NO: 4023089 - RNA, 23 nt, Staphylococcus aureus subsp. aureus MW2
aaauguaacauuaaaaauaaaag

SEQ ID NO: 4023090 - RNA, 15 nt, Staphylococcus aureus subsp. aureus MW2
aaauguacauuguaa

SEQ ID NO: 4023091 - RNA, 22 nt, Staphylococcus aureus subsp. aureus MW2
aaauguauuauucucucauuug

SEQ ID NO: 4023092 - RNA, 16 nt, Staphylococcus aureus subsp. aureus MW2
aaaugucaguuuugaa

SEQ ID NO: 4023093 - RNA, 19 nt, Staphylococcus aureus subsp. aureus MW2
aaaugucaguuuugaagaa

SEQ ID NO: 4023094 - RNA, 21 nt, Staphylococcus aureus subsp. aureus MW2
aaaugucaguuuugaagaaua

SEQ ID NO: 4023095 - RNA, 14 nt, Staphylococcus aureus subsp. aureus MW2
aaaugucauuugaa

SEQ ID NO: 4023096 - RNA, 17 nt, Staphylococcus aureus subsp. aureus MW2
aaaugucguauauguaa

SEQ ID NO: 4023097 - RNA, 18 nt, Staphylococcus aureus subsp. aureus MW2
aaaugucuuugaaaaauu

SEQ ID NO: 4023098 - RNA, 15 nt, Staphylococcus aureus subsp. aureus MW2
aaauguuaaagauua

SEQ ID NO: 4023099 - RNA, 16 nt, Staphylococcus aureus subsp. aureus MW2
aaauguuaaauucuaa

SEQ ID NO: 4023100 - RNA, 13 nt, Staphylococcus aureus subsp. aureus MW2
aaauguuaacgau

SEQ ID NO: 4023101 - RNA, 19 nt, Staphylococcus aureus subsp. aureus MW2
aaauguuaaugcuucguaa

SEQ ID NO: 4023102 - RNA, 21 nt, Staphylococcus aureus subsp. aureus MW2
aaauguuacacaaauuaaaac

SEQ ID NO: 4023103 - RNA, 23 nt, Staphylococcus aureus subsp. aureus MW2
aaauguuauuaaccaacaugaca

SEQ ID NO: 4023104 - RNA, 14 nt, Staphylococcus aureus subsp. aureus MW2
aaauguuauugcuu

SEQ ID NO: 4023105 - RNA, 15 nt, Staphylococcus aureus subsp. aureus MW2
aaauguuauugcuua

SEQ ID NO: 4023106 - RNA, 22 nt, Staphylococcus aureus subsp. aureus MW2
aaauguuauugcuuauuuuugu

SEQ ID NO: 4023107 - RNA, 14 nt, Staphylococcus aureus subsp. aureus MW2
aaauguugaaugug

SEQ ID NO: 4023108 - RNA, 16 nt, Staphylococcus aureus subsp. aureus MW2
aaauguuuaacaauaa

SEQ ID NO: 4023109 - RNA, 18 nt, Staphylococcus aureus subsp. aureus MW2
aaauguuuauaauaauau

SEQ ID NO: 4023110 - RNA, 20 nt, Staphylococcus aureus subsp. aureus MW2
aaauguuuaucaauucccug

SEQ ID NO: 4023111 - RNA, 16 nt, Staphylococcus aureus subsp. aureus MW2
aaauuaaaaaacaaaa

SEQ ID NO: 4023112 - RNA, 17 nt, Staphylococcus aureus subsp. aureus MW2
aaauuaaaaaacaauaa

SEQ ID NO: 4023113 - RNA, 14 nt, Staphylococcus aureus subsp. aureus MW2
aaauuaaaaacacc

SEQ ID NO: 4023114 - RNA, 22 nt, Staphylococcus aureus subsp. aureus MW2
aaauuaaaaacaccuucguuua

SEQ ID NO: 4023115 - RNA, 12 nt, Staphylococcus aureus subsp. aureus MW2
aaauuaaaauaa

SEQ ID NO: 4023116 - RNA, 13 nt, Staphylococcus aureus subsp. aureus MW2
aaauuaaaauaau

SEQ ID NO: 4023117 - RNA, 14 nt, Staphylococcus aureus subsp. aureus MW2
aaauuaaaauaauu

SEQ ID NO: 4023118 - RNA, 17 nt, Staphylococcus aureus subsp. aureus MW2
aaauuaaaauaauuaaa

SEQ ID NO: 4023119 - RNA, 12 nt, Staphylococcus aureus subsp. aureus MW2
aaauuaaaaucu

SEQ ID NO: 4023120 - RNA, 13 nt, Staphylococcus aureus subsp. aureus MW2
aaauuaaaucuac

SEQ ID NO: 4023121 - RNA, 11 nt, Staphylococcus aureus subsp. aureus MW2
aaauuaacuag

SEQ ID NO: 4023122 - RNA, 13 nt, Staphylococcus aureus subsp. aureus MW2
aaauuaacuagug

SEQ ID NO: 4023123 - RNA, 14 nt, Staphylococcus aureus subsp. aureus MW2
aaauuaacuuaaaa

SEQ ID NO: 4023124 - RNA, 17 nt, Staphylococcus aureus subsp. aureus MW2
aaauuaacuuaaaauuu

SEQ ID NO: 4023125 - RNA, 18 nt, Staphylococcus aureus subsp. aureus MW2
aaauuaagagucaguaaa

SEQ ID NO: 4023126 - RNA, 16 nt, Staphylococcus aureus subsp. aureus MW2
aaauuaagaugaaaua

SEQ ID NO: 4023127 - RNA, 18 nt, Staphylococcus aureus subsp. aureus MW2
aaauuaagaugaaauacu

SEQ ID NO: 4023128 - RNA, 17 nt, Staphylococcus aureus subsp. aureus MW2
aaauuaauaugaacaaa

SEQ ID NO: 4023129 - RNA, 13 nt, Staphylococcus aureus subsp. aureus MW2
aaauuaaucacau

SEQ ID NO: 4023130 - RNA, 16 nt, Staphylococcus aureus subsp. aureus MW2
aaauuuauauuaaaua

SEQ ID NO: 4023131 - RNA, 12 nt, Staphylococcus aureus subsp. aureus MW2
aaauuuauuaua

SEQ ID NO: 4023132 - RNA, 13 nt, Staphylococcus aureus subsp. aureus MW2
aaauuuauuauuc

SEQ ID NO: 4023133 - RNA, 22 nt, Staphylococcus aureus subsp. aureus MW2
aaauuuauuauucguuucuuua

SEQ ID NO: 4023134 - RNA, 12 nt, Staphylococcus aureus subsp. aureus MW2
aaauuucaaaaa

SEQ ID NO: 4023135 - RNA, 15 nt, Staphylococcus aureus subsp. aureus MW2
aaauuucaaaaauag

SEQ ID NO: 4023136 - RNA, 18 nt, Staphylococcus aureus subsp. aureus MW2
aaauuuccacuuugaucu

SEQ ID NO: 4023137 - RNA, 21 nt, Staphylococcus aureus subsp. aureus MW2
aaauuuccucaccuucauuuu

SEQ ID NO: 4023138 - RNA, 15 nt, Staphylococcus aureus subsp. aureus MW2
aaauuucgacaucua

SEQ ID NO: 4023139 - RNA, 16 nt, Staphylococcus aureus subsp. aureus MW2
aaauuucgacaucuag

SEQ ID NO: 4023140 - RNA, 19 nt, Staphylococcus aureus subsp. aureus MW2
aaauuucgccucaucuaau

SEQ ID NO: 4023141 - RNA, 17 nt, Staphylococcus aureus subsp. aureus MW2
aaauuugaaauauacca

SEQ ID NO: 4023142 - RNA, 18 nt, Staphylococcus aureus subsp. aureus MW2
aaauuugcaugaaaauua

SEQ ID NO: 4023143 - RNA, 18 nt, Staphylococcus aureus subsp. aureus MW2
aaauuugugauuaugcau

SEQ ID NO: 4023144 - RNA, 22 nt, Staphylococcus aureus subsp. aureus MW2
aaauuuuaucaauuucuucccc

SEQ ID NO: 4023145 - RNA, 19 nt, Staphylococcus aureus subsp. aureus MW2
aaauuuuaucuaaacauuu

SEQ ID NO: 4023146 - RNA, 18 nt, Staphylococcus aureus subsp. aureus MW2
aaauuuugcgaaaauauc

SEQ ID NO: 4023147 - RNA, 17 nt, Staphylococcus aureus subsp. aureus MW2
aaauuuuuaagaagcuu

SEQ ID NO: 4023148 - RNA, 16 nt, Staphylococcus aureus subsp. aureus MW2
aacaaaaaagagcuca

SEQ ID NO: 4023149 - RNA, 17 nt, Staphylococcus aureus subsp. aureus MW2
aacaaaaccaaaauacu

SEQ ID NO: 4023150 - RNA, 17 nt, Staphylococcus aureus subsp. aureus MW2
aacaaaacuuaaaauau

SEQ ID NO: 4023151 - RNA, 22 nt, Staphylococcus aureus subsp. aureus MW2
aacaaaacuuaaaauauuuaac

SEQ ID NO: 4023152 - RNA, 22 nt, Staphylococcus aureus subsp. aureus MW2
aacaaaacuugagcuauucaua

SEQ ID NO: 4023153 - RNA, 12 nt, Staphylococcus aureus subsp. aureus MW2
aacaaaagaaag

SEQ ID NO: 4023154 - RNA, 14 nt, Staphylococcus aureus subsp. aureus MW2
aacaaaagaaaguu

SEQ ID NO: 4023155 - RNA, 16 nt, Staphylococcus aureus subsp. aureus MW2
aacaaaagugaauguu

SEQ ID NO: 4023156 - RNA, 18 nt, Staphylococcus aureus subsp. aureus MW2
aacaaaauauacuaaauu

SEQ ID NO: 4023157 - RNA, 15 nt, Staphylococcus aureus subsp. aureus MW2
aacaaaaugauuggu

SEQ ID NO: 4023158 - RNA, 22 nt, Staphylococcus aureus subsp. aureus MW2
aacaaagaagcuggcggaaagu

SEQ ID NO: 4023159 - RNA, 23 nt, Staphylococcus aureus subsp. aureus MW2
aacaaaguaauccccgaagcaca

SEQ ID NO: 4023160 - RNA, 15 nt, Staphylococcus aureus subsp. aureus MW2
aacaaauaguucaaa

SEQ ID NO: 4023161 - RNA, 16 nt, Staphylococcus aureus subsp. aureus MW2
aacaaaucgauuaauu

SEQ ID NO: 4023162 - RNA, 18 nt, Staphylococcus aureus subsp. aureus MW2
aacaaaucuauaaauauc

SEQ ID NO: 4023163 - RNA, 15 nt, Staphylococcus aureus subsp. aureus MW2
aacaaaucuuuuaaa

SEQ ID NO: 4023164 - RNA, 17 nt, Staphylococcus aureus subsp. aureus MW2
aacaaaucuuuuaaauu

SEQ ID NO: 4023165 - RNA, 19 nt, Staphylococcus aureus subsp. aureus MW2
aacaaauucauauuaacug

SEQ ID NO: 4023166 - RNA, 20 nt, Staphylococcus aureus subsp. aureus MW2
aacaaauucauauuaacugu

SEQ ID NO: 4023167 - RNA, 15 nt, Staphylococcus aureus subsp. aureus MW2
aacaacaaucaaauu

SEQ ID NO: 4023168 - RNA, 12 nt, Staphylococcus aureus subsp. aureus MW2
aacaacaucaaa

SEQ ID NO: 4023169 - RNA, 15 nt, Staphylococcus aureus subsp. aureus MW2
aacaacaucacuuua

SEQ ID NO: 4023170 - RNA, 15 nt, Staphylococcus aureus subsp. aureus MW2
aacaaccuauuaauu

SEQ ID NO: 4023171 - RNA, 12 nt, Staphylococcus aureus subsp. aureus MW2
aacaacuaagau

SEQ ID NO: 4023172 - RNA, 19 nt, Staphylococcus aureus subsp. aureus MW2
aacaacugcaauagcuaua

SEQ ID NO: 4023173 - RNA, 23 nt, Staphylococcus aureus subsp. aureus MW2
aacaacugcaauagcuauaacuc

SEQ ID NO: 4023174 - RNA, 17 nt, Staphylococcus aureus subsp. aureus MW2
aacaagaaguuuccaac

SEQ ID NO: 4023175 - RNA, 14 nt, Staphylococcus aureus subsp. aureus MW2
aacaagcaucauga

SEQ ID NO: 4023176 - RNA, 15 nt, Staphylococcus aureus subsp. aureus MW2
aacaagcaucaugaa

SEQ ID NO: 4023177 - RNA, 16 nt, Staphylococcus aureus subsp. aureus MW2
aacaagccuuaaaaua

SEQ ID NO: 4023178 - RNA, 17 nt, Staphylococcus aureus subsp. aureus MW2
aacaagccuuaaaauau

SEQ ID NO: 4023179 - RNA, 20 nt, Staphylococcus aureus subsp. aureus MW2
aacaagcuuuucauuuuuau

SEQ ID NO: 4023180 - RNA, 18 nt, Staphylococcus aureus subsp. aureus MW2
aacaagcuuuuuucaauu

SEQ ID NO: 4023181 - RNA, 23 nt, Staphylococcus aureus subsp. aureus MW2
aacaagguguucgggaauuuuuu

SEQ ID NO: 4023182 - RNA, 19 nt, Staphylococcus aureus subsp. aureus MW2
aacaagugaugaaaaagag

SEQ ID NO: 4023183 - RNA, 20 nt, Staphylococcus aureus subsp. aureus MW2
aacaaguucauuucaauacc

SEQ ID NO: 4023184 - RNA, 18 nt, Staphylococcus aureus subsp. aureus MW2
aacaaguugauaacuauu

SEQ ID NO: 4023185 - RNA, 15 nt, Staphylococcus aureus subsp. aureus MW2
aacaauaaaaaacca

SEQ ID NO: 4023186 - RNA, 16 nt, Staphylococcus aureus subsp. aureus MW2
aacaauaaaaaaccaa

SEQ ID NO: 4023187 - RNA, 13 nt, Staphylococcus aureus subsp. aureus MW2
aacaauaauaugc

SEQ ID NO: 4023188 - RNA, 13 nt, Staphylococcus aureus subsp. aureus MW2
aacaauaaucaau

SEQ ID NO: 4023189 - RNA, 22 nt, Staphylococcus aureus subsp. aureus MW2
aacaauacguuuucggauugaa

SEQ ID NO: 4023190 - RNA, 19 nt, Staphylococcus aureus subsp. aureus MW2
aacaauagguacaacuaaa

SEQ ID NO: 4023191 - RNA, 21 nt, Staphylococcus aureus subsp. aureus MW2
aacaauagguacaacuaaaua

SEQ ID NO: 4023192 - RNA, 22 nt, Staphylococcus aureus subsp. aureus MW2
aacaauagguacaacuaaauau

SEQ ID NO: 4023193 - RNA, 14 nt, Staphylococcus aureus subsp. aureus MW2
aacaauauaauaua

SEQ ID NO: 4023194 - RNA, 17 nt, Staphylococcus aureus subsp. aureus MW2
aacaauauaauauauac

SEQ ID NO: 4023195 - RNA, 13 nt, Staphylococcus aureus subsp. aureus MW2
aacaauaucaucu

SEQ ID NO: 4023196 - RNA, 14 nt, Staphylococcus aureus subsp. aureus MW2
aacaauaucaucua

SEQ ID NO: 4023197 - RNA, 16 nt, Staphylococcus aureus subsp. aureus MW2
aacaauaucaucuaaa

SEQ ID NO: 4023198 - RNA, 16 nt, Staphylococcus aureus subsp. aureus MW2
aacaaucaaauuacaa

SEQ ID NO: 4023199 - RNA, 15 nt, Staphylococcus aureus subsp. aureus MW2
aacaaucagauaagu

SEQ ID NO: 4023200 - RNA, 18 nt, Staphylococcus aureus subsp. aureus MW2
aacaaucggaagcauauu

SEQ ID NO: 4023201 - RNA, 24 nt, Staphylococcus aureus subsp. aureus MW2
aacaaucggaagcauauuucuaaa

SEQ ID NO: 4023202 - RNA, 15 nt, Staphylococcus aureus subsp. aureus MW2
aacaaugcaaguugg

SEQ ID NO: 4023203 - RNA, 18 nt, Staphylococcus aureus subsp. aureus MW2
aacaaugcgaagaaauca

SEQ ID NO: 4023204 - RNA, 19 nt, Staphylococcus aureus subsp. aureus MW2
aacaaugcgaagaaaucau

SEQ ID NO: 4023205 - RNA, 17 nt, Staphylococcus aureus subsp. aureus MW2
aacaauugauugcucua

SEQ ID NO: 4023206 - RNA, 20 nt, Staphylococcus aureus subsp. aureus MW2
aacaauugguuguuucaauu

SEQ ID NO: 4023207 - RNA, 21 nt, Staphylococcus aureus subsp. aureus MW2
aacaauugguuguuucaauuc

SEQ ID NO: 4023208 - RNA, 16 nt, Staphylococcus aureus subsp. aureus MW2
aacaauuuaaaaagca

SEQ ID NO: 4023209 - RNA, 22 nt, Staphylococcus aureus subsp. aureus MW2
aacaauuugaggauacauaaau

SEQ ID NO: 4023210 - RNA, 18 nt, Staphylococcus aureus subsp. aureus MW2
aacaauuugcauaacauu

SEQ ID NO: 4023211 - RNA, 20 nt, Staphylococcus aureus subsp. aureus MW2
aacaauuuuaaaucuuuuag

SEQ ID NO: 4023212 - RNA, 23 nt, Staphylococcus aureus subsp. aureus MW2
aacaauuuuaauuuuucauuaau

SEQ ID NO: 4023213 - RNA, 18 nt, Staphylococcus aureus subsp. aureus MW2
aacacaaaaaugaagaau

SEQ ID NO: 4023214 - RNA, 22 nt, Staphylococcus aureus subsp. aureus MW2
aacacacuuauaaucuauaaau

SEQ ID NO: 4023215 - RNA, 22 nt, Staphylococcus aureus subsp. aureus MW2
aacacagaagcuggcggaaagu

SEQ ID NO: 4023216 - RNA, 17 nt, Staphylococcus aureus subsp. aureus MW2
aacacagacguuuuuga

SEQ ID NO: 4023217 - RNA, 11 nt, Staphylococcus aureus subsp. aureus MW2
aacacagagaa

SEQ ID NO: 4023218 - RNA, 22 nt, Staphylococcus aureus subsp. aureus MW2
aacauguacuuguaacaaguuc

SEQ ID NO: 4023219 - RNA, 15 nt, Staphylococcus aureus subsp. aureus MW2
aacauguauuuagua

SEQ ID NO: 4023220 - RNA, 22 nt, Staphylococcus aureus subsp. aureus MW2
aacauguuccgcuacaaaacau

SEQ ID NO: 4023221 - RNA, 21 nt, Staphylococcus aureus subsp. aureus MW2
aacauguugauaaaaaggauc

SEQ ID NO: 4023222 - RNA, 15 nt, Staphylococcus aureus subsp. aureus MW2
aacauguuucuagau

SEQ ID NO: 4023223 - RNA, 20 nt, Staphylococcus aureus subsp. aureus MW2
aacauuaaaauaauuaaaua

SEQ ID NO: 4023224 - RNA, 13 nt, Staphylococcus aureus subsp. aureus MW2
aacauuaaaaugu

SEQ ID NO: 4023225 - RNA, 17 nt, Staphylococcus aureus subsp. aureus MW2
aacauuaaaauguguuu

SEQ ID NO: 4023226 - RNA, 14 nt, Staphylococcus aureus subsp. aureus MW2
aacauuaauaaaua

SEQ ID NO: 4023227 - RNA, 23 nt, Staphylococcus aureus subsp. aureus MW2
aacauuaaucuauauaaaaacug

SEQ ID NO: 4023228 - RNA, 22 nt, Staphylococcus aureus subsp. aureus MW2
aacauuacaugcaccuuuacaa

SEQ ID NO: 4023229 - RNA, 12 nt, Staphylococcus aureus subsp. aureus MW2
aacauuacuacu

SEQ ID NO: 4023230 - RNA, 18 nt, Staphylococcus aureus subsp. aureus MW2
aacauuacuguuugcuuu

SEQ ID NO: 4023231 - RNA, 16 nt, Staphylococcus aureus subsp. aureus MW2
aacauuagcaugauaa

SEQ ID NO: 4023232 - RNA, 17 nt, Staphylococcus aureus subsp. aureus MW2
aacauuagcaugauaaa

SEQ ID NO: 4023233 - RNA, 14 nt, Staphylococcus aureus subsp. aureus MW2
aacauuagcauuaa

SEQ ID NO: 4023234 - RNA, 18 nt, Staphylococcus aureus subsp. aureus MW2
aacauuaggauguucagc

SEQ ID NO: 4023235 - RNA, 18 nt, Staphylococcus aureus subsp. aureus MW2
aacauuauuuauauuuag

SEQ ID NO: 4023236 - RNA, 19 nt, Staphylococcus aureus subsp. aureus MW2
aacauuauuuauauuuaga

SEQ ID NO: 4023237 - RNA, 20 nt, Staphylococcus aureus subsp. aureus MW2
aacauucuucaaaaaauaau

SEQ ID NO: 4023238 - RNA, 22 nt, Staphylococcus aureus subsp. aureus MW2
aacauugauaguuuuauaauuc

SEQ ID NO: 4023239 - RNA, 19 nt, Staphylococcus aureus subsp. aureus MW2
aacauugauuauuguucca

SEQ ID NO: 4023240 - RNA, 18 nt, Staphylococcus aureus subsp. aureus MW2
aacauugcuguaaccccu

SEQ ID NO: 4023241 - RNA, 23 nt, Staphylococcus aureus subsp. aureus MW2
aacauuguagcgccuaagacaua

SEQ ID NO: 4023242 - RNA, 14 nt, Staphylococcus aureus subsp. aureus MW2
aacauuuaaaaaau

SEQ ID NO: 4023243 - RNA, 15 nt, Staphylococcus aureus subsp. aureus MW2
aacauuuagauuuca

SEQ ID NO: 4023244 - RNA, 19 nt, Staphylococcus aureus subsp. aureus MW2
aacauuuauuuuuucucua

SEQ ID NO: 4023245 - RNA, 13 nt, Staphylococcus aureus subsp. aureus MW2
aacauuugucaua

SEQ ID NO: 4023246 - RNA, 16 nt, Staphylococcus aureus subsp. aureus MW2
aacauuuguccgauuu

SEQ ID NO: 4023247 - RNA, 22 nt, Staphylococcus aureus subsp. aureus MW2
aacauuuguuggaagccuucaa

SEQ ID NO: 4023248 - RNA, 13 nt, Staphylococcus aureus subsp. aureus MW2
aacauuuugaguc

SEQ ID NO: 4023249 - RNA, 22 nt, Staphylococcus aureus subsp. aureus MW2
aacauuuugauacguaaacacu

SEQ ID NO: 4023250 - RNA, 16 nt, Staphylococcus aureus subsp. aureus MW2
aacauuuuuagaauca

SEQ ID NO: 4023251 - RNA, 14 nt, Staphylococcus aureus subsp. aureus MW2
aacauuuuugauuu

SEQ ID NO: 4023252 - RNA, 20 nt, Staphylococcus aureus subsp. aureus MW2
aacauuuuugugcaaaaguu

SEQ ID NO: 4023253 - RNA, 21 nt, Staphylococcus aureus subsp. aureus MW2
aaccaaaaaauccaagcgcuu

SEQ ID NO: 4023254 - RNA, 15 nt, Staphylococcus aureus subsp. aureus MW2
aaccaaaaccaaaug

SEQ ID NO: 4023255 - RNA, 18 nt, Staphylococcus aureus subsp. aureus MW2
aaccaaaaccaaaugaac

SEQ ID NO: 4023256 - RNA, 19 nt, Staphylococcus aureus subsp. aureus MW2
aaccaaaccauuaauaaaa

SEQ ID NO: 4023257 - RNA, 18 nt, Staphylococcus aureus subsp. aureus MW2
aaccaaaucggaauaaaa

SEQ ID NO: 4023258 - RNA, 23 nt, Staphylococcus aureus subsp. aureus MW2
aaccaaaucggaauaaaauaaau

SEQ ID NO: 4023259 - RNA, 14 nt, Staphylococcus aureus subsp. aureus MW2
aaccaacaauuggu

SEQ ID NO: 4023260 - RNA, 19 nt, Staphylococcus aureus subsp. aureus MW2
aaccaacuuucucaaguaa

SEQ ID NO: 4023261 - RNA, 14 nt, Staphylococcus aureus subsp. aureus MW2
aaccaaguaauucu

SEQ ID NO: 4023262 - RNA, 22 nt, Staphylococcus aureus subsp. aureus MW2
aaccaaguaauucuuuaccauu

SEQ ID NO: 4023263 - RNA, 21 nt, Staphylococcus aureus subsp. aureus MW2
aaccaauuuuaacuuauauac

SEQ ID NO: 4023264 - RNA, 22 nt, Staphylococcus aureus subsp. aureus MW2
aaccaccaucccauuaaaccac

SEQ ID NO: 4023265 - RNA, 15 nt, Staphylococcus aureus subsp. aureus MW2
aaccaccugauaaua

SEQ ID NO: 4023266 - RNA, 13 nt, Staphylococcus aureus subsp. aureus MW2
aaccacgauaucu

SEQ ID NO: 4023267 - RNA, 18 nt, Staphylococcus aureus subsp. aureus MW2
aaccagcuaacaaaagug

SEQ ID NO: 4023268 - RNA, 22 nt, Staphylococcus aureus subsp. aureus MW2
aaccagcuuacugcuuuuuuau

SEQ ID NO: 4023269 - RNA, 13 nt, Staphylococcus aureus subsp. aureus MW2
aaccaguuugauu

SEQ ID NO: 4023270 - RNA, 14 nt, Staphylococcus aureus subsp. aureus MW2
aaccauauuuacac

SEQ ID NO: 4023271 - RNA, 17 nt, Staphylococcus aureus subsp. aureus MW2
aaccaucucaacuaauc

SEQ ID NO: 4023272 - RNA, 17 nt, Staphylococcus aureus subsp. aureus MW2
aaccaugauuagcgcac

SEQ ID NO: 4023273 - RNA, 18 nt, Staphylococcus aureus subsp. aureus MW2
aaccaugcuuuuuagcau

SEQ ID NO: 4023274 - RNA, 17 nt, Staphylococcus aureus subsp. aureus MW2
aaccauuaauaaaacug

SEQ ID NO: 4023275 - RNA, 21 nt, Staphylococcus aureus subsp. aureus MW2
aaccauucacuuauagaauga

SEQ ID NO: 4023276 - RNA, 19 nt, Staphylococcus aureus subsp. aureus MW2
aaccauucuaccaguugau

SEQ ID NO: 4023277 - RNA, 19 nt, Staphylococcus aureus subsp. aureus MW2
aaccauugaaugaauccca

SEQ ID NO: 4023278 - RNA, 14 nt, Staphylococcus aureus subsp. aureus MW2
aaccauuucauuuc

SEQ ID NO: 4023279 - RNA, 14 nt, Staphylococcus aureus subsp. aureus MW2
aaccauuucuuuuu

SEQ ID NO: 4023280 - RNA, 20 nt, Staphylococcus aureus subsp. aureus MW2
aacccauuuucaaaacuagc

SEQ ID NO: 4023281 - RNA, 14 nt, Staphylococcus aureus subsp. aureus MW2
aaccccauguauaa

SEQ ID NO: 4023282 - RNA, 22 nt, Staphylococcus aureus subsp. aureus MW2
aacccuaauguguggauuuaau

SEQ ID NO: 4023283 - RNA, 18 nt, Staphylococcus aureus subsp. aureus MW2
aaccgaaauaucaacaga

SEQ ID NO: 4023284 - RNA, 16 nt, Staphylococcus aureus subsp. aureus MW2
aaccgacuuguugaua

SEQ ID NO: 4023285 - RNA, 19 nt, Staphylococcus aureus subsp. aureus MW2
aaccgagaaucuccauuua

SEQ ID NO: 4023286 - RNA, 18 nt, Staphylococcus aureus subsp. aureus MW2
aaccgaggugucaauaaa

SEQ ID NO: 4023287 - RNA, 18 nt, Staphylococcus aureus subsp. aureus MW2
aaccgcauacagaucuca

SEQ ID NO: 4023288 - RNA, 14 nt, Staphylococcus aureus subsp. aureus MW2
aaccgcuguuuuuc

SEQ ID NO: 4023289 - RNA, 15 nt, Staphylococcus aureus subsp. aureus MW2
aaccggaaauuaaau

SEQ ID NO: 4023290 - RNA, 19 nt, Staphylococcus aureus subsp. aureus MW2
aaccggucuauaacaccau

SEQ ID NO: 4023291 - RNA, 18 nt, Staphylococcus aureus subsp. aureus MW2
aaccguaacuauaugaaa

SEQ ID NO: 4023292 - RNA, 19 nt, Staphylococcus aureus subsp. aureus MW2
aaccguauuauuaguuuug

SEQ ID NO: 4023293 - RNA, 22 nt, Staphylococcus aureus subsp. aureus MW2
aaccgugagggacgucaucaug

SEQ ID NO: 4023294 - RNA, 13 nt, Staphylococcus aureus subsp. aureus MW2
aaccuaaaaacaa

SEQ ID NO: 4023295 - RNA, 17 nt, Staphylococcus aureus subsp. aureus MW2
aaccuaaagauaauauu

SEQ ID NO: 4023296 - RNA, 21 nt, Staphylococcus aureus subsp. aureus MW2
aaccuacacgaccaagacgaa

SEQ ID NO: 4023297 - RNA, 15 nt, Staphylococcus aureus subsp. aureus MW2
aaccuauuaaaauaa

SEQ ID NO: 4023298 - RNA, 22 nt, Staphylococcus aureus subsp. aureus MW2
aaccuauuuuuuauaugaugaa

SEQ ID NO: 4023299 - RNA, 22 nt, Staphylococcus aureus subsp. aureus MW2
aaccucuguuuuguugguguuu

SEQ ID NO: 4023300 - RNA, 22 nt, Staphylococcus aureus subsp. aureus MW2
aaccugagccauaacugaauaa

SEQ ID NO: 4023301 - RNA, 20 nt, Staphylococcus aureus subsp. aureus MW2
aaccuguucuuuauuuaaag

SEQ ID NO: 4023302 - RNA, 21 nt, Staphylococcus aureus subsp. aureus MW2
aaccuuaauuauuuucucgau

SEQ ID NO: 4023303 - RNA, 17 nt, Staphylococcus aureus subsp. aureus MW2
aaccuuacccaaaaaau

SEQ ID NO: 4023304 - RNA, 14 nt, Staphylococcus aureus subsp. aureus MW2
aaccuuuaaaacau

SEQ ID NO: 4023305 - RNA, 15 nt, Staphylococcus aureus subsp. aureus MW2
aacgaagccuaauuu

SEQ ID NO: 4023306 - RNA, 21 nt, Staphylococcus aureus subsp. aureus MW2
aacucguugcgcucuuuucuu

SEQ ID NO: 4023307 - RNA, 22 nt, Staphylococcus aureus subsp. aureus MW2
aacucuaaauauaauagaaaua

SEQ ID NO: 4023308 - RNA, 14 nt, Staphylococcus aureus subsp. aureus MW2
aacucuaacagcuu

SEQ ID NO: 4023309 - RNA, 15 nt, Staphylococcus aureus subsp. aureus MW2
aacucuaacagcuua

SEQ ID NO: 4023310 - RNA, 17 nt, Staphylococcus aureus subsp. aureus MW2
aacucuaacagcuuaau

SEQ ID NO: 4023311 - RNA, 14 nt, Staphylococcus aureus subsp. aureus MW2
aacucuaucuauuu

SEQ ID NO: 4023312 - RNA, 14 nt, Staphylococcus aureus subsp. aureus MW2
aacucugagcacuu

SEQ ID NO: 4023313 - RNA, 22 nt, Staphylococcus aureus subsp. aureus MW2
aacucugauauugaucugauuu

SEQ ID NO: 4023314 - RNA, 18 nt, Staphylococcus aureus subsp. aureus MW2
aacucuuuaauuuuacca

SEQ ID NO: 4023315 - RNA, 19 nt, Staphylococcus aureus subsp. aureus MW2
aacugacccuugucaguuu

SEQ ID NO: 4023316 - RNA, 23 nt, Staphylococcus aureus subsp. aureus MW2
aacugaguucaauuaaauuauau

SEQ ID NO: 4023317 - RNA, 17 nt, Staphylococcus aureus subsp. aureus MW2
aacugauaaaaggggaa

SEQ ID NO: 4023318 - RNA, 23 nt, Staphylococcus aureus subsp. aureus MW2
aacugauaauacuguuuaaauaa

SEQ ID NO: 4023319 - RNA, 17 nt, Staphylococcus aureus subsp. aureus MW2
aacugaucauuuucauu

SEQ ID NO: 4023320 - RNA, 23 nt, Staphylococcus aureus subsp. aureus MW2
aacugaucauuuucauuuaaccc

SEQ ID NO: 4023321 - RNA, 17 nt, Staphylococcus aureus subsp. aureus MW2
aacugaugaaaagguua

SEQ ID NO: 4023322 - RNA, 20 nt, Staphylococcus aureus subsp. aureus MW2
aacugcaaaaccauguguag

SEQ ID NO: 4023323 - RNA, 18 nt, Staphylococcus aureus subsp. aureus MW2
aacugcaaacuugauuca

SEQ ID NO: 4023324 - RNA, 14 nt, Staphylococcus aureus subsp. aureus MW2
aacugcaauaauua

SEQ ID NO: 4023325 - RNA, 20 nt, Staphylococcus aureus subsp. aureus MW2
aacugcgccaguuucuaaua

SEQ ID NO: 4023326 - RNA, 16 nt, Staphylococcus aureus subsp. aureus MW2
aacugguugauaaaua

SEQ ID NO: 4023327 - RNA, 23 nt, Staphylococcus aureus subsp. aureus MW2
aacuguaacgugaggcccauaaa

SEQ ID NO: 4023328 - RNA, 22 nt, Staphylococcus aureus subsp. aureus MW2
aacugucgcucauccucauuaa

SEQ ID NO: 4023329 - RNA, 21 nt, Staphylococcus aureus subsp. aureus MW2
aacugugcaugacgauaauga

SEQ ID NO: 4023330 - RNA, 23 nt, Staphylococcus aureus subsp. aureus MW2
aacugugcaugacgauaaugaaa

SEQ ID NO: 4023331 - RNA, 22 nt, Staphylococcus aureus subsp. aureus MW2
aacuguucuuucgucuuguaaa

SEQ ID NO: 4023332 - RNA, 23 nt, Staphylococcus aureus subsp. aureus MW2
aacuguucuuucgucuuguaaac

SEQ ID NO: 4023333 - RNA, 15 nt, Staphylococcus aureus subsp. aureus MW2
aacuguuuauccaua

SEQ ID NO: 4023334 - RNA, 13 nt, Staphylococcus aureus subsp. aureus MW2
aacuuaaaaauga

SEQ ID NO: 4023335 - RNA, 16 nt, Staphylococcus aureus subsp. aureus MW2
aacuuaaaauauuuaa

SEQ ID NO: 4023336 - RNA, 15 nt, Staphylococcus aureus subsp. aureus MW2
aacuuaaaauuuaaa

SEQ ID NO: 4023337 - RNA, 11 nt, Staphylococcus aureus subsp. aureus MW2
aacuuaaauau

SEQ ID NO: 4023338 - RNA, 17 nt, Staphylococcus aureus subsp. aureus MW2
aacuuaaucaagcuagc

SEQ ID NO: 4023339 - RNA, 20 nt, Staphylococcus aureus subsp. aureus MW2
aacuuaaugcuucaaaugua

SEQ ID NO: 4023340 - RNA, 18 nt, Staphylococcus aureus subsp. aureus MW2
aacuuacauuacauauau

SEQ ID NO: 4023341 - RNA, 22 nt, Staphylococcus aureus subsp. aureus MW2
aacuuaccaugaugagauaaaa

SEQ ID NO: 4023342 - RNA, 18 nt, Staphylococcus aureus subsp. aureus MW2
aacuuaccgcugcuuuua

SEQ ID NO: 4023343 - RNA, 21 nt, Staphylococcus aureus subsp. aureus MW2
aacuuaccgcugcuuuuacuc

SEQ ID NO: 4023344 - RNA, 14 nt, Staphylococcus aureus subsp. aureus MW2
aacuuacuuuugua

SEQ ID NO: 4023345 - RNA, 21 nt, Staphylococcus aureus subsp. aureus MW2
aacuuagaccccuaauuaaaa

SEQ ID NO: 4023346 - RNA, 20 nt, Staphylococcus aureus subsp. aureus MW2
aacuuauauacguugauuaa

SEQ ID NO: 4023347 - RNA, 13 nt, Staphylococcus aureus subsp. aureus MW2
aacuuauuauuua

SEQ ID NO: 4023348 - RNA, 18 nt, Staphylococcus aureus subsp. aureus MW2
aacuuauucaaacagucc

SEQ ID NO: 4023349 - RNA, 16 nt, Staphylococcus aureus subsp. aureus MW2
aacuucugaaacgccu

SEQ ID NO: 4023350 - RNA, 21 nt, Staphylococcus aureus subsp. aureus MW2
aacuucuuuuguuuuaccauc

SEQ ID NO: 4023351 - RNA, 22 nt, Staphylococcus aureus subsp. aureus MW2
aacuucuuuuguuuuaccauca

SEQ ID NO: 4023352 - RNA, 11 nt, Staphylococcus aureus subsp. aureus MW2
aacuucuuuuu

SEQ ID NO: 4023353 - RNA, 16 nt, Staphylococcus aureus subsp. aureus MW2
aacuugaacuaaaaca

SEQ ID NO: 4023354 - RNA, 17 nt, Staphylococcus aureus subsp. aureus MW2
aacuugaucauuauaaa

SEQ ID NO: 4023355 - RNA, 19 nt, Staphylococcus aureus subsp. aureus MW2
aacuugaucauuauaaaau

SEQ ID NO: 4023356 - RNA, 21 nt, Staphylococcus aureus subsp. aureus MW2
aacuugaucauuauaaaaugg

SEQ ID NO: 4023357 - RNA, 14 nt, Staphylococcus aureus subsp. aureus MW2
aacuugauuaugua

SEQ ID NO: 4023358 - RNA, 12 nt, Staphylococcus aureus subsp. aureus MW2
aacuugcacauu

SEQ ID NO: 4023359 - RNA, 21 nt, Staphylococcus aureus subsp. aureus MW2
aacuugcauugccuguagaau

SEQ ID NO: 4023360 - RNA, 13 nt, Staphylococcus aureus subsp. aureus MW2
aacuugcuuuguu

SEQ ID NO: 4023361 - RNA, 15 nt, Staphylococcus aureus subsp. aureus MW2
aacuugcuuuguucu

SEQ ID NO: 4023362 - RNA, 19 nt, Staphylococcus aureus subsp. aureus MW2
aacuugcuuuguucuucgu

SEQ ID NO: 4023363 - RNA, 12 nt, Staphylococcus aureus subsp. aureus MW2
aacuugggauuu

SEQ ID NO: 4023364 - RNA, 14 nt, Staphylococcus aureus subsp. aureus MW2
aacuuuaauaccag

SEQ ID NO: 4023365 - RNA, 13 nt, Staphylococcus aureus subsp. aureus MW2
aacuuuaauacua

SEQ ID NO: 4023366 - RNA, 15 nt, Staphylococcus aureus subsp. aureus MW2
aacuuuaauauaagu

SEQ ID NO: 4023367 - RNA, 20 nt, Staphylococcus aureus subsp. aureus MW2
aacuuuaauuaaagcaucuu

SEQ ID NO: 4023368 - RNA, 22 nt, Staphylococcus aureus subsp. aureus MW2
aacuuuaauuaaagcaucuuca

SEQ ID NO: 4023369 - RNA, 20 nt, Staphylococcus aureus subsp. aureus MW2
aacuuuaccaauaucaugca

SEQ ID NO: 4023370 - RNA, 16 nt, Staphylococcus aureus subsp. aureus MW2
aacuuuagacauaaaa

SEQ ID NO: 4023371 - RNA, 19 nt, Staphylococcus aureus subsp. aureus MW2
aacuuuaguauauucaaca

SEQ ID NO: 4023372 - RNA, 15 nt, Staphylococcus aureus subsp. aureus MW2
aacuuuaguuguuag

SEQ ID NO: 4023373 - RNA, 20 nt, Staphylococcus aureus subsp. aureus MW2
aacuuuaguuguuaggggcu

SEQ ID NO: 4023374 - RNA, 22 nt, Staphylococcus aureus subsp. aureus MW2
aacuuuauagggcgcacauuau

SEQ ID NO: 4023375 - RNA, 12 nt, Staphylococcus aureus subsp. aureus MW2
aacuuuauauug

SEQ ID NO: 4023376 - RNA, 16 nt, Staphylococcus aureus subsp. aureus MW2
aacuuucccuacugcu

SEQ ID NO: 4023377 - RNA, 15 nt, Staphylococcus aureus subsp. aureus MW2
aacuuucucaaauua

SEQ ID NO: 4023378 - RNA, 17 nt, Staphylococcus aureus subsp. aureus MW2
aacuuucucaaauuaga

SEQ ID NO: 4023379 - RNA, 22 nt, Staphylococcus aureus subsp. aureus MW2
aacuuucucaaauuagauaaaa

SEQ ID NO: 4023380 - RNA, 20 nt, Staphylococcus aureus subsp. aureus MW2
aacuuugguaguaugacaaa

SEQ ID NO: 4023381 - RNA, 23 nt, Staphylococcus aureus subsp. aureus MW2
aacuuugucuguauuauuauaau

SEQ ID NO: 4023382 - RNA, 18 nt, Staphylococcus aureus subsp. aureus MW2
aacuuuuauuaucagucc

SEQ ID NO: 4023383 - RNA, 22 nt, Staphylococcus aureus subsp. aureus MW2
aacuuuucagcaguugcacaaa

SEQ ID NO: 4023384 - RNA, 16 nt, Staphylococcus aureus subsp. aureus MW2
aacuuuuccuuguugg

SEQ ID NO: 4023385 - RNA, 19 nt, Staphylococcus aureus subsp. aureus MW2
aacuuuuggucaaguuuug

SEQ ID NO: 4023386 - RNA, 17 nt, Staphylococcus aureus subsp. aureus MW2
aacuuuuuaacugccau

SEQ ID NO: 4023387 - RNA, 19 nt, Staphylococcus aureus subsp. aureus MW2
aacuuuuuaacugccauau

SEQ ID NO: 4023388 - RNA, 22 nt, Staphylococcus aureus subsp. aureus MW2
aacuuuuucgauuaauucuucu

SEQ ID NO: 4023389 - RNA, 13 nt, Staphylococcus aureus subsp. aureus MW2
aacuuuuuuaaca

SEQ ID NO: 4023390 - RNA, 15 nt, Staphylococcus aureus subsp. aureus MW2
aacuuuuuuaacagc

SEQ ID NO: 4023391 - RNA, 18 nt, Staphylococcus aureus subsp. aureus MW2
aagaaaaaacuuuucaug

SEQ ID NO: 4023392 - RNA, 20 nt, Staphylococcus aureus subsp. aureus MW2
aagaaaaagugauaauuaaa

SEQ ID NO: 4023393 - RNA, 20 nt, Staphylococcus aureus subsp. aureus MW2
aagaaaacagguuaucacaa

SEQ ID NO: 4023394 - RNA, 17 nt, Staphylococcus aureus subsp. aureus MW2
aagcaacuguaaaugaa

SEQ ID NO: 4023395 - RNA, 23 nt, Staphylococcus aureus subsp. aureus MW2
aagcaauacgauugcaauggcuu

SEQ ID NO: 4023396 - RNA, 13 nt, Staphylococcus aureus subsp. aureus MW2
aagcaaucauaau

SEQ ID NO: 4023397 - RNA, 15 nt, Staphylococcus aureus subsp. aureus MW2
aagcaauuucguuuu

SEQ ID NO: 4023398 - RNA, 22 nt, Staphylococcus aureus subsp. aureus MW2
aagcaauuucguuuuauuaaug

SEQ ID NO: 4023399 - RNA, 15 nt, Staphylococcus aureus subsp. aureus MW2
aagcagacuaaaagu

SEQ ID NO: 4023400 - RNA, 13 nt, Staphylococcus aureus subsp. aureus MW2
aagcaguaagaga

SEQ ID NO: 4023401 - RNA, 19 nt, Staphylococcus aureus subsp. aureus MW2
aagcagugcuaauuuugag

SEQ ID NO: 4023402 - RNA, 16 nt, Staphylococcus aureus subsp. aureus MW2
aagcaguuguugguuu

SEQ ID NO: 4023403 - RNA, 15 nt, Staphylococcus aureus subsp. aureus MW2
aagcauaccuacaga

SEQ ID NO: 4023404 - RNA, 16 nt, Staphylococcus aureus subsp. aureus MW2
aagcauaucuuuauca

SEQ ID NO: 4023405 - RNA, 14 nt, Staphylococcus aureus subsp. aureus MW2
aagcauauuucuaa

SEQ ID NO: 4023406 - RNA, 17 nt, Staphylococcus aureus subsp. aureus MW2
aagcaucauauacauac

SEQ ID NO: 4023407 - RNA, 15 nt, Staphylococcus aureus subsp. aureus MW2
aagcaucguaaaaaa

SEQ ID NO: 4023408 - RNA, 17 nt, Staphylococcus aureus subsp. aureus MW2
aagcaucguaaaaaaca

SEQ ID NO: 4023409 - RNA, 19 nt, Staphylococcus aureus subsp. aureus MW2
aagcaucguaaaaaacaaa

SEQ ID NO: 4023410 - RNA, 21 nt, Staphylococcus aureus subsp. aureus MW2
aagcaucguaaaaaacaaaaa

SEQ ID NO: 4023411 - RNA, 22 nt, Staphylococcus aureus subsp. aureus MW2
aagcaucguaaaaaacaaaaaa

SEQ ID NO: 4023412 - RNA, 18 nt, Staphylococcus aureus subsp. aureus MW2
aagcaucuucaauauuua

SEQ ID NO: 4023413 - RNA, 21 nt, Staphylococcus aureus subsp. aureus MW2
aagcaucuucaauauuuaaau

SEQ ID NO: 4023414 - RNA, 20 nt, Staphylococcus aureus subsp. aureus MW2
aagcaugacacucauucaau

SEQ ID NO: 4023415 - RNA, 13 nt, Staphylococcus aureus subsp. aureus MW2
aagcaugauacuc

SEQ ID NO: 4023416 - RNA, 20 nt, Staphylococcus aureus subsp. aureus MW2
aagcaugauacucaauaaaa

SEQ ID NO: 4023417 - RNA, 14 nt, Staphylococcus aureus subsp. aureus MW2
aagcauuaaguuca

SEQ ID NO: 4023418 - RNA, 18 nt, Staphylococcus aureus subsp. aureus MW2
aagcauuaaguucaucau

SEQ ID NO: 4023419 - RNA, 12 nt, Staphylococcus aureus subsp. aureus MW2
aagcauuuaaau

SEQ ID NO: 4023420 - RNA, 23 nt, Staphylococcus aureus subsp. aureus MW2
aagcauuuaaauauaaccuaaaa

SEQ ID NO: 4023421 - RNA, 11 nt, Staphylococcus aureus subsp. aureus MW2
aagcauuuguc

SEQ ID NO: 4023422 - RNA, 17 nt, Staphylococcus aureus subsp. aureus MW2
aagcauuuuauuuuuaa

SEQ ID NO: 4023423 - RNA, 14 nt, Staphylococcus aureus subsp. aureus MW2
aagccaagauaaau

SEQ ID NO: 4023424 - RNA, 16 nt, Staphylococcus aureus subsp. aureus MW2
aagccaguugaaguug

SEQ ID NO: 4023425 - RNA, 13 nt, Staphylococcus aureus subsp. aureus MW2
aagccaucaauau

SEQ ID NO: 4023426 - RNA, 14 nt, Staphylococcus aureus subsp. aureus MW2
aagccaucuuucuu

SEQ ID NO: 4023427 - RNA, 12 nt, Staphylococcus aureus subsp. aureus MW2
aagccaugauac

SEQ ID NO: 4023428 - RNA, 23 nt, Staphylococcus aureus subsp. aureus MW2
aagcccaugcccgauaaaaccac

SEQ ID NO: 4023429 - RNA, 14 nt, Staphylococcus aureus subsp. aureus MW2
aagccuacuuuguc

SEQ ID NO: 4023430 - RNA, 17 nt, Staphylococcus aureus subsp. aureus MW2
aagccugauguaccacu

SEQ ID NO: 4023431 - RNA, 17 nt, Staphylococcus aureus subsp. aureus MW2
aagccuguuugacacau

SEQ ID NO: 4023432 - RNA, 21 nt, Staphylococcus aureus subsp. aureus MW2
aagccuuaaaauauuuaacuu

SEQ ID NO: 4023433 - RNA, 16 nt, Staphylococcus aureus subsp. aureus MW2
aagccuucaauaguuu

SEQ ID NO: 4023434 - RNA, 20 nt, Staphylococcus aureus subsp. aureus MW2
aagccuucaauaguuucaau

SEQ ID NO: 4023435 - RNA, 21 nt, Staphylococcus aureus subsp. aureus MW2
aagccuucuauauaguaaaau

SEQ ID NO: 4023436 - RNA, 15 nt, Staphylococcus aureus subsp. aureus MW2
aagcggauucguuuu

SEQ ID NO: 4023437 - RNA, 13 nt, Staphylococcus aureus subsp. aureus MW2
aagcguaauauuu

SEQ ID NO: 4023438 - RNA, 16 nt, Staphylococcus aureus subsp. aureus MW2
aagcguaugauguugu

SEQ ID NO: 4023439 - RNA, 20 nt, Staphylococcus aureus subsp. aureus MW2
aagcuaaauguuaaugcuuc

SEQ ID NO: 4023440 - RNA, 15 nt, Staphylococcus aureus subsp. aureus MW2
aagcuaaguauauaa

SEQ ID NO: 4023441 - RNA, 16 nt, Staphylococcus aureus subsp. aureus MW2
aagcuaaguuugaagg

SEQ ID NO: 4023442 - RNA, 20 nt, Staphylococcus aureus subsp. aureus MW2
aagcuaauauuuauuuuaaa

SEQ ID NO: 4023443 - RNA, 13 nt, Staphylococcus aureus subsp. aureus MW2
aagcuaaugcaag

SEQ ID NO: 4023444 - RNA, 17 nt, Staphylococcus aureus subsp. aureus MW2
aagcuaauucauauuca

SEQ ID NO: 4023445 - RNA, 15 nt, Staphylococcus aureus subsp. aureus MW2
aagcuagaaguucuu

SEQ ID NO: 4023446 - RNA, 17 nt, Staphylococcus aureus subsp. aureus MW2
aagcuaucguaaacaac

SEQ ID NO: 4023447 - RNA, 18 nt, Staphylococcus aureus subsp. aureus MW2
aagcuaucguaaacaaca

SEQ ID NO: 4023448 - RNA, 17 nt, Staphylococcus aureus subsp. aureus MW2
aagcuaucuucagauuc

SEQ ID NO: 4023449 - RNA, 12 nt, Staphylococcus aureus subsp. aureus MW2
aagcuaugcuuu

SEQ ID NO: 4023450 - RNA, 22 nt, Staphylococcus aureus subsp. aureus MW2
aagcucaugaaucagaugauuu

SEQ ID NO: 4023451 - RNA, 19 nt, Staphylococcus aureus subsp. aureus MW2
aagcucggcacucaauuua

SEQ ID NO: 4023452 - RNA, 17 nt, Staphylococcus aureus subsp. aureus MW2
aagcucuuaaucuauaa

SEQ ID NO: 4023453 - RNA, 22 nt, Staphylococcus aureus subsp. aureus MW2
aagcugacaaaccaauuuuaau

SEQ ID NO: 4023454 - RNA, 19 nt, Staphylococcus aureus subsp. aureus MW2
aagcugacgaaaagucagc

SEQ ID NO: 4023455 - RNA, 17 nt, Staphylococcus aureus subsp. aureus MW2
aagcugaugugacaaag

SEQ ID NO: 4023456 - RNA, 14 nt, Staphylococcus aureus subsp. aureus MW2
aagcugauuaaaau

SEQ ID NO: 4023457 - RNA, 21 nt, Staphylococcus aureus subsp. aureus MW2
aagcugauuucuaucaaauaa

SEQ ID NO: 4023458 - RNA, 22 nt, Staphylococcus aureus subsp. aureus MW2
aagcugauuucuaucaaauaau

SEQ ID NO: 4023459 - RNA, 23 nt, Staphylococcus aureus subsp. aureus MW2
aagcugauuucuaucaaauaaug

SEQ ID NO: 4023460 - RNA, 22 nt, Staphylococcus aureus subsp. aureus MW2
aagcugauuucuauuaauuauu

SEQ ID NO: 4023461 - RNA, 20 nt, Staphylococcus aureus subsp. aureus MW2
aagcugcucgauauaagucu

SEQ ID NO: 4023462 - RNA, 18 nt, Staphylococcus aureus subsp. aureus MW2
aagcuggcggaaagucag

SEQ ID NO: 4023463 - RNA, 13 nt, Staphylococcus aureus subsp. aureus MW2
aagcuuaagugcc

SEQ ID NO: 4023464 - RNA, 22 nt, Staphylococcus aureus subsp. aureus MW2
aagcuuaagugccagauuugaa

SEQ ID NO: 4023465 - RNA, 24 nt, Staphylococcus aureus subsp. aureus MW2
aagcuucauauuuagguaauacau

SEQ ID NO: 4023466 - RNA, 14 nt, Staphylococcus aureus subsp. aureus MW2
aagcuugaucaaau

SEQ ID NO: 4023467 - RNA, 20 nt, Staphylococcus aureus subsp. aureus MW2
aagcuuguuacaagcgcauu

SEQ ID NO: 4023468 - RNA, 22 nt, Staphylococcus aureus subsp. aureus MW2
aagcuuucuaucuuguucuucu

SEQ ID NO: 4023469 - RNA, 23 nt, Staphylococcus aureus subsp. aureus MW2
aagcuuuuacgccuucuuuauaa

SEQ ID NO: 4023470 - RNA, 23 nt, Staphylococcus aureus subsp. aureus MW2
aaggaacauuucaauccuuuguu

SEQ ID NO: 4023471 - RNA, 11 nt, Staphylococcus aureus subsp. aureus MW2
aaggaagaaca

SEQ ID NO: 4023472 - RNA, 23 nt, Staphylococcus aureus subsp. aureus MW2
aaggaauaauuuuaaaaauaaaa

SEQ ID NO: 4023473 - RNA, 23 nt, Staphylococcus aureus subsp. aureus MW2
aaggaauauacaauaguauaaau

SEQ ID NO: 4023474 - RNA, 22 nt, Staphylococcus aureus subsp. aureus MW2
aaggaaucguaacgcuguuggu

SEQ ID NO: 4023475 - RNA, 22 nt, Staphylococcus aureus subsp. aureus MW2
aaggaauuacacuuuaaauaca

SEQ ID NO: 4023476 - RNA, 20 nt, Staphylococcus aureus subsp. aureus MW2
aaggagauauugucuucuca

SEQ ID NO: 4023477 - RNA, 18 nt, Staphylococcus aureus subsp. aureus MW2
aaggauaucugaaguaga

SEQ ID NO: 4023478 - RNA, 12 nt, Staphylococcus aureus subsp. aureus MW2
aaggaucauguu

SEQ ID NO: 4023479 - RNA, 22 nt, Staphylococcus aureus subsp. aureus MW2
aaggauccaggcauuaggaaaa

SEQ ID NO: 4023480 - RNA, 16 nt, Staphylococcus aureus subsp. aureus MW2
aaggaugaguuuaaaa

SEQ ID NO: 4023481 - RNA, 14 nt, Staphylococcus aureus subsp. aureus MW2
aaggaugaugugaa

SEQ ID NO: 4023482 - RNA, 17 nt, Staphylococcus aureus subsp. aureus MW2
aagugauuuaaaaaaau

SEQ ID NO: 4023483 - RNA, 18 nt, Staphylococcus aureus subsp. aureus MW2
aagugauuuauuucauau

SEQ ID NO: 4023484 - RNA, 20 nt, Staphylococcus aureus subsp. aureus MW2
aagugauuuauuucauauuu

SEQ ID NO: 4023485 - RNA, 23 nt, Staphylococcus aureus subsp. aureus MW2
aagugauuuauuucauauuuaau

SEQ ID NO: 4023486 - RNA, 22 nt, Staphylococcus aureus subsp. aureus MW2
aagugcagauguugguucauca

SEQ ID NO: 4023487 - RNA, 15 nt, Staphylococcus aureus subsp. aureus MW2
aagugccagauuuga

SEQ ID NO: 4023488 - RNA, 15 nt, Staphylococcus aureus subsp. aureus MW2
aagugccagguucaa

SEQ ID NO: 4023489 - RNA, 17 nt, Staphylococcus aureus subsp. aureus MW2
aagugcgguuauuuaua

SEQ ID NO: 4023490 - RNA, 16 nt, Staphylococcus aureus subsp. aureus MW2
aagugcgguuuaaucu

SEQ ID NO: 4023491 - RNA, 15 nt, Staphylococcus aureus subsp. aureus MW2
aagugcucaaauuuu

SEQ ID NO: 4023492 - RNA, 16 nt, Staphylococcus aureus subsp. aureus MW2
aagugcuguuacuucu

SEQ ID NO: 4023493 - RNA, 20 nt, Staphylococcus aureus subsp. aureus MW2
aagugcuguuacuucucccu

SEQ ID NO: 4023494 - RNA, 21 nt, Staphylococcus aureus subsp. aureus MW2
aagugcuuaugaaugaaauca

SEQ ID NO: 4023495 - RNA, 17 nt, Staphylococcus aureus subsp. aureus MW2
aagugcuucaacuucau

SEQ ID NO: 4023496 - RNA, 19 nt, Staphylococcus aureus subsp. aureus MW2
aagugcuucaacuucaucu

SEQ ID NO: 4023497 - RNA, 13 nt, Staphylococcus aureus subsp. aureus MW2
aagugguaaaaau

SEQ ID NO: 4023498 - RNA, 23 nt, Staphylococcus aureus subsp. aureus MW2
aaguggugcuuuaucaugucuga

SEQ ID NO: 4023499 - RNA, 17 nt, Staphylococcus aureus subsp. aureus MW2
aagugguuguucccauu

SEQ ID NO: 4023500 - RNA, 20 nt, Staphylococcus aureus subsp. aureus MW2
aagugguuuuacugcuucaa

SEQ ID NO: 4023501 - RNA, 14 nt, Staphylococcus aureus subsp. aureus MW2
aaguguaaaugaaa

SEQ ID NO: 4023502 - RNA, 12 nt, Staphylococcus aureus subsp. aureus MW2
aaguguauauag

SEQ ID NO: 4023503 - RNA, 23 nt, Staphylococcus aureus subsp. aureus MW2
aaguguauauaguaggagugaac

SEQ ID NO: 4023504 - RNA, 20 nt, Staphylococcus aureus subsp. aureus MW2
aaguguuauaaauagagaac

SEQ ID NO: 4023505 - RNA, 16 nt, Staphylococcus aureus subsp. aureus MW2
aaguguugaggcguuu

SEQ ID NO: 4023506 - RNA, 14 nt, Staphylococcus aureus subsp. aureus MW2
aaguguuucaacau

SEQ ID NO: 4023507 - RNA, 15 nt, Staphylococcus aureus subsp. aureus MW2
aaguguuucaacaua

SEQ ID NO: 4023508 - RNA, 21 nt, Staphylococcus aureus subsp. aureus MW2
aaguuaaaaccuuuucaaacu

SEQ ID NO: 4023509 - RNA, 18 nt, Staphylococcus aureus subsp. aureus MW2
aaguuaaacgacaugaaa

SEQ ID NO: 4023510 - RNA, 19 nt, Staphylococcus aureus subsp. aureus MW2
aaguuaacuauaacaauag

SEQ ID NO: 4023511 - RNA, 13 nt, Staphylococcus aureus subsp. aureus MW2
aaguuaagucgcc

SEQ ID NO: 4023512 - RNA, 14 nt, Staphylococcus aureus subsp. aureus MW2
aaguuaauuaugua

SEQ ID NO: 4023513 - RNA, 15 nt, Staphylococcus aureus subsp. aureus MW2
aaguuacuuacgcca

SEQ ID NO: 4023514 - RNA, 14 nt, Staphylococcus aureus subsp. aureus MW2
aaguuagacuaaaa

SEQ ID NO: 4023515 - RNA, 12 nt, Staphylococcus aureus subsp. aureus MW2
aaguuagcaaau

SEQ ID NO: 4023516 - RNA, 20 nt, Staphylococcus aureus subsp. aureus MW2
aaguuauaucauaacuuaac

SEQ ID NO: 4023517 - RNA, 18 nt, Staphylococcus aureus subsp. aureus MW2
aaguuaucaaauugaccg

SEQ ID NO: 4023518 - RNA, 14 nt, Staphylococcus aureus subsp. aureus MW2
aaguuauuuaaguu

SEQ ID NO: 4023519 - RNA, 16 nt, Staphylococcus aureus subsp. aureus MW2
aaguuauuuauucagc

SEQ ID NO: 4023520 - RNA, 19 nt, Staphylococcus aureus subsp. aureus MW2
aaguucagcguuaucuuua

SEQ ID NO: 4023521 - RNA, 18 nt, Staphylococcus aureus subsp. aureus MW2
aaguucaucaugcacugu

SEQ ID NO: 4023522 - RNA, 17 nt, Staphylococcus aureus subsp. aureus MW2
aaguucuuaugcaguuu

SEQ ID NO: 4023523 - RNA, 14 nt, Staphylococcus aureus subsp. aureus MW2
aaguugaaaaccuc

SEQ ID NO: 4023524 - RNA, 20 nt, Staphylococcus aureus subsp. aureus MW2
aaguugaagcggguugaagc

SEQ ID NO: 4023525 - RNA, 20 nt, Staphylococcus aureus subsp. aureus MW2
aaguugauaacuauuuaauu

SEQ ID NO: 4023526 - RNA, 15 nt, Staphylococcus aureus subsp. aureus MW2
aaguugcauauaaaa

SEQ ID NO: 4023527 - RNA, 16 nt, Staphylococcus aureus subsp. aureus MW2
aaguugcugaauaaaa

SEQ ID NO: 4023528 - RNA, 18 nt, Staphylococcus aureus subsp. aureus MW2
aaguuggcggggccccaa

SEQ ID NO: 4023529 - RNA, 23 nt, Staphylococcus aureus subsp. aureus MW2
aaguuggcggggccccaacacag

SEQ ID NO: 4023530 - RNA, 20 nt, Staphylococcus aureus subsp. aureus MW2
aaguuggggaugggccccaa

SEQ ID NO: 4023531 - RNA, 22 nt, Staphylococcus aureus subsp. aureus MW2
aaguuggggugugggccccaac

SEQ ID NO: 4023532 - RNA, 18 nt, Staphylococcus aureus subsp. aureus MW2
aaguuuaaucguauuagc

SEQ ID NO: 4023533 - RNA, 14 nt, Staphylococcus aureus subsp. aureus MW2
aaguuuacaucaaa

SEQ ID NO: 4023534 - RNA, 15 nt, Staphylococcus aureus subsp. aureus MW2
aaguuuacaucaaag

SEQ ID NO: 4023535 - RNA, 13 nt, Staphylococcus aureus subsp. aureus MW2
aaguuuccuaucu

SEQ ID NO: 4023536 - RNA, 13 nt, Staphylococcus aureus subsp. aureus MW2
aaguuugaaucau

SEQ ID NO: 4023537 - RNA, 19 nt, Staphylococcus aureus subsp. aureus MW2
aaguuugucuuugaacaua

SEQ ID NO: 4023538 - RNA, 21 nt, Staphylococcus aureus subsp. aureus MW2
aaguuuguuuguaaaacugaa

SEQ ID NO: 4023539 - RNA, 18 nt, Staphylococcus aureus subsp. aureus MW2
aaguuuuagcuuguuguu

SEQ ID NO: 4023540 - RNA, 17 nt, Staphylococcus aureus subsp. aureus MW2
aaguuuuauuuaaauua

SEQ ID NO: 4023541 - RNA, 21 nt, Staphylococcus aureus subsp. aureus MW2
aaguuuucauuuaacauguau

SEQ ID NO: 4023542 - RNA, 13 nt, Staphylococcus aureus subsp. aureus MW2
aaguuuuucaggg

SEQ ID NO: 4023543 - RNA, 23 nt, Staphylococcus aureus subsp. aureus MW2
aaguuuuucaggguuuaagauuu

SEQ ID NO: 4023544 - RNA, 13 nt, Staphylococcus aureus subsp. aureus MW2
aaguuuuugaaua

SEQ ID NO: 4023545 - RNA, 21 nt, Staphylococcus aureus subsp. aureus MW2
aauaaaaaaaucacgcuaaca

SEQ ID NO: 4023546 - RNA, 13 nt, Staphylococcus aureus subsp. aureus MW2
aauaaaaaaccaa

SEQ ID NO: 4023547 - RNA, 13 nt, Staphylococcus aureus subsp. aureus MW2
aauaaaaaagcca

SEQ ID NO: 4023548 - RNA, 21 nt, Staphylococcus aureus subsp. aureus MW2
aauaaaaaauugauaguagcu

SEQ ID NO: 4023549 - RNA, 18 nt, Staphylococcus aureus subsp. aureus MW2
aauaaaaaccagcuaaca

SEQ ID NO: 4023550 - RNA, 17 nt, Staphylococcus aureus subsp. aureus MW2
aauaaaaacuucuauca

SEQ ID NO: 4023551 - RNA, 12 nt, Staphylococcus aureus subsp. aureus MW2
aauaaaaaugcc

SEQ ID NO: 4023552 - RNA, 15 nt, Staphylococcus aureus subsp. aureus MW2
aauaaaaauuauaua

SEQ ID NO: 4023553 - RNA, 17 nt, Staphylococcus aureus subsp. aureus MW2
aauaaaaauuauauaaa

SEQ ID NO: 4023554 - RNA, 19 nt, Staphylococcus aureus subsp. aureus MW2
aauaaaaauuauauaaauu

SEQ ID NO: 4023555 - RNA, 13 nt, Staphylococcus aureus subsp. aureus MW2
aauaaaacaaauu

SEQ ID NO: 4023556 - RNA, 17 nt, Staphylococcus aureus subsp. aureus MW2
aauaaaagcaacaaaua

SEQ ID NO: 4023557 - RNA, 13 nt, Staphylococcus aureus subsp. aureus MW2
aauaaaaggcuuu

SEQ ID NO: 4023558 - RNA, 18 nt, Staphylococcus aureus subsp. aureus MW2
aauaaaaggcuuuguuaa

SEQ ID NO: 4023559 - RNA, 19 nt, Staphylococcus aureus subsp. aureus MW2
aauaaaaggcuuuguuaaa

SEQ ID NO: 4023560 - RNA, 13 nt, Staphylococcus aureus subsp. aureus MW2
aauaaaauauauc

SEQ ID NO: 4023561 - RNA, 14 nt, Staphylococcus aureus subsp. aureus MW2
aauaaaaucaucuu

SEQ ID NO: 4023562 - RNA, 15 nt, Staphylococcus aureus subsp. aureus MW2
aauaaaaugcuacaa

SEQ ID NO: 4023563 - RNA, 15 nt, Staphylococcus aureus subsp. aureus MW2
aauaaacaacugcaa

SEQ ID NO: 4023564 - RNA, 18 nt, Staphylococcus aureus subsp. aureus MW2
aauaaacacccaauaauu

SEQ ID NO: 4023565 - RNA, 16 nt, Staphylococcus aureus subsp. aureus MW2
aauaaacauaaaaaua

SEQ ID NO: 4023566 - RNA, 14 nt, Staphylococcus aureus subsp. aureus MW2
aauaaacauaucau

SEQ ID NO: 4023567 - RNA, 19 nt, Staphylococcus aureus subsp. aureus MW2
aauaaacauaucaucauaa

SEQ ID NO: 4023568 - RNA, 20 nt, Staphylococcus aureus subsp. aureus MW2
aauaaaccacgcacaucuaa

SEQ ID NO: 4023569 - RNA, 22 nt, Staphylococcus aureus subsp. aureus MW2
aauaaaccgauuguuucaccag

SEQ ID NO: 4023570 - RNA, 21 nt, Staphylococcus aureus subsp. aureus MW2
aauaaaccuacaauauagaaa

SEQ ID NO: 4023571 - RNA, 17 nt, Staphylococcus aureus subsp. aureus MW2
aauaauuaaauaaaaau

SEQ ID NO: 4023572 - RNA, 16 nt, Staphylococcus aureus subsp. aureus MW2
aauaauuagauuuaaa

SEQ ID NO: 4023573 - RNA, 17 nt, Staphylococcus aureus subsp. aureus MW2
aauaauuagauuuaaaa

SEQ ID NO: 4023574 - RNA, 19 nt, Staphylococcus aureus subsp. aureus MW2
aauaauuagucauugaaaa

SEQ ID NO: 4023575 - RNA, 16 nt, Staphylococcus aureus subsp. aureus MW2
aauaauuaugaaaagu

SEQ ID NO: 4023576 - RNA, 18 nt, Staphylococcus aureus subsp. aureus MW2
aauaauucauaaaugcuu

SEQ ID NO: 4023577 - RNA, 19 nt, Staphylococcus aureus subsp. aureus MW2
aauaauucauaaaugcuuc

SEQ ID NO: 4023578 - RNA, 13 nt, Staphylococcus aureus subsp. aureus MW2
aauaauucuuuua

SEQ ID NO: 4023579 - RNA, 16 nt, Staphylococcus aureus subsp. aureus MW2
aauaauuggaaucauc

SEQ ID NO: 4023580 - RNA, 17 nt, Staphylococcus aureus subsp. aureus MW2
aauaauuggaaucaucu

SEQ ID NO: 4023581 - RNA, 17 nt, Staphylococcus aureus subsp. aureus MW2
aauaauuggcugaugaa

SEQ ID NO: 4023582 - RNA, 14 nt, Staphylococcus aureus subsp. aureus MW2
aauaauuuaaauua

SEQ ID NO: 4023583 - RNA, 18 nt, Staphylococcus aureus subsp. aureus MW2
aauaauuuaaauuaaaau

SEQ ID NO: 4023584 - RNA, 15 nt, Staphylococcus aureus subsp. aureus MW2
aauaauuuaacuaau

SEQ ID NO: 4023585 - RNA, 22 nt, Staphylococcus aureus subsp. aureus MW2
aauaauuuaauguugcaaaauu

SEQ ID NO: 4023586 - RNA, 17 nt, Staphylococcus aureus subsp. aureus MW2
aauaauuuguaauuccu

SEQ ID NO: 4023587 - RNA, 16 nt, Staphylococcus aureus subsp. aureus MW2
aauaauuuuaaaaaua

SEQ ID NO: 4023588 - RNA, 20 nt, Staphylococcus aureus subsp. aureus MW2
aauaauuuuaaaaauaaaaa

SEQ ID NO: 4023589 - RNA, 14 nt, Staphylococcus aureus subsp. aureus MW2
aauaauuuugauau

SEQ ID NO: 4023590 - RNA, 14 nt, Staphylococcus aureus subsp. aureus MW2
aauacaaaacauua

SEQ ID NO: 4023591 - RNA, 15 nt, Staphylococcus aureus subsp. aureus MW2
aauacaaacacccac

SEQ ID NO: 4023592 - RNA, 22 nt, Staphylococcus aureus subsp. aureus MW2
aauacaaagccuuaauaucaug

SEQ ID NO: 4023593 - RNA, 15 nt, Staphylococcus aureus subsp. aureus MW2
aauacaaauauuaag

SEQ ID NO: 4023594 - RNA, 23 nt, Staphylococcus aureus subsp. aureus MW2
aauacaacgacacgaacaacauu

SEQ ID NO: 4023595 - RNA, 19 nt, Staphylococcus aureus subsp. aureus MW2
aauacaauuucuucauuuu

SEQ ID NO: 4023596 - RNA, 20 nt, Staphylococcus aureus subsp. aureus MW2
aauacaauuucuucauuuuc

SEQ ID NO: 4023597 - RNA, 12 nt, Staphylococcus aureus subsp. aureus MW2
aauacaauuuua

SEQ ID NO: 4023598 - RNA, 14 nt, Staphylococcus aureus subsp. aureus MW2
aauacaauuuuagc

SEQ ID NO: 4023599 - RNA, 18 nt, Staphylococcus aureus subsp. aureus MW2
aauacacuugcuaaaacu

SEQ ID NO: 4023600 - RNA, 19 nt, Staphylococcus aureus subsp. aureus MW2
aauacacuugcuaaaacua

SEQ ID NO: 4023601 - RNA, 23 nt, Staphylococcus aureus subsp. aureus MW2
aauacacuugcuaaaacuaauga

SEQ ID NO: 4023602 - RNA, 11 nt, Staphylococcus aureus subsp. aureus MW2
aauacagauga

SEQ ID NO: 4023603 - RNA, 19 nt, Staphylococcus aureus subsp. aureus MW2
aauacagcuagcaagaaua

SEQ ID NO: 4023604 - RNA, 15 nt, Staphylococcus aureus subsp. aureus MW2
aauacauaaugguuc

SEQ ID NO: 4023605 - RNA, 18 nt, Staphylococcus aureus subsp. aureus MW2
aauacauagguucaucuu

SEQ ID NO: 4023606 - RNA, 17 nt, Staphylococcus aureus subsp. aureus MW2
aauacaucuaauaaaua

SEQ ID NO: 4023607 - RNA, 18 nt, Staphylococcus aureus subsp. aureus MW2
aauacaucuaauaaauau

SEQ ID NO: 4023608 - RNA, 19 nt, Staphylococcus aureus subsp. aureus MW2
aauacaucuaauaaauaua

SEQ ID NO: 4023609 - RNA, 16 nt, Staphylococcus aureus subsp. aureus MW2
aauacaugauauaaau

SEQ ID NO: 4023610 - RNA, 17 nt, Staphylococcus aureus subsp. aureus MW2
aauacaugauauaaaua

SEQ ID NO: 4023611 - RNA, 20 nt, Staphylococcus aureus subsp. aureus MW2
aauacaugugggauaucuuc

SEQ ID NO: 4023612 - RNA, 17 nt, Staphylococcus aureus subsp. aureus MW2
aauacauuaauauaaau

SEQ ID NO: 4023613 - RNA, 16 nt, Staphylococcus aureus subsp. aureus MW2
aauacauuucaaaaaa

SEQ ID NO: 4023614 - RNA, 17 nt, Staphylococcus aureus subsp. aureus MW2
aauacauuucaaaaaaa

SEQ ID NO: 4023615 - RNA, 21 nt, Staphylococcus aureus subsp. aureus MW2
aauacauuucuguauaaacgc

SEQ ID NO: 4023616 - RNA, 23 nt, Staphylococcus aureus subsp. aureus MW2
aauaccaacugcaaauacaccag

SEQ ID NO: 4023617 - RNA, 13 nt, Staphylococcus aureus subsp. aureus MW2
aauaccaauugcu

SEQ ID NO: 4023618 - RNA, 19 nt, Staphylococcus aureus subsp. aureus MW2
aauaccagugggcuccaaa

SEQ ID NO: 4023619 - RNA, 19 nt, Staphylococcus aureus subsp. aureus MW2
aauaccauugugaugauaa

SEQ ID NO: 4023620 - RNA, 23 nt, Staphylococcus aureus subsp. aureus MW2
aauaccuuugccguauuucaaau

SEQ ID NO: 4023621 - RNA, 13 nt, Staphylococcus aureus subsp. aureus MW2
aauaccuuuuucu

SEQ ID NO: 4023622 - RNA, 20 nt, Staphylococcus aureus subsp. aureus MW2
aauaccuuuuucuaaaccaa

SEQ ID NO: 4023623 - RNA, 13 nt, Staphylococcus aureus subsp. aureus MW2
aauacgaaguuuc

SEQ ID NO: 4023624 - RNA, 16 nt, Staphylococcus aureus subsp. aureus MW2
aauacgaauuucauag

SEQ ID NO: 4023625 - RNA, 16 nt, Staphylococcus aureus subsp. aureus MW2
aauacgauaauaacua

SEQ ID NO: 4023626 - RNA, 14 nt, Staphylococcus aureus subsp. aureus MW2
aauacgcaaaccaa

SEQ ID NO: 4023627 - RNA, 15 nt, Staphylococcus aureus subsp. aureus MW2
aauacgucaucuuua

SEQ ID NO: 4023628 - RNA, 22 nt, Staphylococcus aureus subsp. aureus MW2
aauacguggcucuaaaaacaaa

SEQ ID NO: 4023629 - RNA, 19 nt, Staphylococcus aureus subsp. aureus MW2
aauacguuuaauaaugguu

SEQ ID NO: 4023630 - RNA, 20 nt, Staphylococcus aureus subsp. aureus MW2
aauacguuuaauaaugguuc

SEQ ID NO: 4023631 - RNA, 13 nt, Staphylococcus aureus subsp. aureus MW2
aauacuaacguaa

SEQ ID NO: 4023632 - RNA, 13 nt, Staphylococcus aureus subsp. aureus MW2
aauacuaagauua

SEQ ID NO: 4023633 - RNA, 14 nt, Staphylococcus aureus subsp. aureus MW2
aauacuaagauuag

SEQ ID NO: 4023634 - RNA, 16 nt, Staphylococcus aureus subsp. aureus MW2
aauacuaagauuagcu

SEQ ID NO: 4023635 - RNA, 19 nt, Staphylococcus aureus subsp. aureus MW2
aauacuaagauuagcuaug

SEQ ID NO: 4023636 - RNA, 21 nt, Staphylococcus aureus subsp. aureus MW2
aauacuaagauuagcuaugaa

SEQ ID NO: 4023637 - RNA, 22 nt, Staphylococcus aureus subsp. aureus MW2
aauacuaccguuuuuauauacu

SEQ ID NO: 4023638 - RNA, 18 nt, Staphylococcus aureus subsp. aureus MW2
aauacuauacugaugaaa

SEQ ID NO: 4023639 - RNA, 19 nt, Staphylococcus aureus subsp. aureus MW2
aauacuauacugaugaaaa

SEQ ID NO: 4023640 - RNA, 14 nt, Staphylococcus aureus subsp. aureus MW2
aauacuauaguaag

SEQ ID NO: 4023641 - RNA, 14 nt, Staphylococcus aureus subsp. aureus MW2
aauacuauauauaa

SEQ ID NO: 4023642 - RNA, 21 nt, Staphylococcus aureus subsp. aureus MW2
aauacucaacacgauagucau

SEQ ID NO: 4023643 - RNA, 22 nt, Staphylococcus aureus subsp. aureus MW2
aauacucauguaacguaaaaau

SEQ ID NO: 4023644 - RNA, 16 nt, Staphylococcus aureus subsp. aureus MW2
aauacucccuucaaca

SEQ ID NO: 4023645 - RNA, 21 nt, Staphylococcus aureus subsp. aureus MW2
aauacuguuuucauuuguuaa

SEQ ID NO: 4023646 - RNA, 15 nt, Staphylococcus aureus subsp. aureus MW2
aauacuugaauguaa

SEQ ID NO: 4023647 - RNA, 22 nt, Staphylococcus aureus subsp. aureus MW2
aauacuuucaaacaaaucuuuu

SEQ ID NO: 4023648 - RNA, 18 nt, Staphylococcus aureus subsp. aureus MW2
aauacuuucacuuuuuau

SEQ ID NO: 4023649 - RNA, 22 nt, Staphylococcus aureus subsp. aureus MW2
aauacuuucacuuuuuauauca

SEQ ID NO: 4023650 - RNA, 13 nt, Staphylococcus aureus subsp. aureus MW2
aauacuuuucuuc

SEQ ID NO: 4023651 - RNA, 13 nt, Staphylococcus aureus subsp. aureus MW2
aauacuuuuuaac

SEQ ID NO: 4023652 - RNA, 13 nt, Staphylococcus aureus subsp. aureus MW2
aauacuuuuuaua

SEQ ID NO: 4023653 - RNA, 19 nt, Staphylococcus aureus subsp. aureus MW2
aauacuuuuuauauaauuc

SEQ ID NO: 4023654 - RNA, 12 nt, Staphylococcus aureus subsp. aureus MW2
aauacuuuuuga

SEQ ID NO: 4023655 - RNA, 14 nt, Staphylococcus aureus subsp. aureus MW2
aauagaaaaaacaa

SEQ ID NO: 4023656 - RNA, 15 nt, Staphylococcus aureus subsp. aureus MW2
aauagaaauaaucac

SEQ ID NO: 4023657 - RNA, 18 nt, Staphylococcus aureus subsp. aureus MW2
aauagaagaaaagaacau

SEQ ID NO: 4023658 - RNA, 19 nt, Staphylococcus aureus subsp. aureus MW2
aauagaagguuauuuuuua

SEQ ID NO: 4023659 - RNA, 20 nt, Staphylococcus aureus subsp. aureus MW2
aauagaagguuauuuuuuau

SEQ ID NO: 4023660 - RNA, 14 nt, Staphylococcus aureus subsp. aureus MW2
aauaucgacaaauu

SEQ ID NO: 4023661 - RNA, 22 nt, Staphylococcus aureus subsp. aureus MW2
aauaucgacaaauuaaaaaaca

SEQ ID NO: 4023662 - RNA, 23 nt, Staphylococcus aureus subsp. aureus MW2
aauaucgacuuuucuaucaaaaa

SEQ ID NO: 4023663 - RNA, 20 nt, Staphylococcus aureus subsp. aureus MW2
aauaucgauuuuggcacaua

SEQ ID NO: 4023664 - RNA, 15 nt, Staphylococcus aureus subsp. aureus MW2
aauaucuaaagauuu

SEQ ID NO: 4023665 - RNA, 22 nt, Staphylococcus aureus subsp. aureus MW2
aauaucuguugcauuaagugca

SEQ ID NO: 4023666 - RNA, 17 nt, Staphylococcus aureus subsp. aureus MW2
aauaucuuaaagaauua

SEQ ID NO: 4023667 - RNA, 14 nt, Staphylococcus aureus subsp. aureus MW2
aauaucuuacugcu

SEQ ID NO: 4023668 - RNA, 13 nt, Staphylococcus aureus subsp. aureus MW2
aauaucuucagcu

SEQ ID NO: 4023669 - RNA, 13 nt, Staphylococcus aureus subsp. aureus MW2
aauaucuucuuua

SEQ ID NO: 4023670 - RNA, 13 nt, Staphylococcus aureus subsp. aureus MW2
aauaucuugucau

SEQ ID NO: 4023671 - RNA, 12 nt, Staphylococcus aureus subsp. aureus MW2
aauaugaaaaga

SEQ ID NO: 4023672 - RNA, 14 nt, Staphylococcus aureus subsp. aureus MW2
aauaugaaaagaga

SEQ ID NO: 4023673 - RNA, 15 nt, Staphylococcus aureus subsp. aureus MW2
aauaugaaaagagau

SEQ ID NO: 4023674 - RNA, 13 nt, Staphylococcus aureus subsp. aureus MW2
aauaugacacaua

SEQ ID NO: 4023675 - RNA, 22 nt, Staphylococcus aureus subsp. aureus MW2
aauaugagugaaaguuugaagg

SEQ ID NO: 4023676 - RNA, 21 nt, Staphylococcus aureus subsp. aureus MW2
aauaugauccuuuaaugcuuu

SEQ ID NO: 4023677 - RNA, 15 nt, Staphylococcus aureus subsp. aureus MW2
aauaugaucuaacau

SEQ ID NO: 4023678 - RNA, 14 nt, Staphylococcus aureus subsp. aureus MW2
aauaugauguuaaa

SEQ ID NO: 4023679 - RNA, 23 nt, Staphylococcus aureus subsp. aureus MW2
aauaugauguuaaaaaauaugua

SEQ ID NO: 4023680 - RNA, 19 nt, Staphylococcus aureus subsp. aureus MW2
aauaugauugaaugaagcu

SEQ ID NO: 4023681 - RNA, 18 nt, Staphylococcus aureus subsp. aureus MW2
aauaugauugcaaauuau

SEQ ID NO: 4023682 - RNA, 22 nt, Staphylococcus aureus subsp. aureus MW2
aauaugauugcaaauuaucauu

SEQ ID NO: 4023683 - RNA, 17 nt, Staphylococcus aureus subsp. aureus MW2
aauaugcuuuuaauagu

SEQ ID NO: 4023684 - RNA, 21 nt, Staphylococcus aureus subsp. aureus MW2
aauauuaaauuucugaacaua

SEQ ID NO: 4023685 - RNA, 14 nt, Staphylococcus aureus subsp. aureus MW2
aauauuaacaccag

SEQ ID NO: 4023686 - RNA, 15 nt, Staphylococcus aureus subsp. aureus MW2
aauauuaagauguau

SEQ ID NO: 4023687 - RNA, 14 nt, Staphylococcus aureus subsp. aureus MW2
aauauuaauaaagu

SEQ ID NO: 4023688 - RNA, 18 nt, Staphylococcus aureus subsp. aureus MW2
aauauuaauauaaaauaa

SEQ ID NO: 4023689 - RNA, 14 nt, Staphylococcus aureus subsp. aureus MW2
aauauuaauuuaua

SEQ ID NO: 4023690 - RNA, 13 nt, Staphylococcus aureus subsp. aureus MW2
aauauuagucauu

SEQ ID NO: 4023691 - RNA, 12 nt, Staphylococcus aureus subsp. aureus MW2
aauauuauaagu

SEQ ID NO: 4023692 - RNA, 20 nt, Staphylococcus aureus subsp. aureus MW2
aauauuauaaguugcauaua

SEQ ID NO: 4023693 - RNA, 18 nt, Staphylococcus aureus subsp. aureus MW2
aauauuauuaaaucaaag

SEQ ID NO: 4023694 - RNA, 20 nt, Staphylococcus aureus subsp. aureus MW2
aauauuauucauaauauauu

SEQ ID NO: 4023695 - RNA, 13 nt, Staphylococcus aureus subsp. aureus MW2
aauauuauuuuua

SEQ ID NO: 4023696 - RNA, 21 nt, Staphylococcus aureus subsp. aureus MW2
aauauuauuuuuaagugauga

SEQ ID NO: 4023697 - RNA, 17 nt, Staphylococcus aureus subsp. aureus MW2
aauauucaacuuguuaa

SEQ ID NO: 4023698 - RNA, 22 nt, Staphylococcus aureus subsp. aureus MW2
aauauucguagcaugacauuaa

SEQ ID NO: 4023699 - RNA, 15 nt, Staphylococcus aureus subsp. aureus MW2
aauauugaaagauau

SEQ ID NO: 4023700 - RNA, 16 nt, Staphylococcus aureus subsp. aureus MW2
aauauugaaagauauu

SEQ ID NO: 4023701 - RNA, 13 nt, Staphylococcus aureus subsp. aureus MW2
aauauugagacua

SEQ ID NO: 4023702 - RNA, 16 nt, Staphylococcus aureus subsp. aureus MW2
aauauugcguuuaauu

SEQ ID NO: 4023703 - RNA, 15 nt, Staphylococcus aureus subsp. aureus MW2
aauauugucuucauu

SEQ ID NO: 4023704 - RNA, 17 nt, Staphylococcus aureus subsp. aureus MW2
aauauuuaaauuuuaag

SEQ ID NO: 4023705 - RNA, 18 nt, Staphylococcus aureus subsp. aureus MW2
aauauuuaaccuuuaaaa

SEQ ID NO: 4023706 - RNA, 14 nt, Staphylococcus aureus subsp. aureus MW2
aauauuuaaguuuc

SEQ ID NO: 4023707 - RNA, 16 nt, Staphylococcus aureus subsp. aureus MW2
aauauuuauagcauca

SEQ ID NO: 4023708 - RNA, 19 nt, Staphylococcus aureus subsp. aureus MW2
aauauuuauauuaaauacu

SEQ ID NO: 4023709 - RNA, 20 nt, Staphylococcus aureus subsp. aureus MW2
aauauuucccuaugaaauaa

SEQ ID NO: 4023710 - RNA, 17 nt, Staphylococcus aureus subsp. aureus MW2
aauauuucuaaaccauu

SEQ ID NO: 4023711 - RNA, 15 nt, Staphylococcus aureus subsp. aureus MW2
aauauuucuuaccau

SEQ ID NO: 4023712 - RNA, 22 nt, Staphylococcus aureus subsp. aureus MW2
aauauuugauaaguagaaaaua

SEQ ID NO: 4023713 - RNA, 11 nt, Staphylococcus aureus subsp. aureus MW2
aauauuugauu

SEQ ID NO: 4023714 - RNA, 17 nt, Staphylococcus aureus subsp. aureus MW2
aauauuuuacaaaauau

SEQ ID NO: 4023715 - RNA, 15 nt, Staphylococcus aureus subsp. aureus MW2
aauauuuuauuauaa

SEQ ID NO: 4023716 - RNA, 22 nt, Staphylococcus aureus subsp. aureus MW2
aauauuuucuuagaaaaucaag

SEQ ID NO: 4023717 - RNA, 20 nt, Staphylococcus aureus subsp. aureus MW2
aauauuuuuacauauuuaua

SEQ ID NO: 4023718 - RNA, 17 nt, Staphylococcus aureus subsp. aureus MW2
aauauuuuuaucaucgu

SEQ ID NO: 4023719 - RNA, 23 nt, Staphylococcus aureus subsp. aureus MW2
aauauuuuucaauuaaauguuua

SEQ ID NO: 4023720 - RNA, 23 nt, Staphylococcus aureus subsp. aureus MW2
aauauuuuuguugcaauugccuu

SEQ ID NO: 4023721 - RNA, 13 nt, Staphylococcus aureus subsp. aureus MW2
aauauuuuuuaaa

SEQ ID NO: 4023722 - RNA, 16 nt, Staphylococcus aureus subsp. aureus MW2
aauauuuuuuaaaaug

SEQ ID NO: 4023723 - RNA, 21 nt, Staphylococcus aureus subsp. aureus MW2
aauauuuuuugauauuugauc

SEQ ID NO: 4023724 - RNA, 18 nt, Staphylococcus aureus subsp. aureus MW2
aaucaaaauaaugcaacu

SEQ ID NO: 4023725 - RNA, 19 nt, Staphylococcus aureus subsp. aureus MW2
aaucaaagaggcuuuaaaa

SEQ ID NO: 4023726 - RNA, 20 nt, Staphylococcus aureus subsp. aureus MW2
aaucaaagaggcuuuaaaau

SEQ ID NO: 4023727 - RNA, 12 nt, Staphylococcus aureus subsp. aureus MW2
aaucaaagagua

SEQ ID NO: 4023728 - RNA, 22 nt, Staphylococcus aureus subsp. aureus MW2
aaucaaagauuuauaaauguuu

SEQ ID NO: 4023729 - RNA, 14 nt, Staphylococcus aureus subsp. aureus MW2
aaucaaauacauca

SEQ ID NO: 4023730 - RNA, 17 nt, Staphylococcus aureus subsp. aureus MW2
aaucaaauacaucaauu

SEQ ID NO: 4023731 - RNA, 18 nt, Staphylococcus aureus subsp. aureus MW2
aaucaaaugguacaguua

SEQ ID NO: 4023732 - RNA, 15 nt, Staphylococcus aureus subsp. aureus MW2
aaucaaauugaccau

SEQ ID NO: 4023733 - RNA, 14 nt, Staphylococcus aureus subsp. aureus MW2
aaucaacaauauaa

SEQ ID NO: 4023734 - RNA, 12 nt, Staphylococcus aureus subsp. aureus MW2
aaucaacaucau

SEQ ID NO: 4023735 - RNA, 19 nt, Staphylococcus aureus subsp. aureus MW2
aaucaacguauauaaguua

SEQ ID NO: 4023736 - RNA, 15 nt, Staphylococcus aureus subsp. aureus MW2
aaucaacuuagaauu

SEQ ID NO: 4023737 - RNA, 13 nt, Staphylococcus aureus subsp. aureus MW2
aaucaacuucaua

SEQ ID NO: 4023738 - RNA, 15 nt, Staphylococcus aureus subsp. aureus MW2
aaucaacuucauaua

SEQ ID NO: 4023739 - RNA, 23 nt, Staphylococcus aureus subsp. aureus MW2
aaucaacuuuuuguuaauuuuuu

SEQ ID NO: 4023740 - RNA, 15 nt, Staphylococcus aureus subsp. aureus MW2
aaucaagaaauguua

SEQ ID NO: 4023741 - RNA, 12 nt, Staphylococcus aureus subsp. aureus MW2
aaucaagaauau

SEQ ID NO: 4023742 - RNA, 17 nt, Staphylococcus aureus subsp. aureus MW2
aaucaagaauauaaaug

SEQ ID NO: 4023743 - RNA, 20 nt, Staphylococcus aureus subsp. aureus MW2
aaucaagaauauaaaugauu

SEQ ID NO: 4023744 - RNA, 13 nt, Staphylococcus aureus subsp. aureus MW2
aaucaagcaaugc

SEQ ID NO: 4023745 - RNA, 19 nt, Staphylococcus aureus subsp. aureus MW2
aaucaagcaaugcaugcuu

SEQ ID NO: 4023746 - RNA, 18 nt, Staphylococcus aureus subsp. aureus MW2
aaucaagucugcauuaau

SEQ ID NO: 4023747 - RNA, 12 nt, Staphylococcus aureus subsp. aureus MW2
aaucaauacuaa

SEQ ID NO: 4023748 - RNA, 22 nt, Staphylococcus aureus subsp. aureus MW2
aaucaauaguuuauaauuuaau

SEQ ID NO: 4023749 - RNA, 20 nt, Staphylococcus aureus subsp. aureus MW2
aaucguuccaacaacuaaga

SEQ ID NO: 4023750 - RNA, 22 nt, Staphylococcus aureus subsp. aureus MW2
aaucguuccaccgaacccuguu

SEQ ID NO: 4023751 - RNA, 22 nt, Staphylococcus aureus subsp. aureus MW2
aaucguuucauacacuuuaaca

SEQ ID NO: 4023752 - RNA, 13 nt, Staphylococcus aureus subsp. aureus MW2
aaucuaaauguaa

SEQ ID NO: 4023753 - RNA, 14 nt, Staphylococcus aureus subsp. aureus MW2
aaucuaaauguaaa

SEQ ID NO: 4023754 - RNA, 19 nt, Staphylococcus aureus subsp. aureus MW2
aaucuaaggccauuuguag

SEQ ID NO: 4023755 - RNA, 21 nt, Staphylococcus aureus subsp. aureus MW2
aaucuaauacuuucaaacaaa

SEQ ID NO: 4023756 - RNA, 14 nt, Staphylococcus aureus subsp. aureus MW2
aaucuacaauauua

SEQ ID NO: 4023757 - RNA, 18 nt, Staphylococcus aureus subsp. aureus MW2
aaucuacgauuuucaaga

SEQ ID NO: 4023758 - RNA, 15 nt, Staphylococcus aureus subsp. aureus MW2
aaucuagaccuucaa

SEQ ID NO: 4023759 - RNA, 22 nt, Staphylococcus aureus subsp. aureus MW2
aaucuauaaauaucaauaauuc

SEQ ID NO: 4023760 - RNA, 14 nt, Staphylococcus aureus subsp. aureus MW2
aaucuauaaauuau

SEQ ID NO: 4023761 - RNA, 21 nt, Staphylococcus aureus subsp. aureus MW2
aaucuauaccauuccaaaaau

SEQ ID NO: 4023762 - RNA, 13 nt, Staphylococcus aureus subsp. aureus MW2
aaucuauauaaag

SEQ ID NO: 4023763 - RNA, 14 nt, Staphylococcus aureus subsp. aureus MW2
aaucuauauaacgc

SEQ ID NO: 4023764 - RNA, 21 nt, Staphylococcus aureus subsp. aureus MW2
aaucuauauaacgcuuuaaau

SEQ ID NO: 4023765 - RNA, 12 nt, Staphylococcus aureus subsp. aureus MW2
aaucuauauaua

SEQ ID NO: 4023766 - RNA, 13 nt, Staphylococcus aureus subsp. aureus MW2
aaucuaucuauuc

SEQ ID NO: 4023767 - RNA, 16 nt, Staphylococcus aureus subsp. aureus MW2
aaucuauugugauaua

SEQ ID NO: 4023768 - RNA, 13 nt, Staphylococcus aureus subsp. aureus MW2
aaucuauuuuaaa

SEQ ID NO: 4023769 - RNA, 16 nt, Staphylococcus aureus subsp. aureus MW2
aaucuauuuuaaacuc

SEQ ID NO: 4023770 - RNA, 16 nt, Staphylococcus aureus subsp. aureus MW2
aaucucauaauaauuc

SEQ ID NO: 4023771 - RNA, 13 nt, Staphylococcus aureus subsp. aureus MW2
aaucucaucuaac

SEQ ID NO: 4023772 - RNA, 17 nt, Staphylococcus aureus subsp. aureus MW2
aaucucaugccaaaaac

SEQ ID NO: 4023773 - RNA, 20 nt, Staphylococcus aureus subsp. aureus MW2
aaucucauucuuuaauauaa

SEQ ID NO: 4023774 - RNA, 23 nt, Staphylococcus aureus subsp. aureus MW2
aaucuccuugcucaugagcacaa

SEQ ID NO: 4023775 - RNA, 16 nt, Staphylococcus aureus subsp. aureus MW2
aaucugauucauuaaa

SEQ ID NO: 4023776 - RNA, 15 nt, Staphylococcus aureus subsp. aureus MW2
aaucugcaaaugccu

SEQ ID NO: 4023777 - RNA, 19 nt, Staphylococcus aureus subsp. aureus MW2
aaucugcaacgauuuuaaa

SEQ ID NO: 4023778 - RNA, 23 nt, Staphylococcus aureus subsp. aureus MW2
aaucugcuugugugucauuacca

SEQ ID NO: 4023779 - RNA, 20 nt, Staphylococcus aureus subsp. aureus MW2
aaucuguacuucuaauuugc

SEQ ID NO: 4023780 - RNA, 14 nt, Staphylococcus aureus subsp. aureus MW2
aaucuuaauugucu

SEQ ID NO: 4023781 - RNA, 19 nt, Staphylococcus aureus subsp. aureus MW2
aaucuuaggugucaucgcu

SEQ ID NO: 4023782 - RNA, 22 nt, Staphylococcus aureus subsp. aureus MW2
aaucuuauuuuguuuuaaaaaa

SEQ ID NO: 4023783 - RNA, 17 nt, Staphylococcus aureus subsp. aureus MW2
aaucuucuaguaauucu

SEQ ID NO: 4023784 - RNA, 20 nt, Staphylococcus aureus subsp. aureus MW2
aaucuucuccaaucaucauu

SEQ ID NO: 4023785 - RNA, 16 nt, Staphylococcus aureus subsp. aureus MW2
aaucuugcauaaccaa

SEQ ID NO: 4023786 - RNA, 20 nt, Staphylococcus aureus subsp. aureus MW2
aaucuugcauaaccaaguaa

SEQ ID NO: 4023787 - RNA, 19 nt, Staphylococcus aureus subsp. aureus MW2
aaucuuuacuuguaauuaa

SEQ ID NO: 4023788 - RNA, 21 nt, Staphylococcus aureus subsp. aureus MW2
aaucuuuacuuguaauuaaua

SEQ ID NO: 4023789 - RNA, 15 nt, Staphylococcus aureus subsp. aureus MW2
aaucuuuaucaguuu

SEQ ID NO: 4023790 - RNA, 14 nt, Staphylococcus aureus subsp. aureus MW2
aaucuuuauuaaua

SEQ ID NO: 4023791 - RNA, 19 nt, Staphylococcus aureus subsp. aureus MW2
aaucuuuuagcuuuuguaa

SEQ ID NO: 4023792 - RNA, 17 nt, Staphylococcus aureus subsp. aureus MW2
aaucuuuuccuaaaccu

SEQ ID NO: 4023793 - RNA, 18 nt, Staphylococcus aureus subsp. aureus MW2
aaugaaaacagguggaag

SEQ ID NO: 4023794 - RNA, 19 nt, Staphylococcus aureus subsp. aureus MW2
aaugaaagcaccuaaaaua

SEQ ID NO: 4023795 - RNA, 17 nt, Staphylococcus aureus subsp. aureus MW2
aaugaaccagcuaacca

SEQ ID NO: 4023796 - RNA, 20 nt, Staphylococcus aureus subsp. aureus MW2
aaugaaccagcuaaccaaau

SEQ ID NO: 4023797 - RNA, 18 nt, Staphylococcus aureus subsp. aureus MW2
aaugaacuucucuuaguu

SEQ ID NO: 4023798 - RNA, 12 nt, Staphylococcus aureus subsp. aureus MW2
aaugaagaauac

SEQ ID NO: 4023799 - RNA, 15 nt, Staphylococcus aureus subsp. aureus MW2
aaugaagaauacaaa

SEQ ID NO: 4023800 - RNA, 16 nt, Staphylococcus aureus subsp. aureus MW2
aaugaagcugugugaa

SEQ ID NO: 4023801 - RNA, 18 nt, Staphylococcus aureus subsp. aureus MW2
aaugaaguaauauauaaa

SEQ ID NO: 4023802 - RNA, 21 nt, Staphylococcus aureus subsp. aureus MW2
aaugaaguaauauauaaaagu

SEQ ID NO: 4023803 - RNA, 24 nt, Staphylococcus aureus subsp. aureus MW2
aaugaaguaggcugaaguugaagc

SEQ ID NO: 4023804 - RNA, 16 nt, Staphylococcus aureus subsp. aureus MW2
aaugaauaaauugaua

SEQ ID NO: 4023805 - RNA, 16 nt, Staphylococcus aureus subsp. aureus MW2
aaugaauaaugacaaa

SEQ ID NO: 4023806 - RNA, 21 nt, Staphylococcus aureus subsp. aureus MW2
aaugaauaaugacaaauuauc

SEQ ID NO: 4023807 - RNA, 12 nt, Staphylococcus aureus subsp. aureus MW2
aaugaauaauua

SEQ ID NO: 4023808 - RNA, 21 nt, Staphylococcus aureus subsp. aureus MW2
aaugaauaauuacuaaaauau

SEQ ID NO: 4023809 - RNA, 19 nt, Staphylococcus aureus subsp. aureus MW2
aaugaauaguaaucagcuu

SEQ ID NO: 4023810 - RNA, 18 nt, Staphylococcus aureus subsp. aureus MW2
aaugaaucaaaucaauau

SEQ ID NO: 4023811 - RNA, 16 nt, Staphylococcus aureus subsp. aureus MW2
aaugaaucaauugcau

SEQ ID NO: 4023812 - RNA, 19 nt, Staphylococcus aureus subsp. aureus MW2
aaugaauccaaauauuaaa

SEQ ID NO: 4023813 - RNA, 13 nt, Staphylococcus aureus subsp. aureus MW2
aaugaauguuaag

SEQ ID NO: 4023814 - RNA, 15 nt, Staphylococcus aureus subsp. aureus MW2
aaugaauuauuuaaa

SEQ ID NO: 4023815 - RNA, 19 nt, Staphylococcus aureus subsp. aureus MW2
aaugaauuauuuaaaaugc

SEQ ID NO: 4023816 - RNA, 17 nt, Staphylococcus aureus subsp. aureus MW2
aaugaauucuauccuaa

SEQ ID NO: 4023817 - RNA, 12 nt, Staphylococcus aureus subsp. aureus MW2
aaugaauugcuu

SEQ ID NO: 4023818 - RNA, 16 nt, Staphylococcus aureus subsp. aureus MW2
aaugaccaauagccau

SEQ ID NO: 4023819 - RNA, 15 nt, Staphylococcus aureus subsp. aureus MW2
aaugaccauugucau

SEQ ID NO: 4023820 - RNA, 15 nt, Staphylococcus aureus subsp. aureus MW2
aaugaccuggaauau

SEQ ID NO: 4023821 - RNA, 13 nt, Staphylococcus aureus subsp. aureus MW2
aaugacuaaaucg

SEQ ID NO: 4023822 - RNA, 23 nt, Staphylococcus aureus subsp. aureus MW2
aaugacuaccuguuggcuuuaaa

SEQ ID NO: 4023823 - RNA, 14 nt, Staphylococcus aureus subsp. aureus MW2
aaugacugaauuaa

SEQ ID NO: 4023824 - RNA, 16 nt, Staphylococcus aureus subsp. aureus MW2
aaugacugagaaaaau

SEQ ID NO: 4023825 - RNA, 19 nt, Staphylococcus aureus subsp. aureus MW2
aaugacuucuuuauauuua

SEQ ID NO: 4023826 - RNA, 20 nt, Staphylococcus aureus subsp. aureus MW2
aaugacuucuuuauauuuau

SEQ ID NO: 4023827 - RNA, 23 nt, Staphylococcus aureus subsp. aureus MW2
aaugagaaugcgcuuguaacaag

SEQ ID NO: 4023828 - RNA, 20 nt, Staphylococcus aureus subsp. aureus MW2
aaugagcccguuaaaaagac

SEQ ID NO: 4023829 - RNA, 24 nt, Staphylococcus aureus subsp. aureus MW2
aaugagcugaacuuucuuuauuau

SEQ ID NO: 4023830 - RNA, 18 nt, Staphylococcus aureus subsp. aureus MW2
aaugagcuuuucuaaugc

SEQ ID NO: 4023831 - RNA, 14 nt, Staphylococcus aureus subsp. aureus MW2
aaugaguacaacau

SEQ ID NO: 4023832 - RNA, 14 nt, Staphylococcus aureus subsp. aureus MW2
aaugauaauuuaau

SEQ ID NO: 4023833 - RNA, 17 nt, Staphylococcus aureus subsp. aureus MW2
aaugauaccuuuaaauc

SEQ ID NO: 4023834 - RNA, 18 nt, Staphylococcus aureus subsp. aureus MW2
aaugauacgccuaaauau

SEQ ID NO: 4023835 - RNA, 19 nt, Staphylococcus aureus subsp. aureus MW2
aaugauagaugcuggcuua

SEQ ID NO: 4023836 - RNA, 15 nt, Staphylococcus aureus subsp. aureus MW2
aaugauagcuaaaca

SEQ ID NO: 4023837 - RNA, 21 nt, Staphylococcus aureus subsp. aureus MW2
aaugugcauugcuuuuguuaa

SEQ ID NO: 4023838 - RNA, 21 nt, Staphylococcus aureus subsp. aureus MW2
aaugugccuuuuguuacgauu

SEQ ID NO: 4023839 - RNA, 18 nt, Staphylococcus aureus subsp. aureus MW2
aaugugcgaacuugcuuu

SEQ ID NO: 4023840 - RNA, 15 nt, Staphylococcus aureus subsp. aureus MW2
aauguguaaacuaga

SEQ ID NO: 4023841 - RNA, 17 nt, Staphylococcus aureus subsp. aureus MW2
aauguguaccuuuuuau

SEQ ID NO: 4023842 - RNA, 15 nt, Staphylococcus aureus subsp. aureus MW2
aauguguuaaaauau

SEQ ID NO: 4023843 - RNA, 18 nt, Staphylococcus aureus subsp. aureus MW2
aauguguuaauacuucau

SEQ ID NO: 4023844 - RNA, 19 nt, Staphylococcus aureus subsp. aureus MW2
aauguuaaacacucaaaau

SEQ ID NO: 4023845 - RNA, 16 nt, Staphylococcus aureus subsp. aureus MW2
aauguuaaagauuauu

SEQ ID NO: 4023846 - RNA, 17 nt, Staphylococcus aureus subsp. aureus MW2
aauguuaaauucuaaaa

SEQ ID NO: 4023847 - RNA, 21 nt, Staphylococcus aureus subsp. aureus MW2
aauguuaacugcaaacuugau

SEQ ID NO: 4023848 - RNA, 18 nt, Staphylococcus aureus subsp. aureus MW2
aauguuacacaaauuaaa

SEQ ID NO: 4023849 - RNA, 17 nt, Staphylococcus aureus subsp. aureus MW2
aauguuaggugcuuggu

SEQ ID NO: 4023850 - RNA, 17 nt, Staphylococcus aureus subsp. aureus MW2
aauguuaucuugcuuau

SEQ ID NO: 4023851 - RNA, 14 nt, Staphylococcus aureus subsp. aureus MW2
aauguuauuagaua

SEQ ID NO: 4023852 - RNA, 16 nt, Staphylococcus aureus subsp. aureus MW2
aauguucccuucaaag

SEQ ID NO: 4023853 - RNA, 22 nt, Staphylococcus aureus subsp. aureus MW2
aauguucuaggcuccuaaaugu

SEQ ID NO: 4023854 - RNA, 23 nt, Staphylococcus aureus subsp. aureus MW2
aauguuggaaaaggucaaaaaau

SEQ ID NO: 4023855 - RNA, 21 nt, Staphylococcus aureus subsp. aureus MW2
aauguugucguuucuagcaac

SEQ ID NO: 4023856 - RNA, 13 nt, Staphylococcus aureus subsp. aureus MW2
aauguuuaacaau

SEQ ID NO: 4023857 - RNA, 15 nt, Staphylococcus aureus subsp. aureus MW2
aauguuuauaucuuu

SEQ ID NO: 4023858 - RNA, 14 nt, Staphylococcus aureus subsp. aureus MW2
aauguuucagaacu

SEQ ID NO: 4023859 - RNA, 16 nt, Staphylococcus aureus subsp. aureus MW2
aauguuucaugaccaa

SEQ ID NO: 4023860 - RNA, 19 nt, Staphylococcus aureus subsp. aureus MW2
aauguuucaugaccaacag

SEQ ID NO: 4023861 - RNA, 19 nt, Staphylococcus aureus subsp. aureus MW2
aauguuucuucaauugucu

SEQ ID NO: 4023862 - RNA, 18 nt, Staphylococcus aureus subsp. aureus MW2
aauguuugcuuuuuguaa

SEQ ID NO: 4023863 - RNA, 23 nt, Staphylococcus aureus subsp. aureus MW2
aauguuuucagccacugucaugu

SEQ ID NO: 4023864 - RNA, 19 nt, Staphylococcus aureus subsp. aureus MW2
aauguuuugacuauguugu

SEQ ID NO: 4023865 - RNA, 18 nt, Staphylococcus aureus subsp. aureus MW2
aauguuuuguguauuuau

SEQ ID NO: 4023866 - RNA, 18 nt, Staphylococcus aureus subsp. aureus MW2
aauguuuuugauaguaau

SEQ ID NO: 4023867 - RNA, 14 nt, Staphylococcus aureus subsp. aureus MW2
aauuaaaaaacaaa

SEQ ID NO: 4023868 - RNA, 18 nt, Staphylococcus aureus subsp. aureus MW2
aauuaaaaaacaauaaaa

SEQ ID NO: 4023869 - RNA, 20 nt, Staphylococcus aureus subsp. aureus MW2
aauuaaaaaacaauaaaauu

SEQ ID NO: 4023870 - RNA, 14 nt, Staphylococcus aureus subsp. aureus MW2
aauuaaaaaaugcu

SEQ ID NO: 4023871 - RNA, 22 nt, Staphylococcus aureus subsp. aureus MW2
aauuaaaacagcaaauaaaauc

SEQ ID NO: 4023872 - RNA, 14 nt, Staphylococcus aureus subsp. aureus MW2
aauuaaaacuauaa

SEQ ID NO: 4023873 - RNA, 18 nt, Staphylococcus aureus subsp. aureus MW2
aauuaaaacuauaauaaa

SEQ ID NO: 4023874 - RNA, 20 nt, Staphylococcus aureus subsp. aureus MW2
aauuaaaacuuucagagaua

SEQ ID NO: 4023875 - RNA, 12 nt, Staphylococcus aureus subsp. aureus MW2
aauuaaaagccc

SEQ ID NO: 4023876 - RNA, 15 nt, Staphylococcus aureus subsp. aureus MW2
aauuaaaauguuaau

SEQ ID NO: 4023877 - RNA, 15 nt, Staphylococcus aureus subsp. aureus MW2
aauuaaaauuuguua

SEQ ID NO: 4023878 - RNA, 14 nt, Staphylococcus aureus subsp. aureus MW2
aauuaaacaaaacu

SEQ ID NO: 4023879 - RNA, 23 nt, Staphylococcus aureus subsp. aureus MW2
aauuaaacaaaacuuaaaauauu

SEQ ID NO: 4023880 - RNA, 23 nt, Staphylococcus aureus subsp. aureus MW2
aauuaaacaagccuuaaaauauu

SEQ ID NO: 4023881 - RNA, 13 nt, Staphylococcus aureus subsp. aureus MW2
aauuaaacaaguu

SEQ ID NO: 4023882 - RNA, 11 nt, Staphylococcus aureus subsp. aureus MW2
aauuaaacugu

SEQ ID NO: 4023883 - RNA, 17 nt, Staphylococcus aureus subsp. aureus MW2
aauuaaacuuaagaaua

SEQ ID NO: 4023884 - RNA, 17 nt, Staphylococcus aureus subsp. aureus MW2
aauuaaagauuaaaaua

SEQ ID NO: 4023885 - RNA, 20 nt, Staphylococcus aureus subsp. aureus MW2
aauuaaagucaauuuaaaua

SEQ ID NO: 4023886 - RNA, 13 nt, Staphylococcus aureus subsp. aureus MW2
aauuaaagugaau

SEQ ID NO: 4023887 - RNA, 14 nt, Staphylococcus aureus subsp. aureus MW2
aauuaaaguuaaag

SEQ ID NO: 4023888 - RNA, 16 nt, Staphylococcus aureus subsp. aureus MW2
aauuaaauaaaaauau

SEQ ID NO: 4023889 - RNA, 15 nt, Staphylococcus aureus subsp. aureus MW2
aauuaaauaaugaua

SEQ ID NO: 4023890 - RNA, 15 nt, Staphylococcus aureus subsp. aureus MW2
aauuaaauauuuaac

SEQ ID NO: 4023891 - RNA, 18 nt, Staphylococcus aureus subsp. aureus MW2
aauuaaauuauauguuuu

SEQ ID NO: 4023892 - RNA, 16 nt, Staphylococcus aureus subsp. aureus MW2
aauuaacaauauuaaa

SEQ ID NO: 4023893 - RNA, 19 nt, Staphylococcus aureus subsp. aureus MW2
aauuaacaauauuaaauuu

SEQ ID NO: 4023894 - RNA, 14 nt, Staphylococcus aureus subsp. aureus MW2
aauuaaccccuuca

SEQ ID NO: 4023895 - RNA, 19 nt, Staphylococcus aureus subsp. aureus MW2
aauuaaccuugauuuaauu

SEQ ID NO: 4023896 - RNA, 16 nt, Staphylococcus aureus subsp. aureus MW2
aauuaacuaguguaau

SEQ ID NO: 4023897 - RNA, 12 nt, Staphylococcus aureus subsp. aureus MW2
aauuaacuugau

SEQ ID NO: 4023898 - RNA, 14 nt, Staphylococcus aureus subsp. aureus MW2
aauuaacuugauau

SEQ ID NO: 4023899 - RNA, 22 nt, Staphylococcus aureus subsp. aureus MW2
aauuaagaaaaucauucauuug

SEQ ID NO: 4023900 - RNA, 14 nt, Staphylococcus aureus subsp. aureus MW2
aauuaagaugaaau

SEQ ID NO: 4023901 - RNA, 17 nt, Staphylococcus aureus subsp. aureus MW2
aauuaagaugaaauacu

SEQ ID NO: 4023902 - RNA, 12 nt, Staphylococcus aureus subsp. aureus MW2
aauuaauaaaaa

SEQ ID NO: 4023903 - RNA, 22 nt, Staphylococcus aureus subsp. aureus MW2
aauuaauaacauccccaaaaau

SEQ ID NO: 4023904 - RNA, 11 nt, Staphylococcus aureus subsp. aureus MW2
aauuaauaauu

SEQ ID NO: 4023905 - RNA, 23 nt, Staphylococcus aureus subsp. aureus MW2
aauuaauacaucaauaucuucua

SEQ ID NO: 4023906 - RNA, 18 nt, Staphylococcus aureus subsp. aureus MW2
aauuaauagagaaaaaau

SEQ ID NO: 4023907 - RNA, 19 nt, Staphylococcus aureus subsp. aureus MW2
aauuaauagagacauuuua

SEQ ID NO: 4023908 - RNA, 16 nt, Staphylococcus aureus subsp. aureus MW2
aauuaaucaauuuaau

SEQ ID NO: 4023909 - RNA, 21 nt, Staphylococcus aureus subsp. aureus MW2
aauuaauccaucuacacccau

SEQ ID NO: 4023910 - RNA, 13 nt, Staphylococcus aureus subsp. aureus MW2
aauuaaugauaaa

SEQ ID NO: 4023911 - RNA, 17 nt, Staphylococcus aureus subsp. aureus MW2
aauuaaugcaucaguau

SEQ ID NO: 4023912 - RNA, 12 nt, Staphylococcus aureus subsp. aureus MW2
aauuaauguaau

SEQ ID NO: 4023913 - RNA, 13 nt, Staphylococcus aureus subsp. aureus MW2
aauuaauuaaaag

SEQ ID NO: 4023914 - RNA, 22 nt, Staphylococcus aureus subsp. aureus MW2
aauuaauuacuuucauuguaaa

SEQ ID NO: 4023915 - RNA, 13 nt, Staphylococcus aureus subsp. aureus MW2
aauuaauuaucau

SEQ ID NO: 4023916 - RNA, 17 nt, Staphylococcus aureus subsp. aureus MW2
aauuaauucuuugaaaa

SEQ ID NO: 4023917 - RNA, 18 nt, Staphylococcus aureus subsp. aureus MW2
aauuacacccuuuaaauu

SEQ ID NO: 4023918 - RNA, 23 nt, Staphylococcus aureus subsp. aureus MW2
aauuacauauacgacauuuuuag

SEQ ID NO: 4023919 - RNA, 22 nt, Staphylococcus aureus subsp. aureus MW2
aauuaccaaugaauaaauugau

SEQ ID NO: 4023920 - RNA, 21 nt, Staphylococcus aureus subsp. aureus MW2
aauuaccuuuccauucguaua

SEQ ID NO: 4023921 - RNA, 14 nt, Staphylococcus aureus subsp. aureus MW2
aauuacgacaagaa

SEQ ID NO: 4023922 - RNA, 16 nt, Staphylococcus aureus subsp. aureus MW2
aauuacgacaagaauu

SEQ ID NO: 4023923 - RNA, 15 nt, Staphylococcus aureus subsp. aureus MW2
aauuacgcaaagaaa

SEQ ID NO: 4023924 - RNA, 17 nt, Staphylococcus aureus subsp. aureus MW2
aauuacgcaaagaaaaa

SEQ ID NO: 4023925 - RNA, 20 nt, Staphylococcus aureus subsp. aureus MW2
aauuacgcauccuaauguaa

SEQ ID NO: 4023926 - RNA, 18 nt, Staphylococcus aureus subsp. aureus MW2
aauugacgcauuaaugau

SEQ ID NO: 4023927 - RNA, 19 nt, Staphylococcus aureus subsp. aureus MW2
aauugacgcauuaaugauu

SEQ ID NO: 4023928 - RNA, 17 nt, Staphylococcus aureus subsp. aureus MW2
aauugacucaaagauau

SEQ ID NO: 4023929 - RNA, 22 nt, Staphylococcus aureus subsp. aureus MW2
aauugacucaaagauauacuua

SEQ ID NO: 4023930 - RNA, 19 nt, Staphylococcus aureus subsp. aureus MW2
aauugacuuacauuuuaau

SEQ ID NO: 4023931 - RNA, 16 nt, Staphylococcus aureus subsp. aureus MW2
aauugaguuguugcaa

SEQ ID NO: 4023932 - RNA, 22 nt, Staphylococcus aureus subsp. aureus MW2
aauugaguuguugcaacuugug

SEQ ID NO: 4023933 - RNA, 22 nt, Staphylococcus aureus subsp. aureus MW2
aauugauaguagcuuaaugcau

SEQ ID NO: 4023934 - RNA, 23 nt, Staphylococcus aureus subsp. aureus MW2
aauugauauuuaccgucuuauga

SEQ ID NO: 4023935 - RNA, 19 nt, Staphylococcus aureus subsp. aureus MW2
aauugaucgaagucaggau

SEQ ID NO: 4023936 - RNA, 21 nt, Staphylococcus aureus subsp. aureus MW2
aauugaucuaaauuaguuaau

SEQ ID NO: 4023937 - RNA, 14 nt, Staphylococcus aureus subsp. aureus MW2
aauugaugauuacu

SEQ ID NO: 4023938 - RNA, 17 nt, Staphylococcus aureus subsp. aureus MW2
aauugauguugaugcaa

SEQ ID NO: 4023939 - RNA, 18 nt, Staphylococcus aureus subsp. aureus MW2
aauugauuacaccacuua

SEQ ID NO: 4023940 - RNA, 22 nt, Staphylococcus aureus subsp. aureus MW2
aauugauuacaccacuuaggau

SEQ ID NO: 4023941 - RNA, 19 nt, Staphylococcus aureus subsp. aureus MW2
aauugauuucuaauugaaa

SEQ ID NO: 4023942 - RNA, 18 nt, Staphylococcus aureus subsp. aureus MW2
aauugauuuugaaucaca

SEQ ID NO: 4023943 - RNA, 15 nt, Staphylococcus aureus subsp. aureus MW2
aauugcaauggcaac

SEQ ID NO: 4023944 - RNA, 21 nt, Staphylococcus aureus subsp. aureus MW2
aauugcguuguuucauuauca

SEQ ID NO: 4023945 - RNA, 14 nt, Staphylococcus aureus subsp. aureus MW2
aauugcguuuaaua

SEQ ID NO: 4023946 - RNA, 15 nt, Staphylococcus aureus subsp. aureus MW2
aauugcuaaaaaaau

SEQ ID NO: 4023947 - RNA, 19 nt, Staphylococcus aureus subsp. aureus MW2
aauugcuaaaaaaauuaaa

SEQ ID NO: 4023948 - RNA, 18 nt, Staphylococcus aureus subsp. aureus MW2
aauugcuaaaucaucuuc

SEQ ID NO: 4023949 - RNA, 22 nt, Staphylococcus aureus subsp. aureus MW2
aauugcuauauuaguauaauuu

SEQ ID NO: 4023950 - RNA, 14 nt, Staphylococcus aureus subsp. aureus MW2
aauugcuguaaaua

SEQ ID NO: 4023951 - RNA, 15 nt, Staphylococcus aureus subsp. aureus MW2
aauugcugucacuaa

SEQ ID NO: 4023952 - RNA, 17 nt, Staphylococcus aureus subsp. aureus MW2
aauugcuuguucuuucu

SEQ ID NO: 4023953 - RNA, 17 nt, Staphylococcus aureus subsp. aureus MW2
aauugcuuuagaaaguc

SEQ ID NO: 4023954 - RNA, 15 nt, Staphylococcus aureus subsp. aureus MW2
aauuggaaguauuua

SEQ ID NO: 4023955 - RNA, 21 nt, Staphylococcus aureus subsp. aureus MW2
aauuggaaucaucuuuuugaa

SEQ ID NO: 4023956 - RNA, 22 nt, Staphylococcus aureus subsp. aureus MW2
aauuggaaucaucuuuuugaaa

SEQ ID NO: 4023957 - RNA, 22 nt, Staphylococcus aureus subsp. aureus MW2
aauuggcaacggcacauucaua

SEQ ID NO: 4023958 - RNA, 16 nt, Staphylococcus aureus subsp. aureus MW2
aauuggcagauagaau

SEQ ID NO: 4023959 - RNA, 20 nt, Staphylococcus aureus subsp. aureus MW2
aauugguuuggauaaaauga

SEQ ID NO: 4023960 - RNA, 22 nt, Staphylococcus aureus subsp. aureus MW2
aauugguuuggauaaaaugaua

SEQ ID NO: 4023961 - RNA, 21 nt, Staphylococcus aureus subsp. aureus MW2
aauugguuuucaugugucaua

SEQ ID NO: 4023962 - RNA, 12 nt, Staphylococcus aureus subsp. aureus MW2
aauuguaaaucu

SEQ ID NO: 4023963 - RNA, 12 nt, Staphylococcus aureus subsp. aureus MW2
aauuguaauacu

SEQ ID NO: 4023964 - RNA, 20 nt, Staphylococcus aureus subsp. aureus MW2
aauuguaaucuauuuucugc

SEQ ID NO: 4023965 - RNA, 17 nt, Staphylococcus aureus subsp. aureus MW2
aauuguacuuaaaccua

SEQ ID NO: 4023966 - RNA, 16 nt, Staphylococcus aureus subsp. aureus MW2
aauuguaguaaugaag

SEQ ID NO: 4023967 - RNA, 13 nt, Staphylococcus aureus subsp. aureus MW2
aauuguauagaau

SEQ ID NO: 4023968 - RNA, 16 nt, Staphylococcus aureus subsp. aureus MW2
aauuguauuuucugcu

SEQ ID NO: 4023969 - RNA, 14 nt, Staphylococcus aureus subsp. aureus MW2
aauugucguuuaau

SEQ ID NO: 4023970 - RNA, 23 nt, Staphylococcus aureus subsp. aureus MW2
aauugugacgcggguaauauuuu

SEQ ID NO: 4023971 - RNA, 20 nt, Staphylococcus aureus subsp. aureus MW2
aauugugccauuuguaacaa

SEQ ID NO: 4023972 - RNA, 17 nt, Staphylococcus aureus subsp. aureus MW2
aauugugcuuuuucaua

SEQ ID NO: 4023973 - RNA, 16 nt, Staphylococcus aureus subsp. aureus MW2
aauuguguugaaucaa

SEQ ID NO: 4023974 - RNA, 21 nt, Staphylococcus aureus subsp. aureus MW2
aauuguguugaaucaacaguu

SEQ ID NO: 4023975 - RNA, 16 nt, Staphylococcus aureus subsp. aureus MW2
aauuguuacuaguucu

SEQ ID NO: 4023976 - RNA, 20 nt, Staphylococcus aureus subsp. aureus MW2
aauuguuagauaaucucauu

SEQ ID NO: 4023977 - RNA, 11 nt, Staphylococcus aureus subsp. aureus MW2
aauuguuaucg

SEQ ID NO: 4023978 - RNA, 14 nt, Staphylococcus aureus subsp. aureus MW2
aauuguuaucguuc

SEQ ID NO: 4023979 - RNA, 23 nt, Staphylococcus aureus subsp. aureus MW2
aauuguucuaauacaccaaaucc

SEQ ID NO: 4023980 - RNA, 18 nt, Staphylococcus aureus subsp. aureus MW2
aauuguucucgucuuuug

SEQ ID NO: 4023981 - RNA, 22 nt, Staphylococcus aureus subsp. aureus MW2
aauuguugcauuacuuucugcc

SEQ ID NO: 4023982 - RNA, 15 nt, Staphylococcus aureus subsp. aureus MW2
aauuuaaaaauagua

SEQ ID NO: 4023983 - RNA, 20 nt, Staphylococcus aureus subsp. aureus MW2
aauuuaaaaauaguucuuua

SEQ ID NO: 4023984 - RNA, 15 nt, Staphylococcus aureus subsp. aureus MW2
aauuuaaaaaugaua

SEQ ID NO: 4023985 - RNA, 16 nt, Staphylococcus aureus subsp. aureus MW2
aauuuaaaacaaugau

SEQ ID NO: 4023986 - RNA, 21 nt, Staphylococcus aureus subsp. aureus MW2
aauuuaaaacaaugauuaaaa

SEQ ID NO: 4023987 - RNA, 15 nt, Staphylococcus aureus subsp. aureus MW2
aauuuaaaagaaaaa

SEQ ID NO: 4023988 - RNA, 13 nt, Staphylococcus aureus subsp. aureus MW2
aauuuaaagcauc

SEQ ID NO: 4023989 - RNA, 18 nt, Staphylococcus aureus subsp. aureus MW2
aauuuaaagcaucauaua

SEQ ID NO: 4023990 - RNA, 16 nt, Staphylococcus aureus subsp. aureus MW2
aauuuaaaggcauaau

SEQ ID NO: 4023991 - RNA, 10 nt, Staphylococcus aureus subsp. aureus MW2
aauuuaaaug

SEQ ID NO: 4023992 - RNA, 13 nt, Staphylococcus aureus subsp. aureus MW2
aauuuaaaugaua

SEQ ID NO: 4023993 - RNA, 12 nt, Staphylococcus aureus subsp. aureus MW2
aauuuaaaugcu

SEQ ID NO: 4023994 - RNA, 19 nt, Staphylococcus aureus subsp. aureus MW2
aauuuaaaugcuuaauuug

SEQ ID NO: 4023995 - RNA, 16 nt, Staphylococcus aureus subsp. aureus MW2
aauuuaaauuaaaaua

SEQ ID NO: 4023996 - RNA, 14 nt, Staphylococcus aureus subsp. aureus MW2
aauuuaacauuuuu

SEQ ID NO: 4023997 - RNA, 20 nt, Staphylococcus aureus subsp. aureus MW2
aauuuaacguuauucauuug

SEQ ID NO: 4023998 - RNA, 17 nt, Staphylococcus aureus subsp. aureus MW2
aauuuaacuaugaaauu

SEQ ID NO: 4023999 - RNA, 21 nt, Staphylococcus aureus subsp. aureus MW2
aauuuaacuuucccuacugcu

SEQ ID NO: 4024000 - RNA, 13 nt, Staphylococcus aureus subsp. aureus MW2
aauuuaauaauua

SEQ ID NO: 4024001 - RNA, 16 nt, Staphylococcus aureus subsp. aureus MW2
aauuuaauaauuaaau

SEQ ID NO: 4024002 - RNA, 14 nt, Staphylococcus aureus subsp. aureus MW2
aauuuaauaugcua

SEQ ID NO: 4024003 - RNA, 15 nt, Staphylococcus aureus subsp. aureus MW2
aauuuaauauuauaa

SEQ ID NO: 4024004 - RNA, 16 nt, Staphylococcus aureus subsp. aureus MW2
aauuuaauauuguuaa

SEQ ID NO: 4024005 - RNA, 17 nt, Staphylococcus aureus subsp. aureus MW2
aauuuaauguugcaaaa

SEQ ID NO: 4024006 - RNA, 19 nt, Staphylococcus aureus subsp. aureus MW2
aauuuaauguugcaaaauu

SEQ ID NO: 4024007 - RNA, 16 nt, Staphylococcus aureus subsp. aureus MW2
aauuuagaugcauaaa

SEQ ID NO: 4024008 - RNA, 15 nt, Staphylococcus aureus subsp. aureus MW2
aauuuagcaaauauu

SEQ ID NO: 4024009 - RNA, 16 nt, Staphylococcus aureus subsp. aureus MW2
aauuuaggaaugaaua

SEQ ID NO: 4024010 - RNA, 17 nt, Staphylococcus aureus subsp. aureus MW2
aauuuaggcaugucaaa

SEQ ID NO: 4024011 - RNA, 24 nt, Staphylococcus aureus subsp. aureus MW2
aauuuagguggagauuuaacaaua

SEQ ID NO: 4024012 - RNA, 13 nt, Staphylococcus aureus subsp. aureus MW2
aauuuagguuaau

SEQ ID NO: 4024013 - RNA, 17 nt, Staphylococcus aureus subsp. aureus MW2
aauuuagguuaauuaaa

SEQ ID NO: 4024014 - RNA, 15 nt, Staphylococcus aureus subsp. aureus MW2
aauuuaguauaaaua

SEQ ID NO: 4024015 - RNA, 18 nt, Staphylococcus aureus subsp. aureus MW2
acaaaagcaacuguaaau

SEQ ID NO: 4024016 - RNA, 15 nt, Staphylococcus aureus subsp. aureus MW2
acaaaaguaugauuu

SEQ ID NO: 4024017 - RNA, 19 nt, Staphylococcus aureus subsp. aureus MW2
acaaaaguaugauuuguuu

SEQ ID NO: 4024018 - RNA, 14 nt, Staphylococcus aureus subsp. aureus MW2
acaaaauaacaugu

SEQ ID NO: 4024019 - RNA, 18 nt, Staphylococcus aureus subsp. aureus MW2
acaaaauacccugcuuua

SEQ ID NO: 4024020 - RNA, 19 nt, Staphylococcus aureus subsp. aureus MW2
acaaaaugcguaucaauau

SEQ ID NO: 4024021 - RNA, 16 nt, Staphylococcus aureus subsp. aureus MW2
acaaaauuuccacuuu

SEQ ID NO: 4024022 - RNA, 13 nt, Staphylococcus aureus subsp. aureus MW2
acaaacaagaaua

SEQ ID NO: 4024023 - RNA, 14 nt, Staphylococcus aureus subsp. aureus MW2
acaaacauaaucau

SEQ ID NO: 4024024 - RNA, 15 nt, Staphylococcus aureus subsp. aureus MW2
acaaacauuccucua

SEQ ID NO: 4024025 - RNA, 15 nt, Staphylococcus aureus subsp. aureus MW2
acaaaccaauuuuaa

SEQ ID NO: 4024026 - RNA, 13 nt, Staphylococcus aureus subsp. aureus MW2
acaaacuucacau

SEQ ID NO: 4024027 - RNA, 15 nt, Staphylococcus aureus subsp. aureus MW2
acaaacuucacauua

SEQ ID NO: 4024028 - RNA, 21 nt, Staphylococcus aureus subsp. aureus MW2
acaaagaaccacgcaucaugu

SEQ ID NO: 4024029 - RNA, 16 nt, Staphylococcus aureus subsp. aureus MW2
acaaagauuauugaaa

SEQ ID NO: 4024030 - RNA, 20 nt, Staphylococcus aureus subsp. aureus MW2
acaaagauuauugaaauuug

SEQ ID NO: 4024031 - RNA, 19 nt, Staphylococcus aureus subsp. aureus MW2
acaaagcucaauaaauuau

SEQ ID NO: 4024032 - RNA, 21 nt, Staphylococcus aureus subsp. aureus MW2
acaaaguauuugaaguauuuu

SEQ ID NO: 4024033 - RNA, 13 nt, Staphylococcus aureus subsp. aureus MW2
acaaagucauuuu

SEQ ID NO: 4024034 - RNA, 15 nt, Staphylococcus aureus subsp. aureus MW2
acaaagugauuuaaa

SEQ ID NO: 4024035 - RNA, 20 nt, Staphylococcus aureus subsp. aureus MW2
acaaagugauuuaaaaaaau

SEQ ID NO: 4024036 - RNA, 13 nt, Staphylococcus aureus subsp. aureus MW2
acaaaguuaauca

SEQ ID NO: 4024037 - RNA, 12 nt, Staphylococcus aureus subsp. aureus MW2
acaaauaaaaaa

SEQ ID NO: 4024038 - RNA, 14 nt, Staphylococcus aureus subsp. aureus MW2
acaaauaacaaaca

SEQ ID NO: 4024039 - RNA, 23 nt, Staphylococcus aureus subsp. aureus MW2
acaaauauaauguauaaaacaga

SEQ ID NO: 4024040 - RNA, 20 nt, Staphylococcus aureus subsp. aureus MW2
acaaauauacuugccuucaa

SEQ ID NO: 4024041 - RNA, 23 nt, Staphylococcus aureus subsp. aureus MW2
acaaauauacuugccuucaaauu

SEQ ID NO: 4024042 - RNA, 20 nt, Staphylococcus aureus subsp. aureus MW2
acaaaucaugacauaaaacu

SEQ ID NO: 4024043 - RNA, 16 nt, Staphylococcus aureus subsp. aureus MW2
acaaaucuauaaauau

SEQ ID NO: 4024044 - RNA, 11 nt, Staphylococcus aureus subsp. aureus MW2
acaaaugaaaa

SEQ ID NO: 4024045 - RNA, 22 nt, Staphylococcus aureus subsp. aureus MW2
acaaaugaagguguugaaaagu

SEQ ID NO: 4024046 - RNA, 18 nt, Staphylococcus aureus subsp. aureus MW2
acaaaugcuacaucaaua

SEQ ID NO: 4024047 - RNA, 19 nt, Staphylococcus aureus subsp. aureus MW2
acaaaugcuacaucaauau

SEQ ID NO: 4024048 - RNA, 15 nt, Staphylococcus aureus subsp. aureus MW2
acaaauggccuuaga

SEQ ID NO: 4024049 - RNA, 24 nt, Staphylococcus aureus subsp. aureus MW2
acaaauguauaccuauuggcauua

SEQ ID NO: 4024050 - RNA, 12 nt, Staphylococcus aureus subsp. aureus MW2
acaaauuaaaaa

SEQ ID NO: 4024051 - RNA, 17 nt, Staphylococcus aureus subsp. aureus MW2
acaaauuaaaaaacaau

SEQ ID NO: 4024052 - RNA, 22 nt, Staphylococcus aureus subsp. aureus MW2
acaaauucuaugagaauagaca

SEQ ID NO: 4024053 - RNA, 16 nt, Staphylococcus aureus subsp. aureus MW2
acaaauuuauauuaaa

SEQ ID NO: 4024054 - RNA, 17 nt, Staphylococcus aureus subsp. aureus MW2
acaaauuuauauuaaau

SEQ ID NO: 4024055 - RNA, 19 nt, Staphylococcus aureus subsp. aureus MW2
acaaauuuauauuaaauaa

SEQ ID NO: 4024056 - RNA, 22 nt, Staphylococcus aureus subsp. aureus MW2
acaaauuuauauuaaauaaagu

SEQ ID NO: 4024057 - RNA, 19 nt, Staphylococcus aureus subsp. aureus MW2
acaaauuugaauauacuua

SEQ ID NO: 4024058 - RNA, 14 nt, Staphylococcus aureus subsp. aureus MW2
acaacacauaaauu

SEQ ID NO: 4024059 - RNA, 14 nt, Staphylococcus aureus subsp. aureus MW2
acaacagugcucua

SEQ ID NO: 4024060 - RNA, 14 nt, Staphylococcus aureus subsp. aureus MW2
acaacauaacaaag

SEQ ID NO: 4024061 - RNA, 21 nt, Staphylococcus aureus subsp. aureus MW2
acaacaucgauuuaucauuau

SEQ ID NO: 4024062 - RNA, 18 nt, Staphylococcus aureus subsp. aureus MW2
acaacaugauuucuucuc

SEQ ID NO: 4024063 - RNA, 21 nt, Staphylococcus aureus subsp. aureus MW2
acaaccucugauacuucacca

SEQ ID NO: 4024064 - RNA, 18 nt, Staphylococcus aureus subsp. aureus MW2
acaaccugugauaaaaau

SEQ ID NO: 4024065 - RNA, 21 nt, Staphylococcus aureus subsp. aureus MW2
acaaccugugauaaaaaucuu

SEQ ID NO: 4024066 - RNA, 20 nt, Staphylococcus aureus subsp. aureus MW2
acaacggcauaauacacauu

SEQ ID NO: 4024067 - RNA, 23 nt, Staphylococcus aureus subsp. aureus MW2
acaacggcauaauacacauugca

SEQ ID NO: 4024068 - RNA, 13 nt, Staphylococcus aureus subsp. aureus MW2
acaacugauuuaa

SEQ ID NO: 4024069 - RNA, 21 nt, Staphylococcus aureus subsp. aureus MW2
acaacuguucuaaaauuaacc

SEQ ID NO: 4024070 - RNA, 23 nt, Staphylococcus aureus subsp. aureus MW2
acaacuucuucuccguauuuacc

SEQ ID NO: 4024071 - RNA, 18 nt, Staphylococcus aureus subsp. aureus MW2
acaacuugaacuaaaaca

SEQ ID NO: 4024072 - RNA, 21 nt, Staphylococcus aureus subsp. aureus MW2
acaacuugaacuaaaacaaua

SEQ ID NO: 4024073 - RNA, 22 nt, Staphylococcus aureus subsp. aureus MW2
acaacuugaacuaaaacaauaa

SEQ ID NO: 4024074 - RNA, 23 nt, Staphylococcus aureus subsp. aureus MW2
acaacuugaacuaaaacaauaau

SEQ ID NO: 4024075 - RNA, 22 nt, Staphylococcus aureus subsp. aureus MW2
acaacuuuaguuguuaggggcu

SEQ ID NO: 4024076 - RNA, 21 nt, Staphylococcus aureus subsp. aureus MW2
acaagaacaugauacugaaau

SEQ ID NO: 4024077 - RNA, 13 nt, Staphylococcus aureus subsp. aureus MW2
acaagagacugaa

SEQ ID NO: 4024078 - RNA, 16 nt, Staphylococcus aureus subsp. aureus MW2
acaagagacugaagag

SEQ ID NO: 4024079 - RNA, 16 nt, Staphylococcus aureus subsp. aureus MW2
acaagauuccuaaaga

SEQ ID NO: 4024080 - RNA, 24 nt, Staphylococcus aureus subsp. aureus MW2
acaagcuauaaauccaaugaugaa

SEQ ID NO: 4024081 - RNA, 13 nt, Staphylococcus aureus subsp. aureus MW2
acaagcuuuuuuc

SEQ ID NO: 4024082 - RNA, 19 nt, Staphylococcus aureus subsp. aureus MW2
acaagcuuuuuucaauucu

SEQ ID NO: 4024083 - RNA, 18 nt, Staphylococcus aureus subsp. aureus MW2
acaaggaauauacaauag

SEQ ID NO: 4024084 - RNA, 14 nt, Staphylococcus aureus subsp. aureus MW2
acaaguauaaaugc

SEQ ID NO: 4024085 - RNA, 20 nt, Staphylococcus aureus subsp. aureus MW2
acaagucuuauuuguuuaau

SEQ ID NO: 4024086 - RNA, 22 nt, Staphylococcus aureus subsp. aureus MW2
acaagucuuuacucuacacuca

SEQ ID NO: 4024087 - RNA, 16 nt, Staphylococcus aureus subsp. aureus MW2
acaagugaugaaaaag

SEQ ID NO: 4024088 - RNA, 17 nt, Staphylococcus aureus subsp. aureus MW2
acaagugaugaaaaaga

SEQ ID NO: 4024089 - RNA, 17 nt, Staphylococcus aureus subsp. aureus MW2
acaaguuacauuaggaa

SEQ ID NO: 4024090 - RNA, 11 nt, Staphylococcus aureus subsp. aureus MW2
acaaguucauu

SEQ ID NO: 4024091 - RNA, 18 nt, Staphylococcus aureus subsp. aureus MW2
acaaguugcacauuauaa

SEQ ID NO: 4024092 - RNA, 16 nt, Staphylococcus aureus subsp. aureus MW2
acaaguugcugaauaa

SEQ ID NO: 4024093 - RNA, 17 nt, Staphylococcus aureus subsp. aureus MW2
acaaguugcugaauaaa

SEQ ID NO: 4024094 - RNA, 19 nt, Staphylococcus aureus subsp. aureus MW2
acaaguugcugaauaaaau

SEQ ID NO: 4024095 - RNA, 15 nt, Staphylococcus aureus subsp. aureus MW2
acaaguuguucaauu

SEQ ID NO: 4024096 - RNA, 15 nt, Staphylococcus aureus subsp. aureus MW2
acaauaaaaaaccaa

SEQ ID NO: 4024097 - RNA, 17 nt, Staphylococcus aureus subsp. aureus MW2
acaauaacuguucuuuc

SEQ ID NO: 4024098 - RNA, 22 nt, Staphylococcus aureus subsp. aureus MW2
acaauaagaacuugcuuuucau

SEQ ID NO: 4024099 - RNA, 17 nt, Staphylococcus aureus subsp. aureus MW2
acaauaauaccuucaau

SEQ ID NO: 4024100 - RNA, 16 nt, Staphylococcus aureus subsp. aureus MW2
acaauaauaugccaaa

SEQ ID NO: 4024101 - RNA, 10 nt, Staphylococcus aureus subsp. aureus MW2
acaauaaugu

SEQ ID NO: 4024102 - RNA, 20 nt, Staphylococcus aureus subsp. aureus MW2
acaauaaugugcaaguuggc

SEQ ID NO: 4024103 - RNA, 14 nt, Staphylococcus aureus subsp. aureus MW2
acacguguaaaaau

SEQ ID NO: 4024104 - RNA, 21 nt, Staphylococcus aureus subsp. aureus MW2
acacguguauuguauuuuaau

SEQ ID NO: 4024105 - RNA, 20 nt, Staphylococcus aureus subsp. aureus MW2
acacguucuugguauuuuuu

SEQ ID NO: 4024106 - RNA, 16 nt, Staphylococcus aureus subsp. aureus MW2
acacuacgcugaugaa

SEQ ID NO: 4024107 - RNA, 16 nt, Staphylococcus aureus subsp. aureus MW2
acacuaucguuuuuau

SEQ ID NO: 4024108 - RNA, 17 nt, Staphylococcus aureus subsp. aureus MW2
acacugcacaucauaau

SEQ ID NO: 4024109 - RNA, 23 nt, Staphylococcus aureus subsp. aureus MW2
acacugcuaaaauuguauuauua

SEQ ID NO: 4024110 - RNA, 16 nt, Staphylococcus aureus subsp. aureus MW2
acacugcuuuuaaauc

SEQ ID NO: 4024111 - RNA, 21 nt, Staphylococcus aureus subsp. aureus MW2
acacugcuuuuaaaucauuaa

SEQ ID NO: 4024112 - RNA, 15 nt, Staphylococcus aureus subsp. aureus MW2
acacuuaauauauuc

SEQ ID NO: 4024113 - RNA, 22 nt, Staphylococcus aureus subsp. aureus MW2
acacuucaacauauaaaucauu

SEQ ID NO: 4024114 - RNA, 15 nt, Staphylococcus aureus subsp. aureus MW2
acacuuuucuuauca

SEQ ID NO: 4024115 - RNA, 24 nt, Staphylococcus aureus subsp. aureus MW2
acagaaaauacauuucuguauaaa

SEQ ID NO: 4024116 - RNA, 22 nt, Staphylococcus aureus subsp. aureus MW2
acagaaaaucguuauaaguaca

SEQ ID NO: 4024117 - RNA, 17 nt, Staphylococcus aureus subsp. aureus MW2
acagaaccgaaaauaau

SEQ ID NO: 4024118 - RNA, 21 nt, Staphylococcus aureus subsp. aureus MW2
acagaagcuggcggaaaguca

SEQ ID NO: 4024119 - RNA, 19 nt, Staphylococcus aureus subsp. aureus MW2
acagaauuauuugauuaug

SEQ ID NO: 4024120 - RNA, 16 nt, Staphylococcus aureus subsp. aureus MW2
acagaauuucaucaaa

SEQ ID NO: 4024121 - RNA, 18 nt, Staphylococcus aureus subsp. aureus MW2
acagaauuucaucaaauc

SEQ ID NO: 4024122 - RNA, 13 nt, Staphylococcus aureus subsp. aureus MW2
acagacaaacauu

SEQ ID NO: 4024123 - RNA, 14 nt, Staphylococcus aureus subsp. aureus MW2
acagacaaacauua

SEQ ID NO: 4024124 - RNA, 18 nt, Staphylococcus aureus subsp. aureus MW2
acagaguugucauucuuc

SEQ ID NO: 4024125 - RNA, 22 nt, Staphylococcus aureus subsp. aureus MW2
acagauaagaauauuuaaguuu

SEQ ID NO: 4024126 - RNA, 17 nt, Staphylococcus aureus subsp. aureus MW2
acagauaaguaauaaua

SEQ ID NO: 4024127 - RNA, 23 nt, Staphylococcus aureus subsp. aureus MW2
acagaucucaauccaauuaaaua

SEQ ID NO: 4024128 - RNA, 23 nt, Staphylococcus aureus subsp. aureus MW2
acagauuuaccucuugauaaaau

SEQ ID NO: 4024129 - RNA, 16 nt, Staphylococcus aureus subsp. aureus MW2
acagauuuuaaaaauu

SEQ ID NO: 4024130 - RNA, 19 nt, Staphylococcus aureus subsp. aureus MW2
acagauuuuaaaaauucau

SEQ ID NO: 4024131 - RNA, 12 nt, Staphylococcus aureus subsp. aureus MW2
acagcaaauaaa

SEQ ID NO: 4024132 - RNA, 14 nt, Staphylococcus aureus subsp. aureus MW2
acagcaaauaaaau

SEQ ID NO: 4024133 - RNA, 18 nt, Staphylococcus aureus subsp. aureus MW2
acagcaaauaaaaucaua

SEQ ID NO: 4024134 - RNA, 16 nt, Staphylococcus aureus subsp. aureus MW2
acagcaguaagauauu

SEQ ID NO: 4024135 - RNA, 20 nt, Staphylococcus aureus subsp. aureus MW2
acagcauuuccuauaugcug

SEQ ID NO: 4024136 - RNA, 15 nt, Staphylococcus aureus subsp. aureus MW2
acagcgauuguuaaa

SEQ ID NO: 4024137 - RNA, 14 nt, Staphylococcus aureus subsp. aureus MW2
acagcgcaucauaa

SEQ ID NO: 4024138 - RNA, 22 nt, Staphylococcus aureus subsp. aureus MW2
acagcguauuuuaaugauuuuu

SEQ ID NO: 4024139 - RNA, 21 nt, Staphylococcus aureus subsp. aureus MW2
acagcgucaccuaaugcuuua

SEQ ID NO: 4024140 - RNA, 13 nt, Staphylococcus aureus subsp. aureus MW2
acagcuaaggcug

SEQ ID NO: 4024141 - RNA, 21 nt, Staphylococcus aureus subsp. aureus MW2
acagcugcuucucuuugaacg

SEQ ID NO: 4024142 - RNA, 13 nt, Staphylococcus aureus subsp. aureus MW2
acagcuucauuaa

SEQ ID NO: 4024143 - RNA, 19 nt, Staphylococcus aureus subsp. aureus MW2
acagcuuguucaauacuuu

SEQ ID NO: 4024144 - RNA, 20 nt, Staphylococcus aureus subsp. aureus MW2
acagcuuguucaauacuuuc

SEQ ID NO: 4024145 - RNA, 20 nt, Staphylococcus aureus subsp. aureus MW2
acaggcaaugcaaguuggcg

SEQ ID NO: 4024146 - RNA, 16 nt, Staphylococcus aureus subsp. aureus MW2
acaggccacacuugag

SEQ ID NO: 4024147 - RNA, 15 nt, Staphylococcus aureus subsp. aureus MW2
acagggguaaaacuu

SEQ ID NO: 4024148 - RNA, 20 nt, Staphylococcus aureus subsp. aureus MW2
acagguaaauuuaaaauaau

SEQ ID NO: 4024149 - RNA, 16 nt, Staphylococcus aureus subsp. aureus MW2
acaguaauuuuuaaac

SEQ ID NO: 4024150 - RNA, 14 nt, Staphylococcus aureus subsp. aureus MW2
acaguacaaauaac

SEQ ID NO: 4024151 - RNA, 17 nt, Staphylococcus aureus subsp. aureus MW2
acaguacaaauaacaaa

SEQ ID NO: 4024152 - RNA, 16 nt, Staphylococcus aureus subsp. aureus MW2
acagucaacuacugcu

SEQ ID NO: 4024153 - RNA, 13 nt, Staphylococcus aureus subsp. aureus MW2
acaguuaauucug

SEQ ID NO: 4024154 - RNA, 14 nt, Staphylococcus aureus subsp. aureus MW2
acaguuacuucagu

SEQ ID NO: 4024155 - RNA, 15 nt, Staphylococcus aureus subsp. aureus MW2
acaguuacuucaguu

SEQ ID NO: 4024156 - RNA, 23 nt, Staphylococcus aureus subsp. aureus MW2
acaguuacuuucgcuugcaaaga

SEQ ID NO: 4024157 - RNA, 14 nt, Staphylococcus aureus subsp. aureus MW2
acaguuauauauua

SEQ ID NO: 4024158 - RNA, 17 nt, Staphylococcus aureus subsp. aureus MW2
acaguuauauauuacuu

SEQ ID NO: 4024159 - RNA, 19 nt, Staphylococcus aureus subsp. aureus MW2
acaguuucaucuucaacuu

SEQ ID NO: 4024160 - RNA, 19 nt, Staphylococcus aureus subsp. aureus MW2
acaguuuccauaaauaaaa

SEQ ID NO: 4024161 - RNA, 22 nt, Staphylococcus aureus subsp. aureus MW2
acaguuucuuggucugcuguau

SEQ ID NO: 4024162 - RNA, 19 nt, Staphylococcus aureus subsp. aureus MW2
acaguuuuuauauuaagac

SEQ ID NO: 4024163 - RNA, 15 nt, Staphylococcus aureus subsp. aureus MW2
acauaaaauuaacuu

SEQ ID NO: 4024164 - RNA, 16 nt, Staphylococcus aureus subsp. aureus MW2
acauaaacaauaauuu

SEQ ID NO: 4024165 - RNA, 18 nt, Staphylococcus aureus subsp. aureus MW2
acauaaagcuuugacaua

SEQ ID NO: 4024166 - RNA, 16 nt, Staphylococcus aureus subsp. aureus MW2
acauaaauacaaaaau

SEQ ID NO: 4024167 - RNA, 21 nt, Staphylococcus aureus subsp. aureus MW2
acauaaauauggauuuugaag

SEQ ID NO: 4024168 - RNA, 15 nt, Staphylococcus aureus subsp. aureus MW2
acauaaaucaauauu

SEQ ID NO: 4024169 - RNA, 23 nt, Staphylococcus aureus subsp. aureus MW2
acauaaauguucgaauaggauug

SEQ ID NO: 4024170 - RNA, 21 nt, Staphylococcus aureus subsp. aureus MW2
acauaacaaacauaccccuuu

SEQ ID NO: 4024171 - RNA, 14 nt, Staphylococcus aureus subsp. aureus MW2
acauaacacaaguu

SEQ ID NO: 4024172 - RNA, 15 nt, Staphylococcus aureus subsp. aureus MW2
acauaacacaaguua

SEQ ID NO: 4024173 - RNA, 18 nt, Staphylococcus aureus subsp. aureus MW2
acauaaccgaugugauuu

SEQ ID NO: 4024174 - RNA, 19 nt, Staphylococcus aureus subsp. aureus MW2
acauaaccuaauucgccau

SEQ ID NO: 4024175 - RNA, 16 nt, Staphylococcus aureus subsp. aureus MW2
acauaagaaaaagcag

SEQ ID NO: 4024176 - RNA, 18 nt, Staphylococcus aureus subsp. aureus MW2
acauaagaaaaagcagua

SEQ ID NO: 4024177 - RNA, 22 nt, Staphylococcus aureus subsp. aureus MW2
acauaagaaaaagcaguaagag

SEQ ID NO: 4024178 - RNA, 23 nt, Staphylococcus aureus subsp. aureus MW2
acauaauaauaauacaauuuuag

SEQ ID NO: 4024179 - RNA, 22 nt, Staphylococcus aureus subsp. aureus MW2
acauaauuaacuuucuuuuguu

SEQ ID NO: 4024180 - RNA, 16 nt, Staphylococcus aureus subsp. aureus MW2
acauaauuuaucaauu

SEQ ID NO: 4024181 - RNA, 16 nt, Staphylococcus aureus subsp. aureus MW2
acauacaccuucagau

SEQ ID NO: 4024182 - RNA, 12 nt, Staphylococcus aureus subsp. aureus MW2
acauacagucaa

SEQ ID NO: 4024183 - RNA, 16 nt, Staphylococcus aureus subsp. aureus MW2
acauacagucaauaca

SEQ ID NO: 4024184 - RNA, 21 nt, Staphylococcus aureus subsp. aureus MW2
acauaccacacuuuaaacaag

SEQ ID NO: 4024185 - RNA, 19 nt, Staphylococcus aureus subsp. aureus MW2
acauaccaguggaaauuau

SEQ ID NO: 4024186 - RNA, 22 nt, Staphylococcus aureus subsp. aureus MW2
acauaccaguggaaauuaugua

SEQ ID NO: 4024187 - RNA, 13 nt, Staphylococcus aureus subsp. aureus MW2
acauaccuaauaa

SEQ ID NO: 4024188 - RNA, 14 nt, Staphylococcus aureus subsp. aureus MW2
acauagaagcuggc

SEQ ID NO: 4024189 - RNA, 21 nt, Staphylococcus aureus subsp. aureus MW2
acauagaagcuggcggaaagu

SEQ ID NO: 4024190 - RNA, 23 nt, Staphylococcus aureus subsp. aureus MW2
acauagaagcuggcggaaaguca

SEQ ID NO: 4024191 - RNA, 16 nt, Staphylococcus aureus subsp. aureus MW2
acauuagaacaaucuc

SEQ ID NO: 4024192 - RNA, 16 nt, Staphylococcus aureus subsp. aureus MW2
acauuagcaugauaaa

SEQ ID NO: 4024193 - RNA, 13 nt, Staphylococcus aureus subsp. aureus MW2
acauuauuaaaua

SEQ ID NO: 4024194 - RNA, 16 nt, Staphylococcus aureus subsp. aureus MW2
acauuauuuauauuua

SEQ ID NO: 4024195 - RNA, 18 nt, Staphylococcus aureus subsp. aureus MW2
acauucagugcaaugaua

SEQ ID NO: 4024196 - RNA, 22 nt, Staphylococcus aureus subsp. aureus MW2
acauuccaaaguaccaucucua

SEQ ID NO: 4024197 - RNA, 19 nt, Staphylococcus aureus subsp. aureus MW2
acauucccuuaauaauaag

SEQ ID NO: 4024198 - RNA, 13 nt, Staphylococcus aureus subsp. aureus MW2
acauuccucuauu

SEQ ID NO: 4024199 - RNA, 16 nt, Staphylococcus aureus subsp. aureus MW2
acauucuucaaaaaau

SEQ ID NO: 4024200 - RNA, 22 nt, Staphylococcus aureus subsp. aureus MW2
acauugaacgauaacaauuuau

SEQ ID NO: 4024201 - RNA, 16 nt, Staphylococcus aureus subsp. aureus MW2
acauugauaaaauaau

SEQ ID NO: 4024202 - RNA, 19 nt, Staphylococcus aureus subsp. aureus MW2
acauugauaguuuuauaau

SEQ ID NO: 4024203 - RNA, 19 nt, Staphylococcus aureus subsp. aureus MW2
acauugccacuuuuguguu

SEQ ID NO: 4024204 - RNA, 16 nt, Staphylococcus aureus subsp. aureus MW2
acauugguuuuuacua

SEQ ID NO: 4024205 - RNA, 21 nt, Staphylococcus aureus subsp. aureus MW2
acauuguaaauauaguaauaa

SEQ ID NO: 4024206 - RNA, 14 nt, Staphylococcus aureus subsp. aureus MW2
acauuguuaaacua

SEQ ID NO: 4024207 - RNA, 12 nt, Staphylococcus aureus subsp. aureus MW2
acauuuaaaaaa

SEQ ID NO: 4024208 - RNA, 18 nt, Staphylococcus aureus subsp. aureus MW2
acauuuaaaaaaugcgcu

SEQ ID NO: 4024209 - RNA, 16 nt, Staphylococcus aureus subsp. aureus MW2
acauuuaaagauugau

SEQ ID NO: 4024210 - RNA, 12 nt, Staphylococcus aureus subsp. aureus MW2
acauuuaacauu

SEQ ID NO: 4024211 - RNA, 14 nt, Staphylococcus aureus subsp. aureus MW2
acauuuaagaaacg

SEQ ID NO: 4024212 - RNA, 20 nt, Staphylococcus aureus subsp. aureus MW2
acauuuaggagccuagaaca

SEQ ID NO: 4024213 - RNA, 17 nt, Staphylococcus aureus subsp. aureus MW2
acauuuauuuuuucucu

SEQ ID NO: 4024214 - RNA, 21 nt, Staphylococcus aureus subsp. aureus MW2
acauuuauuuuuucucuauua

SEQ ID NO: 4024215 - RNA, 18 nt, Staphylococcus aureus subsp. aureus MW2
acauuucugaugcuagcu

SEQ ID NO: 4024216 - RNA, 22 nt, Staphylococcus aureus subsp. aureus MW2
acauuuguaaauauuuuuuaaa

SEQ ID NO: 4024217 - RNA, 21 nt, Staphylococcus aureus subsp. aureus MW2
acauuugucacucuuuaaauc

SEQ ID NO: 4024218 - RNA, 14 nt, Staphylococcus aureus subsp. aureus MW2
acauuuuaaaucua

SEQ ID NO: 4024219 - RNA, 22 nt, Staphylococcus aureus subsp. aureus MW2
acauuuuaaaucuaauuauuca

SEQ ID NO: 4024220 - RNA, 22 nt, Staphylococcus aureus subsp. aureus MW2
acauuuuaacaagugaugaaaa

SEQ ID NO: 4024221 - RNA, 14 nt, Staphylococcus aureus subsp. aureus MW2
acauuuuaugucca

SEQ ID NO: 4024222 - RNA, 21 nt, Staphylococcus aureus subsp. aureus MW2
acauuuuugauuuuaauacua

SEQ ID NO: 4024223 - RNA, 23 nt, Staphylococcus aureus subsp. aureus MW2
acauuuuuggcuuguuaagcagc

SEQ ID NO: 4024224 - RNA, 16 nt, Staphylococcus aureus subsp. aureus MW2
acauuuuugugcaaaa

SEQ ID NO: 4024225 - RNA, 18 nt, Staphylococcus aureus subsp. aureus MW2
acauuuuugugcaaaagu

SEQ ID NO: 4024226 - RNA, 22 nt, Staphylococcus aureus subsp. aureus MW2
acauuuuuuauagcaaauugau

SEQ ID NO: 4024227 - RNA, 14 nt, Staphylococcus aureus subsp. aureus MW2
acauuuuuuucaau

SEQ ID NO: 4024228 - RNA, 15 nt, Staphylococcus aureus subsp. aureus MW2
accaaaaaauccaag

SEQ ID NO: 4024229 - RNA, 16 nt, Staphylococcus aureus subsp. aureus MW2
accaaacaauacauaa

SEQ ID NO: 4024230 - RNA, 16 nt, Staphylococcus aureus subsp. aureus MW2
accaaauuuauaauuu

SEQ ID NO: 4024231 - RNA, 19 nt, Staphylococcus aureus subsp. aureus MW2
accaaccaaaaccaaauga

SEQ ID NO: 4024232 - RNA, 22 nt, Staphylococcus aureus subsp. aureus MW2
accaacucaggcuuaauuaaua

SEQ ID NO: 4024233 - RNA, 21 nt, Staphylococcus aureus subsp. aureus MW2
accaacugucgguucaucuaa

SEQ ID NO: 4024234 - RNA, 22 nt, Staphylococcus aureus subsp. aureus MW2
accaacugucgguucaucuaaa

SEQ ID NO: 4024235 - RNA, 12 nt, Staphylococcus aureus subsp. aureus MW2
accaacuuuuuu

SEQ ID NO: 4024236 - RNA, 22 nt, Staphylococcus aureus subsp. aureus MW2
accaagcccaugcccgauaaaa

SEQ ID NO: 4024237 - RNA, 14 nt, Staphylococcus aureus subsp. aureus MW2
accaaggagaugau

SEQ ID NO: 4024238 - RNA, 21 nt, Staphylococcus aureus subsp. aureus MW2
accaaguaauucuuuaccauu

SEQ ID NO: 4024239 - RNA, 14 nt, Staphylococcus aureus subsp. aureus MW2
accaaguucacuaa

SEQ ID NO: 4024240 - RNA, 14 nt, Staphylococcus aureus subsp. aureus MW2
accaauauuuuucg

SEQ ID NO: 4024241 - RNA, 16 nt, Staphylococcus aureus subsp. aureus MW2
accaaugauuguuaau

SEQ ID NO: 4024242 - RNA, 12 nt, Staphylococcus aureus subsp. aureus MW2
accaauuaggau

SEQ ID NO: 4024243 - RNA, 15 nt, Staphylococcus aureus subsp. aureus MW2
accaauugaaauuaa

SEQ ID NO: 4024244 - RNA, 14 nt, Staphylococcus aureus subsp. aureus MW2
accaauugaauauu

SEQ ID NO: 4024245 - RNA, 23 nt, Staphylococcus aureus subsp. aureus MW2
accaauuuaguccuucuuuacua

SEQ ID NO: 4024246 - RNA, 18 nt, Staphylococcus aureus subsp. aureus MW2
accaauuuuaacuuauau

SEQ ID NO: 4024247 - RNA, 15 nt, Staphylococcus aureus subsp. aureus MW2
accaauuuuaauagu

SEQ ID NO: 4024248 - RNA, 14 nt, Staphylococcus aureus subsp. aureus MW2
accacaaccaguca

SEQ ID NO: 4024249 - RNA, 13 nt, Staphylococcus aureus subsp. aureus MW2
accacacagcauu

SEQ ID NO: 4024250 - RNA, 17 nt, Staphylococcus aureus subsp. aureus MW2
accacacuuuaaacaag

SEQ ID NO: 4024251 - RNA, 14 nt, Staphylococcus aureus subsp. aureus MW2
accaccacuuucag

SEQ ID NO: 4024252 - RNA, 16 nt, Staphylococcus aureus subsp. aureus MW2
accaccacuuucagua

SEQ ID NO: 4024253 - RNA, 19 nt, Staphylococcus aureus subsp. aureus MW2
accacuauaauuucuuaau

SEQ ID NO: 4024254 - RNA, 14 nt, Staphylococcus aureus subsp. aureus MW2
accacuucuucacc

SEQ ID NO: 4024255 - RNA, 21 nt, Staphylococcus aureus subsp. aureus MW2
accacuugaauacuuuuuaac

SEQ ID NO: 4024256 - RNA, 13 nt, Staphylococcus aureus subsp. aureus MW2
accagcacaucaa

SEQ ID NO: 4024257 - RNA, 15 nt, Staphylococcus aureus subsp. aureus MW2
accagcuaacaaaag

SEQ ID NO: 4024258 - RNA, 23 nt, Staphylococcus aureus subsp. aureus MW2
accagcuuucguaccugcucuuu

SEQ ID NO: 4024259 - RNA, 14 nt, Staphylococcus aureus subsp. aureus MW2
accagucguaauga

SEQ ID NO: 4024260 - RNA, 18 nt, Staphylococcus aureus subsp. aureus MW2
accaguggaaauuaugua

SEQ ID NO: 4024261 - RNA, 19 nt, Staphylococcus aureus subsp. aureus MW2
accagugggcuccaaacau

SEQ ID NO: 4024262 - RNA, 23 nt, Staphylococcus aureus subsp. aureus MW2
accaguuugaucauaauucagug

SEQ ID NO: 4024263 - RNA, 18 nt, Staphylococcus aureus subsp. aureus MW2
accauaaauuuauauaua

SEQ ID NO: 4024264 - RNA, 16 nt, Staphylococcus aureus subsp. aureus MW2
accauaauuaaauaac

SEQ ID NO: 4024265 - RNA, 20 nt, Staphylococcus aureus subsp. aureus MW2
accauacuaaaacaugauac

SEQ ID NO: 4024266 - RNA, 14 nt, Staphylococcus aureus subsp. aureus MW2
accauacucuaacu

SEQ ID NO: 4024267 - RNA, 15 nt, Staphylococcus aureus subsp. aureus MW2
accauacucuaacuu

SEQ ID NO: 4024268 - RNA, 17 nt, Staphylococcus aureus subsp. aureus MW2
accauagauuauauuau

SEQ ID NO: 4024269 - RNA, 16 nt, Staphylococcus aureus subsp. aureus MW2
accauaguaacaaaau

SEQ ID NO: 4024270 - RNA, 17 nt, Staphylococcus aureus subsp. aureus MW2
accauaguaacaaaaug

SEQ ID NO: 4024271 - RNA, 19 nt, Staphylococcus aureus subsp. aureus MW2
accauauuuacacagaaug

SEQ ID NO: 4024272 - RNA, 16 nt, Staphylococcus aureus subsp. aureus MW2
accauauuuuuagaaa

SEQ ID NO: 4024273 - RNA, 18 nt, Staphylococcus aureus subsp. aureus MW2
accauauuuuuagaaaag

SEQ ID NO: 4024274 - RNA, 14 nt, Staphylococcus aureus subsp. aureus MW2
accaucauaaaugu

SEQ ID NO: 4024275 - RNA, 17 nt, Staphylococcus aureus subsp. aureus MW2
accaucauauauucauu

SEQ ID NO: 4024276 - RNA, 23 nt, Staphylococcus aureus subsp. aureus MW2
accaucauauauucauugauugu

SEQ ID NO: 4024277 - RNA, 22 nt, Staphylococcus aureus subsp. aureus MW2
accaucucuuucuacuuaguaa

SEQ ID NO: 4024278 - RNA, 20 nt, Staphylococcus aureus subsp. aureus MW2
accaucuggcguuaaccauu

SEQ ID NO: 4024279 - RNA, 20 nt, Staphylococcus aureus subsp. aureus MW2
accaucuucuugauuguaaa

SEQ ID NO: 4024280 - RNA, 13 nt, Staphylococcus aureus subsp. aureus MW2
accuucaauaucu

SEQ ID NO: 4024281 - RNA, 16 nt, Staphylococcus aureus subsp. aureus MW2
accuucagaugcuaca

SEQ ID NO: 4024282 - RNA, 15 nt, Staphylococcus aureus subsp. aureus MW2
accuucaguuucuac

SEQ ID NO: 4024283 - RNA, 17 nt, Staphylococcus aureus subsp. aureus MW2
accuucaucuuuuuuau

SEQ ID NO: 4024284 - RNA, 17 nt, Staphylococcus aureus subsp. aureus MW2
accuucgcauacuuuuu

SEQ ID NO: 4024285 - RNA, 15 nt, Staphylococcus aureus subsp. aureus MW2
accuucguuuaaauu

SEQ ID NO: 4024286 - RNA, 14 nt, Staphylococcus aureus subsp. aureus MW2
accuuuaaaacauc

SEQ ID NO: 4024287 - RNA, 16 nt, Staphylococcus aureus subsp. aureus MW2
accuuuaaaacaucau

SEQ ID NO: 4024288 - RNA, 19 nt, Staphylococcus aureus subsp. aureus MW2
accuuuaaaacaucauuca

SEQ ID NO: 4024289 - RNA, 13 nt, Staphylococcus aureus subsp. aureus MW2
accuuuaauaucu

SEQ ID NO: 4024290 - RNA, 13 nt, Staphylococcus aureus subsp. aureus MW2
accuuuaauuaca

SEQ ID NO: 4024291 - RNA, 14 nt, Staphylococcus aureus subsp. aureus MW2
accuuuacuuucau

SEQ ID NO: 4024292 - RNA, 23 nt, Staphylococcus aureus subsp. aureus MW2
accuuuagacaauauuuuuacau

SEQ ID NO: 4024293 - RNA, 17 nt, Staphylococcus aureus subsp. aureus MW2
accuuuaucuguaucaa

SEQ ID NO: 4024294 - RNA, 20 nt, Staphylococcus aureus subsp. aureus MW2
accuuuaugugcaucauuua

SEQ ID NO: 4024295 - RNA, 23 nt, Staphylococcus aureus subsp. aureus MW2
accuuuaugugcaucauuuauau

SEQ ID NO: 4024296 - RNA, 17 nt, Staphylococcus aureus subsp. aureus MW2
accuuuauuaccagcuu

SEQ ID NO: 4024297 - RNA, 16 nt, Staphylococcus aureus subsp. aureus MW2
accuuuauuauuuaau

SEQ ID NO: 4024298 - RNA, 14 nt, Staphylococcus aureus subsp. aureus MW2
accuuuauuuuuau

SEQ ID NO: 4024299 - RNA, 12 nt, Staphylococcus aureus subsp. aureus MW2
accuuucaaaua

SEQ ID NO: 4024300 - RNA, 18 nt, Staphylococcus aureus subsp. aureus MW2
accuuucaaauauaucua

SEQ ID NO: 4024301 - RNA, 15 nt, Staphylococcus aureus subsp. aureus MW2
accuuucauaggucu

SEQ ID NO: 4024302 - RNA, 22 nt, Staphylococcus aureus subsp. aureus MW2
accuuucgcagcuucuuuaaca

SEQ ID NO: 4024303 - RNA, 21 nt, Staphylococcus aureus subsp. aureus MW2
accuuugcuaaauauuauaaa

SEQ ID NO: 4024304 - RNA, 19 nt, Staphylococcus aureus subsp. aureus MW2
accuuuguaaguauuuaaa

SEQ ID NO: 4024305 - RNA, 21 nt, Staphylococcus aureus subsp. aureus MW2
accuuuuaaggcagcuaaaaa

SEQ ID NO: 4024306 - RNA, 22 nt, Staphylococcus aureus subsp. aureus MW2
accuuuugauguuuaugacaaa

SEQ ID NO: 4024307 - RNA, 17 nt, Staphylococcus aureus subsp. aureus MW2
accuuuuuauugauauu

SEQ ID NO: 4024308 - RNA, 20 nt, Staphylococcus aureus subsp. aureus MW2
accuuuuuauugauauuaau

SEQ ID NO: 4024309 - RNA, 12 nt, Staphylococcus aureus subsp. aureus MW2
accuuuuuuaac

SEQ ID NO: 4024310 - RNA, 21 nt, Staphylococcus aureus subsp. aureus MW2
accuuuuuuaacuuuaacauc

SEQ ID NO: 4024311 - RNA, 12 nt, Staphylococcus aureus subsp. aureus MW2
accuuuuuuaag

SEQ ID NO: 4024312 - RNA, 21 nt, Staphylococcus aureus subsp. aureus MW2
accuuuuuuaguuaaagugau

SEQ ID NO: 4024313 - RNA, 20 nt, Staphylococcus aureus subsp. aureus MW2
acgaaaaagaugguuuuguu

SEQ ID NO: 4024314 - RNA, 13 nt, Staphylococcus aureus subsp. aureus MW2
acgaaaagucagc

SEQ ID NO: 4024315 - RNA, 18 nt, Staphylococcus aureus subsp. aureus MW2
acgaaaagucagcuuaca

SEQ ID NO: 4024316 - RNA, 22 nt, Staphylococcus aureus subsp. aureus MW2
acgaaaagucagcuuacaauaa

SEQ ID NO: 4024317 - RNA, 23 nt, Staphylococcus aureus subsp. aureus MW2
acgaaaauuaagaugaaauacuu

SEQ ID NO: 4024318 - RNA, 17 nt, Staphylococcus aureus subsp. aureus MW2
acgaaaccaaaaauaau

SEQ ID NO: 4024319 - RNA, 15 nt, Staphylococcus aureus subsp. aureus MW2
acgaaagagaaaagc

SEQ ID NO: 4024320 - RNA, 15 nt, Staphylococcus aureus subsp. aureus MW2
acgaaauaaauuuug

SEQ ID NO: 4024321 - RNA, 16 nt, Staphylococcus aureus subsp. aureus MW2
acgaaauaaauuuuga

SEQ ID NO: 4024322 - RNA, 14 nt, Staphylococcus aureus subsp. aureus MW2
acgaaauaguucaa

SEQ ID NO: 4024323 - RNA, 15 nt, Staphylococcus aureus subsp. aureus MW2
acgaaauaguucaaa

SEQ ID NO: 4024324 - RNA, 14 nt, Staphylococcus aureus subsp. aureus MW2
acgaaauugugaac

SEQ ID NO: 4024325 - RNA, 20 nt, Staphylococcus aureus subsp. aureus MW2
acgaaauugugaacuaaauu

SEQ ID NO: 4024326 - RNA, 13 nt, Staphylococcus aureus subsp. aureus MW2
acgaagauuuugu

SEQ ID NO: 4024327 - RNA, 14 nt, Staphylococcus aureus subsp. aureus MW2
acgaagccuaauuu

SEQ ID NO: 4024328 - RNA, 19 nt, Staphylococcus aureus subsp. aureus MW2
acgaagcgggacucaucga

SEQ ID NO: 4024329 - RNA, 21 nt, Staphylococcus aureus subsp. aureus MW2
acgacaacuugaacuaaaaca

SEQ ID NO: 4024330 - RNA, 22 nt, Staphylococcus aureus subsp. aureus MW2
acgacaaucacagcaauaauaa

SEQ ID NO: 4024331 - RNA, 22 nt, Staphylococcus aureus subsp. aureus MW2
acgacauuuuuagacauuaaaa

SEQ ID NO: 4024332 - RNA, 22 nt, Staphylococcus aureus subsp. aureus MW2
acgaccagucgcauauuuugau

SEQ ID NO: 4024333 - RNA, 17 nt, Staphylococcus aureus subsp. aureus MW2
acgacguuuuuuuaugu

SEQ ID NO: 4024334 - RNA, 19 nt, Staphylococcus aureus subsp. aureus MW2
acgacguuuuuuuauguuc

SEQ ID NO: 4024335 - RNA, 16 nt, Staphylococcus aureus subsp. aureus MW2
acgagcaguauauauc

SEQ ID NO: 4024336 - RNA, 20 nt, Staphylococcus aureus subsp. aureus MW2
acgaguguuuuaaucuuauu

SEQ ID NO: 4024337 - RNA, 20 nt, Staphylococcus aureus subsp. aureus MW2
acgauaaauagugauugcuu

SEQ ID NO: 4024338 - RNA, 19 nt, Staphylococcus aureus subsp. aureus MW2
acgauaacaauuuauuaaa

SEQ ID NO: 4024339 - RNA, 23 nt, Staphylococcus aureus subsp. aureus MW2
acgauaauaacuagaacaagaau

SEQ ID NO: 4024340 - RNA, 18 nt, Staphylococcus aureus subsp. aureus MW2
acgauaccggcaacuggu

SEQ ID NO: 4024341 - RNA, 15 nt, Staphylococcus aureus subsp. aureus MW2
acgauauucuacaug

SEQ ID NO: 4024342 - RNA, 20 nt, Staphylococcus aureus subsp. aureus MW2
acgaucaacugcuucacgau

SEQ ID NO: 4024343 - RNA, 17 nt, Staphylococcus aureus subsp. aureus MW2
acgaucauaaauauuuu

SEQ ID NO: 4024344 - RNA, 14 nt, Staphylococcus aureus subsp. aureus MW2
acgauuaauaaaau

SEQ ID NO: 4024345 - RNA, 16 nt, Staphylococcus aureus subsp. aureus MW2
acgauugauuaucaua

SEQ ID NO: 4024346 - RNA, 16 nt, Staphylococcus aureus subsp. aureus MW2
acgauugggcaacuuu

SEQ ID NO: 4024347 - RNA, 16 nt, Staphylococcus aureus subsp. aureus MW2
acgauuuuuaaaaugc

SEQ ID NO: 4024348 - RNA, 20 nt, Staphylococcus aureus subsp. aureus MW2
acgcaaauuaaauauacuuu

SEQ ID NO: 4024349 - RNA, 20 nt, Staphylococcus aureus subsp. aureus MW2
acgcaauguugucguuucua

SEQ ID NO: 4024350 - RNA, 19 nt, Staphylococcus aureus subsp. aureus MW2
acgcacguauauacgauug

SEQ ID NO: 4024351 - RNA, 14 nt, Staphylococcus aureus subsp. aureus MW2
acgcaguugaaaaa

SEQ ID NO: 4024352 - RNA, 15 nt, Staphylococcus aureus subsp. aureus MW2
acgcaguugaaaaag

SEQ ID NO: 4024353 - RNA, 16 nt, Staphylococcus aureus subsp. aureus MW2
acgcauaccacuugaa

SEQ ID NO: 4024354 - RNA, 21 nt, Staphylococcus aureus subsp. aureus MW2
acgccaaauacuaguaauaau

SEQ ID NO: 4024355 - RNA, 22 nt, Staphylococcus aureus subsp. aureus MW2
acgccaguggcauuuaaaaauc

SEQ ID NO: 4024356 - RNA, 16 nt, Staphylococcus aureus subsp. aureus MW2
acgccauaagaaaaua

SEQ ID NO: 4024357 - RNA, 17 nt, Staphylococcus aureus subsp. aureus MW2
acgccgaauaauccagu

SEQ ID NO: 4024358 - RNA, 23 nt, Staphylococcus aureus subsp. aureus MW2
acgccuuggccuacuuuuucaau

SEQ ID NO: 4024359 - RNA, 19 nt, Staphylococcus aureus subsp. aureus MW2
acgcggguaauauuuuugu

SEQ ID NO: 4024360 - RNA, 20 nt, Staphylococcus aureus subsp. aureus MW2
acgcgguaaaacgaagucag

SEQ ID NO: 4024361 - RNA, 17 nt, Staphylococcus aureus subsp. aureus MW2
acgcgugaauuaaaaaa

SEQ ID NO: 4024362 - RNA, 18 nt, Staphylococcus aureus subsp. aureus MW2
acgcguuauagauaagua

SEQ ID NO: 4024363 - RNA, 22 nt, Staphylococcus aureus subsp. aureus MW2
acgcuaauggaugaauauauug

SEQ ID NO: 4024364 - RNA, 15 nt, Staphylococcus aureus subsp. aureus MW2
acgcuaauuuuacuc

SEQ ID NO: 4024365 - RNA, 17 nt, Staphylococcus aureus subsp. aureus MW2
acgcuaauuuuacucug

SEQ ID NO: 4024366 - RNA, 19 nt, Staphylococcus aureus subsp. aureus MW2
acgcucaugaguuucucau

SEQ ID NO: 4024367 - RNA, 23 nt, Staphylococcus aureus subsp. aureus MW2
acgcucaugaguuucucaucuac

SEQ ID NO: 4024368 - RNA, 17 nt, Staphylococcus aureus subsp. aureus MW2
acuaaccuauuaaaaua

SEQ ID NO: 4024369 - RNA, 19 nt, Staphylococcus aureus subsp. aureus MW2
acuaagauauuuaguacau

SEQ ID NO: 4024370 - RNA, 21 nt, Staphylococcus aureus subsp. aureus MW2
acuaagcagucugcucuuuuu

SEQ ID NO: 4024371 - RNA, 20 nt, Staphylococcus aureus subsp. aureus MW2
acuaagugaauuaucuauau

SEQ ID NO: 4024372 - RNA, 17 nt, Staphylococcus aureus subsp. aureus MW2
acuaaguuuguuuucuu

SEQ ID NO: 4024373 - RNA, 15 nt, Staphylococcus aureus subsp. aureus MW2
acuaauaacuaguau

SEQ ID NO: 4024374 - RNA, 11 nt, Staphylococcus aureus subsp. aureus MW2
acuaauaauug

SEQ ID NO: 4024375 - RNA, 14 nt, Staphylococcus aureus subsp. aureus MW2
acuaauaauugucc

SEQ ID NO: 4024376 - RNA, 13 nt, Staphylococcus aureus subsp. aureus MW2
acuaauauauuua

SEQ ID NO: 4024377 - RNA, 13 nt, Staphylococcus aureus subsp. aureus MW2
acuaauauuuaaa

SEQ ID NO: 4024378 - RNA, 17 nt, Staphylococcus aureus subsp. aureus MW2
acuaauauuuaaaaaac

SEQ ID NO: 4024379 - RNA, 23 nt, Staphylococcus aureus subsp. aureus MW2
acuaaucaauacuaaaccaauga

SEQ ID NO: 4024380 - RNA, 13 nt, Staphylococcus aureus subsp. aureus MW2
acuaaucguguau

SEQ ID NO: 4024381 - RNA, 20 nt, Staphylococcus aureus subsp. aureus MW2
acuaaucguuccaacaacua

SEQ ID NO: 4024382 - RNA, 20 nt, Staphylococcus aureus subsp. aureus MW2
acuaaugauaguacauuuau

SEQ ID NO: 4024383 - RNA, 23 nt, Staphylococcus aureus subsp. aureus MW2
acuaauggauaugauaaccaaac

SEQ ID NO: 4024384 - RNA, 20 nt, Staphylococcus aureus subsp. aureus MW2
acuaauggcacuuaauauaa

SEQ ID NO: 4024385 - RNA, 16 nt, Staphylococcus aureus subsp. aureus MW2
acuaauguaaagccac

SEQ ID NO: 4024386 - RNA, 15 nt, Staphylococcus aureus subsp. aureus MW2
acuaauguuaaaaua

SEQ ID NO: 4024387 - RNA, 20 nt, Staphylococcus aureus subsp. aureus MW2
acuaauuuuguacauaaaaa

SEQ ID NO: 4024388 - RNA, 21 nt, Staphylococcus aureus subsp. aureus MW2
acuaauuuuguacauaaaaau

SEQ ID NO: 4024389 - RNA, 22 nt, Staphylococcus aureus subsp. aureus MW2
acuaauuuuguacauaaaaaua

SEQ ID NO: 4024390 - RNA, 15 nt, Staphylococcus aureus subsp. aureus MW2
acuacaaauuuuaaa

SEQ ID NO: 4024391 - RNA, 19 nt, Staphylococcus aureus subsp. aureus MW2
acuacacacguagaaagau

SEQ ID NO: 4024392 - RNA, 22 nt, Staphylococcus aureus subsp. aureus MW2
acuacacuccccuuaucaaaac

SEQ ID NO: 4024393 - RNA, 16 nt, Staphylococcus aureus subsp. aureus MW2
acuacauucuauguag

SEQ ID NO: 4024394 - RNA, 20 nt, Staphylococcus aureus subsp. aureus MW2
acuacauucuucauuacagu

SEQ ID NO: 4024395 - RNA, 20 nt, Staphylococcus aureus subsp. aureus MW2
acuaccuacuuguucaauac

SEQ ID NO: 4024396 - RNA, 16 nt, Staphylococcus aureus subsp. aureus MW2
acuaccuguuggcuuu

SEQ ID NO: 4024397 - RNA, 14 nt, Staphylococcus aureus subsp. aureus MW2
acuacgucaagcuu

SEQ ID NO: 4024398 - RNA, 16 nt, Staphylococcus aureus subsp. aureus MW2
acuacuacauuauuac

SEQ ID NO: 4024399 - RNA, 15 nt, Staphylococcus aureus subsp. aureus MW2
acuacucauuauuaa

SEQ ID NO: 4024400 - RNA, 16 nt, Staphylococcus aureus subsp. aureus MW2
acuacugucaauauaa

SEQ ID NO: 4024401 - RNA, 15 nt, Staphylococcus aureus subsp. aureus MW2
acuacuuaauuaaua

SEQ ID NO: 4024402 - RNA, 19 nt, Staphylococcus aureus subsp. aureus MW2
acuagaaaacauaaauaca

SEQ ID NO: 4024403 - RNA, 13 nt, Staphylococcus aureus subsp. aureus MW2
acuagaauaacuu

SEQ ID NO: 4024404 - RNA, 19 nt, Staphylococcus aureus subsp. aureus MW2
acuagauaguuuauacuuu

SEQ ID NO: 4024405 - RNA, 19 nt, Staphylococcus aureus subsp. aureus MW2
acuagcuaaugcacgugag

SEQ ID NO: 4024406 - RNA, 23 nt, Staphylococcus aureus subsp. aureus MW2
acuaggaauauaaaacugugcau

SEQ ID NO: 4024407 - RNA, 16 nt, Staphylococcus aureus subsp. aureus MW2
acuagggguuuuuaau

SEQ ID NO: 4024408 - RNA, 14 nt, Staphylococcus aureus subsp. aureus MW2
acuaguaauagaau

SEQ ID NO: 4024409 - RNA, 20 nt, Staphylococcus aureus subsp. aureus MW2
acuaguauccuuuauaaaua

SEQ ID NO: 4024410 - RNA, 20 nt, Staphylococcus aureus subsp. aureus MW2
acuagucuuuuuauuuuaau

SEQ ID NO: 4024411 - RNA, 14 nt, Staphylococcus aureus subsp. aureus MW2
acuaguguauacaa

SEQ ID NO: 4024412 - RNA, 22 nt, Staphylococcus aureus subsp. aureus MW2
acuaguucuaaguguugaccau

SEQ ID NO: 4024413 - RNA, 14 nt, Staphylococcus aureus subsp. aureus MW2
acuaguuuggagaa

SEQ ID NO: 4024414 - RNA, 14 nt, Staphylococcus aureus subsp. aureus MW2
acuaguuuguaaua

SEQ ID NO: 4024415 - RNA, 18 nt, Staphylococcus aureus subsp. aureus MW2
acuaguuuguaauaauua

SEQ ID NO: 4024416 - RNA, 17 nt, Staphylococcus aureus subsp. aureus MW2
acuauaaaauucaccaa

SEQ ID NO: 4024417 - RNA, 19 nt, Staphylococcus aureus subsp. aureus MW2
acuauaaaauucaccaacu

SEQ ID NO: 4024418 - RNA, 18 nt, Staphylococcus aureus subsp. aureus MW2
acuauaaauaaaaauaua

SEQ ID NO: 4024419 - RNA, 15 nt, Staphylococcus aureus subsp. aureus MW2
acuauaacaccaauu

SEQ ID NO: 4024420 - RNA, 19 nt, Staphylococcus aureus subsp. aureus MW2
acuauaacaccaauuaaau

SEQ ID NO: 4024421 - RNA, 16 nt, Staphylococcus aureus subsp. aureus MW2
acuauaauuucuuaau

SEQ ID NO: 4024422 - RNA, 16 nt, Staphylococcus aureus subsp. aureus MW2
acuauacugaugaaaa

SEQ ID NO: 4024423 - RNA, 13 nt, Staphylococcus aureus subsp. aureus MW2
acuauacuuugag

SEQ ID NO: 4024424 - RNA, 22 nt, Staphylococcus aureus subsp. aureus MW2
acuauaugaaaagagaaacaaa

SEQ ID NO: 4024425 - RNA, 17 nt, Staphylococcus aureus subsp. aureus MW2
acuauaugugucgagua

SEQ ID NO: 4024426 - RNA, 16 nt, Staphylococcus aureus subsp. aureus MW2
acuauauucaauuuaa

SEQ ID NO: 4024427 - RNA, 19 nt, Staphylococcus aureus subsp. aureus MW2
acuauauuucacacagcuu

SEQ ID NO: 4024428 - RNA, 13 nt, Staphylococcus aureus subsp. aureus MW2
acuaucaauauaa

SEQ ID NO: 4024429 - RNA, 14 nt, Staphylococcus aureus subsp. aureus MW2
acuaucguuuuuau

SEQ ID NO: 4024430 - RNA, 18 nt, Staphylococcus aureus subsp. aureus MW2
acuaucuuauauuuauga

SEQ ID NO: 4024431 - RNA, 18 nt, Staphylococcus aureus subsp. aureus MW2
acuaucuucaucauauuc

SEQ ID NO: 4024432 - RNA, 14 nt, Staphylococcus aureus subsp. aureus MW2
acuaucuuuugcuu

SEQ ID NO: 4024433 - RNA, 14 nt, Staphylococcus aureus subsp. aureus MW2
acuaugcaaaugaa

SEQ ID NO: 4024434 - RNA, 20 nt, Staphylococcus aureus subsp. aureus MW2
acuaugcauaauaccaauug

SEQ ID NO: 4024435 - RNA, 15 nt, Staphylococcus aureus subsp. aureus MW2
acuauguuguuuaaa

SEQ ID NO: 4024436 - RNA, 19 nt, Staphylococcus aureus subsp. aureus MW2
acuauuaaaggaaaucaau

SEQ ID NO: 4024437 - RNA, 17 nt, Staphylococcus aureus subsp. aureus MW2
acuauuuaauuauuccu

SEQ ID NO: 4024438 - RNA, 13 nt, Staphylococcus aureus subsp. aureus MW2
acuauuuguuguu

SEQ ID NO: 4024439 - RNA, 16 nt, Staphylococcus aureus subsp. aureus MW2
acuauuuguuguuaua

SEQ ID NO: 4024440 - RNA, 18 nt, Staphylococcus aureus subsp. aureus MW2
acuauuuguuguuauaua

SEQ ID NO: 4024441 - RNA, 19 nt, Staphylococcus aureus subsp. aureus MW2
acuauuuuugaaaagagcg

SEQ ID NO: 4024442 - RNA, 14 nt, Staphylococcus aureus subsp. aureus MW2
acucaaaauguuua

SEQ ID NO: 4024443 - RNA, 19 nt, Staphylococcus aureus subsp. aureus MW2
acucaaaauguuuaacaau

SEQ ID NO: 4024444 - RNA, 23 nt, Staphylococcus aureus subsp. aureus MW2
acucaaaauguuuaacaauaaua

SEQ ID NO: 4024445 - RNA, 14 nt, Staphylococcus aureus subsp. aureus MW2
acucaacugaugaa

SEQ ID NO: 4024446 - RNA, 17 nt, Staphylococcus aureus subsp. aureus MW2
acucaacugaugaaaag

SEQ ID NO: 4024447 - RNA, 13 nt, Staphylococcus aureus subsp. aureus MW2
acucaauaaaauu

SEQ ID NO: 4024448 - RNA, 12 nt, Staphylococcus aureus subsp. aureus MW2
acucaauucucu

SEQ ID NO: 4024449 - RNA, 16 nt, Staphylococcus aureus subsp. aureus MW2
acucaauucucuaacu

SEQ ID NO: 4024450 - RNA, 15 nt, Staphylococcus aureus subsp. aureus MW2
acucaauuucauuug

SEQ ID NO: 4024451 - RNA, 15 nt, Staphylococcus aureus subsp. aureus MW2
acucaccugcagcau

SEQ ID NO: 4024452 - RNA, 13 nt, Staphylococcus aureus subsp. aureus MW2
acucacuucaacg

SEQ ID NO: 4024453 - RNA, 12 nt, Staphylococcus aureus subsp. aureus MW2
acucacuucuua

SEQ ID NO: 4024454 - RNA, 16 nt, Staphylococcus aureus subsp. aureus MW2
acucaggcuuaauuaa

SEQ ID NO: 4024455 - RNA, 19 nt, Staphylococcus aureus subsp. aureus MW2
acucauaaccgcuucuuuu

SEQ ID NO: 4024456 - RNA, 22 nt, Staphylococcus aureus subsp. aureus MW2
acucauaauuuucuauuauuuu

SEQ ID NO: 4024457 - RNA, 18 nt, Staphylococcus aureus subsp. aureus MW2
acuuagugucacauuaua

SEQ ID NO: 4024458 - RNA, 23 nt, Staphylococcus aureus subsp. aureus MW2
acuuauauacguugauuaacaca

SEQ ID NO: 4024459 - RNA, 14 nt, Staphylococcus aureus subsp. aureus MW2
acuuauauuuuaau

SEQ ID NO: 4024460 - RNA, 15 nt, Staphylococcus aureus subsp. aureus MW2
acuuaugagcaaagc

SEQ ID NO: 4024461 - RNA, 22 nt, Staphylococcus aureus subsp. aureus MW2
acuuaugcucaucuacuuaaaa

SEQ ID NO: 4024462 - RNA, 18 nt, Staphylococcus aureus subsp. aureus MW2
acuuauggguucaauauc

SEQ ID NO: 4024463 - RNA, 18 nt, Staphylococcus aureus subsp. aureus MW2
acuuauuaauuaauagag

SEQ ID NO: 4024464 - RNA, 12 nt, Staphylococcus aureus subsp. aureus MW2
acuuauucuuca

SEQ ID NO: 4024465 - RNA, 19 nt, Staphylococcus aureus subsp. aureus MW2
acuuauugacgaguagauu

SEQ ID NO: 4024466 - RNA, 17 nt, Staphylococcus aureus subsp. aureus MW2
acuucaaacguuaugua

SEQ ID NO: 4024467 - RNA, 18 nt, Staphylococcus aureus subsp. aureus MW2
acuucaaacguuauguac

SEQ ID NO: 4024468 - RNA, 23 nt, Staphylococcus aureus subsp. aureus MW2
acuucaaagcaucuaauccccaa

SEQ ID NO: 4024469 - RNA, 19 nt, Staphylococcus aureus subsp. aureus MW2
acuucaacgucaucugcuu

SEQ ID NO: 4024470 - RNA, 13 nt, Staphylococcus aureus subsp. aureus MW2
acuucauauaagu

SEQ ID NO: 4024471 - RNA, 13 nt, Staphylococcus aureus subsp. aureus MW2
acuucaucuaaau

SEQ ID NO: 4024472 - RNA, 15 nt, Staphylococcus aureus subsp. aureus MW2
acuucauuacaaaca

SEQ ID NO: 4024473 - RNA, 21 nt, Staphylococcus aureus subsp. aureus MW2
acuucauuacaaacauaauca

SEQ ID NO: 4024474 - RNA, 15 nt, Staphylococcus aureus subsp. aureus MW2
acuucauuaguugcc

SEQ ID NO: 4024475 - RNA, 14 nt, Staphylococcus aureus subsp. aureus MW2
acuuccaucaaucc

SEQ ID NO: 4024476 - RNA, 16 nt, Staphylococcus aureus subsp. aureus MW2
acuucgccaagccauu

SEQ ID NO: 4024477 - RNA, 21 nt, Staphylococcus aureus subsp. aureus MW2
acuucgcccuuccauucaucu

SEQ ID NO: 4024478 - RNA, 18 nt, Staphylococcus aureus subsp. aureus MW2
acuucuaacgcaacugaa

SEQ ID NO: 4024479 - RNA, 15 nt, Staphylococcus aureus subsp. aureus MW2
acuucuaauaguaau

SEQ ID NO: 4024480 - RNA, 15 nt, Staphylococcus aureus subsp. aureus MW2
acuucuaauuugcaa

SEQ ID NO: 4024481 - RNA, 22 nt, Staphylococcus aureus subsp. aureus MW2
acuucuauauuaauagaaagug

SEQ ID NO: 4024482 - RNA, 22 nt, Staphylococcus aureus subsp. aureus MW2
acuucuauuuuauaauaaauuu

SEQ ID NO: 4024483 - RNA, 19 nt, Staphylococcus aureus subsp. aureus MW2
acuucuccauggcuuaaau

SEQ ID NO: 4024484 - RNA, 20 nt, Staphylococcus aureus subsp. aureus MW2
acuucuccauggcuuaaauc

SEQ ID NO: 4024485 - RNA, 16 nt, Staphylococcus aureus subsp. aureus MW2
acuucucuaucagucc

SEQ ID NO: 4024486 - RNA, 21 nt, Staphylococcus aureus subsp. aureus MW2
acuucucuuugaacgaaagag

SEQ ID NO: 4024487 - RNA, 13 nt, Staphylococcus aureus subsp. aureus MW2
acuucugaaaaua

SEQ ID NO: 4024488 - RNA, 15 nt, Staphylococcus aureus subsp. aureus MW2
acuucugaaaauaac

SEQ ID NO: 4024489 - RNA, 13 nt, Staphylococcus aureus subsp. aureus MW2
acuucuuaaaaua

SEQ ID NO: 4024490 - RNA, 15 nt, Staphylococcus aureus subsp. aureus MW2
acuucuuuauauuua

SEQ ID NO: 4024491 - RNA, 14 nt, Staphylococcus aureus subsp. aureus MW2
acuucuuuuguuuu

SEQ ID NO: 4024492 - RNA, 20 nt, Staphylococcus aureus subsp. aureus MW2
acuucuuuuguuuuaccauc

SEQ ID NO: 4024493 - RNA, 15 nt, Staphylococcus aureus subsp. aureus MW2
acuucuuuuuuguau

SEQ ID NO: 4024494 - RNA, 13 nt, Staphylococcus aureus subsp. aureus MW2
acuugaauauuau

SEQ ID NO: 4024495 - RNA, 16 nt, Staphylococcus aureus subsp. aureus MW2
acuugaugaaacugau

SEQ ID NO: 4024496 - RNA, 18 nt, Staphylococcus aureus subsp. aureus MW2
acuugauuuucuaaagcu

SEQ ID NO: 4024497 - RNA, 15 nt, Staphylococcus aureus subsp. aureus MW2
acuugcacauuauug

SEQ ID NO: 4024498 - RNA, 20 nt, Staphylococcus aureus subsp. aureus MW2
acuugcauugucuguagaaa

SEQ ID NO: 4024499 - RNA, 21 nt, Staphylococcus aureus subsp. aureus MW2
acuugcuguugcaauaaaauc

SEQ ID NO: 4024500 - RNA, 18 nt, Staphylococcus aureus subsp. aureus MW2
acuuggauuaccguuaaa

SEQ ID NO: 4024501 - RNA, 17 nt, Staphylococcus aureus subsp. aureus MW2
acuuggauucaaaugac

SEQ ID NO: 4024502 - RNA, 14 nt, Staphylococcus aureus subsp. aureus MW2
acuugguauuuauc

SEQ ID NO: 4024503 - RNA, 21 nt, Staphylococcus aureus subsp. aureus MW2
acuugguuaucauuauucaua

SEQ ID NO: 4024504 - RNA, 19 nt, Staphylococcus aureus subsp. aureus MW2
acuuguaaauuuauuuuua

SEQ ID NO: 4024505 - RNA, 17 nt, Staphylococcus aureus subsp. aureus MW2
acuugucguauucuuca

SEQ ID NO: 4024506 - RNA, 18 nt, Staphylococcus aureus subsp. aureus MW2
acuugucguauucuucaa

SEQ ID NO: 4024507 - RNA, 23 nt, Staphylococcus aureus subsp. aureus MW2
acuugugacaaucgcuugcuucu

SEQ ID NO: 4024508 - RNA, 18 nt, Staphylococcus aureus subsp. aureus MW2
acuugugauauauaacca

SEQ ID NO: 4024509 - RNA, 22 nt, Staphylococcus aureus subsp. aureus MW2
acuugugcgcgacguuuaaaug

SEQ ID NO: 4024510 - RNA, 22 nt, Staphylococcus aureus subsp. aureus MW2
acuuguucaauacuucuuguuc

SEQ ID NO: 4024511 - RNA, 23 nt, Staphylococcus aureus subsp. aureus MW2
acuuuaaaaauuaaguaauagca

SEQ ID NO: 4024512 - RNA, 15 nt, Staphylococcus aureus subsp. aureus MW2
acuuuaaaauuguau

SEQ ID NO: 4024513 - RNA, 22 nt, Staphylococcus aureus subsp. aureus MW2
acuuuaaaauuguauagaaugu

SEQ ID NO: 4024514 - RNA, 22 nt, Staphylococcus aureus subsp. aureus MW2
acuuuaaaguuaaaguuuuguu

SEQ ID NO: 4024515 - RNA, 16 nt, Staphylococcus aureus subsp. aureus MW2
acuuuaaauacauaua

SEQ ID NO: 4024516 - RNA, 15 nt, Staphylococcus aureus subsp. aureus MW2
acuuuaaaucuuguu

SEQ ID NO: 4024517 - RNA, 22 nt, Staphylococcus aureus subsp. aureus MW2
acuuuaacaauuuuaucugaau

SEQ ID NO: 4024518 - RNA, 22 nt, Staphylococcus aureus subsp. aureus MW2
acuuuaaccacuccuuaaacaa

SEQ ID NO: 4024519 - RNA, 11 nt, Staphylococcus aureus subsp. aureus MW2
acuuuaacuuc

SEQ ID NO: 4024520 - RNA, 16 nt, Staphylococcus aureus subsp. aureus MW2
acuuuaacuucuuuug

SEQ ID NO: 4024521 - RNA, 20 nt, Staphylococcus aureus subsp. aureus MW2
acuuuaauaccagcauccau

SEQ ID NO: 4024522 - RNA, 22 nt, Staphylococcus aureus subsp. aureus MW2
acuuuaauaccagcauccauug

SEQ ID NO: 4024523 - RNA, 21 nt, Staphylococcus aureus subsp. aureus MW2
acuuuaauacuaccguuuuua

SEQ ID NO: 4024524 - RNA, 11 nt, Staphylococcus aureus subsp. aureus MW2
acuuuaccauc

SEQ ID NO: 4024525 - RNA, 19 nt, Staphylococcus aureus subsp. aureus MW2
acuuuagcauauucgcuua

SEQ ID NO: 4024526 - RNA, 11 nt, Staphylococcus aureus subsp. aureus MW2
acuuuagcauu

SEQ ID NO: 4024527 - RNA, 13 nt, Staphylococcus aureus subsp. aureus MW2
acuuuaguauauu

SEQ ID NO: 4024528 - RNA, 18 nt, Staphylococcus aureus subsp. aureus MW2
acuuuauaaccuaaagcu

SEQ ID NO: 4024529 - RNA, 17 nt, Staphylococcus aureus subsp. aureus MW2
acuuucacaauaucacu

SEQ ID NO: 4024530 - RNA, 16 nt, Staphylococcus aureus subsp. aureus MW2
acuuucacuacauuaa

SEQ ID NO: 4024531 - RNA, 19 nt, Staphylococcus aureus subsp. aureus MW2
acuuucagucguuaaaaua

SEQ ID NO: 4024532 - RNA, 22 nt, Staphylococcus aureus subsp. aureus MW2
acuuucagucguuaaaauacca

SEQ ID NO: 4024533 - RNA, 15 nt, Staphylococcus aureus subsp. aureus MW2
acuuucgcuugcaaa

SEQ ID NO: 4024534 - RNA, 16 nt, Staphylococcus aureus subsp. aureus MW2
acuuucuaaagcaauu

SEQ ID NO: 4024535 - RNA, 14 nt, Staphylococcus aureus subsp. aureus MW2
acuuucuaauuguu

SEQ ID NO: 4024536 - RNA, 21 nt, Staphylococcus aureus subsp. aureus MW2
acuuucuacucuaauuacaua

SEQ ID NO: 4024537 - RNA, 22 nt, Staphylococcus aureus subsp. aureus MW2
acuuucucaucuauuuaauaau

SEQ ID NO: 4024538 - RNA, 22 nt, Staphylococcus aureus subsp. aureus MW2
acuuugagcggaaauaugauug

SEQ ID NO: 4024539 - RNA, 20 nt, Staphylococcus aureus subsp. aureus MW2
acuuugauaucuacagagaa

SEQ ID NO: 4024540 - RNA, 19 nt, Staphylococcus aureus subsp. aureus MW2
acuuugaucuuuaaauaua

SEQ ID NO: 4024541 - RNA, 17 nt, Staphylococcus aureus subsp. aureus MW2
acuuuggacuuuaaagu

SEQ ID NO: 4024542 - RNA, 21 nt, Staphylococcus aureus subsp. aureus MW2
acuuuggcagacguaucauca

SEQ ID NO: 4024543 - RNA, 16 nt, Staphylococcus aureus subsp. aureus MW2
acuuuguaauucuugu

SEQ ID NO: 4024544 - RNA, 14 nt, Staphylococcus aureus subsp. aureus MW2
acuuugucuguauu

SEQ ID NO: 4024545 - RNA, 15 nt, Staphylococcus aureus subsp. aureus MW2
agaauauaaacuauu

SEQ ID NO: 4024546 - RNA, 14 nt, Staphylococcus aureus subsp. aureus MW2
agaauauaacguuc

SEQ ID NO: 4024547 - RNA, 20 nt, Staphylococcus aureus subsp. aureus MW2
agaauauaggaaucuuguuu

SEQ ID NO: 4024548 - RNA, 21 nt, Staphylococcus aureus subsp. aureus MW2
agaauauauguauaacaauau

SEQ ID NO: 4024549 - RNA, 11 nt, Staphylococcus aureus subsp. aureus MW2
agaauauuaac

SEQ ID NO: 4024550 - RNA, 11 nt, Staphylococcus aureus subsp. aureus MW2
agaauauuaag

SEQ ID NO: 4024551 - RNA, 13 nt, Staphylococcus aureus subsp. aureus MW2
agaauauuaagau

SEQ ID NO: 4024552 - RNA, 22 nt, Staphylococcus aureus subsp. aureus MW2
agaauauuaagauguauaugaa

SEQ ID NO: 4024553 - RNA, 17 nt, Staphylococcus aureus subsp. aureus MW2
agaaucaaguaauucau

SEQ ID NO: 4024554 - RNA, 15 nt, Staphylococcus aureus subsp. aureus MW2
agaaucaauuauuga

SEQ ID NO: 4024555 - RNA, 19 nt, Staphylococcus aureus subsp. aureus MW2
agaaucaucuaaaugcacu

SEQ ID NO: 4024556 - RNA, 19 nt, Staphylococcus aureus subsp. aureus MW2
agaauccuaugccaaauaa

SEQ ID NO: 4024557 - RNA, 23 nt, Staphylococcus aureus subsp. aureus MW2
agaaucuuggaaguaucugugaa

SEQ ID NO: 4024558 - RNA, 16 nt, Staphylococcus aureus subsp. aureus MW2
agaaugaauaauucca

SEQ ID NO: 4024559 - RNA, 18 nt, Staphylococcus aureus subsp. aureus MW2
agaaugaauaauuccagu

SEQ ID NO: 4024560 - RNA, 17 nt, Staphylococcus aureus subsp. aureus MW2
agaaugcgauuuccuuu

SEQ ID NO: 4024561 - RNA, 15 nt, Staphylococcus aureus subsp. aureus MW2
agaauuaacaacaaa

SEQ ID NO: 4024562 - RNA, 15 nt, Staphylococcus aureus subsp. aureus MW2
agaauuaaugaaaua

SEQ ID NO: 4024563 - RNA, 17 nt, Staphylococcus aureus subsp. aureus MW2
agaauuauguuggacug

SEQ ID NO: 4024564 - RNA, 22 nt, Staphylococcus aureus subsp. aureus MW2
agaauuauuugauuauguaaau

SEQ ID NO: 4024565 - RNA, 17 nt, Staphylococcus aureus subsp. aureus MW2
agaauucaauuucucac

SEQ ID NO: 4024566 - RNA, 16 nt, Staphylococcus aureus subsp. aureus MW2
agaauucuaaaagaau

SEQ ID NO: 4024567 - RNA, 15 nt, Staphylococcus aureus subsp. aureus MW2
agaauugcaacgcau

SEQ ID NO: 4024568 - RNA, 21 nt, Staphylococcus aureus subsp. aureus MW2
agaauugcaacgcaucacaaa

SEQ ID NO: 4024569 - RNA, 15 nt, Staphylococcus aureus subsp. aureus MW2
agaauuuaguuuucg

SEQ ID NO: 4024570 - RNA, 16 nt, Staphylococcus aureus subsp. aureus MW2
agaauuucgaaaagaa

SEQ ID NO: 4024571 - RNA, 20 nt, Staphylococcus aureus subsp. aureus MW2
agacaauaaugcacgcgugc

SEQ ID NO: 4024572 - RNA, 13 nt, Staphylococcus aureus subsp. aureus MW2
agacaaucaucuu

SEQ ID NO: 4024573 - RNA, 21 nt, Staphylococcus aureus subsp. aureus MW2
agacaaugauuugugguaauc

SEQ ID NO: 4024574 - RNA, 12 nt, Staphylococcus aureus subsp. aureus MW2
agacaaugcaag

SEQ ID NO: 4024575 - RNA, 17 nt, Staphylococcus aureus subsp. aureus MW2
agacaaugcaaguuggc

SEQ ID NO: 4024576 - RNA, 20 nt, Staphylococcus aureus subsp. aureus MW2
agacaauuucuauuuaaaca

SEQ ID NO: 4024577 - RNA, 15 nt, Staphylococcus aureus subsp. aureus MW2
agacaccuucaauau

SEQ ID NO: 4024578 - RNA, 20 nt, Staphylococcus aureus subsp. aureus MW2
agacaccuucaauaucugua

SEQ ID NO: 4024579 - RNA, 19 nt, Staphylococcus aureus subsp. aureus MW2
agacagcuucucauugaaa

SEQ ID NO: 4024580 - RNA, 14 nt, Staphylococcus aureus subsp. aureus MW2
agacauaaaaaaag

SEQ ID NO: 4024581 - RNA, 12 nt, Staphylococcus aureus subsp. aureus MW2
agacauaaauau

SEQ ID NO: 4024582 - RNA, 16 nt, Staphylococcus aureus subsp. aureus MW2
agacauaagcaaagau

SEQ ID NO: 4024583 - RNA, 20 nt, Staphylococcus aureus subsp. aureus MW2
agacauaaggucuuggacua

SEQ ID NO: 4024584 - RNA, 19 nt, Staphylococcus aureus subsp. aureus MW2
agacaucaucuauuuuuaa

SEQ ID NO: 4024585 - RNA, 15 nt, Staphylococcus aureus subsp. aureus MW2
agacauccacagaau

SEQ ID NO: 4024586 - RNA, 15 nt, Staphylococcus aureus subsp. aureus MW2
agacaugagauuauu

SEQ ID NO: 4024587 - RNA, 12 nt, Staphylococcus aureus subsp. aureus MW2
agacauuaaaaa

SEQ ID NO: 4024588 - RNA, 14 nt, Staphylococcus aureus subsp. aureus MW2
agacauuacauuua

SEQ ID NO: 4024589 - RNA, 22 nt, Staphylococcus aureus subsp. aureus MW2
agacauugaaaggaacauuuca

SEQ ID NO: 4024590 - RNA, 17 nt, Staphylococcus aureus subsp. aureus MW2
agacauuucuucaauuu

SEQ ID NO: 4024591 - RNA, 17 nt, Staphylococcus aureus subsp. aureus MW2
agacauuuuaucugaaa

SEQ ID NO: 4024592 - RNA, 17 nt, Staphylococcus aureus subsp. aureus MW2
agaccuucaauaucuuc

SEQ ID NO: 4024593 - RNA, 15 nt, Staphylococcus aureus subsp. aureus MW2
agacgaacaucaucu

SEQ ID NO: 4024594 - RNA, 20 nt, Staphylococcus aureus subsp. aureus MW2
agacguaaguguaaaugaaa

SEQ ID NO: 4024595 - RNA, 21 nt, Staphylococcus aureus subsp. aureus MW2
agacuaaaaaacuaacuuuau

SEQ ID NO: 4024596 - RNA, 17 nt, Staphylococcus aureus subsp. aureus MW2
agacuaaaaugaaugaa

SEQ ID NO: 4024597 - RNA, 17 nt, Staphylococcus aureus subsp. aureus MW2
agacuaauuaucuucau

SEQ ID NO: 4024598 - RNA, 22 nt, Staphylococcus aureus subsp. aureus MW2
agacuacauucuucauuacagu

SEQ ID NO: 4024599 - RNA, 13 nt, Staphylococcus aureus subsp. aureus MW2
agacucaauuuca

SEQ ID NO: 4024600 - RNA, 15 nt, Staphylococcus aureus subsp. aureus MW2
agacucaauuucauu

SEQ ID NO: 4024601 - RNA, 22 nt, Staphylococcus aureus subsp. aureus MW2
agacucaauuucauuugaaaua

SEQ ID NO: 4024602 - RNA, 22 nt, Staphylococcus aureus subsp. aureus MW2
agacucauacacaaugccuuua

SEQ ID NO: 4024603 - RNA, 16 nt, Staphylococcus aureus subsp. aureus MW2
agacuccuaaauuauu

SEQ ID NO: 4024604 - RNA, 16 nt, Staphylococcus aureus subsp. aureus MW2
agacucuaaaauguuc

SEQ ID NO: 4024605 - RNA, 22 nt, Staphylococcus aureus subsp. aureus MW2
agacuugguuacuuaguaagga

SEQ ID NO: 4024606 - RNA, 24 nt, Staphylococcus aureus subsp. aureus MW2
agacuugguuacuuaguaaggaau

SEQ ID NO: 4024607 - RNA, 13 nt, Staphylococcus aureus subsp. aureus MW2
agacuuuaaaauu

SEQ ID NO: 4024608 - RNA, 13 nt, Staphylococcus aureus subsp. aureus MW2
agagaaaagcuag

SEQ ID NO: 4024609 - RNA, 14 nt, Staphylococcus aureus subsp. aureus MW2
agagaaaagcuaga

SEQ ID NO: 4024610 - RNA, 16 nt, Staphylococcus aureus subsp. aureus MW2
agagaaaagcuagaag

SEQ ID NO: 4024611 - RNA, 12 nt, Staphylococcus aureus subsp. aureus MW2
agagaaaauuug

SEQ ID NO: 4024612 - RNA, 19 nt, Staphylococcus aureus subsp. aureus MW2
agagaaauauaguaacaga

SEQ ID NO: 4024613 - RNA, 20 nt, Staphylococcus aureus subsp. aureus MW2
agagaaauuugauuuucaau

SEQ ID NO: 4024614 - RNA, 17 nt, Staphylococcus aureus subsp. aureus MW2
agagaauauaaaauaau

SEQ ID NO: 4024615 - RNA, 19 nt, Staphylococcus aureus subsp. aureus MW2
agagaauauagauuuugua

SEQ ID NO: 4024616 - RNA, 20 nt, Staphylococcus aureus subsp. aureus MW2
agagaaucaauuauugaaaa

SEQ ID NO: 4024617 - RNA, 15 nt, Staphylococcus aureus subsp. aureus MW2
agagaauuucaaaaa

SEQ ID NO: 4024618 - RNA, 18 nt, Staphylococcus aureus subsp. aureus MW2
agagaauuucgaaaagaa

SEQ ID NO: 4024619 - RNA, 23 nt, Staphylococcus aureus subsp. aureus MW2
agagacugaagagcuuuuaguaa

SEQ ID NO: 4024620 - RNA, 17 nt, Staphylococcus aureus subsp. aureus MW2
agagacuuauuuuauac

SEQ ID NO: 4024621 - RNA, 14 nt, Staphylococcus aureus subsp. aureus MW2
agagagaaaagcua

SEQ ID NO: 4024622 - RNA, 13 nt, Staphylococcus aureus subsp. aureus MW2
agagaugaaagau

SEQ ID NO: 4024623 - RNA, 13 nt, Staphylococcus aureus subsp. aureus MW2
agagaugggcuaa

SEQ ID NO: 4024624 - RNA, 16 nt, Staphylococcus aureus subsp. aureus MW2
agagauguauaaaacu

SEQ ID NO: 4024625 - RNA, 13 nt, Staphylococcus aureus subsp. aureus MW2
agagcguuuugcu

SEQ ID NO: 4024626 - RNA, 18 nt, Staphylococcus aureus subsp. aureus MW2
agagcucaagacauuaca

SEQ ID NO: 4024627 - RNA, 17 nt, Staphylococcus aureus subsp. aureus MW2
agagcuuuuaguaaaua

SEQ ID NO: 4024628 - RNA, 22 nt, Staphylococcus aureus subsp. aureus MW2
agaggaacaguggaauacagau

SEQ ID NO: 4024629 - RNA, 19 nt, Staphylococcus aureus subsp. aureus MW2
agaggauagacaacugcaa

SEQ ID NO: 4024630 - RNA, 20 nt, Staphylococcus aureus subsp. aureus MW2
agaggcaaucuugaacaauu

SEQ ID NO: 4024631 - RNA, 17 nt, Staphylococcus aureus subsp. aureus MW2
agagguacuagaauuaa

SEQ ID NO: 4024632 - RNA, 19 nt, Staphylococcus aureus subsp. aureus MW2
agaggucuccaauacuuuu

SEQ ID NO: 4024633 - RNA, 24 nt, Staphylococcus aureus subsp. aureus MW2
agagguuuugcacuaauggcacuu

SEQ ID NO: 4024634 - RNA, 20 nt, Staphylococcus aureus subsp. aureus MW2
agcaaauugauuaaauaaau

SEQ ID NO: 4024635 - RNA, 13 nt, Staphylococcus aureus subsp. aureus MW2
agcaacaaaagau

SEQ ID NO: 4024636 - RNA, 16 nt, Staphylococcus aureus subsp. aureus MW2
agcaacaucggcacca

SEQ ID NO: 4024637 - RNA, 17 nt, Staphylococcus aureus subsp. aureus MW2
agcaacgauaccaaaua

SEQ ID NO: 4024638 - RNA, 15 nt, Staphylococcus aureus subsp. aureus MW2
agcaacgaugucacu

SEQ ID NO: 4024639 - RNA, 20 nt, Staphylococcus aureus subsp. aureus MW2
agcaaguccaaauaaugugc

SEQ ID NO: 4024640 - RNA, 14 nt, Staphylococcus aureus subsp. aureus MW2
agcaauaucaucau

SEQ ID NO: 4024641 - RNA, 19 nt, Staphylococcus aureus subsp. aureus MW2
agcaauaucaucauuuaaa

SEQ ID NO: 4024642 - RNA, 16 nt, Staphylococcus aureus subsp. aureus MW2
agcaaucacaccugca

SEQ ID NO: 4024643 - RNA, 15 nt, Staphylococcus aureus subsp. aureus MW2
agcaaucauaauacu

SEQ ID NO: 4024644 - RNA, 15 nt, Staphylococcus aureus subsp. aureus MW2
agcaaugaguugauc

SEQ ID NO: 4024645 - RNA, 21 nt, Staphylococcus aureus subsp. aureus MW2
agcaaugcaugcuucucaauu

SEQ ID NO: 4024646 - RNA, 17 nt, Staphylococcus aureus subsp. aureus MW2
agcaauucacuuauaca

SEQ ID NO: 4024647 - RNA, 15 nt, Staphylococcus aureus subsp. aureus MW2
agcaauucgauauga

SEQ ID NO: 4024648 - RNA, 19 nt, Staphylococcus aureus subsp. aureus MW2
agcaauucuucaauuucau

SEQ ID NO: 4024649 - RNA, 22 nt, Staphylococcus aureus subsp. aureus MW2
agcaauuucgauugcguuuucu

SEQ ID NO: 4024650 - RNA, 14 nt, Staphylococcus aureus subsp. aureus MW2
agcacaaacuaaaa

SEQ ID NO: 4024651 - RNA, 13 nt, Staphylococcus aureus subsp. aureus MW2
agcacauuuuuag

SEQ ID NO: 4024652 - RNA, 21 nt, Staphylococcus aureus subsp. aureus MW2
agcacauuuuuaguuagaaag

SEQ ID NO: 4024653 - RNA, 23 nt, Staphylococcus aureus subsp. aureus MW2
agcaccgauuuggucagcgacau

SEQ ID NO: 4024654 - RNA, 18 nt, Staphylococcus aureus subsp. aureus MW2
agcaccguaacauaugua

SEQ ID NO: 4024655 - RNA, 14 nt, Staphylococcus aureus subsp. aureus MW2
agcacgcuuauuga

SEQ ID NO: 4024656 - RNA, 13 nt, Staphylococcus aureus subsp. aureus MW2
agcacuacaucaa

SEQ ID NO: 4024657 - RNA, 20 nt, Staphylococcus aureus subsp. aureus MW2
agcacuauaacaagguguuc

SEQ ID NO: 4024658 - RNA, 17 nt, Staphylococcus aureus subsp. aureus MW2
agcacuaucuuuugcuu

SEQ ID NO: 4024659 - RNA, 22 nt, Staphylococcus aureus subsp. aureus MW2
agcacuguugugaguucauaau

SEQ ID NO: 4024660 - RNA, 14 nt, Staphylococcus aureus subsp. aureus MW2
agcagacuaaaagu

SEQ ID NO: 4024661 - RNA, 19 nt, Staphylococcus aureus subsp. aureus MW2
agcaguaguugacuguaaa

SEQ ID NO: 4024662 - RNA, 21 nt, Staphylococcus aureus subsp. aureus MW2
agcaguuguugguuuugcaac

SEQ ID NO: 4024663 - RNA, 13 nt, Staphylococcus aureus subsp. aureus MW2
agcauaaaucaac

SEQ ID NO: 4024664 - RNA, 15 nt, Staphylococcus aureus subsp. aureus MW2
agcauacaauaaugu

SEQ ID NO: 4024665 - RNA, 17 nt, Staphylococcus aureus subsp. aureus MW2
agcauaccuacagaaug

SEQ ID NO: 4024666 - RNA, 20 nt, Staphylococcus aureus subsp. aureus MW2
agcauaguuuucauacuacu

SEQ ID NO: 4024667 - RNA, 17 nt, Staphylococcus aureus subsp. aureus MW2
agcauaucucaagauau

SEQ ID NO: 4024668 - RNA, 19 nt, Staphylococcus aureus subsp. aureus MW2
agcauaucuuuaucauuau

SEQ ID NO: 4024669 - RNA, 20 nt, Staphylococcus aureus subsp. aureus MW2
agcauaucuuuaucauuauu

SEQ ID NO: 4024670 - RNA, 20 nt, Staphylococcus aureus subsp. aureus MW2
agcauaugguaaaucgucau

SEQ ID NO: 4024671 - RNA, 15 nt, Staphylococcus aureus subsp. aureus MW2
agcaucaaaaauaaa

SEQ ID NO: 4024672 - RNA, 19 nt, Staphylococcus aureus subsp. aureus MW2
agcaucacaguguugaauu

SEQ ID NO: 4024673 - RNA, 14 nt, Staphylococcus aureus subsp. aureus MW2
agcaucauuuuucg

SEQ ID NO: 4024674 - RNA, 19 nt, Staphylococcus aureus subsp. aureus MW2
agcaucgauuuauuauuac

SEQ ID NO: 4024675 - RNA, 14 nt, Staphylococcus aureus subsp. aureus MW2
agcaucguaaaaaa

SEQ ID NO: 4024676 - RNA, 21 nt, Staphylococcus aureus subsp. aureus MW2
agcaucguaaaaaacaaaaaa

SEQ ID NO: 4024677 - RNA, 17 nt, Staphylococcus aureus subsp. aureus MW2
agcaucuauaauauuca

SEQ ID NO: 4024678 - RNA, 16 nt, Staphylococcus aureus subsp. aureus MW2
agcaucugcaugguuu

SEQ ID NO: 4024679 - RNA, 23 nt, Staphylococcus aureus subsp. aureus MW2
agcaucugcaugguuugcugguu

SEQ ID NO: 4024680 - RNA, 21 nt, Staphylococcus aureus subsp. aureus MW2
agcaucuugucuaguucgauu

SEQ ID NO: 4024681 - RNA, 14 nt, Staphylococcus aureus subsp. aureus MW2
agcaugaaucgcau

SEQ ID NO: 4024682 - RNA, 15 nt, Staphylococcus aureus subsp. aureus MW2
agcaugaaucgcauu

SEQ ID NO: 4024683 - RNA, 16 nt, Staphylococcus aureus subsp. aureus MW2
agcaugacuguaagua

SEQ ID NO: 4024684 - RNA, 15 nt, Staphylococcus aureus subsp. aureus MW2
agcaugauaaaaaua

SEQ ID NO: 4024685 - RNA, 21 nt, Staphylococcus aureus subsp. aureus MW2
agcaugauaaaguauguuguc

SEQ ID NO: 4024686 - RNA, 20 nt, Staphylococcus aureus subsp. aureus MW2
agcauuaaauuccaugucaa

SEQ ID NO: 4024687 - RNA, 19 nt, Staphylococcus aureus subsp. aureus MW2
agcauuaaucguauuuuua

SEQ ID NO: 4024688 - RNA, 18 nt, Staphylococcus aureus subsp. aureus MW2
agcauuagcaaauauuau

SEQ ID NO: 4024689 - RNA, 20 nt, Staphylococcus aureus subsp. aureus MW2
agcauugggacauaaaauua

SEQ ID NO: 4024690 - RNA, 14 nt, Staphylococcus aureus subsp. aureus MW2
agcauuucuuuauu

SEQ ID NO: 4024691 - RNA, 15 nt, Staphylococcus aureus subsp. aureus MW2
agcauuuuauuuuua

SEQ ID NO: 4024692 - RNA, 23 nt, Staphylococcus aureus subsp. aureus MW2
agcauuuuauuuuuaaauaugau

SEQ ID NO: 4024693 - RNA, 17 nt, Staphylococcus aureus subsp. aureus MW2
agccaagauaaaucauc

SEQ ID NO: 4024694 - RNA, 14 nt, Staphylococcus aureus subsp. aureus MW2
agccaauaaaaugu

SEQ ID NO: 4024695 - RNA, 23 nt, Staphylococcus aureus subsp. aureus MW2
agccaauggaacgccgaauaauc

SEQ ID NO: 4024696 - RNA, 21 nt, Staphylococcus aureus subsp. aureus MW2
agccaauuucuacagacaaug

SEQ ID NO: 4024697 - RNA, 13 nt, Staphylococcus aureus subsp. aureus MW2
agccauaauaucu

SEQ ID NO: 4024698 - RNA, 18 nt, Staphylococcus aureus subsp. aureus MW2
agccauaccuuauuucag

SEQ ID NO: 4024699 - RNA, 20 nt, Staphylococcus aureus subsp. aureus MW2
agccaugauacgaugcguga

SEQ ID NO: 4024700 - RNA, 13 nt, Staphylococcus aureus subsp. aureus MW2
agccauuucaauu

SEQ ID NO: 4024701 - RNA, 18 nt, Staphylococcus aureus subsp. aureus MW2
agccccuuacaaccuuug

SEQ ID NO: 4024702 - RNA, 16 nt, Staphylococcus aureus subsp. aureus MW2
agccccuuacaacuuu

SEQ ID NO: 4024703 - RNA, 19 nt, Staphylococcus aureus subsp. aureus MW2
agccccuuuuaaauucuua

SEQ ID NO: 4024704 - RNA, 17 nt, Staphylococcus aureus subsp. aureus MW2
agcccgcaaaucgccuc

SEQ ID NO: 4024705 - RNA, 14 nt, Staphylococcus aureus subsp. aureus MW2
agcccguuaaaaag

SEQ ID NO: 4024706 - RNA, 14 nt, Staphylococcus aureus subsp. aureus MW2
agccuaauuuuucu

SEQ ID NO: 4024707 - RNA, 20 nt, Staphylococcus aureus subsp. aureus MW2
agccuacuuugucugcaauu

SEQ ID NO: 4024708 - RNA, 22 nt, Staphylococcus aureus subsp. aureus MW2
agccuagaacauugauuauugu

SEQ ID NO: 4024709 - RNA, 13 nt, Staphylococcus aureus subsp. aureus MW2
agccuauccauuc

SEQ ID NO: 4024710 - RNA, 18 nt, Staphylococcus aureus subsp. aureus MW2
agccucuuaaaauaccug

SEQ ID NO: 4024711 - RNA, 17 nt, Staphylococcus aureus subsp. aureus MW2
agccucuugccuugaaa

SEQ ID NO: 4024712 - RNA, 19 nt, Staphylococcus aureus subsp. aureus MW2
agccugaaauagaaauguc

SEQ ID NO: 4024713 - RNA, 19 nt, Staphylococcus aureus subsp. aureus MW2
agccugcaacccauguggu

SEQ ID NO: 4024714 - RNA, 17 nt, Staphylococcus aureus subsp. aureus MW2
agccuuaaaauauuuaa

SEQ ID NO: 4024715 - RNA, 23 nt, Staphylococcus aureus subsp. aureus MW2
agccuuaaaauauuuaacuuuuu

SEQ ID NO: 4024716 - RNA, 13 nt, Staphylococcus aureus subsp. aureus MW2
agccuucaaaaug

SEQ ID NO: 4024717 - RNA, 13 nt, Staphylococcus aureus subsp. aureus MW2
agccuucuaucuu

SEQ ID NO: 4024718 - RNA, 15 nt, Staphylococcus aureus subsp. aureus MW2
agccuuuucaaacau

SEQ ID NO: 4024719 - RNA, 23 nt, Staphylococcus aureus subsp. aureus MW2
agccuuuuucaauucuagucagg

SEQ ID NO: 4024720 - RNA, 22 nt, Staphylococcus aureus subsp. aureus MW2
agcgaaaguaucuaugaaauuu

SEQ ID NO: 4024721 - RNA, 21 nt, Staphylococcus aureus subsp. aureus MW2
agcgauaagcaugauaaaaau

SEQ ID NO: 4024722 - RNA, 21 nt, Staphylococcus aureus subsp. aureus MW2
aggaauauuucccuaugaaau

SEQ ID NO: 4024723 - RNA, 22 nt, Staphylococcus aureus subsp. aureus MW2
aggaaugauauaccuugauuca

SEQ ID NO: 4024724 - RNA, 20 nt, Staphylococcus aureus subsp. aureus MW2
aggaauguauuuuucauauu

SEQ ID NO: 4024725 - RNA, 14 nt, Staphylococcus aureus subsp. aureus MW2
aggacacauaaaug

SEQ ID NO: 4024726 - RNA, 19 nt, Staphylococcus aureus subsp. aureus MW2
aggacacauuuacuuaaga

SEQ ID NO: 4024727 - RNA, 19 nt, Staphylococcus aureus subsp. aureus MW2
aggacaggaauaaauuuug

SEQ ID NO: 4024728 - RNA, 19 nt, Staphylococcus aureus subsp. aureus MW2
aggaccacucaauucucua

SEQ ID NO: 4024729 - RNA, 22 nt, Staphylococcus aureus subsp. aureus MW2
aggagcgagccauuauuauuuu

SEQ ID NO: 4024730 - RNA, 18 nt, Staphylococcus aureus subsp. aureus MW2
aggauacauaaaucuaau

SEQ ID NO: 4024731 - RNA, 19 nt, Staphylococcus aureus subsp. aureus MW2
aggauacauaaaucuaaua

SEQ ID NO: 4024732 - RNA, 15 nt, Staphylococcus aureus subsp. aureus MW2
aggauaucuacgccu

SEQ ID NO: 4024733 - RNA, 21 nt, Staphylococcus aureus subsp. aureus MW2
aggauaugcuguguaucauca

SEQ ID NO: 4024734 - RNA, 22 nt, Staphylococcus aureus subsp. aureus MW2
aggaucacguuuuucuuuaaac

SEQ ID NO: 4024735 - RNA, 17 nt, Staphylococcus aureus subsp. aureus MW2
aggaugaguuuaaaaau

SEQ ID NO: 4024736 - RNA, 18 nt, Staphylococcus aureus subsp. aureus MW2
aggaugaguuuaaaaaua

SEQ ID NO: 4024737 - RNA, 15 nt, Staphylococcus aureus subsp. aureus MW2
aggauguuauaaaau

SEQ ID NO: 4024738 - RNA, 14 nt, Staphylococcus aureus subsp. aureus MW2
aggauguucaucaa

SEQ ID NO: 4024739 - RNA, 20 nt, Staphylococcus aureus subsp. aureus MW2
aggauuauagguauaagaau

SEQ ID NO: 4024740 - RNA, 20 nt, Staphylococcus aureus subsp. aureus MW2
aggauucgauugguuuaaaa

SEQ ID NO: 4024741 - RNA, 20 nt, Staphylococcus aureus subsp. aureus MW2
aggauuuccggaacaauacc

SEQ ID NO: 4024742 - RNA, 15 nt, Staphylococcus aureus subsp. aureus MW2
aggcaauauuaaaau

SEQ ID NO: 4024743 - RNA, 17 nt, Staphylococcus aureus subsp. aureus MW2
aggcaaugcaaguuggg

SEQ ID NO: 4024744 - RNA, 17 nt, Staphylococcus aureus subsp. aureus MW2
aggcaggaaugauauac

SEQ ID NO: 4024745 - RNA, 13 nt, Staphylococcus aureus subsp. aureus MW2
aggcagguacuuc

SEQ ID NO: 4024746 - RNA, 23 nt, Staphylococcus aureus subsp. aureus MW2
aggcauaauuugugguaugacug

SEQ ID NO: 4024747 - RNA, 20 nt, Staphylococcus aureus subsp. aureus MW2
aggcauauccgaaaauugcu

SEQ ID NO: 4024748 - RNA, 15 nt, Staphylococcus aureus subsp. aureus MW2
aggcaucucacaauc

SEQ ID NO: 4024749 - RNA, 16 nt, Staphylococcus aureus subsp. aureus MW2
aggcauucuuccaaca

SEQ ID NO: 4024750 - RNA, 22 nt, Staphylococcus aureus subsp. aureus MW2
aggcgcuacaauguuauauugg

SEQ ID NO: 4024751 - RNA, 23 nt, Staphylococcus aureus subsp. aureus MW2
aggcgcuccuacuuuucaacuuu

SEQ ID NO: 4024752 - RNA, 23 nt, Staphylococcus aureus subsp. aureus MW2
aggcugggacauaaaucaauguu

SEQ ID NO: 4024753 - RNA, 17 nt, Staphylococcus aureus subsp. aureus MW2
aggcuuaaauauaauga

SEQ ID NO: 4024754 - RNA, 13 nt, Staphylococcus aureus subsp. aureus MW2
agggcaaaaaagg

SEQ ID NO: 4024755 - RNA, 11 nt, Staphylococcus aureus subsp. aureus MW2
agggccccaac

SEQ ID NO: 4024756 - RNA, 18 nt, Staphylococcus aureus subsp. aureus MW2
agggccccaacacagaag

SEQ ID NO: 4024757 - RNA, 21 nt, Staphylococcus aureus subsp. aureus MW2
agggcggucaauuuuaccaug

SEQ ID NO: 4024758 - RNA, 17 nt, Staphylococcus aureus subsp. aureus MW2
agggcuccuacuccaua

SEQ ID NO: 4024759 - RNA, 23 nt, Staphylococcus aureus subsp. aureus MW2
aggggacuuaaccauuuaaaaau

SEQ ID NO: 4024760 - RNA, 12 nt, Staphylococcus aureus subsp. aureus MW2
aggggccccaac

SEQ ID NO: 4024761 - RNA, 16 nt, Staphylococcus aureus subsp. aureus MW2
aggggccccaacacag

SEQ ID NO: 4024762 - RNA, 21 nt, Staphylococcus aureus subsp. aureus MW2
aggggcuucuuucuaaaauaa

SEQ ID NO: 4024763 - RNA, 13 nt, Staphylococcus aureus subsp. aureus MW2
agggguaaaacuu

SEQ ID NO: 4024764 - RNA, 20 nt, Staphylococcus aureus subsp. aureus MW2
agggucgugacggaaucuug

SEQ ID NO: 4024765 - RNA, 15 nt, Staphylococcus aureus subsp. aureus MW2
agguaaaaauuaaca

SEQ ID NO: 4024766 - RNA, 17 nt, Staphylococcus aureus subsp. aureus MW2
agguaaaaauuaacaac

SEQ ID NO: 4024767 - RNA, 13 nt, Staphylococcus aureus subsp. aureus MW2
agguaaaucuguu

SEQ ID NO: 4024768 - RNA, 23 nt, Staphylococcus aureus subsp. aureus MW2
agguaaaucuguuuaaauuuaaa

SEQ ID NO: 4024769 - RNA, 13 nt, Staphylococcus aureus subsp. aureus MW2
agguaaauuuaaa

SEQ ID NO: 4024770 - RNA, 18 nt, Staphylococcus aureus subsp. aureus MW2
agguaaauuuaaaauaau

SEQ ID NO: 4024771 - RNA, 19 nt, Staphylococcus aureus subsp. aureus MW2
agguaaauuuaaaauaaua

SEQ ID NO: 4024772 - RNA, 23 nt, Staphylococcus aureus subsp. aureus MW2
agguaacugcuuuggaguuucuu

SEQ ID NO: 4024773 - RNA, 17 nt, Staphylococcus aureus subsp. aureus MW2
agguaauaaagcugauu

SEQ ID NO: 4024774 - RNA, 18 nt, Staphylococcus aureus subsp. aureus MW2
agguacauaaauaccugg

SEQ ID NO: 4024775 - RNA, 17 nt, Staphylococcus aureus subsp. aureus MW2
agguaugaaauaacaau

SEQ ID NO: 4024776 - RNA, 17 nt, Staphylococcus aureus subsp. aureus MW2
agguauucaaauaaaca

SEQ ID NO: 4024777 - RNA, 19 nt, Staphylococcus aureus subsp. aureus MW2
agguauuucauugauaagu

SEQ ID NO: 4024778 - RNA, 13 nt, Staphylococcus aureus subsp. aureus MW2
aggucaaaaaauu

SEQ ID NO: 4024779 - RNA, 19 nt, Staphylococcus aureus subsp. aureus MW2
aggucaaaaaauuaaucaa

SEQ ID NO: 4024780 - RNA, 20 nt, Staphylococcus aureus subsp. aureus MW2
aggucaaaaaauuaaucaau

SEQ ID NO: 4024781 - RNA, 14 nt, Staphylococcus aureus subsp. aureus MW2
aggugauuauauau

SEQ ID NO: 4024782 - RNA, 20 nt, Staphylococcus aureus subsp. aureus MW2
aggugauuauauauauuaaa

SEQ ID NO: 4024783 - RNA, 16 nt, Staphylococcus aureus subsp. aureus MW2
aggugauugaacaaua

SEQ ID NO: 4024784 - RNA, 19 nt, Staphylococcus aureus subsp. aureus MW2
aggugcaguuaaauuaaac

SEQ ID NO: 4024785 - RNA, 19 nt, Staphylococcus aureus subsp. aureus MW2
aggugcaucuuuugguuua

SEQ ID NO: 4024786 - RNA, 20 nt, Staphylococcus aureus subsp. aureus MW2
aggugcaucuuuugguuuag

SEQ ID NO: 4024787 - RNA, 18 nt, Staphylococcus aureus subsp. aureus MW2
agguggagauuuaacaau

SEQ ID NO: 4024788 - RNA, 21 nt, Staphylococcus aureus subsp. aureus MW2
agguggagauuuaacaauaua

SEQ ID NO: 4024789 - RNA, 17 nt, Staphylococcus aureus subsp. aureus MW2
aggugucaauaaauugu

SEQ ID NO: 4024790 - RNA, 13 nt, Staphylococcus aureus subsp. aureus MW2
agguuaauuaaac

SEQ ID NO: 4024791 - RNA, 15 nt, Staphylococcus aureus subsp. aureus MW2
agguuacaauaaugu

SEQ ID NO: 4024792 - RNA, 16 nt, Staphylococcus aureus subsp. aureus MW2
agguuauauuuaaaug

SEQ ID NO: 4024793 - RNA, 20 nt, Staphylococcus aureus subsp. aureus MW2
agguuauauuuaaaugcuuu

SEQ ID NO: 4024794 - RNA, 17 nt, Staphylococcus aureus subsp. aureus MW2
agguuaucacaacagua

SEQ ID NO: 4024795 - RNA, 19 nt, Staphylococcus aureus subsp. aureus MW2
agguuauuauaaaauaaau

SEQ ID NO: 4024796 - RNA, 18 nt, Staphylococcus aureus subsp. aureus MW2
agguucaucuuuaugcaa

SEQ ID NO: 4024797 - RNA, 15 nt, Staphylococcus aureus subsp. aureus MW2
agguucuucaucuuu

SEQ ID NO: 4024798 - RNA, 13 nt, Staphylococcus aureus subsp. aureus MW2
agguuuauauauc

SEQ ID NO: 4024799 - RNA, 18 nt, Staphylococcus aureus subsp. aureus MW2
agguuucacaaauucuuu

SEQ ID NO: 4024800 - RNA, 18 nt, Staphylococcus aureus subsp. aureus MW2
agguuuguaagacaacaa

SEQ ID NO: 4024801 - RNA, 16 nt, Staphylococcus aureus subsp. aureus MW2
agguuuucgccaauaa

SEQ ID NO: 4024802 - RNA, 15 nt, Staphylococcus aureus subsp. aureus MW2
aguaaaacauuggcg

SEQ ID NO: 4024803 - RNA, 14 nt, Staphylococcus aureus subsp. aureus MW2
aguaaaauaaaaaa

SEQ ID NO: 4024804 - RNA, 21 nt, Staphylococcus aureus subsp. aureus MW2
aguaaaauaaauacaauagaa

SEQ ID NO: 4024805 - RNA, 22 nt, Staphylococcus aureus subsp. aureus MW2
aguaaaccuacuaauauauuaa

SEQ ID NO: 4024806 - RNA, 17 nt, Staphylococcus aureus subsp. aureus MW2
aguaaacgagacaucau

SEQ ID NO: 4024807 - RNA, 16 nt, Staphylococcus aureus subsp. aureus MW2
aguaaagugaaauaaa

SEQ ID NO: 4024808 - RNA, 15 nt, Staphylococcus aureus subsp. aureus MW2
aguaaauaauuuaaa

SEQ ID NO: 4024809 - RNA, 13 nt, Staphylococcus aureus subsp. aureus MW2
aguaaauuuauua

SEQ ID NO: 4024810 - RNA, 15 nt, Staphylococcus aureus subsp. aureus MW2
agucaggggccccaa

SEQ ID NO: 4024811 - RNA, 16 nt, Staphylococcus aureus subsp. aureus MW2
agucaggggccccaac

SEQ ID NO: 4024812 - RNA, 20 nt, Staphylococcus aureus subsp. aureus MW2
agucaggggccccaacacag

SEQ ID NO: 4024813 - RNA, 16 nt, Staphylococcus aureus subsp. aureus MW2
agucauaaauauaaaa

SEQ ID NO: 4024814 - RNA, 21 nt, Staphylococcus aureus subsp. aureus MW2
agucauaaauugauuucuaau

SEQ ID NO: 4024815 - RNA, 17 nt, Staphylococcus aureus subsp. aureus MW2
agucauagcuaugauuu

SEQ ID NO: 4024816 - RNA, 12 nt, Staphylococcus aureus subsp. aureus MW2
agucaucaucau

SEQ ID NO: 4024817 - RNA, 19 nt, Staphylococcus aureus subsp. aureus MW2
agucaucaucaugauuacu

SEQ ID NO: 4024818 - RNA, 15 nt, Staphylococcus aureus subsp. aureus MW2
agucauccaaagaaa

SEQ ID NO: 4024819 - RNA, 21 nt, Staphylococcus aureus subsp. aureus MW2
agucauguuuggcauaauaau

SEQ ID NO: 4024820 - RNA, 13 nt, Staphylococcus aureus subsp. aureus MW2
agucauuacaaau

SEQ ID NO: 4024821 - RNA, 17 nt, Staphylococcus aureus subsp. aureus MW2
agucauuguauaaaaag

SEQ ID NO: 4024822 - RNA, 21 nt, Staphylococcus aureus subsp. aureus MW2
agucauuugaauuagaagcaa

SEQ ID NO: 4024823 - RNA, 18 nt, Staphylococcus aureus subsp. aureus MW2
agucauuugaugguuuaa

SEQ ID NO: 4024824 - RNA, 16 nt, Staphylococcus aureus subsp. aureus MW2
aguccaaauaauaucu

SEQ ID NO: 4024825 - RNA, 23 nt, Staphylococcus aureus subsp. aureus MW2
aguccauucgacuccaaccuuuu

SEQ ID NO: 4024826 - RNA, 15 nt, Staphylococcus aureus subsp. aureus MW2
aguccauuuucuuuu

SEQ ID NO: 4024827 - RNA, 16 nt, Staphylococcus aureus subsp. aureus MW2
aguccauuuucuuuuu

SEQ ID NO: 4024828 - RNA, 22 nt, Staphylococcus aureus subsp. aureus MW2
aguccgcguguacuuuaccauc

SEQ ID NO: 4024829 - RNA, 15 nt, Staphylococcus aureus subsp. aureus MW2
agucgauaaguuuuu

SEQ ID NO: 4024830 - RNA, 19 nt, Staphylococcus aureus subsp. aureus MW2
agucgcaauggcaauugau

SEQ ID NO: 4024831 - RNA, 12 nt, Staphylococcus aureus subsp. aureus MW2
agucggggcccc

SEQ ID NO: 4024832 - RNA, 13 nt, Staphylococcus aureus subsp. aureus MW2
agucggggcccca

SEQ ID NO: 4024833 - RNA, 18 nt, Staphylococcus aureus subsp. aureus MW2
agucggggccccaacaca

SEQ ID NO: 4024834 - RNA, 19 nt, Staphylococcus aureus subsp. aureus MW2
agucggggccccaacacag

SEQ ID NO: 4024835 - RNA, 12 nt, Staphylococcus aureus subsp. aureus MW2
agucuaugaaua

SEQ ID NO: 4024836 - RNA, 13 nt, Staphylococcus aureus subsp. aureus MW2
agucuaugaauaa

SEQ ID NO: 4024837 - RNA, 14 nt, Staphylococcus aureus subsp. aureus MW2
agucuaugaauaau

SEQ ID NO: 4024838 - RNA, 16 nt, Staphylococcus aureus subsp. aureus MW2
agucuaugaauaaugu

SEQ ID NO: 4024839 - RNA, 13 nt, Staphylococcus aureus subsp. aureus MW2
agucucguaauaa

SEQ ID NO: 4024840 - RNA, 17 nt, Staphylococcus aureus subsp. aureus MW2
agucucuaaaacuuuuu

SEQ ID NO: 4024841 - RNA, 22 nt, Staphylococcus aureus subsp. aureus MW2
agucugcucuuuuuguaugagu

SEQ ID NO: 4024842 - RNA, 15 nt, Staphylococcus aureus subsp. aureus MW2
agucuggaacaauaa

SEQ ID NO: 4024843 - RNA, 16 nt, Staphylococcus aureus subsp. aureus MW2
agucuuaaacauaaca

SEQ ID NO: 4024844 - RNA, 19 nt, Staphylococcus aureus subsp. aureus MW2
agucuuaaacauaacauga

SEQ ID NO: 4024845 - RNA, 15 nt, Staphylococcus aureus subsp. aureus MW2
agucuucauguucuu

SEQ ID NO: 4024846 - RNA, 17 nt, Staphylococcus aureus subsp. aureus MW2
agucuucauguucuuau

SEQ ID NO: 4024847 - RNA, 18 nt, Staphylococcus aureus subsp. aureus MW2
agucuucauguucuuaua

SEQ ID NO: 4024848 - RNA, 14 nt, Staphylococcus aureus subsp. aureus MW2
agucuugauggugg

SEQ ID NO: 4024849 - RNA, 18 nt, Staphylococcus aureus subsp. aureus MW2
agucuuuacucuacacuc

SEQ ID NO: 4024850 - RNA, 14 nt, Staphylococcus aureus subsp. aureus MW2
agucuuucaacaaa

SEQ ID NO: 4024851 - RNA, 18 nt, Staphylococcus aureus subsp. aureus MW2
agugaaaacuucucuauc

SEQ ID NO: 4024852 - RNA, 16 nt, Staphylococcus aureus subsp. aureus MW2
agugaaaauaccaacu

SEQ ID NO: 4024853 - RNA, 17 nt, Staphylococcus aureus subsp. aureus MW2
agugaaaguauuagaua

SEQ ID NO: 4024854 - RNA, 22 nt, Staphylococcus aureus subsp. aureus MW2
agugaaagucguuguugaaauu

SEQ ID NO: 4024855 - RNA, 17 nt, Staphylococcus aureus subsp. aureus MW2
agugaaaucauuuaaau

SEQ ID NO: 4024856 - RNA, 21 nt, Staphylococcus aureus subsp. aureus MW2
agugaaguuugacgguauaaa

SEQ ID NO: 4024857 - RNA, 19 nt, Staphylococcus aureus subsp. aureus MW2
agugaaucgucuacauuua

SEQ ID NO: 4024858 - RNA, 20 nt, Staphylococcus aureus subsp. aureus MW2
agugaaucgucuacauuuag

SEQ ID NO: 4024859 - RNA, 16 nt, Staphylococcus aureus subsp. aureus MW2
agugaauuaucuauau

SEQ ID NO: 4024860 - RNA, 20 nt, Staphylococcus aureus subsp. aureus MW2
agugaauuaucuauauauga

SEQ ID NO: 4024861 - RNA, 20 nt, Staphylococcus aureus subsp. aureus MW2
agugaguuuuauuuauaaac

SEQ ID NO: 4024862 - RNA, 16 nt, Staphylococcus aureus subsp. aureus MW2
agugauaaauaaugca

SEQ ID NO: 4024863 - RNA, 13 nt, Staphylococcus aureus subsp. aureus MW2
agugauaauuaaa

SEQ ID NO: 4024864 - RNA, 15 nt, Staphylococcus aureus subsp. aureus MW2
agugauaauuaaaau

SEQ ID NO: 4024865 - RNA, 21 nt, Staphylococcus aureus subsp. aureus MW2
agugauaauuaaaauaagaua

SEQ ID NO: 4024866 - RNA, 14 nt, Staphylococcus aureus subsp. aureus MW2
agugauucaggauu

SEQ ID NO: 4024867 - RNA, 14 nt, Staphylococcus aureus subsp. aureus MW2
agugauuuaaaaaa

SEQ ID NO: 4024868 - RNA, 18 nt, Staphylococcus aureus subsp. aureus MW2
agugcaaguccaaauaau

SEQ ID NO: 4024869 - RNA, 22 nt, Staphylococcus aureus subsp. aureus MW2
agugcaauaacaccaauugaau

SEQ ID NO: 4024870 - RNA, 20 nt, Staphylococcus aureus subsp. aureus MW2
agugcauuuuuuauuuuacu

SEQ ID NO: 4024871 - RNA, 21 nt, Staphylococcus aureus subsp. aureus MW2
agugcauuuuuuauuuuacuu

SEQ ID NO: 4024872 - RNA, 12 nt, Staphylococcus aureus subsp. aureus MW2
agugccagguuc

SEQ ID NO: 4024873 - RNA, 16 nt, Staphylococcus aureus subsp. aureus MW2
agugccguccauuucc

SEQ ID NO: 4024874 - RNA, 23 nt, Staphylococcus aureus subsp. aureus MW2
agugcgaauucaacgaaagugau

SEQ ID NO: 4024875 - RNA, 19 nt, Staphylococcus aureus subsp. aureus MW2
agugcgguuauuuauacag

SEQ ID NO: 4024876 - RNA, 22 nt, Staphylococcus aureus subsp. aureus MW2
agugcuaauuuugagacaaaaa

SEQ ID NO: 4024877 - RNA, 15 nt, Staphylococcus aureus subsp. aureus MW2
agugcuucaacuuca

SEQ ID NO: 4024878 - RNA, 19 nt, Staphylococcus aureus subsp. aureus MW2
agugcuucaacuucaucua

SEQ ID NO: 4024879 - RNA, 17 nt, Staphylococcus aureus subsp. aureus MW2
aguggaagacaaugauu

SEQ ID NO: 4024880 - RNA, 14 nt, Staphylococcus aureus subsp. aureus MW2
aguggcauuuaaaa

SEQ ID NO: 4024881 - RNA, 15 nt, Staphylococcus aureus subsp. aureus MW2
aguggccuuuuaaac

SEQ ID NO: 4024882 - RNA, 22 nt, Staphylococcus aureus subsp. aureus MW2
aguggccuuuuaaacaaauaaa

SEQ ID NO: 4024883 - RNA, 15 nt, Staphylococcus aureus subsp. aureus MW2
agugggaaacauuuc

SEQ ID NO: 4024884 - RNA, 20 nt, Staphylococcus aureus subsp. aureus MW2
agugguaaaaaguuuaaagu

SEQ ID NO: 4024885 - RNA, 20 nt, Staphylococcus aureus subsp. aureus MW2
agugguaaaaaugaaccauu

SEQ ID NO: 4024886 - RNA, 20 nt, Staphylococcus aureus subsp. aureus MW2
agugguauuaacuaauaacu

SEQ ID NO: 4024887 - RNA, 17 nt, Staphylococcus aureus subsp. aureus MW2
aguggucguuuauuuua

SEQ ID NO: 4024888 - RNA, 22 nt, Staphylococcus aureus subsp. aureus MW2
agugguuguucccauuuuuaaa

SEQ ID NO: 4024889 - RNA, 21 nt, Staphylococcus aureus subsp. aureus MW2
agugguuuucuuuauuuuaaa

SEQ ID NO: 4024890 - RNA, 13 nt, Staphylococcus aureus subsp. aureus MW2
aguguaccuuguu

SEQ ID NO: 4024891 - RNA, 19 nt, Staphylococcus aureus subsp. aureus MW2
aguguagccaaauaaauuu

SEQ ID NO: 4024892 - RNA, 21 nt, Staphylococcus aureus subsp. aureus MW2
aguguauauaguaggagugaa

SEQ ID NO: 4024893 - RNA, 14 nt, Staphylococcus aureus subsp. aureus MW2
aguguauucauuuu

SEQ ID NO: 4024894 - RNA, 22 nt, Staphylococcus aureus subsp. aureus MW2
agugucacauuauacaauaugu

SEQ ID NO: 4024895 - RNA, 21 nt, Staphylococcus aureus subsp. aureus MW2
agugucaugcuuaauuuaugu

SEQ ID NO: 4024896 - RNA, 17 nt, Staphylococcus aureus subsp. aureus MW2
aguguguaucucuuauu

SEQ ID NO: 4024897 - RNA, 13 nt, Staphylococcus aureus subsp. aureus MW2
aguguuguuuuau

SEQ ID NO: 4024898 - RNA, 19 nt, Staphylococcus aureus subsp. aureus MW2
aguguuucauaaucucuuu

SEQ ID NO: 4024899 - RNA, 15 nt, Staphylococcus aureus subsp. aureus MW2
aguuuuauuuauaaa

SEQ ID NO: 4024900 - RNA, 22 nt, Staphylococcus aureus subsp. aureus MW2
aguuuuauuuauaaacaauaaa

SEQ ID NO: 4024901 - RNA, 21 nt, Staphylococcus aureus subsp. aureus MW2
aguuuucggcuagauuuuaaa

SEQ ID NO: 4024902 - RNA, 19 nt, Staphylococcus aureus subsp. aureus MW2
aguuuuggucaaguaaaug

SEQ ID NO: 4024903 - RNA, 16 nt, Staphylococcus aureus subsp. aureus MW2
aguuuuuaaaauuauc

SEQ ID NO: 4024904 - RNA, 20 nt, Staphylococcus aureus subsp. aureus MW2
aguuuuucaggguuuaagau

SEQ ID NO: 4024905 - RNA, 22 nt, Staphylococcus aureus subsp. aureus MW2
aguuuuuuaaaauaaugauaua

SEQ ID NO: 4024906 - RNA, 13 nt, Staphylococcus aureus subsp. aureus MW2
auaaaaaaagaga

SEQ ID NO: 4024907 - RNA, 18 nt, Staphylococcus aureus subsp. aureus MW2
auaaaaaaaucacgcuaa

SEQ ID NO: 4024908 - RNA, 12 nt, Staphylococcus aureus subsp. aureus MW2
auaaaaaauaac

SEQ ID NO: 4024909 - RNA, 14 nt, Staphylococcus aureus subsp. aureus MW2
auaaaaaaugaaug

SEQ ID NO: 4024910 - RNA, 21 nt, Staphylococcus aureus subsp. aureus MW2
auaaaaaggagcgacaaugga

SEQ ID NO: 4024911 - RNA, 16 nt, Staphylococcus aureus subsp. aureus MW2
auaaaaagugaaagua

SEQ ID NO: 4024912 - RNA, 12 nt, Staphylococcus aureus subsp. aureus MW2
auaaaaauaaaa

SEQ ID NO: 4024913 - RNA, 16 nt, Staphylococcus aureus subsp. aureus MW2
auaaaaauacauaauu

SEQ ID NO: 4024914 - RNA, 13 nt, Staphylococcus aureus subsp. aureus MW2
auaaaaauagaaa

SEQ ID NO: 4024915 - RNA, 19 nt, Staphylococcus aureus subsp. aureus MW2
auaaaaauaggauuguguu

SEQ ID NO: 4024916 - RNA, 18 nt, Staphylococcus aureus subsp. aureus MW2
auaaaaaucuuaugaugu

SEQ ID NO: 4024917 - RNA, 19 nt, Staphylococcus aureus subsp. aureus MW2
auaaaaaucuuaugauguc

SEQ ID NO: 4024918 - RNA, 17 nt, Staphylococcus aureus subsp. aureus MW2
auaaaaaucuuggugau

SEQ ID NO: 4024919 - RNA, 23 nt, Staphylococcus aureus subsp. aureus MW2
auaaaaaugguauucgcaucauu

SEQ ID NO: 4024920 - RNA, 16 nt, Staphylococcus aureus subsp. aureus MW2
auaaaaauguauuaaa

SEQ ID NO: 4024921 - RNA, 17 nt, Staphylococcus aureus subsp. aureus MW2
auaaaaauuauauaaau

SEQ ID NO: 4024922 - RNA, 13 nt, Staphylococcus aureus subsp. aureus MW2
auaaaaauugaau

SEQ ID NO: 4024923 - RNA, 21 nt, Staphylococcus aureus subsp. aureus MW2
auaaaacaaaaccaaaauacu

SEQ ID NO: 4024924 - RNA, 14 nt, Staphylococcus aureus subsp. aureus MW2
auaaaacaaauuau

SEQ ID NO: 4024925 - RNA, 15 nt, Staphylococcus aureus subsp. aureus MW2
auaaaacaucaucgu

SEQ ID NO: 4024926 - RNA, 16 nt, Staphylococcus aureus subsp. aureus MW2
auaaaaccgguacuuu

SEQ ID NO: 4024927 - RNA, 19 nt, Staphylococcus aureus subsp. aureus MW2
auaaaaccgguacuuucau

SEQ ID NO: 4024928 - RNA, 20 nt, Staphylococcus aureus subsp. aureus MW2
auaaaacuuacauuacauau

SEQ ID NO: 4024929 - RNA, 14 nt, Staphylococcus aureus subsp. aureus MW2
auaaaagagaagcu

SEQ ID NO: 4024930 - RNA, 14 nt, Staphylococcus aureus subsp. aureus MW2
auaaaagcaacaaa

SEQ ID NO: 4024931 - RNA, 21 nt, Staphylococcus aureus subsp. aureus MW2
auaaaagcacuauuuuuauaa

SEQ ID NO: 4024932 - RNA, 20 nt, Staphylococcus aureus subsp. aureus MW2
auaaaaggggaaaucauuug

SEQ ID NO: 4024933 - RNA, 16 nt, Staphylococcus aureus subsp. aureus MW2
auaaaaguacuuuaaa

SEQ ID NO: 4024934 - RNA, 21 nt, Staphylococcus aureus subsp. aureus MW2
auaaaaguacuuuaaaauugu

SEQ ID NO: 4024935 - RNA, 17 nt, Staphylococcus aureus subsp. aureus MW2
auaaaaguguaauguuc

SEQ ID NO: 4024936 - RNA, 23 nt, Staphylococcus aureus subsp. aureus MW2
auaaaaguuaccuacuacauucu

SEQ ID NO: 4024937 - RNA, 16 nt, Staphylococcus aureus subsp. aureus MW2
auaaaaguuaggcgac

SEQ ID NO: 4024938 - RNA, 21 nt, Staphylococcus aureus subsp. aureus MW2
auaaaaguuaggcgacuuaac

SEQ ID NO: 4024939 - RNA, 18 nt, Staphylococcus aureus subsp. aureus MW2
auaaaauaaaaaagccac

SEQ ID NO: 4024940 - RNA, 13 nt, Staphylococcus aureus subsp. aureus MW2
auaaaauaaaaug

SEQ ID NO: 4024941 - RNA, 23 nt, Staphylococcus aureus subsp. aureus MW2
auaaaauaccagaugaaccaaaa

SEQ ID NO: 4024942 - RNA, 20 nt, Staphylococcus aureus subsp. aureus MW2
auaaaaucaucuuaacaauu

SEQ ID NO: 4024943 - RNA, 13 nt, Staphylococcus aureus subsp. aureus MW2
auaaaaucauuaa

SEQ ID NO: 4024944 - RNA, 18 nt, Staphylococcus aureus subsp. aureus MW2
auaaaaucauuaauaauu

SEQ ID NO: 4024945 - RNA, 22 nt, Staphylococcus aureus subsp. aureus MW2
auaaaauccuaagcaucguaaa

SEQ ID NO: 4024946 - RNA, 13 nt, Staphylococcus aureus subsp. aureus MW2
auaaaaugcuaca

SEQ ID NO: 4024947 - RNA, 16 nt, Staphylococcus aureus subsp. aureus MW2
auaaaaugcuacaauu

SEQ ID NO: 4024948 - RNA, 13 nt, Staphylococcus aureus subsp. aureus MW2
auaaaauuaaaac

SEQ ID NO: 4024949 - RNA, 19 nt, Staphylococcus aureus subsp. aureus MW2
auaaaauuacgcaaagaaa

SEQ ID NO: 4024950 - RNA, 14 nt, Staphylococcus aureus subsp. aureus MW2
auaaaauucaccaa

SEQ ID NO: 4024951 - RNA, 16 nt, Staphylococcus aureus subsp. aureus MW2
auaaaauuguaauacu

SEQ ID NO: 4024952 - RNA, 19 nt, Staphylococcus aureus subsp. aureus MW2
auaaaauuuaaaacaauga

SEQ ID NO: 4024953 - RNA, 22 nt, Staphylococcus aureus subsp. aureus MW2
auaaaauuucugcuucuuuuaa

SEQ ID NO: 4024954 - RNA, 12 nt, Staphylococcus aureus subsp. aureus MW2
auaaacaauaaa

SEQ ID NO: 4024955 - RNA, 14 nt, Staphylococcus aureus subsp. aureus MW2
auaaacaauaacug

SEQ ID NO: 4024956 - RNA, 19 nt, Staphylococcus aureus subsp. aureus MW2
auaaacaauaacuguucuu

SEQ ID NO: 4024957 - RNA, 13 nt, Staphylococcus aureus subsp. aureus MW2
auaaacauaucau

SEQ ID NO: 4024958 - RNA, 17 nt, Staphylococcus aureus subsp. aureus MW2
auaaacaucuucuucau

SEQ ID NO: 4024959 - RNA, 19 nt, Staphylococcus aureus subsp. aureus MW2
auaaacaucuucuucauca

SEQ ID NO: 4024960 - RNA, 14 nt, Staphylococcus aureus subsp. aureus MW2
auaaaccagcugau

SEQ ID NO: 4024961 - RNA, 19 nt, Staphylococcus aureus subsp. aureus MW2
auaaaccuacaauauagaa

SEQ ID NO: 4024962 - RNA, 20 nt, Staphylococcus aureus subsp. aureus MW2
auaaacgacgcaagugacuu

SEQ ID NO: 4024963 - RNA, 14 nt, Staphylococcus aureus subsp. aureus MW2
auaaacuacacacg

SEQ ID NO: 4024964 - RNA, 18 nt, Staphylococcus aureus subsp. aureus MW2
auaaacuacuaaaaggac

SEQ ID NO: 4024965 - RNA, 16 nt, Staphylococcus aureus subsp. aureus MW2
auaaacuauuaaauca

SEQ ID NO: 4024966 - RNA, 14 nt, Staphylococcus aureus subsp. aureus MW2
auaaacucuuauaa

SEQ ID NO: 4024967 - RNA, 16 nt, Staphylococcus aureus subsp. aureus MW2
auaaacucuuauaagu

SEQ ID NO: 4024968 - RNA, 14 nt, Staphylococcus aureus subsp. aureus MW2
auaaacuuaaaaga

SEQ ID NO: 4024969 - RNA, 15 nt, Staphylococcus aureus subsp. aureus MW2
auaaacuuaaaagag

SEQ ID NO: 4024970 - RNA, 17 nt, Staphylococcus aureus subsp. aureus MW2
auaaacuuaaaagagaa

SEQ ID NO: 4024971 - RNA, 13 nt, Staphylococcus aureus subsp. aureus MW2
auaaagaaugauu

SEQ ID NO: 4024972 - RNA, 22 nt, Staphylococcus aureus subsp. aureus MW2
auaaagaaugauuuauaaaaaa

SEQ ID NO: 4024973 - RNA, 18 nt, Staphylococcus aureus subsp. aureus MW2
auaaagauagaaugaaua

SEQ ID NO: 4024974 - RNA, 17 nt, Staphylococcus aureus subsp. aureus MW2
auaaagauuauaucuuu

SEQ ID NO: 4024975 - RNA, 13 nt, Staphylococcus aureus subsp. aureus MW2
auaaagauucaau

SEQ ID NO: 4024976 - RNA, 14 nt, Staphylococcus aureus subsp. aureus MW2
auaaagauucaauu

SEQ ID NO: 4024977 - RNA, 21 nt, Staphylococcus aureus subsp. aureus MW2
auaaagcugauuuuucauuga

SEQ ID NO: 4024978 - RNA, 15 nt, Staphylococcus aureus subsp. aureus MW2
auaaaggaauagcua

SEQ ID NO: 4024979 - RNA, 18 nt, Staphylococcus aureus subsp. aureus MW2
auaaaggucuauauauau

SEQ ID NO: 4024980 - RNA, 23 nt, Staphylococcus aureus subsp. aureus MW2
auaaaggucuauauauauuuaaa

SEQ ID NO: 4024981 - RNA, 15 nt, Staphylococcus aureus subsp. aureus MW2
auaaagucauauggu

SEQ ID NO: 4024982 - RNA, 16 nt, Staphylococcus aureus subsp. aureus MW2
auaaagucauaugguu

SEQ ID NO: 4024983 - RNA, 17 nt, Staphylococcus aureus subsp. aureus MW2
auaaaguguaaauuuga

SEQ ID NO: 4024984 - RNA, 14 nt, Staphylococcus aureus subsp. aureus MW2
auaaaguugacaau

SEQ ID NO: 4024985 - RNA, 15 nt, Staphylococcus aureus subsp. aureus MW2
auaaaguuuauuuau

SEQ ID NO: 4024986 - RNA, 15 nt, Staphylococcus aureus subsp. aureus MW2
auaaauaaaaauaca

SEQ ID NO: 4024987 - RNA, 22 nt, Staphylococcus aureus subsp. aureus MW2
auaaauaaaaauacauaauuaa

SEQ ID NO: 4024988 - RNA, 19 nt, Staphylococcus aureus subsp. aureus MW2
auaaccauaguaacaaaau

SEQ ID NO: 4024989 - RNA, 13 nt, Staphylococcus aureus subsp. aureus MW2
auaacccuaauuc

SEQ ID NO: 4024990 - RNA, 18 nt, Staphylococcus aureus subsp. aureus MW2
auaacccuaauucuuuaa

SEQ ID NO: 4024991 - RNA, 22 nt, Staphylococcus aureus subsp. aureus MW2
auaacccuaauucuuuaauaaa

SEQ ID NO: 4024992 - RNA, 14 nt, Staphylococcus aureus subsp. aureus MW2
auaaccgaaauauu

SEQ ID NO: 4024993 - RNA, 16 nt, Staphylococcus aureus subsp. aureus MW2
auaaccgcuacaauua

SEQ ID NO: 4024994 - RNA, 20 nt, Staphylococcus aureus subsp. aureus MW2
auaaccuaauucgccaucuu

SEQ ID NO: 4024995 - RNA, 15 nt, Staphylococcus aureus subsp. aureus MW2
auaaccuagguuaaa

SEQ ID NO: 4024996 - RNA, 14 nt, Staphylococcus aureus subsp. aureus MW2
auaaccuguaauug

SEQ ID NO: 4024997 - RNA, 23 nt, Staphylococcus aureus subsp. aureus MW2
auaaccuguuuuuauuuguuuau

SEQ ID NO: 4024998 - RNA, 13 nt, Staphylococcus aureus subsp. aureus MW2
auaaccuuuaaaa

SEQ ID NO: 4024999 - RNA, 15 nt, Staphylococcus aureus subsp. aureus MW2
auaaccuuuaaaaca

SEQ ID NO: 4025000 - RNA, 20 nt, Staphylococcus aureus subsp. aureus MW2
auaacgaagcgggacucauc

SEQ ID NO: 4025001 - RNA, 19 nt, Staphylococcus aureus subsp. aureus MW2
auaacgagcaguauauauc

SEQ ID NO: 4025002 - RNA, 20 nt, Staphylococcus aureus subsp. aureus MW2
auaacgagcaguauauauca

SEQ ID NO: 4025003 - RNA, 18 nt, Staphylococcus aureus subsp. aureus MW2
auaacgauaccuuuaaua

SEQ ID NO: 4025004 - RNA, 15 nt, Staphylococcus aureus subsp. aureus MW2
auaacgcacugcauu

SEQ ID NO: 4025005 - RNA, 14 nt, Staphylococcus aureus subsp. aureus MW2
auaacgcuuuaaau

SEQ ID NO: 4025006 - RNA, 18 nt, Staphylococcus aureus subsp. aureus MW2
auaacgcuuuaaaucauu

SEQ ID NO: 4025007 - RNA, 24 nt, Staphylococcus aureus subsp. aureus MW2
auaacgucacaacggcauaauaca

SEQ ID NO: 4025008 - RNA, 16 nt, Staphylococcus aureus subsp. aureus MW2
auaacgucauauguuu

SEQ ID NO: 4025009 - RNA, 14 nt, Staphylococcus aureus subsp. aureus MW2
auaacgugcuuuuu

SEQ ID NO: 4025010 - RNA, 19 nt, Staphylococcus aureus subsp. aureus MW2
auaacguuaauauaauuaa

SEQ ID NO: 4025011 - RNA, 19 nt, Staphylococcus aureus subsp. aureus MW2
auaacguucgccaacuaaa

SEQ ID NO: 4025012 - RNA, 17 nt, Staphylococcus aureus subsp. aureus MW2
auaacuaagauauuuag

SEQ ID NO: 4025013 - RNA, 22 nt, Staphylococcus aureus subsp. aureus MW2
auaacuaagugaauuaucuaua

SEQ ID NO: 4025014 - RNA, 13 nt, Staphylococcus aureus subsp. aureus MW2
auaacuacacuua

SEQ ID NO: 4025015 - RNA, 15 nt, Staphylococcus aureus subsp. aureus MW2
auaacuacacuuaau

SEQ ID NO: 4025016 - RNA, 17 nt, Staphylococcus aureus subsp. aureus MW2
auaacuauuuaauuauu

SEQ ID NO: 4025017 - RNA, 15 nt, Staphylococcus aureus subsp. aureus MW2
auaacucaaauaucu

SEQ ID NO: 4025018 - RNA, 17 nt, Staphylococcus aureus subsp. aureus MW2
auaacucaguaaauuua

SEQ ID NO: 4025019 - RNA, 22 nt, Staphylococcus aureus subsp. aureus MW2
auaacucaguaaauuuauuauu

SEQ ID NO: 4025020 - RNA, 15 nt, Staphylococcus aureus subsp. aureus MW2
auaacucuaaauaua

SEQ ID NO: 4025021 - RNA, 16 nt, Staphylococcus aureus subsp. aureus MW2
auaacucuaaauauaa

SEQ ID NO: 4025022 - RNA, 14 nt, Staphylococcus aureus subsp. aureus MW2
auaacucuucuaag

SEQ ID NO: 4025023 - RNA, 15 nt, Staphylococcus aureus subsp. aureus MW2
auaacucuucuaagu

SEQ ID NO: 4025024 - RNA, 19 nt, Staphylococcus aureus subsp. aureus MW2
auaacucuucuaaguuauu

SEQ ID NO: 4025025 - RNA, 15 nt, Staphylococcus aureus subsp. aureus MW2
auaacuguaaaacau

SEQ ID NO: 4025026 - RNA, 22 nt, Staphylococcus aureus subsp. aureus MW2
auaacuguauaccucuuagcac

SEQ ID NO: 4025027 - RNA, 19 nt, Staphylococcus aureus subsp. aureus MW2
auaacuguuuaucaugaug

SEQ ID NO: 4025028 - RNA, 15 nt, Staphylococcus aureus subsp. aureus MW2
auaacuucguuuuaa

SEQ ID NO: 4025029 - RNA, 15 nt, Staphylococcus aureus subsp. aureus MW2
auaacuugauauuau

SEQ ID NO: 4025030 - RNA, 21 nt, Staphylococcus aureus subsp. aureus MW2
auaacuugauauuauauaaaa

SEQ ID NO: 4025031 - RNA, 13 nt, Staphylococcus aureus subsp. aureus MW2
auaacuuguaaua

SEQ ID NO: 4025032 - RNA, 16 nt, Staphylococcus aureus subsp. aureus MW2
auaacuuuaaaaauua

SEQ ID NO: 4025033 - RNA, 22 nt, Staphylococcus aureus subsp. aureus MW2
auaacuuuuuaaaggaccacuu

SEQ ID NO: 4025034 - RNA, 24 nt, Staphylococcus aureus subsp. aureus MW2
auaagaaaaagacggauaauuaau

SEQ ID NO: 4025035 - RNA, 15 nt, Staphylococcus aureus subsp. aureus MW2
auaagaaaauaccua

SEQ ID NO: 4025036 - RNA, 14 nt, Staphylococcus aureus subsp. aureus MW2
auaagaaaauacua

SEQ ID NO: 4025037 - RNA, 18 nt, Staphylococcus aureus subsp. aureus MW2
auaagaagguguuugauu

SEQ ID NO: 4025038 - RNA, 19 nt, Staphylococcus aureus subsp. aureus MW2
auaagaagguguuugauuu

SEQ ID NO: 4025039 - RNA, 11 nt, Staphylococcus aureus subsp. aureus MW2
auaagaaucag

SEQ ID NO: 4025040 - RNA, 17 nt, Staphylococcus aureus subsp. aureus MW2
auaagaaucaucuaaau

SEQ ID NO: 4025041 - RNA, 20 nt, Staphylococcus aureus subsp. aureus MW2
auaagaauuaacaacaaaua

SEQ ID NO: 4025042 - RNA, 15 nt, Staphylococcus aureus subsp. aureus MW2
auaagaauuguugau

SEQ ID NO: 4025043 - RNA, 15 nt, Staphylococcus aureus subsp. aureus MW2
auaagaauuuaaaag

SEQ ID NO: 4025044 - RNA, 17 nt, Staphylococcus aureus subsp. aureus MW2
auaagaauuuaaaaggg

SEQ ID NO: 4025045 - RNA, 21 nt, Staphylococcus aureus subsp. aureus MW2
auaagacuucccuauauguag

SEQ ID NO: 4025046 - RNA, 14 nt, Staphylococcus aureus subsp. aureus MW2
auaagauuuugcuu

SEQ ID NO: 4025047 - RNA, 12 nt, Staphylococcus aureus subsp. aureus MW2
auaagcaaagac

SEQ ID NO: 4025048 - RNA, 19 nt, Staphylococcus aureus subsp. aureus MW2
auaagcaaagacaaaagca

SEQ ID NO: 4025049 - RNA, 17 nt, Staphylococcus aureus subsp. aureus MW2
auaagcaaagaugauac

SEQ ID NO: 4025050 - RNA, 18 nt, Staphylococcus aureus subsp. aureus MW2
auaagcaugauaaaaaua

SEQ ID NO: 4025051 - RNA, 16 nt, Staphylococcus aureus subsp. aureus MW2
auaagccuuuucaaac

SEQ ID NO: 4025052 - RNA, 17 nt, Staphylococcus aureus subsp. aureus MW2
auaagccuuuucaaaca

SEQ ID NO: 4025053 - RNA, 14 nt, Staphylococcus aureus subsp. aureus MW2
auaagcuaauauuu

SEQ ID NO: 4025054 - RNA, 23 nt, Staphylococcus aureus subsp. aureus MW2
auaagcuaauauuuauuuuaaau

SEQ ID NO: 4025055 - RNA, 17 nt, Staphylococcus aureus subsp. aureus MW2
auaaggaagcguaugau

SEQ ID NO: 4025056 - RNA, 18 nt, Staphylococcus aureus subsp. aureus MW2
auaaggaauguauuuuuc

SEQ ID NO: 4025057 - RNA, 19 nt, Staphylococcus aureus subsp. aureus MW2
auaaggaauguauuuuuca

SEQ ID NO: 4025058 - RNA, 22 nt, Staphylococcus aureus subsp. aureus MW2
auaaggaugauuuauuaacuca

SEQ ID NO: 4025059 - RNA, 21 nt, Staphylococcus aureus subsp. aureus MW2
auaaggaugucgauuugauuu

SEQ ID NO: 4025060 - RNA, 16 nt, Staphylococcus aureus subsp. aureus MW2
auaagguacauaaaua

SEQ ID NO: 4025061 - RNA, 21 nt, Staphylococcus aureus subsp. aureus MW2
auaaguaagcguaauauuuaa

SEQ ID NO: 4025062 - RNA, 16 nt, Staphylococcus aureus subsp. aureus MW2
auaaguaauaauauaa

SEQ ID NO: 4025063 - RNA, 17 nt, Staphylococcus aureus subsp. aureus MW2
auaaguaauaauuuauu

SEQ ID NO: 4025064 - RNA, 14 nt, Staphylococcus aureus subsp. aureus MW2
auaaguacaaauaa

SEQ ID NO: 4025065 - RNA, 13 nt, Staphylococcus aureus subsp. aureus MW2
auaaguaguucaa

SEQ ID NO: 4025066 - RNA, 21 nt, Staphylococcus aureus subsp. aureus MW2
auaaguaguucaauaaauuuu

SEQ ID NO: 4025067 - RNA, 20 nt, Staphylococcus aureus subsp. aureus MW2
auaaguauggucgugagccc

SEQ ID NO: 4025068 - RNA, 13 nt, Staphylococcus aureus subsp. aureus MW2
auaaguauuuuuu

SEQ ID NO: 4025069 - RNA, 17 nt, Staphylococcus aureus subsp. aureus MW2
auaagucuauuauguac

SEQ ID NO: 4025070 - RNA, 13 nt, Staphylococcus aureus subsp. aureus MW2
auaagugauaaau

SEQ ID NO: 4025071 - RNA, 17 nt, Staphylococcus aureus subsp. aureus MW2
auaaguuaaaaauguaa

SEQ ID NO: 4025072 - RNA, 13 nt, Staphylococcus aureus subsp. aureus MW2
auaaguuaaaauu

SEQ ID NO: 4025073 - RNA, 16 nt, Staphylococcus aureus subsp. aureus MW2
auaaguuaauguaauc

SEQ ID NO: 4025074 - RNA, 17 nt, Staphylococcus aureus subsp. aureus MW2
auaaguuacuagcauua

SEQ ID NO: 4025075 - RNA, 17 nt, Staphylococcus aureus subsp. aureus MW2
auaaguugcauauaaaa

SEQ ID NO: 4025076 - RNA, 19 nt, Staphylococcus aureus subsp. aureus MW2
auaaguuuuugaauaucua

SEQ ID NO: 4025077 - RNA, 14 nt, Staphylococcus aureus subsp. aureus MW2
auaauuaaguguau

SEQ ID NO: 4025078 - RNA, 13 nt, Staphylococcus aureus subsp. aureus MW2
auaauuaauaaca

SEQ ID NO: 4025079 - RNA, 23 nt, Staphylococcus aureus subsp. aureus MW2
auaauuaauccgucuuuuuuuau

SEQ ID NO: 4025080 - RNA, 18 nt, Staphylococcus aureus subsp. aureus MW2
auaauuaauuaaaagccc

SEQ ID NO: 4025081 - RNA, 21 nt, Staphylococcus aureus subsp. aureus MW2
auaauuaccuuuccauucgua

SEQ ID NO: 4025082 - RNA, 23 nt, Staphylococcus aureus subsp. aureus MW2
auaauuaccuuuccauucguaua

SEQ ID NO: 4025083 - RNA, 13 nt, Staphylococcus aureus subsp. aureus MW2
auaauuacuaaaa

SEQ ID NO: 4025084 - RNA, 15 nt, Staphylococcus aureus subsp. aureus MW2
auaauuacuaaaaua

SEQ ID NO: 4025085 - RNA, 16 nt, Staphylococcus aureus subsp. aureus MW2
auaauuacuaaccuaa

SEQ ID NO: 4025086 - RNA, 15 nt, Staphylococcus aureus subsp. aureus MW2
auaauuagauuuaaa

SEQ ID NO: 4025087 - RNA, 15 nt, Staphylococcus aureus subsp. aureus MW2
auaauucagaugaau

SEQ ID NO: 4025088 - RNA, 21 nt, Staphylococcus aureus subsp. aureus MW2
auaauucaguguuacuauaca

SEQ ID NO: 4025089 - RNA, 14 nt, Staphylococcus aureus subsp. aureus MW2
auaauucauaaaug

SEQ ID NO: 4025090 - RNA, 16 nt, Staphylococcus aureus subsp. aureus MW2
auaauuccaguauuaa

SEQ ID NO: 4025091 - RNA, 17 nt, Staphylococcus aureus subsp. aureus MW2
auaauuccugaaacaau

SEQ ID NO: 4025092 - RNA, 14 nt, Staphylococcus aureus subsp. aureus MW2
auaauugaaaaucu

SEQ ID NO: 4025093 - RNA, 16 nt, Staphylococcus aureus subsp. aureus MW2
auaauugaaaaucuaa

SEQ ID NO: 4025094 - RNA, 19 nt, Staphylococcus aureus subsp. aureus MW2
auaauugagaaaaagguua

SEQ ID NO: 4025095 - RNA, 13 nt, Staphylococcus aureus subsp. aureus MW2
auaauugcauuac

SEQ ID NO: 4025096 - RNA, 17 nt, Staphylococcus aureus subsp. aureus MW2
auaauugcugucacuaa

SEQ ID NO: 4025097 - RNA, 18 nt, Staphylococcus aureus subsp. aureus MW2
auaauuggaaucaucuuu

SEQ ID NO: 4025098 - RNA, 19 nt, Staphylococcus aureus subsp. aureus MW2
auaauuggcugaugaacuu

SEQ ID NO: 4025099 - RNA, 19 nt, Staphylococcus aureus subsp. aureus MW2
auaauuguccaugccuuau

SEQ ID NO: 4025100 - RNA, 14 nt, Staphylococcus aureus subsp. aureus MW2
auaauuguugcauu

SEQ ID NO: 4025101 - RNA, 15 nt, Staphylococcus aureus subsp. aureus MW2
auaauuguugcauua

SEQ ID NO: 4025102 - RNA, 16 nt, Staphylococcus aureus subsp. aureus MW2
auaauuuaaauuaaaa

SEQ ID NO: 4025103 - RNA, 15 nt, Staphylococcus aureus subsp. aureus MW2
auaauuuaauaaugu

SEQ ID NO: 4025104 - RNA, 12 nt, Staphylococcus aureus subsp. aureus MW2
auaauuuaauuu

SEQ ID NO: 4025105 - RNA, 15 nt, Staphylococcus aureus subsp. aureus MW2
auaauuuagaagauu

SEQ ID NO: 4025106 - RNA, 23 nt, Staphylococcus aureus subsp. aureus MW2
auaauuuaggagucuggaacaau

SEQ ID NO: 4025107 - RNA, 22 nt, Staphylococcus aureus subsp. aureus MW2
auaauuuauuuagcaucuuuac

SEQ ID NO: 4025108 - RNA, 15 nt, Staphylococcus aureus subsp. aureus MW2
auaauuucaauuugg

SEQ ID NO: 4025109 - RNA, 13 nt, Staphylococcus aureus subsp. aureus MW2
auaauuucaguag

SEQ ID NO: 4025110 - RNA, 15 nt, Staphylococcus aureus subsp. aureus MW2
auaauuucuaaaucu

SEQ ID NO: 4025111 - RNA, 16 nt, Staphylococcus aureus subsp. aureus MW2
auaauuucuaaaucua

SEQ ID NO: 4025112 - RNA, 15 nt, Staphylococcus aureus subsp. aureus MW2
auaauuuguauuaua

SEQ ID NO: 4025113 - RNA, 16 nt, Staphylococcus aureus subsp. aureus MW2
auaauuuuaauauuau

SEQ ID NO: 4025114 - RNA, 20 nt, Staphylococcus aureus subsp. aureus MW2
auaauuuuccaucuauccga

SEQ ID NO: 4025115 - RNA, 20 nt, Staphylococcus aureus subsp. aureus MW2
auaauuuucuguccaaaaag

SEQ ID NO: 4025116 - RNA, 14 nt, Staphylococcus aureus subsp. aureus MW2
auaauuuuggauuu

SEQ ID NO: 4025117 - RNA, 21 nt, Staphylococcus aureus subsp. aureus MW2
auaauuuuucuucuuuuuuau

SEQ ID NO: 4025118 - RNA, 17 nt, Staphylococcus aureus subsp. aureus MW2
auaauuuuuugacacgu

SEQ ID NO: 4025119 - RNA, 22 nt, Staphylococcus aureus subsp. aureus MW2
auacaaaacauuacguaucuuu

SEQ ID NO: 4025120 - RNA, 21 nt, Staphylococcus aureus subsp. aureus MW2
auacaaaagaggcgccacaac

SEQ ID NO: 4025121 - RNA, 20 nt, Staphylococcus aureus subsp. aureus MW2
auacaaacacccacaauugu

SEQ ID NO: 4025122 - RNA, 19 nt, Staphylococcus aureus subsp. aureus MW2
auacaaacccauauaaaug

SEQ ID NO: 4025123 - RNA, 22 nt, Staphylococcus aureus subsp. aureus MW2
auacaaaccuaucaucaaucgu

SEQ ID NO: 4025124 - RNA, 12 nt, Staphylococcus aureus subsp. aureus MW2
auacaaauugau

SEQ ID NO: 4025125 - RNA, 14 nt, Staphylococcus aureus subsp. aureus MW2
auacaaauuuauau

SEQ ID NO: 4025126 - RNA, 18 nt, Staphylococcus aureus subsp. aureus MW2
auacaaauuuauauuaaa

SEQ ID NO: 4025127 - RNA, 22 nt, Staphylococcus aureus subsp. aureus MW2
auacaaauuuauauuaaauaaa

SEQ ID NO: 4025128 - RNA, 13 nt, Staphylococcus aureus subsp. aureus MW2
auacaaauuuuuu

SEQ ID NO: 4025129 - RNA, 22 nt, Staphylococcus aureus subsp. aureus MW2
auacaaggcauauccgaaaauu

SEQ ID NO: 4025130 - RNA, 16 nt, Staphylococcus aureus subsp. aureus MW2
auacaauaaugugcaa

SEQ ID NO: 4025131 - RNA, 13 nt, Staphylococcus aureus subsp. aureus MW2
auacaauauguga

SEQ ID NO: 4025132 - RNA, 22 nt, Staphylococcus aureus subsp. aureus MW2
auacaauaugugauaaauagaa

SEQ ID NO: 4025133 - RNA, 21 nt, Staphylococcus aureus subsp. aureus MW2
auacaauuauggauaaaauuu

SEQ ID NO: 4025134 - RNA, 22 nt, Staphylococcus aureus subsp. aureus MW2
auacaauuauggauaaaauuua

SEQ ID NO: 4025135 - RNA, 21 nt, Staphylococcus aureus subsp. aureus MW2
auacaauuucuucauuuucau

SEQ ID NO: 4025136 - RNA, 13 nt, Staphylococcus aureus subsp. aureus MW2
auacaauuuuacc

SEQ ID NO: 4025137 - RNA, 12 nt, Staphylococcus aureus subsp. aureus MW2
auacaauuuuuu

SEQ ID NO: 4025138 - RNA, 13 nt, Staphylococcus aureus subsp. aureus MW2
auacacaaauuuu

SEQ ID NO: 4025139 - RNA, 22 nt, Staphylococcus aureus subsp. aureus MW2
auacacaacgauagauaucauu

SEQ ID NO: 4025140 - RNA, 23 nt, Staphylococcus aureus subsp. aureus MW2
auacacaaugauuauaaauacau

SEQ ID NO: 4025141 - RNA, 15 nt, Staphylococcus aureus subsp. aureus MW2
auacaccuucagaug

SEQ ID NO: 4025142 - RNA, 20 nt, Staphylococcus aureus subsp. aureus MW2
auacacguaacgcaguugaa

SEQ ID NO: 4025143 - RNA, 16 nt, Staphylococcus aureus subsp. aureus MW2
auacacguacaaaaua

SEQ ID NO: 4025144 - RNA, 17 nt, Staphylococcus aureus subsp. aureus MW2
auacacguacaaaauaa

SEQ ID NO: 4025145 - RNA, 22 nt, Staphylococcus aureus subsp. aureus MW2
auacacuaucauuaucaaauaa

SEQ ID NO: 4025146 - RNA, 23 nt, Staphylococcus aureus subsp. aureus MW2
auacacuaucauuaucaaauaac

SEQ ID NO: 4025147 - RNA, 22 nt, Staphylococcus aureus subsp. aureus MW2
auacacugcacaucauaauaaa

SEQ ID NO: 4025148 - RNA, 15 nt, Staphylococcus aureus subsp. aureus MW2
auacacuuacaaaua

SEQ ID NO: 4025149 - RNA, 16 nt, Staphylococcus aureus subsp. aureus MW2
auacacuuacaaauau

SEQ ID NO: 4025150 - RNA, 14 nt, Staphylococcus aureus subsp. aureus MW2
auacacuugcuaaa

SEQ ID NO: 4025151 - RNA, 18 nt, Staphylococcus aureus subsp. aureus MW2
auacacuugcuaaaacua

SEQ ID NO: 4025152 - RNA, 18 nt, Staphylococcus aureus subsp. aureus MW2
auacacuuuuugacauau

SEQ ID NO: 4025153 - RNA, 18 nt, Staphylococcus aureus subsp. aureus MW2
auacagaaccaacaauaa

SEQ ID NO: 4025154 - RNA, 22 nt, Staphylococcus aureus subsp. aureus MW2
auacagaaccaacaauaaaucu

SEQ ID NO: 4025155 - RNA, 19 nt, Staphylococcus aureus subsp. aureus MW2
auacagaucucaauccaau

SEQ ID NO: 4025156 - RNA, 15 nt, Staphylococcus aureus subsp. aureus MW2
auacaggaaauugaa

SEQ ID NO: 4025157 - RNA, 22 nt, Staphylococcus aureus subsp. aureus MW2
auacaguuaucaccgcauuaaa

SEQ ID NO: 4025158 - RNA, 20 nt, Staphylococcus aureus subsp. aureus MW2
auacauaacgucccauaaua

SEQ ID NO: 4025159 - RNA, 23 nt, Staphylococcus aureus subsp. aureus MW2
auacauaacgucccauaauagcu

SEQ ID NO: 4025160 - RNA, 22 nt, Staphylococcus aureus subsp. aureus MW2
auacauagguucaucuuuaugc

SEQ ID NO: 4025161 - RNA, 14 nt, Staphylococcus aureus subsp. aureus MW2
auacauauaagaau

SEQ ID NO: 4025162 - RNA, 18 nt, Staphylococcus aureus subsp. aureus MW2
auacauaugcuauaucca

SEQ ID NO: 4025163 - RNA, 14 nt, Staphylococcus aureus subsp. aureus MW2
auacauauuuauau

SEQ ID NO: 4025164 - RNA, 13 nt, Staphylococcus aureus subsp. aureus MW2
auacaucaauauc

SEQ ID NO: 4025165 - RNA, 16 nt, Staphylococcus aureus subsp. aureus MW2
auacuucuuuagcaaa

SEQ ID NO: 4025166 - RNA, 21 nt, Staphylococcus aureus subsp. aureus MW2
auacuucuuuagcaaaacgca

SEQ ID NO: 4025167 - RNA, 17 nt, Staphylococcus aureus subsp. aureus MW2
auacuugaagcaucgau

SEQ ID NO: 4025168 - RNA, 21 nt, Staphylococcus aureus subsp. aureus MW2
auacuugaagcaucgauuuau

SEQ ID NO: 4025169 - RNA, 21 nt, Staphylococcus aureus subsp. aureus MW2
auacuugagcaaguuauauca

SEQ ID NO: 4025170 - RNA, 23 nt, Staphylococcus aureus subsp. aureus MW2
auacuugagcaaguuauaucaua

SEQ ID NO: 4025171 - RNA, 18 nt, Staphylococcus aureus subsp. aureus MW2
auacuuuaucuauuucua

SEQ ID NO: 4025172 - RNA, 12 nt, Staphylococcus aureus subsp. aureus MW2
auacuuuucuuc

SEQ ID NO: 4025173 - RNA, 18 nt, Staphylococcus aureus subsp. aureus MW2
auacuuuuggucuguuga

SEQ ID NO: 4025174 - RNA, 22 nt, Staphylococcus aureus subsp. aureus MW2
auacuuuuggucuguugaaguc

SEQ ID NO: 4025175 - RNA, 14 nt, Staphylococcus aureus subsp. aureus MW2
auacuuuuuauaua

SEQ ID NO: 4025176 - RNA, 18 nt, Staphylococcus aureus subsp. aureus MW2
auagaaaaauuucaaaaa

SEQ ID NO: 4025177 - RNA, 20 nt, Staphylococcus aureus subsp. aureus MW2
auagaaaaugaguacaacau

SEQ ID NO: 4025178 - RNA, 14 nt, Staphylococcus aureus subsp. aureus MW2
auagaaaauuaacu

SEQ ID NO: 4025179 - RNA, 16 nt, Staphylococcus aureus subsp. aureus MW2
auagaaauaaucacau

SEQ ID NO: 4025180 - RNA, 16 nt, Staphylococcus aureus subsp. aureus MW2
auagaaauaauuuaaa

SEQ ID NO: 4025181 - RNA, 14 nt, Staphylococcus aureus subsp. aureus MW2
auagaacaaaaugu

SEQ ID NO: 4025182 - RNA, 23 nt, Staphylococcus aureus subsp. aureus MW2
auagaaccuauuuuuuauaugau

SEQ ID NO: 4025183 - RNA, 12 nt, Staphylococcus aureus subsp. aureus MW2
auagaaggggac

SEQ ID NO: 4025184 - RNA, 20 nt, Staphylococcus aureus subsp. aureus MW2
auagaagguuauuuuuuaug

SEQ ID NO: 4025185 - RNA, 14 nt, Staphylococcus aureus subsp. aureus MW2
auagaaguuuuuug

SEQ ID NO: 4025186 - RNA, 18 nt, Staphylococcus aureus subsp. aureus MW2
auagaaguuuuuugauua

SEQ ID NO: 4025187 - RNA, 16 nt, Staphylococcus aureus subsp. aureus MW2
auagaauaccaauugg

SEQ ID NO: 4025188 - RNA, 14 nt, Staphylococcus aureus subsp. aureus MW2
auagaauacuaaaa

SEQ ID NO: 4025189 - RNA, 15 nt, Staphylococcus aureus subsp. aureus MW2
auagaaugaauaauu

SEQ ID NO: 4025190 - RNA, 19 nt, Staphylococcus aureus subsp. aureus MW2
auagaaugauuaaaauuaa

SEQ ID NO: 4025191 - RNA, 13 nt, Staphylococcus aureus subsp. aureus MW2
auagaccuaugaa

SEQ ID NO: 4025192 - RNA, 22 nt, Staphylococcus aureus subsp. aureus MW2
auagacuaauuaucuucaucau

SEQ ID NO: 4025193 - RNA, 22 nt, Staphylococcus aureus subsp. aureus MW2
auagacuuucuugaugaauuaa

SEQ ID NO: 4025194 - RNA, 14 nt, Staphylococcus aureus subsp. aureus MW2
auagagaacagcag

SEQ ID NO: 4025195 - RNA, 14 nt, Staphylococcus aureus subsp. aureus MW2
auagagacauuuua

SEQ ID NO: 4025196 - RNA, 23 nt, Staphylococcus aureus subsp. aureus MW2
auagagccgugaaagaaaaaacu

SEQ ID NO: 4025197 - RNA, 19 nt, Staphylococcus aureus subsp. aureus MW2
auagauagaaauugugcuu

SEQ ID NO: 4025198 - RNA, 22 nt, Staphylococcus aureus subsp. aureus MW2
auagaugacuguagaaaacaug

SEQ ID NO: 4025199 - RNA, 15 nt, Staphylococcus aureus subsp. aureus MW2
auagauuauauuauc

SEQ ID NO: 4025200 - RNA, 17 nt, Staphylococcus aureus subsp. aureus MW2
auagauuauauuaucau

SEQ ID NO: 4025201 - RNA, 13 nt, Staphylococcus aureus subsp. aureus MW2
auagauugaaaaa

SEQ ID NO: 4025202 - RNA, 12 nt, Staphylococcus aureus subsp. aureus MW2
auagauuuuaau

SEQ ID NO: 4025203 - RNA, 15 nt, Staphylococcus aureus subsp. aureus MW2
auagauuuuaauaaa

SEQ ID NO: 4025204 - RNA, 20 nt, Staphylococcus aureus subsp. aureus MW2
auagauuuuuucauagcuuu

SEQ ID NO: 4025205 - RNA, 21 nt, Staphylococcus aureus subsp. aureus MW2
auagcaaaauuauguaaaaaa

SEQ ID NO: 4025206 - RNA, 21 nt, Staphylococcus aureus subsp. aureus MW2
auagcaaauugauuaaauaaa

SEQ ID NO: 4025207 - RNA, 18 nt, Staphylococcus aureus subsp. aureus MW2
auagcaaccauauuuuua

SEQ ID NO: 4025208 - RNA, 17 nt, Staphylococcus aureus subsp. aureus MW2
auagcaaugaauuaaua

SEQ ID NO: 4025209 - RNA, 21 nt, Staphylococcus aureus subsp. aureus MW2
auagcaccguaacauauguac

SEQ ID NO: 4025210 - RNA, 19 nt, Staphylococcus aureus subsp. aureus MW2
auagcauaaaauuucugcu

SEQ ID NO: 4025211 - RNA, 13 nt, Staphylococcus aureus subsp. aureus MW2
auagcauuucuuu

SEQ ID NO: 4025212 - RNA, 22 nt, Staphylococcus aureus subsp. aureus MW2
auagcauuucuuuauuagaaug

SEQ ID NO: 4025213 - RNA, 22 nt, Staphylococcus aureus subsp. aureus MW2
auagcccuuuauacaauuuuuu

SEQ ID NO: 4025214 - RNA, 17 nt, Staphylococcus aureus subsp. aureus MW2
auagccgccuuuuaaca

SEQ ID NO: 4025215 - RNA, 14 nt, Staphylococcus aureus subsp. aureus MW2
auagccuucauuug

SEQ ID NO: 4025216 - RNA, 22 nt, Staphylococcus aureus subsp. aureus MW2
auagcgauuuuaaagaaaaguu

SEQ ID NO: 4025217 - RNA, 15 nt, Staphylococcus aureus subsp. aureus MW2
auagcuaaacauuuu

SEQ ID NO: 4025218 - RNA, 13 nt, Staphylococcus aureus subsp. aureus MW2
auagcuaaauaaa

SEQ ID NO: 4025219 - RNA, 20 nt, Staphylococcus aureus subsp. aureus MW2
auagcuaaauaaauuagagc

SEQ ID NO: 4025220 - RNA, 14 nt, Staphylococcus aureus subsp. aureus MW2
auagcuacaauuaa

SEQ ID NO: 4025221 - RNA, 18 nt, Staphylococcus aureus subsp. aureus MW2
auagcuagcaaucccauu

SEQ ID NO: 4025222 - RNA, 18 nt, Staphylococcus aureus subsp. aureus MW2
auagcuauuacuauaaaa

SEQ ID NO: 4025223 - RNA, 16 nt, Staphylococcus aureus subsp. aureus MW2
auagcucuauggcuuc

SEQ ID NO: 4025224 - RNA, 21 nt, Staphylococcus aureus subsp. aureus MW2
auagcucuucuuuuucuugca

SEQ ID NO: 4025225 - RNA, 20 nt, Staphylococcus aureus subsp. aureus MW2
auagcugugauuugaucaac

SEQ ID NO: 4025226 - RNA, 22 nt, Staphylococcus aureus subsp. aureus MW2
auagcuuucguuucuuuuauau

SEQ ID NO: 4025227 - RNA, 14 nt, Staphylococcus aureus subsp. aureus MW2
auaggaaacuuaaa

SEQ ID NO: 4025228 - RNA, 17 nt, Staphylococcus aureus subsp. aureus MW2
auaggaaacuuaaauau

SEQ ID NO: 4025229 - RNA, 14 nt, Staphylococcus aureus subsp. aureus MW2
auaggaaucuuguu

SEQ ID NO: 4025230 - RNA, 16 nt, Staphylococcus aureus subsp. aureus MW2
auaggauuuccuauua

SEQ ID NO: 4025231 - RNA, 19 nt, Staphylococcus aureus subsp. aureus MW2
auagguaaccuuaaauaua

SEQ ID NO: 4025232 - RNA, 14 nt, Staphylococcus aureus subsp. aureus MW2
auagguauaagaau

SEQ ID NO: 4025233 - RNA, 15 nt, Staphylococcus aureus subsp. aureus MW2
auagguauaaucauu

SEQ ID NO: 4025234 - RNA, 13 nt, Staphylococcus aureus subsp. aureus MW2
auagguaucuuaa

SEQ ID NO: 4025235 - RNA, 17 nt, Staphylococcus aureus subsp. aureus MW2
auaggugauuauauaua

SEQ ID NO: 4025236 - RNA, 12 nt, Staphylococcus aureus subsp. aureus MW2
auaguaaaauaa

SEQ ID NO: 4025237 - RNA, 19 nt, Staphylococcus aureus subsp. aureus MW2
auaguaaaauaaauacaau

SEQ ID NO: 4025238 - RNA, 17 nt, Staphylococcus aureus subsp. aureus MW2
auaguaaagugaaauaa

SEQ ID NO: 4025239 - RNA, 20 nt, Staphylococcus aureus subsp. aureus MW2
auaguaacgucugguuuaau

SEQ ID NO: 4025240 - RNA, 12 nt, Staphylococcus aureus subsp. aureus MW2
auaguaagaaaa

SEQ ID NO: 4025241 - RNA, 13 nt, Staphylococcus aureus subsp. aureus MW2
auaguaagaaaag

SEQ ID NO: 4025242 - RNA, 18 nt, Staphylococcus aureus subsp. aureus MW2
auaguaagguuugaacuc

SEQ ID NO: 4025243 - RNA, 16 nt, Staphylococcus aureus subsp. aureus MW2
auaguaauaaaagucg

SEQ ID NO: 4025244 - RNA, 19 nt, Staphylococcus aureus subsp. aureus MW2
auaguacauuuauuuucaa

SEQ ID NO: 4025245 - RNA, 19 nt, Staphylococcus aureus subsp. aureus MW2
auaguaccaagcuucauua

SEQ ID NO: 4025246 - RNA, 15 nt, Staphylococcus aureus subsp. aureus MW2
auaguaccaugcucu

SEQ ID NO: 4025247 - RNA, 19 nt, Staphylococcus aureus subsp. aureus MW2
auaguaggguauugaaaua

SEQ ID NO: 4025248 - RNA, 20 nt, Staphylococcus aureus subsp. aureus MW2
auagucauaacgauuguugc

SEQ ID NO: 4025249 - RNA, 20 nt, Staphylococcus aureus subsp. aureus MW2
auaguccgcguguacuuuac

SEQ ID NO: 4025250 - RNA, 22 nt, Staphylococcus aureus subsp. aureus MW2
auaguccgcguguacuuuacca

SEQ ID NO: 4025251 - RNA, 14 nt, Staphylococcus aureus subsp. aureus MW2
auagucggggcccc

SEQ ID NO: 4025252 - RNA, 23 nt, Staphylococcus aureus subsp. aureus MW2
auagucggggccccaacacagag

SEQ ID NO: 4025253 - RNA, 22 nt, Staphylococcus aureus subsp. aureus MW2
auauauuacuaaccuauuaaaa

SEQ ID NO: 4025254 - RNA, 18 nt, Staphylococcus aureus subsp. aureus MW2
auauauuaggucauguua

SEQ ID NO: 4025255 - RNA, 14 nt, Staphylococcus aureus subsp. aureus MW2
auauauuauaaaaa

SEQ ID NO: 4025256 - RNA, 18 nt, Staphylococcus aureus subsp. aureus MW2
auauauucguuacaaaug

SEQ ID NO: 4025257 - RNA, 13 nt, Staphylococcus aureus subsp. aureus MW2
auauauuuaaacu

SEQ ID NO: 4025258 - RNA, 16 nt, Staphylococcus aureus subsp. aureus MW2
auauauuuaaaucaau

SEQ ID NO: 4025259 - RNA, 12 nt, Staphylococcus aureus subsp. aureus MW2
auauauuuuguu

SEQ ID NO: 4025260 - RNA, 13 nt, Staphylococcus aureus subsp. aureus MW2
auaucaaauacau

SEQ ID NO: 4025261 - RNA, 21 nt, Staphylococcus aureus subsp. aureus MW2
auaucaaauacauuucaaaaa

SEQ ID NO: 4025262 - RNA, 15 nt, Staphylococcus aureus subsp. aureus MW2
auaucaauaaugcug

SEQ ID NO: 4025263 - RNA, 15 nt, Staphylococcus aureus subsp. aureus MW2
auaucaauaauucgu

SEQ ID NO: 4025264 - RNA, 17 nt, Staphylococcus aureus subsp. aureus MW2
auaucaauuguugcaaa

SEQ ID NO: 4025265 - RNA, 17 nt, Staphylococcus aureus subsp. aureus MW2
auaucacugaaugcuaa

SEQ ID NO: 4025266 - RNA, 20 nt, Staphylococcus aureus subsp. aureus MW2
auaucagcuaaguuaaauau

SEQ ID NO: 4025267 - RNA, 22 nt, Staphylococcus aureus subsp. aureus MW2
auaucagcuaaguuaaauauca

SEQ ID NO: 4025268 - RNA, 15 nt, Staphylococcus aureus subsp. aureus MW2
auaucagcuuuuuca

SEQ ID NO: 4025269 - RNA, 15 nt, Staphylococcus aureus subsp. aureus MW2
auaucauaacuuaac

SEQ ID NO: 4025270 - RNA, 20 nt, Staphylococcus aureus subsp. aureus MW2
auaucauaccaaaaaguauu

SEQ ID NO: 4025271 - RNA, 16 nt, Staphylococcus aureus subsp. aureus MW2
auaucauauaaugguu

SEQ ID NO: 4025272 - RNA, 13 nt, Staphylococcus aureus subsp. aureus MW2
auaucauauuacu

SEQ ID NO: 4025273 - RNA, 14 nt, Staphylococcus aureus subsp. aureus MW2
auaucauauuacuu

SEQ ID NO: 4025274 - RNA, 18 nt, Staphylococcus aureus subsp. aureus MW2
auaucauauucaaaauaa

SEQ ID NO: 4025275 - RNA, 15 nt, Staphylococcus aureus subsp. aureus MW2
auaucaucauuuaaa

SEQ ID NO: 4025276 - RNA, 17 nt, Staphylococcus aureus subsp. aureus MW2
auaucaucucuaugucu

SEQ ID NO: 4025277 - RNA, 15 nt, Staphylococcus aureus subsp. aureus MW2
auaucaugcaaaaua

SEQ ID NO: 4025278 - RNA, 16 nt, Staphylococcus aureus subsp. aureus MW2
auaucauuuuauccaa

SEQ ID NO: 4025279 - RNA, 21 nt, Staphylococcus aureus subsp. aureus MW2
auauccaaaauccugaaauua

SEQ ID NO: 4025280 - RNA, 17 nt, Staphylococcus aureus subsp. aureus MW2
auauccacgguuuacca

SEQ ID NO: 4025281 - RNA, 17 nt, Staphylococcus aureus subsp. aureus MW2
auauccaguuaauuauu

SEQ ID NO: 4025282 - RNA, 17 nt, Staphylococcus aureus subsp. aureus MW2
auauccauuaugaugua

SEQ ID NO: 4025283 - RNA, 17 nt, Staphylococcus aureus subsp. aureus MW2
auauccauucuuuuuca

SEQ ID NO: 4025284 - RNA, 21 nt, Staphylococcus aureus subsp. aureus MW2
auauccgaaaauugcuaaaaa

SEQ ID NO: 4025285 - RNA, 17 nt, Staphylococcus aureus subsp. aureus MW2
auauccugccaauauau

SEQ ID NO: 4025286 - RNA, 15 nt, Staphylococcus aureus subsp. aureus MW2
auauccuguuucaua

SEQ ID NO: 4025287 - RNA, 17 nt, Staphylococcus aureus subsp. aureus MW2
auauccuucaaagauuu

SEQ ID NO: 4025288 - RNA, 14 nt, Staphylococcus aureus subsp. aureus MW2
auauccuucauuag

SEQ ID NO: 4025289 - RNA, 14 nt, Staphylococcus aureus subsp. aureus MW2
auaucgacaaauua

SEQ ID NO: 4025290 - RNA, 16 nt, Staphylococcus aureus subsp. aureus MW2
auaucgacaccauuua

SEQ ID NO: 4025291 - RNA, 23 nt, Staphylococcus aureus subsp. aureus MW2
auaucgagaggguacacuucaac

SEQ ID NO: 4025292 - RNA, 14 nt, Staphylococcus aureus subsp. aureus MW2
auaucgauaaaugu

SEQ ID NO: 4025293 - RNA, 21 nt, Staphylococcus aureus subsp. aureus MW2
auaucgauauucuccaacucu

SEQ ID NO: 4025294 - RNA, 19 nt, Staphylococcus aureus subsp. aureus MW2
auaucgcgcaucaaaaaug

SEQ ID NO: 4025295 - RNA, 16 nt, Staphylococcus aureus subsp. aureus MW2
auaucgucguaacucu

SEQ ID NO: 4025296 - RNA, 23 nt, Staphylococcus aureus subsp. aureus MW2
auaucgugcguuaaauauauauu

SEQ ID NO: 4025297 - RNA, 11 nt, Staphylococcus aureus subsp. aureus MW2
auaucuaaguc

SEQ ID NO: 4025298 - RNA, 16 nt, Staphylococcus aureus subsp. aureus MW2
auaucuaaugcaacuu

SEQ ID NO: 4025299 - RNA, 13 nt, Staphylococcus aureus subsp. aureus MW2
auaucuaauucgu

SEQ ID NO: 4025300 - RNA, 18 nt, Staphylococcus aureus subsp. aureus MW2
auaucuaauucguaauuu

SEQ ID NO: 4025301 - RNA, 14 nt, Staphylococcus aureus subsp. aureus MW2
auaucuacagagaa

SEQ ID NO: 4025302 - RNA, 23 nt, Staphylococcus aureus subsp. aureus MW2
auaucuacagagaaucaauuauu

SEQ ID NO: 4025303 - RNA, 22 nt, Staphylococcus aureus subsp. aureus MW2
auaucuagcugcuucugcugua

SEQ ID NO: 4025304 - RNA, 20 nt, Staphylococcus aureus subsp. aureus MW2
auaucuauaggucuacaaau

SEQ ID NO: 4025305 - RNA, 14 nt, Staphylococcus aureus subsp. aureus MW2
auaucucaagauau

SEQ ID NO: 4025306 - RNA, 15 nt, Staphylococcus aureus subsp. aureus MW2
auaucucaagauauc

SEQ ID NO: 4025307 - RNA, 20 nt, Staphylococcus aureus subsp. aureus MW2
auaucugaaguagauugaua

SEQ ID NO: 4025308 - RNA, 16 nt, Staphylococcus aureus subsp. aureus MW2
auaucuguauaaaaac

SEQ ID NO: 4025309 - RNA, 15 nt, Staphylococcus aureus subsp. aureus MW2
auaucuguauaucca

SEQ ID NO: 4025310 - RNA, 18 nt, Staphylococcus aureus subsp. aureus MW2
auaucuuaaguacauaaa

SEQ ID NO: 4025311 - RNA, 23 nt, Staphylococcus aureus subsp. aureus MW2
auaucuuaaucuaaaaauagaug

SEQ ID NO: 4025312 - RNA, 21 nt, Staphylococcus aureus subsp. aureus MW2
auaucuuaugauacuuugaaa

SEQ ID NO: 4025313 - RNA, 22 nt, Staphylococcus aureus subsp. aureus MW2
auaucuucuuuuuuauaguggu

SEQ ID NO: 4025314 - RNA, 18 nt, Staphylococcus aureus subsp. aureus MW2
auaucuuuaucauuauuc

SEQ ID NO: 4025315 - RNA, 15 nt, Staphylococcus aureus subsp. aureus MW2
auaucuuuauuugau

SEQ ID NO: 4025316 - RNA, 21 nt, Staphylococcus aureus subsp. aureus MW2
auaucuuucaauuaauuuaaa

SEQ ID NO: 4025317 - RNA, 14 nt, Staphylococcus aureus subsp. aureus MW2
auaucuuuguugca

SEQ ID NO: 4025318 - RNA, 16 nt, Staphylococcus aureus subsp. aureus MW2
auaucuuuuaauguuu

SEQ ID NO: 4025319 - RNA, 20 nt, Staphylococcus aureus subsp. aureus MW2
auaugaaaaaugucuaaaaa

SEQ ID NO: 4025320 - RNA, 21 nt, Staphylococcus aureus subsp. aureus MW2
auaugaaaaaugucuaaaaaa

SEQ ID NO: 4025321 - RNA, 12 nt, Staphylococcus aureus subsp. aureus MW2
auaugaaaagag

SEQ ID NO: 4025322 - RNA, 14 nt, Staphylococcus aureus subsp. aureus MW2
auaugaaaagagaa

SEQ ID NO: 4025323 - RNA, 15 nt, Staphylococcus aureus subsp. aureus MW2
auaugaaauauuuau

SEQ ID NO: 4025324 - RNA, 21 nt, Staphylococcus aureus subsp. aureus MW2
auaugaagcguuuuuauuaca

SEQ ID NO: 4025325 - RNA, 18 nt, Staphylococcus aureus subsp. aureus MW2
auaugaauggcauuuaau

SEQ ID NO: 4025326 - RNA, 21 nt, Staphylococcus aureus subsp. aureus MW2
auaugaauuuagaugcauaaa

SEQ ID NO: 4025327 - RNA, 23 nt, Staphylococcus aureus subsp. aureus MW2
auaugaauuuagaugcauaaaaa

SEQ ID NO: 4025328 - RNA, 16 nt, Staphylococcus aureus subsp. aureus MW2
auaugacacauacacc

SEQ ID NO: 4025329 - RNA, 17 nt, Staphylococcus aureus subsp. aureus MW2
auaugacgcgugaauua

SEQ ID NO: 4025330 - RNA, 23 nt, Staphylococcus aureus subsp. aureus MW2
auaugacgcgugaauuaaaaaau

SEQ ID NO: 4025331 - RNA, 16 nt, Staphylococcus aureus subsp. aureus MW2
auaugacuuuagcauu

SEQ ID NO: 4025332 - RNA, 16 nt, Staphylococcus aureus subsp. aureus MW2
auaugacuuuauuucu

SEQ ID NO: 4025333 - RNA, 17 nt, Staphylococcus aureus subsp. aureus MW2
auaugacuuuauuucua

SEQ ID NO: 4025334 - RNA, 19 nt, Staphylococcus aureus subsp. aureus MW2
auaugauaaccaaaccauu

SEQ ID NO: 4025335 - RNA, 17 nt, Staphylococcus aureus subsp. aureus MW2
auaugaucuaacaucau

SEQ ID NO: 4025336 - RNA, 15 nt, Staphylococcus aureus subsp. aureus MW2
auaugauugaaugaa

SEQ ID NO: 4025337 - RNA, 17 nt, Staphylococcus aureus subsp. aureus MW2
auaugauugcaaauuau

SEQ ID NO: 4025338 - RNA, 13 nt, Staphylococcus aureus subsp. aureus MW2
auaugauugguuu

SEQ ID NO: 4025339 - RNA, 17 nt, Staphylococcus aureus subsp. aureus MW2
auaugcaacuuauaaua

SEQ ID NO: 4025340 - RNA, 13 nt, Staphylococcus aureus subsp. aureus MW2
auaugcaucaaca

SEQ ID NO: 4025341 - RNA, 20 nt, Staphylococcus aureus subsp. aureus MW2
auaugccaaaguaauaaugg

SEQ ID NO: 4025342 - RNA, 23 nt, Staphylococcus aureus subsp. aureus MW2
auauuggcuugcuucauuauaua

SEQ ID NO: 4025343 - RNA, 19 nt, Staphylococcus aureus subsp. aureus MW2
auauugguuauauauuguc

SEQ ID NO: 4025344 - RNA, 13 nt, Staphylococcus aureus subsp. aureus MW2
auauuguauuuua

SEQ ID NO: 4025345 - RNA, 13 nt, Staphylococcus aureus subsp. aureus MW2
auauuguuaauuc

SEQ ID NO: 4025346 - RNA, 18 nt, Staphylococcus aureus subsp. aureus MW2
auauuguuauacauauau

SEQ ID NO: 4025347 - RNA, 12 nt, Staphylococcus aureus subsp. aureus MW2
auauuuaaacuc

SEQ ID NO: 4025348 - RNA, 19 nt, Staphylococcus aureus subsp. aureus MW2
auauuuaaacucauaauuu

SEQ ID NO: 4025349 - RNA, 14 nt, Staphylococcus aureus subsp. aureus MW2
auauuuaaaucaau

SEQ ID NO: 4025350 - RNA, 21 nt, Staphylococcus aureus subsp. aureus MW2
auauuuaaaucaauauucucu

SEQ ID NO: 4025351 - RNA, 18 nt, Staphylococcus aureus subsp. aureus MW2
auauuuaaaugcuuucaa

SEQ ID NO: 4025352 - RNA, 21 nt, Staphylococcus aureus subsp. aureus MW2
auauuuaacgaaaauuaagau

SEQ ID NO: 4025353 - RNA, 17 nt, Staphylococcus aureus subsp. aureus MW2
auauuuaagaaguuaaa

SEQ ID NO: 4025354 - RNA, 22 nt, Staphylococcus aureus subsp. aureus MW2
auauuuagauuggucaaacuua

SEQ ID NO: 4025355 - RNA, 23 nt, Staphylococcus aureus subsp. aureus MW2
auauuuaggugugucaauaguaa

SEQ ID NO: 4025356 - RNA, 22 nt, Staphylococcus aureus subsp. aureus MW2
auauuuaucgcgauuauuacca

SEQ ID NO: 4025357 - RNA, 12 nt, Staphylococcus aureus subsp. aureus MW2
auauuuauucua

SEQ ID NO: 4025358 - RNA, 22 nt, Staphylococcus aureus subsp. aureus MW2
auauuuauuguuuuuaaaaucu

SEQ ID NO: 4025359 - RNA, 15 nt, Staphylococcus aureus subsp. aureus MW2
auauuuauuuuaaau

SEQ ID NO: 4025360 - RNA, 16 nt, Staphylococcus aureus subsp. aureus MW2
auauuuauuuuaaauu

SEQ ID NO: 4025361 - RNA, 17 nt, Staphylococcus aureus subsp. aureus MW2
auauuuauuuuauaaua

SEQ ID NO: 4025362 - RNA, 18 nt, Staphylococcus aureus subsp. aureus MW2
auauuucaacuuuuuaau

SEQ ID NO: 4025363 - RNA, 20 nt, Staphylococcus aureus subsp. aureus MW2
auauuuccaaauugaaauua

SEQ ID NO: 4025364 - RNA, 17 nt, Staphylococcus aureus subsp. aureus MW2
auauuucccuaugaaau

SEQ ID NO: 4025365 - RNA, 16 nt, Staphylococcus aureus subsp. aureus MW2
auauuucggacaauaa

SEQ ID NO: 4025366 - RNA, 21 nt, Staphylococcus aureus subsp. aureus MW2
auauuucgguuagucuuaauc

SEQ ID NO: 4025367 - RNA, 16 nt, Staphylococcus aureus subsp. aureus MW2
auauuucuaaaccauu

SEQ ID NO: 4025368 - RNA, 13 nt, Staphylococcus aureus subsp. aureus MW2
auauuucuuacca

SEQ ID NO: 4025369 - RNA, 19 nt, Staphylococcus aureus subsp. aureus MW2
auauuugaaagguaaguac

SEQ ID NO: 4025370 - RNA, 15 nt, Staphylococcus aureus subsp. aureus MW2
auauuugauccauau

SEQ ID NO: 4025371 - RNA, 14 nt, Staphylococcus aureus subsp. aureus MW2
auauuugauuauuc

SEQ ID NO: 4025372 - RNA, 12 nt, Staphylococcus aureus subsp. aureus MW2
auauuuuaaaaa

SEQ ID NO: 4025373 - RNA, 17 nt, Staphylococcus aureus subsp. aureus MW2
auauuuuaaaaaguaau

SEQ ID NO: 4025374 - RNA, 13 nt, Staphylococcus aureus subsp. aureus MW2
auauuuuauuaua

SEQ ID NO: 4025375 - RNA, 14 nt, Staphylococcus aureus subsp. aureus MW2
auauuuuauuauaa

SEQ ID NO: 4025376 - RNA, 14 nt, Staphylococcus aureus subsp. aureus MW2
auauuuuauuuaaa

SEQ ID NO: 4025377 - RNA, 19 nt, Staphylococcus aureus subsp. aureus MW2
auauuuuauuuaaaaauag

SEQ ID NO: 4025378 - RNA, 16 nt, Staphylococcus aureus subsp. aureus MW2
auauuuucgcaaaauu

SEQ ID NO: 4025379 - RNA, 17 nt, Staphylococcus aureus subsp. aureus MW2
auauuuucgcaaaauuu

SEQ ID NO: 4025380 - RNA, 19 nt, Staphylococcus aureus subsp. aureus MW2
auauuuucgcaaaauuuau

SEQ ID NO: 4025381 - RNA, 14 nt, Staphylococcus aureus subsp. aureus MW2
auauuuucugcgau

SEQ ID NO: 4025382 - RNA, 19 nt, Staphylococcus aureus subsp. aureus MW2
auauuuucuuagaaaauca

SEQ ID NO: 4025383 - RNA, 14 nt, Staphylococcus aureus subsp. aureus MW2
auauuuuguaugaa

SEQ ID NO: 4025384 - RNA, 13 nt, Staphylococcus aureus subsp. aureus MW2
auauuuuguuaau

SEQ ID NO: 4025385 - RNA, 13 nt, Staphylococcus aureus subsp. aureus MW2
auauuuuuagaaa

SEQ ID NO: 4025386 - RNA, 17 nt, Staphylococcus aureus subsp. aureus MW2
auauuuuuaucaucuuc

SEQ ID NO: 4025387 - RNA, 14 nt, Staphylococcus aureus subsp. aureus MW2
auauuuuuuaaauu

SEQ ID NO: 4025388 - RNA, 15 nt, Staphylococcus aureus subsp. aureus MW2
auauuuuuuaaugaa

SEQ ID NO: 4025389 - RNA, 16 nt, Staphylococcus aureus subsp. aureus MW2
auauuuuuugauauaa

SEQ ID NO: 4025390 - RNA, 16 nt, Staphylococcus aureus subsp. aureus MW2
auauuuuuuguacauu

SEQ ID NO: 4025391 - RNA, 20 nt, Staphylococcus aureus subsp. aureus MW2
auauuuuuuguacauuauua

SEQ ID NO: 4025392 - RNA, 21 nt, Staphylococcus aureus subsp. aureus MW2
auauuuuuuguacauuauuaa

SEQ ID NO: 4025393 - RNA, 22 nt, Staphylococcus aureus subsp. aureus MW2
auauuuuuuguacauuauuaau

SEQ ID NO: 4025394 - RNA, 23 nt, Staphylococcus aureus subsp. aureus MW2
auauuuuuuguacauuauuaaua

SEQ ID NO: 4025395 - RNA, 19 nt, Staphylococcus aureus subsp. aureus MW2
aucaaaaaaacaaaaaaua

SEQ ID NO: 4025396 - RNA, 12 nt, Staphylococcus aureus subsp. aureus MW2
aucaaaauauaa

SEQ ID NO: 4025397 - RNA, 14 nt, Staphylococcus aureus subsp. aureus MW2
aucaaaaucaugcu

SEQ ID NO: 4025398 - RNA, 12 nt, Staphylococcus aureus subsp. aureus MW2
aucaaaauuuaa

SEQ ID NO: 4025399 - RNA, 15 nt, Staphylococcus aureus subsp. aureus MW2
aucaaacaacaucac

SEQ ID NO: 4025400 - RNA, 18 nt, Staphylococcus aureus subsp. aureus MW2
aucaaagaaauguaugac

SEQ ID NO: 4025401 - RNA, 23 nt, Staphylococcus aureus subsp. aureus MW2
aucaaagaaauguaugacauaaa

SEQ ID NO: 4025402 - RNA, 19 nt, Staphylococcus aureus subsp. aureus MW2
aucaaagaggcuuuaaaau

SEQ ID NO: 4025403 - RNA, 16 nt, Staphylococcus aureus subsp. aureus MW2
aucaaagaguaaaguu

SEQ ID NO: 4025404 - RNA, 18 nt, Staphylococcus aureus subsp. aureus MW2
aucaaagauuuuguugaa

SEQ ID NO: 4025405 - RNA, 11 nt, Staphylococcus aureus subsp. aureus MW2
aucaaaggcuu

SEQ ID NO: 4025406 - RNA, 21 nt, Staphylococcus aureus subsp. aureus MW2
aucaaaguaucagucauugca

SEQ ID NO: 4025407 - RNA, 19 nt, Staphylococcus aureus subsp. aureus MW2
aucaaagucucuaguaucu

SEQ ID NO: 4025408 - RNA, 17 nt, Staphylococcus aureus subsp. aureus MW2
aucaaaguuuucaggaa

SEQ ID NO: 4025409 - RNA, 24 nt, Staphylococcus aureus subsp. aureus MW2
aucaaaguuuucaggaauuguuaa

SEQ ID NO: 4025410 - RNA, 18 nt, Staphylococcus aureus subsp. aureus MW2
aucaaauagacaccaaaa

SEQ ID NO: 4025411 - RNA, 19 nt, Staphylococcus aureus subsp. aureus MW2
aucaaauauuuuauuacau

SEQ ID NO: 4025412 - RNA, 16 nt, Staphylococcus aureus subsp. aureus MW2
aucaaaucaauaucau

SEQ ID NO: 4025413 - RNA, 23 nt, Staphylococcus aureus subsp. aureus MW2
aucaaauccaaaaucuuuacuug

SEQ ID NO: 4025414 - RNA, 15 nt, Staphylococcus aureus subsp. aureus MW2
aucaaaugguacagu

SEQ ID NO: 4025415 - RNA, 22 nt, Staphylococcus aureus subsp. aureus MW2
aucaaauuacuuauucaaaugu

SEQ ID NO: 4025416 - RNA, 21 nt, Staphylococcus aureus subsp. aureus MW2
aucaaauuagucauccaaaga

SEQ ID NO: 4025417 - RNA, 19 nt, Staphylococcus aureus subsp. aureus MW2
aucaaauucaaauuauaau

SEQ ID NO: 4025418 - RNA, 14 nt, Staphylococcus aureus subsp. aureus MW2
aucaaauugaccau

SEQ ID NO: 4025419 - RNA, 13 nt, Staphylococcus aureus subsp. aureus MW2
aucaaauuuuucg

SEQ ID NO: 4025420 - RNA, 17 nt, Staphylococcus aureus subsp. aureus MW2
aucaacaaauuuaacuu

SEQ ID NO: 4025421 - RNA, 12 nt, Staphylococcus aureus subsp. aureus MW2
aucaacacacac

SEQ ID NO: 4025422 - RNA, 17 nt, Staphylococcus aureus subsp. aureus MW2
aucaacagcuucaaaau

SEQ ID NO: 4025423 - RNA, 21 nt, Staphylococcus aureus subsp. aureus MW2
aucaacaguuuuauuaucuuu

SEQ ID NO: 4025424 - RNA, 23 nt, Staphylococcus aureus subsp. aureus MW2
aucaacauauuuaucucuuucuu

SEQ ID NO: 4025425 - RNA, 17 nt, Staphylococcus aureus subsp. aureus MW2
aucaacauuaauaaaua

SEQ ID NO: 4025426 - RNA, 22 nt, Staphylococcus aureus subsp. aureus MW2
aucaaccuguucuuuauuuaaa

SEQ ID NO: 4025427 - RNA, 20 nt, Staphylococcus aureus subsp. aureus MW2
aucaacgagucauaaauaua

SEQ ID NO: 4025428 - RNA, 19 nt, Staphylococcus aureus subsp. aureus MW2
aucaacgauugaauuguag

SEQ ID NO: 4025429 - RNA, 18 nt, Staphylococcus aureus subsp. aureus MW2
aucaacgauuuugucuuu

SEQ ID NO: 4025430 - RNA, 17 nt, Staphylococcus aureus subsp. aureus MW2
aucaacgccauauuuau

SEQ ID NO: 4025431 - RNA, 15 nt, Staphylococcus aureus subsp. aureus MW2
aucauacgagaaauu

SEQ ID NO: 4025432 - RNA, 16 nt, Staphylococcus aureus subsp. aureus MW2
aucauagauauaagaa

SEQ ID NO: 4025433 - RNA, 21 nt, Staphylococcus aureus subsp. aureus MW2
aucauauauaccuugaacaua

SEQ ID NO: 4025434 - RNA, 14 nt, Staphylococcus aureus subsp. aureus MW2
aucauaucauacca

SEQ ID NO: 4025435 - RNA, 15 nt, Staphylococcus aureus subsp. aureus MW2
aucauaugucuuaac

SEQ ID NO: 4025436 - RNA, 15 nt, Staphylococcus aureus subsp. aureus MW2
aucauauucaaaaua

SEQ ID NO: 4025437 - RNA, 15 nt, Staphylococcus aureus subsp. aureus MW2
aucauauugcacaua

SEQ ID NO: 4025438 - RNA, 21 nt, Staphylococcus aureus subsp. aureus MW2
aucauauuugaauacuuuauu

SEQ ID NO: 4025439 - RNA, 14 nt, Staphylococcus aureus subsp. aureus MW2
aucaucaaaauuua

SEQ ID NO: 4025440 - RNA, 23 nt, Staphylococcus aureus subsp. aureus MW2
aucaucaagacauuuuaacaagu

SEQ ID NO: 4025441 - RNA, 22 nt, Staphylococcus aureus subsp. aureus MW2
aucaucaaguucaccguaaucu

SEQ ID NO: 4025442 - RNA, 13 nt, Staphylococcus aureus subsp. aureus MW2
aucaucacacaua

SEQ ID NO: 4025443 - RNA, 21 nt, Staphylococcus aureus subsp. aureus MW2
aucaucacuguagauucaaau

SEQ ID NO: 4025444 - RNA, 23 nt, Staphylococcus aureus subsp. aureus MW2
aucaucauauugcacauaaacuu

SEQ ID NO: 4025445 - RNA, 14 nt, Staphylococcus aureus subsp. aureus MW2
aucaucgaacauga

SEQ ID NO: 4025446 - RNA, 24 nt, Staphylococcus aureus subsp. aureus MW2
aucaucguauagaugugucuuuug

SEQ ID NO: 4025447 - RNA, 18 nt, Staphylococcus aureus subsp. aureus MW2
aucaucucugcuuuaaua

SEQ ID NO: 4025448 - RNA, 20 nt, Staphylococcus aureus subsp. aureus MW2
aucaucucugcuuuaauaua

SEQ ID NO: 4025449 - RNA, 21 nt, Staphylococcus aureus subsp. aureus MW2
aucaucucugcuuuaauauaa

SEQ ID NO: 4025450 - RNA, 23 nt, Staphylococcus aureus subsp. aureus MW2
aucaucugcaagugcuucaacuu

SEQ ID NO: 4025451 - RNA, 14 nt, Staphylococcus aureus subsp. aureus MW2
aucaucuucaguua

SEQ ID NO: 4025452 - RNA, 19 nt, Staphylococcus aureus subsp. aureus MW2
aucaucuuuaauuuucuug

SEQ ID NO: 4025453 - RNA, 20 nt, Staphylococcus aureus subsp. aureus MW2
aucaucuuuuugaaauuucg

SEQ ID NO: 4025454 - RNA, 17 nt, Staphylococcus aureus subsp. aureus MW2
aucaugaaauuaaaaac

SEQ ID NO: 4025455 - RNA, 23 nt, Staphylococcus aureus subsp. aureus MW2
aucaugaaauuaaaaacaccuuc

SEQ ID NO: 4025456 - RNA, 16 nt, Staphylococcus aureus subsp. aureus MW2
aucaugaaguugguuu

SEQ ID NO: 4025457 - RNA, 14 nt, Staphylococcus aureus subsp. aureus MW2
aucaugacacaaag

SEQ ID NO: 4025458 - RNA, 17 nt, Staphylococcus aureus subsp. aureus MW2
aucaugacacaaaggau

SEQ ID NO: 4025459 - RNA, 16 nt, Staphylococcus aureus subsp. aureus MW2
aucaugacauaaaacu

SEQ ID NO: 4025460 - RNA, 19 nt, Staphylococcus aureus subsp. aureus MW2
aucaugacuauuuuccauc

SEQ ID NO: 4025461 - RNA, 24 nt, Staphylococcus aureus subsp. aureus MW2
aucaugacuauuuuccaucacaua

SEQ ID NO: 4025462 - RNA, 13 nt, Staphylococcus aureus subsp. aureus MW2
aucaugccuucau

SEQ ID NO: 4025463 - RNA, 19 nt, Staphylococcus aureus subsp. aureus MW2
aucaugccuucaugaauaa

SEQ ID NO: 4025464 - RNA, 16 nt, Staphylococcus aureus subsp. aureus MW2
aucaugcucauuugau

SEQ ID NO: 4025465 - RNA, 12 nt, Staphylococcus aureus subsp. aureus MW2
aucaugcuuuuu

SEQ ID NO: 4025466 - RNA, 15 nt, Staphylococcus aureus subsp. aureus MW2
aucaugcuuuuuaau

SEQ ID NO: 4025467 - RNA, 14 nt, Staphylococcus aureus subsp. aureus MW2
aucaugcuuuuuug

SEQ ID NO: 4025468 - RNA, 23 nt, Staphylococcus aureus subsp. aureus MW2
aucauguaaugcuuaaaaacaau

SEQ ID NO: 4025469 - RNA, 23 nt, Staphylococcus aureus subsp. aureus MW2
aucauguauauggcaucaucacc

SEQ ID NO: 4025470 - RNA, 15 nt, Staphylococcus aureus subsp. aureus MW2
aucauguuuauuagc

SEQ ID NO: 4025471 - RNA, 22 nt, Staphylococcus aureus subsp. aureus MW2
aucauuaaaucugauucauuaa

SEQ ID NO: 4025472 - RNA, 18 nt, Staphylococcus aureus subsp. aureus MW2
aucauuaagaaaaggcuc

SEQ ID NO: 4025473 - RNA, 19 nt, Staphylococcus aureus subsp. aureus MW2
aucauuagacuuucuuaau

SEQ ID NO: 4025474 - RNA, 19 nt, Staphylococcus aureus subsp. aureus MW2
aucauuaguguagaaaaua

SEQ ID NO: 4025475 - RNA, 20 nt, Staphylococcus aureus subsp. aureus MW2
aucauuaguuuuuaaaauua

SEQ ID NO: 4025476 - RNA, 13 nt, Staphylococcus aureus subsp. aureus MW2
aucauuauaaaau

SEQ ID NO: 4025477 - RNA, 14 nt, Staphylococcus aureus subsp. aureus MW2
aucauuauaaaaug

SEQ ID NO: 4025478 - RNA, 15 nt, Staphylococcus aureus subsp. aureus MW2
aucauuauaaaaugg

SEQ ID NO: 4025479 - RNA, 18 nt, Staphylococcus aureus subsp. aureus MW2
aucauuauuuaauuuuaa

SEQ ID NO: 4025480 - RNA, 13 nt, Staphylococcus aureus subsp. aureus MW2
aucauuauuuuac

SEQ ID NO: 4025481 - RNA, 16 nt, Staphylococcus aureus subsp. aureus MW2
aucauucauuugcaaa

SEQ ID NO: 4025482 - RNA, 15 nt, Staphylococcus aureus subsp. aureus MW2
aucauucgaauacug

SEQ ID NO: 4025483 - RNA, 24 nt, Staphylococcus aureus subsp. aureus MW2
aucauugaauguuggaucggcauu

SEQ ID NO: 4025484 - RNA, 21 nt, Staphylococcus aureus subsp. aureus MW2
aucauugauauagucaaugaa

SEQ ID NO: 4025485 - RNA, 16 nt, Staphylococcus aureus subsp. aureus MW2
aucauuguaaaacaaa

SEQ ID NO: 4025486 - RNA, 13 nt, Staphylococcus aureus subsp. aureus MW2
aucauuguggcuu

SEQ ID NO: 4025487 - RNA, 22 nt, Staphylococcus aureus subsp. aureus MW2
aucauuguguccauaaauauua

SEQ ID NO: 4025488 - RNA, 15 nt, Staphylococcus aureus subsp. aureus MW2
aucauuguuuuaaau

SEQ ID NO: 4025489 - RNA, 19 nt, Staphylococcus aureus subsp. aureus MW2
aucauuuaaauuaguuaua

SEQ ID NO: 4025490 - RNA, 23 nt, Staphylococcus aureus subsp. aureus MW2
aucauuuaaauuaguuauacuaa

SEQ ID NO: 4025491 - RNA, 23 nt, Staphylococcus aureus subsp. aureus MW2
aucauuuacuuuagaaacaccuu

SEQ ID NO: 4025492 - RNA, 16 nt, Staphylococcus aureus subsp. aureus MW2
aucauuucaaauaaga

SEQ ID NO: 4025493 - RNA, 18 nt, Staphylococcus aureus subsp. aureus MW2
aucauuucagaaauacau

SEQ ID NO: 4025494 - RNA, 23 nt, Staphylococcus aureus subsp. aureus MW2
aucauuuguacaaucaaaggcuu

SEQ ID NO: 4025495 - RNA, 12 nt, Staphylococcus aureus subsp. aureus MW2
aucauuuguguu

SEQ ID NO: 4025496 - RNA, 16 nt, Staphylococcus aureus subsp. aureus MW2
aucauuuucuugauuu

SEQ ID NO: 4025497 - RNA, 18 nt, Staphylococcus aureus subsp. aureus MW2
aucauuuuuaauuuugac

SEQ ID NO: 4025498 - RNA, 21 nt, Staphylococcus aureus subsp. aureus MW2
auccaaggauguuauaaaaug

SEQ ID NO: 4025499 - RNA, 23 nt, Staphylococcus aureus subsp. aureus MW2
auccaagucuaaaugcaauaugu

SEQ ID NO: 4025500 - RNA, 16 nt, Staphylococcus aureus subsp. aureus MW2
auccaagugacaacau

SEQ ID NO: 4025501 - RNA, 13 nt, Staphylococcus aureus subsp. aureus MW2
auccaauauacaa

SEQ ID NO: 4025502 - RNA, 14 nt, Staphylococcus aureus subsp. aureus MW2
auccaaugcauaaa

SEQ ID NO: 4025503 - RNA, 17 nt, Staphylococcus aureus subsp. aureus MW2
auccaauuaaauauuua

SEQ ID NO: 4025504 - RNA, 14 nt, Staphylococcus aureus subsp. aureus MW2
auccaccaaauaca

SEQ ID NO: 4025505 - RNA, 16 nt, Staphylococcus aureus subsp. aureus MW2
auccaccguuaaaaua

SEQ ID NO: 4025506 - RNA, 18 nt, Staphylococcus aureus subsp. aureus MW2
auccaccguuaaaauaua

SEQ ID NO: 4025507 - RNA, 16 nt, Staphylococcus aureus subsp. aureus MW2
auccaccuaaaaagua

SEQ ID NO: 4025508 - RNA, 15 nt, Staphylococcus aureus subsp. aureus MW2
auccauauauguaac

SEQ ID NO: 4025509 - RNA, 20 nt, Staphylococcus aureus subsp. aureus MW2
auccaucaauaccauaauua

SEQ ID NO: 4025510 - RNA, 14 nt, Staphylococcus aureus subsp. aureus MW2
auccaucuacaccc

SEQ ID NO: 4025511 - RNA, 21 nt, Staphylococcus aureus subsp. aureus MW2
auccauucuaacgguaaauaa

SEQ ID NO: 4025512 - RNA, 20 nt, Staphylococcus aureus subsp. aureus MW2
auccauucuuuuucaaaaua

SEQ ID NO: 4025513 - RNA, 15 nt, Staphylococcus aureus subsp. aureus MW2
aucccauuaaaccac

SEQ ID NO: 4025514 - RNA, 22 nt, Staphylococcus aureus subsp. aureus MW2
auccccaacccggugcauguug

SEQ ID NO: 4025515 - RNA, 19 nt, Staphylococcus aureus subsp. aureus MW2
auccccagccauuuguugu

SEQ ID NO: 4025516 - RNA, 14 nt, Staphylococcus aureus subsp. aureus MW2
auccccauuuaugu

SEQ ID NO: 4025517 - RNA, 17 nt, Staphylococcus aureus subsp. aureus MW2
auccccgagcaauucuu

SEQ ID NO: 4025518 - RNA, 18 nt, Staphylococcus aureus subsp. aureus MW2
aucccgaaaguuagacua

SEQ ID NO: 4025519 - RNA, 13 nt, Staphylococcus aureus subsp. aureus MW2
aucuacuuuuucg

SEQ ID NO: 4025520 - RNA, 21 nt, Staphylococcus aureus subsp. aureus MW2
aucuagccugaaauagaaaug

SEQ ID NO: 4025521 - RNA, 14 nt, Staphylococcus aureus subsp. aureus MW2
aucuaguacaccuc

SEQ ID NO: 4025522 - RNA, 15 nt, Staphylococcus aureus subsp. aureus MW2
aucuaguuguuuuau

SEQ ID NO: 4025523 - RNA, 13 nt, Staphylococcus aureus subsp. aureus MW2
aucuauaaauggc

SEQ ID NO: 4025524 - RNA, 15 nt, Staphylococcus aureus subsp. aureus MW2
aucuauaaauuauuu

SEQ ID NO: 4025525 - RNA, 17 nt, Staphylococcus aureus subsp. aureus MW2
aucuauaagauuucuca

SEQ ID NO: 4025526 - RNA, 13 nt, Staphylococcus aureus subsp. aureus MW2
aucuauacuuuau

SEQ ID NO: 4025527 - RNA, 14 nt, Staphylococcus aureus subsp. aureus MW2
aucuauauaaaaac

SEQ ID NO: 4025528 - RNA, 12 nt, Staphylococcus aureus subsp. aureus MW2
aucuauaugcau

SEQ ID NO: 4025529 - RNA, 13 nt, Staphylococcus aureus subsp. aureus MW2
aucuaucuugugc

SEQ ID NO: 4025530 - RNA, 20 nt, Staphylococcus aureus subsp. aureus MW2
aucuaugcccgugaugggua

SEQ ID NO: 4025531 - RNA, 18 nt, Staphylococcus aureus subsp. aureus MW2
aucuauuauuauguuaua

SEQ ID NO: 4025532 - RNA, 21 nt, Staphylococcus aureus subsp. aureus MW2
aucuauuauuauguuauaaau

SEQ ID NO: 4025533 - RNA, 15 nt, Staphylococcus aureus subsp. aureus MW2
aucuauucaaauaua

SEQ ID NO: 4025534 - RNA, 18 nt, Staphylococcus aureus subsp. aureus MW2
aucuauugugauauauga

SEQ ID NO: 4025535 - RNA, 18 nt, Staphylococcus aureus subsp. aureus MW2
aucuauuuaauaauguau

SEQ ID NO: 4025536 - RNA, 14 nt, Staphylococcus aureus subsp. aureus MW2
aucuauuuaucaua

SEQ ID NO: 4025537 - RNA, 16 nt, Staphylococcus aureus subsp. aureus MW2
aucuauuuaucauacu

SEQ ID NO: 4025538 - RNA, 15 nt, Staphylococcus aureus subsp. aureus MW2
aucuauuucuauaua

SEQ ID NO: 4025539 - RNA, 18 nt, Staphylococcus aureus subsp. aureus MW2
aucuauuuuaaacucauc

SEQ ID NO: 4025540 - RNA, 17 nt, Staphylococcus aureus subsp. aureus MW2
aucuauuuuacucuuuu

SEQ ID NO: 4025541 - RNA, 12 nt, Staphylococcus aureus subsp. aureus MW2
aucucaaaauuu

SEQ ID NO: 4025542 - RNA, 14 nt, Staphylococcus aureus subsp. aureus MW2
aucucaaaauuucg

SEQ ID NO: 4025543 - RNA, 15 nt, Staphylococcus aureus subsp. aureus MW2
aucucaaauauuaau

SEQ ID NO: 4025544 - RNA, 14 nt, Staphylococcus aureus subsp. aureus MW2
aucucaauccaauu

SEQ ID NO: 4025545 - RNA, 21 nt, Staphylococcus aureus subsp. aureus MW2
aucucaauccaauuaaauauu

SEQ ID NO: 4025546 - RNA, 14 nt, Staphylococcus aureus subsp. aureus MW2
aucucauaauaauu

SEQ ID NO: 4025547 - RNA, 16 nt, Staphylococcus aureus subsp. aureus MW2
aucucauacuauacaa

SEQ ID NO: 4025548 - RNA, 19 nt, Staphylococcus aureus subsp. aureus MW2
aucucauacuauacaaugu

SEQ ID NO: 4025549 - RNA, 21 nt, Staphylococcus aureus subsp. aureus MW2
aucucauacuauacaauguau

SEQ ID NO: 4025550 - RNA, 19 nt, Staphylococcus aureus subsp. aureus MW2
aucucaugccaaaaacauu

SEQ ID NO: 4025551 - RNA, 22 nt, Staphylococcus aureus subsp. aureus MW2
aucucauuuuuucgagaugaua

SEQ ID NO: 4025552 - RNA, 16 nt, Staphylococcus aureus subsp. aureus MW2
aucuccauuagaacua

SEQ ID NO: 4025553 - RNA, 19 nt, Staphylococcus aureus subsp. aureus MW2
aucucuaaauccuuuggac

SEQ ID NO: 4025554 - RNA, 18 nt, Staphylococcus aureus subsp. aureus MW2
aucucuauuuuuuauguu

SEQ ID NO: 4025555 - RNA, 11 nt, Staphylococcus aureus subsp. aureus MW2
aucucugaaaa

SEQ ID NO: 4025556 - RNA, 17 nt, Staphylococcus aureus subsp. aureus MW2
aucucugcuuuaauaua

SEQ ID NO: 4025557 - RNA, 18 nt, Staphylococcus aureus subsp. aureus MW2
aucucugcuuuaauauaa

SEQ ID NO: 4025558 - RNA, 15 nt, Staphylococcus aureus subsp. aureus MW2
aucucuuauuuuaaa

SEQ ID NO: 4025559 - RNA, 16 nt, Staphylococcus aureus subsp. aureus MW2
aucucuuauuuuaaaa

SEQ ID NO: 4025560 - RNA, 18 nt, Staphylococcus aureus subsp. aureus MW2
aucucuuauuuuaaaaua

SEQ ID NO: 4025561 - RNA, 16 nt, Staphylococcus aureus subsp. aureus MW2
aucucuucaauuuauu

SEQ ID NO: 4025562 - RNA, 18 nt, Staphylococcus aureus subsp. aureus MW2
aucucuucaauuuauuuu

SEQ ID NO: 4025563 - RNA, 20 nt, Staphylococcus aureus subsp. aureus MW2
aucucuucaauuuauuuuua

SEQ ID NO: 4025564 - RNA, 20 nt, Staphylococcus aureus subsp. aureus MW2
aucucuucugucuaaaaaca

SEQ ID NO: 4025565 - RNA, 20 nt, Staphylococcus aureus subsp. aureus MW2
aucugaaaaaccaauacgaa

SEQ ID NO: 4025566 - RNA, 15 nt, Staphylococcus aureus subsp. aureus MW2
aucugacauuguugc

SEQ ID NO: 4025567 - RNA, 18 nt, Staphylococcus aureus subsp. aureus MW2
aucugacauuucaucaau

SEQ ID NO: 4025568 - RNA, 17 nt, Staphylococcus aureus subsp. aureus MW2
aucugauaccguuagua

SEQ ID NO: 4025569 - RNA, 18 nt, Staphylococcus aureus subsp. aureus MW2
aucugauuguucauguuu

SEQ ID NO: 4025570 - RNA, 23 nt, Staphylococcus aureus subsp. aureus MW2
aucugcaagugcuucaacuucau

SEQ ID NO: 4025571 - RNA, 16 nt, Staphylococcus aureus subsp. aureus MW2
aucugcgaaaugcauu

SEQ ID NO: 4025572 - RNA, 14 nt, Staphylococcus aureus subsp. aureus MW2
aucuguaacauaaa

SEQ ID NO: 4025573 - RNA, 18 nt, Staphylococcus aureus subsp. aureus MW2
aucuguaacauaaacaau

SEQ ID NO: 4025574 - RNA, 15 nt, Staphylococcus aureus subsp. aureus MW2
aucuguaaugcacua

SEQ ID NO: 4025575 - RNA, 16 nt, Staphylococcus aureus subsp. aureus MW2
aucuguagaaacacuu

SEQ ID NO: 4025576 - RNA, 14 nt, Staphylococcus aureus subsp. aureus MW2
aucuguaucaaagu

SEQ ID NO: 4025577 - RNA, 20 nt, Staphylococcus aureus subsp. aureus MW2
aucuguccgauuuaauauug

SEQ ID NO: 4025578 - RNA, 19 nt, Staphylococcus aureus subsp. aureus MW2
aucuguugcauuaagugca

SEQ ID NO: 4025579 - RNA, 14 nt, Staphylococcus aureus subsp. aureus MW2
aucuguuuguuguu

SEQ ID NO: 4025580 - RNA, 17 nt, Staphylococcus aureus subsp. aureus MW2
aucuuaacaauuuuaau

SEQ ID NO: 4025581 - RNA, 18 nt, Staphylococcus aureus subsp. aureus MW2
aucuuaacaauuuuaauu

SEQ ID NO: 4025582 - RNA, 23 nt, Staphylococcus aureus subsp. aureus MW2
aucuuaacaauuuuaauuuuuca

SEQ ID NO: 4025583 - RNA, 14 nt, Staphylococcus aureus subsp. aureus MW2
aucuuaagucauca

SEQ ID NO: 4025584 - RNA, 19 nt, Staphylococcus aureus subsp. aureus MW2
aucuuaaucagcuauaaaa

SEQ ID NO: 4025585 - RNA, 15 nt, Staphylococcus aureus subsp. aureus MW2
aucuuaaucuaaaaa

SEQ ID NO: 4025586 - RNA, 12 nt, Staphylococcus aureus subsp. aureus MW2
aucuuaaugcua

SEQ ID NO: 4025587 - RNA, 19 nt, Staphylococcus aureus subsp. aureus MW2
aucuuacauugauaaaaua

SEQ ID NO: 4025588 - RNA, 19 nt, Staphylococcus aureus subsp. aureus MW2
aucuuacugcuuuuuuaaa

SEQ ID NO: 4025589 - RNA, 22 nt, Staphylococcus aureus subsp. aureus MW2
aucuuagacgcuguuuuaaauu

SEQ ID NO: 4025590 - RNA, 20 nt, Staphylococcus aureus subsp. aureus MW2
aucuuaggugucaucgcuuu

SEQ ID NO: 4025591 - RNA, 20 nt, Staphylococcus aureus subsp. aureus MW2
aucuuauaacaaaaauugcu

SEQ ID NO: 4025592 - RNA, 22 nt, Staphylococcus aureus subsp. aureus MW2
aucuuauaacaaaaauugcuau

SEQ ID NO: 4025593 - RNA, 18 nt, Staphylococcus aureus subsp. aureus MW2
aucuuaugacugcuuuuu

SEQ ID NO: 4025594 - RNA, 20 nt, Staphylococcus aureus subsp. aureus MW2
aucuuaugauacuuugaaag

SEQ ID NO: 4025595 - RNA, 22 nt, Staphylococcus aureus subsp. aureus MW2
aucuuaugauacuuugaaagaa

SEQ ID NO: 4025596 - RNA, 22 nt, Staphylococcus aureus subsp. aureus MW2
aucuucaacauaacucaaauau

SEQ ID NO: 4025597 - RNA, 23 nt, Staphylococcus aureus subsp. aureus MW2
aucuucaacauaacucaaauauc

SEQ ID NO: 4025598 - RNA, 22 nt, Staphylococcus aureus subsp. aureus MW2
aucuucaagugccauuuuuaaa

SEQ ID NO: 4025599 - RNA, 16 nt, Staphylococcus aureus subsp. aureus MW2
aucuucaauauuuaaa

SEQ ID NO: 4025600 - RNA, 18 nt, Staphylococcus aureus subsp. aureus MW2
aucuucaauauuuaaauu

SEQ ID NO: 4025601 - RNA, 20 nt, Staphylococcus aureus subsp. aureus MW2
aucuucacgcuuauucgaac

SEQ ID NO: 4025602 - RNA, 16 nt, Staphylococcus aureus subsp. aureus MW2
aucuucccaucuuuua

SEQ ID NO: 4025603 - RNA, 22 nt, Staphylococcus aureus subsp. aureus MW2
aucuucguauaguacuaaaagu

SEQ ID NO: 4025604 - RNA, 23 nt, Staphylococcus aureus subsp. aureus MW2
aucuucuaauucguuuugcuaac

SEQ ID NO: 4025605 - RNA, 21 nt, Staphylococcus aureus subsp. aureus MW2
aucuucuuuuaauauuugaua

SEQ ID NO: 4025606 - RNA, 14 nt, Staphylococcus aureus subsp. aureus MW2
aucuucuuuuuuau

SEQ ID NO: 4025607 - RNA, 22 nt, Staphylococcus aureus subsp. aureus MW2
augaauuuagaugcauaaaaaa

SEQ ID NO: 4025608 - RNA, 22 nt, Staphylococcus aureus subsp. aureus MW2
augaauuucuaauuuaguaucu

SEQ ID NO: 4025609 - RNA, 23 nt, Staphylococcus aureus subsp. aureus MW2
augaauuucuaauuuaguaucua

SEQ ID NO: 4025610 - RNA, 16 nt, Staphylococcus aureus subsp. aureus MW2
augaauuuuaauauau

SEQ ID NO: 4025611 - RNA, 13 nt, Staphylococcus aureus subsp. aureus MW2
augaauuuuauaa

SEQ ID NO: 4025612 - RNA, 14 nt, Staphylococcus aureus subsp. aureus MW2
augaauuuuauaaa

SEQ ID NO: 4025613 - RNA, 18 nt, Staphylococcus aureus subsp. aureus MW2
augaauuuuauaaauuaa

SEQ ID NO: 4025614 - RNA, 16 nt, Staphylococcus aureus subsp. aureus MW2
augaauuuucaucauu

SEQ ID NO: 4025615 - RNA, 15 nt, Staphylococcus aureus subsp. aureus MW2
augacaaaaauaaaa

SEQ ID NO: 4025616 - RNA, 14 nt, Staphylococcus aureus subsp. aureus MW2
augacacauacacc

SEQ ID NO: 4025617 - RNA, 16 nt, Staphylococcus aureus subsp. aureus MW2
augacaccuaauacca

SEQ ID NO: 4025618 - RNA, 13 nt, Staphylococcus aureus subsp. aureus MW2
augacaucaauau

SEQ ID NO: 4025619 - RNA, 15 nt, Staphylococcus aureus subsp. aureus MW2
augacaucaauaucu

SEQ ID NO: 4025620 - RNA, 16 nt, Staphylococcus aureus subsp. aureus MW2
augacauggaaaauau

SEQ ID NO: 4025621 - RNA, 20 nt, Staphylococcus aureus subsp. aureus MW2
augacauggaaaauauauua

SEQ ID NO: 4025622 - RNA, 23 nt, Staphylococcus aureus subsp. aureus MW2
augacuaugcaaaugaaauucuu

SEQ ID NO: 4025623 - RNA, 20 nt, Staphylococcus aureus subsp. aureus MW2
augacugaauuaauauccaa

SEQ ID NO: 4025624 - RNA, 18 nt, Staphylococcus aureus subsp. aureus MW2
augacugagaaaaauauu

SEQ ID NO: 4025625 - RNA, 22 nt, Staphylococcus aureus subsp. aureus MW2
augacugagaaaaauauuucua

SEQ ID NO: 4025626 - RNA, 23 nt, Staphylococcus aureus subsp. aureus MW2
augacugagaaaaauauuucuaa

SEQ ID NO: 4025627 - RNA, 13 nt, Staphylococcus aureus subsp. aureus MW2
augacuguagaaa

SEQ ID NO: 4025628 - RNA, 23 nt, Staphylococcus aureus subsp. aureus MW2
augacuuuuuauuaguauucaaa

SEQ ID NO: 4025629 - RNA, 12 nt, Staphylococcus aureus subsp. aureus MW2
augagaaauguu

SEQ ID NO: 4025630 - RNA, 21 nt, Staphylococcus aureus subsp. aureus MW2
augagacgcauugcaagacuu

SEQ ID NO: 4025631 - RNA, 14 nt, Staphylococcus aureus subsp. aureus MW2
augagagauagaaa

SEQ ID NO: 4025632 - RNA, 21 nt, Staphylococcus aureus subsp. aureus MW2
augagaguaauguuccauaua

SEQ ID NO: 4025633 - RNA, 16 nt, Staphylococcus aureus subsp. aureus MW2
augagcucauguuuca

SEQ ID NO: 4025634 - RNA, 20 nt, Staphylococcus aureus subsp. aureus MW2
augagcucauguuucaguau

SEQ ID NO: 4025635 - RNA, 15 nt, Staphylococcus aureus subsp. aureus MW2
augagcucugaagaa

SEQ ID NO: 4025636 - RNA, 19 nt, Staphylococcus aureus subsp. aureus MW2
augagcuucuuuaaauaca

SEQ ID NO: 4025637 - RNA, 17 nt, Staphylococcus aureus subsp. aureus MW2
augagucuuuuugauua

SEQ ID NO: 4025638 - RNA, 18 nt, Staphylococcus aureus subsp. aureus MW2
augaguugaacaacuaug

SEQ ID NO: 4025639 - RNA, 20 nt, Staphylococcus aureus subsp. aureus MW2
augaguuguucagauuugua

SEQ ID NO: 4025640 - RNA, 14 nt, Staphylococcus aureus subsp. aureus MW2
augaguuuaaaaau

SEQ ID NO: 4025641 - RNA, 20 nt, Staphylococcus aureus subsp. aureus MW2
augauaaccaaucaucgcaa

SEQ ID NO: 4025642 - RNA, 19 nt, Staphylococcus aureus subsp. aureus MW2
augauaaccauuaugauua

SEQ ID NO: 4025643 - RNA, 14 nt, Staphylococcus aureus subsp. aureus MW2
augauaagaaucau

SEQ ID NO: 4025644 - RNA, 16 nt, Staphylococcus aureus subsp. aureus MW2
augauaauaagaauau

SEQ ID NO: 4025645 - RNA, 16 nt, Staphylococcus aureus subsp. aureus MW2
augauaauuaauuaaa

SEQ ID NO: 4025646 - RNA, 12 nt, Staphylococcus aureus subsp. aureus MW2
augauacauuau

SEQ ID NO: 4025647 - RNA, 18 nt, Staphylococcus aureus subsp. aureus MW2
augauacgccuaaauauu

SEQ ID NO: 4025648 - RNA, 18 nt, Staphylococcus aureus subsp. aureus MW2
augauacgcuuuuuaaaa

SEQ ID NO: 4025649 - RNA, 16 nt, Staphylococcus aureus subsp. aureus MW2
augauacucaauaaaa

SEQ ID NO: 4025650 - RNA, 17 nt, Staphylococcus aureus subsp. aureus MW2
augauacucaauaaaau

SEQ ID NO: 4025651 - RNA, 19 nt, Staphylococcus aureus subsp. aureus MW2
augauagcaaugaauuaau

SEQ ID NO: 4025652 - RNA, 16 nt, Staphylococcus aureus subsp. aureus MW2
augauauaaccgcaua

SEQ ID NO: 4025653 - RNA, 13 nt, Staphylococcus aureus subsp. aureus MW2
augauauauguaa

SEQ ID NO: 4025654 - RNA, 16 nt, Staphylococcus aureus subsp. aureus MW2
augauauccaaagcuu

SEQ ID NO: 4025655 - RNA, 16 nt, Staphylococcus aureus subsp. aureus MW2
augauauuaacuguac

SEQ ID NO: 4025656 - RNA, 16 nt, Staphylococcus aureus subsp. aureus MW2
augauauuacauauaa

SEQ ID NO: 4025657 - RNA, 20 nt, Staphylococcus aureus subsp. aureus MW2
augauauuaggcuuaaauau

SEQ ID NO: 4025658 - RNA, 14 nt, Staphylococcus aureus subsp. aureus MW2
augauauucauaua

SEQ ID NO: 4025659 - RNA, 16 nt, Staphylococcus aureus subsp. aureus MW2
augauauugaaagugu

SEQ ID NO: 4025660 - RNA, 22 nt, Staphylococcus aureus subsp. aureus MW2
augauauugaaaguguaugcau

SEQ ID NO: 4025661 - RNA, 22 nt, Staphylococcus aureus subsp. aureus MW2
augauauugauuugauucauua

SEQ ID NO: 4025662 - RNA, 19 nt, Staphylococcus aureus subsp. aureus MW2
augauauuuaacgaaaauu

SEQ ID NO: 4025663 - RNA, 16 nt, Staphylococcus aureus subsp. aureus MW2
augaucaauaagauuu

SEQ ID NO: 4025664 - RNA, 18 nt, Staphylococcus aureus subsp. aureus MW2
augaucagggaaaucauc

SEQ ID NO: 4025665 - RNA, 21 nt, Staphylococcus aureus subsp. aureus MW2
augaugaauuguuguacaugu

SEQ ID NO: 4025666 - RNA, 22 nt, Staphylococcus aureus subsp. aureus MW2
augaugacaaaaauaaaaccga

SEQ ID NO: 4025667 - RNA, 16 nt, Staphylococcus aureus subsp. aureus MW2
augaugagauaaaauc

SEQ ID NO: 4025668 - RNA, 15 nt, Staphylococcus aureus subsp. aureus MW2
augaugauaaauuga

SEQ ID NO: 4025669 - RNA, 14 nt, Staphylococcus aureus subsp. aureus MW2
augaugauuuaagu

SEQ ID NO: 4025670 - RNA, 21 nt, Staphylococcus aureus subsp. aureus MW2
augaugcugccaucaggcuuu

SEQ ID NO: 4025671 - RNA, 21 nt, Staphylococcus aureus subsp. aureus MW2
augaugcuucuaacugaauua

SEQ ID NO: 4025672 - RNA, 20 nt, Staphylococcus aureus subsp. aureus MW2
augaugggaaaucaguaaua

SEQ ID NO: 4025673 - RNA, 14 nt, Staphylococcus aureus subsp. aureus MW2
augaugucauguau

SEQ ID NO: 4025674 - RNA, 16 nt, Staphylococcus aureus subsp. aureus MW2
augaugucauguauug

SEQ ID NO: 4025675 - RNA, 21 nt, Staphylococcus aureus subsp. aureus MW2
augaugugcaaacgauauguu

SEQ ID NO: 4025676 - RNA, 15 nt, Staphylococcus aureus subsp. aureus MW2
augauguuaaaaaau

SEQ ID NO: 4025677 - RNA, 21 nt, Staphylococcus aureus subsp. aureus MW2
augauguuaaaaaauauguau

SEQ ID NO: 4025678 - RNA, 17 nt, Staphylococcus aureus subsp. aureus MW2
augauuaaaaaucaaag

SEQ ID NO: 4025679 - RNA, 16 nt, Staphylococcus aureus subsp. aureus MW2
augauuaauuaaagau

SEQ ID NO: 4025680 - RNA, 22 nt, Staphylococcus aureus subsp. aureus MW2
augauuaauuaaagauuaaaau

SEQ ID NO: 4025681 - RNA, 18 nt, Staphylococcus aureus subsp. aureus MW2
augauuacaacuuauucu

SEQ ID NO: 4025682 - RNA, 15 nt, Staphylococcus aureus subsp. aureus MW2
augauuacuaauaca

SEQ ID NO: 4025683 - RNA, 16 nt, Staphylococcus aureus subsp. aureus MW2
augauuacuuuaagau

SEQ ID NO: 4025684 - RNA, 22 nt, Staphylococcus aureus subsp. aureus MW2
augauuacuuuaagauuauuug

SEQ ID NO: 4025685 - RNA, 14 nt, Staphylococcus aureus subsp. aureus MW2
augauuaguaauga

SEQ ID NO: 4025686 - RNA, 17 nt, Staphylococcus aureus subsp. aureus MW2
augauuccaaguauuuu

SEQ ID NO: 4025687 - RNA, 15 nt, Staphylococcus aureus subsp. aureus MW2
augauugaaauccuu

SEQ ID NO: 4025688 - RNA, 16 nt, Staphylococcus aureus subsp. aureus MW2
augauugaaugaagcu

SEQ ID NO: 4025689 - RNA, 16 nt, Staphylococcus aureus subsp. aureus MW2
augauugcauugauuu

SEQ ID NO: 4025690 - RNA, 15 nt, Staphylococcus aureus subsp. aureus MW2
augauuuacuaaugc

SEQ ID NO: 4025691 - RNA, 14 nt, Staphylococcus aureus subsp. aureus MW2
augauuuauaaaaa

SEQ ID NO: 4025692 - RNA, 15 nt, Staphylococcus aureus subsp. aureus MW2
augauuuauaaaaaa

SEQ ID NO: 4025693 - RNA, 21 nt, Staphylococcus aureus subsp. aureus MW2
augauuucacuucauaaagcg

SEQ ID NO: 4025694 - RNA, 16 nt, Staphylococcus aureus subsp. aureus MW2
augauuugauauuuca

SEQ ID NO: 4025695 - RNA, 21 nt, Staphylococcus aureus subsp. aureus MW2
auggguauccuucucaucauu

SEQ ID NO: 4025696 - RNA, 23 nt, Staphylococcus aureus subsp. aureus MW2
augggucaaugacugagaaaaau

SEQ ID NO: 4025697 - RNA, 20 nt, Staphylococcus aureus subsp. aureus MW2
augguaaguauaauuaaacu

SEQ ID NO: 4025698 - RNA, 20 nt, Staphylococcus aureus subsp. aureus MW2
augguagauacauagaaagg

SEQ ID NO: 4025699 - RNA, 20 nt, Staphylococcus aureus subsp. aureus MW2
auggucaacuuuuuuaacuu

SEQ ID NO: 4025700 - RNA, 18 nt, Staphylococcus aureus subsp. aureus MW2
auggucuuuuaauauuuu

SEQ ID NO: 4025701 - RNA, 18 nt, Staphylococcus aureus subsp. aureus MW2
auggugaacuguuaaacu

SEQ ID NO: 4025702 - RNA, 22 nt, Staphylococcus aureus subsp. aureus MW2
auggugaacuguuaaacucaua

SEQ ID NO: 4025703 - RNA, 21 nt, Staphylococcus aureus subsp. aureus MW2
augguuaucacuuauuauuuu

SEQ ID NO: 4025704 - RNA, 17 nt, Staphylococcus aureus subsp. aureus MW2
augguucaaauaucauu

SEQ ID NO: 4025705 - RNA, 15 nt, Staphylococcus aureus subsp. aureus MW2
augguugaucgaaua

SEQ ID NO: 4025706 - RNA, 20 nt, Staphylococcus aureus subsp. aureus MW2
augguugauuacaauuguuc

SEQ ID NO: 4025707 - RNA, 19 nt, Staphylococcus aureus subsp. aureus MW2
augguugauucgauaugaa

SEQ ID NO: 4025708 - RNA, 17 nt, Staphylococcus aureus subsp. aureus MW2
augguuuaucuuuuuca

SEQ ID NO: 4025709 - RNA, 13 nt, Staphylococcus aureus subsp. aureus MW2
augguuucaaaau

SEQ ID NO: 4025710 - RNA, 18 nt, Staphylococcus aureus subsp. aureus MW2
augguuucaaaaucaauu

SEQ ID NO: 4025711 - RNA, 15 nt, Staphylococcus aureus subsp. aureus MW2
augguuucauaaacu

SEQ ID NO: 4025712 - RNA, 21 nt, Staphylococcus aureus subsp. aureus MW2
augguuuucuuuuuaucauga

SEQ ID NO: 4025713 - RNA, 20 nt, Staphylococcus aureus subsp. aureus MW2
augguuuucuuuuucuauac

SEQ ID NO: 4025714 - RNA, 13 nt, Staphylococcus aureus subsp. aureus MW2
auguaaaaaauau

SEQ ID NO: 4025715 - RNA, 18 nt, Staphylococcus aureus subsp. aureus MW2
auguaaaaaauaucuugu

SEQ ID NO: 4025716 - RNA, 20 nt, Staphylococcus aureus subsp. aureus MW2
auguaaaaaauaucuuguca

SEQ ID NO: 4025717 - RNA, 19 nt, Staphylococcus aureus subsp. aureus MW2
auguaaagaguacagcggu

SEQ ID NO: 4025718 - RNA, 19 nt, Staphylococcus aureus subsp. aureus MW2
auguaaagccaccuaaauc

SEQ ID NO: 4025719 - RNA, 15 nt, Staphylococcus aureus subsp. aureus MW2
auguaaauaaaaauu

SEQ ID NO: 4025720 - RNA, 18 nt, Staphylococcus aureus subsp. aureus MW2
auguaaauaaaaauuaua

SEQ ID NO: 4025721 - RNA, 19 nt, Staphylococcus aureus subsp. aureus MW2
auguaaauaaaaauuauau

SEQ ID NO: 4025722 - RNA, 17 nt, Staphylococcus aureus subsp. aureus MW2
auguaaaugaaauaggu

SEQ ID NO: 4025723 - RNA, 13 nt, Staphylococcus aureus subsp. aureus MW2
auguaacaaacaa

SEQ ID NO: 4025724 - RNA, 20 nt, Staphylococcus aureus subsp. aureus MW2
auguaacagugugaaauaau

SEQ ID NO: 4025725 - RNA, 13 nt, Staphylococcus aureus subsp. aureus MW2
auguaacauaaag

SEQ ID NO: 4025726 - RNA, 15 nt, Staphylococcus aureus subsp. aureus MW2
auguaacguaaaaau

SEQ ID NO: 4025727 - RNA, 18 nt, Staphylococcus aureus subsp. aureus MW2
auguaacguuucuuugua

SEQ ID NO: 4025728 - RNA, 17 nt, Staphylococcus aureus subsp. aureus MW2
auguaagcuaucguaaa

SEQ ID NO: 4025729 - RNA, 15 nt, Staphylococcus aureus subsp. aureus MW2
auguaaucagguuua

SEQ ID NO: 4025730 - RNA, 14 nt, Staphylococcus aureus subsp. aureus MW2
auguaaugaaucaa

SEQ ID NO: 4025731 - RNA, 21 nt, Staphylococcus aureus subsp. aureus MW2
auguaaugauacaaacccaua

SEQ ID NO: 4025732 - RNA, 22 nt, Staphylococcus aureus subsp. aureus MW2
auguaauuauugcaucauaauu

SEQ ID NO: 4025733 - RNA, 12 nt, Staphylococcus aureus subsp. aureus MW2
auguaauuauuu

SEQ ID NO: 4025734 - RNA, 13 nt, Staphylococcus aureus subsp. aureus MW2
auguaauuauuuu

SEQ ID NO: 4025735 - RNA, 16 nt, Staphylococcus aureus subsp. aureus MW2
auguaauuauuuuucu

SEQ ID NO: 4025736 - RNA, 18 nt, Staphylococcus aureus subsp. aureus MW2
auguacaauuuuuaaaaa

SEQ ID NO: 4025737 - RNA, 20 nt, Staphylococcus aureus subsp. aureus MW2
auguacacgagucauuaaau

SEQ ID NO: 4025738 - RNA, 18 nt, Staphylococcus aureus subsp. aureus MW2
auguacauuguaaauaua

SEQ ID NO: 4025739 - RNA, 15 nt, Staphylococcus aureus subsp. aureus MW2
auguaccgaauccuu

SEQ ID NO: 4025740 - RNA, 22 nt, Staphylococcus aureus subsp. aureus MW2
auguaccgaauccuucaucaau

SEQ ID NO: 4025741 - RNA, 18 nt, Staphylococcus aureus subsp. aureus MW2
auguacguuuuuuuaaau

SEQ ID NO: 4025742 - RNA, 23 nt, Staphylococcus aureus subsp. aureus MW2
auguacguuuuuuuaaauacaua

SEQ ID NO: 4025743 - RNA, 15 nt, Staphylococcus aureus subsp. aureus MW2
auguacuaccuacuu

SEQ ID NO: 4025744 - RNA, 21 nt, Staphylococcus aureus subsp. aureus MW2
auguacuaccuacuuguucaa

SEQ ID NO: 4025745 - RNA, 22 nt, Staphylococcus aureus subsp. aureus MW2
auguacuuuucugucuguaaau

SEQ ID NO: 4025746 - RNA, 13 nt, Staphylococcus aureus subsp. aureus MW2
auguagcuuugug

SEQ ID NO: 4025747 - RNA, 22 nt, Staphylococcus aureus subsp. aureus MW2
auguagugaaagucguuguuga

SEQ ID NO: 4025748 - RNA, 19 nt, Staphylococcus aureus subsp. aureus MW2
auguauaaaacagaauuuc

SEQ ID NO: 4025749 - RNA, 13 nt, Staphylococcus aureus subsp. aureus MW2
auguauaguaacg

SEQ ID NO: 4025750 - RNA, 20 nt, Staphylococcus aureus subsp. aureus MW2
auguauaguguuaauguuug

SEQ ID NO: 4025751 - RNA, 18 nt, Staphylococcus aureus subsp. aureus MW2
auguauauggcaucauca

SEQ ID NO: 4025752 - RNA, 15 nt, Staphylococcus aureus subsp. aureus MW2
auguaugacauaaac

SEQ ID NO: 4025753 - RNA, 13 nt, Staphylococcus aureus subsp. aureus MW2
auguaugcuugua

SEQ ID NO: 4025754 - RNA, 22 nt, Staphylococcus aureus subsp. aureus MW2
auguauguuuuaucaauauuag

SEQ ID NO: 4025755 - RNA, 15 nt, Staphylococcus aureus subsp. aureus MW2
auguauuaaauuuca

SEQ ID NO: 4025756 - RNA, 23 nt, Staphylococcus aureus subsp. aureus MW2
auguauuaauugaauugauuaua

SEQ ID NO: 4025757 - RNA, 23 nt, Staphylococcus aureus subsp. aureus MW2
auguauuuaguaucauaauagcc

SEQ ID NO: 4025758 - RNA, 15 nt, Staphylococcus aureus subsp. aureus MW2
augucacauaugacu

SEQ ID NO: 4025759 - RNA, 18 nt, Staphylococcus aureus subsp. aureus MW2
augucagucguuguauaa

SEQ ID NO: 4025760 - RNA, 21 nt, Staphylococcus aureus subsp. aureus MW2
augucauagccuauuuaaaag

SEQ ID NO: 4025761 - RNA, 23 nt, Staphylococcus aureus subsp. aureus MW2
augucauaucuuuauuugauucu

SEQ ID NO: 4025762 - RNA, 16 nt, Staphylococcus aureus subsp. aureus MW2
augucaugaauuuuca

SEQ ID NO: 4025763 - RNA, 17 nt, Staphylococcus aureus subsp. aureus MW2
augucauguauugucca

SEQ ID NO: 4025764 - RNA, 17 nt, Staphylococcus aureus subsp. aureus MW2
augucauuugaauccaa

SEQ ID NO: 4025765 - RNA, 23 nt, Staphylococcus aureus subsp. aureus MW2
auguccaucuuuuauuaaagaaa

SEQ ID NO: 4025766 - RNA, 15 nt, Staphylococcus aureus subsp. aureus MW2
auguccugaauguuc

SEQ ID NO: 4025767 - RNA, 16 nt, Staphylococcus aureus subsp. aureus MW2
augucgauauuucuag

SEQ ID NO: 4025768 - RNA, 18 nt, Staphylococcus aureus subsp. aureus MW2
augucgcacuauaaaauu

SEQ ID NO: 4025769 - RNA, 20 nt, Staphylococcus aureus subsp. aureus MW2
augucgcacuauaaaauuca

SEQ ID NO: 4025770 - RNA, 17 nt, Staphylococcus aureus subsp. aureus MW2
augucguuuucuuaaac

SEQ ID NO: 4025771 - RNA, 14 nt, Staphylococcus aureus subsp. aureus MW2
augucuaaaaaugu

SEQ ID NO: 4025772 - RNA, 14 nt, Staphylococcus aureus subsp. aureus MW2
augucuagauuuca

SEQ ID NO: 4025773 - RNA, 22 nt, Staphylococcus aureus subsp. aureus MW2
augucuagauuucaaaucaaua

SEQ ID NO: 4025774 - RNA, 18 nt, Staphylococcus aureus subsp. aureus MW2
augucucagauucauauc

SEQ ID NO: 4025775 - RNA, 19 nt, Staphylococcus aureus subsp. aureus MW2
augucucagauucauaucu

SEQ ID NO: 4025776 - RNA, 22 nt, Staphylococcus aureus subsp. aureus MW2
augucuuaggcgcuacaauguu

SEQ ID NO: 4025777 - RNA, 15 nt, Staphylococcus aureus subsp. aureus MW2
augucuuaucaauua

SEQ ID NO: 4025778 - RNA, 15 nt, Staphylococcus aureus subsp. aureus MW2
augucuuugaaaaau

SEQ ID NO: 4025779 - RNA, 16 nt, Staphylococcus aureus subsp. aureus MW2
augucuuugaaaaauu

SEQ ID NO: 4025780 - RNA, 17 nt, Staphylococcus aureus subsp. aureus MW2
augugaaaaagcuaauu

SEQ ID NO: 4025781 - RNA, 17 nt, Staphylococcus aureus subsp. aureus MW2
augugaauguuuugugu

SEQ ID NO: 4025782 - RNA, 15 nt, Staphylococcus aureus subsp. aureus MW2
augugacauaccagu

SEQ ID NO: 4025783 - RNA, 18 nt, Staphylococcus aureus subsp. aureus MW2
auuaaagcaucgaacaau

SEQ ID NO: 4025784 - RNA, 20 nt, Staphylococcus aureus subsp. aureus MW2
auuaaagcuagaaacaaugc

SEQ ID NO: 4025785 - RNA, 14 nt, Staphylococcus aureus subsp. aureus MW2
auuaaaguaaaaua

SEQ ID NO: 4025786 - RNA, 17 nt, Staphylococcus aureus subsp. aureus MW2
auuaaaguguuucaaca

SEQ ID NO: 4025787 - RNA, 21 nt, Staphylococcus aureus subsp. aureus MW2
auuaaaguguuucaacauauu

SEQ ID NO: 4025788 - RNA, 16 nt, Staphylococcus aureus subsp. aureus MW2
auuaaaguuaaagacu

SEQ ID NO: 4025789 - RNA, 16 nt, Staphylococcus aureus subsp. aureus MW2
auuaaaguugauuuug

SEQ ID NO: 4025790 - RNA, 13 nt, Staphylococcus aureus subsp. aureus MW2
auuaaauaacuca

SEQ ID NO: 4025791 - RNA, 11 nt, Staphylococcus aureus subsp. aureus MW2
auuaaauagau

SEQ ID NO: 4025792 - RNA, 17 nt, Staphylococcus aureus subsp. aureus MW2
auuaaauagcuuuacuu

SEQ ID NO: 4025793 - RNA, 22 nt, Staphylococcus aureus subsp. aureus MW2
auuaaauauuuaaccuuuaaaa

SEQ ID NO: 4025794 - RNA, 23 nt, Staphylococcus aureus subsp. aureus MW2
auuaaauccgcuuguucaacuaa

SEQ ID NO: 4025795 - RNA, 16 nt, Staphylococcus aureus subsp. aureus MW2
auuaaaucgauuaaga

SEQ ID NO: 4025796 - RNA, 18 nt, Staphylococcus aureus subsp. aureus MW2
auuaaaucguauauuaaa

SEQ ID NO: 4025797 - RNA, 13 nt, Staphylococcus aureus subsp. aureus MW2
auuaaaucugcuu

SEQ ID NO: 4025798 - RNA, 20 nt, Staphylococcus aureus subsp. aureus MW2
auuaaaucuucuaguaauuc

SEQ ID NO: 4025799 - RNA, 22 nt, Staphylococcus aureus subsp. aureus MW2
auuaaaugaugcaguaaaacca

SEQ ID NO: 4025800 - RNA, 12 nt, Staphylococcus aureus subsp. aureus MW2
auuaaaugcaau

SEQ ID NO: 4025801 - RNA, 19 nt, Staphylococcus aureus subsp. aureus MW2
auuaaauguacauuguaaa

SEQ ID NO: 4025802 - RNA, 19 nt, Staphylococcus aureus subsp. aureus MW2
auuaaauuauauguuuuua

SEQ ID NO: 4025803 - RNA, 22 nt, Staphylococcus aureus subsp. aureus MW2
auuaaauuauauguuuuuauua

SEQ ID NO: 4025804 - RNA, 19 nt, Staphylococcus aureus subsp. aureus MW2
auuaaauuuacaaaaacua

SEQ ID NO: 4025805 - RNA, 21 nt, Staphylococcus aureus subsp. aureus MW2
auuaaauuucaaauauaaaaa

SEQ ID NO: 4025806 - RNA, 11 nt, Staphylococcus aureus subsp. aureus MW2
auuaaauuuug

SEQ ID NO: 4025807 - RNA, 22 nt, Staphylococcus aureus subsp. aureus MW2
auuaaauuuuggcgucaucauu

SEQ ID NO: 4025808 - RNA, 19 nt, Staphylococcus aureus subsp. aureus MW2
auuaaauuuuguauaaccu

SEQ ID NO: 4025809 - RNA, 17 nt, Staphylococcus aureus subsp. aureus MW2
auuaacaacaaauauaa

SEQ ID NO: 4025810 - RNA, 17 nt, Staphylococcus aureus subsp. aureus MW2
auuaacaauauuaaauu

SEQ ID NO: 4025811 - RNA, 15 nt, Staphylococcus aureus subsp. aureus MW2
auuaacauaauaaua

SEQ ID NO: 4025812 - RNA, 11 nt, Staphylococcus aureus subsp. aureus MW2
auuaacaucau

SEQ ID NO: 4025813 - RNA, 23 nt, Staphylococcus aureus subsp. aureus MW2
auuaacauuuugaaucauacgaa

SEQ ID NO: 4025814 - RNA, 15 nt, Staphylococcus aureus subsp. aureus MW2
auuaaccauuucuuu

SEQ ID NO: 4025815 - RNA, 22 nt, Staphylococcus aureus subsp. aureus MW2
auuaaccauuucuuuuuucaau

SEQ ID NO: 4025816 - RNA, 13 nt, Staphylococcus aureus subsp. aureus MW2
auuaaccccuuca

SEQ ID NO: 4025817 - RNA, 19 nt, Staphylococcus aureus subsp. aureus MW2
auuaaccuugauuuaauuu

SEQ ID NO: 4025818 - RNA, 19 nt, Staphylococcus aureus subsp. aureus MW2
auuaacgcuuauacuauau

SEQ ID NO: 4025819 - RNA, 16 nt, Staphylococcus aureus subsp. aureus MW2
auuaacgucaacagca

SEQ ID NO: 4025820 - RNA, 14 nt, Staphylococcus aureus subsp. aureus MW2
auuaacguguacac

SEQ ID NO: 4025821 - RNA, 15 nt, Staphylococcus aureus subsp. aureus MW2
auuaacuaauaacua

SEQ ID NO: 4025822 - RNA, 20 nt, Staphylococcus aureus subsp. aureus MW2
auuaacuuaaaauuuaaaua

SEQ ID NO: 4025823 - RNA, 21 nt, Staphylococcus aureus subsp. aureus MW2
auuaacuuacuuuuguaaaaa

SEQ ID NO: 4025824 - RNA, 16 nt, Staphylococcus aureus subsp. aureus MW2
auuaacuugauaucau

SEQ ID NO: 4025825 - RNA, 16 nt, Staphylococcus aureus subsp. aureus MW2
auuaagaugaaauacu

SEQ ID NO: 4025826 - RNA, 17 nt, Staphylococcus aureus subsp. aureus MW2
auuaagaugaaauacuu

SEQ ID NO: 4025827 - RNA, 19 nt, Staphylococcus aureus subsp. aureus MW2
auuaagcaugacacucauu

SEQ ID NO: 4025828 - RNA, 21 nt, Staphylococcus aureus subsp. aureus MW2
auuaagccaucccaacuuaau

SEQ ID NO: 4025829 - RNA, 15 nt, Staphylococcus aureus subsp. aureus MW2
auuaagcuaugcuuu

SEQ ID NO: 4025830 - RNA, 19 nt, Staphylococcus aureus subsp. aureus MW2
auuaagcuugaaacaaggu

SEQ ID NO: 4025831 - RNA, 14 nt, Staphylococcus aureus subsp. aureus MW2
auuaagcuuuguuu

SEQ ID NO: 4025832 - RNA, 15 nt, Staphylococcus aureus subsp. aureus MW2
auuaaguauaucuuu

SEQ ID NO: 4025833 - RNA, 16 nt, Staphylococcus aureus subsp. aureus MW2
auuaagugcaauaaca

SEQ ID NO: 4025834 - RNA, 14 nt, Staphylococcus aureus subsp. aureus MW2
auuaauaaaacugc

SEQ ID NO: 4025835 - RNA, 14 nt, Staphylococcus aureus subsp. aureus MW2
auuaauaauuaaac

SEQ ID NO: 4025836 - RNA, 15 nt, Staphylococcus aureus subsp. aureus MW2
auuaauacaucaaua

SEQ ID NO: 4025837 - RNA, 14 nt, Staphylococcus aureus subsp. aureus MW2
auuaauagaaagug

SEQ ID NO: 4025838 - RNA, 15 nt, Staphylococcus aureus subsp. aureus MW2
auuaauagaaagugc

SEQ ID NO: 4025839 - RNA, 20 nt, Staphylococcus aureus subsp. aureus MW2
auuaauagagaaaaaauaaa

SEQ ID NO: 4025840 - RNA, 12 nt, Staphylococcus aureus subsp. aureus MW2
auuaauagagac

SEQ ID NO: 4025841 - RNA, 20 nt, Staphylococcus aureus subsp. aureus MW2
auuaauaggauuauuaucaa

SEQ ID NO: 4025842 - RNA, 16 nt, Staphylococcus aureus subsp. aureus MW2
auuaauagguuauuug

SEQ ID NO: 4025843 - RNA, 16 nt, Staphylococcus aureus subsp. aureus MW2
auuaauauaaaauaaa

SEQ ID NO: 4025844 - RNA, 20 nt, Staphylococcus aureus subsp. aureus MW2
auuaauauaaauaucaauug

SEQ ID NO: 4025845 - RNA, 21 nt, Staphylococcus aureus subsp. aureus MW2
auuaauauaagucuauuaugu

SEQ ID NO: 4025846 - RNA, 13 nt, Staphylococcus aureus subsp. aureus MW2
auuaauauauaua

SEQ ID NO: 4025847 - RNA, 14 nt, Staphylococcus aureus subsp. aureus MW2
auuaauauugagac

SEQ ID NO: 4025848 - RNA, 13 nt, Staphylococcus aureus subsp. aureus MW2
auuaaucaaauau

SEQ ID NO: 4025849 - RNA, 17 nt, Staphylococcus aureus subsp. aureus MW2
auuaauccacaaauaac

SEQ ID NO: 4025850 - RNA, 17 nt, Staphylococcus aureus subsp. aureus MW2
auuaaucguauuuuuaa

SEQ ID NO: 4025851 - RNA, 15 nt, Staphylococcus aureus subsp. aureus MW2
auuaaucuguaaugc

SEQ ID NO: 4025852 - RNA, 15 nt, Staphylococcus aureus subsp. aureus MW2
auuaauggcaacuaa

SEQ ID NO: 4025853 - RNA, 18 nt, Staphylococcus aureus subsp. aureus MW2
auuaauggcaacuaagau

SEQ ID NO: 4025854 - RNA, 13 nt, Staphylococcus aureus subsp. aureus MW2
auuaaugucacau

SEQ ID NO: 4025855 - RNA, 15 nt, Staphylococcus aureus subsp. aureus MW2
auuaauuaaaagccc

SEQ ID NO: 4025856 - RNA, 14 nt, Staphylococcus aureus subsp. aureus MW2
auuaauuaaagauu

SEQ ID NO: 4025857 - RNA, 12 nt, Staphylococcus aureus subsp. aureus MW2
auuaauuaacaa

SEQ ID NO: 4025858 - RNA, 12 nt, Staphylococcus aureus subsp. aureus MW2
auuaauuacagc

SEQ ID NO: 4025859 - RNA, 21 nt, Staphylococcus aureus subsp. aureus MW2
auuaauuacuguaaauaugaa

SEQ ID NO: 4025860 - RNA, 22 nt, Staphylococcus aureus subsp. aureus MW2
auuaauuauaaguagugauuuu

SEQ ID NO: 4025861 - RNA, 12 nt, Staphylococcus aureus subsp. aureus MW2
auuaauuaucau

SEQ ID NO: 4025862 - RNA, 15 nt, Staphylococcus aureus subsp. aureus MW2
auuaauuaucauaaa

SEQ ID NO: 4025863 - RNA, 17 nt, Staphylococcus aureus subsp. aureus MW2
auuaauuaucuuaaguc

SEQ ID NO: 4025864 - RNA, 21 nt, Staphylococcus aureus subsp. aureus MW2
auuaauuauugagaauauuua

SEQ ID NO: 4025865 - RNA, 17 nt, Staphylococcus aureus subsp. aureus MW2
auuaauucuucuucagu

SEQ ID NO: 4025866 - RNA, 13 nt, Staphylococcus aureus subsp. aureus MW2
auuaauugaaaaa

SEQ ID NO: 4025867 - RNA, 13 nt, Staphylococcus aureus subsp. aureus MW2
auuaauuuaaaaa

SEQ ID NO: 4025868 - RNA, 15 nt, Staphylococcus aureus subsp. aureus MW2
auuaauuuaaaaaug

SEQ ID NO: 4025869 - RNA, 17 nt, Staphylococcus aureus subsp. aureus MW2
auuaauuuauaauuucu

SEQ ID NO: 4025870 - RNA, 20 nt, Staphylococcus aureus subsp. aureus MW2
auuaauuuucucaaacuauc

SEQ ID NO: 4025871 - RNA, 11 nt, Staphylococcus aureus subsp. aureus MW2
auuaauuuuuc

SEQ ID NO: 4025872 - RNA, 14 nt, Staphylococcus aureus subsp. aureus MW2
auuaucaacuuuau

SEQ ID NO: 4025873 - RNA, 18 nt, Staphylococcus aureus subsp. aureus MW2
auuaucaccuucaaacuu

SEQ ID NO: 4025874 - RNA, 17 nt, Staphylococcus aureus subsp. aureus MW2
auuaucauaaauauaag

SEQ ID NO: 4025875 - RNA, 22 nt, Staphylococcus aureus subsp. aureus MW2
auuaucauuacagauaauuauu

SEQ ID NO: 4025876 - RNA, 15 nt, Staphylococcus aureus subsp. aureus MW2
auuaucguaaaaaaa

SEQ ID NO: 4025877 - RNA, 15 nt, Staphylococcus aureus subsp. aureus MW2
auuaucuaaagaaau

SEQ ID NO: 4025878 - RNA, 22 nt, Staphylococcus aureus subsp. aureus MW2
auuaucuaaagaaaucucuauc

SEQ ID NO: 4025879 - RNA, 13 nt, Staphylococcus aureus subsp. aureus MW2
auuaucuaacuca

SEQ ID NO: 4025880 - RNA, 16 nt, Staphylococcus aureus subsp. aureus MW2
auuaucuaauucuucu

SEQ ID NO: 4025881 - RNA, 13 nt, Staphylococcus aureus subsp. aureus MW2
auuaucuauauau

SEQ ID NO: 4025882 - RNA, 15 nt, Staphylococcus aureus subsp. aureus MW2
auuaucuauccauuu

SEQ ID NO: 4025883 - RNA, 20 nt, Staphylococcus aureus subsp. aureus MW2
auuaucuauccauuugguuu

SEQ ID NO: 4025884 - RNA, 22 nt, Staphylococcus aureus subsp. aureus MW2
auuaucuauccauuugguuuaa

SEQ ID NO: 4025885 - RNA, 16 nt, Staphylococcus aureus subsp. aureus MW2
auuaucuguaauuaau

SEQ ID NO: 4025886 - RNA, 22 nt, Staphylococcus aureus subsp. aureus MW2
auuaucuguaauuaauccaucu

SEQ ID NO: 4025887 - RNA, 20 nt, Staphylococcus aureus subsp. aureus MW2
auuaucuuaagucaucaauc

SEQ ID NO: 4025888 - RNA, 13 nt, Staphylococcus aureus subsp. aureus MW2
auuaucuuuaaau

SEQ ID NO: 4025889 - RNA, 17 nt, Staphylococcus aureus subsp. aureus MW2
auuaucuuuaguauuuc

SEQ ID NO: 4025890 - RNA, 22 nt, Staphylococcus aureus subsp. aureus MW2
auuaucuuuaguauuucaucau

SEQ ID NO: 4025891 - RNA, 18 nt, Staphylococcus aureus subsp. aureus MW2
auuaugaacaugaaauua

SEQ ID NO: 4025892 - RNA, 13 nt, Staphylococcus aureus subsp. aureus MW2
auuaugacaacau

SEQ ID NO: 4025893 - RNA, 16 nt, Staphylococcus aureus subsp. aureus MW2
auuaugacaagagacu

SEQ ID NO: 4025894 - RNA, 20 nt, Staphylococcus aureus subsp. aureus MW2
auuaugauacgcuuuuuaaa

SEQ ID NO: 4025895 - RNA, 15 nt, Staphylococcus aureus subsp. aureus MW2
auuaugauuaauccu

SEQ ID NO: 4025896 - RNA, 17 nt, Staphylococcus aureus subsp. aureus MW2
auuaugauuauuuuucu

SEQ ID NO: 4025897 - RNA, 13 nt, Staphylococcus aureus subsp. aureus MW2
auuaugcauaugu

SEQ ID NO: 4025898 - RNA, 20 nt, Staphylococcus aureus subsp. aureus MW2
auuaugcauauguaauacaa

SEQ ID NO: 4025899 - RNA, 14 nt, Staphylococcus aureus subsp. aureus MW2
auuaugcugaaacu

SEQ ID NO: 4025900 - RNA, 15 nt, Staphylococcus aureus subsp. aureus MW2
auuaugcuucaaagu

SEQ ID NO: 4025901 - RNA, 20 nt, Staphylococcus aureus subsp. aureus MW2
auuaugcuugccacugcaau

SEQ ID NO: 4025902 - RNA, 14 nt, Staphylococcus aureus subsp. aureus MW2
auuauguaaaaaau

SEQ ID NO: 4025903 - RNA, 18 nt, Staphylococcus aureus subsp. aureus MW2
auuauguaaaaaauaucu

SEQ ID NO: 4025904 - RNA, 23 nt, Staphylococcus aureus subsp. aureus MW2
auuauguaaauugguauaacaau

SEQ ID NO: 4025905 - RNA, 16 nt, Staphylococcus aureus subsp. aureus MW2
auuauguaccaaauuu

SEQ ID NO: 4025906 - RNA, 13 nt, Staphylococcus aureus subsp. aureus MW2
auuauguauuuuu

SEQ ID NO: 4025907 - RNA, 14 nt, Staphylococcus aureus subsp. aureus MW2
auuauguguauauu

SEQ ID NO: 4025908 - RNA, 17 nt, Staphylococcus aureus subsp. aureus MW2
auuauguuauaaauucu

SEQ ID NO: 4025909 - RNA, 14 nt, Staphylococcus aureus subsp. aureus MW2
auuauuaacuguac

SEQ ID NO: 4025910 - RNA, 22 nt, Staphylococcus aureus subsp. aureus MW2
auuauuaacuguaccugcuaca

SEQ ID NO: 4025911 - RNA, 20 nt, Staphylococcus aureus subsp. aureus MW2
auuauuaaggggguaauacu

SEQ ID NO: 4025912 - RNA, 21 nt, Staphylococcus aureus subsp. aureus MW2
auuauuaaggggguaauacua

SEQ ID NO: 4025913 - RNA, 19 nt, Staphylococcus aureus subsp. aureus MW2
auuauuaagugaguuuuau

SEQ ID NO: 4025914 - RNA, 14 nt, Staphylococcus aureus subsp. aureus MW2
auuauuacaaucaa

SEQ ID NO: 4025915 - RNA, 22 nt, Staphylococcus aureus subsp. aureus MW2
auuauuacaaucaaaaaacgag

SEQ ID NO: 4025916 - RNA, 13 nt, Staphylococcus aureus subsp. aureus MW2
auuauuaccauau

SEQ ID NO: 4025917 - RNA, 18 nt, Staphylococcus aureus subsp. aureus MW2
auuauuaccuuugcuaaa

SEQ ID NO: 4025918 - RNA, 15 nt, Staphylococcus aureus subsp. aureus MW2
auuauuaguuuugaa

SEQ ID NO: 4025919 - RNA, 16 nt, Staphylococcus aureus subsp. aureus MW2
auuauuauaauaaaua

SEQ ID NO: 4025920 - RNA, 20 nt, Staphylococcus aureus subsp. aureus MW2
auuauuauguguauauuauu

SEQ ID NO: 4025921 - RNA, 13 nt, Staphylococcus aureus subsp. aureus MW2
auuauuauucuaa

SEQ ID NO: 4025922 - RNA, 17 nt, Staphylococcus aureus subsp. aureus MW2
auuauucaaguaaaaca

SEQ ID NO: 4025923 - RNA, 20 nt, Staphylococcus aureus subsp. aureus MW2
auuauucauaauauauuaac

SEQ ID NO: 4025924 - RNA, 23 nt, Staphylococcus aureus subsp. aureus MW2
auuauucguauucaaaguuuuca

SEQ ID NO: 4025925 - RNA, 14 nt, Staphylococcus aureus subsp. aureus MW2
auuauucguuucuu

SEQ ID NO: 4025926 - RNA, 14 nt, Staphylococcus aureus subsp. aureus MW2
auuauucucuuuau

SEQ ID NO: 4025927 - RNA, 17 nt, Staphylococcus aureus subsp. aureus MW2
auuauucuucauuuaua

SEQ ID NO: 4025928 - RNA, 14 nt, Staphylococcus aureus subsp. aureus MW2
auuauucuuuaauu

SEQ ID NO: 4025929 - RNA, 17 nt, Staphylococcus aureus subsp. aureus MW2
auuauucuuuaauuaaa

SEQ ID NO: 4025930 - RNA, 16 nt, Staphylococcus aureus subsp. aureus MW2
auuauugaaacuaaua

SEQ ID NO: 4025931 - RNA, 18 nt, Staphylococcus aureus subsp. aureus MW2
auuauugguugaaauuaa

SEQ ID NO: 4025932 - RNA, 16 nt, Staphylococcus aureus subsp. aureus MW2
auuauuuaaaaugcuu

SEQ ID NO: 4025933 - RNA, 15 nt, Staphylococcus aureus subsp. aureus MW2
auuauuuaaucuauu

SEQ ID NO: 4025934 - RNA, 22 nt, Staphylococcus aureus subsp. aureus MW2
auuauuuagaauucuaaaagaa

SEQ ID NO: 4025935 - RNA, 18 nt, Staphylococcus aureus subsp. aureus MW2
auuauuuagauaaaaaau

SEQ ID NO: 4025936 - RNA, 16 nt, Staphylococcus aureus subsp. aureus MW2
auuauuucauuagaaa

SEQ ID NO: 4025937 - RNA, 22 nt, Staphylococcus aureus subsp. aureus MW2
auuauuucccuggaaaaugauu

SEQ ID NO: 4025938 - RNA, 17 nt, Staphylococcus aureus subsp. aureus MW2
auuauuuccuguuacuu

SEQ ID NO: 4025939 - RNA, 13 nt, Staphylococcus aureus subsp. aureus MW2
auuauuugauaaa

SEQ ID NO: 4025940 - RNA, 17 nt, Staphylococcus aureus subsp. aureus MW2
auuauuugcgauaucag

SEQ ID NO: 4025941 - RNA, 16 nt, Staphylococcus aureus subsp. aureus MW2
auuauuuuacuuugua

SEQ ID NO: 4025942 - RNA, 15 nt, Staphylococcus aureus subsp. aureus MW2
auuauuuuguauuuu

SEQ ID NO: 4025943 - RNA, 18 nt, Staphylococcus aureus subsp. aureus MW2
auuauuuuguauuuuuca

SEQ ID NO: 4025944 - RNA, 21 nt, Staphylococcus aureus subsp. aureus MW2
auuauuuuguauuuuucaaau

SEQ ID NO: 4025945 - RNA, 16 nt, Staphylococcus aureus subsp. aureus MW2
auuauuuuuauagaua

SEQ ID NO: 4025946 - RNA, 13 nt, Staphylococcus aureus subsp. aureus MW2
auuauuuuucuca

SEQ ID NO: 4025947 - RNA, 14 nt, Staphylococcus aureus subsp. aureus MW2
auuauuuuuuuaaa

SEQ ID NO: 4025948 - RNA, 13 nt, Staphylococcus aureus subsp. aureus MW2
auucaaaaaaaua

SEQ ID NO: 4025949 - RNA, 13 nt, Staphylococcus aureus subsp. aureus MW2
auucaaaaauugu

SEQ ID NO: 4025950 - RNA, 14 nt, Staphylococcus aureus subsp. aureus MW2
auucaaaaauuguu

SEQ ID NO: 4025951 - RNA, 14 nt, Staphylococcus aureus subsp. aureus MW2
auucaaaauuauau

SEQ ID NO: 4025952 - RNA, 19 nt, Staphylococcus aureus subsp. aureus MW2
auucaaauaaaucaaacuu

SEQ ID NO: 4025953 - RNA, 21 nt, Staphylococcus aureus subsp. aureus MW2
auucaaauaaaucaaacuuuu

SEQ ID NO: 4025954 - RNA, 23 nt, Staphylococcus aureus subsp. aureus MW2
auucaaauaaaucaaacuuuuca

SEQ ID NO: 4025955 - RNA, 13 nt, Staphylococcus aureus subsp. aureus MW2
auucaaaucauaa

SEQ ID NO: 4025956 - RNA, 17 nt, Staphylococcus aureus subsp. aureus MW2
auucaaccuuaauagga

SEQ ID NO: 4025957 - RNA, 21 nt, Staphylococcus aureus subsp. aureus MW2
auucaacgaaagugauuuauu

SEQ ID NO: 4025958 - RNA, 18 nt, Staphylococcus aureus subsp. aureus MW2
auucaacgucaucaaaac

SEQ ID NO: 4025959 - RNA, 15 nt, Staphylococcus aureus subsp. aureus MW2
auucaacuaauuuaa

SEQ ID NO: 4025960 - RNA, 17 nt, Staphylococcus aureus subsp. aureus MW2
auucaacuuauuauuua

SEQ ID NO: 4025961 - RNA, 14 nt, Staphylococcus aureus subsp. aureus MW2
auucuauacuuuua

SEQ ID NO: 4025962 - RNA, 16 nt, Staphylococcus aureus subsp. aureus MW2
auucuauacuuuuaau

SEQ ID NO: 4025963 - RNA, 22 nt, Staphylococcus aureus subsp. aureus MW2
auucuaucguuguuuuaacgaa

SEQ ID NO: 4025964 - RNA, 13 nt, Staphylococcus aureus subsp. aureus MW2
auucuauuuuuca

SEQ ID NO: 4025965 - RNA, 22 nt, Staphylococcus aureus subsp. aureus MW2
auucucaaagguuuacuauuaa

SEQ ID NO: 4025966 - RNA, 14 nt, Staphylococcus aureus subsp. aureus MW2
auucucauuuacuu

SEQ ID NO: 4025967 - RNA, 22 nt, Staphylococcus aureus subsp. aureus MW2
auucucuaacuuuaccaauauc

SEQ ID NO: 4025968 - RNA, 23 nt, Staphylococcus aureus subsp. aureus MW2
auucucuaacuuuaccaauauca

SEQ ID NO: 4025969 - RNA, 13 nt, Staphylococcus aureus subsp. aureus MW2
auucucuuuacca

SEQ ID NO: 4025970 - RNA, 14 nt, Staphylococcus aureus subsp. aureus MW2
auucugaaaucagu

SEQ ID NO: 4025971 - RNA, 14 nt, Staphylococcus aureus subsp. aureus MW2
auucugauacagaa

SEQ ID NO: 4025972 - RNA, 19 nt, Staphylococcus aureus subsp. aureus MW2
auucugugagguaaaacua

SEQ ID NO: 4025973 - RNA, 14 nt, Staphylococcus aureus subsp. aureus MW2
auucuuauaaaaua

SEQ ID NO: 4025974 - RNA, 15 nt, Staphylococcus aureus subsp. aureus MW2
auucuuaucuuuaau

SEQ ID NO: 4025975 - RNA, 12 nt, Staphylococcus aureus subsp. aureus MW2
auucuucaaaaa

SEQ ID NO: 4025976 - RNA, 14 nt, Staphylococcus aureus subsp. aureus MW2
auucuucaaaaaau

SEQ ID NO: 4025977 - RNA, 18 nt, Staphylococcus aureus subsp. aureus MW2
auucuucaaaaaauaaua

SEQ ID NO: 4025978 - RNA, 20 nt, Staphylococcus aureus subsp. aureus MW2
auucuucaaccauuuguucu

SEQ ID NO: 4025979 - RNA, 22 nt, Staphylococcus aureus subsp. aureus MW2
auucuucaauuucauuuuugau

SEQ ID NO: 4025980 - RNA, 22 nt, Staphylococcus aureus subsp. aureus MW2
auucuucaccaacuuuuuuaac

SEQ ID NO: 4025981 - RNA, 17 nt, Staphylococcus aureus subsp. aureus MW2
auucuucaguuuguugg

SEQ ID NO: 4025982 - RNA, 16 nt, Staphylococcus aureus subsp. aureus MW2
auucuucaucaugacu

SEQ ID NO: 4025983 - RNA, 18 nt, Staphylococcus aureus subsp. aureus MW2
auucuucaucaugacuau

SEQ ID NO: 4025984 - RNA, 20 nt, Staphylococcus aureus subsp. aureus MW2
auucuucaucaugacuauuu

SEQ ID NO: 4025985 - RNA, 17 nt, Staphylococcus aureus subsp. aureus MW2
auucuucauuuauaaca

SEQ ID NO: 4025986 - RNA, 15 nt, Staphylococcus aureus subsp. aureus MW2
auucuugaaaaguuu

SEQ ID NO: 4025987 - RNA, 15 nt, Staphylococcus aureus subsp. aureus MW2
auucuuuaauauaaa

SEQ ID NO: 4025988 - RNA, 22 nt, Staphylococcus aureus subsp. aureus MW2
auucuuuauguuggggccucgc

SEQ ID NO: 4025989 - RNA, 17 nt, Staphylococcus aureus subsp. aureus MW2
auucuuuugaguccauu

SEQ ID NO: 4025990 - RNA, 15 nt, Staphylococcus aureus subsp. aureus MW2
auucuuuuucaaaau

SEQ ID NO: 4025991 - RNA, 16 nt, Staphylococcus aureus subsp. aureus MW2
auugaaaaaauaacug

SEQ ID NO: 4025992 - RNA, 14 nt, Staphylococcus aureus subsp. aureus MW2
auugaaaaauuaaa

SEQ ID NO: 4025993 - RNA, 21 nt, Staphylococcus aureus subsp. aureus MW2
auugaaaaauuaaaaaacaaa

SEQ ID NO: 4025994 - RNA, 18 nt, Staphylococcus aureus subsp. aureus MW2
auugaaagaagucugcag

SEQ ID NO: 4025995 - RNA, 15 nt, Staphylococcus aureus subsp. aureus MW2
auugaaagauauuuc

SEQ ID NO: 4025996 - RNA, 19 nt, Staphylococcus aureus subsp. aureus MW2
auugaaagauauuucuguu

SEQ ID NO: 4025997 - RNA, 16 nt, Staphylococcus aureus subsp. aureus MW2
auugaaauaauauaaa

SEQ ID NO: 4025998 - RNA, 18 nt, Staphylococcus aureus subsp. aureus MW2
auugaaauaauauaaaaa

SEQ ID NO: 4025999 - RNA, 21 nt, Staphylococcus aureus subsp. aureus MW2
auugaaaucgucuuacugcug

SEQ ID NO: 4026000 - RNA, 16 nt, Staphylococcus aureus subsp. aureus MW2
auugaaaugauaaaaa

SEQ ID NO: 4026001 - RNA, 20 nt, Staphylococcus aureus subsp. aureus MW2
auugaacaaaaaagugguuu

SEQ ID NO: 4026002 - RNA, 23 nt, Staphylococcus aureus subsp. aureus MW2
auugaacaaaaaagugguuuaau

SEQ ID NO: 4026003 - RNA, 22 nt, Staphylococcus aureus subsp. aureus MW2
auugaacaauaauaugccaaag

SEQ ID NO: 4026004 - RNA, 13 nt, Staphylococcus aureus subsp. aureus MW2
auugaacuucuuu

SEQ ID NO: 4026005 - RNA, 16 nt, Staphylococcus aureus subsp. aureus MW2
auugaagaauauaaac

SEQ ID NO: 4026006 - RNA, 14 nt, Staphylococcus aureus subsp. aureus MW2
auugaaugaaguag

SEQ ID NO: 4026007 - RNA, 14 nt, Staphylococcus aureus subsp. aureus MW2
auugaauuaagaaa

SEQ ID NO: 4026008 - RNA, 12 nt, Staphylococcus aureus subsp. aureus MW2
auugacaucuuc

SEQ ID NO: 4026009 - RNA, 23 nt, Staphylococcus aureus subsp. aureus MW2
auugacauuaaugauagcaauga

SEQ ID NO: 4026010 - RNA, 18 nt, Staphylococcus aureus subsp. aureus MW2
auugacauucacauuauu

SEQ ID NO: 4026011 - RNA, 21 nt, Staphylococcus aureus subsp. aureus MW2
auugaccaacguucgauaacg

SEQ ID NO: 4026012 - RNA, 15 nt, Staphylococcus aureus subsp. aureus MW2
auugaccgacaaagc

SEQ ID NO: 4026013 - RNA, 19 nt, Staphylococcus aureus subsp. aureus MW2
auugacucgaccuuuauau

SEQ ID NO: 4026014 - RNA, 22 nt, Staphylococcus aureus subsp. aureus MW2
auugacucgaccuuuauaugaa

SEQ ID NO: 4026015 - RNA, 13 nt, Staphylococcus aureus subsp. aureus MW2
auugacuuuaauu

SEQ ID NO: 4026016 - RNA, 17 nt, Staphylococcus aureus subsp. aureus MW2
auugagaaauagcaaca

SEQ ID NO: 4026017 - RNA, 21 nt, Staphylococcus aureus subsp. aureus MW2
auugagaauauuaagauguau

SEQ ID NO: 4026018 - RNA, 23 nt, Staphylococcus aureus subsp. aureus MW2
auugaggaucaaaaguuguugca

SEQ ID NO: 4026019 - RNA, 22 nt, Staphylococcus aureus subsp. aureus MW2
auugaguguaugcauauaagau

SEQ ID NO: 4026020 - RNA, 16 nt, Staphylococcus aureus subsp. aureus MW2
auugaguugaaaauaa

SEQ ID NO: 4026021 - RNA, 15 nt, Staphylococcus aureus subsp. aureus MW2
auugauaaauuuuua

SEQ ID NO: 4026022 - RNA, 23 nt, Staphylococcus aureus subsp. aureus MW2
auugauagcaccguaacauaugu

SEQ ID NO: 4026023 - RNA, 12 nt, Staphylococcus aureus subsp. aureus MW2
auugauagucac

SEQ ID NO: 4026024 - RNA, 20 nt, Staphylococcus aureus subsp. aureus MW2
auugauaucccuaacauggg

SEQ ID NO: 4026025 - RNA, 13 nt, Staphylococcus aureus subsp. aureus MW2
auugauaugguua

SEQ ID NO: 4026026 - RNA, 17 nt, Staphylococcus aureus subsp. aureus MW2
auugauauuaauauauu

SEQ ID NO: 4026027 - RNA, 19 nt, Staphylococcus aureus subsp. aureus MW2
auugaucuuuuauaaugaa

SEQ ID NO: 4026028 - RNA, 20 nt, Staphylococcus aureus subsp. aureus MW2
auugaugaaagacugacuaa

SEQ ID NO: 4026029 - RNA, 14 nt, Staphylococcus aureus subsp. aureus MW2
auugaugaauaaau

SEQ ID NO: 4026030 - RNA, 21 nt, Staphylococcus aureus subsp. aureus MW2
auugaugaauaaauagauaau

SEQ ID NO: 4026031 - RNA, 20 nt, Staphylococcus aureus subsp. aureus MW2
auugaugaucaauuaacacu

SEQ ID NO: 4026032 - RNA, 13 nt, Staphylococcus aureus subsp. aureus MW2
auugaugauguac

SEQ ID NO: 4026033 - RNA, 15 nt, Staphylococcus aureus subsp. aureus MW2
auugauuaaauaaau

SEQ ID NO: 4026034 - RNA, 17 nt, Staphylococcus aureus subsp. aureus MW2
auugauuauucuuuaau

SEQ ID NO: 4026035 - RNA, 21 nt, Staphylococcus aureus subsp. aureus MW2
auugauuauucuuuaauuaaa

SEQ ID NO: 4026036 - RNA, 15 nt, Staphylococcus aureus subsp. aureus MW2
auugauucuacagcg

SEQ ID NO: 4026037 - RNA, 19 nt, Staphylococcus aureus subsp. aureus MW2
auugauucuagugaaauac

SEQ ID NO: 4026038 - RNA, 12 nt, Staphylococcus aureus subsp. aureus MW2
auugauuguuaa

SEQ ID NO: 4026039 - RNA, 15 nt, Staphylococcus aureus subsp. aureus MW2
auugcaaaaauaaua

SEQ ID NO: 4026040 - RNA, 21 nt, Staphylococcus aureus subsp. aureus MW2
auugcaaaaauaauaugaauu

SEQ ID NO: 4026041 - RNA, 22 nt, Staphylococcus aureus subsp. aureus MW2
auugcaaaacuugcgcaugcuu

SEQ ID NO: 4026042 - RNA, 14 nt, Staphylococcus aureus subsp. aureus MW2
auugcaaaugcaau

SEQ ID NO: 4026043 - RNA, 14 nt, Staphylococcus aureus subsp. aureus MW2
auugcaaaugcucu

SEQ ID NO: 4026044 - RNA, 23 nt, Staphylococcus aureus subsp. aureus MW2
auugcaagacuuggugcccaagu

SEQ ID NO: 4026045 - RNA, 13 nt, Staphylococcus aureus subsp. aureus MW2
auugcaauggcuu

SEQ ID NO: 4026046 - RNA, 22 nt, Staphylococcus aureus subsp. aureus MW2
auugcacgucuuguaucaacau

SEQ ID NO: 4026047 - RNA, 21 nt, Staphylococcus aureus subsp. aureus MW2
auugcacguuugaaugaaccu

SEQ ID NO: 4026048 - RNA, 19 nt, Staphylococcus aureus subsp. aureus MW2
auugcauacguaaauggua

SEQ ID NO: 4026049 - RNA, 23 nt, Staphylococcus aureus subsp. aureus MW2
auuuaaaaaucuacauaugaaaa

SEQ ID NO: 4026050 - RNA, 18 nt, Staphylococcus aureus subsp. aureus MW2
auuuaaaaauugaaggaa

SEQ ID NO: 4026051 - RNA, 22 nt, Staphylococcus aureus subsp. aureus MW2
auuuaaaacaaugauuaaaauu

SEQ ID NO: 4026052 - RNA, 19 nt, Staphylococcus aureus subsp. aureus MW2
auuuaaaauaauagauaau

SEQ ID NO: 4026053 - RNA, 12 nt, Staphylococcus aureus subsp. aureus MW2
auuuaaaauaua

SEQ ID NO: 4026054 - RNA, 14 nt, Staphylococcus aureus subsp. aureus MW2
auuuaaaauauuaa

SEQ ID NO: 4026055 - RNA, 21 nt, Staphylococcus aureus subsp. aureus MW2
auuuaaaaucgggcaacugag

SEQ ID NO: 4026056 - RNA, 15 nt, Staphylococcus aureus subsp. aureus MW2
auuuaaaaugauucu

SEQ ID NO: 4026057 - RNA, 19 nt, Staphylococcus aureus subsp. aureus MW2
auuuaaaauuauugacauu

SEQ ID NO: 4026058 - RNA, 19 nt, Staphylococcus aureus subsp. aureus MW2
auuuaaacaagaaaacuaa

SEQ ID NO: 4026059 - RNA, 16 nt, Staphylococcus aureus subsp. aureus MW2
auuuaaacauccaauu

SEQ ID NO: 4026060 - RNA, 20 nt, Staphylococcus aureus subsp. aureus MW2
auuuaaacauccaauuaugu

SEQ ID NO: 4026061 - RNA, 17 nt, Staphylococcus aureus subsp. aureus MW2
auuuaaacgguaacaaa

SEQ ID NO: 4026062 - RNA, 13 nt, Staphylococcus aureus subsp. aureus MW2
auuuaaacuagua

SEQ ID NO: 4026063 - RNA, 14 nt, Staphylococcus aureus subsp. aureus MW2
auuuaaacuaguaa

SEQ ID NO: 4026064 - RNA, 23 nt, Staphylococcus aureus subsp. aureus MW2
auuuaaacucauaauuuucuauu

SEQ ID NO: 4026065 - RNA, 20 nt, Staphylococcus aureus subsp. aureus MW2
auuuaaaggcauaauaacca

SEQ ID NO: 4026066 - RNA, 13 nt, Staphylococcus aureus subsp. aureus MW2
auuuaaauagaag

SEQ ID NO: 4026067 - RNA, 22 nt, Staphylococcus aureus subsp. aureus MW2
auuuaaauauaaccuaaaaaca

SEQ ID NO: 4026068 - RNA, 19 nt, Staphylococcus aureus subsp. aureus MW2
auuuaaaugcuucucuaua

SEQ ID NO: 4026069 - RNA, 16 nt, Staphylococcus aureus subsp. aureus MW2
auuuaaauuaaaauaa

SEQ ID NO: 4026070 - RNA, 23 nt, Staphylococcus aureus subsp. aureus MW2
auuuaaauuacaguuucuauauu

SEQ ID NO: 4026071 - RNA, 18 nt, Staphylococcus aureus subsp. aureus MW2
auuuaaauugacuuuaau

SEQ ID NO: 4026072 - RNA, 17 nt, Staphylococcus aureus subsp. aureus MW2
auuuaacauguauuuag

SEQ ID NO: 4026073 - RNA, 15 nt, Staphylococcus aureus subsp. aureus MW2
auuuaaccuuuaaaa

SEQ ID NO: 4026074 - RNA, 20 nt, Staphylococcus aureus subsp. aureus MW2
auuuaacucaacuuaaauau

SEQ ID NO: 4026075 - RNA, 21 nt, Staphylococcus aureus subsp. aureus MW2
auuuaacuuucccuacugcuu

SEQ ID NO: 4026076 - RNA, 21 nt, Staphylococcus aureus subsp. aureus MW2
auuuaacuuuuugugauuauu

SEQ ID NO: 4026077 - RNA, 20 nt, Staphylococcus aureus subsp. aureus MW2
auuuaauaaacaccaauauu

SEQ ID NO: 4026078 - RNA, 14 nt, Staphylococcus aureus subsp. aureus MW2
auuuaauaaaccag

SEQ ID NO: 4026079 - RNA, 12 nt, Staphylococcus aureus subsp. aureus MW2
auuuaauaaugu

SEQ ID NO: 4026080 - RNA, 23 nt, Staphylococcus aureus subsp. aureus MW2
auuuaauacuaauaacucuucua

SEQ ID NO: 4026081 - RNA, 16 nt, Staphylococcus aureus subsp. aureus MW2
auuuaauagacauuaa

SEQ ID NO: 4026082 - RNA, 23 nt, Staphylococcus aureus subsp. aureus MW2
auuuaauaucacgaucuuuaaag

SEQ ID NO: 4026083 - RNA, 12 nt, Staphylococcus aureus subsp. aureus MW2
auuuaauaugcu

SEQ ID NO: 4026084 - RNA, 19 nt, Staphylococcus aureus subsp. aureus MW2
auuuaaucguaacauauca

SEQ ID NO: 4026085 - RNA, 12 nt, Staphylococcus aureus subsp. aureus MW2
auuuaaucuauu

SEQ ID NO: 4026086 - RNA, 23 nt, Staphylococcus aureus subsp. aureus MW2
auuuaaucuauuaacugaccuaa

SEQ ID NO: 4026087 - RNA, 20 nt, Staphylococcus aureus subsp. aureus MW2
auuuaaucuuaauauuuauu

SEQ ID NO: 4026088 - RNA, 16 nt, Staphylococcus aureus subsp. aureus MW2
auuuaauguuaaacaa

SEQ ID NO: 4026089 - RNA, 21 nt, Staphylococcus aureus subsp. aureus MW2
auuuaauguuuuagugacaaa

SEQ ID NO: 4026090 - RNA, 22 nt, Staphylococcus aureus subsp. aureus MW2
auuuaauugguuucacauuguc

SEQ ID NO: 4026091 - RNA, 17 nt, Staphylococcus aureus subsp. aureus MW2
auuuaauuuuauuuugu

SEQ ID NO: 4026092 - RNA, 18 nt, Staphylococcus aureus subsp. aureus MW2
auuuaauuuuauuuugug

SEQ ID NO: 4026093 - RNA, 12 nt, Staphylococcus aureus subsp. aureus MW2
auuuacaaaaac

SEQ ID NO: 4026094 - RNA, 15 nt, Staphylococcus aureus subsp. aureus MW2
auuuacaaaaacuau

SEQ ID NO: 4026095 - RNA, 18 nt, Staphylococcus aureus subsp. aureus MW2
auuuacaaaaacuauuuu

SEQ ID NO: 4026096 - RNA, 21 nt, Staphylococcus aureus subsp. aureus MW2
auuuacaaaaacuauuuuuua

SEQ ID NO: 4026097 - RNA, 21 nt, Staphylococcus aureus subsp. aureus MW2
auuuacaauguuaucuugcuu

SEQ ID NO: 4026098 - RNA, 13 nt, Staphylococcus aureus subsp. aureus MW2
auuuacacagaau

SEQ ID NO: 4026099 - RNA, 19 nt, Staphylococcus aureus subsp. aureus MW2
auuuaccaguuugaucaua

SEQ ID NO: 4026100 - RNA, 19 nt, Staphylococcus aureus subsp. aureus MW2
auuuacccauuacauuugg

SEQ ID NO: 4026101 - RNA, 20 nt, Staphylococcus aureus subsp. aureus MW2
auuuaccucuugauaaaaua

SEQ ID NO: 4026102 - RNA, 21 nt, Staphylococcus aureus subsp. aureus MW2
auuuaccucuugauaaaauaa

SEQ ID NO: 4026103 - RNA, 22 nt, Staphylococcus aureus subsp. aureus MW2
auuuaccucuugauaaaauaaa

SEQ ID NO: 4026104 - RNA, 17 nt, Staphylococcus aureus subsp. aureus MW2
auuuaccuucaucuuuu

SEQ ID NO: 4026105 - RNA, 15 nt, Staphylococcus aureus subsp. aureus MW2
auuuaccuucuucua

SEQ ID NO: 4026106 - RNA, 23 nt, Staphylococcus aureus subsp. aureus MW2
auuuacgaaguuuaaaugugcaa

SEQ ID NO: 4026107 - RNA, 18 nt, Staphylococcus aureus subsp. aureus MW2
auuuacuccuuacaauaa

SEQ ID NO: 4026108 - RNA, 11 nt, Staphylococcus aureus subsp. aureus MW2
auuuacucuaa

SEQ ID NO: 4026109 - RNA, 16 nt, Staphylococcus aureus subsp. aureus MW2
auuuacuuuagaaaca

SEQ ID NO: 4026110 - RNA, 11 nt, Staphylococcus aureus subsp. aureus MW2
auuuagaaaua

SEQ ID NO: 4026111 - RNA, 15 nt, Staphylococcus aureus subsp. aureus MW2
auuuagauaaaaaau

SEQ ID NO: 4026112 - RNA, 18 nt, Staphylococcus aureus subsp. aureus MW2
auuuagauaaaaaauacu

SEQ ID NO: 4026113 - RNA, 19 nt, Staphylococcus aureus subsp. aureus MW2
auuuagauaaaaaauacua

SEQ ID NO: 4026114 - RNA, 20 nt, Staphylococcus aureus subsp. aureus MW2
auuuagauaaaaaauacuaa

SEQ ID NO: 4026115 - RNA, 22 nt, Staphylococcus aureus subsp. aureus MW2
auuuagauaaaaaauacuaacg

SEQ ID NO: 4026116 - RNA, 22 nt, Staphylococcus aureus subsp. aureus MW2
auuuagaucgauguguaacauu

SEQ ID NO: 4026117 - RNA, 18 nt, Staphylococcus aureus subsp. aureus MW2
auuuagaugauucuuauc

SEQ ID NO: 4026118 - RNA, 17 nt, Staphylococcus aureus subsp. aureus MW2
auuuagaugcauaaaaa

SEQ ID NO: 4026119 - RNA, 20 nt, Staphylococcus aureus subsp. aureus MW2
auuuagaugcauaaaaaaag

SEQ ID NO: 4026120 - RNA, 15 nt, Staphylococcus aureus subsp. aureus MW2
auuuagauucuuuuc

SEQ ID NO: 4026121 - RNA, 16 nt, Staphylococcus aureus subsp. aureus MW2
auuuagauuuauaacg

SEQ ID NO: 4026122 - RNA, 19 nt, Staphylococcus aureus subsp. aureus MW2
auuuagauuucauaauguu

SEQ ID NO: 4026123 - RNA, 18 nt, Staphylococcus aureus subsp. aureus MW2
auuuagcaaauauuucug

SEQ ID NO: 4026124 - RNA, 15 nt, Staphylococcus aureus subsp. aureus MW2
auuuagcaucaaaaa

SEQ ID NO: 4026125 - RNA, 21 nt, Staphylococcus aureus subsp. aureus MW2
auuuaggaguauccugauuua

SEQ ID NO: 4026126 - RNA, 23 nt, Staphylococcus aureus subsp. aureus MW2
auuuaggaguauccugauuuaau

SEQ ID NO: 4026127 - RNA, 19 nt, Staphylococcus aureus subsp. aureus MW2
auuuagguaauacaucauc

SEQ ID NO: 4026128 - RNA, 14 nt, Staphylococcus aureus subsp. aureus MW2
auuuaguacauaug

SEQ ID NO: 4026129 - RNA, 14 nt, Staphylococcus aureus subsp. aureus MW2
auuuaguauaaaua

SEQ ID NO: 4026130 - RNA, 15 nt, Staphylococcus aureus subsp. aureus MW2
auuuaguauaaauaa

SEQ ID NO: 4026131 - RNA, 16 nt, Staphylococcus aureus subsp. aureus MW2
auuuaguauaaauaaa

SEQ ID NO: 4026132 - RNA, 22 nt, Staphylococcus aureus subsp. aureus MW2
auuuaguauaaauaaaaauaca

SEQ ID NO: 4026133 - RNA, 16 nt, Staphylococcus aureus subsp. aureus MW2
auuuaguaucuauaca

SEQ ID NO: 4026134 - RNA, 15 nt, Staphylococcus aureus subsp. aureus MW2
auuuaguaucucauu

SEQ ID NO: 4026135 - RNA, 15 nt, Staphylococcus aureus subsp. aureus MW2
auuuagucauuacaa

SEQ ID NO: 4026136 - RNA, 18 nt, Staphylococcus aureus subsp. aureus MW2
auuuagucauuacaaauc

SEQ ID NO: 4026137 - RNA, 22 nt, Staphylococcus aureus subsp. aureus MW2
auuucuacagacaaugcaaguu

SEQ ID NO: 4026138 - RNA, 14 nt, Staphylococcus aureus subsp. aureus MW2
auuucuacucgaaa

SEQ ID NO: 4026139 - RNA, 14 nt, Staphylococcus aureus subsp. aureus MW2
auuucuaucaaaua

SEQ ID NO: 4026140 - RNA, 16 nt, Staphylococcus aureus subsp. aureus MW2
auuucuaucaaauaau

SEQ ID NO: 4026141 - RNA, 16 nt, Staphylococcus aureus subsp. aureus MW2
auuucuaugaaaaaaa

SEQ ID NO: 4026142 - RNA, 18 nt, Staphylococcus aureus subsp. aureus MW2
auuucucacugcuguucu

SEQ ID NO: 4026143 - RNA, 19 nt, Staphylococcus aureus subsp. aureus MW2
auuucucccauccccuuug

SEQ ID NO: 4026144 - RNA, 20 nt, Staphylococcus aureus subsp. aureus MW2
auuucucguuucgucagauu

SEQ ID NO: 4026145 - RNA, 21 nt, Staphylococcus aureus subsp. aureus MW2
auuucugaaaugauacauuau

SEQ ID NO: 4026146 - RNA, 17 nt, Staphylococcus aureus subsp. aureus MW2
auuucugcaaaauguua

SEQ ID NO: 4026147 - RNA, 22 nt, Staphylococcus aureus subsp. aureus MW2
auuucuguaccaaauuugugau

SEQ ID NO: 4026148 - RNA, 19 nt, Staphylococcus aureus subsp. aureus MW2
auuucuugauggauauuca

SEQ ID NO: 4026149 - RNA, 15 nt, Staphylococcus aureus subsp. aureus MW2
auuucuuuugaaucu

SEQ ID NO: 4026150 - RNA, 10 nt, Staphylococcus aureus subsp. aureus MW2
auuucuuuuu

SEQ ID NO: 4026151 - RNA, 13 nt, Staphylococcus aureus subsp. aureus MW2
auuucuuuuuaaa

SEQ ID NO: 4026152 - RNA, 15 nt, Staphylococcus aureus subsp. aureus MW2
auuucuuuuuaaaau

SEQ ID NO: 4026153 - RNA, 19 nt, Staphylococcus aureus subsp. aureus MW2
auuucuuuuuaaaaucguu

SEQ ID NO: 4026154 - RNA, 13 nt, Staphylococcus aureus subsp. aureus MW2
auuucuuuuuuca

SEQ ID NO: 4026155 - RNA, 20 nt, Staphylococcus aureus subsp. aureus MW2
auuucuuuuuucaauguuug

SEQ ID NO: 4026156 - RNA, 15 nt, Staphylococcus aureus subsp. aureus MW2
auuugaaauauacca

SEQ ID NO: 4026157 - RNA, 16 nt, Staphylococcus aureus subsp. aureus MW2
auuugaacaucauuua

SEQ ID NO: 4026158 - RNA, 19 nt, Staphylococcus aureus subsp. aureus MW2
auuugaagcauuaaguuca

SEQ ID NO: 4026159 - RNA, 14 nt, Staphylococcus aureus subsp. aureus MW2
auuugaaguauuuu

SEQ ID NO: 4026160 - RNA, 12 nt, Staphylococcus aureus subsp. aureus MW2
auuugaauacuu

SEQ ID NO: 4026161 - RNA, 19 nt, Staphylococcus aureus subsp. aureus MW2
auuugaauugacuuacauu

SEQ ID NO: 4026162 - RNA, 15 nt, Staphylococcus aureus subsp. aureus MW2
auuugauaaaaaaug

SEQ ID NO: 4026163 - RNA, 16 nt, Staphylococcus aureus subsp. aureus MW2
auuugauaaauaaaau

SEQ ID NO: 4026164 - RNA, 22 nt, Staphylococcus aureus subsp. aureus MW2
auuugauacaacuauauguguc

SEQ ID NO: 4026165 - RNA, 15 nt, Staphylococcus aureus subsp. aureus MW2
auuugaugguuuaau

SEQ ID NO: 4026166 - RNA, 19 nt, Staphylococcus aureus subsp. aureus MW2
auuugaugguuuaauugca

SEQ ID NO: 4026167 - RNA, 15 nt, Staphylococcus aureus subsp. aureus MW2
auuugauuaguaauu

SEQ ID NO: 4026168 - RNA, 16 nt, Staphylococcus aureus subsp. aureus MW2
auuugauuauguaaau

SEQ ID NO: 4026169 - RNA, 21 nt, Staphylococcus aureus subsp. aureus MW2
auuugauuauucguauucaaa

SEQ ID NO: 4026170 - RNA, 19 nt, Staphylococcus aureus subsp. aureus MW2
auuugauucauuacauguu

SEQ ID NO: 4026171 - RNA, 20 nt, Staphylococcus aureus subsp. aureus MW2
auuugauuuaaaaaguuaau

SEQ ID NO: 4026172 - RNA, 16 nt, Staphylococcus aureus subsp. aureus MW2
auuugauuuauauuuu

SEQ ID NO: 4026173 - RNA, 21 nt, Staphylococcus aureus subsp. aureus MW2
auuugauuuggguaauguuuu

SEQ ID NO: 4026174 - RNA, 13 nt, Staphylococcus aureus subsp. aureus MW2
auuugauuuuagg

SEQ ID NO: 4026175 - RNA, 15 nt, Staphylococcus aureus subsp. aureus MW2
auuugcaaaaucaac

SEQ ID NO: 4026176 - RNA, 19 nt, Staphylococcus aureus subsp. aureus MW2
auuugcacaaagauauguu

SEQ ID NO: 4026177 - RNA, 21 nt, Staphylococcus aureus subsp. aureus MW2
auuugcagaacguucuaaggu

SEQ ID NO: 4026178 - RNA, 15 nt, Staphylococcus aureus subsp. aureus MW2
auuugccaaaaguua

SEQ ID NO: 4026179 - RNA, 21 nt, Staphylococcus aureus subsp. aureus MW2
auuugccccgccauucauaaa

SEQ ID NO: 4026180 - RNA, 22 nt, Staphylococcus aureus subsp. aureus MW2
auuugccuaaaguauuaucuaa

SEQ ID NO: 4026181 - RNA, 17 nt, Staphylococcus aureus subsp. aureus MW2
auuugcgauuucuucug

SEQ ID NO: 4026182 - RNA, 21 nt, Staphylococcus aureus subsp. aureus MW2
auuugcgauuucuucugcuaa

SEQ ID NO: 4026183 - RNA, 20 nt, Staphylococcus aureus subsp. aureus MW2
auuugcucgugaaaagcagu

SEQ ID NO: 4026184 - RNA, 23 nt, Staphylococcus aureus subsp. aureus MW2
auuugcugaaugaagcauuuuau

SEQ ID NO: 4026185 - RNA, 21 nt, Staphylococcus aureus subsp. aureus MW2
auuuggauaauuuuuaacagc

SEQ ID NO: 4026186 - RNA, 21 nt, Staphylococcus aureus subsp. aureus MW2
auuuggaugguaaguauaauu

SEQ ID NO: 4026187 - RNA, 16 nt, Staphylococcus aureus subsp. aureus MW2
auuuggguaauguuuu

SEQ ID NO: 4026188 - RNA, 21 nt, Staphylococcus aureus subsp. aureus MW2
auuuggguaauguuuuuacaa

SEQ ID NO: 4026189 - RNA, 18 nt, Staphylococcus aureus subsp. aureus MW2
auuugguaggcauuuuau

SEQ ID NO: 4026190 - RNA, 16 nt, Staphylococcus aureus subsp. aureus MW2
auuuguaaacaguaug

SEQ ID NO: 4026191 - RNA, 19 nt, Staphylococcus aureus subsp. aureus MW2
auuuguaaagacaccauca

SEQ ID NO: 4026192 - RNA, 23 nt, Staphylococcus aureus subsp. aureus MW2
auuuguaaauauuuuuuaaaaug

SEQ ID NO: 4026193 - RNA, 16 nt, Staphylococcus aureus subsp. aureus MW2
auuuguaaccccauuu

SEQ ID NO: 4026194 - RNA, 20 nt, Staphylococcus aureus subsp. aureus MW2
auuuguaaccccauuuuaaa

SEQ ID NO: 4026195 - RNA, 14 nt, Staphylococcus aureus subsp. aureus MW2
auuuguaauuuaaa

SEQ ID NO: 4026196 - RNA, 19 nt, Staphylococcus aureus subsp. aureus MW2
auuuguagcuugaauaaua

SEQ ID NO: 4026197 - RNA, 15 nt, Staphylococcus aureus subsp. aureus MW2
auuuguaguaaguag

SEQ ID NO: 4026198 - RNA, 14 nt, Staphylococcus aureus subsp. aureus MW2
auuuguauuuaaaa

SEQ ID NO: 4026199 - RNA, 16 nt, Staphylococcus aureus subsp. aureus MW2
auuuguguauaaaugu

SEQ ID NO: 4026200 - RNA, 19 nt, Staphylococcus aureus subsp. aureus MW2
auuuguguauaaaugucau

SEQ ID NO: 4026201 - RNA, 21 nt, Staphylococcus aureus subsp. aureus MW2
auuugugugcgauaagcaaaa

SEQ ID NO: 4026202 - RNA, 23 nt, Staphylococcus aureus subsp. aureus MW2
auuuguguuuuuaauguuugcuu

SEQ ID NO: 4026203 - RNA, 14 nt, Staphylococcus aureus subsp. aureus MW2
auuuguuacuucua

SEQ ID NO: 4026204 - RNA, 20 nt, Staphylococcus aureus subsp. aureus MW2
auuuguuauaccaguauuuu

SEQ ID NO: 4026205 - RNA, 15 nt, Staphylococcus aureus subsp. aureus MW2
auuuguuguuauaua

SEQ ID NO: 4026206 - RNA, 17 nt, Staphylococcus aureus subsp. aureus MW2
auuuguuguuauauaaa

SEQ ID NO: 4026207 - RNA, 16 nt, Staphylococcus aureus subsp. aureus MW2
auuuguuuauggauuu

SEQ ID NO: 4026208 - RNA, 18 nt, Staphylococcus aureus subsp. aureus MW2
auuuguuuauggauuuau

SEQ ID NO: 4026209 - RNA, 16 nt, Staphylococcus aureus subsp. aureus MW2
auuuuaaaaauaaaaa

SEQ ID NO: 4026210 - RNA, 19 nt, Staphylococcus aureus subsp. aureus MW2
auuuuaaaaauucauaauc

SEQ ID NO: 4026211 - RNA, 19 nt, Staphylococcus aureus subsp. aureus MW2
auuuuaaacaugaacaauc

SEQ ID NO: 4026212 - RNA, 22 nt, Staphylococcus aureus subsp. aureus MW2
auuuuaaacaugaacaaucaga

SEQ ID NO: 4026213 - RNA, 20 nt, Staphylococcus aureus subsp. aureus MW2
auuuuaaaccguuauauauu

SEQ ID NO: 4026214 - RNA, 20 nt, Staphylococcus aureus subsp. aureus MW2
auuuuaaauauugauauaaa

SEQ ID NO: 4026215 - RNA, 20 nt, Staphylococcus aureus subsp. aureus MW2
auuuuaaaucuaauuauuca

SEQ ID NO: 4026216 - RNA, 13 nt, Staphylococcus aureus subsp. aureus MW2
auuuuaaauuuaa

SEQ ID NO: 4026217 - RNA, 19 nt, Staphylococcus aureus subsp. aureus MW2
auuuuaaauuuaauuuuau

SEQ ID NO: 4026218 - RNA, 19 nt, Staphylococcus aureus subsp. aureus MW2
auuuuaacaagugaugaaa

SEQ ID NO: 4026219 - RNA, 22 nt, Staphylococcus aureus subsp. aureus MW2
auuuuaacaagugaugaaaaag

SEQ ID NO: 4026220 - RNA, 19 nt, Staphylococcus aureus subsp. aureus MW2
auuuuaacaaugaaccauc

SEQ ID NO: 4026221 - RNA, 18 nt, Staphylococcus aureus subsp. aureus MW2
auuuuaauaaaaucaucu

SEQ ID NO: 4026222 - RNA, 20 nt, Staphylococcus aureus subsp. aureus MW2
auuuuaauaaauuagccauu

SEQ ID NO: 4026223 - RNA, 21 nt, Staphylococcus aureus subsp. aureus MW2
auuuuaauaaauuagccauuu

SEQ ID NO: 4026224 - RNA, 18 nt, Staphylococcus aureus subsp. aureus MW2
auuuuaauaguuuuaaua

SEQ ID NO: 4026225 - RNA, 15 nt, Staphylococcus aureus subsp. aureus MW2
auuuugugaauuuau

SEQ ID NO: 4026226 - RNA, 23 nt, Staphylococcus aureus subsp. aureus MW2
auuuuguuaauaagcgcaucccu

SEQ ID NO: 4026227 - RNA, 18 nt, Staphylococcus aureus subsp. aureus MW2
auuuuguuucaacauuuc

SEQ ID NO: 4026228 - RNA, 12 nt, Staphylococcus aureus subsp. aureus MW2
auuuuguuuuaa

SEQ ID NO: 4026229 - RNA, 15 nt, Staphylococcus aureus subsp. aureus MW2
auuuuguuuuaaaaa

SEQ ID NO: 4026230 - RNA, 21 nt, Staphylococcus aureus subsp. aureus MW2
auuuuuaaaaaccuagggaua

SEQ ID NO: 4026231 - RNA, 11 nt, Staphylococcus aureus subsp. aureus MW2
auuuuuaaaau

SEQ ID NO: 4026232 - RNA, 19 nt, Staphylococcus aureus subsp. aureus MW2
auuuuuaaacaaaaauaag

SEQ ID NO: 4026233 - RNA, 15 nt, Staphylococcus aureus subsp. aureus MW2
auuuuuaaauuacua

SEQ ID NO: 4026234 - RNA, 14 nt, Staphylococcus aureus subsp. aureus MW2
auuuuuaacaucau

SEQ ID NO: 4026235 - RNA, 23 nt, Staphylococcus aureus subsp. aureus MW2
auuuuuaagcugcucgauauaag

SEQ ID NO: 4026236 - RNA, 21 nt, Staphylococcus aureus subsp. aureus MW2
auuuuuacaaagugauuuaaa

SEQ ID NO: 4026237 - RNA, 17 nt, Staphylococcus aureus subsp. aureus MW2
auuuuuagacauuaaaa

SEQ ID NO: 4026238 - RNA, 19 nt, Staphylococcus aureus subsp. aureus MW2
auuuuuagacauuaaaaaa

SEQ ID NO: 4026239 - RNA, 19 nt, Staphylococcus aureus subsp. aureus MW2
auuuuuauagauaaggcua

SEQ ID NO: 4026240 - RNA, 20 nt, Staphylococcus aureus subsp. aureus MW2
auuuuucaaaaagucucauu

SEQ ID NO: 4026241 - RNA, 17 nt, Staphylococcus aureus subsp. aureus MW2
auuuuucaaauaaagau

SEQ ID NO: 4026242 - RNA, 20 nt, Staphylococcus aureus subsp. aureus MW2
auuuuucgucuucaauuaau

SEQ ID NO: 4026243 - RNA, 16 nt, Staphylococcus aureus subsp. aureus MW2
auuuuucuccaguuuu

SEQ ID NO: 4026244 - RNA, 14 nt, Staphylococcus aureus subsp. aureus MW2
auuuuucuuauaaa

SEQ ID NO: 4026245 - RNA, 16 nt, Staphylococcus aureus subsp. aureus MW2
auuuuucuuauaaaaa

SEQ ID NO: 4026246 - RNA, 21 nt, Staphylococcus aureus subsp. aureus MW2
auuuuucuucaguuaaaucuu

SEQ ID NO: 4026247 - RNA, 20 nt, Staphylococcus aureus subsp. aureus MW2
auuuuucuuccuaaauaauu

SEQ ID NO: 4026248 - RNA, 15 nt, Staphylococcus aureus subsp. aureus MW2
auuuuucuucuuuuu

SEQ ID NO: 4026249 - RNA, 21 nt, Staphylococcus aureus subsp. aureus MW2
auuuuucuuuaagcuuucuau

SEQ ID NO: 4026250 - RNA, 21 nt, Staphylococcus aureus subsp. aureus MW2
auuuuucuuuguguuugcuuu

SEQ ID NO: 4026251 - RNA, 22 nt, Staphylococcus aureus subsp. aureus MW2
auuuuugaaaaaaauuuucauu

SEQ ID NO: 4026252 - RNA, 19 nt, Staphylococcus aureus subsp. aureus MW2
auuuuugacuguuaaacaa

SEQ ID NO: 4026253 - RNA, 17 nt, Staphylococcus aureus subsp. aureus MW2
auuuuugauaacuguaa

SEQ ID NO: 4026254 - RNA, 16 nt, Staphylococcus aureus subsp. aureus MW2
auuuuuguauuuaugu

SEQ ID NO: 4026255 - RNA, 12 nt, Staphylococcus aureus subsp. aureus MW2
auuuuugucauc

SEQ ID NO: 4026256 - RNA, 16 nt, Staphylococcus aureus subsp. aureus MW2
auuuuuuaauauacga

SEQ ID NO: 4026257 - RNA, 17 nt, Staphylococcus aureus subsp. aureus MW2
auuuuuuaaugucuaaa

SEQ ID NO: 4026258 - RNA, 18 nt, Staphylococcus aureus subsp. aureus MW2
auuuuuuagacaaauguu

SEQ ID NO: 4026259 - RNA, 23 nt, Staphylococcus aureus subsp. aureus MW2
auuuuuuagacuuuauuuuucca

SEQ ID NO: 4026260 - RNA, 23 nt, Staphylococcus aureus subsp. aureus MW2
auuuuuuagguucuucaucuuuu

SEQ ID NO: 4026261 - RNA, 20 nt, Staphylococcus aureus subsp. aureus MW2
auuuuuuauuccgaacaugu

SEQ ID NO: 4026262 - RNA, 17 nt, Staphylococcus aureus subsp. aureus MW2
auuuuuucaaugucuac

SEQ ID NO: 4026263 - RNA, 18 nt, Staphylococcus aureus subsp. aureus MW2
auuuuuucaugauuuacu

SEQ ID NO: 4026264 - RNA, 22 nt, Staphylococcus aureus subsp. aureus MW2
auuuuuucgagaugauauuaca

SEQ ID NO: 4026265 - RNA, 23 nt, Staphylococcus aureus subsp. aureus MW2
auuuuuucguuaacucuaucuau

SEQ ID NO: 4026266 - RNA, 17 nt, Staphylococcus aureus subsp. aureus MW2
auuuuuucguuuuaaua

SEQ ID NO: 4026267 - RNA, 21 nt, Staphylococcus aureus subsp. aureus MW2
auuuuuucuauggcacaaaug

SEQ ID NO: 4026268 - RNA, 13 nt, Staphylococcus aureus subsp. aureus MW2
auuuuuucucuau

SEQ ID NO: 4026269 - RNA, 16 nt, Staphylococcus aureus subsp. aureus MW2
auuuuuugcaaaauuu

SEQ ID NO: 4026270 - RNA, 13 nt, Staphylococcus aureus subsp. aureus MW2
auuuuuugggcuu

SEQ ID NO: 4026271 - RNA, 17 nt, Staphylococcus aureus subsp. aureus MW2
auuuuuuuaauguuaua

SEQ ID NO: 4026272 - RNA, 19 nt, Staphylococcus aureus subsp. aureus MW2
auuuuuuuaauguuauaaa

SEQ ID NO: 4026273 - RNA, 17 nt, Staphylococcus aureus subsp. aureus MW2
auuuuuuuacaagaaca

SEQ ID NO: 4026274 - RNA, 15 nt, Staphylococcus aureus subsp. aureus MW2
auuuuuuuauauuuu

SEQ ID NO: 4026275 - RNA, 12 nt, Staphylococcus aureus subsp. aureus MW2
auuuuuuuaugu

SEQ ID NO: 4026276 - RNA, 14 nt, Staphylococcus aureus subsp. aureus MW2
auuuuuuuauguua

SEQ ID NO: 4026277 - RNA, 18 nt, Staphylococcus aureus subsp. aureus MW2
auuuuuuucacuaauuuc

SEQ ID NO: 4026278 - RNA, 22 nt, Staphylococcus aureus subsp. aureus MW2
auuuuuuucguaacauuuaaaa

SEQ ID NO: 4026279 - RNA, 23 nt, Staphylococcus aureus subsp. aureus MW2
auuuuuuucguaacauuuaaaaa

SEQ ID NO: 4026280 - RNA, 15 nt, Staphylococcus aureus subsp. aureus MW2
auuuuuuucuuucuu

SEQ ID NO: 4026281 - RNA, 13 nt, Staphylococcus aureus subsp. aureus MW2
auuuuuuugaaaa

SEQ ID NO: 4026282 - RNA, 22 nt, Staphylococcus aureus subsp. aureus MW2
auuuuuuuggugcuuuuuuaag

SEQ ID NO: 4026283 - RNA, 19 nt, Staphylococcus aureus subsp. aureus MW2
auuuuuuuguacuuucuga

SEQ ID NO: 4026284 - RNA, 22 nt, Staphylococcus aureus subsp. aureus MW2
auuuuuuuguugguuuuuaaaa

SEQ ID NO: 4026285 - RNA, 17 nt, Staphylococcus aureus subsp. aureus MW2
caaaaaaacaaaaaaua

SEQ ID NO: 4026286 - RNA, 20 nt, Staphylococcus aureus subsp. aureus MW2
caaaaaaagacacaucacua

SEQ ID NO: 4026287 - RNA, 15 nt, Staphylococcus aureus subsp. aureus MW2
caaaaaaagcugauu

SEQ ID NO: 4026288 - RNA, 20 nt, Staphylococcus aureus subsp. aureus MW2
caaaaaaccgaacaucugaa

SEQ ID NO: 4026289 - RNA, 23 nt, Staphylococcus aureus subsp. aureus MW2
caaaaaagagcucaagacauuac

SEQ ID NO: 4026290 - RNA, 23 nt, Staphylococcus aureus subsp. aureus MW2
caaaaaaggaugaugugaauguu

SEQ ID NO: 4026291 - RNA, 13 nt, Staphylococcus aureus subsp. aureus MW2
caaaaaauaauuu

SEQ ID NO: 4026292 - RNA, 19 nt, Staphylococcus aureus subsp. aureus MW2
caaaaaaucgaacaaauga

SEQ ID NO: 4026293 - RNA, 11 nt, Staphylococcus aureus subsp. aureus MW2
caaaaaaugaa

SEQ ID NO: 4026294 - RNA, 19 nt, Staphylococcus aureus subsp. aureus MW2
caaaaaauuguaagucgaa

SEQ ID NO: 4026295 - RNA, 16 nt, Staphylococcus aureus subsp. aureus MW2
caaaaacauaaucauu

SEQ ID NO: 4026296 - RNA, 14 nt, Staphylococcus aureus subsp. aureus MW2
caaaaauaaaaacu

SEQ ID NO: 4026297 - RNA, 15 nt, Staphylococcus aureus subsp. aureus MW2
caaaaauaaguguug

SEQ ID NO: 4026298 - RNA, 16 nt, Staphylococcus aureus subsp. aureus MW2
caaaaauacuuuuuga

SEQ ID NO: 4026299 - RNA, 21 nt, Staphylococcus aureus subsp. aureus MW2
caaaaauacuuuuugaugauu

SEQ ID NO: 4026300 - RNA, 17 nt, Staphylococcus aureus subsp. aureus MW2
caaaaauagauugaaaa

SEQ ID NO: 4026301 - RNA, 21 nt, Staphylococcus aureus subsp. aureus MW2
caaaaauagauugaaaaaaua

SEQ ID NO: 4026302 - RNA, 21 nt, Staphylococcus aureus subsp. aureus MW2
caaaaaugaagaauacaaaua

SEQ ID NO: 4026303 - RNA, 18 nt, Staphylococcus aureus subsp. aureus MW2
caaaaauuguuaauacau

SEQ ID NO: 4026304 - RNA, 13 nt, Staphylococcus aureus subsp. aureus MW2
caaaacaaaaaau

SEQ ID NO: 4026305 - RNA, 22 nt, Staphylococcus aureus subsp. aureus MW2
caaaacaaaaaauaucuuuuug

SEQ ID NO: 4026306 - RNA, 20 nt, Staphylococcus aureus subsp. aureus MW2
caaaacaauuuaaaaagcag

SEQ ID NO: 4026307 - RNA, 21 nt, Staphylococcus aureus subsp. aureus MW2
caaaacaauuuaaaaagcagu

SEQ ID NO: 4026308 - RNA, 19 nt, Staphylococcus aureus subsp. aureus MW2
caaaacauauucaguauau

SEQ ID NO: 4026309 - RNA, 13 nt, Staphylococcus aureus subsp. aureus MW2
caaaacauuuugu

SEQ ID NO: 4026310 - RNA, 17 nt, Staphylococcus aureus subsp. aureus MW2
caaaaccgcuauaaaau

SEQ ID NO: 4026311 - RNA, 20 nt, Staphylococcus aureus subsp. aureus MW2
caaaaccgcuauaaaauuuu

SEQ ID NO: 4026312 - RNA, 22 nt, Staphylococcus aureus subsp. aureus MW2
caaaaccgcuauaaaauuuuga

SEQ ID NO: 4026313 - RNA, 14 nt, Staphylococcus aureus subsp. aureus MW2
caaauauuucuaaa

SEQ ID NO: 4026314 - RNA, 15 nt, Staphylococcus aureus subsp. aureus MW2
caaauauuuuauuac

SEQ ID NO: 4026315 - RNA, 17 nt, Staphylococcus aureus subsp. aureus MW2
caaauauuuuauuacau

SEQ ID NO: 4026316 - RNA, 14 nt, Staphylococcus aureus subsp. aureus MW2
caaaucaaauacau

SEQ ID NO: 4026317 - RNA, 13 nt, Staphylococcus aureus subsp. aureus MW2
caaaucaauauca

SEQ ID NO: 4026318 - RNA, 20 nt, Staphylococcus aureus subsp. aureus MW2
caaaucggaauaaaauaaau

SEQ ID NO: 4026319 - RNA, 23 nt, Staphylococcus aureus subsp. aureus MW2
caaaucggcuauacauugauaaa

SEQ ID NO: 4026320 - RNA, 15 nt, Staphylococcus aureus subsp. aureus MW2
caaaucuuuuaaauu

SEQ ID NO: 4026321 - RNA, 20 nt, Staphylococcus aureus subsp. aureus MW2
caaaugaaaaaguaaaaucu

SEQ ID NO: 4026322 - RNA, 22 nt, Staphylococcus aureus subsp. aureus MW2
caaaugaaaaaguaaaaucuuu

SEQ ID NO: 4026323 - RNA, 15 nt, Staphylococcus aureus subsp. aureus MW2
caaaugaaauucuuu

SEQ ID NO: 4026324 - RNA, 15 nt, Staphylococcus aureus subsp. aureus MW2
caaaugaaccagcua

SEQ ID NO: 4026325 - RNA, 20 nt, Staphylococcus aureus subsp. aureus MW2
caaaugaauggagcaugauu

SEQ ID NO: 4026326 - RNA, 14 nt, Staphylococcus aureus subsp. aureus MW2
caaaugacauuuua

SEQ ID NO: 4026327 - RNA, 17 nt, Staphylococcus aureus subsp. aureus MW2
caaaugacauuuuaaau

SEQ ID NO: 4026328 - RNA, 17 nt, Staphylococcus aureus subsp. aureus MW2
caaaugagcguuccauu

SEQ ID NO: 4026329 - RNA, 20 nt, Staphylococcus aureus subsp. aureus MW2
caaaugcguaucgagagauu

SEQ ID NO: 4026330 - RNA, 19 nt, Staphylococcus aureus subsp. aureus MW2
caaaugcuacaucaauauu

SEQ ID NO: 4026331 - RNA, 10 nt, Staphylococcus aureus subsp. aureus MW2
caaaugcuua

SEQ ID NO: 4026332 - RNA, 18 nt, Staphylococcus aureus subsp. aureus MW2
caaaugcuuaauaaaauc

SEQ ID NO: 4026333 - RNA, 16 nt, Staphylococcus aureus subsp. aureus MW2
caaauggagcaacgau

SEQ ID NO: 4026334 - RNA, 18 nt, Staphylococcus aureus subsp. aureus MW2
caaaugguacaguuaauu

SEQ ID NO: 4026335 - RNA, 18 nt, Staphylococcus aureus subsp. aureus MW2
caaaugugaaagucaucc

SEQ ID NO: 4026336 - RNA, 17 nt, Staphylococcus aureus subsp. aureus MW2
caaaugugcgaccuuuc

SEQ ID NO: 4026337 - RNA, 20 nt, Staphylococcus aureus subsp. aureus MW2
caaauguugaauguggaaca

SEQ ID NO: 4026338 - RNA, 19 nt, Staphylococcus aureus subsp. aureus MW2
caaauguugacuacucaau

SEQ ID NO: 4026339 - RNA, 14 nt, Staphylococcus aureus subsp. aureus MW2
caaauguuuacugu

SEQ ID NO: 4026340 - RNA, 13 nt, Staphylococcus aureus subsp. aureus MW2
caaauuaaaaaac

SEQ ID NO: 4026341 - RNA, 22 nt, Staphylococcus aureus subsp. aureus MW2
caaauuaaauauacuuuuauag

SEQ ID NO: 4026342 - RNA, 23 nt, Staphylococcus aureus subsp. aureus MW2
caaauuaaauauacuuuuauaga

SEQ ID NO: 4026343 - RNA, 13 nt, Staphylococcus aureus subsp. aureus MW2
caaauuaaaucac

SEQ ID NO: 4026344 - RNA, 18 nt, Staphylococcus aureus subsp. aureus MW2
caaauuaauuaaaccaau

SEQ ID NO: 4026345 - RNA, 18 nt, Staphylococcus aureus subsp. aureus MW2
caaauuaccauucaucgu

SEQ ID NO: 4026346 - RNA, 13 nt, Staphylococcus aureus subsp. aureus MW2
caaauuagauaaa

SEQ ID NO: 4026347 - RNA, 18 nt, Staphylococcus aureus subsp. aureus MW2
caaauuagauaaaacaaa

SEQ ID NO: 4026348 - RNA, 19 nt, Staphylococcus aureus subsp. aureus MW2
caaauuagauaaaacaaaa

SEQ ID NO: 4026349 - RNA, 22 nt, Staphylococcus aureus subsp. aureus MW2
caaauuauaauuguaaugcuuc

SEQ ID NO: 4026350 - RNA, 15 nt, Staphylococcus aureus subsp. aureus MW2
caaauuauuaacgca

SEQ ID NO: 4026351 - RNA, 16 nt, Staphylococcus aureus subsp. aureus MW2
caaauucauauuaacu

SEQ ID NO: 4026352 - RNA, 17 nt, Staphylococcus aureus subsp. aureus MW2
caaauucauauuaacug

SEQ ID NO: 4026353 - RNA, 14 nt, Staphylococcus aureus subsp. aureus MW2
caaauucauuugua

SEQ ID NO: 4026354 - RNA, 23 nt, Staphylococcus aureus subsp. aureus MW2
caaauucuaugagaauagacauu

SEQ ID NO: 4026355 - RNA, 19 nt, Staphylococcus aureus subsp. aureus MW2
caaauucuuuuacagcaag

SEQ ID NO: 4026356 - RNA, 15 nt, Staphylococcus aureus subsp. aureus MW2
caaauugaaauuauc

SEQ ID NO: 4026357 - RNA, 17 nt, Staphylococcus aureus subsp. aureus MW2
caaauugacgcauuaau

SEQ ID NO: 4026358 - RNA, 21 nt, Staphylococcus aureus subsp. aureus MW2
caaauugcaauggcaaccuuu

SEQ ID NO: 4026359 - RNA, 16 nt, Staphylococcus aureus subsp. aureus MW2
caaauugccuuucauu

SEQ ID NO: 4026360 - RNA, 21 nt, Staphylococcus aureus subsp. aureus MW2
caaauuggauaauuucuucuu

SEQ ID NO: 4026361 - RNA, 21 nt, Staphylococcus aureus subsp. aureus MW2
caaauuggucgucauaccuau

SEQ ID NO: 4026362 - RNA, 20 nt, Staphylococcus aureus subsp. aureus MW2
caaauuuauaauuuguauaa

SEQ ID NO: 4026363 - RNA, 20 nt, Staphylococcus aureus subsp. aureus MW2
caaauuugugauuaugcaua

SEQ ID NO: 4026364 - RNA, 16 nt, Staphylococcus aureus subsp. aureus MW2
caaauuuuaaaauaaa

SEQ ID NO: 4026365 - RNA, 14 nt, Staphylococcus aureus subsp. aureus MW2
caaauuuugaguau

SEQ ID NO: 4026366 - RNA, 22 nt, Staphylococcus aureus subsp. aureus MW2
caaauuuugaguauuugccuuu

SEQ ID NO: 4026367 - RNA, 21 nt, Staphylococcus aureus subsp. aureus MW2
caacaaaagugccagguucaa

SEQ ID NO: 4026368 - RNA, 19 nt, Staphylococcus aureus subsp. aureus MW2
caacaaaaugcguaucaau

SEQ ID NO: 4026369 - RNA, 13 nt, Staphylococcus aureus subsp. aureus MW2
caacaaauauaau

SEQ ID NO: 4026370 - RNA, 15 nt, Staphylococcus aureus subsp. aureus MW2
caacaauaaaucuuu

SEQ ID NO: 4026371 - RNA, 16 nt, Staphylococcus aureus subsp. aureus MW2
caacaauauaaaagca

SEQ ID NO: 4026372 - RNA, 22 nt, Staphylococcus aureus subsp. aureus MW2
caacaauugguuguuucaauuc

SEQ ID NO: 4026373 - RNA, 10 nt, Staphylococcus aureus subsp. aureus MW2
caacacagaa

SEQ ID NO: 4026374 - RNA, 15 nt, Staphylococcus aureus subsp. aureus MW2
caacacagaagcugg

SEQ ID NO: 4026375 - RNA, 17 nt, Staphylococcus aureus subsp. aureus MW2
caacacagaagcuggcg

SEQ ID NO: 4026376 - RNA, 12 nt, Staphylococcus aureus subsp. aureus MW2
caacacagagaa

SEQ ID NO: 4026377 - RNA, 13 nt, Staphylococcus aureus subsp. aureus MW2
caacacagagaau

SEQ ID NO: 4026378 - RNA, 16 nt, Staphylococcus aureus subsp. aureus MW2
caacagugcucuaugc

SEQ ID NO: 4026379 - RNA, 14 nt, Staphylococcus aureus subsp. aureus MW2
caacaguuuuaaag

SEQ ID NO: 4026380 - RNA, 21 nt, Staphylococcus aureus subsp. aureus MW2
caacaguuuuauuaucuuugu

SEQ ID NO: 4026381 - RNA, 11 nt, Staphylococcus aureus subsp. aureus MW2
caacauagaag

SEQ ID NO: 4026382 - RNA, 13 nt, Staphylococcus aureus subsp. aureus MW2
caacauagaagcu

SEQ ID NO: 4026383 - RNA, 16 nt, Staphylococcus aureus subsp. aureus MW2
caacauagaagcuggc

SEQ ID NO: 4026384 - RNA, 15 nt, Staphylococcus aureus subsp. aureus MW2
caacauauaaaucau

SEQ ID NO: 4026385 - RNA, 12 nt, Staphylococcus aureus subsp. aureus MW2
caacauaucaua

SEQ ID NO: 4026386 - RNA, 14 nt, Staphylococcus aureus subsp. aureus MW2
caacauaucauaga

SEQ ID NO: 4026387 - RNA, 14 nt, Staphylococcus aureus subsp. aureus MW2
caacauauuauaua

SEQ ID NO: 4026388 - RNA, 15 nt, Staphylococcus aureus subsp. aureus MW2
caacauauuuucaca

SEQ ID NO: 4026389 - RNA, 22 nt, Staphylococcus aureus subsp. aureus MW2
caacaucuuuuguugcucagug

SEQ ID NO: 4026390 - RNA, 22 nt, Staphylococcus aureus subsp. aureus MW2
caacaugguacguacguugaug

SEQ ID NO: 4026391 - RNA, 22 nt, Staphylococcus aureus subsp. aureus MW2
caacauguuccgcuacaaaaca

SEQ ID NO: 4026392 - RNA, 14 nt, Staphylococcus aureus subsp. aureus MW2
caacauguuuggau

SEQ ID NO: 4026393 - RNA, 22 nt, Staphylococcus aureus subsp. aureus MW2
caacauguuuggaugaacaaaa

SEQ ID NO: 4026394 - RNA, 15 nt, Staphylococcus aureus subsp. aureus MW2
caacauuaauaaaua

SEQ ID NO: 4026395 - RNA, 17 nt, Staphylococcus aureus subsp. aureus MW2
caacauuaauaaauaau

SEQ ID NO: 4026396 - RNA, 15 nt, Staphylococcus aureus subsp. aureus MW2
caacauuacaugcac

SEQ ID NO: 4026397 - RNA, 18 nt, Staphylococcus aureus subsp. aureus MW2
caacauuacuaauugauc

SEQ ID NO: 4026398 - RNA, 20 nt, Staphylococcus aureus subsp. aureus MW2
caacauugauaguuuuauaa

SEQ ID NO: 4026399 - RNA, 15 nt, Staphylococcus aureus subsp. aureus MW2
caacauuuuuuauag

SEQ ID NO: 4026400 - RNA, 13 nt, Staphylococcus aureus subsp. aureus MW2
caaccaaaaccaa

SEQ ID NO: 4026401 - RNA, 18 nt, Staphylococcus aureus subsp. aureus MW2
caaccaaaaccaaaugaa

SEQ ID NO: 4026402 - RNA, 22 nt, Staphylococcus aureus subsp. aureus MW2
caaguuggcggggcccaaacau

SEQ ID NO: 4026403 - RNA, 23 nt, Staphylococcus aureus subsp. aureus MW2
caaguuggggugugggccccaac

SEQ ID NO: 4026404 - RNA, 19 nt, Staphylococcus aureus subsp. aureus MW2
caaguugugcugucaaaca

SEQ ID NO: 4026405 - RNA, 13 nt, Staphylococcus aureus subsp. aureus MW2
caaguuuaaaaua

SEQ ID NO: 4026406 - RNA, 15 nt, Staphylococcus aureus subsp. aureus MW2
caaguuuaaaauacg

SEQ ID NO: 4026407 - RNA, 21 nt, Staphylococcus aureus subsp. aureus MW2
caaguuuaguaucuccaucaa

SEQ ID NO: 4026408 - RNA, 19 nt, Staphylococcus aureus subsp. aureus MW2
caauaaaaaaccaagugca

SEQ ID NO: 4026409 - RNA, 11 nt, Staphylococcus aureus subsp. aureus MW2
caauaaaaaug

SEQ ID NO: 4026410 - RNA, 13 nt, Staphylococcus aureus subsp. aureus MW2
caauaaaaugcaa

SEQ ID NO: 4026411 - RNA, 20 nt, Staphylococcus aureus subsp. aureus MW2
caauaaaaugcaauuuuuca

SEQ ID NO: 4026412 - RNA, 10 nt, Staphylococcus aureus subsp. aureus MW2
caauaaaauu

SEQ ID NO: 4026413 - RNA, 16 nt, Staphylococcus aureus subsp. aureus MW2
caauaaauaaacaacu

SEQ ID NO: 4026414 - RNA, 18 nt, Staphylococcus aureus subsp. aureus MW2
caauaaauauugauucua

SEQ ID NO: 4026415 - RNA, 12 nt, Staphylococcus aureus subsp. aureus MW2
caauaaaucuuu

SEQ ID NO: 4026416 - RNA, 14 nt, Staphylococcus aureus subsp. aureus MW2
caauaaaucuuucc

SEQ ID NO: 4026417 - RNA, 17 nt, Staphylococcus aureus subsp. aureus MW2
caauaacaaugcagcug

SEQ ID NO: 4026418 - RNA, 18 nt, Staphylococcus aureus subsp. aureus MW2
caauaacacaucaugaca

SEQ ID NO: 4026419 - RNA, 17 nt, Staphylococcus aureus subsp. aureus MW2
caauaacaccaauugaa

SEQ ID NO: 4026420 - RNA, 20 nt, Staphylococcus aureus subsp. aureus MW2
caauaacagcuacaaauaau

SEQ ID NO: 4026421 - RNA, 14 nt, Staphylococcus aureus subsp. aureus MW2
caauaauaaaucac

SEQ ID NO: 4026422 - RNA, 14 nt, Staphylococcus aureus subsp. aureus MW2
caauaauaccuuca

SEQ ID NO: 4026423 - RNA, 15 nt, Staphylococcus aureus subsp. aureus MW2
caauaauaugccaaa

SEQ ID NO: 4026424 - RNA, 15 nt, Staphylococcus aureus subsp. aureus MW2
caauaaucaauguuc

SEQ ID NO: 4026425 - RNA, 12 nt, Staphylococcus aureus subsp. aureus MW2
caauaaugugca

SEQ ID NO: 4026426 - RNA, 13 nt, Staphylococcus aureus subsp. aureus MW2
caauaaugugcaa

SEQ ID NO: 4026427 - RNA, 15 nt, Staphylococcus aureus subsp. aureus MW2
caauaaugugcaagu

SEQ ID NO: 4026428 - RNA, 18 nt, Staphylococcus aureus subsp. aureus MW2
caauaaugugcaaguugg

SEQ ID NO: 4026429 - RNA, 19 nt, Staphylococcus aureus subsp. aureus MW2
caauaaugugcaaguuggc

SEQ ID NO: 4026430 - RNA, 22 nt, Staphylococcus aureus subsp. aureus MW2
caauaauucguugauuuagcau

SEQ ID NO: 4026431 - RNA, 19 nt, Staphylococcus aureus subsp. aureus MW2
caauaauugaugaaagacu

SEQ ID NO: 4026432 - RNA, 24 nt, Staphylococcus aureus subsp. aureus MW2
caauaauugaugaaagacugacua

SEQ ID NO: 4026433 - RNA, 17 nt, Staphylococcus aureus subsp. aureus MW2
caauaauugcugucacu

SEQ ID NO: 4026434 - RNA, 23 nt, Staphylococcus aureus subsp. aureus MW2
caauaauugcugucacuaaugga

SEQ ID NO: 4026435 - RNA, 16 nt, Staphylococcus aureus subsp. aureus MW2
caauacaaacacccac

SEQ ID NO: 4026436 - RNA, 22 nt, Staphylococcus aureus subsp. aureus MW2
caauacagaacuuuaauaauga

SEQ ID NO: 4026437 - RNA, 17 nt, Staphylococcus aureus subsp. aureus MW2
caauacauaaugguuca

SEQ ID NO: 4026438 - RNA, 17 nt, Staphylococcus aureus subsp. aureus MW2
caauacauuaauauaaa

SEQ ID NO: 4026439 - RNA, 23 nt, Staphylococcus aureus subsp. aureus MW2
caauaccagugggcuccaaacau

SEQ ID NO: 4026440 - RNA, 16 nt, Staphylococcus aureus subsp. aureus MW2
caauaccgaauaauuu

SEQ ID NO: 4026441 - RNA, 20 nt, Staphylococcus aureus subsp. aureus MW2
caauaccgaauaauuuugau

SEQ ID NO: 4026442 - RNA, 19 nt, Staphylococcus aureus subsp. aureus MW2
caauaccuuugccguauuu

SEQ ID NO: 4026443 - RNA, 13 nt, Staphylococcus aureus subsp. aureus MW2
caauacgaaguuu

SEQ ID NO: 4026444 - RNA, 13 nt, Staphylococcus aureus subsp. aureus MW2
caauacgcaaugu

SEQ ID NO: 4026445 - RNA, 15 nt, Staphylococcus aureus subsp. aureus MW2
caauacguuuccaau

SEQ ID NO: 4026446 - RNA, 13 nt, Staphylococcus aureus subsp. aureus MW2
caauacuuuuuau

SEQ ID NO: 4026447 - RNA, 22 nt, Staphylococcus aureus subsp. aureus MW2
caauacuuuuuauauaauucgu

SEQ ID NO: 4026448 - RNA, 16 nt, Staphylococcus aureus subsp. aureus MW2
caauagaaauaacgau

SEQ ID NO: 4026449 - RNA, 15 nt, Staphylococcus aureus subsp. aureus MW2
caauaggaugaaacu

SEQ ID NO: 4026450 - RNA, 18 nt, Staphylococcus aureus subsp. aureus MW2
caauagguacaacuaaau

SEQ ID NO: 4026451 - RNA, 19 nt, Staphylococcus aureus subsp. aureus MW2
caauauaaaagcacuauuu

SEQ ID NO: 4026452 - RNA, 14 nt, Staphylococcus aureus subsp. aureus MW2
caauauaacaucaa

SEQ ID NO: 4026453 - RNA, 15 nt, Staphylococcus aureus subsp. aureus MW2
caauauaacaucaaa

SEQ ID NO: 4026454 - RNA, 16 nt, Staphylococcus aureus subsp. aureus MW2
caauauacauuuacau

SEQ ID NO: 4026455 - RNA, 12 nt, Staphylococcus aureus subsp. aureus MW2
caauauacuuuu

SEQ ID NO: 4026456 - RNA, 15 nt, Staphylococcus aureus subsp. aureus MW2
caauauauucaccua

SEQ ID NO: 4026457 - RNA, 14 nt, Staphylococcus aureus subsp. aureus MW2
caauaucauauuug

SEQ ID NO: 4026458 - RNA, 19 nt, Staphylococcus aureus subsp. aureus MW2
caauaucaucauuuaaaua

SEQ ID NO: 4026459 - RNA, 19 nt, Staphylococcus aureus subsp. aureus MW2
caauaucuucuaauuccau

SEQ ID NO: 4026460 - RNA, 21 nt, Staphylococcus aureus subsp. aureus MW2
caauaucuucuaauuccauca

SEQ ID NO: 4026461 - RNA, 22 nt, Staphylococcus aureus subsp. aureus MW2
caauaucuucuuuuaauauuug

SEQ ID NO: 4026462 - RNA, 20 nt, Staphylococcus aureus subsp. aureus MW2
caauaugaccuuuaugugca

SEQ ID NO: 4026463 - RNA, 20 nt, Staphylococcus aureus subsp. aureus MW2
caauaugaguuacaugguug

SEQ ID NO: 4026464 - RNA, 21 nt, Staphylococcus aureus subsp. aureus MW2
caauauguaacaaacaagcua

SEQ ID NO: 4026465 - RNA, 13 nt, Staphylococcus aureus subsp. aureus MW2
caauauuaaaaua

SEQ ID NO: 4026466 - RNA, 13 nt, Staphylococcus aureus subsp. aureus MW2
caauauuaaaauc

SEQ ID NO: 4026467 - RNA, 13 nt, Staphylococcus aureus subsp. aureus MW2
caauauuaaaauu

SEQ ID NO: 4026468 - RNA, 14 nt, Staphylococcus aureus subsp. aureus MW2
caauauuaggccaa

SEQ ID NO: 4026469 - RNA, 18 nt, Staphylococcus aureus subsp. aureus MW2
caauauucucuuuaccag

SEQ ID NO: 4026470 - RNA, 20 nt, Staphylococcus aureus subsp. aureus MW2
caauauuuauauuaaauacu

SEQ ID NO: 4026471 - RNA, 20 nt, Staphylococcus aureus subsp. aureus MW2
caauauuuucauguccaucu

SEQ ID NO: 4026472 - RNA, 20 nt, Staphylococcus aureus subsp. aureus MW2
caauauuuuuacauauuuau

SEQ ID NO: 4026473 - RNA, 17 nt, Staphylococcus aureus subsp. aureus MW2
caaucacaauauaacau

SEQ ID NO: 4026474 - RNA, 17 nt, Staphylococcus aureus subsp. aureus MW2
caaucacagcaauaaua

SEQ ID NO: 4026475 - RNA, 16 nt, Staphylococcus aureus subsp. aureus MW2
caaucacuauauuuca

SEQ ID NO: 4026476 - RNA, 20 nt, Staphylococcus aureus subsp. aureus MW2
caaucacuccucuauuuuau

SEQ ID NO: 4026477 - RNA, 17 nt, Staphylococcus aureus subsp. aureus MW2
caaucaguaauaaugua

SEQ ID NO: 4026478 - RNA, 18 nt, Staphylococcus aureus subsp. aureus MW2
caaucaucacacauaaau

SEQ ID NO: 4026479 - RNA, 14 nt, Staphylococcus aureus subsp. aureus MW2
caaucaucuuaaug

SEQ ID NO: 4026480 - RNA, 20 nt, Staphylococcus aureus subsp. aureus MW2
caaucaugcuuuuuuguccc

SEQ ID NO: 4026481 - RNA, 16 nt, Staphylococcus aureus subsp. aureus MW2
caaucauuagucauca

SEQ ID NO: 4026482 - RNA, 15 nt, Staphylococcus aureus subsp. aureus MW2
caaucauucacuuca

SEQ ID NO: 4026483 - RNA, 19 nt, Staphylococcus aureus subsp. aureus MW2
caaucgcauuuuguuucaa

SEQ ID NO: 4026484 - RNA, 19 nt, Staphylococcus aureus subsp. aureus MW2
caaucgcuuuagcaauuga

SEQ ID NO: 4026485 - RNA, 17 nt, Staphylococcus aureus subsp. aureus MW2
caaucguaacuaacaug

SEQ ID NO: 4026486 - RNA, 18 nt, Staphylococcus aureus subsp. aureus MW2
caaucguugaaaaauauc

SEQ ID NO: 4026487 - RNA, 15 nt, Staphylococcus aureus subsp. aureus MW2
caaucuaaauguaaa

SEQ ID NO: 4026488 - RNA, 22 nt, Staphylococcus aureus subsp. aureus MW2
caaucuaaauguaaaaucauua

SEQ ID NO: 4026489 - RNA, 15 nt, Staphylococcus aureus subsp. aureus MW2
caaucuacuuuuucg

SEQ ID NO: 4026490 - RNA, 13 nt, Staphylococcus aureus subsp. aureus MW2
caaucuauauaaa

SEQ ID NO: 4026491 - RNA, 14 nt, Staphylococcus aureus subsp. aureus MW2
cacaacacauaaau

SEQ ID NO: 4026492 - RNA, 17 nt, Staphylococcus aureus subsp. aureus MW2
cacaacacauaaauuaa

SEQ ID NO: 4026493 - RNA, 21 nt, Staphylococcus aureus subsp. aureus MW2
cacaacgauagauaucauuuu

SEQ ID NO: 4026494 - RNA, 19 nt, Staphylococcus aureus subsp. aureus MW2
cacaacggcauaauacaca

SEQ ID NO: 4026495 - RNA, 21 nt, Staphylococcus aureus subsp. aureus MW2
cacaacggcauaauacacauu

SEQ ID NO: 4026496 - RNA, 17 nt, Staphylococcus aureus subsp. aureus MW2
cacaauaauccaagaua

SEQ ID NO: 4026497 - RNA, 16 nt, Staphylococcus aureus subsp. aureus MW2
cacaauauacauuuac

SEQ ID NO: 4026498 - RNA, 20 nt, Staphylococcus aureus subsp. aureus MW2
cacaauccuuucaucugcaa

SEQ ID NO: 4026499 - RNA, 20 nt, Staphylococcus aureus subsp. aureus MW2
cacaaugccuuuaaagcaca

SEQ ID NO: 4026500 - RNA, 14 nt, Staphylococcus aureus subsp. aureus MW2
cacaauuguauaau

SEQ ID NO: 4026501 - RNA, 15 nt, Staphylococcus aureus subsp. aureus MW2
cacaauuguauaaug

SEQ ID NO: 4026502 - RNA, 18 nt, Staphylococcus aureus subsp. aureus MW2
cacacacaguuuauaaua

SEQ ID NO: 4026503 - RNA, 21 nt, Staphylococcus aureus subsp. aureus MW2
cacacagguaaauuuaaaaua

SEQ ID NO: 4026504 - RNA, 13 nt, Staphylococcus aureus subsp. aureus MW2
cacacauaaaugu

SEQ ID NO: 4026505 - RNA, 21 nt, Staphylococcus aureus subsp. aureus MW2
cacaccuaauucauauauacu

SEQ ID NO: 4026506 - RNA, 15 nt, Staphylococcus aureus subsp. aureus MW2
cacacuuuaaacaag

SEQ ID NO: 4026507 - RNA, 13 nt, Staphylococcus aureus subsp. aureus MW2
cacagaagcuggc

SEQ ID NO: 4026508 - RNA, 14 nt, Staphylococcus aureus subsp. aureus MW2
cacagaagcuggcg

SEQ ID NO: 4026509 - RNA, 18 nt, Staphylococcus aureus subsp. aureus MW2
cacagacguuuuugaauc

SEQ ID NO: 4026510 - RNA, 19 nt, Staphylococcus aureus subsp. aureus MW2
cacagcaauucacuuauac

SEQ ID NO: 4026511 - RNA, 22 nt, Staphylococcus aureus subsp. aureus MW2
cacagcaauucacuuauacaug

SEQ ID NO: 4026512 - RNA, 18 nt, Staphylococcus aureus subsp. aureus MW2
cacagcgauuaaaugaug

SEQ ID NO: 4026513 - RNA, 18 nt, Staphylococcus aureus subsp. aureus MW2
cacagcuuguucaauacu

SEQ ID NO: 4026514 - RNA, 14 nt, Staphylococcus aureus subsp. aureus MW2
cacaguacaaauaa

SEQ ID NO: 4026515 - RNA, 23 nt, Staphylococcus aureus subsp. aureus MW2
cacaguguugaauuuaaaaauag

SEQ ID NO: 4026516 - RNA, 17 nt, Staphylococcus aureus subsp. aureus MW2
cacaguuucaucuucaa

SEQ ID NO: 4026517 - RNA, 16 nt, Staphylococcus aureus subsp. aureus MW2
cacauacauaucuuuu

SEQ ID NO: 4026518 - RNA, 13 nt, Staphylococcus aureus subsp. aureus MW2
cacauacauuuug

SEQ ID NO: 4026519 - RNA, 12 nt, Staphylococcus aureus subsp. aureus MW2
cacaucauagca

SEQ ID NO: 4026520 - RNA, 13 nt, Staphylococcus aureus subsp. aureus MW2
cacaucgauaucu

SEQ ID NO: 4026521 - RNA, 21 nt, Staphylococcus aureus subsp. aureus MW2
cacaucuuuagcuauuuaaaa

SEQ ID NO: 4026522 - RNA, 14 nt, Staphylococcus aureus subsp. aureus MW2
cacaucuuuuuaaa

SEQ ID NO: 4026523 - RNA, 21 nt, Staphylococcus aureus subsp. aureus MW2
cacauguacguuuuuuuaaau

SEQ ID NO: 4026524 - RNA, 23 nt, Staphylococcus aureus subsp. aureus MW2
cacauguacguuuuuuuaaauac

SEQ ID NO: 4026525 - RNA, 21 nt, Staphylococcus aureus subsp. aureus MW2
cacauuauuguaaccugacuu

SEQ ID NO: 4026526 - RNA, 17 nt, Staphylococcus aureus subsp. aureus MW2
cacauuauuuaaacggu

SEQ ID NO: 4026527 - RNA, 23 nt, Staphylococcus aureus subsp. aureus MW2
cacauuauuuaaacgguaacaaa

SEQ ID NO: 4026528 - RNA, 23 nt, Staphylococcus aureus subsp. aureus MW2
cacauugcaacgucccaacaaca

SEQ ID NO: 4026529 - RNA, 17 nt, Staphylococcus aureus subsp. aureus MW2
cacauugucuacaaagu

SEQ ID NO: 4026530 - RNA, 18 nt, Staphylococcus aureus subsp. aureus MW2
cacauugucuacaaaguu

SEQ ID NO: 4026531 - RNA, 18 nt, Staphylococcus aureus subsp. aureus MW2
cacauuuacuuaagaacu

SEQ ID NO: 4026532 - RNA, 14 nt, Staphylococcus aureus subsp. aureus MW2
cacauuuucaaauu

SEQ ID NO: 4026533 - RNA, 22 nt, Staphylococcus aureus subsp. aureus MW2
caccaaauccaucuaauucaau

SEQ ID NO: 4026534 - RNA, 22 nt, Staphylococcus aureus subsp. aureus MW2
caccaacaauagguacaacuaa

SEQ ID NO: 4026535 - RNA, 14 nt, Staphylococcus aureus subsp. aureus MW2
caccaaguucacua

SEQ ID NO: 4026536 - RNA, 19 nt, Staphylococcus aureus subsp. aureus MW2
caccaaguucacuaaauuc

SEQ ID NO: 4026537 - RNA, 11 nt, Staphylococcus aureus subsp. aureus MW2
caccaauauuu

SEQ ID NO: 4026538 - RNA, 20 nt, Staphylococcus aureus subsp. aureus MW2
caccagcucguuuuuugauu

SEQ ID NO: 4026539 - RNA, 16 nt, Staphylococcus aureus subsp. aureus MW2
caccauacuaaaacau

SEQ ID NO: 4026540 - RNA, 17 nt, Staphylococcus aureus subsp. aureus MW2
caccauacuaaaacaug

SEQ ID NO: 4026541 - RNA, 15 nt, Staphylococcus aureus subsp. aureus MW2
caccaucccauuaaa

SEQ ID NO: 4026542 - RNA, 21 nt, Staphylococcus aureus subsp. aureus MW2
caccauguacauugguuuuua

SEQ ID NO: 4026543 - RNA, 18 nt, Staphylococcus aureus subsp. aureus MW2
caccauuuacuucauaag

SEQ ID NO: 4026544 - RNA, 19 nt, Staphylococcus aureus subsp. aureus MW2
caccauuuacuucauaagu

SEQ ID NO: 4026545 - RNA, 15 nt, Staphylococcus aureus subsp. aureus MW2
cacccauuugucuua

SEQ ID NO: 4026546 - RNA, 21 nt, Staphylococcus aureus subsp. aureus MW2
caccccuucucuaaauuacaa

SEQ ID NO: 4026547 - RNA, 17 nt, Staphylococcus aureus subsp. aureus MW2
cacccugcuuaucauua

SEQ ID NO: 4026548 - RNA, 19 nt, Staphylococcus aureus subsp. aureus MW2
caccgcaaugccacaucau

SEQ ID NO: 4026549 - RNA, 22 nt, Staphylococcus aureus subsp. aureus MW2
caccguggaauuuaccauuuuc

SEQ ID NO: 4026550 - RNA, 16 nt, Staphylococcus aureus subsp. aureus MW2
caccuaauaaugcgau

SEQ ID NO: 4026551 - RNA, 13 nt, Staphylococcus aureus subsp. aureus MW2
caccuaauaccau

SEQ ID NO: 4026552 - RNA, 20 nt, Staphylococcus aureus subsp. aureus MW2
caccuauuuuuugagcacuu

SEQ ID NO: 4026553 - RNA, 15 nt, Staphylococcus aureus subsp. aureus MW2
caccuccaaccgcuu

SEQ ID NO: 4026554 - RNA, 17 nt, Staphylococcus aureus subsp. aureus MW2
caccucuaaguucaccu

SEQ ID NO: 4026555 - RNA, 20 nt, Staphylococcus aureus subsp. aureus MW2
caccugcaauuuguaauaca

SEQ ID NO: 4026556 - RNA, 20 nt, Staphylococcus aureus subsp. aureus MW2
caccugcuaguucagcuucu

SEQ ID NO: 4026557 - RNA, 23 nt, Staphylococcus aureus subsp. aureus MW2
caccuggucguacuuucaaauaa

SEQ ID NO: 4026558 - RNA, 19 nt, Staphylococcus aureus subsp. aureus MW2
caccuucguuuaaauucau

SEQ ID NO: 4026559 - RNA, 12 nt, Staphylococcus aureus subsp. aureus MW2
caccuuuaggaa

SEQ ID NO: 4026560 - RNA, 13 nt, Staphylococcus aureus subsp. aureus MW2
caccuuuaucugu

SEQ ID NO: 4026561 - RNA, 22 nt, Staphylococcus aureus subsp. aureus MW2
cacgaaauugugaacuaaauug

SEQ ID NO: 4026562 - RNA, 17 nt, Staphylococcus aureus subsp. aureus MW2
cacgaacaagucuugca

SEQ ID NO: 4026563 - RNA, 13 nt, Staphylococcus aureus subsp. aureus MW2
cacgaauucauua

SEQ ID NO: 4026564 - RNA, 15 nt, Staphylococcus aureus subsp. aureus MW2
cacgacuuucuaaag

SEQ ID NO: 4026565 - RNA, 14 nt, Staphylococcus aureus subsp. aureus MW2
cacgagcugcuuca

SEQ ID NO: 4026566 - RNA, 23 nt, Staphylococcus aureus subsp. aureus MW2
cacgauauaacauuaaaaugaua

SEQ ID NO: 4026567 - RNA, 14 nt, Staphylococcus aureus subsp. aureus MW2
cacgauuuuuaaaa

SEQ ID NO: 4026568 - RNA, 14 nt, Staphylococcus aureus subsp. aureus MW2
cacgcauuacuuua

SEQ ID NO: 4026569 - RNA, 20 nt, Staphylococcus aureus subsp. aureus MW2
cacgcgguaaaacgaaguca

SEQ ID NO: 4026570 - RNA, 16 nt, Staphylococcus aureus subsp. aureus MW2
cacgcguccgaaguca

SEQ ID NO: 4026571 - RNA, 13 nt, Staphylococcus aureus subsp. aureus MW2
cacgcguucaaau

SEQ ID NO: 4026572 - RNA, 12 nt, Staphylococcus aureus subsp. aureus MW2
cacguaaaauau

SEQ ID NO: 4026573 - RNA, 15 nt, Staphylococcus aureus subsp. aureus MW2
cacguacaaaauaau

SEQ ID NO: 4026574 - RNA, 18 nt, Staphylococcus aureus subsp. aureus MW2
cacguguauuguauuuua

SEQ ID NO: 4026575 - RNA, 19 nt, Staphylococcus aureus subsp. aureus MW2
cacguucuugguauuuuuu

SEQ ID NO: 4026576 - RNA, 20 nt, Staphylococcus aureus subsp. aureus MW2
cacguucuugguauuuuuua

SEQ ID NO: 4026577 - RNA, 17 nt, Staphylococcus aureus subsp. aureus MW2
cacguugugcaauaccu

SEQ ID NO: 4026578 - RNA, 23 nt, Staphylococcus aureus subsp. aureus MW2
cacguugugcaauaccuguucca

SEQ ID NO: 4026579 - RNA, 21 nt, Staphylococcus aureus subsp. aureus MW2
cagauaaguaauaauauaaau

SEQ ID NO: 4026580 - RNA, 17 nt, Staphylococcus aureus subsp. aureus MW2
cagauaggaaacuuaaa

SEQ ID NO: 4026581 - RNA, 15 nt, Staphylococcus aureus subsp. aureus MW2
cagauccauaaggau

SEQ ID NO: 4026582 - RNA, 13 nt, Staphylococcus aureus subsp. aureus MW2
cagaugaauaaug

SEQ ID NO: 4026583 - RNA, 22 nt, Staphylococcus aureus subsp. aureus MW2
cagaugaauaauguuuccauuu

SEQ ID NO: 4026584 - RNA, 17 nt, Staphylococcus aureus subsp. aureus MW2
cagauguugguucauca

SEQ ID NO: 4026585 - RNA, 22 nt, Staphylococcus aureus subsp. aureus MW2
cagauucaaacguuuucacuuc

SEQ ID NO: 4026586 - RNA, 17 nt, Staphylococcus aureus subsp. aureus MW2
cagauucauaucuuuca

SEQ ID NO: 4026587 - RNA, 19 nt, Staphylococcus aureus subsp. aureus MW2
cagauugugacaauuuaaa

SEQ ID NO: 4026588 - RNA, 15 nt, Staphylococcus aureus subsp. aureus MW2
cagauuuuaaaaauu

SEQ ID NO: 4026589 - RNA, 21 nt, Staphylococcus aureus subsp. aureus MW2
cagauuuuaaaaauucauaau

SEQ ID NO: 4026590 - RNA, 20 nt, Staphylococcus aureus subsp. aureus MW2
cagcaagagauagguuuugu

SEQ ID NO: 4026591 - RNA, 14 nt, Staphylococcus aureus subsp. aureus MW2
cagcacauuuuuag

SEQ ID NO: 4026592 - RNA, 16 nt, Staphylococcus aureus subsp. aureus MW2
cagcaguaagauauuu

SEQ ID NO: 4026593 - RNA, 16 nt, Staphylococcus aureus subsp. aureus MW2
cagcaguugcacaaau

SEQ ID NO: 4026594 - RNA, 13 nt, Staphylococcus aureus subsp. aureus MW2
cagcauacaauaa

SEQ ID NO: 4026595 - RNA, 14 nt, Staphylococcus aureus subsp. aureus MW2
cagcaugaaguggg

SEQ ID NO: 4026596 - RNA, 23 nt, Staphylococcus aureus subsp. aureus MW2
cagcaugaaucgcauuuaaauau

SEQ ID NO: 4026597 - RNA, 19 nt, Staphylococcus aureus subsp. aureus MW2
cagcauuaaucguauuuuu

SEQ ID NO: 4026598 - RNA, 20 nt, Staphylococcus aureus subsp. aureus MW2
cagcauuaaucguauuuuua

SEQ ID NO: 4026599 - RNA, 17 nt, Staphylococcus aureus subsp. aureus MW2
cagcauugggacauaaa

SEQ ID NO: 4026600 - RNA, 20 nt, Staphylococcus aureus subsp. aureus MW2
cagcgauaacguacaaugua

SEQ ID NO: 4026601 - RNA, 16 nt, Staphylococcus aureus subsp. aureus MW2
cagcgauuaaaugaug

SEQ ID NO: 4026602 - RNA, 13 nt, Staphylococcus aureus subsp. aureus MW2
cagcgguuuguau

SEQ ID NO: 4026603 - RNA, 15 nt, Staphylococcus aureus subsp. aureus MW2
cagcuaaaaaguaua

SEQ ID NO: 4026604 - RNA, 13 nt, Staphylococcus aureus subsp. aureus MW2
cagcuaaauauuu

SEQ ID NO: 4026605 - RNA, 12 nt, Staphylococcus aureus subsp. aureus MW2
cagcuaacaaaa

SEQ ID NO: 4026606 - RNA, 13 nt, Staphylococcus aureus subsp. aureus MW2
cagcuaauugucg

SEQ ID NO: 4026607 - RNA, 16 nt, Staphylococcus aureus subsp. aureus MW2
cagcuacaaauaauga

SEQ ID NO: 4026608 - RNA, 17 nt, Staphylococcus aureus subsp. aureus MW2
cagcuacaaauaaugag

SEQ ID NO: 4026609 - RNA, 19 nt, Staphylococcus aureus subsp. aureus MW2
cagcucuuaaaucacuagc

SEQ ID NO: 4026610 - RNA, 18 nt, Staphylococcus aureus subsp. aureus MW2
cagcugcuucucuuugaa

SEQ ID NO: 4026611 - RNA, 14 nt, Staphylococcus aureus subsp. aureus MW2
cagcuguauuuaau

SEQ ID NO: 4026612 - RNA, 17 nt, Staphylococcus aureus subsp. aureus MW2
cagcuguauuuaauaaa

SEQ ID NO: 4026613 - RNA, 17 nt, Staphylococcus aureus subsp. aureus MW2
cagcuuacaauaaugug

SEQ ID NO: 4026614 - RNA, 12 nt, Staphylococcus aureus subsp. aureus MW2
cagcuucaacac

SEQ ID NO: 4026615 - RNA, 12 nt, Staphylococcus aureus subsp. aureus MW2
cagcuucauuaa

SEQ ID NO: 4026616 - RNA, 19 nt, Staphylococcus aureus subsp. aureus MW2
cagcuucuaaguaauauaa

SEQ ID NO: 4026617 - RNA, 14 nt, Staphylococcus aureus subsp. aureus MW2
cagcuucuuuaaca

SEQ ID NO: 4026618 - RNA, 20 nt, Staphylococcus aureus subsp. aureus MW2
cagcuucuuuaacaauugau

SEQ ID NO: 4026619 - RNA, 20 nt, Staphylococcus aureus subsp. aureus MW2
cagcuugaccgccuaugaua

SEQ ID NO: 4026620 - RNA, 17 nt, Staphylococcus aureus subsp. aureus MW2
cagcuuguucaauacuu

SEQ ID NO: 4026621 - RNA, 17 nt, Staphylococcus aureus subsp. aureus MW2
cagcuuuaauaauauga

SEQ ID NO: 4026622 - RNA, 15 nt, Staphylococcus aureus subsp. aureus MW2
cagcuuuauaaugug

SEQ ID NO: 4026623 - RNA, 14 nt, Staphylococcus aureus subsp. aureus MW2
cagcuuuucuucaa

SEQ ID NO: 4026624 - RNA, 12 nt, Staphylococcus aureus subsp. aureus MW2
cagcuuuuucua

SEQ ID NO: 4026625 - RNA, 17 nt, Staphylococcus aureus subsp. aureus MW2
caggaauguuuguauuc

SEQ ID NO: 4026626 - RNA, 22 nt, Staphylococcus aureus subsp. aureus MW2
caggagcgagccauuauuauuu

SEQ ID NO: 4026627 - RNA, 14 nt, Staphylococcus aureus subsp. aureus MW2
caggcaaugcaagu

SEQ ID NO: 4026628 - RNA, 18 nt, Staphylococcus aureus subsp. aureus MW2
caggcaaugcgaguuggg

SEQ ID NO: 4026629 - RNA, 16 nt, Staphylococcus aureus subsp. aureus MW2
cagguacuucgguacu

SEQ ID NO: 4026630 - RNA, 21 nt, Staphylococcus aureus subsp. aureus MW2
caggucgcccuugccugugcu

SEQ ID NO: 4026631 - RNA, 13 nt, Staphylococcus aureus subsp. aureus MW2
caggugcaucuuu

SEQ ID NO: 4026632 - RNA, 16 nt, Staphylococcus aureus subsp. aureus MW2
cagguuacuuuuuuaa

SEQ ID NO: 4026633 - RNA, 15 nt, Staphylococcus aureus subsp. aureus MW2
cagguuaucacaaca

SEQ ID NO: 4026634 - RNA, 13 nt, Staphylococcus aureus subsp. aureus MW2
cagguucaauagu

SEQ ID NO: 4026635 - RNA, 17 nt, Staphylococcus aureus subsp. aureus MW2
caguaaaaauacauuuu

SEQ ID NO: 4026636 - RNA, 15 nt, Staphylococcus aureus subsp. aureus MW2
caguaaauuuauuau

SEQ ID NO: 4026637 - RNA, 21 nt, Staphylococcus aureus subsp. aureus MW2
caguaagaugauuucaaaugu

SEQ ID NO: 4026638 - RNA, 14 nt, Staphylococcus aureus subsp. aureus MW2
caguaagauuauuu

SEQ ID NO: 4026639 - RNA, 21 nt, Staphylococcus aureus subsp. aureus MW2
caguaagauuauuuucaauua

SEQ ID NO: 4026640 - RNA, 11 nt, Staphylococcus aureus subsp. aureus MW2
caguaauaaug

SEQ ID NO: 4026641 - RNA, 15 nt, Staphylococcus aureus subsp. aureus MW2
caguaauauguugcu

SEQ ID NO: 4026642 - RNA, 20 nt, Staphylococcus aureus subsp. aureus MW2
caguaauauguugcuuauca

SEQ ID NO: 4026643 - RNA, 16 nt, Staphylococcus aureus subsp. aureus MW2
caguaaucaaaguauc

SEQ ID NO: 4026644 - RNA, 19 nt, Staphylococcus aureus subsp. aureus MW2
caguaaucaugcauucuau

SEQ ID NO: 4026645 - RNA, 15 nt, Staphylococcus aureus subsp. aureus MW2
caguaauucuuaaaa

SEQ ID NO: 4026646 - RNA, 16 nt, Staphylococcus aureus subsp. aureus MW2
caguaauuuuuaaaca

SEQ ID NO: 4026647 - RNA, 14 nt, Staphylococcus aureus subsp. aureus MW2
caguacaaauaaca

SEQ ID NO: 4026648 - RNA, 15 nt, Staphylococcus aureus subsp. aureus MW2
caguacaaauaacaa

SEQ ID NO: 4026649 - RNA, 21 nt, Staphylococcus aureus subsp. aureus MW2
caguacaauccugaagagaaa

SEQ ID NO: 4026650 - RNA, 14 nt, Staphylococcus aureus subsp. aureus MW2
caguacgaacaacu

SEQ ID NO: 4026651 - RNA, 15 nt, Staphylococcus aureus subsp. aureus MW2
caguaggauaauuuc

SEQ ID NO: 4026652 - RNA, 15 nt, Staphylococcus aureus subsp. aureus MW2
caguauauaucaaau

SEQ ID NO: 4026653 - RNA, 18 nt, Staphylococcus aureus subsp. aureus MW2
caguauauaucaaauaca

SEQ ID NO: 4026654 - RNA, 14 nt, Staphylococcus aureus subsp. aureus MW2
caguauaugucgca

SEQ ID NO: 4026655 - RNA, 20 nt, Staphylococcus aureus subsp. aureus MW2
caguauauuuuaacaaugaa

SEQ ID NO: 4026656 - RNA, 17 nt, Staphylococcus aureus subsp. aureus MW2
caguaucucuuuucuau

SEQ ID NO: 4026657 - RNA, 15 nt, Staphylococcus aureus subsp. aureus MW2
caguauguaaaaagu

SEQ ID NO: 4026658 - RNA, 20 nt, Staphylococcus aureus subsp. aureus MW2
caguauguagcuuaacguug

SEQ ID NO: 4026659 - RNA, 22 nt, Staphylococcus aureus subsp. aureus MW2
caguauuaauuacauguuggca

SEQ ID NO: 4026660 - RNA, 18 nt, Staphylococcus aureus subsp. aureus MW2
cagucaauuuuuucaucu

SEQ ID NO: 4026661 - RNA, 20 nt, Staphylococcus aureus subsp. aureus MW2
cagucaauuuuuucaucuuu

SEQ ID NO: 4026662 - RNA, 12 nt, Staphylococcus aureus subsp. aureus MW2
cagucagcuuuu

SEQ ID NO: 4026663 - RNA, 16 nt, Staphylococcus aureus subsp. aureus MW2
cagucaguaaaaauac

SEQ ID NO: 4026664 - RNA, 15 nt, Staphylococcus aureus subsp. aureus MW2
cagucaucaucauga

SEQ ID NO: 4026665 - RNA, 13 nt, Staphylococcus aureus subsp. aureus MW2
cagucauucacau

SEQ ID NO: 4026666 - RNA, 17 nt, Staphylococcus aureus subsp. aureus MW2
cagucauuugauuuaaa

SEQ ID NO: 4026667 - RNA, 14 nt, Staphylococcus aureus subsp. aureus MW2
cagucguuaaaaua

SEQ ID NO: 4026668 - RNA, 20 nt, Staphylococcus aureus subsp. aureus MW2
cauaaucgggaugauaacca

SEQ ID NO: 4026669 - RNA, 20 nt, Staphylococcus aureus subsp. aureus MW2
cauaaucucuuuacaccauu

SEQ ID NO: 4026670 - RNA, 18 nt, Staphylococcus aureus subsp. aureus MW2
cauaaucuucauuaauua

SEQ ID NO: 4026671 - RNA, 24 nt, Staphylococcus aureus subsp. aureus MW2
cauaaugaacaagggccauccauu

SEQ ID NO: 4026672 - RNA, 15 nt, Staphylococcus aureus subsp. aureus MW2
cauaaugaucaagua

SEQ ID NO: 4026673 - RNA, 22 nt, Staphylococcus aureus subsp. aureus MW2
cauaaugugaugguucaaauau

SEQ ID NO: 4026674 - RNA, 15 nt, Staphylococcus aureus subsp. aureus MW2
cauaauuaaauaacu

SEQ ID NO: 4026675 - RNA, 18 nt, Staphylococcus aureus subsp. aureus MW2
cauaauuaccuuuccauu

SEQ ID NO: 4026676 - RNA, 19 nt, Staphylococcus aureus subsp. aureus MW2
cauaauuaccuuuccauuc

SEQ ID NO: 4026677 - RNA, 11 nt, Staphylococcus aureus subsp. aureus MW2
cauaauuuaaa

SEQ ID NO: 4026678 - RNA, 14 nt, Staphylococcus aureus subsp. aureus MW2
cauaauuuaucugc

SEQ ID NO: 4026679 - RNA, 22 nt, Staphylococcus aureus subsp. aureus MW2
cauaauuugauguucuugaaaa

SEQ ID NO: 4026680 - RNA, 15 nt, Staphylococcus aureus subsp. aureus MW2
cauaauuuguugaua

SEQ ID NO: 4026681 - RNA, 15 nt, Staphylococcus aureus subsp. aureus MW2
cauaauuuucuauua

SEQ ID NO: 4026682 - RNA, 13 nt, Staphylococcus aureus subsp. aureus MW2
cauacaaauuuuu

SEQ ID NO: 4026683 - RNA, 14 nt, Staphylococcus aureus subsp. aureus MW2
cauacacaaugauu

SEQ ID NO: 4026684 - RNA, 19 nt, Staphylococcus aureus subsp. aureus MW2
cauacacaaugccuuuaaa

SEQ ID NO: 4026685 - RNA, 14 nt, Staphylococcus aureus subsp. aureus MW2
cauacacuaucauu

SEQ ID NO: 4026686 - RNA, 23 nt, Staphylococcus aureus subsp. aureus MW2
cauacacuaucauuaucaaauaa

SEQ ID NO: 4026687 - RNA, 15 nt, Staphylococcus aureus subsp. aureus MW2
cauacacuugguuau

SEQ ID NO: 4026688 - RNA, 19 nt, Staphylococcus aureus subsp. aureus MW2
cauacacuugguuaucauu

SEQ ID NO: 4026689 - RNA, 16 nt, Staphylococcus aureus subsp. aureus MW2
cauacaggaaauugaa

SEQ ID NO: 4026690 - RNA, 15 nt, Staphylococcus aureus subsp. aureus MW2
cauacauaugcuaua

SEQ ID NO: 4026691 - RNA, 15 nt, Staphylococcus aureus subsp. aureus MW2
cauacauauuuauau

SEQ ID NO: 4026692 - RNA, 22 nt, Staphylococcus aureus subsp. aureus MW2
cauaccaaauaaauaagugaua

SEQ ID NO: 4026693 - RNA, 23 nt, Staphylococcus aureus subsp. aureus MW2
cauaccacuugaauacuuuuuaa

SEQ ID NO: 4026694 - RNA, 21 nt, Staphylococcus aureus subsp. aureus MW2
cauaccaguggaaauuaugua

SEQ ID NO: 4026695 - RNA, 15 nt, Staphylococcus aureus subsp. aureus MW2
cauacccauauuaaa

SEQ ID NO: 4026696 - RNA, 16 nt, Staphylococcus aureus subsp. aureus MW2
cauaccggcaaauaac

SEQ ID NO: 4026697 - RNA, 17 nt, Staphylococcus aureus subsp. aureus MW2
cauaccggcaaauaaca

SEQ ID NO: 4026698 - RNA, 20 nt, Staphylococcus aureus subsp. aureus MW2
cauaccuaauaacgcauaua

SEQ ID NO: 4026699 - RNA, 13 nt, Staphylococcus aureus subsp. aureus MW2
cauaccuacaaau

SEQ ID NO: 4026700 - RNA, 12 nt, Staphylococcus aureus subsp. aureus MW2
cauacuucaaac

SEQ ID NO: 4026701 - RNA, 15 nt, Staphylococcus aureus subsp. aureus MW2
cauacuucguuguca

SEQ ID NO: 4026702 - RNA, 17 nt, Staphylococcus aureus subsp. aureus MW2
cauacuucuauuuuaua

SEQ ID NO: 4026703 - RNA, 22 nt, Staphylococcus aureus subsp. aureus MW2
cauacuugucguauucuucaau

SEQ ID NO: 4026704 - RNA, 22 nt, Staphylococcus aureus subsp. aureus MW2
cauacuuuuagcaacaguauuu

SEQ ID NO: 4026705 - RNA, 12 nt, Staphylococcus aureus subsp. aureus MW2
cauacuuuuuca

SEQ ID NO: 4026706 - RNA, 20 nt, Staphylococcus aureus subsp. aureus MW2
cauagaaauugucuuuucau

SEQ ID NO: 4026707 - RNA, 13 nt, Staphylococcus aureus subsp. aureus MW2
cauagaagcuggc

SEQ ID NO: 4026708 - RNA, 16 nt, Staphylococcus aureus subsp. aureus MW2
cauagacacuuaacuu

SEQ ID NO: 4026709 - RNA, 15 nt, Staphylococcus aureus subsp. aureus MW2
cauagagaauuucaa

SEQ ID NO: 4026710 - RNA, 16 nt, Staphylococcus aureus subsp. aureus MW2
cauagagaauuucaaa

SEQ ID NO: 4026711 - RNA, 22 nt, Staphylococcus aureus subsp. aureus MW2
cauagagaauuucaaaaaggaa

SEQ ID NO: 4026712 - RNA, 13 nt, Staphylococcus aureus subsp. aureus MW2
cauagagcauuug

SEQ ID NO: 4026713 - RNA, 13 nt, Staphylococcus aureus subsp. aureus MW2
cauagauuauauu

SEQ ID NO: 4026714 - RNA, 18 nt, Staphylococcus aureus subsp. aureus MW2
cauagccucuuaaaauac

SEQ ID NO: 4026715 - RNA, 16 nt, Staphylococcus aureus subsp. aureus MW2
cauagcuaaauaaauu

SEQ ID NO: 4026716 - RNA, 16 nt, Staphylococcus aureus subsp. aureus MW2
cauagcucuucuuuuu

SEQ ID NO: 4026717 - RNA, 14 nt, Staphylococcus aureus subsp. aureus MW2
cauaggauaucuac

SEQ ID NO: 4026718 - RNA, 23 nt, Staphylococcus aureus subsp. aureus MW2
cauaggcuuacggggcuuuuugu

SEQ ID NO: 4026719 - RNA, 13 nt, Staphylococcus aureus subsp. aureus MW2
cauagguaaccuu

SEQ ID NO: 4026720 - RNA, 13 nt, Staphylococcus aureus subsp. aureus MW2
cauaguaacaaaa

SEQ ID NO: 4026721 - RNA, 14 nt, Staphylococcus aureus subsp. aureus MW2
cauaguaaucgauu

SEQ ID NO: 4026722 - RNA, 12 nt, Staphylococcus aureus subsp. aureus MW2
cauauaaaaacc

SEQ ID NO: 4026723 - RNA, 19 nt, Staphylococcus aureus subsp. aureus MW2
cauauaaagcugcgauaua

SEQ ID NO: 4026724 - RNA, 23 nt, Staphylococcus aureus subsp. aureus MW2
cauauaaugguugaauaacacua

SEQ ID NO: 4026725 - RNA, 17 nt, Staphylococcus aureus subsp. aureus MW2
cauauacaaauuuauau

SEQ ID NO: 4026726 - RNA, 22 nt, Staphylococcus aureus subsp. aureus MW2
cauauacguauacaucauuaga

SEQ ID NO: 4026727 - RNA, 16 nt, Staphylococcus aureus subsp. aureus MW2
cauauacucuaaaaaa

SEQ ID NO: 4026728 - RNA, 18 nt, Staphylococcus aureus subsp. aureus MW2
cauauaguuguaucaaau

SEQ ID NO: 4026729 - RNA, 14 nt, Staphylococcus aureus subsp. aureus MW2
cauauaucaacaug

SEQ ID NO: 4026730 - RNA, 22 nt, Staphylococcus aureus subsp. aureus MW2
cauauauucauugauuguuaau

SEQ ID NO: 4026731 - RNA, 23 nt, Staphylococcus aureus subsp. aureus MW2
cauauauucuaauugcacauuua

SEQ ID NO: 4026732 - RNA, 17 nt, Staphylococcus aureus subsp. aureus MW2
cauaucauagaaucgua

SEQ ID NO: 4026733 - RNA, 19 nt, Staphylococcus aureus subsp. aureus MW2
cauaucgcgcaucaaaaau

SEQ ID NO: 4026734 - RNA, 23 nt, Staphylococcus aureus subsp. aureus MW2
cauaucuauaucgucgauuucau

SEQ ID NO: 4026735 - RNA, 13 nt, Staphylococcus aureus subsp. aureus MW2
cauaucuauuuuu

SEQ ID NO: 4026736 - RNA, 16 nt, Staphylococcus aureus subsp. aureus MW2
cauaucuuuaucauua

SEQ ID NO: 4026737 - RNA, 13 nt, Staphylococcus aureus subsp. aureus MW2
cauaucuuucaau

SEQ ID NO: 4026738 - RNA, 22 nt, Staphylococcus aureus subsp. aureus MW2
cauauggacguaacuguuuuaa

SEQ ID NO: 4026739 - RNA, 23 nt, Staphylococcus aureus subsp. aureus MW2
cauauggcaaaaucaacuuuaau

SEQ ID NO: 4026740 - RNA, 23 nt, Staphylococcus aureus subsp. aureus MW2
cauauggugaacuguuaaacuca

SEQ ID NO: 4026741 - RNA, 16 nt, Staphylococcus aureus subsp. aureus MW2
cauauguaauacaaaa

SEQ ID NO: 4026742 - RNA, 14 nt, Staphylococcus aureus subsp. aureus MW2
cauaugugguggcu

SEQ ID NO: 4026743 - RNA, 19 nt, Staphylococcus aureus subsp. aureus MW2
cauauguguaugauagaau

SEQ ID NO: 4026744 - RNA, 22 nt, Staphylococcus aureus subsp. aureus MW2
cauauguuguuucuaaugcuca

SEQ ID NO: 4026745 - RNA, 18 nt, Staphylococcus aureus subsp. aureus MW2
cauauuaauauuuuuuga

SEQ ID NO: 4026746 - RNA, 20 nt, Staphylococcus aureus subsp. aureus MW2
cauauuacuuuggaaauuua

SEQ ID NO: 4026747 - RNA, 11 nt, Staphylococcus aureus subsp. aureus MW2
cauauucacau

SEQ ID NO: 4026748 - RNA, 15 nt, Staphylococcus aureus subsp. aureus MW2
cauauucaguauaug

SEQ ID NO: 4026749 - RNA, 20 nt, Staphylococcus aureus subsp. aureus MW2
cauauucauaauaucgauga

SEQ ID NO: 4026750 - RNA, 20 nt, Staphylococcus aureus subsp. aureus MW2
cauauugugccgcuucuaca

SEQ ID NO: 4026751 - RNA, 13 nt, Staphylococcus aureus subsp. aureus MW2
cauauuuaauguu

SEQ ID NO: 4026752 - RNA, 13 nt, Staphylococcus aureus subsp. aureus MW2
cauauuuauauuu

SEQ ID NO: 4026753 - RNA, 23 nt, Staphylococcus aureus subsp. aureus MW2
cauauuuauauuuuguaugaaug

SEQ ID NO: 4026754 - RNA, 15 nt, Staphylococcus aureus subsp. aureus MW2
cauauuuugauuuac

SEQ ID NO: 4026755 - RNA, 13 nt, Staphylococcus aureus subsp. aureus MW2
cauauuuuuuaaa

SEQ ID NO: 4026756 - RNA, 17 nt, Staphylococcus aureus subsp. aureus MW2
cauauuuuuuaaauuua

SEQ ID NO: 4026757 - RNA, 22 nt, Staphylococcus aureus subsp. aureus MW2
caucuuagacgcuguuuuaaau

SEQ ID NO: 4026758 - RNA, 15 nt, Staphylococcus aureus subsp. aureus MW2
caucuuaucaagaau

SEQ ID NO: 4026759 - RNA, 19 nt, Staphylococcus aureus subsp. aureus MW2
caucuuaucaagaauauaa

SEQ ID NO: 4026760 - RNA, 14 nt, Staphylococcus aureus subsp. aureus MW2
caucuucaauauuu

SEQ ID NO: 4026761 - RNA, 22 nt, Staphylococcus aureus subsp. aureus MW2
caucuucaauauuuaaauuuua

SEQ ID NO: 4026762 - RNA, 13 nt, Staphylococcus aureus subsp. aureus MW2
caucuucuaauug

SEQ ID NO: 4026763 - RNA, 18 nt, Staphylococcus aureus subsp. aureus MW2
caucuucuaauuguugug

SEQ ID NO: 4026764 - RNA, 15 nt, Staphylococcus aureus subsp. aureus MW2
caucuucuucaaaac

SEQ ID NO: 4026765 - RNA, 16 nt, Staphylococcus aureus subsp. aureus MW2
caucuucuucaucaua

SEQ ID NO: 4026766 - RNA, 23 nt, Staphylococcus aureus subsp. aureus MW2
caucuucuugauuguaaauaaaa

SEQ ID NO: 4026767 - RNA, 13 nt, Staphylococcus aureus subsp. aureus MW2
caucuugacacaa

SEQ ID NO: 4026768 - RNA, 19 nt, Staphylococcus aureus subsp. aureus MW2
caucuuuagcuauuuaaaa

SEQ ID NO: 4026769 - RNA, 21 nt, Staphylococcus aureus subsp. aureus MW2
caucuuuauacacaaaguauu

SEQ ID NO: 4026770 - RNA, 14 nt, Staphylococcus aureus subsp. aureus MW2
caucuuuauuuaca

SEQ ID NO: 4026771 - RNA, 12 nt, Staphylococcus aureus subsp. aureus MW2
caucuuucaaau

SEQ ID NO: 4026772 - RNA, 17 nt, Staphylococcus aureus subsp. aureus MW2
caucuuucaaaugcuua

SEQ ID NO: 4026773 - RNA, 19 nt, Staphylococcus aureus subsp. aureus MW2
caucuuucacaauuguaua

SEQ ID NO: 4026774 - RNA, 17 nt, Staphylococcus aureus subsp. aureus MW2
caucuuuugguuuaucu

SEQ ID NO: 4026775 - RNA, 18 nt, Staphylococcus aureus subsp. aureus MW2
caucuuuugguuuaucug

SEQ ID NO: 4026776 - RNA, 19 nt, Staphylococcus aureus subsp. aureus MW2
caucuuuugguuuaucugu

SEQ ID NO: 4026777 - RNA, 12 nt, Staphylococcus aureus subsp. aureus MW2
caucuuuuucac

SEQ ID NO: 4026778 - RNA, 16 nt, Staphylococcus aureus subsp. aureus MW2
caucuuuuuuaucaug

SEQ ID NO: 4026779 - RNA, 18 nt, Staphylococcus aureus subsp. aureus MW2
caugaaaauuaaaaaaug

SEQ ID NO: 4026780 - RNA, 15 nt, Staphylococcus aureus subsp. aureus MW2
caugaauaaauacaa

SEQ ID NO: 4026781 - RNA, 22 nt, Staphylococcus aureus subsp. aureus MW2
caugaaucaacaauauaaaagc

SEQ ID NO: 4026782 - RNA, 18 nt, Staphylococcus aureus subsp. aureus MW2
caugaaucgcauuuaaau

SEQ ID NO: 4026783 - RNA, 20 nt, Staphylococcus aureus subsp. aureus MW2
caugacauaaaacuuacauu

SEQ ID NO: 4026784 - RNA, 15 nt, Staphylococcus aureus subsp. aureus MW2
caugacauucauuua

SEQ ID NO: 4026785 - RNA, 21 nt, Staphylococcus aureus subsp. aureus MW2
caugagauuauuuuuuuaaau

SEQ ID NO: 4026786 - RNA, 20 nt, Staphylococcus aureus subsp. aureus MW2
caugauaaaaauaaaaaacg

SEQ ID NO: 4026787 - RNA, 20 nt, Staphylococcus aureus subsp. aureus MW2
caugauaaaguauguuguca

SEQ ID NO: 4026788 - RNA, 17 nt, Staphylococcus aureus subsp. aureus MW2
caugauacugaaauuuc

SEQ ID NO: 4026789 - RNA, 21 nt, Staphylococcus aureus subsp. aureus MW2
caugauacugaaauuucauaa

SEQ ID NO: 4026790 - RNA, 16 nt, Staphylococcus aureus subsp. aureus MW2
caugauauaaauaggu

SEQ ID NO: 4026791 - RNA, 20 nt, Staphylococcus aureus subsp. aureus MW2
caugaugauaaauugaguuu

SEQ ID NO: 4026792 - RNA, 14 nt, Staphylococcus aureus subsp. aureus MW2
caugauucaugaua

SEQ ID NO: 4026793 - RNA, 17 nt, Staphylococcus aureus subsp. aureus MW2
caugauucaugauaugu

SEQ ID NO: 4026794 - RNA, 16 nt, Staphylococcus aureus subsp. aureus MW2
caugauugaaauccuu

SEQ ID NO: 4026795 - RNA, 19 nt, Staphylococcus aureus subsp. aureus MW2
caugcaccuuuacaacaua

SEQ ID NO: 4026796 - RNA, 23 nt, Staphylococcus aureus subsp. aureus MW2
caugcacgaaugguucuucccca

SEQ ID NO: 4026797 - RNA, 16 nt, Staphylococcus aureus subsp. aureus MW2
caugcacuuuauuaaa

SEQ ID NO: 4026798 - RNA, 18 nt, Staphylococcus aureus subsp. aureus MW2
caugcccgauaaaaccac

SEQ ID NO: 4026799 - RNA, 18 nt, Staphylococcus aureus subsp. aureus MW2
caugcgauugaugcguuu

SEQ ID NO: 4026800 - RNA, 16 nt, Staphylococcus aureus subsp. aureus MW2
caugcucauuugauaa

SEQ ID NO: 4026801 - RNA, 20 nt, Staphylococcus aureus subsp. aureus MW2
caugcugaaucgaguuugaa

SEQ ID NO: 4026802 - RNA, 17 nt, Staphylococcus aureus subsp. aureus MW2
caugcuuaauuuaugug

SEQ ID NO: 4026803 - RNA, 12 nt, Staphylococcus aureus subsp. aureus MW2
cauggaaaagug

SEQ ID NO: 4026804 - RNA, 16 nt, Staphylococcus aureus subsp. aureus MW2
cauggaaaauauauua

SEQ ID NO: 4026805 - RNA, 13 nt, Staphylococcus aureus subsp. aureus MW2
cauggcuuaaauc

SEQ ID NO: 4026806 - RNA, 21 nt, Staphylococcus aureus subsp. aureus MW2
cauggcuuaaaucaaauggua

SEQ ID NO: 4026807 - RNA, 15 nt, Staphylococcus aureus subsp. aureus MW2
caugguaucuuuaau

SEQ ID NO: 4026808 - RNA, 23 nt, Staphylococcus aureus subsp. aureus MW2
caugguuaaagacagguuacuuu

SEQ ID NO: 4026809 - RNA, 15 nt, Staphylococcus aureus subsp. aureus MW2
cauguaacaaaauac

SEQ ID NO: 4026810 - RNA, 13 nt, Staphylococcus aureus subsp. aureus MW2
cauguaacagugu

SEQ ID NO: 4026811 - RNA, 17 nt, Staphylococcus aureus subsp. aureus MW2
cauguaaugcuuaaaaa

SEQ ID NO: 4026812 - RNA, 15 nt, Staphylococcus aureus subsp. aureus MW2
cauguacaguuacuu

SEQ ID NO: 4026813 - RNA, 20 nt, Staphylococcus aureus subsp. aureus MW2
cauguacguuuuuuuaaaua

SEQ ID NO: 4026814 - RNA, 21 nt, Staphylococcus aureus subsp. aureus MW2
cauguacguuuuuuuaaauac

SEQ ID NO: 4026815 - RNA, 17 nt, Staphylococcus aureus subsp. aureus MW2
cauguauaaggauaucu

SEQ ID NO: 4026816 - RNA, 19 nt, Staphylococcus aureus subsp. aureus MW2
cauguauauggcaucauca

SEQ ID NO: 4026817 - RNA, 20 nt, Staphylococcus aureus subsp. aureus MW2
cauguauucuuagauauuau

SEQ ID NO: 4026818 - RNA, 15 nt, Staphylococcus aureus subsp. aureus MW2
cauguauuggccaaa

SEQ ID NO: 4026819 - RNA, 22 nt, Staphylococcus aureus subsp. aureus MW2
cauguauuuaguaucauaauag

SEQ ID NO: 4026820 - RNA, 21 nt, Staphylococcus aureus subsp. aureus MW2
caugucaauuuuuucaugauu

SEQ ID NO: 4026821 - RNA, 19 nt, Staphylococcus aureus subsp. aureus MW2
caugucacuggguguuuuu

SEQ ID NO: 4026822 - RNA, 19 nt, Staphylococcus aureus subsp. aureus MW2
cauguccgagacuauauuc

SEQ ID NO: 4026823 - RNA, 18 nt, Staphylococcus aureus subsp. aureus MW2
caugucuagauuucaaau

SEQ ID NO: 4026824 - RNA, 15 nt, Staphylococcus aureus subsp. aureus MW2
caugucuuaaauucu

SEQ ID NO: 4026825 - RNA, 16 nt, Staphylococcus aureus subsp. aureus MW2
caugugucauaaucca

SEQ ID NO: 4026826 - RNA, 15 nt, Staphylococcus aureus subsp. aureus MW2
cauguguugcaauug

SEQ ID NO: 4026827 - RNA, 19 nt, Staphylococcus aureus subsp. aureus MW2
cauguuauauuaugaacau

SEQ ID NO: 4026828 - RNA, 15 nt, Staphylococcus aureus subsp. aureus MW2
cauguuauguuuaag

SEQ ID NO: 4026829 - RNA, 22 nt, Staphylococcus aureus subsp. aureus MW2
cauguuccccauuaauuaacaa

SEQ ID NO: 4026830 - RNA, 19 nt, Staphylococcus aureus subsp. aureus MW2
cauguuccgcuacaaaaca

SEQ ID NO: 4026831 - RNA, 14 nt, Staphylococcus aureus subsp. aureus MW2
cauguugauaaaaa

SEQ ID NO: 4026832 - RNA, 23 nt, Staphylococcus aureus subsp. aureus MW2
cauguuggcauaaccuguuuuua

SEQ ID NO: 4026833 - RNA, 22 nt, Staphylococcus aureus subsp. aureus MW2
cauguuuauuagcuuuuucaac

SEQ ID NO: 4026834 - RNA, 24 nt, Staphylococcus aureus subsp. aureus MW2
cauguuugauucuaaauaaucgaa

SEQ ID NO: 4026835 - RNA, 19 nt, Staphylococcus aureus subsp. aureus MW2
cauguuuggaugaacaaaa

SEQ ID NO: 4026836 - RNA, 15 nt, Staphylococcus aureus subsp. aureus MW2
cauguuuuuuaagua

SEQ ID NO: 4026837 - RNA, 12 nt, Staphylococcus aureus subsp. aureus MW2
cauuaaaaaauc

SEQ ID NO: 4026838 - RNA, 23 nt, Staphylococcus aureus subsp. aureus MW2
cauuaaaaaaucgaacuagacaa

SEQ ID NO: 4026839 - RNA, 14 nt, Staphylococcus aureus subsp. aureus MW2
cauuaaaaauaaaa

SEQ ID NO: 4026840 - RNA, 13 nt, Staphylococcus aureus subsp. aureus MW2
cauuaaaauaauu

SEQ ID NO: 4026841 - RNA, 13 nt, Staphylococcus aureus subsp. aureus MW2
cauuaaaaugaua

SEQ ID NO: 4026842 - RNA, 14 nt, Staphylococcus aureus subsp. aureus MW2
cauuaaaaugauau

SEQ ID NO: 4026843 - RNA, 19 nt, Staphylococcus aureus subsp. aureus MW2
cauuaaaauguguuuucaa

SEQ ID NO: 4026844 - RNA, 18 nt, Staphylococcus aureus subsp. aureus MW2
cauuaaacauauuuuuug

SEQ ID NO: 4026845 - RNA, 20 nt, Staphylococcus aureus subsp. aureus MW2
cauugauaguuuuauaauuc

SEQ ID NO: 4026846 - RNA, 16 nt, Staphylococcus aureus subsp. aureus MW2
cauugaucuuuuauaa

SEQ ID NO: 4026847 - RNA, 21 nt, Staphylococcus aureus subsp. aureus MW2
cauugcaaaagugguuguucc

SEQ ID NO: 4026848 - RNA, 17 nt, Staphylococcus aureus subsp. aureus MW2
cauugcacuaugcauaa

SEQ ID NO: 4026849 - RNA, 23 nt, Staphylococcus aureus subsp. aureus MW2
cauugcacuugucucaaauuaaa

SEQ ID NO: 4026850 - RNA, 22 nt, Staphylococcus aureus subsp. aureus MW2
cauugcguaacaucacagaaaa

SEQ ID NO: 4026851 - RNA, 20 nt, Staphylococcus aureus subsp. aureus MW2
cauuggauagguaacuaaaa

SEQ ID NO: 4026852 - RNA, 22 nt, Staphylococcus aureus subsp. aureus MW2
cauuggcaauauacuuuuuaaa

SEQ ID NO: 4026853 - RNA, 17 nt, Staphylococcus aureus subsp. aureus MW2
cauugguaccuuuuuau

SEQ ID NO: 4026854 - RNA, 23 nt, Staphylococcus aureus subsp. aureus MW2
cauugguaccuuuuuauuaucuu

SEQ ID NO: 4026855 - RNA, 15 nt, Staphylococcus aureus subsp. aureus MW2
cauuguaaaaugcuc

SEQ ID NO: 4026856 - RNA, 22 nt, Staphylococcus aureus subsp. aureus MW2
cauuguaaauauaguaauaaaa

SEQ ID NO: 4026857 - RNA, 14 nt, Staphylococcus aureus subsp. aureus MW2
cauuguaauaccaa

SEQ ID NO: 4026858 - RNA, 23 nt, Staphylococcus aureus subsp. aureus MW2
cauuguagcgccuaagacauaaa

SEQ ID NO: 4026859 - RNA, 22 nt, Staphylococcus aureus subsp. aureus MW2
cauuguguaucguuuuacuuuc

SEQ ID NO: 4026860 - RNA, 15 nt, Staphylococcus aureus subsp. aureus MW2
cauuguuauccaaaa

SEQ ID NO: 4026861 - RNA, 12 nt, Staphylococcus aureus subsp. aureus MW2
cauuuaaaaaau

SEQ ID NO: 4026862 - RNA, 14 nt, Staphylococcus aureus subsp. aureus MW2
cauuuaaaauauuu

SEQ ID NO: 4026863 - RNA, 18 nt, Staphylococcus aureus subsp. aureus MW2
cauuuaaaauauuuuuuc

SEQ ID NO: 4026864 - RNA, 20 nt, Staphylococcus aureus subsp. aureus MW2
cauuuaaaauauuuuuucug

SEQ ID NO: 4026865 - RNA, 15 nt, Staphylococcus aureus subsp. aureus MW2
cauuuaacguaucau

SEQ ID NO: 4026866 - RNA, 22 nt, Staphylococcus aureus subsp. aureus MW2
cauuuaacucaccuuuaucauu

SEQ ID NO: 4026867 - RNA, 22 nt, Staphylococcus aureus subsp. aureus MW2
cauuuaaggauuuccucgguuu

SEQ ID NO: 4026868 - RNA, 14 nt, Staphylococcus aureus subsp. aureus MW2
cauuuaaguuaucu

SEQ ID NO: 4026869 - RNA, 20 nt, Staphylococcus aureus subsp. aureus MW2
cauuuaauuggaguucaucu

SEQ ID NO: 4026870 - RNA, 13 nt, Staphylococcus aureus subsp. aureus MW2
cauuuagauuuca

SEQ ID NO: 4026871 - RNA, 15 nt, Staphylococcus aureus subsp. aureus MW2
cauuuagauuucaua

SEQ ID NO: 4026872 - RNA, 16 nt, Staphylococcus aureus subsp. aureus MW2
cauuuagauuucauaa

SEQ ID NO: 4026873 - RNA, 21 nt, Staphylococcus aureus subsp. aureus MW2
cauuuagauuucauaauguua

SEQ ID NO: 4026874 - RNA, 18 nt, Staphylococcus aureus subsp. aureus MW2
cauuuaguuggacaaauu

SEQ ID NO: 4026875 - RNA, 13 nt, Staphylococcus aureus subsp. aureus MW2
cauuuauaaaucu

SEQ ID NO: 4026876 - RNA, 15 nt, Staphylococcus aureus subsp. aureus MW2
cauuuauaaaucuuu

SEQ ID NO: 4026877 - RNA, 17 nt, Staphylococcus aureus subsp. aureus MW2
cauuuauaugauguuca

SEQ ID NO: 4026878 - RNA, 18 nt, Staphylococcus aureus subsp. aureus MW2
cauuuauauggaauacua

SEQ ID NO: 4026879 - RNA, 12 nt, Staphylococcus aureus subsp. aureus MW2
cauuuauuuaau

SEQ ID NO: 4026880 - RNA, 22 nt, Staphylococcus aureus subsp. aureus MW2
cauuuauuuucaauaaauaaac

SEQ ID NO: 4026881 - RNA, 23 nt, Staphylococcus aureus subsp. aureus MW2
cauuuauuuucuuuggugaaagu

SEQ ID NO: 4026882 - RNA, 15 nt, Staphylococcus aureus subsp. aureus MW2
cauuuauuuuuucuc

SEQ ID NO: 4026883 - RNA, 17 nt, Staphylococcus aureus subsp. aureus MW2
cauuuauuuuuucucua

SEQ ID NO: 4026884 - RNA, 18 nt, Staphylococcus aureus subsp. aureus MW2
cauuuauuuuuucucuau

SEQ ID NO: 4026885 - RNA, 13 nt, Staphylococcus aureus subsp. aureus MW2
cauuucagaaaua

SEQ ID NO: 4026886 - RNA, 16 nt, Staphylococcus aureus subsp. aureus MW2
cauuucagaaauacau

SEQ ID NO: 4026887 - RNA, 20 nt, Staphylococcus aureus subsp. aureus MW2
cauuucaguauauuuuaaca

SEQ ID NO: 4026888 - RNA, 14 nt, Staphylococcus aureus subsp. aureus MW2
cauuucauguguca

SEQ ID NO: 4026889 - RNA, 17 nt, Staphylococcus aureus subsp. aureus MW2
cauuucaugugucacaa

SEQ ID NO: 4026890 - RNA, 20 nt, Staphylococcus aureus subsp. aureus MW2
cauuucaugugucacaauga

SEQ ID NO: 4026891 - RNA, 21 nt, Staphylococcus aureus subsp. aureus MW2
cauuucgauaccuaaaauacc

SEQ ID NO: 4026892 - RNA, 14 nt, Staphylococcus aureus subsp. aureus MW2
cauuucuucaauuu

SEQ ID NO: 4026893 - RNA, 15 nt, Staphylococcus aureus subsp. aureus MW2
cauuucuucaauuuu

SEQ ID NO: 4026894 - RNA, 13 nt, Staphylococcus aureus subsp. aureus MW2
cauuugaccaagu

SEQ ID NO: 4026895 - RNA, 13 nt, Staphylococcus aureus subsp. aureus MW2
cauuugacugauu

SEQ ID NO: 4026896 - RNA, 15 nt, Staphylococcus aureus subsp. aureus MW2
cauuugauuuaaaaa

SEQ ID NO: 4026897 - RNA, 19 nt, Staphylococcus aureus subsp. aureus MW2
cauuugcgauuucuucugc

SEQ ID NO: 4026898 - RNA, 21 nt, Staphylococcus aureus subsp. aureus MW2
cauuugcgauuucuucugcua

SEQ ID NO: 4026899 - RNA, 16 nt, Staphylococcus aureus subsp. aureus MW2
cauuuggcguaaugau

SEQ ID NO: 4026900 - RNA, 15 nt, Staphylococcus aureus subsp. aureus MW2
cauuugguucuucua

SEQ ID NO: 4026901 - RNA, 18 nt, Staphylococcus aureus subsp. aureus MW2
cauuugguuuaacuuuau

SEQ ID NO: 4026902 - RNA, 19 nt, Staphylococcus aureus subsp. aureus MW2
cauuuguaacaauauaaua

SEQ ID NO: 4026903 - RNA, 14 nt, Staphylococcus aureus subsp. aureus MW2
cauuuguauagauu

SEQ ID NO: 4026904 - RNA, 23 nt, Staphylococcus aureus subsp. aureus MW2
cauuugucauaauagauaaugca

SEQ ID NO: 4026905 - RNA, 13 nt, Staphylococcus aureus subsp. aureus MW2
cauuuguguaaau

SEQ ID NO: 4026906 - RNA, 18 nt, Staphylococcus aureus subsp. aureus MW2
cauuuguguuccugcuac

SEQ ID NO: 4026907 - RNA, 23 nt, Staphylococcus aureus subsp. aureus MW2
cauuuguuaaauucaucuuauca

SEQ ID NO: 4026908 - RNA, 14 nt, Staphylococcus aureus subsp. aureus MW2
cauuuguuguaaac

SEQ ID NO: 4026909 - RNA, 14 nt, Staphylococcus aureus subsp. aureus MW2
cauuuuaaauaaaa

SEQ ID NO: 4026910 - RNA, 17 nt, Staphylococcus aureus subsp. aureus MW2
cauuuuaaaucuaauua

SEQ ID NO: 4026911 - RNA, 21 nt, Staphylococcus aureus subsp. aureus MW2
cauuuuaacaagugaugaaaa

SEQ ID NO: 4026912 - RNA, 16 nt, Staphylococcus aureus subsp. aureus MW2
cauuuuaauaaaauca

SEQ ID NO: 4026913 - RNA, 16 nt, Staphylococcus aureus subsp. aureus MW2
cauuuuaguuauacua

SEQ ID NO: 4026914 - RNA, 15 nt, Staphylococcus aureus subsp. aureus MW2
cauuuuaucugaaaa

SEQ ID NO: 4026915 - RNA, 21 nt, Staphylococcus aureus subsp. aureus MW2
cauuuuauggugcuaaaaaau

SEQ ID NO: 4026916 - RNA, 17 nt, Staphylococcus aureus subsp. aureus MW2
cauuuucaaaacuagca

SEQ ID NO: 4026917 - RNA, 14 nt, Staphylococcus aureus subsp. aureus MW2
cauuuucaagagga

SEQ ID NO: 4026918 - RNA, 19 nt, Staphylococcus aureus subsp. aureus MW2
cauuuucaaguuuaaaaua

SEQ ID NO: 4026919 - RNA, 22 nt, Staphylococcus aureus subsp. aureus MW2
cauuuucauuguauguugaaag

SEQ ID NO: 4026920 - RNA, 20 nt, Staphylococcus aureus subsp. aureus MW2
cauuuugcccaugucaugaa

SEQ ID NO: 4026921 - RNA, 20 nt, Staphylococcus aureus subsp. aureus MW2
cauuuuggcaaaagcuuuua

SEQ ID NO: 4026922 - RNA, 17 nt, Staphylococcus aureus subsp. aureus MW2
cauuuugguacaaaaaa

SEQ ID NO: 4026923 - RNA, 12 nt, Staphylococcus aureus subsp. aureus MW2
cauuuuguuuca

SEQ ID NO: 4026924 - RNA, 11 nt, Staphylococcus aureus subsp. aureus MW2
cauuuuuaaaa

SEQ ID NO: 4026925 - RNA, 19 nt, Staphylococcus aureus subsp. aureus MW2
cauuuuuaaauuacuauau

SEQ ID NO: 4026926 - RNA, 16 nt, Staphylococcus aureus subsp. aureus MW2
cauuuuuaauuuugac

SEQ ID NO: 4026927 - RNA, 14 nt, Staphylococcus aureus subsp. aureus MW2
cauuuuuaguuaga

SEQ ID NO: 4026928 - RNA, 20 nt, Staphylococcus aureus subsp. aureus MW2
cauuuuuauuuaacacuuca

SEQ ID NO: 4026929 - RNA, 22 nt, Staphylococcus aureus subsp. aureus MW2
cauuuuucgccaaaaacuuuau

SEQ ID NO: 4026930 - RNA, 17 nt, Staphylococcus aureus subsp. aureus MW2
cauuuuugauuuuaaua

SEQ ID NO: 4026931 - RNA, 16 nt, Staphylococcus aureus subsp. aureus MW2
cauuuuuucauuauua

SEQ ID NO: 4026932 - RNA, 20 nt, Staphylococcus aureus subsp. aureus MW2
cauuuuuuuccaagcaucau

SEQ ID NO: 4026933 - RNA, 13 nt, Staphylococcus aureus subsp. aureus MW2
ccaguauaauuuu

SEQ ID NO: 4026934 - RNA, 13 nt, Staphylococcus aureus subsp. aureus MW2
ccaguaucucuuu

SEQ ID NO: 4026935 - RNA, 13 nt, Staphylococcus aureus subsp. aureus MW2
ccagucauguccc

SEQ ID NO: 4026936 - RNA, 18 nt, Staphylococcus aureus subsp. aureus MW2
ccagucauuguauaaaaa

SEQ ID NO: 4026937 - RNA, 18 nt, Staphylococcus aureus subsp. aureus MW2
ccagucguaaugaugaca

SEQ ID NO: 4026938 - RNA, 14 nt, Staphylococcus aureus subsp. aureus MW2
ccaguuaauuauuu

SEQ ID NO: 4026939 - RNA, 17 nt, Staphylococcus aureus subsp. aureus MW2
ccaguugaaguugaagc

SEQ ID NO: 4026940 - RNA, 15 nt, Staphylococcus aureus subsp. aureus MW2
ccauaaauauuaaau

SEQ ID NO: 4026941 - RNA, 13 nt, Staphylococcus aureus subsp. aureus MW2
ccauaacaccgca

SEQ ID NO: 4026942 - RNA, 14 nt, Staphylococcus aureus subsp. aureus MW2
ccauaacugaauaa

SEQ ID NO: 4026943 - RNA, 22 nt, Staphylococcus aureus subsp. aureus MW2
ccauaaggauuuuuaauuuuau

SEQ ID NO: 4026944 - RNA, 16 nt, Staphylococcus aureus subsp. aureus MW2
ccauaaucuucauuaa

SEQ ID NO: 4026945 - RNA, 14 nt, Staphylococcus aureus subsp. aureus MW2
ccauaaugacuaua

SEQ ID NO: 4026946 - RNA, 20 nt, Staphylococcus aureus subsp. aureus MW2
ccauaauuaaauaacuuuuu

SEQ ID NO: 4026947 - RNA, 17 nt, Staphylococcus aureus subsp. aureus MW2
ccauaccuuauuucagc

SEQ ID NO: 4026948 - RNA, 11 nt, Staphylococcus aureus subsp. aureus MW2
ccauacguugu

SEQ ID NO: 4026949 - RNA, 22 nt, Staphylococcus aureus subsp. aureus MW2
ccauacuucuauuuuauaauaa

SEQ ID NO: 4026950 - RNA, 11 nt, Staphylococcus aureus subsp. aureus MW2
ccauagauuau

SEQ ID NO: 4026951 - RNA, 17 nt, Staphylococcus aureus subsp. aureus MW2
ccauaguaacaaaauga

SEQ ID NO: 4026952 - RNA, 18 nt, Staphylococcus aureus subsp. aureus MW2
ccauaguaacaaaaugau

SEQ ID NO: 4026953 - RNA, 18 nt, Staphylococcus aureus subsp. aureus MW2
ccauaguauguaucuuuc

SEQ ID NO: 4026954 - RNA, 23 nt, Staphylococcus aureus subsp. aureus MW2
ccauauaaagcugcgauauaacu

SEQ ID NO: 4026955 - RNA, 23 nt, Staphylococcus aureus subsp. aureus MW2
ccauaucgugcguuaaauauaua

SEQ ID NO: 4026956 - RNA, 15 nt, Staphylococcus aureus subsp. aureus MW2
ccauaugcuugcugu

SEQ ID NO: 4026957 - RNA, 22 nt, Staphylococcus aureus subsp. aureus MW2
ccauauuuuuuaguaauaacau

SEQ ID NO: 4026958 - RNA, 20 nt, Staphylococcus aureus subsp. aureus MW2
ccaucaauauuuauauuaaa

SEQ ID NO: 4026959 - RNA, 16 nt, Staphylococcus aureus subsp. aureus MW2
ccaucaguauuuguau

SEQ ID NO: 4026960 - RNA, 16 nt, Staphylococcus aureus subsp. aureus MW2
ccaucauuuauaugga

SEQ ID NO: 4026961 - RNA, 21 nt, Staphylococcus aureus subsp. aureus MW2
ccaucccaacuuaauaaccau

SEQ ID NO: 4026962 - RNA, 18 nt, Staphylococcus aureus subsp. aureus MW2
ccaucuggcguuaaccau

SEQ ID NO: 4026963 - RNA, 16 nt, Staphylococcus aureus subsp. aureus MW2
ccaucugugucagcau

SEQ ID NO: 4026964 - RNA, 22 nt, Staphylococcus aureus subsp. aureus MW2
ccaucuuuguaaccuaaaaaca

SEQ ID NO: 4026965 - RNA, 22 nt, Staphylococcus aureus subsp. aureus MW2
ccaugacgauuccaaucuauuu

SEQ ID NO: 4026966 - RNA, 17 nt, Staphylococcus aureus subsp. aureus MW2
ccaugauuagcgcacca

SEQ ID NO: 4026967 - RNA, 19 nt, Staphylococcus aureus subsp. aureus MW2
ccaugauuagcgcaccaau

SEQ ID NO: 4026968 - RNA, 19 nt, Staphylococcus aureus subsp. aureus MW2
ccaugcccgauaaaaccac

SEQ ID NO: 4026969 - RNA, 16 nt, Staphylococcus aureus subsp. aureus MW2
ccaugcucuuuuuccc

SEQ ID NO: 4026970 - RNA, 17 nt, Staphylococcus aureus subsp. aureus MW2
ccauggcuuaaaucaaa

SEQ ID NO: 4026971 - RNA, 23 nt, Staphylococcus aureus subsp. aureus MW2
ccauguauucuuagauauuauug

SEQ ID NO: 4026972 - RNA, 22 nt, Staphylococcus aureus subsp. aureus MW2
ccaugucaugaauuuucaucau

SEQ ID NO: 4026973 - RNA, 19 nt, Staphylococcus aureus subsp. aureus MW2
ccaugugccuuugcuuuuu

SEQ ID NO: 4026974 - RNA, 18 nt, Staphylococcus aureus subsp. aureus MW2
ccauuaaaccuaaucugc

SEQ ID NO: 4026975 - RNA, 19 nt, Staphylococcus aureus subsp. aureus MW2
ccauuaaugcucuauauau

SEQ ID NO: 4026976 - RNA, 16 nt, Staphylococcus aureus subsp. aureus MW2
ccauucaauguuuaau

SEQ ID NO: 4026977 - RNA, 21 nt, Staphylococcus aureus subsp. aureus MW2
ccauucaauguuuaauuuucu

SEQ ID NO: 4026978 - RNA, 12 nt, Staphylococcus aureus subsp. aureus MW2
ccauucauuaag

SEQ ID NO: 4026979 - RNA, 22 nt, Staphylococcus aureus subsp. aureus MW2
ccauugcacaguuucaucuuca

SEQ ID NO: 4026980 - RNA, 14 nt, Staphylococcus aureus subsp. aureus MW2
ccauugcacuaugc

SEQ ID NO: 4026981 - RNA, 13 nt, Staphylococcus aureus subsp. aureus MW2
ccauugucaugcc

SEQ ID NO: 4026982 - RNA, 18 nt, Staphylococcus aureus subsp. aureus MW2
ccauugucaugccuucau

SEQ ID NO: 4026983 - RNA, 22 nt, Staphylococcus aureus subsp. aureus MW2
ccauuguccaacugcuuuuuau

SEQ ID NO: 4026984 - RNA, 15 nt, Staphylococcus aureus subsp. aureus MW2
ccauuguuauccaaa

SEQ ID NO: 4026985 - RNA, 19 nt, Staphylococcus aureus subsp. aureus MW2
ccauuuaacucaccuuuau

SEQ ID NO: 4026986 - RNA, 17 nt, Staphylococcus aureus subsp. aureus MW2
ccauuuaaggauuuccu

SEQ ID NO: 4026987 - RNA, 22 nt, Staphylococcus aureus subsp. aureus MW2
ccauuucaauugcacuuacugc

SEQ ID NO: 4026988 - RNA, 15 nt, Staphylococcus aureus subsp. aureus MW2
ccauuuguaaauccu

SEQ ID NO: 4026989 - RNA, 16 nt, Staphylococcus aureus subsp. aureus MW2
ccauuuguaacaauau

SEQ ID NO: 4026990 - RNA, 17 nt, Staphylococcus aureus subsp. aureus MW2
ccauuuuuuuccaagca

SEQ ID NO: 4026991 - RNA, 11 nt, Staphylococcus aureus subsp. aureus MW2
cccaaacauag

SEQ ID NO: 4026992 - RNA, 13 nt, Staphylococcus aureus subsp. aureus MW2
cccaaacauagag

SEQ ID NO: 4026993 - RNA, 14 nt, Staphylococcus aureus subsp. aureus MW2
cccaaauugccaau

SEQ ID NO: 4026994 - RNA, 17 nt, Staphylococcus aureus subsp. aureus MW2
cccaacaacauaucaua

SEQ ID NO: 4026995 - RNA, 12 nt, Staphylococcus aureus subsp. aureus MW2
cccaacacagaa

SEQ ID NO: 4026996 - RNA, 17 nt, Staphylococcus aureus subsp. aureus MW2
cccaacacagaagcugg

SEQ ID NO: 4026997 - RNA, 15 nt, Staphylococcus aureus subsp. aureus MW2
cccaacacagagaaa

SEQ ID NO: 4026998 - RNA, 15 nt, Staphylococcus aureus subsp. aureus MW2
cccaaccaugcuuuu

SEQ ID NO: 4026999 - RNA, 13 nt, Staphylococcus aureus subsp. aureus MW2
cccaacuugcauu

SEQ ID NO: 4027000 - RNA, 14 nt, Staphylococcus aureus subsp. aureus MW2
cccaagcucuuuuu

SEQ ID NO: 4027001 - RNA, 15 nt, Staphylococcus aureus subsp. aureus MW2
cccaauaauugcugu

SEQ ID NO: 4027002 - RNA, 17 nt, Staphylococcus aureus subsp. aureus MW2
cccaauauuaauccaca

SEQ ID NO: 4027003 - RNA, 20 nt, Staphylococcus aureus subsp. aureus MW2
cccaauauuaauccacaaau

SEQ ID NO: 4027004 - RNA, 19 nt, Staphylococcus aureus subsp. aureus MW2
cccaaugcuugaauuuuau

SEQ ID NO: 4027005 - RNA, 16 nt, Staphylococcus aureus subsp. aureus MW2
cccaggugcaucuuuu

SEQ ID NO: 4027006 - RNA, 17 nt, Staphylococcus aureus subsp. aureus MW2
cccauaccuacaaauau

SEQ ID NO: 4027007 - RNA, 14 nt, Staphylococcus aureus subsp. aureus MW2
cccauccccaacuu

SEQ ID NO: 4027008 - RNA, 21 nt, Staphylococcus aureus subsp. aureus MW2
cccaucuuuuagguaauaauu

SEQ ID NO: 4027009 - RNA, 13 nt, Staphylococcus aureus subsp. aureus MW2
cccaugcuucuau

SEQ ID NO: 4027010 - RNA, 13 nt, Staphylococcus aureus subsp. aureus MW2
cccauuuuaaagu

SEQ ID NO: 4027011 - RNA, 11 nt, Staphylococcus aureus subsp. aureus MW2
ccccaacacag

SEQ ID NO: 4027012 - RNA, 19 nt, Staphylococcus aureus subsp. aureus MW2
ccccaacacagaagcugac

SEQ ID NO: 4027013 - RNA, 16 nt, Staphylococcus aureus subsp. aureus MW2
ccccaacacagagaaa

SEQ ID NO: 4027014 - RNA, 16 nt, Staphylococcus aureus subsp. aureus MW2
ccccaacacagagaau

SEQ ID NO: 4027015 - RNA, 19 nt, Staphylococcus aureus subsp. aureus MW2
ccccaacauagaagcuggc

SEQ ID NO: 4027016 - RNA, 21 nt, Staphylococcus aureus subsp. aureus MW2
ccccaacauagaagcuggcgg

SEQ ID NO: 4027017 - RNA, 14 nt, Staphylococcus aureus subsp. aureus MW2
ccccaacuugcauu

SEQ ID NO: 4027018 - RNA, 15 nt, Staphylococcus aureus subsp. aureus MW2
ccccaacuugcauug

SEQ ID NO: 4027019 - RNA, 20 nt, Staphylococcus aureus subsp. aureus MW2
ccccaacuugcauugucugu

SEQ ID NO: 4027020 - RNA, 16 nt, Staphylococcus aureus subsp. aureus MW2
ccccaggccagucaau

SEQ ID NO: 4027021 - RNA, 21 nt, Staphylococcus aureus subsp. aureus MW2
ccccauuuauguguuggcuuu

SEQ ID NO: 4027022 - RNA, 18 nt, Staphylococcus aureus subsp. aureus MW2
ccuucaauguucaauuca

SEQ ID NO: 4027023 - RNA, 20 nt, Staphylococcus aureus subsp. aureus MW2
ccuucaauguucaauucacg

SEQ ID NO: 4027024 - RNA, 17 nt, Staphylococcus aureus subsp. aureus MW2
ccuucauuagccaaauc

SEQ ID NO: 4027025 - RNA, 24 nt, Staphylococcus aureus subsp. aureus MW2
ccuucauugaagaauauaaacuau

SEQ ID NO: 4027026 - RNA, 19 nt, Staphylococcus aureus subsp. aureus MW2
ccuucgaagucauaugcau

SEQ ID NO: 4027027 - RNA, 17 nt, Staphylococcus aureus subsp. aureus MW2
ccuucgcauacuuuuuc

SEQ ID NO: 4027028 - RNA, 19 nt, Staphylococcus aureus subsp. aureus MW2
ccuucgcauacuuuuucag

SEQ ID NO: 4027029 - RNA, 15 nt, Staphylococcus aureus subsp. aureus MW2
ccuucucaucauuuu

SEQ ID NO: 4027030 - RNA, 21 nt, Staphylococcus aureus subsp. aureus MW2
ccuucuguacguuuuaaauaa

SEQ ID NO: 4027031 - RNA, 15 nt, Staphylococcus aureus subsp. aureus MW2
ccuucuuucgcuuca

SEQ ID NO: 4027032 - RNA, 18 nt, Staphylococcus aureus subsp. aureus MW2
ccuuguuggcuuuuuuaa

SEQ ID NO: 4027033 - RNA, 11 nt, Staphylococcus aureus subsp. aureus MW2
ccuuguuuauu

SEQ ID NO: 4027034 - RNA, 16 nt, Staphylococcus aureus subsp. aureus MW2
ccuuguuuauuuuuaa

SEQ ID NO: 4027035 - RNA, 12 nt, Staphylococcus aureus subsp. aureus MW2
ccuuuaaaacau

SEQ ID NO: 4027036 - RNA, 20 nt, Staphylococcus aureus subsp. aureus MW2
ccuuuaaaucuacuuuguuc

SEQ ID NO: 4027037 - RNA, 22 nt, Staphylococcus aureus subsp. aureus MW2
ccuuuaagaagucgaauucacc

SEQ ID NO: 4027038 - RNA, 13 nt, Staphylococcus aureus subsp. aureus MW2
ccuuuaauaauau

SEQ ID NO: 4027039 - RNA, 18 nt, Staphylococcus aureus subsp. aureus MW2
ccuuuaauuacacuacgc

SEQ ID NO: 4027040 - RNA, 19 nt, Staphylococcus aureus subsp. aureus MW2
ccuuuacaacauacaugcc

SEQ ID NO: 4027041 - RNA, 16 nt, Staphylococcus aureus subsp. aureus MW2
ccuuuagccaaugcuu

SEQ ID NO: 4027042 - RNA, 17 nt, Staphylococcus aureus subsp. aureus MW2
ccuuuauacaauuuuuu

SEQ ID NO: 4027043 - RNA, 16 nt, Staphylococcus aureus subsp. aureus MW2
ccuuuauuaccagcuu

SEQ ID NO: 4027044 - RNA, 20 nt, Staphylococcus aureus subsp. aureus MW2
ccuuuauuuugauagacuaa

SEQ ID NO: 4027045 - RNA, 20 nt, Staphylococcus aureus subsp. aureus MW2
ccuuucauuuuggcaaaagc

SEQ ID NO: 4027046 - RNA, 16 nt, Staphylococcus aureus subsp. aureus MW2
ccuuucuaauauuuug

SEQ ID NO: 4027047 - RNA, 20 nt, Staphylococcus aureus subsp. aureus MW2
ccuuugauuuaauaauauuu

SEQ ID NO: 4027048 - RNA, 17 nt, Staphylococcus aureus subsp. aureus MW2
ccuuugcuuaaaccuua

SEQ ID NO: 4027049 - RNA, 11 nt, Staphylococcus aureus subsp. aureus MW2
ccuuuucaaac

SEQ ID NO: 4027050 - RNA, 22 nt, Staphylococcus aureus subsp. aureus MW2
ccuuuugauguuuaugacaaag

SEQ ID NO: 4027051 - RNA, 15 nt, Staphylococcus aureus subsp. aureus MW2
ccuuuuguuucaaau

SEQ ID NO: 4027052 - RNA, 20 nt, Staphylococcus aureus subsp. aureus MW2
ccuuuuguuucaaauuuugu

SEQ ID NO: 4027053 - RNA, 13 nt, Staphylococcus aureus subsp. aureus MW2
ccuuuuuguaauu

SEQ ID NO: 4027054 - RNA, 17 nt, Staphylococcus aureus subsp. aureus MW2
ccuuuuuguaauuguaa

SEQ ID NO: 4027055 - RNA, 18 nt, Staphylococcus aureus subsp. aureus MW2
ccuuuuuuaacuuuaaca

SEQ ID NO: 4027056 - RNA, 18 nt, Staphylococcus aureus subsp. aureus MW2
ccuuuuuuaggcagguac

SEQ ID NO: 4027057 - RNA, 20 nt, Staphylococcus aureus subsp. aureus MW2
cgaaaauagcuauuaaaaua

SEQ ID NO: 4027058 - RNA, 22 nt, Staphylococcus aureus subsp. aureus MW2
cgaaaauagcuauuaaaauaga

SEQ ID NO: 4027059 - RNA, 18 nt, Staphylococcus aureus subsp. aureus MW2
cgaaaauugcuaaaaaaa

SEQ ID NO: 4027060 - RNA, 19 nt, Staphylococcus aureus subsp. aureus MW2
cgaaagagaaaagcuagaa

SEQ ID NO: 4027061 - RNA, 17 nt, Staphylococcus aureus subsp. aureus MW2
cgaaagaugauauauuc

SEQ ID NO: 4027062 - RNA, 20 nt, Staphylococcus aureus subsp. aureus MW2
cgaaaguuagacuaaaaaac

SEQ ID NO: 4027063 - RNA, 21 nt, Staphylococcus aureus subsp. aureus MW2
cgaaaugcauugagcaucuug

SEQ ID NO: 4027064 - RNA, 13 nt, Staphylococcus aureus subsp. aureus MW2
cgaaauucucugu

SEQ ID NO: 4027065 - RNA, 17 nt, Staphylococcus aureus subsp. aureus MW2
cgaaauucucuguguug

SEQ ID NO: 4027066 - RNA, 13 nt, Staphylococcus aureus subsp. aureus MW2
cgaacaaaugaaa

SEQ ID NO: 4027067 - RNA, 12 nt, Staphylococcus aureus subsp. aureus MW2
cgaacaucaucu

SEQ ID NO: 4027068 - RNA, 16 nt, Staphylococcus aureus subsp. aureus MW2
cgaacaucugaaaaaa

SEQ ID NO: 4027069 - RNA, 14 nt, Staphylococcus aureus subsp. aureus MW2
cgaacaugaaugau

SEQ ID NO: 4027070 - RNA, 22 nt, Staphylococcus aureus subsp. aureus MW2
cgaacuagacaagaugcucaau

SEQ ID NO: 4027071 - RNA, 18 nt, Staphylococcus aureus subsp. aureus MW2
cgaagaaaacuuccauug

SEQ ID NO: 4027072 - RNA, 13 nt, Staphylococcus aureus subsp. aureus MW2
cgaagaaugauac

SEQ ID NO: 4027073 - RNA, 18 nt, Staphylococcus aureus subsp. aureus MW2
cgaagauguuaaacuguc

SEQ ID NO: 4027074 - RNA, 23 nt, Staphylococcus aureus subsp. aureus MW2
cgaagggcggucaauuuuaccau

SEQ ID NO: 4027075 - RNA, 17 nt, Staphylococcus aureus subsp. aureus MW2
cgaagucauaugcauac

SEQ ID NO: 4027076 - RNA, 20 nt, Staphylococcus aureus subsp. aureus MW2
cgaauaacguuggaaacuuc

SEQ ID NO: 4027077 - RNA, 16 nt, Staphylococcus aureus subsp. aureus MW2
cgaauaacuguuuauc

SEQ ID NO: 4027078 - RNA, 17 nt, Staphylococcus aureus subsp. aureus MW2
cgaauaucuuaaagaau

SEQ ID NO: 4027079 - RNA, 22 nt, Staphylococcus aureus subsp. aureus MW2
cgaauguuccuuguuuuaaacu

SEQ ID NO: 4027080 - RNA, 14 nt, Staphylococcus aureus subsp. aureus MW2
cgaauuaaaauaac

SEQ ID NO: 4027081 - RNA, 15 nt, Staphylococcus aureus subsp. aureus MW2
cgaauuaaaauaacu

SEQ ID NO: 4027082 - RNA, 21 nt, Staphylococcus aureus subsp. aureus MW2
cgaauucucgauuuuuuuaua

SEQ ID NO: 4027083 - RNA, 17 nt, Staphylococcus aureus subsp. aureus MW2
cgaauugguaaaaaucu

SEQ ID NO: 4027084 - RNA, 20 nt, Staphylococcus aureus subsp. aureus MW2
cgacaauuauaauaaaacuu

SEQ ID NO: 4027085 - RNA, 14 nt, Staphylococcus aureus subsp. aureus MW2
cgacacauauaguu

SEQ ID NO: 4027086 - RNA, 17 nt, Staphylococcus aureus subsp. aureus MW2
cgacacgaacaacauua

SEQ ID NO: 4027087 - RNA, 17 nt, Staphylococcus aureus subsp. aureus MW2
cgacacguguaaaaaug

SEQ ID NO: 4027088 - RNA, 15 nt, Staphylococcus aureus subsp. aureus MW2
cgacaggggcuuaac

SEQ ID NO: 4027089 - RNA, 18 nt, Staphylococcus aureus subsp. aureus MW2
cgacaucgccaauuugau

SEQ ID NO: 4027090 - RNA, 15 nt, Staphylococcus aureus subsp. aureus MW2
cgacaugaaaguugu

SEQ ID NO: 4027091 - RNA, 14 nt, Staphylococcus aureus subsp. aureus MW2
cgacguuuaaaugc

SEQ ID NO: 4027092 - RNA, 17 nt, Staphylococcus aureus subsp. aureus MW2
cgacuucauuacaaaca

SEQ ID NO: 4027093 - RNA, 16 nt, Staphylococcus aureus subsp. aureus MW2
cgacuuucacuacauu

SEQ ID NO: 4027094 - RNA, 23 nt, Staphylococcus aureus subsp. aureus MW2
cgacuuucacuacauuaaaaaua

SEQ ID NO: 4027095 - RNA, 20 nt, Staphylococcus aureus subsp. aureus MW2
cgagauguguccuaauaagu

SEQ ID NO: 4027096 - RNA, 18 nt, Staphylococcus aureus subsp. aureus MW2
cgagcaguauauaucaaa

SEQ ID NO: 4027097 - RNA, 16 nt, Staphylococcus aureus subsp. aureus MW2
cgagcguaauggauua

SEQ ID NO: 4027098 - RNA, 20 nt, Staphylococcus aureus subsp. aureus MW2
cgagcuaauaugucuagacu

SEQ ID NO: 4027099 - RNA, 16 nt, Staphylococcus aureus subsp. aureus MW2
cgagcuggugagaaau

SEQ ID NO: 4027100 - RNA, 18 nt, Staphylococcus aureus subsp. aureus MW2
cgagcuuugcucauagau

SEQ ID NO: 4027101 - RNA, 20 nt, Staphylococcus aureus subsp. aureus MW2
cgagcuuugcucauagauga

SEQ ID NO: 4027102 - RNA, 15 nt, Staphylococcus aureus subsp. aureus MW2
cgaggaccaucucua

SEQ ID NO: 4027103 - RNA, 15 nt, Staphylococcus aureus subsp. aureus MW2
cgaggucuuuaauuu

SEQ ID NO: 4027104 - RNA, 17 nt, Staphylococcus aureus subsp. aureus MW2
cgaggucuuuaauuuau

SEQ ID NO: 4027105 - RNA, 19 nt, Staphylococcus aureus subsp. aureus MW2
cgaguuuguuucuaaauuc

SEQ ID NO: 4027106 - RNA, 23 nt, Staphylococcus aureus subsp. aureus MW2
cgaguuuguuucuaaauucuuuu

SEQ ID NO: 4027107 - RNA, 12 nt, Staphylococcus aureus subsp. aureus MW2
cgauaaaagaac

SEQ ID NO: 4027108 - RNA, 17 nt, Staphylococcus aureus subsp. aureus MW2
cgauaaaaguuguauuc

SEQ ID NO: 4027109 - RNA, 17 nt, Staphylococcus aureus subsp. aureus MW2
cgauaaauguauuaaac

SEQ ID NO: 4027110 - RNA, 20 nt, Staphylococcus aureus subsp. aureus MW2
cggggccccaacacagagaa

SEQ ID NO: 4027111 - RNA, 23 nt, Staphylococcus aureus subsp. aureus MW2
cgggggacauagguauaaucauu

SEQ ID NO: 4027112 - RNA, 22 nt, Staphylococcus aureus subsp. aureus MW2
cgguacgaagugcaacaaaagu

SEQ ID NO: 4027113 - RNA, 23 nt, Staphylococcus aureus subsp. aureus MW2
cgguacgaagugcaacaaaagug

SEQ ID NO: 4027114 - RNA, 18 nt, Staphylococcus aureus subsp. aureus MW2
cgguaggaccucuuauuu

SEQ ID NO: 4027115 - RNA, 14 nt, Staphylococcus aureus subsp. aureus MW2
cgguauuuucaaag

SEQ ID NO: 4027116 - RNA, 16 nt, Staphylococcus aureus subsp. aureus MW2
cggucucaacuugccu

SEQ ID NO: 4027117 - RNA, 22 nt, Staphylococcus aureus subsp. aureus MW2
cggugaccuuauauuuuauuua

SEQ ID NO: 4027118 - RNA, 17 nt, Staphylococcus aureus subsp. aureus MW2
cggugugaauugauuuu

SEQ ID NO: 4027119 - RNA, 20 nt, Staphylococcus aureus subsp. aureus MW2
cgguuaauaagcuaauauuu

SEQ ID NO: 4027120 - RNA, 20 nt, Staphylococcus aureus subsp. aureus MW2
cgguuauuuaauaaugcuuu

SEQ ID NO: 4027121 - RNA, 14 nt, Staphylococcus aureus subsp. aureus MW2
cgguucauaaugau

SEQ ID NO: 4027122 - RNA, 15 nt, Staphylococcus aureus subsp. aureus MW2
cgguucauaaugauc

SEQ ID NO: 4027123 - RNA, 15 nt, Staphylococcus aureus subsp. aureus MW2
cgguuuuauuuuugu

SEQ ID NO: 4027124 - RNA, 15 nt, Staphylococcus aureus subsp. aureus MW2
cguaaauuuuaucua

SEQ ID NO: 4027125 - RNA, 19 nt, Staphylococcus aureus subsp. aureus MW2
cguaacucuuuaauuuuac

SEQ ID NO: 4027126 - RNA, 22 nt, Staphylococcus aureus subsp. aureus MW2
cguaacuguuuuaaauuaacuu

SEQ ID NO: 4027127 - RNA, 15 nt, Staphylococcus aureus subsp. aureus MW2
cguaaugauauuacc

SEQ ID NO: 4027128 - RNA, 22 nt, Staphylococcus aureus subsp. aureus MW2
cguaauuuaccuauuugcugaa

SEQ ID NO: 4027129 - RNA, 16 nt, Staphylococcus aureus subsp. aureus MW2
cguauaauaguuuacg

SEQ ID NO: 4027130 - RNA, 16 nt, Staphylococcus aureus subsp. aureus MW2
cguaucauuuaaaaua

SEQ ID NO: 4027131 - RNA, 14 nt, Staphylococcus aureus subsp. aureus MW2
cguaucuguuuaug

SEQ ID NO: 4027132 - RNA, 18 nt, Staphylococcus aureus subsp. aureus MW2
cguauuagccaauaaaau

SEQ ID NO: 4027133 - RNA, 15 nt, Staphylococcus aureus subsp. aureus MW2
cguauugaaaaugag

SEQ ID NO: 4027134 - RNA, 15 nt, Staphylococcus aureus subsp. aureus MW2
cguauuuaccuucuu

SEQ ID NO: 4027135 - RNA, 14 nt, Staphylococcus aureus subsp. aureus MW2
cguauuuuaauauu

SEQ ID NO: 4027136 - RNA, 14 nt, Staphylococcus aureus subsp. aureus MW2
cguauuuuaaugau

SEQ ID NO: 4027137 - RNA, 22 nt, Staphylococcus aureus subsp. aureus MW2
cguauuuuaguacuuaauacua

SEQ ID NO: 4027138 - RNA, 14 nt, Staphylococcus aureus subsp. aureus MW2
cgucacuuuauuaa

SEQ ID NO: 4027139 - RNA, 19 nt, Staphylococcus aureus subsp. aureus MW2
cgucaucaaaacguuugaa

SEQ ID NO: 4027140 - RNA, 13 nt, Staphylococcus aureus subsp. aureus MW2
cgucccauaauag

SEQ ID NO: 4027141 - RNA, 21 nt, Staphylococcus aureus subsp. aureus MW2
cgucccauaauagcuagguuu

SEQ ID NO: 4027142 - RNA, 16 nt, Staphylococcus aureus subsp. aureus MW2
cguccgaagucaccuu

SEQ ID NO: 4027143 - RNA, 17 nt, Staphylococcus aureus subsp. aureus MW2
cgucuuaauucuucugu

SEQ ID NO: 4027144 - RNA, 18 nt, Staphylococcus aureus subsp. aureus MW2
cgucuucaauuaaugauu

SEQ ID NO: 4027145 - RNA, 22 nt, Staphylococcus aureus subsp. aureus MW2
cgucuucaauuaaugauucacc

SEQ ID NO: 4027146 - RNA, 19 nt, Staphylococcus aureus subsp. aureus MW2
cgucuuuugcaaauuggaa

SEQ ID NO: 4027147 - RNA, 14 nt, Staphylococcus aureus subsp. aureus MW2
cgucuuuuuauacu

SEQ ID NO: 4027148 - RNA, 15 nt, Staphylococcus aureus subsp. aureus MW2
cgugaaagaaaaaac

SEQ ID NO: 4027149 - RNA, 16 nt, Staphylococcus aureus subsp. aureus MW2
cgugaaagaaaaaacu

SEQ ID NO: 4027150 - RNA, 22 nt, Staphylococcus aureus subsp. aureus MW2
cgugauuacauucuauacuuuu

SEQ ID NO: 4027151 - RNA, 22 nt, Staphylococcus aureus subsp. aureus MW2
cgugauuuggaauacuuuucuu

SEQ ID NO: 4027152 - RNA, 21 nt, Staphylococcus aureus subsp. aureus MW2
cgugguucaaaaaucauacca

SEQ ID NO: 4027153 - RNA, 14 nt, Staphylococcus aureus subsp. aureus MW2
cguguaaaaaugau

SEQ ID NO: 4027154 - RNA, 23 nt, Staphylococcus aureus subsp. aureus MW2
cguguaaaaaugauuauucuuuu

SEQ ID NO: 4027155 - RNA, 20 nt, Staphylococcus aureus subsp. aureus MW2
cguguauacaacauguguau

SEQ ID NO: 4027156 - RNA, 17 nt, Staphylococcus aureus subsp. aureus MW2
cguuaaaucacauauga

SEQ ID NO: 4027157 - RNA, 20 nt, Staphylococcus aureus subsp. aureus MW2
cguuaauaaaccuacaauau

SEQ ID NO: 4027158 - RNA, 17 nt, Staphylococcus aureus subsp. aureus MW2
cguuaauaauuuguuuu

SEQ ID NO: 4027159 - RNA, 11 nt, Staphylococcus aureus subsp. aureus MW2
cguuacauuua

SEQ ID NO: 4027160 - RNA, 18 nt, Staphylococcus aureus subsp. aureus MW2
cguuacggcuucgugcua

SEQ ID NO: 4027161 - RNA, 22 nt, Staphylococcus aureus subsp. aureus MW2
cguuacuuuggucaacuuuuuc

SEQ ID NO: 4027162 - RNA, 22 nt, Staphylococcus aureus subsp. aureus MW2
cguuaguacggcugcuuuaacu

SEQ ID NO: 4027163 - RNA, 22 nt, Staphylococcus aureus subsp. aureus MW2
cguuaguauaaacguccaaaca

SEQ ID NO: 4027164 - RNA, 19 nt, Staphylococcus aureus subsp. aureus MW2
cguuauaaguacaaauaau

SEQ ID NO: 4027165 - RNA, 15 nt, Staphylococcus aureus subsp. aureus MW2
cguuauagauaagua

SEQ ID NO: 4027166 - RNA, 20 nt, Staphylococcus aureus subsp. aureus MW2
cguuaucuuuaaguaauuca

SEQ ID NO: 4027167 - RNA, 13 nt, Staphylococcus aureus subsp. aureus MW2
cguuauucauuug

SEQ ID NO: 4027168 - RNA, 16 nt, Staphylococcus aureus subsp. aureus MW2
cguuauuuucaauaaa

SEQ ID NO: 4027169 - RNA, 21 nt, Staphylococcus aureus subsp. aureus MW2
cguuauuuucaauauuugaua

SEQ ID NO: 4027170 - RNA, 20 nt, Staphylococcus aureus subsp. aureus MW2
cguucaauacaaacacccac

SEQ ID NO: 4027171 - RNA, 17 nt, Staphylococcus aureus subsp. aureus MW2
cguucaauguuauuaaa

SEQ ID NO: 4027172 - RNA, 10 nt, Staphylococcus aureus subsp. aureus MW2
cguucaauuu

SEQ ID NO: 4027173 - RNA, 22 nt, Staphylococcus aureus subsp. aureus MW2
cguucauauaugauaaauauug

SEQ ID NO: 4027174 - RNA, 15 nt, Staphylococcus aureus subsp. aureus MW2
cguucccauucuuug

SEQ ID NO: 4027175 - RNA, 13 nt, Staphylococcus aureus subsp. aureus MW2
cguucgcaucuuu

SEQ ID NO: 4027176 - RNA, 15 nt, Staphylococcus aureus subsp. aureus MW2
cguucuaauaauuua

SEQ ID NO: 4027177 - RNA, 14 nt, Staphylococcus aureus subsp. aureus MW2
cguucucuuaaaua

SEQ ID NO: 4027178 - RNA, 10 nt, Staphylococcus aureus subsp. aureus MW2
cguucugcua

SEQ ID NO: 4027179 - RNA, 11 nt, Staphylococcus aureus subsp. aureus MW2
cguucugcuaa

SEQ ID NO: 4027180 - RNA, 14 nt, Staphylococcus aureus subsp. aureus MW2
cguucuguuuugcg

SEQ ID NO: 4027181 - RNA, 17 nt, Staphylococcus aureus subsp. aureus MW2
cguugauuaacauuacg

SEQ ID NO: 4027182 - RNA, 20 nt, Staphylococcus aureus subsp. aureus MW2
cguugauuuagcauacauua

SEQ ID NO: 4027183 - RNA, 23 nt, Staphylococcus aureus subsp. aureus MW2
cguugcuuuuauuuuuaauguua

SEQ ID NO: 4027184 - RNA, 17 nt, Staphylococcus aureus subsp. aureus MW2
cguugguauucaucuuc

SEQ ID NO: 4027185 - RNA, 14 nt, Staphylococcus aureus subsp. aureus MW2
cguuuaaauucauu

SEQ ID NO: 4027186 - RNA, 12 nt, Staphylococcus aureus subsp. aureus MW2
cguuuaauaaug

SEQ ID NO: 4027187 - RNA, 16 nt, Staphylococcus aureus subsp. aureus MW2
cguuuaauaccuauga

SEQ ID NO: 4027188 - RNA, 13 nt, Staphylococcus aureus subsp. aureus MW2
cguuuccaaucca

SEQ ID NO: 4027189 - RNA, 19 nt, Staphylococcus aureus subsp. aureus MW2
cguuucuuuguauaccuau

SEQ ID NO: 4027190 - RNA, 15 nt, Staphylococcus aureus subsp. aureus MW2
cguuugaauuauuua

SEQ ID NO: 4027191 - RNA, 15 nt, Staphylococcus aureus subsp. aureus MW2
cguuuuagacauaaa

SEQ ID NO: 4027192 - RNA, 14 nt, Staphylococcus aureus subsp. aureus MW2
cguuuuauauuuau

SEQ ID NO: 4027193 - RNA, 13 nt, Staphylococcus aureus subsp. aureus MW2
cguuuuuuuaaau

SEQ ID NO: 4027194 - RNA, 17 nt, Staphylococcus aureus subsp. aureus MW2
cguuuuuuuaaauacau

SEQ ID NO: 4027195 - RNA, 14 nt, Staphylococcus aureus subsp. aureus MW2
cuaaaaaaauguug

SEQ ID NO: 4027196 - RNA, 15 nt, Staphylococcus aureus subsp. aureus MW2
cuaaaaaaauuaaaa

SEQ ID NO: 4027197 - RNA, 12 nt, Staphylococcus aureus subsp. aureus MW2
cuaaaaaacuaa

SEQ ID NO: 4027198 - RNA, 12 nt, Staphylococcus aureus subsp. aureus MW2
cuaaaaaauuug

SEQ ID NO: 4027199 - RNA, 17 nt, Staphylococcus aureus subsp. aureus MW2
cuaauaaguuaccuucg

SEQ ID NO: 4027200 - RNA, 14 nt, Staphylococcus aureus subsp. aureus MW2
cuaauaauaaaaua

SEQ ID NO: 4027201 - RNA, 22 nt, Staphylococcus aureus subsp. aureus MW2
cuaauaaugauugucaaauugg

SEQ ID NO: 4027202 - RNA, 12 nt, Staphylococcus aureus subsp. aureus MW2
cuaauaauuuaa

SEQ ID NO: 4027203 - RNA, 22 nt, Staphylococcus aureus subsp. aureus MW2
cuaauacacuugcuaaaacuaa

SEQ ID NO: 4027204 - RNA, 23 nt, Staphylococcus aureus subsp. aureus MW2
cuaauacacuugcuaaaacuaau

SEQ ID NO: 4027205 - RNA, 16 nt, Staphylococcus aureus subsp. aureus MW2
cuaauacuuucacuuu

SEQ ID NO: 4027206 - RNA, 14 nt, Staphylococcus aureus subsp. aureus MW2
cuaauagcauuugu

SEQ ID NO: 4027207 - RNA, 20 nt, Staphylococcus aureus subsp. aureus MW2
cuaauagcauuuguaaacag

SEQ ID NO: 4027208 - RNA, 16 nt, Staphylococcus aureus subsp. aureus MW2
cuaauauaucuauagg

SEQ ID NO: 4027209 - RNA, 15 nt, Staphylococcus aureus subsp. aureus MW2
cuaauaugauugguu

SEQ ID NO: 4027210 - RNA, 13 nt, Staphylococcus aureus subsp. aureus MW2
cuaauaugucuag

SEQ ID NO: 4027211 - RNA, 24 nt, Staphylococcus aureus subsp. aureus MW2
cuaauauuagauaucuuaaucuaa

SEQ ID NO: 4027212 - RNA, 19 nt, Staphylococcus aureus subsp. aureus MW2
cuaauauuuaaaaaacaaa

SEQ ID NO: 4027213 - RNA, 14 nt, Staphylococcus aureus subsp. aureus MW2
cuaaucaauacuaa

SEQ ID NO: 4027214 - RNA, 11 nt, Staphylococcus aureus subsp. aureus MW2
cuaaucagaua

SEQ ID NO: 4027215 - RNA, 16 nt, Staphylococcus aureus subsp. aureus MW2
cuaaucgacuuuuaca

SEQ ID NO: 4027216 - RNA, 21 nt, Staphylococcus aureus subsp. aureus MW2
cuaaucguuaauaaaccuaca

SEQ ID NO: 4027217 - RNA, 13 nt, Staphylococcus aureus subsp. aureus MW2
cuaaucuaaauuc

SEQ ID NO: 4027218 - RNA, 11 nt, Staphylococcus aureus subsp. aureus MW2
cuaaucuauuu

SEQ ID NO: 4027219 - RNA, 16 nt, Staphylococcus aureus subsp. aureus MW2
cuaaucugccguguuu

SEQ ID NO: 4027220 - RNA, 16 nt, Staphylococcus aureus subsp. aureus MW2
cuaaucuuaauugucu

SEQ ID NO: 4027221 - RNA, 21 nt, Staphylococcus aureus subsp. aureus MW2
cuaaugagcccguuaaaaaga

SEQ ID NO: 4027222 - RNA, 18 nt, Staphylococcus aureus subsp. aureus MW2
cuaaugcuaauuuaacug

SEQ ID NO: 4027223 - RNA, 20 nt, Staphylococcus aureus subsp. aureus MW2
cuaauguaauuauugcauca

SEQ ID NO: 4027224 - RNA, 19 nt, Staphylococcus aureus subsp. aureus MW2
cuaauguguggauuuaauu

SEQ ID NO: 4027225 - RNA, 20 nt, Staphylococcus aureus subsp. aureus MW2
cuaauguuaaaauaacugcu

SEQ ID NO: 4027226 - RNA, 12 nt, Staphylococcus aureus subsp. aureus MW2
cuaauuauucau

SEQ ID NO: 4027227 - RNA, 15 nt, Staphylococcus aureus subsp. aureus MW2
cuaauucauucaaua

SEQ ID NO: 4027228 - RNA, 14 nt, Staphylococcus aureus subsp. aureus MW2
cuaauucgccaucu

SEQ ID NO: 4027229 - RNA, 19 nt, Staphylococcus aureus subsp. aureus MW2
cuaauucgccaucuuuuuu

SEQ ID NO: 4027230 - RNA, 15 nt, Staphylococcus aureus subsp. aureus MW2
cuaauucuguuucaa

SEQ ID NO: 4027231 - RNA, 15 nt, Staphylococcus aureus subsp. aureus MW2
cuaauucuuuaauaa

SEQ ID NO: 4027232 - RNA, 16 nt, Staphylococcus aureus subsp. aureus MW2
cuaauucuuuaauaaa

SEQ ID NO: 4027233 - RNA, 20 nt, Staphylococcus aureus subsp. aureus MW2
cuaauuuaguaucuauacaa

SEQ ID NO: 4027234 - RNA, 14 nt, Staphylococcus aureus subsp. aureus MW2
cuaauuuguaaccc

SEQ ID NO: 4027235 - RNA, 15 nt, Staphylococcus aureus subsp. aureus MW2
cuaauuuuaaucauu

SEQ ID NO: 4027236 - RNA, 22 nt, Staphylococcus aureus subsp. aureus MW2
cuaauuuuaaucauuguuuuaa

SEQ ID NO: 4027237 - RNA, 16 nt, Staphylococcus aureus subsp. aureus MW2
cuaauuuugagacaaa

SEQ ID NO: 4027238 - RNA, 20 nt, Staphylococcus aureus subsp. aureus MW2
cuaauuuugagacaaaaaau

SEQ ID NO: 4027239 - RNA, 20 nt, Staphylococcus aureus subsp. aureus MW2
cuaauuuuguacauaaaaau

SEQ ID NO: 4027240 - RNA, 20 nt, Staphylococcus aureus subsp. aureus MW2
cuaauuuugugaauuuauuu

SEQ ID NO: 4027241 - RNA, 21 nt, Staphylococcus aureus subsp. aureus MW2
cuaauuuuuccaacuucuuuu

SEQ ID NO: 4027242 - RNA, 13 nt, Staphylococcus aureus subsp. aureus MW2
cuaauuuuuucau

SEQ ID NO: 4027243 - RNA, 21 nt, Staphylococcus aureus subsp. aureus MW2
cuacaaagcacaccuaauuca

SEQ ID NO: 4027244 - RNA, 23 nt, Staphylococcus aureus subsp. aureus MW2
cuacaaaguuuauacuuaauaua

SEQ ID NO: 4027245 - RNA, 23 nt, Staphylococcus aureus subsp. aureus MW2
cuacaacgaagaauccuaugcca

SEQ ID NO: 4027246 - RNA, 14 nt, Staphylococcus aureus subsp. aureus MW2
cuacaacuucuucu

SEQ ID NO: 4027247 - RNA, 23 nt, Staphylococcus aureus subsp. aureus MW2
cuacaacuucuucuccguauuua

SEQ ID NO: 4027248 - RNA, 16 nt, Staphylococcus aureus subsp. aureus MW2
cuacaauauagaaaau

SEQ ID NO: 4027249 - RNA, 19 nt, Staphylococcus aureus subsp. aureus MW2
cuacaauauuaaaauuaaa

SEQ ID NO: 4027250 - RNA, 19 nt, Staphylococcus aureus subsp. aureus MW2
cuacaaucauaccggcaaa

SEQ ID NO: 4027251 - RNA, 22 nt, Staphylococcus aureus subsp. aureus MW2
cuacaaucauaccggcaaauaa

SEQ ID NO: 4027252 - RNA, 22 nt, Staphylococcus aureus subsp. aureus MW2
cuacaauccuauggcgcaauuu

SEQ ID NO: 4027253 - RNA, 18 nt, Staphylococcus aureus subsp. aureus MW2
cuacaauucauaagaaaa

SEQ ID NO: 4027254 - RNA, 19 nt, Staphylococcus aureus subsp. aureus MW2
cuacacgaguguuaucaca

SEQ ID NO: 4027255 - RNA, 21 nt, Staphylococcus aureus subsp. aureus MW2
cuacagaauggauaccuaaag

SEQ ID NO: 4027256 - RNA, 17 nt, Staphylococcus aureus subsp. aureus MW2
cuacagacaaugcaagu

SEQ ID NO: 4027257 - RNA, 15 nt, Staphylococcus aureus subsp. aureus MW2
cuacagagaaucaau

SEQ ID NO: 4027258 - RNA, 20 nt, Staphylococcus aureus subsp. aureus MW2
cuacagagaaucaauuauug

SEQ ID NO: 4027259 - RNA, 17 nt, Staphylococcus aureus subsp. aureus MW2
cuacagauaaagcuucg

SEQ ID NO: 4027260 - RNA, 20 nt, Staphylococcus aureus subsp. aureus MW2
cuacagauuuuaaaaauuca

SEQ ID NO: 4027261 - RNA, 17 nt, Staphylococcus aureus subsp. aureus MW2
cuacaggcaaugcaagu

SEQ ID NO: 4027262 - RNA, 20 nt, Staphylococcus aureus subsp. aureus MW2
cuacauauacaaauuuauau

SEQ ID NO: 4027263 - RNA, 15 nt, Staphylococcus aureus subsp. aureus MW2
cuacauauuggcuug

SEQ ID NO: 4027264 - RNA, 16 nt, Staphylococcus aureus subsp. aureus MW2
cuacaugaaucaacaa

SEQ ID NO: 4027265 - RNA, 14 nt, Staphylococcus aureus subsp. aureus MW2
cuacauuaaaaaua

SEQ ID NO: 4027266 - RNA, 16 nt, Staphylococcus aureus subsp. aureus MW2
cuacauuaaagaaaau

SEQ ID NO: 4027267 - RNA, 20 nt, Staphylococcus aureus subsp. aureus MW2
cuacauuaaagaaaauaucu

SEQ ID NO: 4027268 - RNA, 14 nt, Staphylococcus aureus subsp. aureus MW2
cuacauuaauuuau

SEQ ID NO: 4027269 - RNA, 13 nt, Staphylococcus aureus subsp. aureus MW2
cuaccaauaauuc

SEQ ID NO: 4027270 - RNA, 14 nt, Staphylococcus aureus subsp. aureus MW2
cuacccuauuuuac

SEQ ID NO: 4027271 - RNA, 18 nt, Staphylococcus aureus subsp. aureus MW2
cuacccuugcaaauauau

SEQ ID NO: 4027272 - RNA, 14 nt, Staphylococcus aureus subsp. aureus MW2
cuaccgcuaaaauu

SEQ ID NO: 4027273 - RNA, 21 nt, Staphylococcus aureus subsp. aureus MW2
cuaccuacuuguucaauacuu

SEQ ID NO: 4027274 - RNA, 20 nt, Staphylococcus aureus subsp. aureus MW2
cuaccuauuugauuaaauua

SEQ ID NO: 4027275 - RNA, 23 nt, Staphylococcus aureus subsp. aureus MW2
cuacgauuuucaagaccaaauau

SEQ ID NO: 4027276 - RNA, 15 nt, Staphylococcus aureus subsp. aureus MW2
cuacgcccaucauca

SEQ ID NO: 4027277 - RNA, 17 nt, Staphylococcus aureus subsp. aureus MW2
cuacgcugaugaaugau

SEQ ID NO: 4027278 - RNA, 24 nt, Staphylococcus aureus subsp. aureus MW2
cuacguguguaguagcaccgauuu

SEQ ID NO: 4027279 - RNA, 17 nt, Staphylococcus aureus subsp. aureus MW2
cuacuaaaggaauuuca

SEQ ID NO: 4027280 - RNA, 21 nt, Staphylococcus aureus subsp. aureus MW2
cuacuaaaggaauuucaaacg

SEQ ID NO: 4027281 - RNA, 13 nt, Staphylococcus aureus subsp. aureus MW2
cuacuaaauaacu

SEQ ID NO: 4027282 - RNA, 15 nt, Staphylococcus aureus subsp. aureus MW2
cuacuaaucguugug

SEQ ID NO: 4027283 - RNA, 18 nt, Staphylococcus aureus subsp. aureus MW2
cuacuacaaauuuuaaaa

SEQ ID NO: 4027284 - RNA, 15 nt, Staphylococcus aureus subsp. aureus MW2
cuacuauuaaauaau

SEQ ID NO: 4027285 - RNA, 16 nt, Staphylococcus aureus subsp. aureus MW2
cuacuauuuaaucuua

SEQ ID NO: 4027286 - RNA, 16 nt, Staphylococcus aureus subsp. aureus MW2
cuacugcuaaaauaaa

SEQ ID NO: 4027287 - RNA, 21 nt, Staphylococcus aureus subsp. aureus MW2
cuaucguuuauugauagucac

SEQ ID NO: 4027288 - RNA, 14 nt, Staphylococcus aureus subsp. aureus MW2
cuaucuauaaacgu

SEQ ID NO: 4027289 - RNA, 14 nt, Staphylococcus aureus subsp. aureus MW2
cuaucuauuuuacu

SEQ ID NO: 4027290 - RNA, 22 nt, Staphylococcus aureus subsp. aureus MW2
cuaucuccgcuacaauuauaug

SEQ ID NO: 4027291 - RNA, 20 nt, Staphylococcus aureus subsp. aureus MW2
cuaucucuuuaguuaaaagu

SEQ ID NO: 4027292 - RNA, 14 nt, Staphylococcus aureus subsp. aureus MW2
cuaucuuauauuua

SEQ ID NO: 4027293 - RNA, 15 nt, Staphylococcus aureus subsp. aureus MW2
cuaucuuauauuuau

SEQ ID NO: 4027294 - RNA, 15 nt, Staphylococcus aureus subsp. aureus MW2
cuaucuuguucuucu

SEQ ID NO: 4027295 - RNA, 16 nt, Staphylococcus aureus subsp. aureus MW2
cuaucuuguucuucuu

SEQ ID NO: 4027296 - RNA, 18 nt, Staphylococcus aureus subsp. aureus MW2
cuaucuuguucuucuuua

SEQ ID NO: 4027297 - RNA, 17 nt, Staphylococcus aureus subsp. aureus MW2
cuaucuuuucaucguuc

SEQ ID NO: 4027298 - RNA, 20 nt, Staphylococcus aureus subsp. aureus MW2
cuaugaaacuggauaaauaa

SEQ ID NO: 4027299 - RNA, 21 nt, Staphylococcus aureus subsp. aureus MW2
cuaugaaacuggauaaauaaa

SEQ ID NO: 4027300 - RNA, 23 nt, Staphylococcus aureus subsp. aureus MW2
cuaugaaauuggaauagauguug

SEQ ID NO: 4027301 - RNA, 19 nt, Staphylococcus aureus subsp. aureus MW2
cuaugaacgaaucuauaac

SEQ ID NO: 4027302 - RNA, 14 nt, Staphylococcus aureus subsp. aureus MW2
cuaugaccaugaua

SEQ ID NO: 4027303 - RNA, 23 nt, Staphylococcus aureus subsp. aureus MW2
cuaugaugcuucuaacugaauua

SEQ ID NO: 4027304 - RNA, 19 nt, Staphylococcus aureus subsp. aureus MW2
cuaugauuugauauuucaa

SEQ ID NO: 4027305 - RNA, 16 nt, Staphylococcus aureus subsp. aureus MW2
cuauggcacaaaugaa

SEQ ID NO: 4027306 - RNA, 19 nt, Staphylococcus aureus subsp. aureus MW2
cuauggcgcaauuuuuaac

SEQ ID NO: 4027307 - RNA, 23 nt, Staphylococcus aureus subsp. aureus MW2
cuauggcgcaauuuuuaacaaaa

SEQ ID NO: 4027308 - RNA, 17 nt, Staphylococcus aureus subsp. aureus MW2
cuauguauaauacauga

SEQ ID NO: 4027309 - RNA, 16 nt, Staphylococcus aureus subsp. aureus MW2
cuaugucauaaauaaa

SEQ ID NO: 4027310 - RNA, 15 nt, Staphylococcus aureus subsp. aureus MW2
cuauguuggggcccc

SEQ ID NO: 4027311 - RNA, 18 nt, Staphylococcus aureus subsp. aureus MW2
cuauuaaacauuuuugau

SEQ ID NO: 4027312 - RNA, 19 nt, Staphylococcus aureus subsp. aureus MW2
cuauuaaacauuuuugauu

SEQ ID NO: 4027313 - RNA, 13 nt, Staphylococcus aureus subsp. aureus MW2
cuauuaaaggaaa

SEQ ID NO: 4027314 - RNA, 12 nt, Staphylococcus aureus subsp. aureus MW2
cuauuaaauaau

SEQ ID NO: 4027315 - RNA, 17 nt, Staphylococcus aureus subsp. aureus MW2
cuauuaauuacgucaua

SEQ ID NO: 4027316 - RNA, 23 nt, Staphylococcus aureus subsp. aureus MW2
cuauuaauugaaaugauaaaaau

SEQ ID NO: 4027317 - RNA, 22 nt, Staphylococcus aureus subsp. aureus MW2
cuauuacuacauaauuuaucaa

SEQ ID NO: 4027318 - RNA, 21 nt, Staphylococcus aureus subsp. aureus MW2
cuauuauguaccaaauuuaua

SEQ ID NO: 4027319 - RNA, 22 nt, Staphylococcus aureus subsp. aureus MW2
cuauuauuauguuauaaauucu

SEQ ID NO: 4027320 - RNA, 16 nt, Staphylococcus aureus subsp. aureus MW2
cuauuauuuuacuuug

SEQ ID NO: 4027321 - RNA, 13 nt, Staphylococcus aureus subsp. aureus MW2
cuauuauuuuuuu

SEQ ID NO: 4027322 - RNA, 19 nt, Staphylococcus aureus subsp. aureus MW2
cuauucaaauauaaauaaa

SEQ ID NO: 4027323 - RNA, 19 nt, Staphylococcus aureus subsp. aureus MW2
cuauucauagaccuaugaa

SEQ ID NO: 4027324 - RNA, 17 nt, Staphylococcus aureus subsp. aureus MW2
cuauucguuugaauuau

SEQ ID NO: 4027325 - RNA, 15 nt, Staphylococcus aureus subsp. aureus MW2
cuauucucagucucu

SEQ ID NO: 4027326 - RNA, 17 nt, Staphylococcus aureus subsp. aureus MW2
cuauugauauucuaaaa

SEQ ID NO: 4027327 - RNA, 17 nt, Staphylococcus aureus subsp. aureus MW2
cuauuggucauuacuaa

SEQ ID NO: 4027328 - RNA, 21 nt, Staphylococcus aureus subsp. aureus MW2
cuauuguauucgcuuacauua

SEQ ID NO: 4027329 - RNA, 16 nt, Staphylococcus aureus subsp. aureus MW2
cuauuuaaaauuauug

SEQ ID NO: 4027330 - RNA, 19 nt, Staphylococcus aureus subsp. aureus MW2
cuauuuaucauacuucaaa

SEQ ID NO: 4027331 - RNA, 13 nt, Staphylococcus aureus subsp. aureus MW2
cuauuuuuuuaau

SEQ ID NO: 4027332 - RNA, 16 nt, Staphylococcus aureus subsp. aureus MW2
cucaaaaagccaacac

SEQ ID NO: 4027333 - RNA, 15 nt, Staphylococcus aureus subsp. aureus MW2
cucaaaacaauuuaa

SEQ ID NO: 4027334 - RNA, 20 nt, Staphylococcus aureus subsp. aureus MW2
cucaaaacaauuuaaaaagc

SEQ ID NO: 4027335 - RNA, 17 nt, Staphylococcus aureus subsp. aureus MW2
cucaaacuaucuuauau

SEQ ID NO: 4027336 - RNA, 22 nt, Staphylococcus aureus subsp. aureus MW2
cucaaacuaucuuauauuuaug

SEQ ID NO: 4027337 - RNA, 20 nt, Staphylococcus aureus subsp. aureus MW2
cucaaagguuuacuauuaaa

SEQ ID NO: 4027338 - RNA, 11 nt, Staphylococcus aureus subsp. aureus MW2
cucaaauauua

SEQ ID NO: 4027339 - RNA, 12 nt, Staphylococcus aureus subsp. aureus MW2
cucaaauauuaa

SEQ ID NO: 4027340 - RNA, 16 nt, Staphylococcus aureus subsp. aureus MW2
cucaaauauuaauuua

SEQ ID NO: 4027341 - RNA, 15 nt, Staphylococcus aureus subsp. aureus MW2
cucaaauuagauaaa

SEQ ID NO: 4027342 - RNA, 22 nt, Staphylococcus aureus subsp. aureus MW2
cucaaauuagauaaaacaaaac

SEQ ID NO: 4027343 - RNA, 17 nt, Staphylococcus aureus subsp. aureus MW2
cucaacacgauagucau

SEQ ID NO: 4027344 - RNA, 18 nt, Staphylococcus aureus subsp. aureus MW2
cucaacgggaacaucaua

SEQ ID NO: 4027345 - RNA, 20 nt, Staphylococcus aureus subsp. aureus MW2
cucaacgggaacaucauaau

SEQ ID NO: 4027346 - RNA, 19 nt, Staphylococcus aureus subsp. aureus MW2
cucaagacauuacaucuuu

SEQ ID NO: 4027347 - RNA, 17 nt, Staphylococcus aureus subsp. aureus MW2
cucaauccaauuaaaua

SEQ ID NO: 4027348 - RNA, 20 nt, Staphylococcus aureus subsp. aureus MW2
cucaauccaauuaaauauuu

SEQ ID NO: 4027349 - RNA, 22 nt, Staphylococcus aureus subsp. aureus MW2
cucaauuaauuuagucauuaca

SEQ ID NO: 4027350 - RNA, 17 nt, Staphylococcus aureus subsp. aureus MW2
cucaauuuaguauaaau

SEQ ID NO: 4027351 - RNA, 24 nt, Staphylococcus aureus subsp. aureus MW2
cucaauuucauuugaaauaguuaa

SEQ ID NO: 4027352 - RNA, 23 nt, Staphylococcus aureus subsp. aureus MW2
cucaccuuuagacaauauuuuua

SEQ ID NO: 4027353 - RNA, 16 nt, Staphylococcus aureus subsp. aureus MW2
cucaccuuuaucauua

SEQ ID NO: 4027354 - RNA, 17 nt, Staphylococcus aureus subsp. aureus MW2
cucacgauuaauaaaau

SEQ ID NO: 4027355 - RNA, 20 nt, Staphylococcus aureus subsp. aureus MW2
cucacugcuguucuuuuuau

SEQ ID NO: 4027356 - RNA, 14 nt, Staphylococcus aureus subsp. aureus MW2
cucagauucauauc

SEQ ID NO: 4027357 - RNA, 20 nt, Staphylococcus aureus subsp. aureus MW2
cucagguauaggugcaguua

SEQ ID NO: 4027358 - RNA, 13 nt, Staphylococcus aureus subsp. aureus MW2
cucagugcauuuu

SEQ ID NO: 4027359 - RNA, 21 nt, Staphylococcus aureus subsp. aureus MW2
cucaguugcccgauuuuaaau

SEQ ID NO: 4027360 - RNA, 13 nt, Staphylococcus aureus subsp. aureus MW2
cucauaaaucaug

SEQ ID NO: 4027361 - RNA, 18 nt, Staphylococcus aureus subsp. aureus MW2
cucauaaccgcuucuuuu

SEQ ID NO: 4027362 - RNA, 10 nt, Staphylococcus aureus subsp. aureus MW2
cucauaauaa

SEQ ID NO: 4027363 - RNA, 12 nt, Staphylococcus aureus subsp. aureus MW2
cucauaauaauu

SEQ ID NO: 4027364 - RNA, 14 nt, Staphylococcus aureus subsp. aureus MW2
cucauaaucaaguc

SEQ ID NO: 4027365 - RNA, 15 nt, Staphylococcus aureus subsp. aureus MW2
cucauacaaauuuuu

SEQ ID NO: 4027366 - RNA, 14 nt, Staphylococcus aureus subsp. aureus MW2
cucauacuauacaa

SEQ ID NO: 4027367 - RNA, 16 nt, Staphylococcus aureus subsp. aureus MW2
cucauauugaauacuu

SEQ ID NO: 4027368 - RNA, 18 nt, Staphylococcus aureus subsp. aureus MW2
cucaucccucuaucaaau

SEQ ID NO: 4027369 - RNA, 20 nt, Staphylococcus aureus subsp. aureus MW2
cucauccgccaauuaaaauu

SEQ ID NO: 4027370 - RNA, 17 nt, Staphylococcus aureus subsp. aureus MW2
cucaucgaauucauuug

SEQ ID NO: 4027371 - RNA, 20 nt, Staphylococcus aureus subsp. aureus MW2
cucaucgcauccauuuuuug

SEQ ID NO: 4027372 - RNA, 21 nt, Staphylococcus aureus subsp. aureus MW2
cucaucuguccgauaucuuuu

SEQ ID NO: 4027373 - RNA, 12 nt, Staphylococcus aureus subsp. aureus MW2
cucaucuucuaa

SEQ ID NO: 4027374 - RNA, 19 nt, Staphylococcus aureus subsp. aureus MW2
cucaugcacuuuauuaaaa

SEQ ID NO: 4027375 - RNA, 14 nt, Staphylococcus aureus subsp. aureus MW2
cugaauaaaauaua

SEQ ID NO: 4027376 - RNA, 21 nt, Staphylococcus aureus subsp. aureus MW2
cugaaucugaagguaauuuaa

SEQ ID NO: 4027377 - RNA, 18 nt, Staphylococcus aureus subsp. aureus MW2
cugaaucugcuaauuuau

SEQ ID NO: 4027378 - RNA, 14 nt, Staphylococcus aureus subsp. aureus MW2
cugaaugcucaucu

SEQ ID NO: 4027379 - RNA, 16 nt, Staphylococcus aureus subsp. aureus MW2
cugaaugcucaucuuc

SEQ ID NO: 4027380 - RNA, 18 nt, Staphylococcus aureus subsp. aureus MW2
cugaauuaauauccaaaa

SEQ ID NO: 4027381 - RNA, 19 nt, Staphylococcus aureus subsp. aureus MW2
cugaauuaauauccaaaau

SEQ ID NO: 4027382 - RNA, 16 nt, Staphylococcus aureus subsp. aureus MW2
cugaauuuaggaauga

SEQ ID NO: 4027383 - RNA, 18 nt, Staphylococcus aureus subsp. aureus MW2
cugacauuucaucaauaa

SEQ ID NO: 4027384 - RNA, 17 nt, Staphylococcus aureus subsp. aureus MW2
cugacauuuuuggcuug

SEQ ID NO: 4027385 - RNA, 16 nt, Staphylococcus aureus subsp. aureus MW2
cugacgaaaagucagc

SEQ ID NO: 4027386 - RNA, 12 nt, Staphylococcus aureus subsp. aureus MW2
cugacuaauaaa

SEQ ID NO: 4027387 - RNA, 20 nt, Staphylococcus aureus subsp. aureus MW2
cugacuuuccgccagcuucu

SEQ ID NO: 4027388 - RNA, 18 nt, Staphylococcus aureus subsp. aureus MW2
cugauaauacuguuuaaa

SEQ ID NO: 4027389 - RNA, 22 nt, Staphylococcus aureus subsp. aureus MW2
cugauaauacuguuuaaauaaa

SEQ ID NO: 4027390 - RNA, 15 nt, Staphylococcus aureus subsp. aureus MW2
cugauaauuuuucuu

SEQ ID NO: 4027391 - RNA, 17 nt, Staphylococcus aureus subsp. aureus MW2
cugaucgcauguuugua

SEQ ID NO: 4027392 - RNA, 15 nt, Staphylococcus aureus subsp. aureus MW2
cugaucguaacauua

SEQ ID NO: 4027393 - RNA, 15 nt, Staphylococcus aureus subsp. aureus MW2
cugaucuaaaaccau

SEQ ID NO: 4027394 - RNA, 16 nt, Staphylococcus aureus subsp. aureus MW2
cugaugaacauaccug

SEQ ID NO: 4027395 - RNA, 22 nt, Staphylococcus aureus subsp. aureus MW2
cugaugcuagcuuucuuuuuca

SEQ ID NO: 4027396 - RNA, 20 nt, Staphylococcus aureus subsp. aureus MW2
cugauucaaaaauuguuaau

SEQ ID NO: 4027397 - RNA, 23 nt, Staphylococcus aureus subsp. aureus MW2
cugauugcugcuguacaauuucg

SEQ ID NO: 4027398 - RNA, 13 nt, Staphylococcus aureus subsp. aureus MW2
cugauuucacuuc

SEQ ID NO: 4027399 - RNA, 21 nt, Staphylococcus aureus subsp. aureus MW2
cugauuucuauuaauuauuug

SEQ ID NO: 4027400 - RNA, 19 nt, Staphylococcus aureus subsp. aureus MW2
cugcaaaauguuacacaaa

SEQ ID NO: 4027401 - RNA, 22 nt, Staphylococcus aureus subsp. aureus MW2
cugcaaaauguuacacaaauua

SEQ ID NO: 4027402 - RNA, 15 nt, Staphylococcus aureus subsp. aureus MW2
cugcaacgccuuuau

SEQ ID NO: 4027403 - RNA, 16 nt, Staphylococcus aureus subsp. aureus MW2
cugcaacuaauaugau

SEQ ID NO: 4027404 - RNA, 20 nt, Staphylococcus aureus subsp. aureus MW2
cugcaagugccguccauuuc

SEQ ID NO: 4027405 - RNA, 17 nt, Staphylococcus aureus subsp. aureus MW2
cugcaagugcuucaacu

SEQ ID NO: 4027406 - RNA, 16 nt, Staphylococcus aureus subsp. aureus MW2
cugcaaucguugaaaa

SEQ ID NO: 4027407 - RNA, 15 nt, Staphylococcus aureus subsp. aureus MW2
cugcaauguagcaau

SEQ ID NO: 4027408 - RNA, 17 nt, Staphylococcus aureus subsp. aureus MW2
cugcacaucauaauaaa

SEQ ID NO: 4027409 - RNA, 13 nt, Staphylococcus aureus subsp. aureus MW2
cugcagcaaucac

SEQ ID NO: 4027410 - RNA, 12 nt, Staphylococcus aureus subsp. aureus MW2
cugcagucgcuu

SEQ ID NO: 4027411 - RNA, 23 nt, Staphylococcus aureus subsp. aureus MW2
cugcauauucacgauauaacauu

SEQ ID NO: 4027412 - RNA, 16 nt, Staphylococcus aureus subsp. aureus MW2
cugccaaaaugguuaa

SEQ ID NO: 4027413 - RNA, 13 nt, Staphylococcus aureus subsp. aureus MW2
cugccaauauaac

SEQ ID NO: 4027414 - RNA, 13 nt, Staphylococcus aureus subsp. aureus MW2
cugccauauguuu

SEQ ID NO: 4027415 - RNA, 21 nt, Staphylococcus aureus subsp. aureus MW2
cugccaucaggcuuuauuguu

SEQ ID NO: 4027416 - RNA, 21 nt, Staphylococcus aureus subsp. aureus MW2
cugccuaaucgcacucugcau

SEQ ID NO: 4027417 - RNA, 17 nt, Staphylococcus aureus subsp. aureus MW2
cugccugacauucauca

SEQ ID NO: 4027418 - RNA, 18 nt, Staphylococcus aureus subsp. aureus MW2
cugcgaacagcugcuucu

SEQ ID NO: 4027419 - RNA, 13 nt, Staphylococcus aureus subsp. aureus MW2
cugcuaaaauugu

SEQ ID NO: 4027420 - RNA, 13 nt, Staphylococcus aureus subsp. aureus MW2
cugcuaacucuga

SEQ ID NO: 4027421 - RNA, 14 nt, Staphylococcus aureus subsp. aureus MW2
cugcuaauuuauaa

SEQ ID NO: 4027422 - RNA, 14 nt, Staphylococcus aureus subsp. aureus MW2
cugcuaauuuuuuc

SEQ ID NO: 4027423 - RNA, 15 nt, Staphylococcus aureus subsp. aureus MW2
cugcuaauuuuuuca

SEQ ID NO: 4027424 - RNA, 21 nt, Staphylococcus aureus subsp. aureus MW2
cugcuaauuuuuucaucauuc

SEQ ID NO: 4027425 - RNA, 17 nt, Staphylococcus aureus subsp. aureus MW2
cugcuaguucagcuucu

SEQ ID NO: 4027426 - RNA, 15 nt, Staphylococcus aureus subsp. aureus MW2
cugcuauuuuuuuaa

SEQ ID NO: 4027427 - RNA, 21 nt, Staphylococcus aureus subsp. aureus MW2
cugcucuuuauauauaaaauc

SEQ ID NO: 4027428 - RNA, 13 nt, Staphylococcus aureus subsp. aureus MW2
cugcucuuuauca

SEQ ID NO: 4027429 - RNA, 20 nt, Staphylococcus aureus subsp. aureus MW2
cugcugcuucggcaccuuua

SEQ ID NO: 4027430 - RNA, 17 nt, Staphylococcus aureus subsp. aureus MW2
cugcuggaacaccaaua

SEQ ID NO: 4027431 - RNA, 23 nt, Staphylococcus aureus subsp. aureus MW2
cugcuggaacaccaauauaaaca

SEQ ID NO: 4027432 - RNA, 20 nt, Staphylococcus aureus subsp. aureus MW2
cugcugguaacucuucagua

SEQ ID NO: 4027433 - RNA, 19 nt, Staphylococcus aureus subsp. aureus MW2
cugcuucaacuacuucauc

SEQ ID NO: 4027434 - RNA, 17 nt, Staphylococcus aureus subsp. aureus MW2
cugcuucuacccuugca

SEQ ID NO: 4027435 - RNA, 14 nt, Staphylococcus aureus subsp. aureus MW2
cugcuucugcugua

SEQ ID NO: 4027436 - RNA, 21 nt, Staphylococcus aureus subsp. aureus MW2
cugcuucuucagguguuuuac

SEQ ID NO: 4027437 - RNA, 16 nt, Staphylococcus aureus subsp. aureus MW2
cugcuugugugaaauu

SEQ ID NO: 4027438 - RNA, 20 nt, Staphylococcus aureus subsp. aureus MW2
cugcuuuuuauuauuaugug

SEQ ID NO: 4027439 - RNA, 18 nt, Staphylococcus aureus subsp. aureus MW2
cugcuuuuuuuauaagua

SEQ ID NO: 4027440 - RNA, 21 nt, Staphylococcus aureus subsp. aureus MW2
cuggaaaugauaauuuaauaa

SEQ ID NO: 4027441 - RNA, 18 nt, Staphylococcus aureus subsp. aureus MW2
cuggaacuuuaauaccag

SEQ ID NO: 4027442 - RNA, 23 nt, Staphylococcus aureus subsp. aureus MW2
cuggauaaauaaagauucaauua

SEQ ID NO: 4027443 - RNA, 16 nt, Staphylococcus aureus subsp. aureus MW2
cuggauccuuuauacg

SEQ ID NO: 4027444 - RNA, 20 nt, Staphylococcus aureus subsp. aureus MW2
cuggauuuuucuuauaaaaa

SEQ ID NO: 4027445 - RNA, 12 nt, Staphylococcus aureus subsp. aureus MW2
cuggcggaaagu

SEQ ID NO: 4027446 - RNA, 16 nt, Staphylococcus aureus subsp. aureus MW2
cuggcggaaagucagc

SEQ ID NO: 4027447 - RNA, 18 nt, Staphylococcus aureus subsp. aureus MW2
cuggcggaaagucagguu

SEQ ID NO: 4027448 - RNA, 12 nt, Staphylococcus aureus subsp. aureus MW2
cuggcuuuuuaa

SEQ ID NO: 4027449 - RNA, 19 nt, Staphylococcus aureus subsp. aureus MW2
cugguaacguucuacucua

SEQ ID NO: 4027450 - RNA, 17 nt, Staphylococcus aureus subsp. aureus MW2
cuggucguacuuucaaa

SEQ ID NO: 4027451 - RNA, 12 nt, Staphylococcus aureus subsp. aureus MW2
cugguucuucac

SEQ ID NO: 4027452 - RNA, 13 nt, Staphylococcus aureus subsp. aureus MW2
cuguaaaacauuc

SEQ ID NO: 4027453 - RNA, 21 nt, Staphylococcus aureus subsp. aureus MW2
cuguaacauaaacaauaacug

SEQ ID NO: 4027454 - RNA, 17 nt, Staphylococcus aureus subsp. aureus MW2
cuguaacgaguccauuu

SEQ ID NO: 4027455 - RNA, 23 nt, Staphylococcus aureus subsp. aureus MW2
cuguaacgaguccauuuucuuuu

SEQ ID NO: 4027456 - RNA, 14 nt, Staphylococcus aureus subsp. aureus MW2
cuguaauaccuuua

SEQ ID NO: 4027457 - RNA, 18 nt, Staphylococcus aureus subsp. aureus MW2
cuguaauccauucccuuu

SEQ ID NO: 4027458 - RNA, 16 nt, Staphylococcus aureus subsp. aureus MW2
cuguaccaaauuugug

SEQ ID NO: 4027459 - RNA, 21 nt, Staphylococcus aureus subsp. aureus MW2
cuguaccguuuuuuauaaauc

SEQ ID NO: 4027460 - RNA, 18 nt, Staphylococcus aureus subsp. aureus MW2
cuguacguuuuaaauaaa

SEQ ID NO: 4027461 - RNA, 15 nt, Staphylococcus aureus subsp. aureus MW2
cuguagaaacacuuu

SEQ ID NO: 4027462 - RNA, 15 nt, Staphylococcus aureus subsp. aureus MW2
cuguagaaauuggcu

SEQ ID NO: 4027463 - RNA, 17 nt, Staphylococcus aureus subsp. aureus MW2
cuguagcgauaccuuua

SEQ ID NO: 4027464 - RNA, 13 nt, Staphylococcus aureus subsp. aureus MW2
cuuacauugauaa

SEQ ID NO: 4027465 - RNA, 16 nt, Staphylococcus aureus subsp. aureus MW2
cuuacauuuuaauaaa

SEQ ID NO: 4027466 - RNA, 21 nt, Staphylococcus aureus subsp. aureus MW2
cuuaccuuuauguucaaaugu

SEQ ID NO: 4027467 - RNA, 18 nt, Staphylococcus aureus subsp. aureus MW2
cuuacgaauagaaaauaa

SEQ ID NO: 4027468 - RNA, 20 nt, Staphylococcus aureus subsp. aureus MW2
cuuacuaaguaaccaagucu

SEQ ID NO: 4027469 - RNA, 14 nt, Staphylococcus aureus subsp. aureus MW2
cuuacugcugcuuc

SEQ ID NO: 4027470 - RNA, 15 nt, Staphylococcus aureus subsp. aureus MW2
cuuacugcugcuucg

SEQ ID NO: 4027471 - RNA, 22 nt, Staphylococcus aureus subsp. aureus MW2
cuuacugcuguuuuuagguuau

SEQ ID NO: 4027472 - RNA, 17 nt, Staphylococcus aureus subsp. aureus MW2
cuuacugugaaaauacc

SEQ ID NO: 4027473 - RNA, 17 nt, Staphylococcus aureus subsp. aureus MW2
cuuacuuauauuuuaau

SEQ ID NO: 4027474 - RNA, 17 nt, Staphylococcus aureus subsp. aureus MW2
cuuagaccccuaauuaa

SEQ ID NO: 4027475 - RNA, 23 nt, Staphylococcus aureus subsp. aureus MW2
cuuagaccccuaauuaaaaugcu

SEQ ID NO: 4027476 - RNA, 19 nt, Staphylococcus aureus subsp. aureus MW2
cuuagauaaauuaauauga

SEQ ID NO: 4027477 - RNA, 16 nt, Staphylococcus aureus subsp. aureus MW2
cuuagcaaucucuuua

SEQ ID NO: 4027478 - RNA, 18 nt, Staphylococcus aureus subsp. aureus MW2
cuuaggugucaucgcuuu

SEQ ID NO: 4027479 - RNA, 22 nt, Staphylococcus aureus subsp. aureus MW2
cuuaggugucaucgcuuuaauu

SEQ ID NO: 4027480 - RNA, 13 nt, Staphylococcus aureus subsp. aureus MW2
cuuaguacaaaau

SEQ ID NO: 4027481 - RNA, 20 nt, Staphylococcus aureus subsp. aureus MW2
cuuagucauguuuggcauaa

SEQ ID NO: 4027482 - RNA, 16 nt, Staphylococcus aureus subsp. aureus MW2
cuuaguuugacaucua

SEQ ID NO: 4027483 - RNA, 17 nt, Staphylococcus aureus subsp. aureus MW2
cuuaguuugacaucuau

SEQ ID NO: 4027484 - RNA, 19 nt, Staphylococcus aureus subsp. aureus MW2
cuuaguuugacaucuauuu

SEQ ID NO: 4027485 - RNA, 21 nt, Staphylococcus aureus subsp. aureus MW2
cuuauaaagacaccuucaaua

SEQ ID NO: 4027486 - RNA, 14 nt, Staphylococcus aureus subsp. aureus MW2
cuuauaacauucuu

SEQ ID NO: 4027487 - RNA, 21 nt, Staphylococcus aureus subsp. aureus MW2
cuuauaacauucuucaaaaaa

SEQ ID NO: 4027488 - RNA, 17 nt, Staphylococcus aureus subsp. aureus MW2
cuuauaagauauagaag

SEQ ID NO: 4027489 - RNA, 16 nt, Staphylococcus aureus subsp. aureus MW2
cuuauaaguacauuuu

SEQ ID NO: 4027490 - RNA, 21 nt, Staphylococcus aureus subsp. aureus MW2
cuuauaaguucaaccauauga

SEQ ID NO: 4027491 - RNA, 17 nt, Staphylococcus aureus subsp. aureus MW2
cuuauacuauauaauaa

SEQ ID NO: 4027492 - RNA, 13 nt, Staphylococcus aureus subsp. aureus MW2
cuuauagaaugau

SEQ ID NO: 4027493 - RNA, 20 nt, Staphylococcus aureus subsp. aureus MW2
cuuauagaaugauuaaaauu

SEQ ID NO: 4027494 - RNA, 22 nt, Staphylococcus aureus subsp. aureus MW2
cuuauauuuuauuuaaaaauag

SEQ ID NO: 4027495 - RNA, 13 nt, Staphylococcus aureus subsp. aureus MW2
cuuauauuuuuua

SEQ ID NO: 4027496 - RNA, 14 nt, Staphylococcus aureus subsp. aureus MW2
cuuaucaacaacaa

SEQ ID NO: 4027497 - RNA, 16 nt, Staphylococcus aureus subsp. aureus MW2
cuuaucaacagcuuca

SEQ ID NO: 4027498 - RNA, 18 nt, Staphylococcus aureus subsp. aureus MW2
cuuaucaacagcuucaaa

SEQ ID NO: 4027499 - RNA, 22 nt, Staphylococcus aureus subsp. aureus MW2
cuuaucaagaauauaacgaaug

SEQ ID NO: 4027500 - RNA, 20 nt, Staphylococcus aureus subsp. aureus MW2
cuuaucaguuugcacuucaa

SEQ ID NO: 4027501 - RNA, 14 nt, Staphylococcus aureus subsp. aureus MW2
cuuaucauuacuug

SEQ ID NO: 4027502 - RNA, 15 nt, Staphylococcus aureus subsp. aureus MW2
cuuaucauuucaaau

SEQ ID NO: 4027503 - RNA, 23 nt, Staphylococcus aureus subsp. aureus MW2
cuuaucgccuggugcaggcauca

SEQ ID NO: 4027504 - RNA, 14 nt, Staphylococcus aureus subsp. aureus MW2
cuuaucugauuguu

SEQ ID NO: 4027505 - RNA, 13 nt, Staphylococcus aureus subsp. aureus MW2
cuuaugacugcuu

SEQ ID NO: 4027506 - RNA, 14 nt, Staphylococcus aureus subsp. aureus MW2
cuuaugagcaaagc

SEQ ID NO: 4027507 - RNA, 14 nt, Staphylococcus aureus subsp. aureus MW2
cuuaugauagugcu

SEQ ID NO: 4027508 - RNA, 15 nt, Staphylococcus aureus subsp. aureus MW2
cuuaugaugucaugu

SEQ ID NO: 4027509 - RNA, 18 nt, Staphylococcus aureus subsp. aureus MW2
cuuaugcaguuuuaauua

SEQ ID NO: 4027510 - RNA, 19 nt, Staphylococcus aureus subsp. aureus MW2
cuuaugcaguuuuaauuaa

SEQ ID NO: 4027511 - RNA, 16 nt, Staphylococcus aureus subsp. aureus MW2
cuuaugucauauacua

SEQ ID NO: 4027512 - RNA, 20 nt, Staphylococcus aureus subsp. aureus MW2
cuuauguggaggacacauuu

SEQ ID NO: 4027513 - RNA, 12 nt, Staphylococcus aureus subsp. aureus MW2
cuuauuaaaauu

SEQ ID NO: 4027514 - RNA, 12 nt, Staphylococcus aureus subsp. aureus MW2
cuuauuauuuau

SEQ ID NO: 4027515 - RNA, 13 nt, Staphylococcus aureus subsp. aureus MW2
cuuauuauuuugu

SEQ ID NO: 4027516 - RNA, 15 nt, Staphylococcus aureus subsp. aureus MW2
cuuauucaaauguuu

SEQ ID NO: 4027517 - RNA, 16 nt, Staphylococcus aureus subsp. aureus MW2
cuuauucaaauguuua

SEQ ID NO: 4027518 - RNA, 17 nt, Staphylococcus aureus subsp. aureus MW2
cuuauucgcaccacugg

SEQ ID NO: 4027519 - RNA, 21 nt, Staphylococcus aureus subsp. aureus MW2
cuuauucgcaccacuggccuu

SEQ ID NO: 4027520 - RNA, 19 nt, Staphylococcus aureus subsp. aureus MW2
cuuauucugaaaaauauuu

SEQ ID NO: 4027521 - RNA, 17 nt, Staphylococcus aureus subsp. aureus MW2
cuuauugaaaagauaaa

SEQ ID NO: 4027522 - RNA, 14 nt, Staphylococcus aureus subsp. aureus MW2
cuuauuuguuuaau

SEQ ID NO: 4027523 - RNA, 14 nt, Staphylococcus aureus subsp. aureus MW2
cuuauuuuaaaaua

SEQ ID NO: 4027524 - RNA, 17 nt, Staphylococcus aureus subsp. aureus MW2
cuuauuuuaaaauauua

SEQ ID NO: 4027525 - RNA, 18 nt, Staphylococcus aureus subsp. aureus MW2
cuuauuuuaaaauauuaa

SEQ ID NO: 4027526 - RNA, 13 nt, Staphylococcus aureus subsp. aureus MW2
cuuauuuuacuau

SEQ ID NO: 4027527 - RNA, 13 nt, Staphylococcus aureus subsp. aureus MW2
cuuauuuuauacg

SEQ ID NO: 4027528 - RNA, 19 nt, Staphylococcus aureus subsp. aureus MW2
cuuauuuuguuuuaaaaaa

SEQ ID NO: 4027529 - RNA, 13 nt, Staphylococcus aureus subsp. aureus MW2
cuucaaaaaauaa

SEQ ID NO: 4027530 - RNA, 15 nt, Staphylococcus aureus subsp. aureus MW2
cuucaaaauuuugac

SEQ ID NO: 4027531 - RNA, 18 nt, Staphylococcus aureus subsp. aureus MW2
cuucaaaguuuucauuuu

SEQ ID NO: 4027532 - RNA, 20 nt, Staphylococcus aureus subsp. aureus MW2
cuucaaaguuuucauuuuuu

SEQ ID NO: 4027533 - RNA, 23 nt, Staphylococcus aureus subsp. aureus MW2
cuucaaaguuuucauuuuuucaa

SEQ ID NO: 4027534 - RNA, 17 nt, Staphylococcus aureus subsp. aureus MW2
cuucaaauguaacauua

SEQ ID NO: 4027535 - RNA, 13 nt, Staphylococcus aureus subsp. aureus MW2
cuucaacauaacu

SEQ ID NO: 4027536 - RNA, 17 nt, Staphylococcus aureus subsp. aureus MW2
cuucaaccauuuguucu

SEQ ID NO: 4027537 - RNA, 15 nt, Staphylococcus aureus subsp. aureus MW2
cuucaacuucaucua

SEQ ID NO: 4027538 - RNA, 20 nt, Staphylococcus aureus subsp. aureus MW2
cuucaacuucaucuaaauga

SEQ ID NO: 4027539 - RNA, 14 nt, Staphylococcus aureus subsp. aureus MW2
cuucaagugccauu

SEQ ID NO: 4027540 - RNA, 13 nt, Staphylococcus aureus subsp. aureus MW2
cuucaauauuuaa

SEQ ID NO: 4027541 - RNA, 15 nt, Staphylococcus aureus subsp. aureus MW2
cuucaauuuaaugua

SEQ ID NO: 4027542 - RNA, 21 nt, Staphylococcus aureus subsp. aureus MW2
cuucaauuuauuuuuauauga

SEQ ID NO: 4027543 - RNA, 14 nt, Staphylococcus aureus subsp. aureus MW2
cuucacauuuaucc

SEQ ID NO: 4027544 - RNA, 14 nt, Staphylococcus aureus subsp. aureus MW2
cuucacuaaaaauc

SEQ ID NO: 4027545 - RNA, 19 nt, Staphylococcus aureus subsp. aureus MW2
cuucagccauaauaucuuu

SEQ ID NO: 4027546 - RNA, 19 nt, Staphylococcus aureus subsp. aureus MW2
cuucaggaauaucuuucaa

SEQ ID NO: 4027547 - RNA, 22 nt, Staphylococcus aureus subsp. aureus MW2
cuucaguacaauccugaagaga

SEQ ID NO: 4027548 - RNA, 21 nt, Staphylococcus aureus subsp. aureus MW2
cuucaguuaaaucuuuaacuu

SEQ ID NO: 4027549 - RNA, 20 nt, Staphylococcus aureus subsp. aureus MW2
cuucauaagucacaguaucu

SEQ ID NO: 4027550 - RNA, 13 nt, Staphylococcus aureus subsp. aureus MW2
cuucauagucacu

SEQ ID NO: 4027551 - RNA, 21 nt, Staphylococcus aureus subsp. aureus MW2
cuucauagucacuuuuaacga

SEQ ID NO: 4027552 - RNA, 22 nt, Staphylococcus aureus subsp. aureus MW2
cuucauaguucaaauugaacuu

SEQ ID NO: 4027553 - RNA, 16 nt, Staphylococcus aureus subsp. aureus MW2
cuugcucaugagcaca

SEQ ID NO: 4027554 - RNA, 19 nt, Staphylococcus aureus subsp. aureus MW2
cuugcucuaauucaaugau

SEQ ID NO: 4027555 - RNA, 23 nt, Staphylococcus aureus subsp. aureus MW2
cuugcuggacggcuacaauuuuc

SEQ ID NO: 4027556 - RNA, 20 nt, Staphylococcus aureus subsp. aureus MW2
cuugcuuacaauaaucacuu

SEQ ID NO: 4027557 - RNA, 22 nt, Staphylococcus aureus subsp. aureus MW2
cuugcuucauuauauaauucuu

SEQ ID NO: 4027558 - RNA, 14 nt, Staphylococcus aureus subsp. aureus MW2
cuugcuucuguauc

SEQ ID NO: 4027559 - RNA, 18 nt, Staphylococcus aureus subsp. aureus MW2
cuugcuuuguucuucguc

SEQ ID NO: 4027560 - RNA, 22 nt, Staphylococcus aureus subsp. aureus MW2
cuuggaaacgauauagaccguu

SEQ ID NO: 4027561 - RNA, 17 nt, Staphylococcus aureus subsp. aureus MW2
cuuggauucaaaugaca

SEQ ID NO: 4027562 - RNA, 14 nt, Staphylococcus aureus subsp. aureus MW2
cuuggcauuuuuuc

SEQ ID NO: 4027563 - RNA, 19 nt, Staphylococcus aureus subsp. aureus MW2
cuuggccuacuuuuucaau

SEQ ID NO: 4027564 - RNA, 17 nt, Staphylococcus aureus subsp. aureus MW2
cuuggcgacauuuguaa

SEQ ID NO: 4027565 - RNA, 20 nt, Staphylococcus aureus subsp. aureus MW2
cuuggcguauuuuuuguucu

SEQ ID NO: 4027566 - RNA, 19 nt, Staphylococcus aureus subsp. aureus MW2
cuugggcugacauuuuugg

SEQ ID NO: 4027567 - RNA, 14 nt, Staphylococcus aureus subsp. aureus MW2
cuugguauuuaucc

SEQ ID NO: 4027568 - RNA, 17 nt, Staphylococcus aureus subsp. aureus MW2
cuugguauuuuuuaaau

SEQ ID NO: 4027569 - RNA, 20 nt, Staphylococcus aureus subsp. aureus MW2
cuugguuaucauuauucaua

SEQ ID NO: 4027570 - RNA, 15 nt, Staphylococcus aureus subsp. aureus MW2
cuuguaaacuucuuu

SEQ ID NO: 4027571 - RNA, 18 nt, Staphylococcus aureus subsp. aureus MW2
cuuguaauauaacaagua

SEQ ID NO: 4027572 - RNA, 21 nt, Staphylococcus aureus subsp. aureus MW2
cuugucaguuuuuuuauaagc

SEQ ID NO: 4027573 - RNA, 14 nt, Staphylococcus aureus subsp. aureus MW2
cuugucuuuuuuaa

SEQ ID NO: 4027574 - RNA, 20 nt, Staphylococcus aureus subsp. aureus MW2
cuugucuuuuuuaaagaggc

SEQ ID NO: 4027575 - RNA, 23 nt, Staphylococcus aureus subsp. aureus MW2
cuuguucaaguaaucauuuuucg

SEQ ID NO: 4027576 - RNA, 18 nt, Staphylococcus aureus subsp. aureus MW2
cuuguucaauacuuucag

SEQ ID NO: 4027577 - RNA, 14 nt, Staphylococcus aureus subsp. aureus MW2
cuuguucuucuuua

SEQ ID NO: 4027578 - RNA, 13 nt, Staphylococcus aureus subsp. aureus MW2
cuuguucuuuacu

SEQ ID NO: 4027579 - RNA, 20 nt, Staphylococcus aureus subsp. aureus MW2
cuuguugaacucugauauug

SEQ ID NO: 4027580 - RNA, 16 nt, Staphylococcus aureus subsp. aureus MW2
cuuguuggauuuuaac

SEQ ID NO: 4027581 - RNA, 18 nt, Staphylococcus aureus subsp. aureus MW2
cuuguuggcuuuuuuaau

SEQ ID NO: 4027582 - RNA, 23 nt, Staphylococcus aureus subsp. aureus MW2
cuuguuuauuuuuaaucuucauc

SEQ ID NO: 4027583 - RNA, 13 nt, Staphylococcus aureus subsp. aureus MW2
cuuguuucagacu

SEQ ID NO: 4027584 - RNA, 22 nt, Staphylococcus aureus subsp. aureus MW2
cuuguuucgucagauucaaacg

SEQ ID NO: 4027585 - RNA, 13 nt, Staphylococcus aureus subsp. aureus MW2
cuuguuuuaaacu

SEQ ID NO: 4027586 - RNA, 20 nt, Staphylococcus aureus subsp. aureus MW2
cuuuaaaacguuaguacuuu

SEQ ID NO: 4027587 - RNA, 14 nt, Staphylococcus aureus subsp. aureus MW2
cuuuaaaauucucu

SEQ ID NO: 4027588 - RNA, 15 nt, Staphylococcus aureus subsp. aureus MW2
cuuuaaaauucucua

SEQ ID NO: 4027589 - RNA, 13 nt, Staphylococcus aureus subsp. aureus MW2
cuuuaaaauuuuu

SEQ ID NO: 4027590 - RNA, 14 nt, Staphylococcus aureus subsp. aureus MW2
cuuuaaacaagcau

SEQ ID NO: 4027591 - RNA, 11 nt, Staphylococcus aureus subsp. aureus MW2
cuuuaaacucg

SEQ ID NO: 4027592 - RNA, 18 nt, Staphylococcus aureus subsp. aureus MW2
cuuuaaauauacuucuau

SEQ ID NO: 4027593 - RNA, 11 nt, Staphylococcus aureus subsp. aureus MW2
cuuuaaaucuu

SEQ ID NO: 4027594 - RNA, 13 nt, Staphylococcus aureus subsp. aureus MW2
cuuuaaauguuuu

SEQ ID NO: 4027595 - RNA, 14 nt, Staphylococcus aureus subsp. aureus MW2
cuuuaaauuauaua

SEQ ID NO: 4027596 - RNA, 22 nt, Staphylococcus aureus subsp. aureus MW2
cuuuaaauuauauacucaccac

SEQ ID NO: 4027597 - RNA, 21 nt, Staphylococcus aureus subsp. aureus MW2
cuuuaacaauuuuaucugaau

SEQ ID NO: 4027598 - RNA, 15 nt, Staphylococcus aureus subsp. aureus MW2
cuuuaacaucugaau

SEQ ID NO: 4027599 - RNA, 13 nt, Staphylococcus aureus subsp. aureus MW2
cuuuaacauuuau

SEQ ID NO: 4027600 - RNA, 15 nt, Staphylococcus aureus subsp. aureus MW2
cuuuaacucuugaaa

SEQ ID NO: 4027601 - RNA, 21 nt, Staphylococcus aureus subsp. aureus MW2
cuuuaacugcgugaauguuac

SEQ ID NO: 4027602 - RNA, 21 nt, Staphylococcus aureus subsp. aureus MW2
cuuuaacuguacgauucaauu

SEQ ID NO: 4027603 - RNA, 17 nt, Staphylococcus aureus subsp. aureus MW2
cuuuaacuucuuuuguu

SEQ ID NO: 4027604 - RNA, 17 nt, Staphylococcus aureus subsp. aureus MW2
cuuuaacuuuaauuaaa

SEQ ID NO: 4027605 - RNA, 16 nt, Staphylococcus aureus subsp. aureus MW2
cuuuaagcccuucccc

SEQ ID NO: 4027606 - RNA, 19 nt, Staphylococcus aureus subsp. aureus MW2
cuuuaaggaacuuaauguc

SEQ ID NO: 4027607 - RNA, 20 nt, Staphylococcus aureus subsp. aureus MW2
cuuuaaguaauucauuugcu

SEQ ID NO: 4027608 - RNA, 12 nt, Staphylococcus aureus subsp. aureus MW2
cuuuaauacuac

SEQ ID NO: 4027609 - RNA, 12 nt, Staphylococcus aureus subsp. aureus MW2
cuuuaauaucua

SEQ ID NO: 4027610 - RNA, 20 nt, Staphylococcus aureus subsp. aureus MW2
cuuuaaugaaagcaucuugc

SEQ ID NO: 4027611 - RNA, 17 nt, Staphylococcus aureus subsp. aureus MW2
cuuuaauguaauuauuu

SEQ ID NO: 4027612 - RNA, 15 nt, Staphylococcus aureus subsp. aureus MW2
cuuuaauuaaaguua

SEQ ID NO: 4027613 - RNA, 15 nt, Staphylococcus aureus subsp. aureus MW2
cuuuaauuuaucauu

SEQ ID NO: 4027614 - RNA, 16 nt, Staphylococcus aureus subsp. aureus MW2
cuuuaauuucauuuau

SEQ ID NO: 4027615 - RNA, 18 nt, Staphylococcus aureus subsp. aureus MW2
cuuuaauuuucuugccau

SEQ ID NO: 4027616 - RNA, 18 nt, Staphylococcus aureus subsp. aureus MW2
cuuuacaacaguaaucau

SEQ ID NO: 4027617 - RNA, 20 nt, Staphylococcus aureus subsp. aureus MW2
cuuuacauucuuuguauuua

SEQ ID NO: 4027618 - RNA, 15 nt, Staphylococcus aureus subsp. aureus MW2
cuuuaccaauaucau

SEQ ID NO: 4027619 - RNA, 20 nt, Staphylococcus aureus subsp. aureus MW2
cuuuaccaguaacagcuaag

SEQ ID NO: 4027620 - RNA, 12 nt, Staphylococcus aureus subsp. aureus MW2
cuuuaccaucuu

SEQ ID NO: 4027621 - RNA, 18 nt, Staphylococcus aureus subsp. aureus MW2
cuuuacuauauucaauga

SEQ ID NO: 4027622 - RNA, 21 nt, Staphylococcus aureus subsp. aureus MW2
cuuuacuugcuuuuucaaaua

SEQ ID NO: 4027623 - RNA, 23 nt, Staphylococcus aureus subsp. aureus MW2
cuuuacuugcuuuuucaaauaau

SEQ ID NO: 4027624 - RNA, 14 nt, Staphylococcus aureus subsp. aureus MW2
cuuuagaaagugau

SEQ ID NO: 4027625 - RNA, 14 nt, Staphylococcus aureus subsp. aureus MW2
cuuuagcaauugaa

SEQ ID NO: 4027626 - RNA, 22 nt, Staphylococcus aureus subsp. aureus MW2
cuuuagcauauucgcuuaaaaa

SEQ ID NO: 4027627 - RNA, 17 nt, Staphylococcus aureus subsp. aureus MW2
cuuuagcuauuuaaaau

SEQ ID NO: 4027628 - RNA, 18 nt, Staphylococcus aureus subsp. aureus MW2
cuuuagcuauuuaaaauu

SEQ ID NO: 4027629 - RNA, 21 nt, Staphylococcus aureus subsp. aureus MW2
cuuuagcucuuuuuugauuua

SEQ ID NO: 4027630 - RNA, 18 nt, Staphylococcus aureus subsp. aureus MW2
cuuuaggaaucgucauau

SEQ ID NO: 4027631 - RNA, 17 nt, Staphylococcus aureus subsp. aureus MW2
cuuuaggguucauugcu

SEQ ID NO: 4027632 - RNA, 17 nt, Staphylococcus aureus subsp. aureus MW2
cuuuaguacgcuguaau

SEQ ID NO: 4027633 - RNA, 18 nt, Staphylococcus aureus subsp. aureus MW2
cuuuaguuguuaggggcu

SEQ ID NO: 4027634 - RNA, 14 nt, Staphylococcus aureus subsp. aureus MW2
cuuuauaugagaaa

SEQ ID NO: 4027635 - RNA, 14 nt, Staphylococcus aureus subsp. aureus MW2
cuuuauauuuauca

SEQ ID NO: 4027636 - RNA, 19 nt, Staphylococcus aureus subsp. aureus MW2
cuuuaugaagugaaaucau

SEQ ID NO: 4027637 - RNA, 21 nt, Staphylococcus aureus subsp. aureus MW2
cuuuaugcaaaauuaaugaac

SEQ ID NO: 4027638 - RNA, 20 nt, Staphylococcus aureus subsp. aureus MW2
cuuuauggguauccuucuca

SEQ ID NO: 4027639 - RNA, 22 nt, Staphylococcus aureus subsp. aureus MW2
cuuuaugugguuuugauuaaac

SEQ ID NO: 4027640 - RNA, 14 nt, Staphylococcus aureus subsp. aureus MW2
cuuuauuaaauaac

SEQ ID NO: 4027641 - RNA, 13 nt, Staphylococcus aureus subsp. aureus MW2
cuuuauuaaauuc

SEQ ID NO: 4027642 - RNA, 15 nt, Staphylococcus aureus subsp. aureus MW2
cuuuugauagcuaau

SEQ ID NO: 4027643 - RNA, 20 nt, Staphylococcus aureus subsp. aureus MW2
cuuuugauguuuaugacaaa

SEQ ID NO: 4027644 - RNA, 14 nt, Staphylococcus aureus subsp. aureus MW2
cuuuugauuuugaa

SEQ ID NO: 4027645 - RNA, 18 nt, Staphylococcus aureus subsp. aureus MW2
cuuuugcaauuuuugaaa

SEQ ID NO: 4027646 - RNA, 14 nt, Staphylococcus aureus subsp. aureus MW2
cuuuugcaccuuca

SEQ ID NO: 4027647 - RNA, 17 nt, Staphylococcus aureus subsp. aureus MW2
cuuuugcaccuucaagu

SEQ ID NO: 4027648 - RNA, 16 nt, Staphylococcus aureus subsp. aureus MW2
cuuuugcuguaucuuc

SEQ ID NO: 4027649 - RNA, 13 nt, Staphylococcus aureus subsp. aureus MW2
cuuuuggucuguu

SEQ ID NO: 4027650 - RNA, 13 nt, Staphylococcus aureus subsp. aureus MW2
cuuuuguaaaaaa

SEQ ID NO: 4027651 - RNA, 21 nt, Staphylococcus aureus subsp. aureus MW2
cuuuuguaaagcuuuaguuaa

SEQ ID NO: 4027652 - RNA, 19 nt, Staphylococcus aureus subsp. aureus MW2
cuuuuguaccaucaauaaa

SEQ ID NO: 4027653 - RNA, 16 nt, Staphylococcus aureus subsp. aureus MW2
cuuuuguccaacaugu

SEQ ID NO: 4027654 - RNA, 11 nt, Staphylococcus aureus subsp. aureus MW2
cuuuuguuaau

SEQ ID NO: 4027655 - RNA, 19 nt, Staphylococcus aureus subsp. aureus MW2
cuuuuguuuaguauggaau

SEQ ID NO: 4027656 - RNA, 13 nt, Staphylococcus aureus subsp. aureus MW2
cuuuuguuucaaa

SEQ ID NO: 4027657 - RNA, 18 nt, Staphylococcus aureus subsp. aureus MW2
cuuuuguuuucacuguuu

SEQ ID NO: 4027658 - RNA, 12 nt, Staphylococcus aureus subsp. aureus MW2
cuuuuuaaaaua

SEQ ID NO: 4027659 - RNA, 23 nt, Staphylococcus aureus subsp. aureus MW2
cuuuuuaaacguacauuuuuaug

SEQ ID NO: 4027660 - RNA, 12 nt, Staphylococcus aureus subsp. aureus MW2
cuuuuuaaagga

SEQ ID NO: 4027661 - RNA, 17 nt, Staphylococcus aureus subsp. aureus MW2
cuuuuuagccccagcaa

SEQ ID NO: 4027662 - RNA, 23 nt, Staphylococcus aureus subsp. aureus MW2
cuuuuuagccccagcaaauacuu

SEQ ID NO: 4027663 - RNA, 17 nt, Staphylococcus aureus subsp. aureus MW2
cuuuuuaggaaugauag

SEQ ID NO: 4027664 - RNA, 12 nt, Staphylococcus aureus subsp. aureus MW2
cuuuuuaggaug

SEQ ID NO: 4027665 - RNA, 15 nt, Staphylococcus aureus subsp. aureus MW2
cuuuuuauaucaaaa

SEQ ID NO: 4027666 - RNA, 19 nt, Staphylococcus aureus subsp. aureus MW2
cuuuuuaucaacaaauuua

SEQ ID NO: 4027667 - RNA, 13 nt, Staphylococcus aureus subsp. aureus MW2
cuuuuuaucauga

SEQ ID NO: 4027668 - RNA, 22 nt, Staphylococcus aureus subsp. aureus MW2
cuuuuuaucaugauuaauuaaa

SEQ ID NO: 4027669 - RNA, 18 nt, Staphylococcus aureus subsp. aureus MW2
cuuuuuauugauauuaau

SEQ ID NO: 4027670 - RNA, 23 nt, Staphylococcus aureus subsp. aureus MW2
cuuuuuauuuauaacuuuaaaaa

SEQ ID NO: 4027671 - RNA, 17 nt, Staphylococcus aureus subsp. aureus MW2
cuuuuuauuuuaauauu

SEQ ID NO: 4027672 - RNA, 14 nt, Staphylococcus aureus subsp. aureus MW2
cuuuuuauuuugua

SEQ ID NO: 4027673 - RNA, 13 nt, Staphylococcus aureus subsp. aureus MW2
cuuuuucaaaaau

SEQ ID NO: 4027674 - RNA, 23 nt, Staphylococcus aureus subsp. aureus MW2
cuuuuucaaaaauuguuaauccc

SEQ ID NO: 4027675 - RNA, 21 nt, Staphylococcus aureus subsp. aureus MW2
cuuuuucaaauaauauaaaac

SEQ ID NO: 4027676 - RNA, 18 nt, Staphylococcus aureus subsp. aureus MW2
cuuuuucaauucuaguca

SEQ ID NO: 4027677 - RNA, 12 nt, Staphylococcus aureus subsp. aureus MW2
cuuuuucacauu

SEQ ID NO: 4027678 - RNA, 22 nt, Staphylococcus aureus subsp. aureus MW2
cuuuuucacgauuuuuaaaaug

SEQ ID NO: 4027679 - RNA, 18 nt, Staphylococcus aureus subsp. aureus MW2
cuuuuucacuaaucauuu

SEQ ID NO: 4027680 - RNA, 22 nt, Staphylococcus aureus subsp. aureus MW2
cuuuuucacuaaucauuuuuuc

SEQ ID NO: 4027681 - RNA, 23 nt, Staphylococcus aureus subsp. aureus MW2
cuuuuucagguguaucccaacca

SEQ ID NO: 4027682 - RNA, 13 nt, Staphylococcus aureus subsp. aureus MW2
cuuuuucaucuuu

SEQ ID NO: 4027683 - RNA, 21 nt, Staphylococcus aureus subsp. aureus MW2
cuuuuucgauuaauucuucuu

SEQ ID NO: 4027684 - RNA, 16 nt, Staphylococcus aureus subsp. aureus MW2
cuuuuucuaaauaaac

SEQ ID NO: 4027685 - RNA, 14 nt, Staphylococcus aureus subsp. aureus MW2
cuuuuucuauacaa

SEQ ID NO: 4027686 - RNA, 19 nt, Staphylococcus aureus subsp. aureus MW2
cuuuuucuauacaaugaau

SEQ ID NO: 4027687 - RNA, 17 nt, Staphylococcus aureus subsp. aureus MW2
cuuuuucuucuacauau

SEQ ID NO: 4027688 - RNA, 22 nt, Staphylococcus aureus subsp. aureus MW2
cuuuuugaaauuucgacaucua

SEQ ID NO: 4027689 - RNA, 19 nt, Staphylococcus aureus subsp. aureus MW2
cuuuuugacauauuuuuua

SEQ ID NO: 4027690 - RNA, 21 nt, Staphylococcus aureus subsp. aureus MW2
cuuuuugacauauuuuuuaaa

SEQ ID NO: 4027691 - RNA, 20 nt, Staphylococcus aureus subsp. aureus MW2
cuuuuugacucaaaaucuua

SEQ ID NO: 4027692 - RNA, 14 nt, Staphylococcus aureus subsp. aureus MW2
cuuuuuuaaauuua

SEQ ID NO: 4027693 - RNA, 16 nt, Staphylococcus aureus subsp. aureus MW2
cuuuuuuaagaucaau

SEQ ID NO: 4027694 - RNA, 20 nt, Staphylococcus aureus subsp. aureus MW2
cuuuuuuacauuuaacauuu

SEQ ID NO: 4027695 - RNA, 19 nt, Staphylococcus aureus subsp. aureus MW2
cuuuuuugaaaugguaucu

SEQ ID NO: 4027696 - RNA, 15 nt, Staphylococcus aureus subsp. aureus MW2
gaaaaaaauuuucau

SEQ ID NO: 4027697 - RNA, 15 nt, Staphylococcus aureus subsp. aureus MW2
gaaaaaacuuuucau

SEQ ID NO: 4027698 - RNA, 21 nt, Staphylococcus aureus subsp. aureus MW2
gaaaaaacuuuucauggaguc

SEQ ID NO: 4027699 - RNA, 22 nt, Staphylococcus aureus subsp. aureus MW2
gaaaaaaucggacagcugaaaa

SEQ ID NO: 4027700 - RNA, 17 nt, Staphylococcus aureus subsp. aureus MW2
gaaaaacuguaaaucau

SEQ ID NO: 4027701 - RNA, 19 nt, Staphylococcus aureus subsp. aureus MW2
gaaaaacuguaaaucauca

SEQ ID NO: 4027702 - RNA, 21 nt, Staphylococcus aureus subsp. aureus MW2
gaaaaacuucuuaacuugaaa

SEQ ID NO: 4027703 - RNA, 20 nt, Staphylococcus aureus subsp. aureus MW2
gaaaaagauucggaaaauau

SEQ ID NO: 4027704 - RNA, 17 nt, Staphylococcus aureus subsp. aureus MW2
gaaaaagcaggcaagcu

SEQ ID NO: 4027705 - RNA, 17 nt, Staphylococcus aureus subsp. aureus MW2
gaaaaagcuaauucuua

SEQ ID NO: 4027706 - RNA, 11 nt, Staphylococcus aureus subsp. aureus MW2
gaaaaauaauu

SEQ ID NO: 4027707 - RNA, 15 nt, Staphylococcus aureus subsp. aureus MW2
gaaaaauauuuaaau

SEQ ID NO: 4027708 - RNA, 16 nt, Staphylococcus aureus subsp. aureus MW2
gaaaaauauuuaaaua

SEQ ID NO: 4027709 - RNA, 19 nt, Staphylococcus aureus subsp. aureus MW2
gaaaaauguguuaaaauau

SEQ ID NO: 4027710 - RNA, 12 nt, Staphylococcus aureus subsp. aureus MW2
gaaaaauuaaaa

SEQ ID NO: 4027711 - RNA, 18 nt, Staphylococcus aureus subsp. aureus MW2
gaaaaauugcucauugug

SEQ ID NO: 4027712 - RNA, 16 nt, Staphylococcus aureus subsp. aureus MW2
gaaaaauuucaaaaau

SEQ ID NO: 4027713 - RNA, 20 nt, Staphylococcus aureus subsp. aureus MW2
gaaaaauuucaaaaauagcg

SEQ ID NO: 4027714 - RNA, 22 nt, Staphylococcus aureus subsp. aureus MW2
gaaaacauaaauacaaaaauau

SEQ ID NO: 4027715 - RNA, 14 nt, Staphylococcus aureus subsp. aureus MW2
gaaaacgaacaagg

SEQ ID NO: 4027716 - RNA, 16 nt, Staphylococcus aureus subsp. aureus MW2
gaaaagaaauucuaca

SEQ ID NO: 4027717 - RNA, 15 nt, Staphylococcus aureus subsp. aureus MW2
gaaaagagaaacaaa

SEQ ID NO: 4027718 - RNA, 17 nt, Staphylococcus aureus subsp. aureus MW2
gaaaagagauuuuuuug

SEQ ID NO: 4027719 - RNA, 21 nt, Staphylococcus aureus subsp. aureus MW2
gaaaagagauuuuuuugaaaa

SEQ ID NO: 4027720 - RNA, 14 nt, Staphylococcus aureus subsp. aureus MW2
gaaaagcuagaagu

SEQ ID NO: 4027721 - RNA, 19 nt, Staphylococcus aureus subsp. aureus MW2
gaaaagcuagaaguucuua

SEQ ID NO: 4027722 - RNA, 20 nt, Staphylococcus aureus subsp. aureus MW2
gaaaaggucaaaaaauuaau

SEQ ID NO: 4027723 - RNA, 14 nt, Staphylococcus aureus subsp. aureus MW2
gaaaaguauaugaa

SEQ ID NO: 4027724 - RNA, 16 nt, Staphylococcus aureus subsp. aureus MW2
gaaaagucacagugua

SEQ ID NO: 4027725 - RNA, 23 nt, Staphylococcus aureus subsp. aureus MW2
gaaaagucagcuuacaauaaugu

SEQ ID NO: 4027726 - RNA, 18 nt, Staphylococcus aureus subsp. aureus MW2
gaaaagugcgauuaucag

SEQ ID NO: 4027727 - RNA, 17 nt, Staphylococcus aureus subsp. aureus MW2
gaaaauaaaacaaauua

SEQ ID NO: 4027728 - RNA, 17 nt, Staphylococcus aureus subsp. aureus MW2
gaaaauacuauacugau

SEQ ID NO: 4027729 - RNA, 18 nt, Staphylococcus aureus subsp. aureus MW2
gaaaauagcuauuaaaau

SEQ ID NO: 4027730 - RNA, 22 nt, Staphylococcus aureus subsp. aureus MW2
gaaaauagcuauuaaaauagag

SEQ ID NO: 4027731 - RNA, 20 nt, Staphylococcus aureus subsp. aureus MW2
gaaauuugauuuucaauuuc

SEQ ID NO: 4027732 - RNA, 15 nt, Staphylococcus aureus subsp. aureus MW2
gaacaaaauaacaug

SEQ ID NO: 4027733 - RNA, 20 nt, Staphylococcus aureus subsp. aureus MW2
gaacaacauugagauuaucu

SEQ ID NO: 4027734 - RNA, 21 nt, Staphylococcus aureus subsp. aureus MW2
gaacaauaauaugccaaagua

SEQ ID NO: 4027735 - RNA, 19 nt, Staphylococcus aureus subsp. aureus MW2
gaacaauaccgccuacugu

SEQ ID NO: 4027736 - RNA, 22 nt, Staphylococcus aureus subsp. aureus MW2
gaacaaucggaagcauauuucu

SEQ ID NO: 4027737 - RNA, 18 nt, Staphylococcus aureus subsp. aureus MW2
gaacaccaauauaaacau

SEQ ID NO: 4027738 - RNA, 16 nt, Staphylococcus aureus subsp. aureus MW2
gaacagcacauuuuua

SEQ ID NO: 4027739 - RNA, 17 nt, Staphylococcus aureus subsp. aureus MW2
gaacagcugcuucucuu

SEQ ID NO: 4027740 - RNA, 16 nt, Staphylococcus aureus subsp. aureus MW2
gaacauaccugcauau

SEQ ID NO: 4027741 - RNA, 22 nt, Staphylococcus aureus subsp. aureus MW2
gaacauaccugcauauguguuu

SEQ ID NO: 4027742 - RNA, 21 nt, Staphylococcus aureus subsp. aureus MW2
gaacauagucugcuauuuuuu

SEQ ID NO: 4027743 - RNA, 18 nt, Staphylococcus aureus subsp. aureus MW2
gaacauauucauaauauc

SEQ ID NO: 4027744 - RNA, 13 nt, Staphylococcus aureus subsp. aureus MW2
gaacaucaucuau

SEQ ID NO: 4027745 - RNA, 14 nt, Staphylococcus aureus subsp. aureus MW2
gaacaucaucuaug

SEQ ID NO: 4027746 - RNA, 19 nt, Staphylococcus aureus subsp. aureus MW2
gaacaucuaguuauuucau

SEQ ID NO: 4027747 - RNA, 12 nt, Staphylococcus aureus subsp. aureus MW2
gaacaucugaaa

SEQ ID NO: 4027748 - RNA, 15 nt, Staphylococcus aureus subsp. aureus MW2
gaacaucugaaaaaa

SEQ ID NO: 4027749 - RNA, 17 nt, Staphylococcus aureus subsp. aureus MW2
gaacaugaaauuaauca

SEQ ID NO: 4027750 - RNA, 16 nt, Staphylococcus aureus subsp. aureus MW2
gaacaugaaugauauu

SEQ ID NO: 4027751 - RNA, 18 nt, Staphylococcus aureus subsp. aureus MW2
gaacaugguaucuuuaau

SEQ ID NO: 4027752 - RNA, 23 nt, Staphylococcus aureus subsp. aureus MW2
gaacauguacuuguaacaaguuc

SEQ ID NO: 4027753 - RNA, 15 nt, Staphylococcus aureus subsp. aureus MW2
gaacauguuucuaga

SEQ ID NO: 4027754 - RNA, 14 nt, Staphylococcus aureus subsp. aureus MW2
gaacauuaaaagga

SEQ ID NO: 4027755 - RNA, 15 nt, Staphylococcus aureus subsp. aureus MW2
gaaccacgcaucaug

SEQ ID NO: 4027756 - RNA, 17 nt, Staphylococcus aureus subsp. aureus MW2
gaaccauacucuaacuu

SEQ ID NO: 4027757 - RNA, 12 nt, Staphylococcus aureus subsp. aureus MW2
gaaccauauuua

SEQ ID NO: 4027758 - RNA, 15 nt, Staphylococcus aureus subsp. aureus MW2
gaacccaggugcauc

SEQ ID NO: 4027759 - RNA, 15 nt, Staphylococcus aureus subsp. aureus MW2
gaacccuguuaagcu

SEQ ID NO: 4027760 - RNA, 21 nt, Staphylococcus aureus subsp. aureus MW2
gaaccguauaaugccuaauuu

SEQ ID NO: 4027761 - RNA, 13 nt, Staphylococcus aureus subsp. aureus MW2
gaaccuauuuuuu

SEQ ID NO: 4027762 - RNA, 16 nt, Staphylococcus aureus subsp. aureus MW2
gaaccugcugaaguuu

SEQ ID NO: 4027763 - RNA, 13 nt, Staphylococcus aureus subsp. aureus MW2
gaacgaaaaugcg

SEQ ID NO: 4027764 - RNA, 15 nt, Staphylococcus aureus subsp. aureus MW2
gaacgaaagagaaaa

SEQ ID NO: 4027765 - RNA, 18 nt, Staphylococcus aureus subsp. aureus MW2
gaacgaaagagaaaagcu

SEQ ID NO: 4027766 - RNA, 21 nt, Staphylococcus aureus subsp. aureus MW2
gaacgaaagagaaaagcuaga

SEQ ID NO: 4027767 - RNA, 15 nt, Staphylococcus aureus subsp. aureus MW2
gaacgagagagaaaa

SEQ ID NO: 4027768 - RNA, 16 nt, Staphylococcus aureus subsp. aureus MW2
gaacgagagagaaaag

SEQ ID NO: 4027769 - RNA, 21 nt, Staphylococcus aureus subsp. aureus MW2
gaacgauauuuuaaaaaguaa

SEQ ID NO: 4027770 - RNA, 14 nt, Staphylococcus aureus subsp. aureus MW2
gaacgccgaauaau

SEQ ID NO: 4027771 - RNA, 15 nt, Staphylococcus aureus subsp. aureus MW2
gaacguuauuuucaa

SEQ ID NO: 4027772 - RNA, 12 nt, Staphylococcus aureus subsp. aureus MW2
gaacuaaaacaa

SEQ ID NO: 4027773 - RNA, 16 nt, Staphylococcus aureus subsp. aureus MW2
gaacuaagaugugcau

SEQ ID NO: 4027774 - RNA, 19 nt, Staphylococcus aureus subsp. aureus MW2
gaacuacaauucauaagaa

SEQ ID NO: 4027775 - RNA, 22 nt, Staphylococcus aureus subsp. aureus MW2
gaacuacaauucauaagaaaaa

SEQ ID NO: 4027776 - RNA, 17 nt, Staphylococcus aureus subsp. aureus MW2
gaacuagacaagaugcu

SEQ ID NO: 4027777 - RNA, 18 nt, Staphylococcus aureus subsp. aureus MW2
gaacuaguacgaaaugca

SEQ ID NO: 4027778 - RNA, 16 nt, Staphylococcus aureus subsp. aureus MW2
gaacucugagcacuua

SEQ ID NO: 4027779 - RNA, 16 nt, Staphylococcus aureus subsp. aureus MW2
gaacuuaaugcuucaa

SEQ ID NO: 4027780 - RNA, 17 nt, Staphylococcus aureus subsp. aureus MW2
gaacuuauaagucugau

SEQ ID NO: 4027781 - RNA, 16 nt, Staphylococcus aureus subsp. aureus MW2
gaacuugcuuuguucu

SEQ ID NO: 4027782 - RNA, 15 nt, Staphylococcus aureus subsp. aureus MW2
gaacuuuaauaccag

SEQ ID NO: 4027783 - RNA, 22 nt, Staphylococcus aureus subsp. aureus MW2
gaagaaacuaaauacgaguguu

SEQ ID NO: 4027784 - RNA, 16 nt, Staphylococcus aureus subsp. aureus MW2
gaagaaacuuaaucaa

SEQ ID NO: 4027785 - RNA, 19 nt, Staphylococcus aureus subsp. aureus MW2
gaagaaacuuaaucaagcu

SEQ ID NO: 4027786 - RNA, 21 nt, Staphylococcus aureus subsp. aureus MW2
gaagaauauaaacuauuaaau

SEQ ID NO: 4027787 - RNA, 22 nt, Staphylococcus aureus subsp. aureus MW2
gaagaauccuaugccaaauaac

SEQ ID NO: 4027788 - RNA, 14 nt, Staphylococcus aureus subsp. aureus MW2
gaagaccuucuaaa

SEQ ID NO: 4027789 - RNA, 23 nt, Staphylococcus aureus subsp. aureus MW2
gaagaccuucuaaaaucguucca

SEQ ID NO: 4027790 - RNA, 12 nt, Staphylococcus aureus subsp. aureus MW2
gaagagaaaauu

SEQ ID NO: 4027791 - RNA, 14 nt, Staphylococcus aureus subsp. aureus MW2
gaagagaugaaaga

SEQ ID NO: 4027792 - RNA, 15 nt, Staphylococcus aureus subsp. aureus MW2
gaagagaugaaagau

SEQ ID NO: 4027793 - RNA, 15 nt, Staphylococcus aureus subsp. aureus MW2
gaagagcuuuuagua

SEQ ID NO: 4027794 - RNA, 22 nt, Staphylococcus aureus subsp. aureus MW2
gaagauuuuguugaaacuguau

SEQ ID NO: 4027795 - RNA, 17 nt, Staphylococcus aureus subsp. aureus MW2
gaagcaaaagaugaaaa

SEQ ID NO: 4027796 - RNA, 23 nt, Staphylococcus aureus subsp. aureus MW2
gaagcaauuaaguauagugacau

SEQ ID NO: 4027797 - RNA, 14 nt, Staphylococcus aureus subsp. aureus MW2
gaagcacagaaaau

SEQ ID NO: 4027798 - RNA, 20 nt, Staphylococcus aureus subsp. aureus MW2
gaagcaguuguugguuuugc

SEQ ID NO: 4027799 - RNA, 19 nt, Staphylococcus aureus subsp. aureus MW2
gaagccccuggugauucac

SEQ ID NO: 4027800 - RNA, 16 nt, Staphylococcus aureus subsp. aureus MW2
gaagcccuuugauuua

SEQ ID NO: 4027801 - RNA, 21 nt, Staphylococcus aureus subsp. aureus MW2
gaagcuaaguauauaagcaaa

SEQ ID NO: 4027802 - RNA, 15 nt, Staphylococcus aureus subsp. aureus MW2
gaagcugacgaaaag

SEQ ID NO: 4027803 - RNA, 21 nt, Staphylococcus aureus subsp. aureus MW2
gaagcugacgaaaagucagcu

SEQ ID NO: 4027804 - RNA, 20 nt, Staphylococcus aureus subsp. aureus MW2
gaagcuggcggaaagucagg

SEQ ID NO: 4027805 - RNA, 18 nt, Staphylococcus aureus subsp. aureus MW2
gaagcugucuuacugcug

SEQ ID NO: 4027806 - RNA, 18 nt, Staphylococcus aureus subsp. aureus MW2
gaaggaaaauaaaaacca

SEQ ID NO: 4027807 - RNA, 21 nt, Staphylococcus aureus subsp. aureus MW2
gaaggaauaauuuuaaaaaua

SEQ ID NO: 4027808 - RNA, 20 nt, Staphylococcus aureus subsp. aureus MW2
gaaggacaggaauaaauuuu

SEQ ID NO: 4027809 - RNA, 22 nt, Staphylococcus aureus subsp. aureus MW2
gaaggccauuuuuauuuaacac

SEQ ID NO: 4027810 - RNA, 16 nt, Staphylococcus aureus subsp. aureus MW2
gaagggaguauuuuuu

SEQ ID NO: 4027811 - RNA, 15 nt, Staphylococcus aureus subsp. aureus MW2
gaaggucuacuaaau

SEQ ID NO: 4027812 - RNA, 16 nt, Staphylococcus aureus subsp. aureus MW2
gaaguagauugauauc

SEQ ID NO: 4027813 - RNA, 18 nt, Staphylococcus aureus subsp. aureus MW2
gaaguagauugauauccc

SEQ ID NO: 4027814 - RNA, 16 nt, Staphylococcus aureus subsp. aureus MW2
gaagucuuucaacaaa

SEQ ID NO: 4027815 - RNA, 17 nt, Staphylococcus aureus subsp. aureus MW2
gaagucuuucaacaaaa

SEQ ID NO: 4027816 - RNA, 20 nt, Staphylococcus aureus subsp. aureus MW2
gaagugacaucguugcuuuu

SEQ ID NO: 4027817 - RNA, 16 nt, Staphylococcus aureus subsp. aureus MW2
gaagugguauuaacua

SEQ ID NO: 4027818 - RNA, 13 nt, Staphylococcus aureus subsp. aureus MW2
gaaguucuuaugc

SEQ ID NO: 4027819 - RNA, 23 nt, Staphylococcus aureus subsp. aureus MW2
gaaguugaagccaguugaaguug

SEQ ID NO: 4027820 - RNA, 17 nt, Staphylococcus aureus subsp. aureus MW2
gacagcaucaccaauuu

SEQ ID NO: 4027821 - RNA, 11 nt, Staphylococcus aureus subsp. aureus MW2
gacaguuuuua

SEQ ID NO: 4027822 - RNA, 19 nt, Staphylococcus aureus subsp. aureus MW2
gacauaaaaaaagagaccu

SEQ ID NO: 4027823 - RNA, 23 nt, Staphylococcus aureus subsp. aureus MW2
gacauaaaauuaacuuaaaauuu

SEQ ID NO: 4027824 - RNA, 14 nt, Staphylococcus aureus subsp. aureus MW2
gacauaaggucuug

SEQ ID NO: 4027825 - RNA, 20 nt, Staphylococcus aureus subsp. aureus MW2
gacauagguauaaucauuua

SEQ ID NO: 4027826 - RNA, 18 nt, Staphylococcus aureus subsp. aureus MW2
gacaucaauaucuucuuc

SEQ ID NO: 4027827 - RNA, 12 nt, Staphylococcus aureus subsp. aureus MW2
gacaucuagaug

SEQ ID NO: 4027828 - RNA, 21 nt, Staphylococcus aureus subsp. aureus MW2
gacauuaaucaugcguuuuaa

SEQ ID NO: 4027829 - RNA, 23 nt, Staphylococcus aureus subsp. aureus MW2
gacauuaaugauagcaaugaauu

SEQ ID NO: 4027830 - RNA, 19 nt, Staphylococcus aureus subsp. aureus MW2
gacauuacaucuuuaagcu

SEQ ID NO: 4027831 - RNA, 17 nt, Staphylococcus aureus subsp. aureus MW2
gacauuccaaaaccgaa

SEQ ID NO: 4027832 - RNA, 23 nt, Staphylococcus aureus subsp. aureus MW2
gacauugaaaggaacauuucaau

SEQ ID NO: 4027833 - RNA, 15 nt, Staphylococcus aureus subsp. aureus MW2
gacauuucaucaaua

SEQ ID NO: 4027834 - RNA, 15 nt, Staphylococcus aureus subsp. aureus MW2
gacauuuguaaauau

SEQ ID NO: 4027835 - RNA, 15 nt, Staphylococcus aureus subsp. aureus MW2
gacauuuucaaguuu

SEQ ID NO: 4027836 - RNA, 15 nt, Staphylococcus aureus subsp. aureus MW2
gacauuuuuggcuug

SEQ ID NO: 4027837 - RNA, 11 nt, Staphylococcus aureus subsp. aureus MW2
gaccaacagcu

SEQ ID NO: 4027838 - RNA, 17 nt, Staphylococcus aureus subsp. aureus MW2
gaccaccuuuaucugua

SEQ ID NO: 4027839 - RNA, 18 nt, Staphylococcus aureus subsp. aureus MW2
gaccagucgcauauuuug

SEQ ID NO: 4027840 - RNA, 21 nt, Staphylococcus aureus subsp. aureus MW2
gaccauugucaugccuucauu

SEQ ID NO: 4027841 - RNA, 17 nt, Staphylococcus aureus subsp. aureus MW2
gaccauuuuauauuuua

SEQ ID NO: 4027842 - RNA, 19 nt, Staphylococcus aureus subsp. aureus MW2
gaccguauuuuuuuauaau

SEQ ID NO: 4027843 - RNA, 21 nt, Staphylococcus aureus subsp. aureus MW2
gaccgugguucaaaaaucaua

SEQ ID NO: 4027844 - RNA, 18 nt, Staphylococcus aureus subsp. aureus MW2
gaccucguuacauuuaug

SEQ ID NO: 4027845 - RNA, 20 nt, Staphylococcus aureus subsp. aureus MW2
gaccuucaauaucuucagcu

SEQ ID NO: 4027846 - RNA, 21 nt, Staphylococcus aureus subsp. aureus MW2
gacgaaccauuuccgaauaaa

SEQ ID NO: 4027847 - RNA, 21 nt, Staphylococcus aureus subsp. aureus MW2
gacgaucuucaugaacagcau

SEQ ID NO: 4027848 - RNA, 19 nt, Staphylococcus aureus subsp. aureus MW2
gacgauuuauuaguuuuua

SEQ ID NO: 4027849 - RNA, 14 nt, Staphylococcus aureus subsp. aureus MW2
gacggcuacaauuu

SEQ ID NO: 4027850 - RNA, 19 nt, Staphylococcus aureus subsp. aureus MW2
gacuaaaaugaaugaagac

SEQ ID NO: 4027851 - RNA, 15 nt, Staphylococcus aureus subsp. aureus MW2
gacuaacuuucuaau

SEQ ID NO: 4027852 - RNA, 14 nt, Staphylococcus aureus subsp. aureus MW2
gacuaauaauuguc

SEQ ID NO: 4027853 - RNA, 11 nt, Staphylococcus aureus subsp. aureus MW2
gacuacucaau

SEQ ID NO: 4027854 - RNA, 16 nt, Staphylococcus aureus subsp. aureus MW2
gacuaguuuggagaau

SEQ ID NO: 4027855 - RNA, 14 nt, Staphylococcus aureus subsp. aureus MW2
gacuauauaacaca

SEQ ID NO: 4027856 - RNA, 17 nt, Staphylococcus aureus subsp. aureus MW2
gacuaugcaaaugaaau

SEQ ID NO: 4027857 - RNA, 19 nt, Staphylococcus aureus subsp. aureus MW2
gacuauguuguuuaaauuu

SEQ ID NO: 4027858 - RNA, 22 nt, Staphylococcus aureus subsp. aureus MW2
gacuauucucagucucuuugaa

SEQ ID NO: 4027859 - RNA, 14 nt, Staphylococcus aureus subsp. aureus MW2
gacuauuuuugaaa

SEQ ID NO: 4027860 - RNA, 15 nt, Staphylococcus aureus subsp. aureus MW2
gacucaaacaauaaa

SEQ ID NO: 4027861 - RNA, 14 nt, Staphylococcus aureus subsp. aureus MW2
gacucacuucuuaa

SEQ ID NO: 4027862 - RNA, 15 nt, Staphylococcus aureus subsp. aureus MW2
gacucuaaaauguuc

SEQ ID NO: 4027863 - RNA, 16 nt, Staphylococcus aureus subsp. aureus MW2
gacucuacuagaauaa

SEQ ID NO: 4027864 - RNA, 16 nt, Staphylococcus aureus subsp. aureus MW2
gacucuccaaauauug

SEQ ID NO: 4027865 - RNA, 15 nt, Staphylococcus aureus subsp. aureus MW2
gacugaacgaaaaug

SEQ ID NO: 4027866 - RNA, 15 nt, Staphylococcus aureus subsp. aureus MW2
gacugacuaauaaaa

SEQ ID NO: 4027867 - RNA, 18 nt, Staphylococcus aureus subsp. aureus MW2
gacugccaauaaaaugca

SEQ ID NO: 4027868 - RNA, 19 nt, Staphylococcus aureus subsp. aureus MW2
gacugguacauuaguuuga

SEQ ID NO: 4027869 - RNA, 15 nt, Staphylococcus aureus subsp. aureus MW2
gacuguaaguaugua

SEQ ID NO: 4027870 - RNA, 14 nt, Staphylococcus aureus subsp. aureus MW2
gacuguagaaaaca

SEQ ID NO: 4027871 - RNA, 18 nt, Staphylococcus aureus subsp. aureus MW2
gacuuuaaaucuuguucu

SEQ ID NO: 4027872 - RNA, 19 nt, Staphylococcus aureus subsp. aureus MW2
gacuuuccgccagcuucua

SEQ ID NO: 4027873 - RNA, 19 nt, Staphylococcus aureus subsp. aureus MW2
gacuuuccgccagcuucuu

SEQ ID NO: 4027874 - RNA, 18 nt, Staphylococcus aureus subsp. aureus MW2
gacuuuuaaaaaacauac

SEQ ID NO: 4027875 - RNA, 23 nt, Staphylococcus aureus subsp. aureus MW2
gacuuuuacagaacguucauaua

SEQ ID NO: 4027876 - RNA, 13 nt, Staphylococcus aureus subsp. aureus MW2
gagaaauuagaac

SEQ ID NO: 4027877 - RNA, 17 nt, Staphylococcus aureus subsp. aureus MW2
gagaacaucaucauguu

SEQ ID NO: 4027878 - RNA, 17 nt, Staphylococcus aureus subsp. aureus MW2
gagaaccauauuuacac

SEQ ID NO: 4027879 - RNA, 23 nt, Staphylococcus aureus subsp. aureus MW2
gagaagcuugcgauaaguucagc

SEQ ID NO: 4027880 - RNA, 22 nt, Staphylococcus aureus subsp. aureus MW2
gagaauagacauuguuaaacua

SEQ ID NO: 4027881 - RNA, 14 nt, Staphylococcus aureus subsp. aureus MW2
gagaaucaauuauu

SEQ ID NO: 4027882 - RNA, 12 nt, Staphylococcus aureus subsp. aureus MW2
gagaaucuccau

SEQ ID NO: 4027883 - RNA, 17 nt, Staphylococcus aureus subsp. aureus MW2
gagaaugcgcuuguaac

SEQ ID NO: 4027884 - RNA, 12 nt, Staphylococcus aureus subsp. aureus MW2
gagaauuucaaa

SEQ ID NO: 4027885 - RNA, 18 nt, Staphylococcus aureus subsp. aureus MW2
gagaauuucaaaaaggaa

SEQ ID NO: 4027886 - RNA, 15 nt, Staphylococcus aureus subsp. aureus MW2
gagacaaaaaaugaa

SEQ ID NO: 4027887 - RNA, 12 nt, Staphylococcus aureus subsp. aureus MW2
gagagagaaaag

SEQ ID NO: 4027888 - RNA, 16 nt, Staphylococcus aureus subsp. aureus MW2
gagaguaauguuccau

SEQ ID NO: 4027889 - RNA, 14 nt, Staphylococcus aureus subsp. aureus MW2
gagauauaaaggaa

SEQ ID NO: 4027890 - RNA, 16 nt, Staphylococcus aureus subsp. aureus MW2
gagauauauuaauauu

SEQ ID NO: 4027891 - RNA, 16 nt, Staphylococcus aureus subsp. aureus MW2
gagaugaaagauacug

SEQ ID NO: 4027892 - RNA, 20 nt, Staphylococcus aureus subsp. aureus MW2
gagaugaggcgauaaaagaa

SEQ ID NO: 4027893 - RNA, 21 nt, Staphylococcus aureus subsp. aureus MW2
gagaugaucagggaaaucauc

SEQ ID NO: 4027894 - RNA, 23 nt, Staphylococcus aureus subsp. aureus MW2
gagaugaucagggaaaucaucug

SEQ ID NO: 4027895 - RNA, 21 nt, Staphylococcus aureus subsp. aureus MW2
gagauuauuuuuuuaaaucua

SEQ ID NO: 4027896 - RNA, 18 nt, Staphylococcus aureus subsp. aureus MW2
gagauucucgguuuuuuc

SEQ ID NO: 4027897 - RNA, 15 nt, Staphylococcus aureus subsp. aureus MW2
gagauuguaagaauu

SEQ ID NO: 4027898 - RNA, 13 nt, Staphylococcus aureus subsp. aureus MW2
gagauuuaacaau

SEQ ID NO: 4027899 - RNA, 19 nt, Staphylococcus aureus subsp. aureus MW2
gagcaagucuucuaaaaaa

SEQ ID NO: 4027900 - RNA, 16 nt, Staphylococcus aureus subsp. aureus MW2
gagcaaguuauaucau

SEQ ID NO: 4027901 - RNA, 14 nt, Staphylococcus aureus subsp. aureus MW2
gagcaauucuucaa

SEQ ID NO: 4027902 - RNA, 15 nt, Staphylococcus aureus subsp. aureus MW2
gagcaauucuucaau

SEQ ID NO: 4027903 - RNA, 15 nt, Staphylococcus aureus subsp. aureus MW2
gagcacuaucuuuug

SEQ ID NO: 4027904 - RNA, 19 nt, Staphylococcus aureus subsp. aureus MW2
gagcacuaucuuuugcuuc

SEQ ID NO: 4027905 - RNA, 22 nt, Staphylococcus aureus subsp. aureus MW2
gagcaguauauaucaaauacau

SEQ ID NO: 4027906 - RNA, 20 nt, Staphylococcus aureus subsp. aureus MW2
gagccaauuucuacagacaa

SEQ ID NO: 4027907 - RNA, 22 nt, Staphylococcus aureus subsp. aureus MW2
gagccaauuucuacagacaaug

SEQ ID NO: 4027908 - RNA, 18 nt, Staphylococcus aureus subsp. aureus MW2
gagccauuauuauuuuuu

SEQ ID NO: 4027909 - RNA, 15 nt, Staphylococcus aureus subsp. aureus MW2
gauauacgaauccuc

SEQ ID NO: 4027910 - RNA, 21 nt, Staphylococcus aureus subsp. aureus MW2
gauauagagccgugaaagaaa

SEQ ID NO: 4027911 - RNA, 23 nt, Staphylococcus aureus subsp. aureus MW2
gauauauaacuauggucaucaau

SEQ ID NO: 4027912 - RNA, 22 nt, Staphylococcus aureus subsp. aureus MW2
gauauauacuagcaauucacau

SEQ ID NO: 4027913 - RNA, 19 nt, Staphylococcus aureus subsp. aureus MW2
gauaucagcuaaguuaaau

SEQ ID NO: 4027914 - RNA, 21 nt, Staphylococcus aureus subsp. aureus MW2
gauaucuaagucgauaaguuu

SEQ ID NO: 4027915 - RNA, 17 nt, Staphylococcus aureus subsp. aureus MW2
gauaucugaaguagauu

SEQ ID NO: 4027916 - RNA, 12 nt, Staphylococcus aureus subsp. aureus MW2
gauaucuuuuaa

SEQ ID NO: 4027917 - RNA, 13 nt, Staphylococcus aureus subsp. aureus MW2
gauauguuuauau

SEQ ID NO: 4027918 - RNA, 15 nt, Staphylococcus aureus subsp. aureus MW2
gauauuaauauauuu

SEQ ID NO: 4027919 - RNA, 20 nt, Staphylococcus aureus subsp. aureus MW2
gauauuaauugaaaaaccaa

SEQ ID NO: 4027920 - RNA, 22 nt, Staphylococcus aureus subsp. aureus MW2
gauauuaauugaaaaaccaagu

SEQ ID NO: 4027921 - RNA, 13 nt, Staphylococcus aureus subsp. aureus MW2
gauauuacauaua

SEQ ID NO: 4027922 - RNA, 16 nt, Staphylococcus aureus subsp. aureus MW2
gauauuaggcuuaaau

SEQ ID NO: 4027923 - RNA, 15 nt, Staphylococcus aureus subsp. aureus MW2
gauauugaaaacacg

SEQ ID NO: 4027924 - RNA, 16 nt, Staphylococcus aureus subsp. aureus MW2
gauauugaucugauuu

SEQ ID NO: 4027925 - RNA, 16 nt, Staphylococcus aureus subsp. aureus MW2
gauauuguuaaguaga

SEQ ID NO: 4027926 - RNA, 22 nt, Staphylococcus aureus subsp. aureus MW2
gauauuuacagcgauuguuaaa

SEQ ID NO: 4027927 - RNA, 24 nt, Staphylococcus aureus subsp. aureus MW2
gaucaauuaaacuuaagaauacau

SEQ ID NO: 4027928 - RNA, 14 nt, Staphylococcus aureus subsp. aureus MW2
gaucaucguauaga

SEQ ID NO: 4027929 - RNA, 17 nt, Staphylococcus aureus subsp. aureus MW2
gaucauuaguguagaaa

SEQ ID NO: 4027930 - RNA, 19 nt, Staphylococcus aureus subsp. aureus MW2
gaucgcccauacuaaauaa

SEQ ID NO: 4027931 - RNA, 20 nt, Staphylococcus aureus subsp. aureus MW2
gaucgcccauacuaaauaag

SEQ ID NO: 4027932 - RNA, 21 nt, Staphylococcus aureus subsp. aureus MW2
gaucguucuuugauuagcaua

SEQ ID NO: 4027933 - RNA, 18 nt, Staphylococcus aureus subsp. aureus MW2
gaucuucaugaacagcau

SEQ ID NO: 4027934 - RNA, 18 nt, Staphylococcus aureus subsp. aureus MW2
gaucuucccaucuuuuag

SEQ ID NO: 4027935 - RNA, 16 nt, Staphylococcus aureus subsp. aureus MW2
gaugaaaaucaguugc

SEQ ID NO: 4027936 - RNA, 17 nt, Staphylococcus aureus subsp. aureus MW2
gaugaaaaucuuuaacu

SEQ ID NO: 4027937 - RNA, 21 nt, Staphylococcus aureus subsp. aureus MW2
gaugaaagacugacuaauaaa

SEQ ID NO: 4027938 - RNA, 19 nt, Staphylococcus aureus subsp. aureus MW2
gaugaacauaccugcauau

SEQ ID NO: 4027939 - RNA, 14 nt, Staphylococcus aureus subsp. aureus MW2
gaugaaccaaaaaa

SEQ ID NO: 4027940 - RNA, 21 nt, Staphylococcus aureus subsp. aureus MW2
gaugaacuuaaugcuucaaau

SEQ ID NO: 4027941 - RNA, 14 nt, Staphylococcus aureus subsp. aureus MW2
gaugaauaaauaga

SEQ ID NO: 4027942 - RNA, 14 nt, Staphylococcus aureus subsp. aureus MW2
gaugaauuaaacug

SEQ ID NO: 4027943 - RNA, 14 nt, Staphylococcus aureus subsp. aureus MW2
gaugacuguagaaa

SEQ ID NO: 4027944 - RNA, 23 nt, Staphylococcus aureus subsp. aureus MW2
gaugacuuugucuuuaaugaaag

SEQ ID NO: 4027945 - RNA, 19 nt, Staphylococcus aureus subsp. aureus MW2
gaugauuuauuaacucaug

SEQ ID NO: 4027946 - RNA, 14 nt, Staphylococcus aureus subsp. aureus MW2
gaugcgcuucuaac

SEQ ID NO: 4027947 - RNA, 23 nt, Staphylococcus aureus subsp. aureus MW2
gaugcuacuuaaagcuaauaaug

SEQ ID NO: 4027948 - RNA, 16 nt, Staphylococcus aureus subsp. aureus MW2
gaugcucguauagaaa

SEQ ID NO: 4027949 - RNA, 16 nt, Staphylococcus aureus subsp. aureus MW2
gaugcuugaauguuug

SEQ ID NO: 4027950 - RNA, 12 nt, Staphylococcus aureus subsp. aureus MW2
gauggaaucauu

SEQ ID NO: 4027951 - RNA, 22 nt, Staphylococcus aureus subsp. aureus MW2
gauggcguaagcaguuaauaag

SEQ ID NO: 4027952 - RNA, 21 nt, Staphylococcus aureus subsp. aureus MW2
gaugggccccaacacagagaa

SEQ ID NO: 4027953 - RNA, 13 nt, Staphylococcus aureus subsp. aureus MW2
gaugguugcuuca

SEQ ID NO: 4027954 - RNA, 13 nt, Staphylococcus aureus subsp. aureus MW2
gaugguuuuguuu

SEQ ID NO: 4027955 - RNA, 13 nt, Staphylococcus aureus subsp. aureus MW2
gauguaauucugu

SEQ ID NO: 4027956 - RNA, 13 nt, Staphylococcus aureus subsp. aureus MW2
gaugucauguauu

SEQ ID NO: 4027957 - RNA, 21 nt, Staphylococcus aureus subsp. aureus MW2
gaugugccuuucuaauauuuu

SEQ ID NO: 4027958 - RNA, 13 nt, Staphylococcus aureus subsp. aureus MW2
gauguguugaaac

SEQ ID NO: 4027959 - RNA, 14 nt, Staphylococcus aureus subsp. aureus MW2
gauguuaaaaaaua

SEQ ID NO: 4027960 - RNA, 15 nt, Staphylococcus aureus subsp. aureus MW2
gauguucaucaacau

SEQ ID NO: 4027961 - RNA, 15 nt, Staphylococcus aureus subsp. aureus MW2
gauguugaaaaguau

SEQ ID NO: 4027962 - RNA, 18 nt, Staphylococcus aureus subsp. aureus MW2
gauguuuaacuaaaccau

SEQ ID NO: 4027963 - RNA, 23 nt, Staphylococcus aureus subsp. aureus MW2
gauuaaaaguaucgccaaucuau

SEQ ID NO: 4027964 - RNA, 13 nt, Staphylococcus aureus subsp. aureus MW2
gauuaaaaguguu

SEQ ID NO: 4027965 - RNA, 20 nt, Staphylococcus aureus subsp. aureus MW2
gauuaaauucuuuucaagaa

SEQ ID NO: 4027966 - RNA, 22 nt, Staphylococcus aureus subsp. aureus MW2
gauuaauccuauacguacugca

SEQ ID NO: 4027967 - RNA, 20 nt, Staphylococcus aureus subsp. aureus MW2
gauuaauuauaaguagugau

SEQ ID NO: 4027968 - RNA, 16 nt, Staphylococcus aureus subsp. aureus MW2
gauuaccaaguaauga

SEQ ID NO: 4027969 - RNA, 19 nt, Staphylococcus aureus subsp. aureus MW2
gauuaccaaguaaugauac

SEQ ID NO: 4027970 - RNA, 15 nt, Staphylococcus aureus subsp. aureus MW2
gauuaccguuaaaaa

SEQ ID NO: 4027971 - RNA, 22 nt, Staphylococcus aureus subsp. aureus MW2
gauuaguaauuuuuaaaucuac

SEQ ID NO: 4027972 - RNA, 21 nt, Staphylococcus aureus subsp. aureus MW2
gauuauauuuagauuuauaac

SEQ ID NO: 4027973 - RNA, 14 nt, Staphylococcus aureus subsp. aureus MW2
gauuauauuuuucu

SEQ ID NO: 4027974 - RNA, 15 nt, Staphylococcus aureus subsp. aureus MW2
gauuauauuuuucuu

SEQ ID NO: 4027975 - RNA, 18 nt, Staphylococcus aureus subsp. aureus MW2
gauuauauuuuucuucag

SEQ ID NO: 4027976 - RNA, 15 nt, Staphylococcus aureus subsp. aureus MW2
gauuaucuaacucau

SEQ ID NO: 4027977 - RNA, 20 nt, Staphylococcus aureus subsp. aureus MW2
gauuaugacaacauaacaaa

SEQ ID NO: 4027978 - RNA, 17 nt, Staphylococcus aureus subsp. aureus MW2
gauuauguaauucuagc

SEQ ID NO: 4027979 - RNA, 21 nt, Staphylococcus aureus subsp. aureus MW2
gauuauguucagaacuacaau

SEQ ID NO: 4027980 - RNA, 15 nt, Staphylococcus aureus subsp. aureus MW2
gauuauuaccauaua

SEQ ID NO: 4027981 - RNA, 20 nt, Staphylococcus aureus subsp. aureus MW2
gauuauuaugccuuugauuu

SEQ ID NO: 4027982 - RNA, 18 nt, Staphylococcus aureus subsp. aureus MW2
gauuauuccacauuaucu

SEQ ID NO: 4027983 - RNA, 12 nt, Staphylococcus aureus subsp. aureus MW2
gauuauucuuca

SEQ ID NO: 4027984 - RNA, 22 nt, Staphylococcus aureus subsp. aureus MW2
gauuauuuaaaacuuguaaauu

SEQ ID NO: 4027985 - RNA, 19 nt, Staphylococcus aureus subsp. aureus MW2
gauuauuuagauaaaaaau

SEQ ID NO: 4027986 - RNA, 22 nt, Staphylococcus aureus subsp. aureus MW2
gauucaaauaaaucaaacuuuu

SEQ ID NO: 4027987 - RNA, 18 nt, Staphylococcus aureus subsp. aureus MW2
gauucaccaauuaggauu

SEQ ID NO: 4027988 - RNA, 15 nt, Staphylococcus aureus subsp. aureus MW2
gauucaccuaauaau

SEQ ID NO: 4027989 - RNA, 15 nt, Staphylococcus aureus subsp. aureus MW2
gauucauauuuaucg

SEQ ID NO: 4027990 - RNA, 15 nt, Staphylococcus aureus subsp. aureus MW2
gauucaugauauguu

SEQ ID NO: 4027991 - RNA, 14 nt, Staphylococcus aureus subsp. aureus MW2
gauucccaaauagu

SEQ ID NO: 4027992 - RNA, 21 nt, Staphylococcus aureus subsp. aureus MW2
gauucgugauuuggaauacuu

SEQ ID NO: 4027993 - RNA, 16 nt, Staphylococcus aureus subsp. aureus MW2
gauucuauagcacuga

SEQ ID NO: 4027994 - RNA, 21 nt, Staphylococcus aureus subsp. aureus MW2
gauugacuaaguuuguuuucu

SEQ ID NO: 4027995 - RNA, 16 nt, Staphylococcus aureus subsp. aureus MW2
gauugaguugaaaaua

SEQ ID NO: 4027996 - RNA, 23 nt, Staphylococcus aureus subsp. aureus MW2
gauugauaugguuagaaaaaaau

SEQ ID NO: 4027997 - RNA, 19 nt, Staphylococcus aureus subsp. aureus MW2
gcaauugaaucaaauacau

SEQ ID NO: 4027998 - RNA, 13 nt, Staphylococcus aureus subsp. aureus MW2
gcaauuucauagu

SEQ ID NO: 4027999 - RNA, 13 nt, Staphylococcus aureus subsp. aureus MW2
gcacaaaugaaug

SEQ ID NO: 4028000 - RNA, 12 nt, Staphylococcus aureus subsp. aureus MW2
gcacaaaugcua

SEQ ID NO: 4028001 - RNA, 14 nt, Staphylococcus aureus subsp. aureus MW2
gcacaagcaucuau

SEQ ID NO: 4028002 - RNA, 14 nt, Staphylococcus aureus subsp. aureus MW2
gcacagucaaugac

SEQ ID NO: 4028003 - RNA, 13 nt, Staphylococcus aureus subsp. aureus MW2
gcacauaaaucaa

SEQ ID NO: 4028004 - RNA, 14 nt, Staphylococcus aureus subsp. aureus MW2
gcacaucagcacag

SEQ ID NO: 4028005 - RNA, 16 nt, Staphylococcus aureus subsp. aureus MW2
gcacaucauugauaga

SEQ ID NO: 4028006 - RNA, 20 nt, Staphylococcus aureus subsp. aureus MW2
gcacauuauuguaaccugac

SEQ ID NO: 4028007 - RNA, 16 nt, Staphylococcus aureus subsp. aureus MW2
gcacauuauuguaagu

SEQ ID NO: 4028008 - RNA, 18 nt, Staphylococcus aureus subsp. aureus MW2
gcacauuuuuaguuagaa

SEQ ID NO: 4028009 - RNA, 21 nt, Staphylococcus aureus subsp. aureus MW2
gcaccacauacauaucuuuug

SEQ ID NO: 4028010 - RNA, 14 nt, Staphylococcus aureus subsp. aureus MW2
gcacccuaaaaguu

SEQ ID NO: 4028011 - RNA, 16 nt, Staphylococcus aureus subsp. aureus MW2
gcaccgacaauuauaa

SEQ ID NO: 4028012 - RNA, 21 nt, Staphylococcus aureus subsp. aureus MW2
gcaccgauuuggucagcgaca

SEQ ID NO: 4028013 - RNA, 19 nt, Staphylococcus aureus subsp. aureus MW2
gcaccgccugaaauagcuu

SEQ ID NO: 4028014 - RNA, 15 nt, Staphylococcus aureus subsp. aureus MW2
gcaccuaaaauagaa

SEQ ID NO: 4028015 - RNA, 18 nt, Staphylococcus aureus subsp. aureus MW2
gcaccucuuuuguuuagu

SEQ ID NO: 4028016 - RNA, 16 nt, Staphylococcus aureus subsp. aureus MW2
gcaccuuuauuaccag

SEQ ID NO: 4028017 - RNA, 21 nt, Staphylococcus aureus subsp. aureus MW2
gcaccuuuauuaccagcuuuc

SEQ ID NO: 4028018 - RNA, 13 nt, Staphylococcus aureus subsp. aureus MW2
gcacgacuuucua

SEQ ID NO: 4028019 - RNA, 14 nt, Staphylococcus aureus subsp. aureus MW2
gcacgagaaauguc

SEQ ID NO: 4028020 - RNA, 15 nt, Staphylococcus aureus subsp. aureus MW2
gcacgagacaauaau

SEQ ID NO: 4028021 - RNA, 14 nt, Staphylococcus aureus subsp. aureus MW2
gcacgucuuguauc

SEQ ID NO: 4028022 - RNA, 17 nt, Staphylococcus aureus subsp. aureus MW2
gcacuaauauuuaaaaa

SEQ ID NO: 4028023 - RNA, 21 nt, Staphylococcus aureus subsp. aureus MW2
gcacuauaaaauucaccaacu

SEQ ID NO: 4028024 - RNA, 15 nt, Staphylococcus aureus subsp. aureus MW2
gcacugagcaacaaa

SEQ ID NO: 4028025 - RNA, 16 nt, Staphylococcus aureus subsp. aureus MW2
gcacuucaaaagaaau

SEQ ID NO: 4028026 - RNA, 18 nt, Staphylococcus aureus subsp. aureus MW2
gcacuucuauauuaauag

SEQ ID NO: 4028027 - RNA, 12 nt, Staphylococcus aureus subsp. aureus MW2
gcacuuggauuu

SEQ ID NO: 4028028 - RNA, 21 nt, Staphylococcus aureus subsp. aureus MW2
gcacuuuauuaaaaauccuca

SEQ ID NO: 4028029 - RNA, 22 nt, Staphylococcus aureus subsp. aureus MW2
gcacuuuauuaaaaauccucac

SEQ ID NO: 4028030 - RNA, 15 nt, Staphylococcus aureus subsp. aureus MW2
gcagacuaaaagugg

SEQ ID NO: 4028031 - RNA, 13 nt, Staphylococcus aureus subsp. aureus MW2
gcagcaucauaau

SEQ ID NO: 4028032 - RNA, 19 nt, Staphylococcus aureus subsp. aureus MW2
gcagcgauacguuuauauc

SEQ ID NO: 4028033 - RNA, 13 nt, Staphylococcus aureus subsp. aureus MW2
gcagcuucuuuaa

SEQ ID NO: 4028034 - RNA, 13 nt, Staphylococcus aureus subsp. aureus MW2
gcagcuuuauaau

SEQ ID NO: 4028035 - RNA, 16 nt, Staphylococcus aureus subsp. aureus MW2
gcaguaaguugauuuc

SEQ ID NO: 4028036 - RNA, 22 nt, Staphylococcus aureus subsp. aureus MW2
gcaguaguugacugaacgaaaa

SEQ ID NO: 4028037 - RNA, 22 nt, Staphylococcus aureus subsp. aureus MW2
gcaguaguugacuguaaaacaa

SEQ ID NO: 4028038 - RNA, 12 nt, Staphylococcus aureus subsp. aureus MW2
gcaguauauauc

SEQ ID NO: 4028039 - RNA, 18 nt, Staphylococcus aureus subsp. aureus MW2
gcaguaucucaaauauua

SEQ ID NO: 4028040 - RNA, 22 nt, Staphylococcus aureus subsp. aureus MW2
gcagugaaguuaacuauaacaa

SEQ ID NO: 4028041 - RNA, 14 nt, Staphylococcus aureus subsp. aureus MW2
gcaguuaauaagaa

SEQ ID NO: 4028042 - RNA, 17 nt, Staphylococcus aureus subsp. aureus MW2
gcaguucugaaacauuu

SEQ ID NO: 4028043 - RNA, 18 nt, Staphylococcus aureus subsp. aureus MW2
gcaguucugaaacauuua

SEQ ID NO: 4028044 - RNA, 14 nt, Staphylococcus aureus subsp. aureus MW2
gcauaaaaaaagaa

SEQ ID NO: 4028045 - RNA, 23 nt, Staphylococcus aureus subsp. aureus MW2
gcauaaaaaaagaacuacgcauu

SEQ ID NO: 4028046 - RNA, 19 nt, Staphylococcus aureus subsp. aureus MW2
gcauaaccaaguaauucuu

SEQ ID NO: 4028047 - RNA, 13 nt, Staphylococcus aureus subsp. aureus MW2
gcauaagauugcu

SEQ ID NO: 4028048 - RNA, 18 nt, Staphylococcus aureus subsp. aureus MW2
gcauaagauugcuuuuuc

SEQ ID NO: 4028049 - RNA, 16 nt, Staphylococcus aureus subsp. aureus MW2
gcauaauauauuaaaa

SEQ ID NO: 4028050 - RNA, 21 nt, Staphylococcus aureus subsp. aureus MW2
gcauaauauauuaaaaaucaa

SEQ ID NO: 4028051 - RNA, 20 nt, Staphylococcus aureus subsp. aureus MW2
gcauacaauaaugugcaagu

SEQ ID NO: 4028052 - RNA, 21 nt, Staphylococcus aureus subsp. aureus MW2
gcauacacuugguuaucauua

SEQ ID NO: 4028053 - RNA, 16 nt, Staphylococcus aureus subsp. aureus MW2
gcauaccuauaaacau

SEQ ID NO: 4028054 - RNA, 17 nt, Staphylococcus aureus subsp. aureus MW2
gcauacgaauuaaaaua

SEQ ID NO: 4028055 - RNA, 18 nt, Staphylococcus aureus subsp. aureus MW2
gcauacgaauuaaaauaa

SEQ ID NO: 4028056 - RNA, 18 nt, Staphylococcus aureus subsp. aureus MW2
gcauauaauauuugaaaa

SEQ ID NO: 4028057 - RNA, 16 nt, Staphylococcus aureus subsp. aureus MW2
gcauaucuuuaucauu

SEQ ID NO: 4028058 - RNA, 16 nt, Staphylococcus aureus subsp. aureus MW2
gcauauguaauacaaa

SEQ ID NO: 4028059 - RNA, 19 nt, Staphylococcus aureus subsp. aureus MW2
gcauauguaauacaaaaga

SEQ ID NO: 4028060 - RNA, 14 nt, Staphylococcus aureus subsp. aureus MW2
gcauauucacgaua

SEQ ID NO: 4028061 - RNA, 16 nt, Staphylococcus aureus subsp. aureus MW2
gcauauucaucauaua

SEQ ID NO: 4028062 - RNA, 23 nt, Staphylococcus aureus subsp. aureus MW2
gcauauucgcuuaaaaacgcuuu

SEQ ID NO: 4028063 - RNA, 16 nt, Staphylococcus aureus subsp. aureus MW2
gcauauucuaucguug

SEQ ID NO: 4028064 - RNA, 16 nt, Staphylococcus aureus subsp. aureus MW2
gcaucaacagauacuu

SEQ ID NO: 4028065 - RNA, 19 nt, Staphylococcus aureus subsp. aureus MW2
gcaucacaguguugaauuu

SEQ ID NO: 4028066 - RNA, 22 nt, Staphylococcus aureus subsp. aureus MW2
gcaucaguauuaggauuuacuc

SEQ ID NO: 4028067 - RNA, 16 nt, Staphylococcus aureus subsp. aureus MW2
gcaucuacuaaaucaa

SEQ ID NO: 4028068 - RNA, 17 nt, Staphylococcus aureus subsp. aureus MW2
gcaucuacuaaaucaaa

SEQ ID NO: 4028069 - RNA, 19 nt, Staphylococcus aureus subsp. aureus MW2
gcaucuucaauauuuaaau

SEQ ID NO: 4028070 - RNA, 19 nt, Staphylococcus aureus subsp. aureus MW2
gcaucuuguucuucgucaa

SEQ ID NO: 4028071 - RNA, 16 nt, Staphylococcus aureus subsp. aureus MW2
gcaucuuuguuuucaa

SEQ ID NO: 4028072 - RNA, 18 nt, Staphylococcus aureus subsp. aureus MW2
gcaucuuuguuuucaaac

SEQ ID NO: 4028073 - RNA, 19 nt, Staphylococcus aureus subsp. aureus MW2
gcaugaaucgcauuuaaau

SEQ ID NO: 4028074 - RNA, 17 nt, Staphylococcus aureus subsp. aureus MW2
gcaugacagcaaauuuu

SEQ ID NO: 4028075 - RNA, 17 nt, Staphylococcus aureus subsp. aureus MW2
gcaugacuguaaguaug

SEQ ID NO: 4028076 - RNA, 15 nt, Staphylococcus aureus subsp. aureus MW2
gcaugccagaugcaa

SEQ ID NO: 4028077 - RNA, 17 nt, Staphylococcus aureus subsp. aureus MW2
gcauguccugaauguuc

SEQ ID NO: 4028078 - RNA, 18 nt, Staphylococcus aureus subsp. aureus MW2
gcauuaaauuccauguca

SEQ ID NO: 4028079 - RNA, 17 nt, Staphylococcus aureus subsp. aureus MW2
gcauuaaguucaucaug

SEQ ID NO: 4028080 - RNA, 13 nt, Staphylococcus aureus subsp. aureus MW2
gcauuaaugauuc

SEQ ID NO: 4028081 - RNA, 18 nt, Staphylococcus aureus subsp. aureus MW2
gcauuacuacuuuauaaa

SEQ ID NO: 4028082 - RNA, 21 nt, Staphylococcus aureus subsp. aureus MW2
gcauuauagaugacuguagaa

SEQ ID NO: 4028083 - RNA, 16 nt, Staphylococcus aureus subsp. aureus MW2
gcauuaucaacuugaa

SEQ ID NO: 4028084 - RNA, 14 nt, Staphylococcus aureus subsp. aureus MW2
gcauuauuauaaua

SEQ ID NO: 4028085 - RNA, 16 nt, Staphylococcus aureus subsp. aureus MW2
gcauuauuauuucauu

SEQ ID NO: 4028086 - RNA, 17 nt, Staphylococcus aureus subsp. aureus MW2
gcgcuucuaacucaccu

SEQ ID NO: 4028087 - RNA, 21 nt, Staphylococcus aureus subsp. aureus MW2
gcgcuuuuuaauuuguauuua

SEQ ID NO: 4028088 - RNA, 17 nt, Staphylococcus aureus subsp. aureus MW2
gcgcuuuuuuuuauaag

SEQ ID NO: 4028089 - RNA, 13 nt, Staphylococcus aureus subsp. aureus MW2
gcggaaauaugau

SEQ ID NO: 4028090 - RNA, 15 nt, Staphylococcus aureus subsp. aureus MW2
gcggauaguguugcg

SEQ ID NO: 4028091 - RNA, 22 nt, Staphylococcus aureus subsp. aureus MW2
gcgggccccaacauagaagcug

SEQ ID NO: 4028092 - RNA, 19 nt, Staphylococcus aureus subsp. aureus MW2
gcggggcccaaacauagag

SEQ ID NO: 4028093 - RNA, 23 nt, Staphylococcus aureus subsp. aureus MW2
gcggggccccaacaaagaagcug

SEQ ID NO: 4028094 - RNA, 23 nt, Staphylococcus aureus subsp. aureus MW2
gcggucaauuuuaccauguuuua

SEQ ID NO: 4028095 - RNA, 15 nt, Staphylococcus aureus subsp. aureus MW2
gcgucaccuaaugcu

SEQ ID NO: 4028096 - RNA, 14 nt, Staphylococcus aureus subsp. aureus MW2
gcguucaacauuac

SEQ ID NO: 4028097 - RNA, 20 nt, Staphylococcus aureus subsp. aureus MW2
gcguuuaaucacaucuuuuu

SEQ ID NO: 4028098 - RNA, 13 nt, Staphylococcus aureus subsp. aureus MW2
gcuaaaaaaauua

SEQ ID NO: 4028099 - RNA, 16 nt, Staphylococcus aureus subsp. aureus MW2
gcuaaaaaauuugcau

SEQ ID NO: 4028100 - RNA, 18 nt, Staphylococcus aureus subsp. aureus MW2
gcuaaacgcaauacgaau

SEQ ID NO: 4028101 - RNA, 21 nt, Staphylococcus aureus subsp. aureus MW2
gcuaaaguguagccaaauaaa

SEQ ID NO: 4028102 - RNA, 14 nt, Staphylococcus aureus subsp. aureus MW2
gcuaaauauuauaa

SEQ ID NO: 4028103 - RNA, 16 nt, Staphylococcus aureus subsp. aureus MW2
gcuaaauauuauaaaa

SEQ ID NO: 4028104 - RNA, 14 nt, Staphylococcus aureus subsp. aureus MW2
gcuaauacuaauca

SEQ ID NO: 4028105 - RNA, 14 nt, Staphylococcus aureus subsp. aureus MW2
gcuaauaucaauaa

SEQ ID NO: 4028106 - RNA, 20 nt, Staphylococcus aureus subsp. aureus MW2
gcuaauauuuauagcaucaa

SEQ ID NO: 4028107 - RNA, 18 nt, Staphylococcus aureus subsp. aureus MW2
gcuaaugcaacuaaaacu

SEQ ID NO: 4028108 - RNA, 20 nt, Staphylococcus aureus subsp. aureus MW2
gcuaaugcaacuaaaacuau

SEQ ID NO: 4028109 - RNA, 18 nt, Staphylococcus aureus subsp. aureus MW2
gcuaaugcauuauuauaa

SEQ ID NO: 4028110 - RNA, 16 nt, Staphylococcus aureus subsp. aureus MW2
gcuaaugcuaguaacu

SEQ ID NO: 4028111 - RNA, 17 nt, Staphylococcus aureus subsp. aureus MW2
gcuaauucauauucaaa

SEQ ID NO: 4028112 - RNA, 22 nt, Staphylococcus aureus subsp. aureus MW2
gcuaauucauauucaaauuuac

SEQ ID NO: 4028113 - RNA, 17 nt, Staphylococcus aureus subsp. aureus MW2
gcuaauuucuaauacau

SEQ ID NO: 4028114 - RNA, 21 nt, Staphylococcus aureus subsp. aureus MW2
gcuaauuuuuucaucauucaa

SEQ ID NO: 4028115 - RNA, 19 nt, Staphylococcus aureus subsp. aureus MW2
gcuacaaagucauuuucau

SEQ ID NO: 4028116 - RNA, 17 nt, Staphylococcus aureus subsp. aureus MW2
gcuacccaccuuucuuu

SEQ ID NO: 4028117 - RNA, 18 nt, Staphylococcus aureus subsp. aureus MW2
gcuacuaaaggaauuuca

SEQ ID NO: 4028118 - RNA, 15 nt, Staphylococcus aureus subsp. aureus MW2
gcuacuauuaaauaa

SEQ ID NO: 4028119 - RNA, 19 nt, Staphylococcus aureus subsp. aureus MW2
gcuacuuuuucaucuuuca

SEQ ID NO: 4028120 - RNA, 12 nt, Staphylococcus aureus subsp. aureus MW2
gcuagaaguucu

SEQ ID NO: 4028121 - RNA, 14 nt, Staphylococcus aureus subsp. aureus MW2
gcuagaaguucuua

SEQ ID NO: 4028122 - RNA, 16 nt, Staphylococcus aureus subsp. aureus MW2
gcuagaaguucuuaug

SEQ ID NO: 4028123 - RNA, 22 nt, Staphylococcus aureus subsp. aureus MW2
gcuagauuuuaaacgcucauca

SEQ ID NO: 4028124 - RNA, 15 nt, Staphylococcus aureus subsp. aureus MW2
gcuaguucagcuucu

SEQ ID NO: 4028125 - RNA, 18 nt, Staphylococcus aureus subsp. aureus MW2
gcuaguuuuuuauuuuug

SEQ ID NO: 4028126 - RNA, 18 nt, Staphylococcus aureus subsp. aureus MW2
gcuauaaaaaaucuuuug

SEQ ID NO: 4028127 - RNA, 11 nt, Staphylococcus aureus subsp. aureus MW2
gcuauaaaagu

SEQ ID NO: 4028128 - RNA, 20 nt, Staphylococcus aureus subsp. aureus MW2
gcuauaaaaguacuuuaaaa

SEQ ID NO: 4028129 - RNA, 20 nt, Staphylococcus aureus subsp. aureus MW2
gcuauaaaauuuugaagaag

SEQ ID NO: 4028130 - RNA, 19 nt, Staphylococcus aureus subsp. aureus MW2
gcuauaagaacuaaugguu

SEQ ID NO: 4028131 - RNA, 18 nt, Staphylococcus aureus subsp. aureus MW2
gcuauaaucuaucuugug

SEQ ID NO: 4028132 - RNA, 21 nt, Staphylococcus aureus subsp. aureus MW2
gcuauauuuuuguauuuaugu

SEQ ID NO: 4028133 - RNA, 17 nt, Staphylococcus aureus subsp. aureus MW2
gcuaucaacgauugaau

SEQ ID NO: 4028134 - RNA, 16 nt, Staphylococcus aureus subsp. aureus MW2
gcucauaugucuguuc

SEQ ID NO: 4028135 - RNA, 15 nt, Staphylococcus aureus subsp. aureus MW2
gcucauccucauuaa

SEQ ID NO: 4028136 - RNA, 19 nt, Staphylococcus aureus subsp. aureus MW2
gcucauccucauuaauaaa

SEQ ID NO: 4028137 - RNA, 15 nt, Staphylococcus aureus subsp. aureus MW2
gcucauugugcuuga

SEQ ID NO: 4028138 - RNA, 14 nt, Staphylococcus aureus subsp. aureus MW2
gcuccuaaauguua

SEQ ID NO: 4028139 - RNA, 13 nt, Staphylococcus aureus subsp. aureus MW2
gcuccuacuccau

SEQ ID NO: 4028140 - RNA, 13 nt, Staphylococcus aureus subsp. aureus MW2
gcuccuacuuuuc

SEQ ID NO: 4028141 - RNA, 15 nt, Staphylococcus aureus subsp. aureus MW2
gcuccuccaaagcua

SEQ ID NO: 4028142 - RNA, 20 nt, Staphylococcus aureus subsp. aureus MW2
gcucguuaaaucacauauga

SEQ ID NO: 4028143 - RNA, 23 nt, Staphylococcus aureus subsp. aureus MW2
gcucguuuuuuuagcuauagaaa

SEQ ID NO: 4028144 - RNA, 20 nt, Staphylococcus aureus subsp. aureus MW2
gcucuaaacuucuauuaaua

SEQ ID NO: 4028145 - RNA, 21 nt, Staphylococcus aureus subsp. aureus MW2
gcucuaauucaaugauuuuua

SEQ ID NO: 4028146 - RNA, 22 nt, Staphylococcus aureus subsp. aureus MW2
gcucuaauucaaugauuuuuaa

SEQ ID NO: 4028147 - RNA, 22 nt, Staphylococcus aureus subsp. aureus MW2
gcucugaagaagacauucccca

SEQ ID NO: 4028148 - RNA, 20 nt, Staphylococcus aureus subsp. aureus MW2
gcucuuaauguacuuuucug

SEQ ID NO: 4028149 - RNA, 16 nt, Staphylococcus aureus subsp. aureus MW2
gcucuucuucuucagg

SEQ ID NO: 4028150 - RNA, 18 nt, Staphylococcus aureus subsp. aureus MW2
gcucuuuaucaccauaaa

SEQ ID NO: 4028151 - RNA, 16 nt, Staphylococcus aureus subsp. aureus MW2
gcucuuuuuauuuaua

SEQ ID NO: 4028152 - RNA, 17 nt, Staphylococcus aureus subsp. aureus MW2
gcucuuuuuguaugagu

SEQ ID NO: 4028153 - RNA, 14 nt, Staphylococcus aureus subsp. aureus MW2
gcugaacuuucuuu

SEQ ID NO: 4028154 - RNA, 21 nt, Staphylococcus aureus subsp. aureus MW2
gcugaaguuugaacaacaucu

SEQ ID NO: 4028155 - RNA, 22 nt, Staphylococcus aureus subsp. aureus MW2
gcugaaugugcgaacuugcuuu

SEQ ID NO: 4028156 - RNA, 15 nt, Staphylococcus aureus subsp. aureus MW2
gcugauaauuuuucu

SEQ ID NO: 4028157 - RNA, 16 nt, Staphylococcus aureus subsp. aureus MW2
gcugauacauaaaaug

SEQ ID NO: 4028158 - RNA, 17 nt, Staphylococcus aureus subsp. aureus MW2
gcugauucaaaaauugu

SEQ ID NO: 4028159 - RNA, 12 nt, Staphylococcus aureus subsp. aureus MW2
gcugauuucuau

SEQ ID NO: 4028160 - RNA, 18 nt, Staphylococcus aureus subsp. aureus MW2
gcugcaaucguugaaaaa

SEQ ID NO: 4028161 - RNA, 17 nt, Staphylococcus aureus subsp. aureus MW2
gcugcuguacaauuucg

SEQ ID NO: 4028162 - RNA, 23 nt, Staphylococcus aureus subsp. aureus MW2
gcugggacauaaaucaauguucu

SEQ ID NO: 4028163 - RNA, 15 nt, Staphylococcus aureus subsp. aureus MW2
gcugucauaccuuuu

SEQ ID NO: 4028164 - RNA, 20 nt, Staphylococcus aureus subsp. aureus MW2
gcuguuuuuauuauaauaga

SEQ ID NO: 4028165 - RNA, 14 nt, Staphylococcus aureus subsp. aureus MW2
gcuuaaaucaaaug

SEQ ID NO: 4028166 - RNA, 16 nt, Staphylococcus aureus subsp. aureus MW2
gcuuaagaaauuuuuu

SEQ ID NO: 4028167 - RNA, 18 nt, Staphylococcus aureus subsp. aureus MW2
gcuuaagaaauuuuuucu

SEQ ID NO: 4028168 - RNA, 22 nt, Staphylococcus aureus subsp. aureus MW2
gcuuaaguaagauuuaaacauc

SEQ ID NO: 4028169 - RNA, 19 nt, Staphylococcus aureus subsp. aureus MW2
gcuuaauaagcugaaauaa

SEQ ID NO: 4028170 - RNA, 16 nt, Staphylococcus aureus subsp. aureus MW2
gcuuaauaauuaauaa

SEQ ID NO: 4028171 - RNA, 19 nt, Staphylococcus aureus subsp. aureus MW2
gcuuaauggcgugcuuuuc

SEQ ID NO: 4028172 - RNA, 14 nt, Staphylococcus aureus subsp. aureus MW2
gcuuaauucuucau

SEQ ID NO: 4028173 - RNA, 20 nt, Staphylococcus aureus subsp. aureus MW2
gcuuaauuugacaaucuaaa

SEQ ID NO: 4028174 - RNA, 15 nt, Staphylococcus aureus subsp. aureus MW2
ggaaauuuauuauaa

SEQ ID NO: 4028175 - RNA, 22 nt, Staphylococcus aureus subsp. aureus MW2
ggaaauuuauuauaaaauagaa

SEQ ID NO: 4028176 - RNA, 16 nt, Staphylococcus aureus subsp. aureus MW2
ggaacaccaauauaaa

SEQ ID NO: 4028177 - RNA, 18 nt, Staphylococcus aureus subsp. aureus MW2
ggaacuacuacauuauua

SEQ ID NO: 4028178 - RNA, 22 nt, Staphylococcus aureus subsp. aureus MW2
ggaacuacuacauuauuacuga

SEQ ID NO: 4028179 - RNA, 12 nt, Staphylococcus aureus subsp. aureus MW2
ggaagaacagca

SEQ ID NO: 4028180 - RNA, 15 nt, Staphylococcus aureus subsp. aureus MW2
ggaagaccauuuuau

SEQ ID NO: 4028181 - RNA, 15 nt, Staphylococcus aureus subsp. aureus MW2
ggaagcauauuucua

SEQ ID NO: 4028182 - RNA, 15 nt, Staphylococcus aureus subsp. aureus MW2
ggaauaacuuuuuaa

SEQ ID NO: 4028183 - RNA, 19 nt, Staphylococcus aureus subsp. aureus MW2
ggaauacagaugaugcuuc

SEQ ID NO: 4028184 - RNA, 15 nt, Staphylococcus aureus subsp. aureus MW2
ggaauauaaaacugu

SEQ ID NO: 4028185 - RNA, 19 nt, Staphylococcus aureus subsp. aureus MW2
ggaauauuaacaccagaua

SEQ ID NO: 4028186 - RNA, 14 nt, Staphylococcus aureus subsp. aureus MW2
ggaaucgucauauu

SEQ ID NO: 4028187 - RNA, 18 nt, Staphylococcus aureus subsp. aureus MW2
ggaaugguauagauuuua

SEQ ID NO: 4028188 - RNA, 12 nt, Staphylococcus aureus subsp. aureus MW2
ggaauuaauaau

SEQ ID NO: 4028189 - RNA, 13 nt, Staphylococcus aureus subsp. aureus MW2
ggaauuaauaaug

SEQ ID NO: 4028190 - RNA, 21 nt, Staphylococcus aureus subsp. aureus MW2
ggaauuguuaauuucaacauu

SEQ ID NO: 4028191 - RNA, 20 nt, Staphylococcus aureus subsp. aureus MW2
ggaauuuuuaugcauuauag

SEQ ID NO: 4028192 - RNA, 19 nt, Staphylococcus aureus subsp. aureus MW2
ggacaacuaauaacaaaua

SEQ ID NO: 4028193 - RNA, 10 nt, Staphylococcus aureus subsp. aureus MW2
ggacaaguuu

SEQ ID NO: 4028194 - RNA, 18 nt, Staphylococcus aureus subsp. aureus MW2
ggacuaacgucauuauau

SEQ ID NO: 4028195 - RNA, 12 nt, Staphylococcus aureus subsp. aureus MW2
ggacugaaagaa

SEQ ID NO: 4028196 - RNA, 20 nt, Staphylococcus aureus subsp. aureus MW2
ggagaaaucaguuaggauga

SEQ ID NO: 4028197 - RNA, 17 nt, Staphylococcus aureus subsp. aureus MW2
ggagcacuaucuuuugc

SEQ ID NO: 4028198 - RNA, 23 nt, Staphylococcus aureus subsp. aureus MW2
ggagccaauuucuacagacaaug

SEQ ID NO: 4028199 - RNA, 15 nt, Staphylococcus aureus subsp. aureus MW2
ggauaaaaaugaaaa

SEQ ID NO: 4028200 - RNA, 21 nt, Staphylococcus aureus subsp. aureus MW2
ggauaaucacaauacgaaacc

SEQ ID NO: 4028201 - RNA, 20 nt, Staphylococcus aureus subsp. aureus MW2
ggauaauuuuuaacagcgug

SEQ ID NO: 4028202 - RNA, 18 nt, Staphylococcus aureus subsp. aureus MW2
ggauaucugaaguagauu

SEQ ID NO: 4028203 - RNA, 13 nt, Staphylococcus aureus subsp. aureus MW2
ggauaucuuuguu

SEQ ID NO: 4028204 - RNA, 15 nt, Staphylococcus aureus subsp. aureus MW2
ggaugaacaaaauaa

SEQ ID NO: 4028205 - RNA, 20 nt, Staphylococcus aureus subsp. aureus MW2
ggaugggccccaacacagag

SEQ ID NO: 4028206 - RNA, 22 nt, Staphylococcus aureus subsp. aureus MW2
ggaugggccccaacacagagaa

SEQ ID NO: 4028207 - RNA, 16 nt, Staphylococcus aureus subsp. aureus MW2
ggaugugacaaauacu

SEQ ID NO: 4028208 - RNA, 16 nt, Staphylococcus aureus subsp. aureus MW2
ggauguuuucguuugc

SEQ ID NO: 4028209 - RNA, 13 nt, Staphylococcus aureus subsp. aureus MW2
ggauucaaaugac

SEQ ID NO: 4028210 - RNA, 17 nt, Staphylococcus aureus subsp. aureus MW2
ggauugaaaaaagcuag

SEQ ID NO: 4028211 - RNA, 22 nt, Staphylococcus aureus subsp. aureus MW2
ggauuuccuauuaggauccaau

SEQ ID NO: 4028212 - RNA, 19 nt, Staphylococcus aureus subsp. aureus MW2
ggauuucuuauuuguaauu

SEQ ID NO: 4028213 - RNA, 23 nt, Staphylococcus aureus subsp. aureus MW2
ggcaaaaaaggaugaugugaaug

SEQ ID NO: 4028214 - RNA, 15 nt, Staphylococcus aureus subsp. aureus MW2
ggcaaagucauuaaa

SEQ ID NO: 4028215 - RNA, 17 nt, Staphylococcus aureus subsp. aureus MW2
ggcaacacucggaaaca

SEQ ID NO: 4028216 - RNA, 14 nt, Staphylococcus aureus subsp. aureus MW2
ggcaauauacuuuu

SEQ ID NO: 4028217 - RNA, 17 nt, Staphylococcus aureus subsp. aureus MW2
ggcaaucuauauaaaug

SEQ ID NO: 4028218 - RNA, 21 nt, Staphylococcus aureus subsp. aureus MW2
ggcaaucuugaacaauucuuc

SEQ ID NO: 4028219 - RNA, 22 nt, Staphylococcus aureus subsp. aureus MW2
ggcaccacauacauaucuuuug

SEQ ID NO: 4028220 - RNA, 16 nt, Staphylococcus aureus subsp. aureus MW2
ggcauaaccuguaauu

SEQ ID NO: 4028221 - RNA, 12 nt, Staphylococcus aureus subsp. aureus MW2
ggcauaauaaua

SEQ ID NO: 4028222 - RNA, 19 nt, Staphylococcus aureus subsp. aureus MW2
ggcauaauacacauugcaa

SEQ ID NO: 4028223 - RNA, 13 nt, Staphylococcus aureus subsp. aureus MW2
ggccccaacacag

SEQ ID NO: 4028224 - RNA, 20 nt, Staphylococcus aureus subsp. aureus MW2
ggccgugguaugauuuuuga

SEQ ID NO: 4028225 - RNA, 13 nt, Staphylococcus aureus subsp. aureus MW2
ggcgacauuugua

SEQ ID NO: 4028226 - RNA, 23 nt, Staphylococcus aureus subsp. aureus MW2
ggcgcuccuacuuuucaacuuua

SEQ ID NO: 4028227 - RNA, 12 nt, Staphylococcus aureus subsp. aureus MW2
ggcgggccccaa

SEQ ID NO: 4028228 - RNA, 13 nt, Staphylococcus aureus subsp. aureus MW2
ggcggggccccaa

SEQ ID NO: 4028229 - RNA, 21 nt, Staphylococcus aureus subsp. aureus MW2
ggcucauuuguuaaauucauc

SEQ ID NO: 4028230 - RNA, 13 nt, Staphylococcus aureus subsp. aureus MW2
ggcuuaaaucaaa

SEQ ID NO: 4028231 - RNA, 19 nt, Staphylococcus aureus subsp. aureus MW2
ggcuuaauuaauaaaaaaa

SEQ ID NO: 4028232 - RNA, 17 nt, Staphylococcus aureus subsp. aureus MW2
ggcuuaugcauagcucu

SEQ ID NO: 4028233 - RNA, 11 nt, Staphylococcus aureus subsp. aureus MW2
ggcuuuuucac

SEQ ID NO: 4028234 - RNA, 18 nt, Staphylococcus aureus subsp. aureus MW2
ggcuuuuuuauuuuauaa

SEQ ID NO: 4028235 - RNA, 21 nt, Staphylococcus aureus subsp. aureus MW2
ggcuuuuuuauuuuauaagaa

SEQ ID NO: 4028236 - RNA, 15 nt, Staphylococcus aureus subsp. aureus MW2
gggaaggacaggaau

SEQ ID NO: 4028237 - RNA, 14 nt, Staphylococcus aureus subsp. aureus MW2
gggaucuaauuuuu

SEQ ID NO: 4028238 - RNA, 18 nt, Staphylococcus aureus subsp. aureus MW2
gggaugggccccaacaca

SEQ ID NO: 4028239 - RNA, 22 nt, Staphylococcus aureus subsp. aureus MW2
gggauuuuuucguuuuaauaau

SEQ ID NO: 4028240 - RNA, 19 nt, Staphylococcus aureus subsp. aureus MW2
gggcauugagauuggaagg

SEQ ID NO: 4028241 - RNA, 21 nt, Staphylococcus aureus subsp. aureus MW2
gggccccaacaaagaagcugg

SEQ ID NO: 4028242 - RNA, 12 nt, Staphylococcus aureus subsp. aureus MW2
gggccccaacac

SEQ ID NO: 4028243 - RNA, 13 nt, Staphylococcus aureus subsp. aureus MW2
gggccccaacaca

SEQ ID NO: 4028244 - RNA, 15 nt, Staphylococcus aureus subsp. aureus MW2
gggccccaacacaga

SEQ ID NO: 4028245 - RNA, 21 nt, Staphylococcus aureus subsp. aureus MW2
gggccccaacacagaagcuga

SEQ ID NO: 4028246 - RNA, 17 nt, Staphylococcus aureus subsp. aureus MW2
gggccccaacacagaga

SEQ ID NO: 4028247 - RNA, 13 nt, Staphylococcus aureus subsp. aureus MW2
gggcguucugcua

SEQ ID NO: 4028248 - RNA, 15 nt, Staphylococcus aureus subsp. aureus MW2
gggcuccaaacauag

SEQ ID NO: 4028249 - RNA, 23 nt, Staphylococcus aureus subsp. aureus MW2
gggcuguuuuuuaaugcuuuaaa

SEQ ID NO: 4028250 - RNA, 17 nt, Staphylococcus aureus subsp. aureus MW2
ggggacuuaaccauuua

SEQ ID NO: 4028251 - RNA, 18 nt, Staphylococcus aureus subsp. aureus MW2
ggggcccaaacauagaga

SEQ ID NO: 4028252 - RNA, 15 nt, Staphylococcus aureus subsp. aureus MW2
ggggccccaacacag

SEQ ID NO: 4028253 - RNA, 23 nt, Staphylococcus aureus subsp. aureus MW2
ggggccccaacauagaagcuggc

SEQ ID NO: 4028254 - RNA, 12 nt, Staphylococcus aureus subsp. aureus MW2
ggggccccgcca

SEQ ID NO: 4028255 - RNA, 19 nt, Staphylococcus aureus subsp. aureus MW2
ggggugggacgacgaaaua

SEQ ID NO: 4028256 - RNA, 11 nt, Staphylococcus aureus subsp. aureus MW2
ggguaauacua

SEQ ID NO: 4028257 - RNA, 12 nt, Staphylococcus aureus subsp. aureus MW2
ggguaauguuuu

SEQ ID NO: 4028258 - RNA, 19 nt, Staphylococcus aureus subsp. aureus MW2
gggugagggccccaacaca

SEQ ID NO: 4028259 - RNA, 18 nt, Staphylococcus aureus subsp. aureus MW2
gggugggacgacgaaaua

SEQ ID NO: 4028260 - RNA, 11 nt, Staphylococcus aureus subsp. aureus MW2
gguaaaaaaau

SEQ ID NO: 4028261 - RNA, 11 nt, Staphylococcus aureus subsp. aureus MW2
gguaaaaaguu

SEQ ID NO: 4028262 - RNA, 22 nt, Staphylococcus aureus subsp. aureus MW2
gguaaaucuguuuaaauuuaaa

SEQ ID NO: 4028263 - RNA, 15 nt, Staphylococcus aureus subsp. aureus MW2
guaaguguaaaugaa

SEQ ID NO: 4028264 - RNA, 23 nt, Staphylococcus aureus subsp. aureus MW2
guaauaaaagucgauaaauauga

SEQ ID NO: 4028265 - RNA, 16 nt, Staphylococcus aureus subsp. aureus MW2
guaauaauauaaauaa

SEQ ID NO: 4028266 - RNA, 15 nt, Staphylococcus aureus subsp. aureus MW2
guaauaauaucaccu

SEQ ID NO: 4028267 - RNA, 21 nt, Staphylococcus aureus subsp. aureus MW2
guaauacuauaugaaaagaga

SEQ ID NO: 4028268 - RNA, 22 nt, Staphylococcus aureus subsp. aureus MW2
guaauacugaaugcucaucuuc

SEQ ID NO: 4028269 - RNA, 17 nt, Staphylococcus aureus subsp. aureus MW2
guaauagcaaccauauu

SEQ ID NO: 4028270 - RNA, 15 nt, Staphylococcus aureus subsp. aureus MW2
guaauauauaaaagu

SEQ ID NO: 4028271 - RNA, 19 nt, Staphylococcus aureus subsp. aureus MW2
guaauauguugcuuaucaa

SEQ ID NO: 4028272 - RNA, 12 nt, Staphylococcus aureus subsp. aureus MW2
guaauauuuuug

SEQ ID NO: 4028273 - RNA, 20 nt, Staphylococcus aureus subsp. aureus MW2
guaauauuuuuguugcaauu

SEQ ID NO: 4028274 - RNA, 21 nt, Staphylococcus aureus subsp. aureus MW2
guaaucagguuuaaacaguuu

SEQ ID NO: 4028275 - RNA, 16 nt, Staphylococcus aureus subsp. aureus MW2
guaaucauaccagcaa

SEQ ID NO: 4028276 - RNA, 18 nt, Staphylococcus aureus subsp. aureus MW2
guaaucauagcaacaucg

SEQ ID NO: 4028277 - RNA, 20 nt, Staphylococcus aureus subsp. aureus MW2
guaauccauucccuuuucau

SEQ ID NO: 4028278 - RNA, 14 nt, Staphylococcus aureus subsp. aureus MW2
guaaucuauuuucu

SEQ ID NO: 4028279 - RNA, 12 nt, Staphylococcus aureus subsp. aureus MW2
guaaucuuuuaa

SEQ ID NO: 4028280 - RNA, 17 nt, Staphylococcus aureus subsp. aureus MW2
guaaugagaguaauguu

SEQ ID NO: 4028281 - RNA, 16 nt, Staphylococcus aureus subsp. aureus MW2
guaaugauuuugcuuu

SEQ ID NO: 4028282 - RNA, 16 nt, Staphylococcus aureus subsp. aureus MW2
guaaugcuuaaaaaca

SEQ ID NO: 4028283 - RNA, 16 nt, Staphylococcus aureus subsp. aureus MW2
guaaugcuugagcuuu

SEQ ID NO: 4028284 - RNA, 15 nt, Staphylococcus aureus subsp. aureus MW2
guaaugugcauugcu

SEQ ID NO: 4028285 - RNA, 21 nt, Staphylococcus aureus subsp. aureus MW2
guaauguuccccugaaaagaa

SEQ ID NO: 4028286 - RNA, 14 nt, Staphylococcus aureus subsp. aureus MW2
guaauuauuauaau

SEQ ID NO: 4028287 - RNA, 23 nt, Staphylococcus aureus subsp. aureus MW2
guaauuauuuuucucaacaguuu

SEQ ID NO: 4028288 - RNA, 19 nt, Staphylococcus aureus subsp. aureus MW2
guaauucaccaucauauuc

SEQ ID NO: 4028289 - RNA, 11 nt, Staphylococcus aureus subsp. aureus MW2
guaauuguaau

SEQ ID NO: 4028290 - RNA, 15 nt, Staphylococcus aureus subsp. aureus MW2
guaauuguaaucuau

SEQ ID NO: 4028291 - RNA, 21 nt, Staphylococcus aureus subsp. aureus MW2
guaauuuaccuauuugcugaa

SEQ ID NO: 4028292 - RNA, 21 nt, Staphylococcus aureus subsp. aureus MW2
guaauuuuuaaacaaaaauaa

SEQ ID NO: 4028293 - RNA, 17 nt, Staphylococcus aureus subsp. aureus MW2
guaauuuuuaaaucuac

SEQ ID NO: 4028294 - RNA, 23 nt, Staphylococcus aureus subsp. aureus MW2
guaauuuuuaaaucuacaauauu

SEQ ID NO: 4028295 - RNA, 12 nt, Staphylococcus aureus subsp. aureus MW2
guacaaauaaua

SEQ ID NO: 4028296 - RNA, 21 nt, Staphylococcus aureus subsp. aureus MW2
guacaauaauaccuucaauug

SEQ ID NO: 4028297 - RNA, 15 nt, Staphylococcus aureus subsp. aureus MW2
guacaccuacaaaua

SEQ ID NO: 4028298 - RNA, 17 nt, Staphylococcus aureus subsp. aureus MW2
guacacuuuugauuguu

SEQ ID NO: 4028299 - RNA, 18 nt, Staphylococcus aureus subsp. aureus MW2
guacaguuacuuucgcuu

SEQ ID NO: 4028300 - RNA, 14 nt, Staphylococcus aureus subsp. aureus MW2
guacauaaaaauaa

SEQ ID NO: 4028301 - RNA, 18 nt, Staphylococcus aureus subsp. aureus MW2
guacauaaauagugaaau

SEQ ID NO: 4028302 - RNA, 14 nt, Staphylococcus aureus subsp. aureus MW2
guacauauaauaug

SEQ ID NO: 4028303 - RNA, 18 nt, Staphylococcus aureus subsp. aureus MW2
guacauauguguaugaua

SEQ ID NO: 4028304 - RNA, 11 nt, Staphylococcus aureus subsp. aureus MW2
guacauguauu

SEQ ID NO: 4028305 - RNA, 21 nt, Staphylococcus aureus subsp. aureus MW2
guacauuaguuugaucauuua

SEQ ID NO: 4028306 - RNA, 16 nt, Staphylococcus aureus subsp. aureus MW2
guacauuguaaauaua

SEQ ID NO: 4028307 - RNA, 23 nt, Staphylococcus aureus subsp. aureus MW2
guacauuuauuuaaugugcauau

SEQ ID NO: 4028308 - RNA, 14 nt, Staphylococcus aureus subsp. aureus MW2
guaccaauuagcau

SEQ ID NO: 4028309 - RNA, 15 nt, Staphylococcus aureus subsp. aureus MW2
guaccaauuagcaug

SEQ ID NO: 4028310 - RNA, 13 nt, Staphylococcus aureus subsp. aureus MW2
guaccaauugauu

SEQ ID NO: 4028311 - RNA, 21 nt, Staphylococcus aureus subsp. aureus MW2
guaccacucauaaucaagucu

SEQ ID NO: 4028312 - RNA, 18 nt, Staphylococcus aureus subsp. aureus MW2
guaccaucaauaaaaauu

SEQ ID NO: 4028313 - RNA, 18 nt, Staphylococcus aureus subsp. aureus MW2
guaccaucucuauuuuuu

SEQ ID NO: 4028314 - RNA, 12 nt, Staphylococcus aureus subsp. aureus MW2
guaccguauuuu

SEQ ID NO: 4028315 - RNA, 14 nt, Staphylococcus aureus subsp. aureus MW2
guacgauucaauuu

SEQ ID NO: 4028316 - RNA, 19 nt, Staphylococcus aureus subsp. aureus MW2
guacgcaauuuaauauuau

SEQ ID NO: 4028317 - RNA, 22 nt, Staphylococcus aureus subsp. aureus MW2
guacgcaauuuaauauuauaag

SEQ ID NO: 4028318 - RNA, 16 nt, Staphylococcus aureus subsp. aureus MW2
guacguuaaucaguga

SEQ ID NO: 4028319 - RNA, 15 nt, Staphylococcus aureus subsp. aureus MW2
guacguuguaauagu

SEQ ID NO: 4028320 - RNA, 16 nt, Staphylococcus aureus subsp. aureus MW2
guacguuuagugaaaa

SEQ ID NO: 4028321 - RNA, 21 nt, Staphylococcus aureus subsp. aureus MW2
guacuaggaccuacaauuuuc

SEQ ID NO: 4028322 - RNA, 14 nt, Staphylococcus aureus subsp. aureus MW2
guacuuacaaauau

SEQ ID NO: 4028323 - RNA, 16 nt, Staphylococcus aureus subsp. aureus MW2
guacuuacgaauagaa

SEQ ID NO: 4028324 - RNA, 22 nt, Staphylococcus aureus subsp. aureus MW2
guacuuacgaauagaaaauaau

SEQ ID NO: 4028325 - RNA, 18 nt, Staphylococcus aureus subsp. aureus MW2
guacuucgcccuuccauu

SEQ ID NO: 4028326 - RNA, 12 nt, Staphylococcus aureus subsp. aureus MW2
guacuugccuau

SEQ ID NO: 4028327 - RNA, 15 nt, Staphylococcus aureus subsp. aureus MW2
guacuuucaaauaau

SEQ ID NO: 4028328 - RNA, 23 nt, Staphylococcus aureus subsp. aureus MW2
guacuuugauaucuacagagaau

SEQ ID NO: 4028329 - RNA, 14 nt, Staphylococcus aureus subsp. aureus MW2
guacuuuucuuuuu

SEQ ID NO: 4028330 - RNA, 20 nt, Staphylococcus aureus subsp. aureus MW2
guagaaucuacgauuuucaa

SEQ ID NO: 4028331 - RNA, 16 nt, Staphylococcus aureus subsp. aureus MW2
guagaauuucuuuucg

SEQ ID NO: 4028332 - RNA, 19 nt, Staphylococcus aureus subsp. aureus MW2
guagauaaaucgauaaaau

SEQ ID NO: 4028333 - RNA, 13 nt, Staphylococcus aureus subsp. aureus MW2
guagccaaauaaa

SEQ ID NO: 4028334 - RNA, 14 nt, Staphylococcus aureus subsp. aureus MW2
guagccaaauaaau

SEQ ID NO: 4028335 - RNA, 16 nt, Staphylococcus aureus subsp. aureus MW2
guagcuaaugcaacua

SEQ ID NO: 4028336 - RNA, 22 nt, Staphylococcus aureus subsp. aureus MW2
guagcuuaacguugcagagaau

SEQ ID NO: 4028337 - RNA, 18 nt, Staphylococcus aureus subsp. aureus MW2
guagcuugaauaauauau

SEQ ID NO: 4028338 - RNA, 16 nt, Staphylococcus aureus subsp. aureus MW2
guaggauaauuucaau

SEQ ID NO: 4028339 - RNA, 23 nt, Staphylococcus aureus subsp. aureus MW2
guaggcgauuuuauuaugacaag

SEQ ID NO: 4028340 - RNA, 20 nt, Staphylococcus aureus subsp. aureus MW2
guaggcugaaguugaagcca

SEQ ID NO: 4028341 - RNA, 11 nt, Staphylococcus aureus subsp. aureus MW2
guaguauauau

SEQ ID NO: 4028342 - RNA, 13 nt, Staphylococcus aureus subsp. aureus MW2
guaguauauauga

SEQ ID NO: 4028343 - RNA, 19 nt, Staphylococcus aureus subsp. aureus MW2
guaguaugacaaauuaaaa

SEQ ID NO: 4028344 - RNA, 12 nt, Staphylococcus aureus subsp. aureus MW2
guaguauuuuuu

SEQ ID NO: 4028345 - RNA, 22 nt, Staphylococcus aureus subsp. aureus MW2
guaguuaagauaccuuuuucua

SEQ ID NO: 4028346 - RNA, 18 nt, Staphylococcus aureus subsp. aureus MW2
guaguuagguaaaaauua

SEQ ID NO: 4028347 - RNA, 14 nt, Staphylococcus aureus subsp. aureus MW2
guaguuuauaucaa

SEQ ID NO: 4028348 - RNA, 19 nt, Staphylococcus aureus subsp. aureus MW2
guauaaaaauguauuaaau

SEQ ID NO: 4028349 - RNA, 20 nt, Staphylococcus aureus subsp. aureus MW2
guauaaaaauguauuaaaua

SEQ ID NO: 4028350 - RNA, 23 nt, Staphylococcus aureus subsp. aureus MW2
guauaaaaauguauuaaauaugc

SEQ ID NO: 4028351 - RNA, 12 nt, Staphylococcus aureus subsp. aureus MW2
guauaaauaaaa

SEQ ID NO: 4028352 - RNA, 14 nt, Staphylococcus aureus subsp. aureus MW2
gucacuuuauuaaa

SEQ ID NO: 4028353 - RNA, 12 nt, Staphylococcus aureus subsp. aureus MW2
gucagauucaaa

SEQ ID NO: 4028354 - RNA, 16 nt, Staphylococcus aureus subsp. aureus MW2
gucagcauacaauaau

SEQ ID NO: 4028355 - RNA, 15 nt, Staphylococcus aureus subsp. aureus MW2
gucagcuuacaauaa

SEQ ID NO: 4028356 - RNA, 16 nt, Staphylococcus aureus subsp. aureus MW2
gucagcuuacaauaau

SEQ ID NO: 4028357 - RNA, 14 nt, Staphylococcus aureus subsp. aureus MW2
gucaggggccccaa

SEQ ID NO: 4028358 - RNA, 23 nt, Staphylococcus aureus subsp. aureus MW2
gucaggggccccaacacagagaa

SEQ ID NO: 4028359 - RNA, 14 nt, Staphylococcus aureus subsp. aureus MW2
gucaguaaaaauac

SEQ ID NO: 4028360 - RNA, 13 nt, Staphylococcus aureus subsp. aureus MW2
gucauaaaauacc

SEQ ID NO: 4028361 - RNA, 17 nt, Staphylococcus aureus subsp. aureus MW2
gucauaaauauaaaaua

SEQ ID NO: 4028362 - RNA, 18 nt, Staphylococcus aureus subsp. aureus MW2
gucauaauagauaaugca

SEQ ID NO: 4028363 - RNA, 23 nt, Staphylococcus aureus subsp. aureus MW2
gucauacacaaugauuauaaaua

SEQ ID NO: 4028364 - RNA, 20 nt, Staphylococcus aureus subsp. aureus MW2
gucauauacuauaugucuua

SEQ ID NO: 4028365 - RNA, 14 nt, Staphylococcus aureus subsp. aureus MW2
gucaucaacacaca

SEQ ID NO: 4028366 - RNA, 22 nt, Staphylococcus aureus subsp. aureus MW2
gucaucaucaugauuacuaaua

SEQ ID NO: 4028367 - RNA, 19 nt, Staphylococcus aureus subsp. aureus MW2
gucaucaugauuauuucgc

SEQ ID NO: 4028368 - RNA, 20 nt, Staphylococcus aureus subsp. aureus MW2
gucaucauggucaacuuuuu

SEQ ID NO: 4028369 - RNA, 15 nt, Staphylococcus aureus subsp. aureus MW2
gucauccaaagaaac

SEQ ID NO: 4028370 - RNA, 16 nt, Staphylococcus aureus subsp. aureus MW2
gucaucuguuaauuca

SEQ ID NO: 4028371 - RNA, 22 nt, Staphylococcus aureus subsp. aureus MW2
gucaucuucaauucuuacaccu

SEQ ID NO: 4028372 - RNA, 12 nt, Staphylococcus aureus subsp. aureus MW2
gucaugccuuca

SEQ ID NO: 4028373 - RNA, 23 nt, Staphylococcus aureus subsp. aureus MW2
gucaugucuagauuucaaaucaa

SEQ ID NO: 4028374 - RNA, 17 nt, Staphylococcus aureus subsp. aureus MW2
gucauguguucaaauaa

SEQ ID NO: 4028375 - RNA, 15 nt, Staphylococcus aureus subsp. aureus MW2
gucauugaaaauauu

SEQ ID NO: 4028376 - RNA, 16 nt, Staphylococcus aureus subsp. aureus MW2
gucauuugauuuaaaa

SEQ ID NO: 4028377 - RNA, 13 nt, Staphylococcus aureus subsp. aureus MW2
guccaauaaauuu

SEQ ID NO: 4028378 - RNA, 15 nt, Staphylococcus aureus subsp. aureus MW2
guccaaucaguuuca

SEQ ID NO: 4028379 - RNA, 14 nt, Staphylococcus aureus subsp. aureus MW2
guccagcuaauaac

SEQ ID NO: 4028380 - RNA, 23 nt, Staphylococcus aureus subsp. aureus MW2
guccagcuaauaacgcugcaccu

SEQ ID NO: 4028381 - RNA, 18 nt, Staphylococcus aureus subsp. aureus MW2
guccauaaucuuuauuaa

SEQ ID NO: 4028382 - RNA, 20 nt, Staphylococcus aureus subsp. aureus MW2
guccauaaucuuuauuaaua

SEQ ID NO: 4028383 - RNA, 20 nt, Staphylococcus aureus subsp. aureus MW2
guccaucauuuguguuuuua

SEQ ID NO: 4028384 - RNA, 18 nt, Staphylococcus aureus subsp. aureus MW2
guccaucgucaucacuuu

SEQ ID NO: 4028385 - RNA, 21 nt, Staphylococcus aureus subsp. aureus MW2
guccaugcguggugugaaugu

SEQ ID NO: 4028386 - RNA, 17 nt, Staphylococcus aureus subsp. aureus MW2
guccauuuccaugaaua

SEQ ID NO: 4028387 - RNA, 22 nt, Staphylococcus aureus subsp. aureus MW2
gucccacucccuuuauuuucga

SEQ ID NO: 4028388 - RNA, 15 nt, Staphylococcus aureus subsp. aureus MW2
guccgacaucauaaa

SEQ ID NO: 4028389 - RNA, 20 nt, Staphylococcus aureus subsp. aureus MW2
guccgauuuaauauugaaua

SEQ ID NO: 4028390 - RNA, 17 nt, Staphylococcus aureus subsp. aureus MW2
guccgcuuuuucauaga

SEQ ID NO: 4028391 - RNA, 14 nt, Staphylococcus aureus subsp. aureus MW2
guccucuaaaacau

SEQ ID NO: 4028392 - RNA, 21 nt, Staphylococcus aureus subsp. aureus MW2
guccuuuuuauuuuauuuuuu

SEQ ID NO: 4028393 - RNA, 16 nt, Staphylococcus aureus subsp. aureus MW2
gucgaaaauagcuauu

SEQ ID NO: 4028394 - RNA, 22 nt, Staphylococcus aureus subsp. aureus MW2
gucgaaaauagcuauuaaaaua

SEQ ID NO: 4028395 - RNA, 19 nt, Staphylococcus aureus subsp. aureus MW2
gucgaagaagauuaugaaa

SEQ ID NO: 4028396 - RNA, 17 nt, Staphylococcus aureus subsp. aureus MW2
gucgaauauaauuuuuu

SEQ ID NO: 4028397 - RNA, 12 nt, Staphylococcus aureus subsp. aureus MW2
gucgaauuuuuu

SEQ ID NO: 4028398 - RNA, 22 nt, Staphylococcus aureus subsp. aureus MW2
gucgauaaauaugauguuaaaa

SEQ ID NO: 4028399 - RNA, 20 nt, Staphylococcus aureus subsp. aureus MW2
gucgauuucauuaauuuuuu

SEQ ID NO: 4028400 - RNA, 22 nt, Staphylococcus aureus subsp. aureus MW2
gucgcacuauaaaauucaccaa

SEQ ID NO: 4028401 - RNA, 13 nt, Staphylococcus aureus subsp. aureus MW2
gucggggccccaa

SEQ ID NO: 4028402 - RNA, 20 nt, Staphylococcus aureus subsp. aureus MW2
gucggggccccaacacagag

SEQ ID NO: 4028403 - RNA, 14 nt, Staphylococcus aureus subsp. aureus MW2
gucgguucaucuaa

SEQ ID NO: 4028404 - RNA, 15 nt, Staphylococcus aureus subsp. aureus MW2
gucguacuuucaaau

SEQ ID NO: 4028405 - RNA, 21 nt, Staphylococcus aureus subsp. aureus MW2
gucguuuaccgucuuuugcaa

SEQ ID NO: 4028406 - RNA, 24 nt, Staphylococcus aureus subsp. aureus MW2
gucuaaaaaugucguauauguaau

SEQ ID NO: 4028407 - RNA, 13 nt, Staphylococcus aureus subsp. aureus MW2
gucuaacaguuaa

SEQ ID NO: 4028408 - RNA, 19 nt, Staphylococcus aureus subsp. aureus MW2
gucuaaucgacuuuuacaa

SEQ ID NO: 4028409 - RNA, 16 nt, Staphylococcus aureus subsp. aureus MW2
gucuaauguuggaaaa

SEQ ID NO: 4028410 - RNA, 19 nt, Staphylococcus aureus subsp. aureus MW2
gucuaauguuggaaaaggu

SEQ ID NO: 4028411 - RNA, 14 nt, Staphylococcus aureus subsp. aureus MW2
gucuacgaucaaaa

SEQ ID NO: 4028412 - RNA, 17 nt, Staphylococcus aureus subsp. aureus MW2
gucuauauauauuuaaa

SEQ ID NO: 4028413 - RNA, 21 nt, Staphylococcus aureus subsp. aureus MW2
gucuauauauauuuaaaucaa

SEQ ID NO: 4028414 - RNA, 19 nt, Staphylococcus aureus subsp. aureus MW2
gucuaucgccuaaaaauaa

SEQ ID NO: 4028415 - RNA, 22 nt, Staphylococcus aureus subsp. aureus MW2
gucuaugaauaauguuuucauu

SEQ ID NO: 4028416 - RNA, 18 nt, Staphylococcus aureus subsp. aureus MW2
gucuaugucaaauugaac

SEQ ID NO: 4028417 - RNA, 14 nt, Staphylococcus aureus subsp. aureus MW2
gucuauuauguacc

SEQ ID NO: 4028418 - RNA, 21 nt, Staphylococcus aureus subsp. aureus MW2
gucuauuguaaaaacguucaa

SEQ ID NO: 4028419 - RNA, 22 nt, Staphylococcus aureus subsp. aureus MW2
gucucagauucauaucuuucaa

SEQ ID NO: 4028420 - RNA, 14 nt, Staphylococcus aureus subsp. aureus MW2
gucucauuaucacc

SEQ ID NO: 4028421 - RNA, 15 nt, Staphylococcus aureus subsp. aureus MW2
gucuccaauacuuuu

SEQ ID NO: 4028422 - RNA, 14 nt, Staphylococcus aureus subsp. aureus MW2
gucucgaugcuaau

SEQ ID NO: 4028423 - RNA, 19 nt, Staphylococcus aureus subsp. aureus MW2
gucugaugucgaaaauagc

SEQ ID NO: 4028424 - RNA, 20 nt, Staphylococcus aureus subsp. aureus MW2
gucugaugucgaaaauagcu

SEQ ID NO: 4028425 - RNA, 18 nt, Staphylococcus aureus subsp. aureus MW2
gucugcauuaauuucaug

SEQ ID NO: 4028426 - RNA, 23 nt, Staphylococcus aureus subsp. aureus MW2
gucuguaaauuaucuaaagaaau

SEQ ID NO: 4028427 - RNA, 23 nt, Staphylococcus aureus subsp. aureus MW2
gucuguagaaauuggcuccccaa

SEQ ID NO: 4028428 - RNA, 16 nt, Staphylococcus aureus subsp. aureus MW2
gucuguauuauuauaa

SEQ ID NO: 4028429 - RNA, 12 nt, Staphylococcus aureus subsp. aureus MW2
gucuuaaacaua

SEQ ID NO: 4028430 - RNA, 22 nt, Staphylococcus aureus subsp. aureus MW2
gucuuaacaaauuaaaaaggua

SEQ ID NO: 4028431 - RNA, 19 nt, Staphylococcus aureus subsp. aureus MW2
gucuuccaaucaacuucau

SEQ ID NO: 4028432 - RNA, 14 nt, Staphylococcus aureus subsp. aureus MW2
gucuugaguacuaa

SEQ ID NO: 4028433 - RNA, 15 nt, Staphylococcus aureus subsp. aureus MW2
gucuugaguacuaau

SEQ ID NO: 4028434 - RNA, 22 nt, Staphylococcus aureus subsp. aureus MW2
gucuugaguacuaaucaauacu

SEQ ID NO: 4028435 - RNA, 16 nt, Staphylococcus aureus subsp. aureus MW2
gucuugugauaauucu

SEQ ID NO: 4028436 - RNA, 20 nt, Staphylococcus aureus subsp. aureus MW2
gucuuguggcacauaaccga

SEQ ID NO: 4028437 - RNA, 13 nt, Staphylococcus aureus subsp. aureus MW2
gucuuucuaaguu

SEQ ID NO: 4028438 - RNA, 19 nt, Staphylococcus aureus subsp. aureus MW2
gucuuuuaauauuuucauu

SEQ ID NO: 4028439 - RNA, 14 nt, Staphylococcus aureus subsp. aureus MW2
gucuuuuugauuaa

SEQ ID NO: 4028440 - RNA, 11 nt, Staphylococcus aureus subsp. aureus MW2
guuaaaaagac

SEQ ID NO: 4028441 - RNA, 23 nt, Staphylococcus aureus subsp. aureus MW2
guuaaaacacccugcuuaucauu

SEQ ID NO: 4028442 - RNA, 16 nt, Staphylococcus aureus subsp. aureus MW2
guuaaaaccuuuucaa

SEQ ID NO: 4028443 - RNA, 23 nt, Staphylococcus aureus subsp. aureus MW2
guuaaaaucgcagcaaugacacu

SEQ ID NO: 4028444 - RNA, 13 nt, Staphylococcus aureus subsp. aureus MW2
guuaaagauguug

SEQ ID NO: 4028445 - RNA, 19 nt, Staphylococcus aureus subsp. aureus MW2
guuaaagauuauuauuaca

SEQ ID NO: 4028446 - RNA, 19 nt, Staphylococcus aureus subsp. aureus MW2
guuaaaguacuuacaaaua

SEQ ID NO: 4028447 - RNA, 13 nt, Staphylococcus aureus subsp. aureus MW2
guuaaauauauau

SEQ ID NO: 4028448 - RNA, 13 nt, Staphylococcus aureus subsp. aureus MW2
guuaaauucaucu

SEQ ID NO: 4028449 - RNA, 14 nt, Staphylococcus aureus subsp. aureus MW2
guuaaauucuaaaa

SEQ ID NO: 4028450 - RNA, 19 nt, Staphylococcus aureus subsp. aureus MW2
guuaacauuugucauaaua

SEQ ID NO: 4028451 - RNA, 15 nt, Staphylococcus aureus subsp. aureus MW2
guuaacgauauugcu

SEQ ID NO: 4028452 - RNA, 14 nt, Staphylococcus aureus subsp. aureus MW2
guuaacucuaucua

SEQ ID NO: 4028453 - RNA, 18 nt, Staphylococcus aureus subsp. aureus MW2
guuaagauaccuuuuucu

SEQ ID NO: 4028454 - RNA, 19 nt, Staphylococcus aureus subsp. aureus MW2
guuaauaacccauuuucaa

SEQ ID NO: 4028455 - RNA, 20 nt, Staphylococcus aureus subsp. aureus MW2
guuaauaacccauuuucaaa

SEQ ID NO: 4028456 - RNA, 13 nt, Staphylococcus aureus subsp. aureus MW2
guuaauacaacca

SEQ ID NO: 4028457 - RNA, 21 nt, Staphylococcus aureus subsp. aureus MW2
guuaauauugguuauauauug

SEQ ID NO: 4028458 - RNA, 13 nt, Staphylococcus aureus subsp. aureus MW2
guuaauuaaacaa

SEQ ID NO: 4028459 - RNA, 16 nt, Staphylococcus aureus subsp. aureus MW2
guuaauuauguauuuu

SEQ ID NO: 4028460 - RNA, 23 nt, Staphylococcus aureus subsp. aureus MW2
guuaauuuaauaauuaaauauaa

SEQ ID NO: 4028461 - RNA, 22 nt, Staphylococcus aureus subsp. aureus MW2
guuacacaugcaucaacuauuu

SEQ ID NO: 4028462 - RNA, 20 nt, Staphylococcus aureus subsp. aureus MW2
guuacacuuuucuuaucagu

SEQ ID NO: 4028463 - RNA, 15 nt, Staphylococcus aureus subsp. aureus MW2
guuacauauugcauu

SEQ ID NO: 4028464 - RNA, 16 nt, Staphylococcus aureus subsp. aureus MW2
guuacauauugcauuu

SEQ ID NO: 4028465 - RNA, 15 nt, Staphylococcus aureus subsp. aureus MW2
guuacccuuuuucaa

SEQ ID NO: 4028466 - RNA, 20 nt, Staphylococcus aureus subsp. aureus MW2
guuacucugcgauuucuaaa

SEQ ID NO: 4028467 - RNA, 18 nt, Staphylococcus aureus subsp. aureus MW2
guuacuuuuuuaauguaa

SEQ ID NO: 4028468 - RNA, 20 nt, Staphylococcus aureus subsp. aureus MW2
guuagacucacuucuuaaaa

SEQ ID NO: 4028469 - RNA, 22 nt, Staphylococcus aureus subsp. aureus MW2
guuagaggauggauacuuaaag

SEQ ID NO: 4028470 - RNA, 13 nt, Staphylococcus aureus subsp. aureus MW2
guuagauuucaaa

SEQ ID NO: 4028471 - RNA, 15 nt, Staphylococcus aureus subsp. aureus MW2
guuaggagagaugua

SEQ ID NO: 4028472 - RNA, 19 nt, Staphylococcus aureus subsp. aureus MW2
guuaggcgacuuaacuuaa

SEQ ID NO: 4028473 - RNA, 21 nt, Staphylococcus aureus subsp. aureus MW2
guuaguauaaacguccaaaca

SEQ ID NO: 4028474 - RNA, 13 nt, Staphylococcus aureus subsp. aureus MW2
guuauaaaaugaa

SEQ ID NO: 4028475 - RNA, 16 nt, Staphylococcus aureus subsp. aureus MW2
guuauaaauucuaucu

SEQ ID NO: 4028476 - RNA, 16 nt, Staphylococcus aureus subsp. aureus MW2
guuauaaguacaaaua

SEQ ID NO: 4028477 - RNA, 22 nt, Staphylococcus aureus subsp. aureus MW2
guuauauuggcgggccccaaca

SEQ ID NO: 4028478 - RNA, 22 nt, Staphylococcus aureus subsp. aureus MW2
guuauauuguauuuuauuuauu

SEQ ID NO: 4028479 - RNA, 16 nt, Staphylococcus aureus subsp. aureus MW2
guuaucauuauucaua

SEQ ID NO: 4028480 - RNA, 20 nt, Staphylococcus aureus subsp. aureus MW2
guuaucgauuuuaucgaaau

SEQ ID NO: 4028481 - RNA, 16 nt, Staphylococcus aureus subsp. aureus MW2
guuaucguucaauguu

SEQ ID NO: 4028482 - RNA, 14 nt, Staphylococcus aureus subsp. aureus MW2
guuaucuaaugauc

SEQ ID NO: 4028483 - RNA, 22 nt, Staphylococcus aureus subsp. aureus MW2
guuaucuugcuuauugauauaa

SEQ ID NO: 4028484 - RNA, 14 nt, Staphylococcus aureus subsp. aureus MW2
guuaugguguguug

SEQ ID NO: 4028485 - RNA, 23 nt, Staphylococcus aureus subsp. aureus MW2
guuauguacacgagucauuaaau

SEQ ID NO: 4028486 - RNA, 14 nt, Staphylococcus aureus subsp. aureus MW2
guuauguaugaaag

SEQ ID NO: 4028487 - RNA, 17 nt, Staphylococcus aureus subsp. aureus MW2
guuaugugcuaaucuau

SEQ ID NO: 4028488 - RNA, 17 nt, Staphylococcus aureus subsp. aureus MW2
guuauuaaaauuaaaua

SEQ ID NO: 4028489 - RNA, 15 nt, Staphylococcus aureus subsp. aureus MW2
guuauuauaaaauaa

SEQ ID NO: 4028490 - RNA, 17 nt, Staphylococcus aureus subsp. aureus MW2
guuauuaucguaaaaaa

SEQ ID NO: 4028491 - RNA, 18 nt, Staphylococcus aureus subsp. aureus MW2
guuauuuauacagugaau

SEQ ID NO: 4028492 - RNA, 15 nt, Staphylococcus aureus subsp. aureus MW2
guucaaaauacucaa

SEQ ID NO: 4028493 - RNA, 18 nt, Staphylococcus aureus subsp. aureus MW2
guucaaauguugaaugug

SEQ ID NO: 4028494 - RNA, 18 nt, Staphylococcus aureus subsp. aureus MW2
guucaacuaaauuuucua

SEQ ID NO: 4028495 - RNA, 12 nt, Staphylococcus aureus subsp. aureus MW2
guucaaguauau

SEQ ID NO: 4028496 - RNA, 18 nt, Staphylococcus aureus subsp. aureus MW2
guucaaucgcaucuguua

SEQ ID NO: 4028497 - RNA, 18 nt, Staphylococcus aureus subsp. aureus MW2
guucagaacuacaauuca

SEQ ID NO: 4028498 - RNA, 14 nt, Staphylococcus aureus subsp. aureus MW2
guucaguaggaauu

SEQ ID NO: 4028499 - RNA, 16 nt, Staphylococcus aureus subsp. aureus MW2
guucaucaaacaacau

SEQ ID NO: 4028500 - RNA, 16 nt, Staphylococcus aureus subsp. aureus MW2
guucauguuuaaaaua

SEQ ID NO: 4028501 - RNA, 14 nt, Staphylococcus aureus subsp. aureus MW2
guuccaaucuuuuu

SEQ ID NO: 4028502 - RNA, 17 nt, Staphylococcus aureus subsp. aureus MW2
guuccaccgaacccugu

SEQ ID NO: 4028503 - RNA, 18 nt, Staphylococcus aureus subsp. aureus MW2
guuccaccgaacccuguu

SEQ ID NO: 4028504 - RNA, 19 nt, Staphylococcus aureus subsp. aureus MW2
guuccaccgaacccuguua

SEQ ID NO: 4028505 - RNA, 14 nt, Staphylococcus aureus subsp. aureus MW2
guucccauucuuug

SEQ ID NO: 4028506 - RNA, 19 nt, Staphylococcus aureus subsp. aureus MW2
guucgauuguaauaaccau

SEQ ID NO: 4028507 - RNA, 12 nt, Staphylococcus aureus subsp. aureus MW2
guucuaaaauag

SEQ ID NO: 4028508 - RNA, 16 nt, Staphylococcus aureus subsp. aureus MW2
guucuaaaauuaacca

SEQ ID NO: 4028509 - RNA, 18 nt, Staphylococcus aureus subsp. aureus MW2
guucuaaaauuaaccauu

SEQ ID NO: 4028510 - RNA, 20 nt, Staphylococcus aureus subsp. aureus MW2
guucuaauacuucuaacgca

SEQ ID NO: 4028511 - RNA, 22 nt, Staphylococcus aureus subsp. aureus MW2
guucucauuauaaugauuuuua

SEQ ID NO: 4028512 - RNA, 14 nt, Staphylococcus aureus subsp. aureus MW2
guucuccgaucaug

SEQ ID NO: 4028513 - RNA, 19 nt, Staphylococcus aureus subsp. aureus MW2
guucuccgaucaugccuuc

SEQ ID NO: 4028514 - RNA, 17 nt, Staphylococcus aureus subsp. aureus MW2
guucucguguaaaaugc

SEQ ID NO: 4028515 - RNA, 22 nt, Staphylococcus aureus subsp. aureus MW2
guucugcuaaucuucucauaaa

SEQ ID NO: 4028516 - RNA, 14 nt, Staphylococcus aureus subsp. aureus MW2
guucugcuuuuucu

SEQ ID NO: 4028517 - RNA, 15 nt, Staphylococcus aureus subsp. aureus MW2
guucuuauauugacu

SEQ ID NO: 4028518 - RNA, 13 nt, Staphylococcus aureus subsp. aureus MW2
guucuugagcugu

SEQ ID NO: 4028519 - RNA, 17 nt, Staphylococcus aureus subsp. aureus MW2
guucuugguauuuuuua

SEQ ID NO: 4028520 - RNA, 18 nt, Staphylococcus aureus subsp. aureus MW2
guucuugguauuuuuuaa

SEQ ID NO: 4028521 - RNA, 14 nt, Staphylococcus aureus subsp. aureus MW2
guucuuucuuucuu

SEQ ID NO: 4028522 - RNA, 17 nt, Staphylococcus aureus subsp. aureus MW2
guugaaacuguaucaac

SEQ ID NO: 4028523 - RNA, 19 nt, Staphylococcus aureus subsp. aureus MW2
guugaauguggaacaugau

SEQ ID NO: 4028524 - RNA, 16 nt, Staphylococcus aureus subsp. aureus MW2
guugaauuaacaauau

SEQ ID NO: 4028525 - RNA, 23 nt, Staphylococcus aureus subsp. aureus MW2
guugacguuguggcaugcugaau

SEQ ID NO: 4028526 - RNA, 14 nt, Staphylococcus aureus subsp. aureus MW2
guugauaacuauuu

SEQ ID NO: 4028527 - RNA, 21 nt, Staphylococcus aureus subsp. aureus MW2
guugaucuuugacauguguua

SEQ ID NO: 4028528 - RNA, 16 nt, Staphylococcus aureus subsp. aureus MW2
guugauguguugcauu

SEQ ID NO: 4028529 - RNA, 16 nt, Staphylococcus aureus subsp. aureus MW2
guuuguuucuaaauuc

SEQ ID NO: 4028530 - RNA, 18 nt, Staphylococcus aureus subsp. aureus MW2
guuuuaaacuuauuaauu

SEQ ID NO: 4028531 - RNA, 19 nt, Staphylococcus aureus subsp. aureus MW2
guuuuaagacuuuaaaauu

SEQ ID NO: 4028532 - RNA, 14 nt, Staphylococcus aureus subsp. aureus MW2
guuuuaaucuuauu

SEQ ID NO: 4028533 - RNA, 23 nt, Staphylococcus aureus subsp. aureus MW2
guuuuacaugauuaaugaugcga

SEQ ID NO: 4028534 - RNA, 22 nt, Staphylococcus aureus subsp. aureus MW2
guuuuaccccuguugaauauac

SEQ ID NO: 4028535 - RNA, 15 nt, Staphylococcus aureus subsp. aureus MW2
guuuuauaauucgga

SEQ ID NO: 4028536 - RNA, 23 nt, Staphylococcus aureus subsp. aureus MW2
guuuuauauuuauuuuauaauaa

SEQ ID NO: 4028537 - RNA, 17 nt, Staphylococcus aureus subsp. aureus MW2
guuuuauuaaugaagcu

SEQ ID NO: 4028538 - RNA, 18 nt, Staphylococcus aureus subsp. aureus MW2
guuuuauuaaugaagcug

SEQ ID NO: 4028539 - RNA, 12 nt, Staphylococcus aureus subsp. aureus MW2
guuuuauucaau

SEQ ID NO: 4028540 - RNA, 18 nt, Staphylococcus aureus subsp. aureus MW2
guuuuauucgauaauaua

SEQ ID NO: 4028541 - RNA, 19 nt, Staphylococcus aureus subsp. aureus MW2
guuuuauucgauaauauaa

SEQ ID NO: 4028542 - RNA, 15 nt, Staphylococcus aureus subsp. aureus MW2
guuuuauuuauaaac

SEQ ID NO: 4028543 - RNA, 13 nt, Staphylococcus aureus subsp. aureus MW2
guuuuauuuuugg

SEQ ID NO: 4028544 - RNA, 20 nt, Staphylococcus aureus subsp. aureus MW2
guuuuauuuuugucaucaug

SEQ ID NO: 4028545 - RNA, 17 nt, Staphylococcus aureus subsp. aureus MW2
guuuucacuguuuuauc

SEQ ID NO: 4028546 - RNA, 20 nt, Staphylococcus aureus subsp. aureus MW2
guuuucacuguuuuaucuac

SEQ ID NO: 4028547 - RNA, 22 nt, Staphylococcus aureus subsp. aureus MW2
guuuucacuguuuuaucuacag

SEQ ID NO: 4028548 - RNA, 16 nt, Staphylococcus aureus subsp. aureus MW2
guuuucuaauuguuuu

SEQ ID NO: 4028549 - RNA, 12 nt, Staphylococcus aureus subsp. aureus MW2
guuuugagagau

SEQ ID NO: 4028550 - RNA, 12 nt, Staphylococcus aureus subsp. aureus MW2
guuuugcuaacc

SEQ ID NO: 4028551 - RNA, 14 nt, Staphylococcus aureus subsp. aureus MW2
guuuugguacauaa

SEQ ID NO: 4028552 - RNA, 15 nt, Staphylococcus aureus subsp. aureus MW2
guuuugguacauaaa

SEQ ID NO: 4028553 - RNA, 22 nt, Staphylococcus aureus subsp. aureus MW2
guuuugguuguucuuuuuguug

SEQ ID NO: 4028554 - RNA, 13 nt, Staphylococcus aureus subsp. aureus MW2
guuuuguauucag

SEQ ID NO: 4028555 - RNA, 16 nt, Staphylococcus aureus subsp. aureus MW2
guuuuguguauuuauu

SEQ ID NO: 4028556 - RNA, 14 nt, Staphylococcus aureus subsp. aureus MW2
guuuuuaaauaauc

SEQ ID NO: 4028557 - RNA, 20 nt, Staphylococcus aureus subsp. aureus MW2
guuuuucaucauuaaaauca

SEQ ID NO: 4028558 - RNA, 13 nt, Staphylococcus aureus subsp. aureus MW2
guuuuugaaaugu

SEQ ID NO: 4028559 - RNA, 18 nt, Staphylococcus aureus subsp. aureus MW2
guuuuuguggaaaauuga

SEQ ID NO: 4028560 - RNA, 18 nt, Staphylococcus aureus subsp. aureus MW2
guuuuuugauuaguaaau

SEQ ID NO: 4028561 - RNA, 21 nt, Staphylococcus aureus subsp. aureus MW2
guuuuuugauuaguaaauaua

SEQ ID NO: 4028562 - RNA, 12 nt, Staphylococcus aureus subsp. aureus MW2
guuuuuuuaaau

SEQ ID NO: 4028563 - RNA, 22 nt, Staphylococcus aureus subsp. aureus MW2
guuuuuuuagcuauagaaauga

SEQ ID NO: 4028564 - RNA, 23 nt, Staphylococcus aureus subsp. aureus MW2
uaaaaaaacgucuuuccauuuau

SEQ ID NO: 4028565 - RNA, 19 nt, Staphylococcus aureus subsp. aureus MW2
uaaaaaaauacucccuuca

SEQ ID NO: 4028566 - RNA, 20 nt, Staphylococcus aureus subsp. aureus MW2
uaaaaaaauacucccuucaa

SEQ ID NO: 4028567 - RNA, 14 nt, Staphylococcus aureus subsp. aureus MW2
uaaaaaaauuaaug

SEQ ID NO: 4028568 - RNA, 16 nt, Staphylococcus aureus subsp. aureus MW2
uaaaaaacaaauguuu

SEQ ID NO: 4028569 - RNA, 16 nt, Staphylococcus aureus subsp. aureus MW2
uaaaaaacgguacaga

SEQ ID NO: 4028570 - RNA, 18 nt, Staphylococcus aureus subsp. aureus MW2
uaaaaaaguugauuaaaa

SEQ ID NO: 4028571 - RNA, 19 nt, Staphylococcus aureus subsp. aureus MW2
uaaaaaaguugauuaaaag

SEQ ID NO: 4028572 - RNA, 13 nt, Staphylococcus aureus subsp. aureus MW2
uaaaaaaugaaug

SEQ ID NO: 4028573 - RNA, 18 nt, Staphylococcus aureus subsp. aureus MW2
uaaaaaauuuaaauaaua

SEQ ID NO: 4028574 - RNA, 19 nt, Staphylococcus aureus subsp. aureus MW2
uaaaaaauuugcaugaaaa

SEQ ID NO: 4028575 - RNA, 15 nt, Staphylococcus aureus subsp. aureus MW2
uaaaaacaaaagaaa

SEQ ID NO: 4028576 - RNA, 23 nt, Staphylococcus aureus subsp. aureus MW2
uaaaaacaaagguuuguaagaca

SEQ ID NO: 4028577 - RNA, 17 nt, Staphylococcus aureus subsp. aureus MW2
uaaaaacagcagugaag

SEQ ID NO: 4028578 - RNA, 15 nt, Staphylococcus aureus subsp. aureus MW2
uaaaaacguucaauc

SEQ ID NO: 4028579 - RNA, 17 nt, Staphylococcus aureus subsp. aureus MW2
uaaaaacguucaaucgu

SEQ ID NO: 4028580 - RNA, 19 nt, Staphylococcus aureus subsp. aureus MW2
uaaaaagaagaucccucaa

SEQ ID NO: 4028581 - RNA, 18 nt, Staphylococcus aureus subsp. aureus MW2
uaaaaagagaugggcuaa

SEQ ID NO: 4028582 - RNA, 18 nt, Staphylococcus aureus subsp. aureus MW2
uaaaaagagguuuucauu

SEQ ID NO: 4028583 - RNA, 16 nt, Staphylococcus aureus subsp. aureus MW2
uaaaaagauauaagaa

SEQ ID NO: 4028584 - RNA, 24 nt, Staphylococcus aureus subsp. aureus MW2
uaaaaagcguaaggaauuacacuu

SEQ ID NO: 4028585 - RNA, 21 nt, Staphylococcus aureus subsp. aureus MW2
uaaaaagguacuaauguuaau

SEQ ID NO: 4028586 - RNA, 20 nt, Staphylococcus aureus subsp. aureus MW2
uaaaaagugguuaauaacag

SEQ ID NO: 4028587 - RNA, 15 nt, Staphylococcus aureus subsp. aureus MW2
uaaaaaguuauuuaa

SEQ ID NO: 4028588 - RNA, 20 nt, Staphylococcus aureus subsp. aureus MW2
uaaaaauacauaauaaaaag

SEQ ID NO: 4028589 - RNA, 15 nt, Staphylococcus aureus subsp. aureus MW2
uaaaaauagaaaaaa

SEQ ID NO: 4028590 - RNA, 16 nt, Staphylococcus aureus subsp. aureus MW2
uaaaaauagaaaaaac

SEQ ID NO: 4028591 - RNA, 17 nt, Staphylococcus aureus subsp. aureus MW2
uaaaaauagaaaaaaca

SEQ ID NO: 4028592 - RNA, 14 nt, Staphylococcus aureus subsp. aureus MW2
uaaaaauaguaaag

SEQ ID NO: 4028593 - RNA, 20 nt, Staphylococcus aureus subsp. aureus MW2
uaaaaauaguucuuuaaauu

SEQ ID NO: 4028594 - RNA, 14 nt, Staphylococcus aureus subsp. aureus MW2
uaaaaaucaaagag

SEQ ID NO: 4028595 - RNA, 19 nt, Staphylococcus aureus subsp. aureus MW2
uaaaaaucauaaauaacac

SEQ ID NO: 4028596 - RNA, 19 nt, Staphylococcus aureus subsp. aureus MW2
uaaaaauccacacauuaag

SEQ ID NO: 4028597 - RNA, 15 nt, Staphylococcus aureus subsp. aureus MW2
uaaaaauccucacaa

SEQ ID NO: 4028598 - RNA, 19 nt, Staphylococcus aureus subsp. aureus MW2
uaaaaaucuacauaugaaa

SEQ ID NO: 4028599 - RNA, 20 nt, Staphylococcus aureus subsp. aureus MW2
uaaaaaucuacauaugaaaa

SEQ ID NO: 4028600 - RNA, 16 nt, Staphylococcus aureus subsp. aureus MW2
uaaaaaucucaaaauu

SEQ ID NO: 4028601 - RNA, 16 nt, Staphylococcus aureus subsp. aureus MW2
uaaaaaucuuaugaug

SEQ ID NO: 4028602 - RNA, 18 nt, Staphylococcus aureus subsp. aureus MW2
uaaaaaucuuaugauguc

SEQ ID NO: 4028603 - RNA, 15 nt, Staphylococcus aureus subsp. aureus MW2
uaaaaauguauuaaa

SEQ ID NO: 4028604 - RNA, 22 nt, Staphylococcus aureus subsp. aureus MW2
uaaaaauguauuaaauaugcac

SEQ ID NO: 4028605 - RNA, 13 nt, Staphylococcus aureus subsp. aureus MW2
uaaaaauucugga

SEQ ID NO: 4028606 - RNA, 16 nt, Staphylococcus aureus subsp. aureus MW2
uaaaaauugcaaugcu

SEQ ID NO: 4028607 - RNA, 22 nt, Staphylococcus aureus subsp. aureus MW2
uaaaaauugcaaugcuaucaug

SEQ ID NO: 4028608 - RNA, 15 nt, Staphylococcus aureus subsp. aureus MW2
uaaaaauuuaugucu

SEQ ID NO: 4028609 - RNA, 21 nt, Staphylococcus aureus subsp. aureus MW2
uaaaaauuucgccucaucuaa

SEQ ID NO: 4028610 - RNA, 23 nt, Staphylococcus aureus subsp. aureus MW2
uaaaaauuucgccucaucuaauu

SEQ ID NO: 4028611 - RNA, 22 nt, Staphylococcus aureus subsp. aureus MW2
uaaaacaaaaccaaaauacuga

SEQ ID NO: 4028612 - RNA, 20 nt, Staphylococcus aureus subsp. aureus MW2
uaaaacaaauucauauuaac

SEQ ID NO: 4028613 - RNA, 21 nt, Staphylococcus aureus subsp. aureus MW2
uaaaacaaauucauauuaacu

SEQ ID NO: 4028614 - RNA, 13 nt, Staphylococcus aureus subsp. aureus MW2
uaaaacaauaaua

SEQ ID NO: 4028615 - RNA, 14 nt, Staphylococcus aureus subsp. aureus MW2
uaaaacaauaauaa

SEQ ID NO: 4028616 - RNA, 15 nt, Staphylococcus aureus subsp. aureus MW2
uaaaacaaugauuaa

SEQ ID NO: 4028617 - RNA, 14 nt, Staphylococcus aureus subsp. aureus MW2
uaaaauuaaauaau

SEQ ID NO: 4028618 - RNA, 17 nt, Staphylococcus aureus subsp. aureus MW2
uaaaauuaaccauuucu

SEQ ID NO: 4028619 - RNA, 17 nt, Staphylococcus aureus subsp. aureus MW2
uaaaauuaacuuaaaau

SEQ ID NO: 4028620 - RNA, 22 nt, Staphylococcus aureus subsp. aureus MW2
uaaaauuaacuuaaaauuuaaa

SEQ ID NO: 4028621 - RNA, 22 nt, Staphylococcus aureus subsp. aureus MW2
uaaaauuacgcaaagaaaaaca

SEQ ID NO: 4028622 - RNA, 20 nt, Staphylococcus aureus subsp. aureus MW2
uaaaauuacuugaauauuau

SEQ ID NO: 4028623 - RNA, 12 nt, Staphylococcus aureus subsp. aureus MW2
uaaaauuaucaa

SEQ ID NO: 4028624 - RNA, 23 nt, Staphylococcus aureus subsp. aureus MW2
uaaaauuaugauuauuuuucuca

SEQ ID NO: 4028625 - RNA, 11 nt, Staphylococcus aureus subsp. aureus MW2
uaaaauucuuu

SEQ ID NO: 4028626 - RNA, 14 nt, Staphylococcus aureus subsp. aureus MW2
uaaaauucuuucag

SEQ ID NO: 4028627 - RNA, 22 nt, Staphylococcus aureus subsp. aureus MW2
uaaaauugccaguaucucuuuu

SEQ ID NO: 4028628 - RNA, 16 nt, Staphylococcus aureus subsp. aureus MW2
uaaaauuguauagaau

SEQ ID NO: 4028629 - RNA, 17 nt, Staphylococcus aureus subsp. aureus MW2
uaaaauuuaaaacaaug

SEQ ID NO: 4028630 - RNA, 15 nt, Staphylococcus aureus subsp. aureus MW2
uaaaauuuaaauauu

SEQ ID NO: 4028631 - RNA, 18 nt, Staphylococcus aureus subsp. aureus MW2
uaaaauuuaaauauugaa

SEQ ID NO: 4028632 - RNA, 20 nt, Staphylococcus aureus subsp. aureus MW2
uaaaauuucugcuucuuuua

SEQ ID NO: 4028633 - RNA, 18 nt, Staphylococcus aureus subsp. aureus MW2
uaaaauuuguaauuuaaa

SEQ ID NO: 4028634 - RNA, 16 nt, Staphylococcus aureus subsp. aureus MW2
uaaaauuuguuaauuu

SEQ ID NO: 4028635 - RNA, 21 nt, Staphylococcus aureus subsp. aureus MW2
uaaaauuuucguguuaauaac

SEQ ID NO: 4028636 - RNA, 18 nt, Staphylococcus aureus subsp. aureus MW2
uaaaauuuugaagaagug

SEQ ID NO: 4028637 - RNA, 14 nt, Staphylococcus aureus subsp. aureus MW2
uaaacaaaaauaag

SEQ ID NO: 4028638 - RNA, 17 nt, Staphylococcus aureus subsp. aureus MW2
uaaacaaaaggcuggga

SEQ ID NO: 4028639 - RNA, 23 nt, Staphylococcus aureus subsp. aureus MW2
uaaacaaagcuauguaugaguca

SEQ ID NO: 4028640 - RNA, 14 nt, Staphylococcus aureus subsp. aureus MW2
uaaacaacauacag

SEQ ID NO: 4028641 - RNA, 22 nt, Staphylococcus aureus subsp. aureus MW2
uaaacaacaucgauuuaucauu

SEQ ID NO: 4028642 - RNA, 21 nt, Staphylococcus aureus subsp. aureus MW2
uaaacaacugagucaaaguca

SEQ ID NO: 4028643 - RNA, 23 nt, Staphylococcus aureus subsp. aureus MW2
uaaacaacugagucaaagucauu

SEQ ID NO: 4028644 - RNA, 21 nt, Staphylococcus aureus subsp. aureus MW2
uaaacaacugcaauagcuaua

SEQ ID NO: 4028645 - RNA, 14 nt, Staphylococcus aureus subsp. aureus MW2
uaaacaagcaucau

SEQ ID NO: 4028646 - RNA, 14 nt, Staphylococcus aureus subsp. aureus MW2
uaaacaaguugaua

SEQ ID NO: 4028647 - RNA, 19 nt, Staphylococcus aureus subsp. aureus MW2
uaaacaaguugauaacuau

SEQ ID NO: 4028648 - RNA, 19 nt, Staphylococcus aureus subsp. aureus MW2
uaaacaauuccccaaagcc

SEQ ID NO: 4028649 - RNA, 15 nt, Staphylococcus aureus subsp. aureus MW2
uaaacacaucuaugu

SEQ ID NO: 4028650 - RNA, 17 nt, Staphylococcus aureus subsp. aureus MW2
uaaacacccaauaauug

SEQ ID NO: 4028651 - RNA, 17 nt, Staphylococcus aureus subsp. aureus MW2
uaaacacuauaaaagcc

SEQ ID NO: 4028652 - RNA, 18 nt, Staphylococcus aureus subsp. aureus MW2
uaaacacuauaaaagcca

SEQ ID NO: 4028653 - RNA, 23 nt, Staphylococcus aureus subsp. aureus MW2
uaaacacuauaaaagccaugaua

SEQ ID NO: 4028654 - RNA, 15 nt, Staphylococcus aureus subsp. aureus MW2
uaaacaguuuaauuc

SEQ ID NO: 4028655 - RNA, 15 nt, Staphylococcus aureus subsp. aureus MW2
uaaacauaaaaauau

SEQ ID NO: 4028656 - RNA, 14 nt, Staphylococcus aureus subsp. aureus MW2
uaaacauaacauga

SEQ ID NO: 4028657 - RNA, 16 nt, Staphylococcus aureus subsp. aureus MW2
uaaacauaucaucaua

SEQ ID NO: 4028658 - RNA, 17 nt, Staphylococcus aureus subsp. aureus MW2
uaaacaucuucuucauc

SEQ ID NO: 4028659 - RNA, 14 nt, Staphylococcus aureus subsp. aureus MW2
uaaacaugaacaau

SEQ ID NO: 4028660 - RNA, 18 nt, Staphylococcus aureus subsp. aureus MW2
uaaacaugaacaaucaga

SEQ ID NO: 4028661 - RNA, 15 nt, Staphylococcus aureus subsp. aureus MW2
uaaacauguacaauu

SEQ ID NO: 4028662 - RNA, 21 nt, Staphylococcus aureus subsp. aureus MW2
uaaaccaaaucggaauaaaau

SEQ ID NO: 4028663 - RNA, 22 nt, Staphylococcus aureus subsp. aureus MW2
uaaaccaaaucggaauaaaaua

SEQ ID NO: 4028664 - RNA, 23 nt, Staphylococcus aureus subsp. aureus MW2
uaaaccaaucaauaguuuauaau

SEQ ID NO: 4028665 - RNA, 15 nt, Staphylococcus aureus subsp. aureus MW2
uaaaccaaugauugu

SEQ ID NO: 4028666 - RNA, 20 nt, Staphylococcus aureus subsp. aureus MW2
uaaaccacgcacaucuaagu

SEQ ID NO: 4028667 - RNA, 18 nt, Staphylococcus aureus subsp. aureus MW2
uaaaccagcuaaaccauc

SEQ ID NO: 4028668 - RNA, 18 nt, Staphylococcus aureus subsp. aureus MW2
uaaaccaguuuaguauua

SEQ ID NO: 4028669 - RNA, 21 nt, Staphylococcus aureus subsp. aureus MW2
uaaaccaucugugucagcauu

SEQ ID NO: 4028670 - RNA, 18 nt, Staphylococcus aureus subsp. aureus MW2
uaaaccgauuaauauaau

SEQ ID NO: 4028671 - RNA, 21 nt, Staphylococcus aureus subsp. aureus MW2
uaaaccgauuguuucaccagc

SEQ ID NO: 4028672 - RNA, 17 nt, Staphylococcus aureus subsp. aureus MW2
uaaaccggcacuuauuu

SEQ ID NO: 4028673 - RNA, 20 nt, Staphylococcus aureus subsp. aureus MW2
uaaaccguauagucauuaca

SEQ ID NO: 4028674 - RNA, 16 nt, Staphylococcus aureus subsp. aureus MW2
uaaaccuaaugauaau

SEQ ID NO: 4028675 - RNA, 22 nt, Staphylococcus aureus subsp. aureus MW2
uaaaccuacuaauauauuaauu

SEQ ID NO: 4028676 - RNA, 14 nt, Staphylococcus aureus subsp. aureus MW2
uaaaccucaacauu

SEQ ID NO: 4028677 - RNA, 18 nt, Staphylococcus aureus subsp. aureus MW2
uaaaccucuaaauaaaau

SEQ ID NO: 4028678 - RNA, 19 nt, Staphylococcus aureus subsp. aureus MW2
uaaaccucuaaauaaaauu

SEQ ID NO: 4028679 - RNA, 22 nt, Staphylococcus aureus subsp. aureus MW2
uaaaccucuaaauaaaauuaaa

SEQ ID NO: 4028680 - RNA, 11 nt, Staphylococcus aureus subsp. aureus MW2
uaaaccuguua

SEQ ID NO: 4028681 - RNA, 15 nt, Staphylococcus aureus subsp. aureus MW2
uaaaccuuaauaaug

SEQ ID NO: 4028682 - RNA, 18 nt, Staphylococcus aureus subsp. aureus MW2
uaaacgacaugaaaguug

SEQ ID NO: 4028683 - RNA, 13 nt, Staphylococcus aureus subsp. aureus MW2
uaaacgaucaacu

SEQ ID NO: 4028684 - RNA, 21 nt, Staphylococcus aureus subsp. aureus MW2
uaaacgcaauacgaauaucug

SEQ ID NO: 4028685 - RNA, 17 nt, Staphylococcus aureus subsp. aureus MW2
uaaacguacauuuuuau

SEQ ID NO: 4028686 - RNA, 19 nt, Staphylococcus aureus subsp. aureus MW2
uaaacguguacuucaauug

SEQ ID NO: 4028687 - RNA, 18 nt, Staphylococcus aureus subsp. aureus MW2
uaaacguugcaccuauuu

SEQ ID NO: 4028688 - RNA, 14 nt, Staphylococcus aureus subsp. aureus MW2
uaaacuaguaauag

SEQ ID NO: 4028689 - RNA, 19 nt, Staphylococcus aureus subsp. aureus MW2
uaaacuaguaauagaauag

SEQ ID NO: 4028690 - RNA, 16 nt, Staphylococcus aureus subsp. aureus MW2
uaaacuauaauaauug

SEQ ID NO: 4028691 - RNA, 13 nt, Staphylococcus aureus subsp. aureus MW2
uaaacuauuaaau

SEQ ID NO: 4028692 - RNA, 15 nt, Staphylococcus aureus subsp. aureus MW2
uaaacuauuaaauca

SEQ ID NO: 4028693 - RNA, 20 nt, Staphylococcus aureus subsp. aureus MW2
uaaacucauaauuuucuauu

SEQ ID NO: 4028694 - RNA, 15 nt, Staphylococcus aureus subsp. aureus MW2
uaaacugaucaugau

SEQ ID NO: 4028695 - RNA, 15 nt, Staphylococcus aureus subsp. aureus MW2
uaaacuguaaacauu

SEQ ID NO: 4028696 - RNA, 15 nt, Staphylococcus aureus subsp. aureus MW2
uaaacuuaaaagaga

SEQ ID NO: 4028697 - RNA, 13 nt, Staphylococcus aureus subsp. aureus MW2
uaaacuuaagaau

SEQ ID NO: 4028698 - RNA, 13 nt, Staphylococcus aureus subsp. aureus MW2
uaaacuuauuaau

SEQ ID NO: 4028699 - RNA, 15 nt, Staphylococcus aureus subsp. aureus MW2
uaaacuucuuuucuu

SEQ ID NO: 4028700 - RNA, 14 nt, Staphylococcus aureus subsp. aureus MW2
uaaacuuuaugaaa

SEQ ID NO: 4028701 - RNA, 15 nt, Staphylococcus aureus subsp. aureus MW2
uaaacuuuaugaaaa

SEQ ID NO: 4028702 - RNA, 19 nt, Staphylococcus aureus subsp. aureus MW2
uaaagaaacaugauugaaa

SEQ ID NO: 4028703 - RNA, 20 nt, Staphylococcus aureus subsp. aureus MW2
uaaagaacuauguucaauuu

SEQ ID NO: 4028704 - RNA, 19 nt, Staphylococcus aureus subsp. aureus MW2
uaaagaaugauuuauaaaa

SEQ ID NO: 4028705 - RNA, 17 nt, Staphylococcus aureus subsp. aureus MW2
uaaauacgccaaauacu

SEQ ID NO: 4028706 - RNA, 18 nt, Staphylococcus aureus subsp. aureus MW2
uaaauacgccaaauacua

SEQ ID NO: 4028707 - RNA, 22 nt, Staphylococcus aureus subsp. aureus MW2
uaaauacucauguaacguaaaa

SEQ ID NO: 4028708 - RNA, 21 nt, Staphylococcus aureus subsp. aureus MW2
uaaauacuugcucuaauucaa

SEQ ID NO: 4028709 - RNA, 21 nt, Staphylococcus aureus subsp. aureus MW2
uaaauagaagaaaagaacauu

SEQ ID NO: 4028710 - RNA, 18 nt, Staphylococcus aureus subsp. aureus MW2
uaaauagauaauauauag

SEQ ID NO: 4028711 - RNA, 18 nt, Staphylococcus aureus subsp. aureus MW2
uaaauagcuucuuaaauc

SEQ ID NO: 4028712 - RNA, 19 nt, Staphylococcus aureus subsp. aureus MW2
uaaauagcuucuuaaauca

SEQ ID NO: 4028713 - RNA, 14 nt, Staphylococcus aureus subsp. aureus MW2
uaaauagcuuuacu

SEQ ID NO: 4028714 - RNA, 21 nt, Staphylococcus aureus subsp. aureus MW2
uaaauaggguaauagaucuau

SEQ ID NO: 4028715 - RNA, 16 nt, Staphylococcus aureus subsp. aureus MW2
uaaauaguuuuucaua

SEQ ID NO: 4028716 - RNA, 19 nt, Staphylococcus aureus subsp. aureus MW2
uaaauauaaaccagcugau

SEQ ID NO: 4028717 - RNA, 19 nt, Staphylococcus aureus subsp. aureus MW2
uaaauauaauagaaauaau

SEQ ID NO: 4028718 - RNA, 16 nt, Staphylococcus aureus subsp. aureus MW2
uaaauauacuucuauu

SEQ ID NO: 4028719 - RNA, 19 nt, Staphylococcus aureus subsp. aureus MW2
uaaauauacuucuauuaaa

SEQ ID NO: 4028720 - RNA, 19 nt, Staphylococcus aureus subsp. aureus MW2
uaaauauacuuuuauagaa

SEQ ID NO: 4028721 - RNA, 15 nt, Staphylococcus aureus subsp. aureus MW2
uaaauauaguaauaa

SEQ ID NO: 4028722 - RNA, 17 nt, Staphylococcus aureus subsp. aureus MW2
uaaauauaguaauaaaa

SEQ ID NO: 4028723 - RNA, 12 nt, Staphylococcus aureus subsp. aureus MW2
uaaauaucaauu

SEQ ID NO: 4028724 - RNA, 20 nt, Staphylococcus aureus subsp. aureus MW2
uaaauaucuuaguauguuca

SEQ ID NO: 4028725 - RNA, 21 nt, Staphylococcus aureus subsp. aureus MW2
uaaauaugacgcgugaauuaa

SEQ ID NO: 4028726 - RNA, 14 nt, Staphylococcus aureus subsp. aureus MW2
uaaauauuauaaaa

SEQ ID NO: 4028727 - RNA, 15 nt, Staphylococcus aureus subsp. aureus MW2
uaaauauuauaaaaa

SEQ ID NO: 4028728 - RNA, 13 nt, Staphylococcus aureus subsp. aureus MW2
uaaauauugaaga

SEQ ID NO: 4028729 - RNA, 19 nt, Staphylococcus aureus subsp. aureus MW2
uaaauauugauauaaaaaa

SEQ ID NO: 4028730 - RNA, 19 nt, Staphylococcus aureus subsp. aureus MW2
uaaauauuggaauacucuu

SEQ ID NO: 4028731 - RNA, 14 nt, Staphylococcus aureus subsp. aureus MW2
uaaauauuuagauu

SEQ ID NO: 4028732 - RNA, 15 nt, Staphylococcus aureus subsp. aureus MW2
uaaauauuuuuuaau

SEQ ID NO: 4028733 - RNA, 16 nt, Staphylococcus aureus subsp. aureus MW2
uaaaucaaacuuuuca

SEQ ID NO: 4028734 - RNA, 15 nt, Staphylococcus aureus subsp. aureus MW2
uaaaucaaagaguaa

SEQ ID NO: 4028735 - RNA, 21 nt, Staphylococcus aureus subsp. aureus MW2
uaaaucaaagaugacuuggcc

SEQ ID NO: 4028736 - RNA, 13 nt, Staphylococcus aureus subsp. aureus MW2
uaaaucaagaaau

SEQ ID NO: 4028737 - RNA, 17 nt, Staphylococcus aureus subsp. aureus MW2
uaaaucaagaaauguua

SEQ ID NO: 4028738 - RNA, 16 nt, Staphylococcus aureus subsp. aureus MW2
uaaaucauacgagaaa

SEQ ID NO: 4028739 - RNA, 23 nt, Staphylococcus aureus subsp. aureus MW2
uaaaucauagucgguuauuacaa

SEQ ID NO: 4028740 - RNA, 22 nt, Staphylococcus aureus subsp. aureus MW2
uaaaucaucuucaguuaguuuu

SEQ ID NO: 4028741 - RNA, 18 nt, Staphylococcus aureus subsp. aureus MW2
uaaaucaugaaauuaaaa

SEQ ID NO: 4028742 - RNA, 19 nt, Staphylococcus aureus subsp. aureus MW2
uaaaucaugaaauuaaaaa

SEQ ID NO: 4028743 - RNA, 21 nt, Staphylococcus aureus subsp. aureus MW2
uaaaucaugaaauuaaaaaca

SEQ ID NO: 4028744 - RNA, 14 nt, Staphylococcus aureus subsp. aureus MW2
uaaaucaugacaua

SEQ ID NO: 4028745 - RNA, 14 nt, Staphylococcus aureus subsp. aureus MW2
uaaaucauucuuua

SEQ ID NO: 4028746 - RNA, 16 nt, Staphylococcus aureus subsp. aureus MW2
uaaaucauuucguuca

SEQ ID NO: 4028747 - RNA, 23 nt, Staphylococcus aureus subsp. aureus MW2
uaaauccaaugaugaauuguaaa

SEQ ID NO: 4028748 - RNA, 21 nt, Staphylococcus aureus subsp. aureus MW2
uaaauccgcuuguucaacuaa

SEQ ID NO: 4028749 - RNA, 17 nt, Staphylococcus aureus subsp. aureus MW2
uaaaucgauaaaaugua

SEQ ID NO: 4028750 - RNA, 19 nt, Staphylococcus aureus subsp. aureus MW2
uaaaucgugcccauaugau

SEQ ID NO: 4028751 - RNA, 16 nt, Staphylococcus aureus subsp. aureus MW2
uaaaucuauacuuuau

SEQ ID NO: 4028752 - RNA, 17 nt, Staphylococcus aureus subsp. aureus MW2
uaaaucuauacuuuauc

SEQ ID NO: 4028753 - RNA, 21 nt, Staphylococcus aureus subsp. aureus MW2
uaaaucuauacuuuaucuauu

SEQ ID NO: 4028754 - RNA, 16 nt, Staphylococcus aureus subsp. aureus MW2
uaaaucugauucauua

SEQ ID NO: 4028755 - RNA, 20 nt, Staphylococcus aureus subsp. aureus MW2
uaaaucuguacuucuaauuu

SEQ ID NO: 4028756 - RNA, 16 nt, Staphylococcus aureus subsp. aureus MW2
uaaaucuguuuaaauu

SEQ ID NO: 4028757 - RNA, 19 nt, Staphylococcus aureus subsp. aureus MW2
uaaaucuguuuaaauuuaa

SEQ ID NO: 4028758 - RNA, 20 nt, Staphylococcus aureus subsp. aureus MW2
uaaaucuguuuaaauuuaaa

SEQ ID NO: 4028759 - RNA, 22 nt, Staphylococcus aureus subsp. aureus MW2
uaaaucuuuauaaaauuguaau

SEQ ID NO: 4028760 - RNA, 13 nt, Staphylococcus aureus subsp. aureus MW2
uaaaucuuugauu

SEQ ID NO: 4028761 - RNA, 20 nt, Staphylococcus aureus subsp. aureus MW2
uaaaucuuugauuaugaacu

SEQ ID NO: 4028762 - RNA, 20 nt, Staphylococcus aureus subsp. aureus MW2
uaaaucuuuuacuaaaugaa

SEQ ID NO: 4028763 - RNA, 23 nt, Staphylococcus aureus subsp. aureus MW2
uaaaucuuuuagcuuuuguaaag

SEQ ID NO: 4028764 - RNA, 22 nt, Staphylococcus aureus subsp. aureus MW2
uaaaugaaagcaccuaaaauag

SEQ ID NO: 4028765 - RNA, 21 nt, Staphylococcus aureus subsp. aureus MW2
uaaaugaaauaggugcuugua

SEQ ID NO: 4028766 - RNA, 16 nt, Staphylococcus aureus subsp. aureus MW2
uaaaugaauuauuuaa

SEQ ID NO: 4028767 - RNA, 17 nt, Staphylococcus aureus subsp. aureus MW2
uaaaugaauuauuuaaa

SEQ ID NO: 4028768 - RNA, 16 nt, Staphylococcus aureus subsp. aureus MW2
uaaaugacuucacauu

SEQ ID NO: 4028769 - RNA, 21 nt, Staphylococcus aureus subsp. aureus MW2
uaaaugacuucacauuuaucc

SEQ ID NO: 4028770 - RNA, 17 nt, Staphylococcus aureus subsp. aureus MW2
uaaaugaugcaguaaaa

SEQ ID NO: 4028771 - RNA, 18 nt, Staphylococcus aureus subsp. aureus MW2
uaaaugaugcaguaaaac

SEQ ID NO: 4028772 - RNA, 14 nt, Staphylococcus aureus subsp. aureus MW2
uaaaugauuaauaa

SEQ ID NO: 4028773 - RNA, 18 nt, Staphylococcus aureus subsp. aureus MW2
uaaaugauuaauaacaua

SEQ ID NO: 4028774 - RNA, 12 nt, Staphylococcus aureus subsp. aureus MW2
uaaaugauuuaa

SEQ ID NO: 4028775 - RNA, 16 nt, Staphylococcus aureus subsp. aureus MW2
uaaaugauuuaauaaa

SEQ ID NO: 4028776 - RNA, 15 nt, Staphylococcus aureus subsp. aureus MW2
uaaaugauuucacuu

SEQ ID NO: 4028777 - RNA, 22 nt, Staphylococcus aureus subsp. aureus MW2
uaaaugauuucuucauuaucaa

SEQ ID NO: 4028778 - RNA, 16 nt, Staphylococcus aureus subsp. aureus MW2
uaaaugcaauacauua

SEQ ID NO: 4028779 - RNA, 17 nt, Staphylococcus aureus subsp. aureus MW2
uaaaugcacuagcaaca

SEQ ID NO: 4028780 - RNA, 21 nt, Staphylococcus aureus subsp. aureus MW2
uaaaugcacuagcaacaucuu

SEQ ID NO: 4028781 - RNA, 17 nt, Staphylococcus aureus subsp. aureus MW2
uaaaugcauaauauauu

SEQ ID NO: 4028782 - RNA, 20 nt, Staphylococcus aureus subsp. aureus MW2
uaaaugcauaauauauuaaa

SEQ ID NO: 4028783 - RNA, 20 nt, Staphylococcus aureus subsp. aureus MW2
uaaaugcccaccauguacau

SEQ ID NO: 4028784 - RNA, 18 nt, Staphylococcus aureus subsp. aureus MW2
uaaaugcgguuaaugacu

SEQ ID NO: 4028785 - RNA, 15 nt, Staphylococcus aureus subsp. aureus MW2
uaaaugcuaaaagua

SEQ ID NO: 4028786 - RNA, 21 nt, Staphylococcus aureus subsp. aureus MW2
uaaaugcuuaauuuguuuuaa

SEQ ID NO: 4028787 - RNA, 22 nt, Staphylococcus aureus subsp. aureus MW2
uaaaugcuuaauuuguuuuaaa

SEQ ID NO: 4028788 - RNA, 16 nt, Staphylococcus aureus subsp. aureus MW2
uaaaugcuuuaaauau

SEQ ID NO: 4028789 - RNA, 19 nt, Staphylococcus aureus subsp. aureus MW2
uaaaugcuuucaaauacac

SEQ ID NO: 4028790 - RNA, 17 nt, Staphylococcus aureus subsp. aureus MW2
uaaauggaaagacguuu

SEQ ID NO: 4028791 - RNA, 18 nt, Staphylococcus aureus subsp. aureus MW2
uaaauggugucgauacuc

SEQ ID NO: 4028792 - RNA, 14 nt, Staphylococcus aureus subsp. aureus MW2
uaaaugguuuucuu

SEQ ID NO: 4028793 - RNA, 14 nt, Staphylococcus aureus subsp. aureus MW2
uaacauaugcaagu

SEQ ID NO: 4028794 - RNA, 22 nt, Staphylococcus aureus subsp. aureus MW2
uaacaucaaauagacaccaaaa

SEQ ID NO: 4028795 - RNA, 19 nt, Staphylococcus aureus subsp. aureus MW2
uaacaucacagaaaauaca

SEQ ID NO: 4028796 - RNA, 22 nt, Staphylococcus aureus subsp. aureus MW2
uaacaucacagaaaauacauuu

SEQ ID NO: 4028797 - RNA, 21 nt, Staphylococcus aureus subsp. aureus MW2
uaacauccccaaaaauagauu

SEQ ID NO: 4028798 - RNA, 20 nt, Staphylococcus aureus subsp. aureus MW2
uaacauccugcuuauuaauu

SEQ ID NO: 4028799 - RNA, 23 nt, Staphylococcus aureus subsp. aureus MW2
uaacaucuguagguuuaauguuu

SEQ ID NO: 4028800 - RNA, 21 nt, Staphylococcus aureus subsp. aureus MW2
uaacaucuucauguaugaagu

SEQ ID NO: 4028801 - RNA, 23 nt, Staphylococcus aureus subsp. aureus MW2
uaacauguauuuaguaucauaau

SEQ ID NO: 4028802 - RNA, 17 nt, Staphylococcus aureus subsp. aureus MW2
uaacauguuuguggcac

SEQ ID NO: 4028803 - RNA, 12 nt, Staphylococcus aureus subsp. aureus MW2
uaacauuagcau

SEQ ID NO: 4028804 - RNA, 13 nt, Staphylococcus aureus subsp. aureus MW2
uaacauuagcaug

SEQ ID NO: 4028805 - RNA, 18 nt, Staphylococcus aureus subsp. aureus MW2
uaacauucuucaaaaaau

SEQ ID NO: 4028806 - RNA, 20 nt, Staphylococcus aureus subsp. aureus MW2
uaacauugaacgauaacaau

SEQ ID NO: 4028807 - RNA, 19 nt, Staphylococcus aureus subsp. aureus MW2
uaacauuuauuuuuucucu

SEQ ID NO: 4028808 - RNA, 21 nt, Staphylococcus aureus subsp. aureus MW2
uaacauuuauuuuuucucuau

SEQ ID NO: 4028809 - RNA, 22 nt, Staphylococcus aureus subsp. aureus MW2
uaacauuucugaugcuagcuuu

SEQ ID NO: 4028810 - RNA, 14 nt, Staphylococcus aureus subsp. aureus MW2
uaacauuugucaua

SEQ ID NO: 4028811 - RNA, 20 nt, Staphylococcus aureus subsp. aureus MW2
uaacauuuguccgauuuauu

SEQ ID NO: 4028812 - RNA, 15 nt, Staphylococcus aureus subsp. aureus MW2
uaacauuuuuuucaa

SEQ ID NO: 4028813 - RNA, 19 nt, Staphylococcus aureus subsp. aureus MW2
uaaccaaaccauuaauaaa

SEQ ID NO: 4028814 - RNA, 19 nt, Staphylococcus aureus subsp. aureus MW2
uaaccaaggagaugauaac

SEQ ID NO: 4028815 - RNA, 22 nt, Staphylococcus aureus subsp. aureus MW2
uaaccaaucaucgcaaaaacau

SEQ ID NO: 4028816 - RNA, 21 nt, Staphylococcus aureus subsp. aureus MW2
uaaccacaucauucgaauacu

SEQ ID NO: 4028817 - RNA, 22 nt, Staphylococcus aureus subsp. aureus MW2
uaaccacaucauucgaauacug

SEQ ID NO: 4028818 - RNA, 23 nt, Staphylococcus aureus subsp. aureus MW2
uaaccaccaucccauuaaaccac

SEQ ID NO: 4028819 - RNA, 18 nt, Staphylococcus aureus subsp. aureus MW2
uaaccacuccuuaaacaa

SEQ ID NO: 4028820 - RNA, 12 nt, Staphylococcus aureus subsp. aureus MW2
uaaccauaguaa

SEQ ID NO: 4028821 - RNA, 18 nt, Staphylococcus aureus subsp. aureus MW2
uaaccauaguaacaaaau

SEQ ID NO: 4028822 - RNA, 18 nt, Staphylococcus aureus subsp. aureus MW2
uaaccaugccagcuucua

SEQ ID NO: 4028823 - RNA, 14 nt, Staphylococcus aureus subsp. aureus MW2
uaaccauuuaaaaa

SEQ ID NO: 4028824 - RNA, 16 nt, Staphylococcus aureus subsp. aureus MW2
uaaccccauuuuaaag

SEQ ID NO: 4028825 - RNA, 17 nt, Staphylococcus aureus subsp. aureus MW2
uaaccccauuuuaaagu

SEQ ID NO: 4028826 - RNA, 16 nt, Staphylococcus aureus subsp. aureus MW2
uaaccccuccuggugc

SEQ ID NO: 4028827 - RNA, 14 nt, Staphylococcus aureus subsp. aureus MW2
uaaccccuucaaaa

SEQ ID NO: 4028828 - RNA, 20 nt, Staphylococcus aureus subsp. aureus MW2
uaacccuaaagcuaaugcaa

SEQ ID NO: 4028829 - RNA, 21 nt, Staphylococcus aureus subsp. aureus MW2
uaacccuaaagcuaaugcaag

SEQ ID NO: 4028830 - RNA, 15 nt, Staphylococcus aureus subsp. aureus MW2
uaaccgaaauauugu

SEQ ID NO: 4028831 - RNA, 21 nt, Staphylococcus aureus subsp. aureus MW2
uaaccgcuucuuuuaaguuau

SEQ ID NO: 4028832 - RNA, 21 nt, Staphylococcus aureus subsp. aureus MW2
uaaccuaauucgccaucuuuu

SEQ ID NO: 4028833 - RNA, 14 nt, Staphylococcus aureus subsp. aureus MW2
uaaccuacuuugau

SEQ ID NO: 4028834 - RNA, 14 nt, Staphylococcus aureus subsp. aureus MW2
uaaccuguuuuuau

SEQ ID NO: 4028835 - RNA, 12 nt, Staphylococcus aureus subsp. aureus MW2
uaaccuuacaua

SEQ ID NO: 4028836 - RNA, 16 nt, Staphylococcus aureus subsp. aureus MW2
uaaccuuuaaaacauc

SEQ ID NO: 4028837 - RNA, 17 nt, Staphylococcus aureus subsp. aureus MW2
uaaccuuuaaaacauca

SEQ ID NO: 4028838 - RNA, 19 nt, Staphylococcus aureus subsp. aureus MW2
uaaccuuuaaaacaucauu

SEQ ID NO: 4028839 - RNA, 23 nt, Staphylococcus aureus subsp. aureus MW2
uaacgaagauuuuguugaaacug

SEQ ID NO: 4028840 - RNA, 17 nt, Staphylococcus aureus subsp. aureus MW2
uaacgacccaaauuaua

SEQ ID NO: 4028841 - RNA, 18 nt, Staphylococcus aureus subsp. aureus MW2
uaacgaguccauuuucuu

SEQ ID NO: 4028842 - RNA, 22 nt, Staphylococcus aureus subsp. aureus MW2
uaacgagugaaaauaagauuau

SEQ ID NO: 4028843 - RNA, 15 nt, Staphylococcus aureus subsp. aureus MW2
uaacgaguuuucagu

SEQ ID NO: 4028844 - RNA, 14 nt, Staphylococcus aureus subsp. aureus MW2
uaacgauagacauu

SEQ ID NO: 4028845 - RNA, 16 nt, Staphylococcus aureus subsp. aureus MW2
uaacgcuuuaaaucau

SEQ ID NO: 4028846 - RNA, 12 nt, Staphylococcus aureus subsp. aureus MW2
uaacggcucgcg

SEQ ID NO: 4028847 - RNA, 14 nt, Staphylococcus aureus subsp. aureus MW2
uaacgguuaauaag

SEQ ID NO: 4028848 - RNA, 19 nt, Staphylococcus aureus subsp. aureus MW2
uaacgguuaauaagcuaau

SEQ ID NO: 4028849 - RNA, 16 nt, Staphylococcus aureus subsp. aureus MW2
uaacguacaauguauu

SEQ ID NO: 4028850 - RNA, 20 nt, Staphylococcus aureus subsp. aureus MW2
uaacgucaacagcauaaaua

SEQ ID NO: 4028851 - RNA, 13 nt, Staphylococcus aureus subsp. aureus MW2
uaacgucauucuu

SEQ ID NO: 4028852 - RNA, 15 nt, Staphylococcus aureus subsp. aureus MW2
uaacguuaauauaau

SEQ ID NO: 4028853 - RNA, 14 nt, Staphylococcus aureus subsp. aureus MW2
uaacguuauucauu

SEQ ID NO: 4028854 - RNA, 15 nt, Staphylococcus aureus subsp. aureus MW2
uaacguucacuuggu

SEQ ID NO: 4028855 - RNA, 15 nt, Staphylococcus aureus subsp. aureus MW2
uaacguucuguuuug

SEQ ID NO: 4028856 - RNA, 20 nt, Staphylococcus aureus subsp. aureus MW2
uaacguugcagagaauauag

SEQ ID NO: 4028857 - RNA, 21 nt, Staphylococcus aureus subsp. aureus MW2
uaacguuucuuuguauaccua

SEQ ID NO: 4028858 - RNA, 13 nt, Staphylococcus aureus subsp. aureus MW2
uaacuaaaauguc

SEQ ID NO: 4028859 - RNA, 21 nt, Staphylococcus aureus subsp. aureus MW2
uaacuaaaaugucuuugaaaa

SEQ ID NO: 4028860 - RNA, 23 nt, Staphylococcus aureus subsp. aureus MW2
uaacuaaaaugucuuugaaaaau

SEQ ID NO: 4028861 - RNA, 17 nt, Staphylococcus aureus subsp. aureus MW2
uaacuaaaccauugaau

SEQ ID NO: 4028862 - RNA, 21 nt, Staphylococcus aureus subsp. aureus MW2
uaacuaaagaacuauguucaa

SEQ ID NO: 4028863 - RNA, 23 nt, Staphylococcus aureus subsp. aureus MW2
uaacuaguauccuuuauaaauaa

SEQ ID NO: 4028864 - RNA, 17 nt, Staphylococcus aureus subsp. aureus MW2
uaacuaguguaaugucu

SEQ ID NO: 4028865 - RNA, 18 nt, Staphylococcus aureus subsp. aureus MW2
uaacuauaaucauuaagu

SEQ ID NO: 4028866 - RNA, 16 nt, Staphylococcus aureus subsp. aureus MW2
uaacuauccauaaagu

SEQ ID NO: 4028867 - RNA, 14 nt, Staphylococcus aureus subsp. aureus MW2
uaacuauuuaauua

SEQ ID NO: 4028868 - RNA, 19 nt, Staphylococcus aureus subsp. aureus MW2
uaacucaugcacuuuauua

SEQ ID NO: 4028869 - RNA, 16 nt, Staphylococcus aureus subsp. aureus MW2
uaacucguaaucauag

SEQ ID NO: 4028870 - RNA, 16 nt, Staphylococcus aureus subsp. aureus MW2
uaacucuaaauauaau

SEQ ID NO: 4028871 - RNA, 20 nt, Staphylococcus aureus subsp. aureus MW2
uaacucuaaauauaauagaa

SEQ ID NO: 4028872 - RNA, 20 nt, Staphylococcus aureus subsp. aureus MW2
uaacucugaucuaaaaccau

SEQ ID NO: 4028873 - RNA, 14 nt, Staphylococcus aureus subsp. aureus MW2
uaacucuucaguac

SEQ ID NO: 4028874 - RNA, 22 nt, Staphylococcus aureus subsp. aureus MW2
uaacucuucuaaguuauuacaa

SEQ ID NO: 4028875 - RNA, 17 nt, Staphylococcus aureus subsp. aureus MW2
uaacugaauuaaagcau

SEQ ID NO: 4028876 - RNA, 21 nt, Staphylococcus aureus subsp. aureus MW2
uaacugccauauagauauuag

SEQ ID NO: 4028877 - RNA, 19 nt, Staphylococcus aureus subsp. aureus MW2
uaacugcgccaguuucuaa

SEQ ID NO: 4028878 - RNA, 22 nt, Staphylococcus aureus subsp. aureus MW2
uaacugcuuuggaguuucuuca

SEQ ID NO: 4028879 - RNA, 14 nt, Staphylococcus aureus subsp. aureus MW2
uaacugggauauag

SEQ ID NO: 4028880 - RNA, 14 nt, Staphylococcus aureus subsp. aureus MW2
uaacuguaaaacau

SEQ ID NO: 4028881 - RNA, 14 nt, Staphylococcus aureus subsp. aureus MW2
uaaguagaugauua

SEQ ID NO: 4028882 - RNA, 12 nt, Staphylococcus aureus subsp. aureus MW2
uaaguaguucaa

SEQ ID NO: 4028883 - RNA, 12 nt, Staphylococcus aureus subsp. aureus MW2
uaaguauucaua

SEQ ID NO: 4028884 - RNA, 13 nt, Staphylococcus aureus subsp. aureus MW2
uaaguauuuuaau

SEQ ID NO: 4028885 - RNA, 16 nt, Staphylococcus aureus subsp. aureus MW2
uaagucacgauauagu

SEQ ID NO: 4028886 - RNA, 21 nt, Staphylococcus aureus subsp. aureus MW2
uaagucgcucuagacauuaca

SEQ ID NO: 4028887 - RNA, 19 nt, Staphylococcus aureus subsp. aureus MW2
uaagucuaauguuggaaaa

SEQ ID NO: 4028888 - RNA, 19 nt, Staphylococcus aureus subsp. aureus MW2
uaagucuuaacaaauuaaa

SEQ ID NO: 4028889 - RNA, 13 nt, Staphylococcus aureus subsp. aureus MW2
uaagugauaaaua

SEQ ID NO: 4028890 - RNA, 22 nt, Staphylococcus aureus subsp. aureus MW2
uaagugauauacgacaaucaca

SEQ ID NO: 4028891 - RNA, 14 nt, Staphylococcus aureus subsp. aureus MW2
uaaguguauauagu

SEQ ID NO: 4028892 - RNA, 15 nt, Staphylococcus aureus subsp. aureus MW2
uaaguuaaaaaugua

SEQ ID NO: 4028893 - RNA, 22 nt, Staphylococcus aureus subsp. aureus MW2
uaaguuaaaaauguaaauaaaa

SEQ ID NO: 4028894 - RNA, 14 nt, Staphylococcus aureus subsp. aureus MW2
uaaguuaugacuaa

SEQ ID NO: 4028895 - RNA, 21 nt, Staphylococcus aureus subsp. aureus MW2
uaaguuaugacuaacgaaaaa

SEQ ID NO: 4028896 - RNA, 12 nt, Staphylococcus aureus subsp. aureus MW2
uaaguuauuaca

SEQ ID NO: 4028897 - RNA, 14 nt, Staphylococcus aureus subsp. aureus MW2
uaaguugauuucua

SEQ ID NO: 4028898 - RNA, 15 nt, Staphylococcus aureus subsp. aureus MW2
uaaguugauuucuac

SEQ ID NO: 4028899 - RNA, 16 nt, Staphylococcus aureus subsp. aureus MW2
uaaguuguugauuuaa

SEQ ID NO: 4028900 - RNA, 17 nt, Staphylococcus aureus subsp. aureus MW2
uaaguuuaaugaucagu

SEQ ID NO: 4028901 - RNA, 14 nt, Staphylococcus aureus subsp. aureus MW2
uaaguuugaaucau

SEQ ID NO: 4028902 - RNA, 17 nt, Staphylococcus aureus subsp. aureus MW2
uaauaaaacugcaauaa

SEQ ID NO: 4028903 - RNA, 16 nt, Staphylococcus aureus subsp. aureus MW2
uaauaaaacuugugau

SEQ ID NO: 4028904 - RNA, 21 nt, Staphylococcus aureus subsp. aureus MW2
uaauaaacgacgcaagugacu

SEQ ID NO: 4028905 - RNA, 20 nt, Staphylococcus aureus subsp. aureus MW2
uaauaaacgcuucauaguca

SEQ ID NO: 4028906 - RNA, 23 nt, Staphylococcus aureus subsp. aureus MW2
uaauaaagaauaaacaacauaca

SEQ ID NO: 4028907 - RNA, 22 nt, Staphylococcus aureus subsp. aureus MW2
uaauaaauaggaugaaaaagau

SEQ ID NO: 4028908 - RNA, 22 nt, Staphylococcus aureus subsp. aureus MW2
uaauaaaucauuaguuguauca

SEQ ID NO: 4028909 - RNA, 23 nt, Staphylococcus aureus subsp. aureus MW2
uaauaaaucuaucuauucaaaua

SEQ ID NO: 4028910 - RNA, 20 nt, Staphylococcus aureus subsp. aureus MW2
uaauaaauuagccauuucaa

SEQ ID NO: 4028911 - RNA, 14 nt, Staphylococcus aureus subsp. aureus MW2
uaauaacaaauagu

SEQ ID NO: 4028912 - RNA, 20 nt, Staphylococcus aureus subsp. aureus MW2
uaauaacauccccaaaaaua

SEQ ID NO: 4028913 - RNA, 21 nt, Staphylococcus aureus subsp. aureus MW2
uaauaacauccccaaaaauag

SEQ ID NO: 4028914 - RNA, 20 nt, Staphylococcus aureus subsp. aureus MW2
uaauaacccgaacacaaaaa

SEQ ID NO: 4028915 - RNA, 17 nt, Staphylococcus aureus subsp. aureus MW2
uaauaacgcauauaagc

SEQ ID NO: 4028916 - RNA, 19 nt, Staphylococcus aureus subsp. aureus MW2
uaauaacgcugcaccuaac

SEQ ID NO: 4028917 - RNA, 15 nt, Staphylococcus aureus subsp. aureus MW2
uaauaacucuucuaa

SEQ ID NO: 4028918 - RNA, 17 nt, Staphylococcus aureus subsp. aureus MW2
uaauaacucuucuaagu

SEQ ID NO: 4028919 - RNA, 15 nt, Staphylococcus aureus subsp. aureus MW2
uaauaagagguauag

SEQ ID NO: 4028920 - RNA, 16 nt, Staphylococcus aureus subsp. aureus MW2
uaauaagcuaauauuu

SEQ ID NO: 4028921 - RNA, 17 nt, Staphylococcus aureus subsp. aureus MW2
uaauaagcuaauauuua

SEQ ID NO: 4028922 - RNA, 16 nt, Staphylococcus aureus subsp. aureus MW2
uaauaagcugaaauaa

SEQ ID NO: 4028923 - RNA, 16 nt, Staphylococcus aureus subsp. aureus MW2
uaauaaguaauaauuu

SEQ ID NO: 4028924 - RNA, 12 nt, Staphylococcus aureus subsp. aureus MW2
uaauaauacauu

SEQ ID NO: 4028925 - RNA, 16 nt, Staphylococcus aureus subsp. aureus MW2
uaauaauacauucauu

SEQ ID NO: 4028926 - RNA, 21 nt, Staphylococcus aureus subsp. aureus MW2
uaauaauacauucauuaacag

SEQ ID NO: 4028927 - RNA, 19 nt, Staphylococcus aureus subsp. aureus MW2
uaauaauacuucuaaucgu

SEQ ID NO: 4028928 - RNA, 20 nt, Staphylococcus aureus subsp. aureus MW2
uaauaauauuugcuaaugcu

SEQ ID NO: 4028929 - RNA, 18 nt, Staphylococcus aureus subsp. aureus MW2
uaauaaucuuuaacauuu

SEQ ID NO: 4028930 - RNA, 16 nt, Staphylococcus aureus subsp. aureus MW2
uaauaaugaauucuau

SEQ ID NO: 4028931 - RNA, 15 nt, Staphylococcus aureus subsp. aureus MW2
uaauaaugacgagaa

SEQ ID NO: 4028932 - RNA, 20 nt, Staphylococcus aureus subsp. aureus MW2
uaauaaugacgagaauuaaa

SEQ ID NO: 4028933 - RNA, 20 nt, Staphylococcus aureus subsp. aureus MW2
uaauaaugcgauuacagugu

SEQ ID NO: 4028934 - RNA, 19 nt, Staphylococcus aureus subsp. aureus MW2
uaauaauggcaauuaaaac

SEQ ID NO: 4028935 - RNA, 20 nt, Staphylococcus aureus subsp. aureus MW2
uaauaauggcaauuaaaacu

SEQ ID NO: 4028936 - RNA, 21 nt, Staphylococcus aureus subsp. aureus MW2
uaauaaugguucucugucaaa

SEQ ID NO: 4028937 - RNA, 14 nt, Staphylococcus aureus subsp. aureus MW2
uaauaauuaaacaa

SEQ ID NO: 4028938 - RNA, 15 nt, Staphylococcus aureus subsp. aureus MW2
uaauaauuaaacaaa

SEQ ID NO: 4028939 - RNA, 16 nt, Staphylococcus aureus subsp. aureus MW2
uaauaauuggaaucau

SEQ ID NO: 4028940 - RNA, 18 nt, Staphylococcus aureus subsp. aureus MW2
uaauaauuggaaucaucu

SEQ ID NO: 4028941 - RNA, 19 nt, Staphylococcus aureus subsp. aureus MW2
uaauaauuggaaucaucuu

SEQ ID NO: 4028942 - RNA, 12 nt, Staphylococcus aureus subsp. aureus MW2
uaauaauuuaac

SEQ ID NO: 4028943 - RNA, 15 nt, Staphylococcus aureus subsp. aureus MW2
uaauaauuuaacuaa

SEQ ID NO: 4028944 - RNA, 19 nt, Staphylococcus aureus subsp. aureus MW2
uaauaauuuaacuaaucaa

SEQ ID NO: 4028945 - RNA, 21 nt, Staphylococcus aureus subsp. aureus MW2
uaauaauuugguuaacauccu

SEQ ID NO: 4028946 - RNA, 21 nt, Staphylococcus aureus subsp. aureus MW2
uaauacaucaucaaguucacc

SEQ ID NO: 4028947 - RNA, 18 nt, Staphylococcus aureus subsp. aureus MW2
uaauacaucuaauaaaua

SEQ ID NO: 4028948 - RNA, 18 nt, Staphylococcus aureus subsp. aureus MW2
uaauacaugacauucauu

SEQ ID NO: 4028949 - RNA, 18 nt, Staphylococcus aureus subsp. aureus MW2
uaauacaugauauaaaua

SEQ ID NO: 4028950 - RNA, 18 nt, Staphylococcus aureus subsp. aureus MW2
uaauacaugcccaaauug

SEQ ID NO: 4028951 - RNA, 17 nt, Staphylococcus aureus subsp. aureus MW2
uaauaccagcauccauu

SEQ ID NO: 4028952 - RNA, 15 nt, Staphylococcus aureus subsp. aureus MW2
uaauaccauugugau

SEQ ID NO: 4028953 - RNA, 23 nt, Staphylococcus aureus subsp. aureus MW2
uaauaccuucaauugacauuaau

SEQ ID NO: 4028954 - RNA, 20 nt, Staphylococcus aureus subsp. aureus MW2
uaauaccuuuacuuucauua

SEQ ID NO: 4028955 - RNA, 21 nt, Staphylococcus aureus subsp. aureus MW2
uaauacuaauaacucuucuaa

SEQ ID NO: 4028956 - RNA, 16 nt, Staphylococcus aureus subsp. aureus MW2
uaauacuguuuaaaua

SEQ ID NO: 4028957 - RNA, 19 nt, Staphylococcus aureus subsp. aureus MW2
uaauacuucauauccuuca

SEQ ID NO: 4028958 - RNA, 22 nt, Staphylococcus aureus subsp. aureus MW2
uaauacuucauauccuucauua

SEQ ID NO: 4028959 - RNA, 14 nt, Staphylococcus aureus subsp. aureus MW2
uaauacuuucacuu

SEQ ID NO: 4028960 - RNA, 20 nt, Staphylococcus aureus subsp. aureus MW2
uaauacuuucacuuuuuaua

SEQ ID NO: 4028961 - RNA, 17 nt, Staphylococcus aureus subsp. aureus MW2
uaauacuuuuugaguau

SEQ ID NO: 4028962 - RNA, 22 nt, Staphylococcus aureus subsp. aureus MW2
uaauacuuuuugaguauccaau

SEQ ID NO: 4028963 - RNA, 13 nt, Staphylococcus aureus subsp. aureus MW2
uaauagaaauaau

SEQ ID NO: 4028964 - RNA, 14 nt, Staphylococcus aureus subsp. aureus MW2
uaauagaaauaauc

SEQ ID NO: 4028965 - RNA, 21 nt, Staphylococcus aureus subsp. aureus MW2
uaauagaacgaaauaguucaa

SEQ ID NO: 4028966 - RNA, 21 nt, Staphylococcus aureus subsp. aureus MW2
uaauagagaaaaaauaaaugu

SEQ ID NO: 4028967 - RNA, 19 nt, Staphylococcus aureus subsp. aureus MW2
uaauagagguauaauuaaa

SEQ ID NO: 4028968 - RNA, 17 nt, Staphylococcus aureus subsp. aureus MW2
uaauagcaccauacuuc

SEQ ID NO: 4028969 - RNA, 13 nt, Staphylococcus aureus subsp. aureus MW2
uaaucgcauucuu

SEQ ID NO: 4028970 - RNA, 16 nt, Staphylococcus aureus subsp. aureus MW2
uaaucgguaauuacuu

SEQ ID NO: 4028971 - RNA, 13 nt, Staphylococcus aureus subsp. aureus MW2
uaaucguguauua

SEQ ID NO: 4028972 - RNA, 22 nt, Staphylococcus aureus subsp. aureus MW2
uaaucuaaaaauagauguacaa

SEQ ID NO: 4028973 - RNA, 16 nt, Staphylococcus aureus subsp. aureus MW2
uaaucuaaauucaguu

SEQ ID NO: 4028974 - RNA, 14 nt, Staphylococcus aureus subsp. aureus MW2
uaaucuacugcugu

SEQ ID NO: 4028975 - RNA, 15 nt, Staphylococcus aureus subsp. aureus MW2
uaaucuauaaauggc

SEQ ID NO: 4028976 - RNA, 14 nt, Staphylococcus aureus subsp. aureus MW2
uaaucuauauauau

SEQ ID NO: 4028977 - RNA, 16 nt, Staphylococcus aureus subsp. aureus MW2
uaaucuauuuucugcc

SEQ ID NO: 4028978 - RNA, 19 nt, Staphylococcus aureus subsp. aureus MW2
uaaucucaugccaaaaaca

SEQ ID NO: 4028979 - RNA, 19 nt, Staphylococcus aureus subsp. aureus MW2
uaaucucuucaauuuauuu

SEQ ID NO: 4028980 - RNA, 15 nt, Staphylococcus aureus subsp. aureus MW2
uaaucuggguuguaa

SEQ ID NO: 4028981 - RNA, 20 nt, Staphylococcus aureus subsp. aureus MW2
uaaucuggguuguaaucuca

SEQ ID NO: 4028982 - RNA, 14 nt, Staphylococcus aureus subsp. aureus MW2
uaaucuuaauauuu

SEQ ID NO: 4028983 - RNA, 22 nt, Staphylococcus aureus subsp. aureus MW2
uaaucuuacugcuuuuuuaaau

SEQ ID NO: 4028984 - RNA, 15 nt, Staphylococcus aureus subsp. aureus MW2
uaaucuucacgcuua

SEQ ID NO: 4028985 - RNA, 15 nt, Staphylococcus aureus subsp. aureus MW2
uaaucuucucauaaa

SEQ ID NO: 4028986 - RNA, 17 nt, Staphylococcus aureus subsp. aureus MW2
uaaucuugauuauauuu

SEQ ID NO: 4028987 - RNA, 22 nt, Staphylococcus aureus subsp. aureus MW2
uaaucuugauuauauuuuucuu

SEQ ID NO: 4028988 - RNA, 14 nt, Staphylococcus aureus subsp. aureus MW2
uaaucuuuaacauu

SEQ ID NO: 4028989 - RNA, 15 nt, Staphylococcus aureus subsp. aureus MW2
uaaucuuuaacauuu

SEQ ID NO: 4028990 - RNA, 17 nt, Staphylococcus aureus subsp. aureus MW2
uaaucuuuaacauuuau

SEQ ID NO: 4028991 - RNA, 18 nt, Staphylococcus aureus subsp. aureus MW2
uaaucuuuuuuacuaaaa

SEQ ID NO: 4028992 - RNA, 16 nt, Staphylococcus aureus subsp. aureus MW2
uaaugaacaacaaauu

SEQ ID NO: 4028993 - RNA, 13 nt, Staphylococcus aureus subsp. aureus MW2
uaaugaacaaggg

SEQ ID NO: 4028994 - RNA, 16 nt, Staphylococcus aureus subsp. aureus MW2
uaaugacaaauuauca

SEQ ID NO: 4028995 - RNA, 16 nt, Staphylococcus aureus subsp. aureus MW2
uaaugacacgacaccu

SEQ ID NO: 4028996 - RNA, 17 nt, Staphylococcus aureus subsp. aureus MW2
uaaugacuauaacacca

SEQ ID NO: 4028997 - RNA, 16 nt, Staphylococcus aureus subsp. aureus MW2
uaaugacugacacuuu

SEQ ID NO: 4028998 - RNA, 22 nt, Staphylococcus aureus subsp. aureus MW2
uaaugacuucuuuauauuuauc

SEQ ID NO: 4028999 - RNA, 12 nt, Staphylococcus aureus subsp. aureus MW2
uaaugagaguaa

SEQ ID NO: 4029000 - RNA, 18 nt, Staphylococcus aureus subsp. aureus MW2
uaaugagcccguuaaaaa

SEQ ID NO: 4029001 - RNA, 20 nt, Staphylococcus aureus subsp. aureus MW2
uaaugauacaaacccauaua

SEQ ID NO: 4029002 - RNA, 15 nt, Staphylococcus aureus subsp. aureus MW2
uaaugaucaaguagu

SEQ ID NO: 4029003 - RNA, 13 nt, Staphylococcus aureus subsp. aureus MW2
uaaugaucaucua

SEQ ID NO: 4029004 - RNA, 14 nt, Staphylococcus aureus subsp. aureus MW2
uaaugaucaucuau

SEQ ID NO: 4029005 - RNA, 14 nt, Staphylococcus aureus subsp. aureus MW2
uaaugaugacauca

SEQ ID NO: 4029006 - RNA, 14 nt, Staphylococcus aureus subsp. aureus MW2
uaaugaugcgaugg

SEQ ID NO: 4029007 - RNA, 14 nt, Staphylococcus aureus subsp. aureus MW2
uaaugauuaaaaau

SEQ ID NO: 4029008 - RNA, 20 nt, Staphylococcus aureus subsp. aureus MW2
uaaugauuuaauuuguuaua

SEQ ID NO: 4029009 - RNA, 11 nt, Staphylococcus aureus subsp. aureus MW2
uaaugauuuug

SEQ ID NO: 4029010 - RNA, 22 nt, Staphylococcus aureus subsp. aureus MW2
uaaugauuuuuauuauugucau

SEQ ID NO: 4029011 - RNA, 14 nt, Staphylococcus aureus subsp. aureus MW2
uaaugauuuuucau

SEQ ID NO: 4029012 - RNA, 23 nt, Staphylococcus aureus subsp. aureus MW2
uaaugcaagcgacgauuggaaag

SEQ ID NO: 4029013 - RNA, 21 nt, Staphylococcus aureus subsp. aureus MW2
uaaugcagauucuucaccaac

SEQ ID NO: 4029014 - RNA, 21 nt, Staphylococcus aureus subsp. aureus MW2
uaaugcaucaguauuaggauu

SEQ ID NO: 4029015 - RNA, 23 nt, Staphylococcus aureus subsp. aureus MW2
uaaugccaccguggaauuuacca

SEQ ID NO: 4029016 - RNA, 22 nt, Staphylococcus aureus subsp. aureus MW2
uaaugccuaauuuguaacccca

SEQ ID NO: 4029017 - RNA, 21 nt, Staphylococcus aureus subsp. aureus MW2
uaaugccugccccuuagucau

SEQ ID NO: 4029018 - RNA, 17 nt, Staphylococcus aureus subsp. aureus MW2
uaaugcuacuauuaaau

SEQ ID NO: 4029019 - RNA, 17 nt, Staphylococcus aureus subsp. aureus MW2
uaaugcuaugauuaaag

SEQ ID NO: 4029020 - RNA, 14 nt, Staphylococcus aureus subsp. aureus MW2
uaaugcuuauuaaa

SEQ ID NO: 4029021 - RNA, 18 nt, Staphylococcus aureus subsp. aureus MW2
uaauggagcacuaucuuu

SEQ ID NO: 4029022 - RNA, 14 nt, Staphylococcus aureus subsp. aureus MW2
uaauggcaauuaaa

SEQ ID NO: 4029023 - RNA, 15 nt, Staphylococcus aureus subsp. aureus MW2
uaauggcgugcuuuu

SEQ ID NO: 4029024 - RNA, 23 nt, Staphylococcus aureus subsp. aureus MW2
uaaugguucucugucaaauugga

SEQ ID NO: 4029025 - RNA, 16 nt, Staphylococcus aureus subsp. aureus MW2
uaaugguuucaaaauc

SEQ ID NO: 4029026 - RNA, 16 nt, Staphylococcus aureus subsp. aureus MW2
uaauguacauguauaa

SEQ ID NO: 4029027 - RNA, 15 nt, Staphylococcus aureus subsp. aureus MW2
uaauguauaaaacag

SEQ ID NO: 4029028 - RNA, 21 nt, Staphylococcus aureus subsp. aureus MW2
uaauguaucauuucagaaaua

SEQ ID NO: 4029029 - RNA, 13 nt, Staphylococcus aureus subsp. aureus MW2
uaauguauucuuc

SEQ ID NO: 4029030 - RNA, 15 nt, Staphylococcus aureus subsp. aureus MW2
uaaugucauaucuuu

SEQ ID NO: 4029031 - RNA, 13 nt, Staphylococcus aureus subsp. aureus MW2
uaaugucuuacuu

SEQ ID NO: 4029032 - RNA, 23 nt, Staphylococcus aureus subsp. aureus MW2
uaaugucuucauaaucguauuca

SEQ ID NO: 4029033 - RNA, 23 nt, Staphylococcus aureus subsp. aureus MW2
uaaugugaugguucaaauaucau

SEQ ID NO: 4029034 - RNA, 19 nt, Staphylococcus aureus subsp. aureus MW2
uaaugugcaaguuggcggg

SEQ ID NO: 4029035 - RNA, 22 nt, Staphylococcus aureus subsp. aureus MW2
uaaugugcaaguuggcggggcc

SEQ ID NO: 4029036 - RNA, 17 nt, Staphylococcus aureus subsp. aureus MW2
uaaugugcgucacucac

SEQ ID NO: 4029037 - RNA, 19 nt, Staphylococcus aureus subsp. aureus MW2
uaauguguaccuuuuuauu

SEQ ID NO: 4029038 - RNA, 17 nt, Staphylococcus aureus subsp. aureus MW2
uaauguguuaauacuuc

SEQ ID NO: 4029039 - RNA, 20 nt, Staphylococcus aureus subsp. aureus MW2
uaauguuaaaauaacugcua

SEQ ID NO: 4029040 - RNA, 22 nt, Staphylococcus aureus subsp. aureus MW2
uaauguuaaaauaacugcuaau

SEQ ID NO: 4029041 - RNA, 23 nt, Staphylococcus aureus subsp. aureus MW2
uaauguuaaacuagaaaacauaa

SEQ ID NO: 4029042 - RNA, 20 nt, Staphylococcus aureus subsp. aureus MW2
uaauguucaauuuauauggu

SEQ ID NO: 4029043 - RNA, 18 nt, Staphylococcus aureus subsp. aureus MW2
uaauguuccauauaaccu

SEQ ID NO: 4029044 - RNA, 19 nt, Staphylococcus aureus subsp. aureus MW2
uaauguuccccugaaaaga

SEQ ID NO: 4029045 - RNA, 18 nt, Staphylococcus aureus subsp. aureus MW2
uaauguuggcaaacuauu

SEQ ID NO: 4029046 - RNA, 13 nt, Staphylococcus aureus subsp. aureus MW2
uaauguuuccauu

SEQ ID NO: 4029047 - RNA, 23 nt, Staphylococcus aureus subsp. aureus MW2
uaauguuuccugauauuucaacu

SEQ ID NO: 4029048 - RNA, 23 nt, Staphylococcus aureus subsp. aureus MW2
uaauguuucuucaauugucucaa

SEQ ID NO: 4029049 - RNA, 21 nt, Staphylococcus aureus subsp. aureus MW2
uaauguuugaagaccuucuaa

SEQ ID NO: 4029050 - RNA, 15 nt, Staphylococcus aureus subsp. aureus MW2
uaauguuugcuuuuu

SEQ ID NO: 4029051 - RNA, 12 nt, Staphylococcus aureus subsp. aureus MW2
uaauuaaaauaa

SEQ ID NO: 4029052 - RNA, 18 nt, Staphylococcus aureus subsp. aureus MW2
uaauuaaacaaaacuuaa

SEQ ID NO: 4029053 - RNA, 15 nt, Staphylococcus aureus subsp. aureus MW2
uaauuaaacauuuag

SEQ ID NO: 4029054 - RNA, 15 nt, Staphylococcus aureus subsp. aureus MW2
uaauuaaagcaucuu

SEQ ID NO: 4029055 - RNA, 14 nt, Staphylococcus aureus subsp. aureus MW2
uaauuaaauaacuu

SEQ ID NO: 4029056 - RNA, 19 nt, Staphylococcus aureus subsp. aureus MW2
uaauuaaauagcuuuacuu

SEQ ID NO: 4029057 - RNA, 22 nt, Staphylococcus aureus subsp. aureus MW2
uaauuaacuuacuuuuguaaaa

SEQ ID NO: 4029058 - RNA, 16 nt, Staphylococcus aureus subsp. aureus MW2
uaauuuucuauuauuu

SEQ ID NO: 4029059 - RNA, 23 nt, Staphylococcus aureus subsp. aureus MW2
uaauuuucuugccaucaauuucu

SEQ ID NO: 4029060 - RNA, 16 nt, Staphylococcus aureus subsp. aureus MW2
uaauuuugacauaaaa

SEQ ID NO: 4029061 - RNA, 18 nt, Staphylococcus aureus subsp. aureus MW2
uaauuuugacauaaaaaa

SEQ ID NO: 4029062 - RNA, 21 nt, Staphylococcus aureus subsp. aureus MW2
uaauuuugagacaaaaaauga

SEQ ID NO: 4029063 - RNA, 13 nt, Staphylococcus aureus subsp. aureus MW2
uaauuuuguuuca

SEQ ID NO: 4029064 - RNA, 14 nt, Staphylococcus aureus subsp. aureus MW2
uaauuuuuaaacaa

SEQ ID NO: 4029065 - RNA, 13 nt, Staphylococcus aureus subsp. aureus MW2
uaauuuuuaaauc

SEQ ID NO: 4029066 - RNA, 16 nt, Staphylococcus aureus subsp. aureus MW2
uaauuuuuaaaucuac

SEQ ID NO: 4029067 - RNA, 15 nt, Staphylococcus aureus subsp. aureus MW2
uaauuuuuaacagcg

SEQ ID NO: 4029068 - RNA, 24 nt, Staphylococcus aureus subsp. aureus MW2
uaauuuuuaacagcgugaauauaa

SEQ ID NO: 4029069 - RNA, 17 nt, Staphylococcus aureus subsp. aureus MW2
uaauuuuuaacaucauu

SEQ ID NO: 4029070 - RNA, 18 nt, Staphylococcus aureus subsp. aureus MW2
uaauuuuuauucuguaac

SEQ ID NO: 4029071 - RNA, 13 nt, Staphylococcus aureus subsp. aureus MW2
uaauuuuucauua

SEQ ID NO: 4029072 - RNA, 14 nt, Staphylococcus aureus subsp. aureus MW2
uaauuuuucgucuu

SEQ ID NO: 4029073 - RNA, 12 nt, Staphylococcus aureus subsp. aureus MW2
uaauuuuucuuu

SEQ ID NO: 4029074 - RNA, 13 nt, Staphylococcus aureus subsp. aureus MW2
uaauuuuucuuua

SEQ ID NO: 4029075 - RNA, 18 nt, Staphylococcus aureus subsp. aureus MW2
uaauuuuucuuucaggcu

SEQ ID NO: 4029076 - RNA, 20 nt, Staphylococcus aureus subsp. aureus MW2
uaauuuuuuauuaagacuga

SEQ ID NO: 4029077 - RNA, 24 nt, Staphylococcus aureus subsp. aureus MW2
uaauuuuuucguuaacucuaucua

SEQ ID NO: 4029078 - RNA, 18 nt, Staphylococcus aureus subsp. aureus MW2
uaauuuuuugacacgucg

SEQ ID NO: 4029079 - RNA, 21 nt, Staphylococcus aureus subsp. aureus MW2
uacaaaagaggcgccacaaca

SEQ ID NO: 4029080 - RNA, 14 nt, Staphylococcus aureus subsp. aureus MW2
uacaaaauaaugau

SEQ ID NO: 4029081 - RNA, 20 nt, Staphylococcus aureus subsp. aureus MW2
uacaaaauaaugauacuaau

SEQ ID NO: 4029082 - RNA, 13 nt, Staphylococcus aureus subsp. aureus MW2
uacaaacacccac

SEQ ID NO: 4029083 - RNA, 18 nt, Staphylococcus aureus subsp. aureus MW2
uacaaacauaaucauaau

SEQ ID NO: 4029084 - RNA, 22 nt, Staphylococcus aureus subsp. aureus MW2
uacaaacauuccucuauuguau

SEQ ID NO: 4029085 - RNA, 19 nt, Staphylococcus aureus subsp. aureus MW2
uacaaacuucacauuaugu

SEQ ID NO: 4029086 - RNA, 18 nt, Staphylococcus aureus subsp. aureus MW2
uacaaagcacaccuaauu

SEQ ID NO: 4029087 - RNA, 16 nt, Staphylococcus aureus subsp. aureus MW2
uacaaagucauuuuca

SEQ ID NO: 4029088 - RNA, 20 nt, Staphylococcus aureus subsp. aureus MW2
uacaaagucauuuucauuca

SEQ ID NO: 4029089 - RNA, 14 nt, Staphylococcus aureus subsp. aureus MW2
uacaaagugauuua

SEQ ID NO: 4029090 - RNA, 21 nt, Staphylococcus aureus subsp. aureus MW2
uacaaaguuaaucauacauau

SEQ ID NO: 4029091 - RNA, 20 nt, Staphylococcus aureus subsp. aureus MW2
uacaaaguuuauacuuaaua

SEQ ID NO: 4029092 - RNA, 19 nt, Staphylococcus aureus subsp. aureus MW2
uacaaauacaguuaucacc

SEQ ID NO: 4029093 - RNA, 20 nt, Staphylococcus aureus subsp. aureus MW2
uacaaaucaugacauaaaac

SEQ ID NO: 4029094 - RNA, 21 nt, Staphylococcus aureus subsp. aureus MW2
uacaaaucaugacauaaaacu

SEQ ID NO: 4029095 - RNA, 17 nt, Staphylococcus aureus subsp. aureus MW2
uacaaauuuuaaaauaa

SEQ ID NO: 4029096 - RNA, 22 nt, Staphylococcus aureus subsp. aureus MW2
uacaaauuuuaaaauaaaaaau

SEQ ID NO: 4029097 - RNA, 18 nt, Staphylococcus aureus subsp. aureus MW2
uacaaauuuuuuuuauua

SEQ ID NO: 4029098 - RNA, 18 nt, Staphylococcus aureus subsp. aureus MW2
uacaacaccaauugaaau

SEQ ID NO: 4029099 - RNA, 15 nt, Staphylococcus aureus subsp. aureus MW2
uacaacaguaaucau

SEQ ID NO: 4029100 - RNA, 20 nt, Staphylococcus aureus subsp. aureus MW2
uacaacaguaaucaugcauu

SEQ ID NO: 4029101 - RNA, 15 nt, Staphylococcus aureus subsp. aureus MW2
uacaacaguugcacc

SEQ ID NO: 4029102 - RNA, 14 nt, Staphylococcus aureus subsp. aureus MW2
uacaacauguguau

SEQ ID NO: 4029103 - RNA, 22 nt, Staphylococcus aureus subsp. aureus MW2
uacaaccuuugcuuaaaccuua

SEQ ID NO: 4029104 - RNA, 23 nt, Staphylococcus aureus subsp. aureus MW2
uacaacgacacgaacaacauuag

SEQ ID NO: 4029105 - RNA, 14 nt, Staphylococcus aureus subsp. aureus MW2
uacaacuaaauaug

SEQ ID NO: 4029106 - RNA, 12 nt, Staphylococcus aureus subsp. aureus MW2
uacaacuucauu

SEQ ID NO: 4029107 - RNA, 23 nt, Staphylococcus aureus subsp. aureus MW2
uacaacuuuaguuguuaggggcu

SEQ ID NO: 4029108 - RNA, 23 nt, Staphylococcus aureus subsp. aureus MW2
uacaagucuaguucgaacacaca

SEQ ID NO: 4029109 - RNA, 22 nt, Staphylococcus aureus subsp. aureus MW2
uacaauaaugugcaaguugggg

SEQ ID NO: 4029110 - RNA, 18 nt, Staphylococcus aureus subsp. aureus MW2
uacaauaguauaaauauc

SEQ ID NO: 4029111 - RNA, 20 nt, Staphylococcus aureus subsp. aureus MW2
uacaauaguauaaauaucau

SEQ ID NO: 4029112 - RNA, 14 nt, Staphylococcus aureus subsp. aureus MW2
uacaauaugauuaa

SEQ ID NO: 4029113 - RNA, 15 nt, Staphylococcus aureus subsp. aureus MW2
uacaauaugauuaau

SEQ ID NO: 4029114 - RNA, 17 nt, Staphylococcus aureus subsp. aureus MW2
uacaauauuaaaauuaa

SEQ ID NO: 4029115 - RNA, 18 nt, Staphylococcus aureus subsp. aureus MW2
uacaauauuaaaauuaaa

SEQ ID NO: 4029116 - RNA, 13 nt, Staphylococcus aureus subsp. aureus MW2
uacaaucauuagu

SEQ ID NO: 4029117 - RNA, 23 nt, Staphylococcus aureus subsp. aureus MW2
uacaauccuaaaauacuguuuuc

SEQ ID NO: 4029118 - RNA, 16 nt, Staphylococcus aureus subsp. aureus MW2
uacaaugaauuucuaa

SEQ ID NO: 4029119 - RNA, 17 nt, Staphylococcus aureus subsp. aureus MW2
uacaaugcgguauugca

SEQ ID NO: 4029120 - RNA, 14 nt, Staphylococcus aureus subsp. aureus MW2
uacaaugcugauac

SEQ ID NO: 4029121 - RNA, 13 nt, Staphylococcus aureus subsp. aureus MW2
uacaauuaauuac

SEQ ID NO: 4029122 - RNA, 23 nt, Staphylococcus aureus subsp. aureus MW2
uacaauuaauuacuguaaauaug

SEQ ID NO: 4029123 - RNA, 14 nt, Staphylococcus aureus subsp. aureus MW2
uacaauuauggaua

SEQ ID NO: 4029124 - RNA, 18 nt, Staphylococcus aureus subsp. aureus MW2
uacaauuauggauaaaau

SEQ ID NO: 4029125 - RNA, 19 nt, Staphylococcus aureus subsp. aureus MW2
uacaauuuagguuaauuaa

SEQ ID NO: 4029126 - RNA, 15 nt, Staphylococcus aureus subsp. aureus MW2
uacaauuuccuaccc

SEQ ID NO: 4029127 - RNA, 21 nt, Staphylococcus aureus subsp. aureus MW2
uacaauuucuucauuuucauu

SEQ ID NO: 4029128 - RNA, 22 nt, Staphylococcus aureus subsp. aureus MW2
uacaauuuuccuuucaauaaua

SEQ ID NO: 4029129 - RNA, 23 nt, Staphylococcus aureus subsp. aureus MW2
uacaauuuuccuuucaauaauaa

SEQ ID NO: 4029130 - RNA, 17 nt, Staphylococcus aureus subsp. aureus MW2
uacaauuuucucauuaa

SEQ ID NO: 4029131 - RNA, 15 nt, Staphylococcus aureus subsp. aureus MW2
uacaauuuuuaaaaa

SEQ ID NO: 4029132 - RNA, 16 nt, Staphylococcus aureus subsp. aureus MW2
uacaauuuuuaaaaac

SEQ ID NO: 4029133 - RNA, 11 nt, Staphylococcus aureus subsp. aureus MW2
uacaauuuuug

SEQ ID NO: 4029134 - RNA, 15 nt, Staphylococcus aureus subsp. aureus MW2
uacaccacuuaggau

SEQ ID NO: 4029135 - RNA, 15 nt, Staphylococcus aureus subsp. aureus MW2
uacaccuacaaauau

SEQ ID NO: 4029136 - RNA, 19 nt, Staphylococcus aureus subsp. aureus MW2
uacacgaauucauuaacgu

SEQ ID NO: 4029137 - RNA, 14 nt, Staphylococcus aureus subsp. aureus MW2
uacacgcauuacuu

SEQ ID NO: 4029138 - RNA, 23 nt, Staphylococcus aureus subsp. aureus MW2
uacacguaacgcaguugaaaaag

SEQ ID NO: 4029139 - RNA, 15 nt, Staphylococcus aureus subsp. aureus MW2
uacacgucuaauuuu

SEQ ID NO: 4029140 - RNA, 22 nt, Staphylococcus aureus subsp. aureus MW2
uacacuaaaaccuauuccuaau

SEQ ID NO: 4029141 - RNA, 14 nt, Staphylococcus aureus subsp. aureus MW2
uacacuagucuuuu

SEQ ID NO: 4029142 - RNA, 24 nt, Staphylococcus aureus subsp. aureus MW2
uacacuaucauuaucaaauaaccu

SEQ ID NO: 4029143 - RNA, 18 nt, Staphylococcus aureus subsp. aureus MW2
uacacugcacaucauaau

SEQ ID NO: 4029144 - RNA, 22 nt, Staphylococcus aureus subsp. aureus MW2
uacacugcacaucauaauaaau

SEQ ID NO: 4029145 - RNA, 17 nt, Staphylococcus aureus subsp. aureus MW2
uacacuguuuuauaaau

SEQ ID NO: 4029146 - RNA, 19 nt, Staphylococcus aureus subsp. aureus MW2
uaccaacugcaaauacacc

SEQ ID NO: 4029147 - RNA, 21 nt, Staphylococcus aureus subsp. aureus MW2
uaccaacugcaaauacaccag

SEQ ID NO: 4029148 - RNA, 21 nt, Staphylococcus aureus subsp. aureus MW2
uaccaacugucgguucaucua

SEQ ID NO: 4029149 - RNA, 22 nt, Staphylococcus aureus subsp. aureus MW2
uaccaauacguuuccaauccau

SEQ ID NO: 4029150 - RNA, 22 nt, Staphylococcus aureus subsp. aureus MW2
uaccaauaucaugcaaaauaau

SEQ ID NO: 4029151 - RNA, 22 nt, Staphylococcus aureus subsp. aureus MW2
uaccaaugaauaaauugauauu

SEQ ID NO: 4029152 - RNA, 13 nt, Staphylococcus aureus subsp. aureus MW2
uaccaauuagcau

SEQ ID NO: 4029153 - RNA, 17 nt, Staphylococcus aureus subsp. aureus MW2
uaccaauugcuucuucg

SEQ ID NO: 4029154 - RNA, 17 nt, Staphylococcus aureus subsp. aureus MW2
uaccaauuguuucagcu

SEQ ID NO: 4029155 - RNA, 16 nt, Staphylococcus aureus subsp. aureus MW2
uaccacauuuuccuug

SEQ ID NO: 4029156 - RNA, 20 nt, Staphylococcus aureus subsp. aureus MW2
uaccacgaacaagucuugca

SEQ ID NO: 4029157 - RNA, 15 nt, Staphylococcus aureus subsp. aureus MW2
uaccacuugaauacu

SEQ ID NO: 4029158 - RNA, 22 nt, Staphylococcus aureus subsp. aureus MW2
uaccacuugaauacuuuuuaac

SEQ ID NO: 4029159 - RNA, 14 nt, Staphylococcus aureus subsp. aureus MW2
uaccagcauccauu

SEQ ID NO: 4029160 - RNA, 18 nt, Staphylococcus aureus subsp. aureus MW2
uaccagugggcuccaaac

SEQ ID NO: 4029161 - RNA, 22 nt, Staphylococcus aureus subsp. aureus MW2
uaccagugggcuccaaacauag

SEQ ID NO: 4029162 - RNA, 18 nt, Staphylococcus aureus subsp. aureus MW2
uaccauagauuauauuau

SEQ ID NO: 4029163 - RNA, 15 nt, Staphylococcus aureus subsp. aureus MW2
uaccauauaauucuu

SEQ ID NO: 4029164 - RNA, 20 nt, Staphylococcus aureus subsp. aureus MW2
uaccauauuuuuuaguaaua

SEQ ID NO: 4029165 - RNA, 23 nt, Staphylococcus aureus subsp. aureus MW2
uaccauauuuuuuaguaauaaca

SEQ ID NO: 4029166 - RNA, 13 nt, Staphylococcus aureus subsp. aureus MW2
uaccaucaauaaa

SEQ ID NO: 4029167 - RNA, 22 nt, Staphylococcus aureus subsp. aureus MW2
uaccaucaauaaaaauugaauu

SEQ ID NO: 4029168 - RNA, 22 nt, Staphylococcus aureus subsp. aureus MW2
uaccaucuucgacuacaaguuu

SEQ ID NO: 4029169 - RNA, 15 nt, Staphylococcus aureus subsp. aureus MW2
uaccaucuuuaauac

SEQ ID NO: 4029170 - RNA, 17 nt, Staphylococcus aureus subsp. aureus MW2
uaccaucuuuaauacga

SEQ ID NO: 4029171 - RNA, 22 nt, Staphylococcus aureus subsp. aureus MW2
uaccaugaugagauaaaaucau

SEQ ID NO: 4029172 - RNA, 23 nt, Staphylococcus aureus subsp. aureus MW2
uaccaugaugagauaaaaucaua

SEQ ID NO: 4029173 - RNA, 12 nt, Staphylococcus aureus subsp. aureus MW2
uaccauguuuuu

SEQ ID NO: 4029174 - RNA, 18 nt, Staphylococcus aureus subsp. aureus MW2
uaccauguuuuuuaagua

SEQ ID NO: 4029175 - RNA, 13 nt, Staphylococcus aureus subsp. aureus MW2
uaccauuccaaaa

SEQ ID NO: 4029176 - RNA, 18 nt, Staphylococcus aureus subsp. aureus MW2
uaccauugugaugauaau

SEQ ID NO: 4029177 - RNA, 18 nt, Staphylococcus aureus subsp. aureus MW2
uacccaauauuaauccac

SEQ ID NO: 4029178 - RNA, 16 nt, Staphylococcus aureus subsp. aureus MW2
uacccauaauuuaaau

SEQ ID NO: 4029179 - RNA, 22 nt, Staphylococcus aureus subsp. aureus MW2
uacccauaauuuaaaugauauu

SEQ ID NO: 4029180 - RNA, 22 nt, Staphylococcus aureus subsp. aureus MW2
uaccccuguugaauauacuaaa

SEQ ID NO: 4029181 - RNA, 22 nt, Staphylococcus aureus subsp. aureus MW2
uacccuugcaaauauaucaucu

SEQ ID NO: 4029182 - RNA, 15 nt, Staphylococcus aureus subsp. aureus MW2
uacccuuuaaucuca

SEQ ID NO: 4029183 - RNA, 13 nt, Staphylococcus aureus subsp. aureus MW2
uacccuuuuucaa

SEQ ID NO: 4029184 - RNA, 21 nt, Staphylococcus aureus subsp. aureus MW2
uaccgcuaaaauucuuucagc

SEQ ID NO: 4029185 - RNA, 15 nt, Staphylococcus aureus subsp. aureus MW2
uaccgcugcuuuuac

SEQ ID NO: 4029186 - RNA, 18 nt, Staphylococcus aureus subsp. aureus MW2
uaccguauuuuaauauug

SEQ ID NO: 4029187 - RNA, 19 nt, Staphylococcus aureus subsp. aureus MW2
uaccguauuuuaauauuga

SEQ ID NO: 4029188 - RNA, 15 nt, Staphylococcus aureus subsp. aureus MW2
uaccuaaauuaaauu

SEQ ID NO: 4029189 - RNA, 18 nt, Staphylococcus aureus subsp. aureus MW2
uaccuaagcugauuaaaa

SEQ ID NO: 4029190 - RNA, 19 nt, Staphylococcus aureus subsp. aureus MW2
uaccuaauaggauuuccua

SEQ ID NO: 4029191 - RNA, 14 nt, Staphylococcus aureus subsp. aureus MW2
uaccuacaaauaug

SEQ ID NO: 4029192 - RNA, 15 nt, Staphylococcus aureus subsp. aureus MW2
uaccuacagaaugga

SEQ ID NO: 4029193 - RNA, 21 nt, Staphylococcus aureus subsp. aureus MW2
uaccuacagaauggauaccua

SEQ ID NO: 4029194 - RNA, 17 nt, Staphylococcus aureus subsp. aureus MW2
uaccuauuugauuaaau

SEQ ID NO: 4029195 - RNA, 19 nt, Staphylococcus aureus subsp. aureus MW2
uaccuauuugcugaaugaa

SEQ ID NO: 4029196 - RNA, 13 nt, Staphylococcus aureus subsp. aureus MW2
uaccuguccaaau

SEQ ID NO: 4029197 - RNA, 17 nt, Staphylococcus aureus subsp. aureus MW2
uaccuuauggaaaauuu

SEQ ID NO: 4029198 - RNA, 13 nt, Staphylococcus aureus subsp. aureus MW2
uaccuucaucuuu

SEQ ID NO: 4029199 - RNA, 16 nt, Staphylococcus aureus subsp. aureus MW2
uaccuucaucuuuuuu

SEQ ID NO: 4029200 - RNA, 22 nt, Staphylococcus aureus subsp. aureus MW2
uaccuucuucuacccauaauuu

SEQ ID NO: 4029201 - RNA, 18 nt, Staphylococcus aureus subsp. aureus MW2
uaccuuuaaaucuacuuu

SEQ ID NO: 4029202 - RNA, 16 nt, Staphylococcus aureus subsp. aureus MW2
uaccuuuaauaauauu

SEQ ID NO: 4029203 - RNA, 15 nt, Staphylococcus aureus subsp. aureus MW2
uaccuuuaauaucua

SEQ ID NO: 4029204 - RNA, 15 nt, Staphylococcus aureus subsp. aureus MW2
uaccuuuacuuucau

SEQ ID NO: 4029205 - RNA, 12 nt, Staphylococcus aureus subsp. aureus MW2
uaccuuuccauu

SEQ ID NO: 4029206 - RNA, 18 nt, Staphylococcus aureus subsp. aureus MW2
uacgaacaacuaacacgu

SEQ ID NO: 4029207 - RNA, 19 nt, Staphylococcus aureus subsp. aureus MW2
uacgaaguuuaaaugugca

SEQ ID NO: 4029208 - RNA, 23 nt, Staphylococcus aureus subsp. aureus MW2
uacgaauaucuguugcauuaagu

SEQ ID NO: 4029209 - RNA, 16 nt, Staphylococcus aureus subsp. aureus MW2
uacgaccagucgcaua

SEQ ID NO: 4029210 - RNA, 18 nt, Staphylococcus aureus subsp. aureus MW2
uacgacgucgcaacagga

SEQ ID NO: 4029211 - RNA, 11 nt, Staphylococcus aureus subsp. aureus MW2
uacgacucucc

SEQ ID NO: 4029212 - RNA, 18 nt, Staphylococcus aureus subsp. aureus MW2
uacgagacauuucuucaa

SEQ ID NO: 4029213 - RNA, 15 nt, Staphylococcus aureus subsp. aureus MW2
uacgauaaauaguga

SEQ ID NO: 4029214 - RNA, 17 nt, Staphylococcus aureus subsp. aureus MW2
uacgaucauaaauauuu

SEQ ID NO: 4029215 - RNA, 16 nt, Staphylococcus aureus subsp. aureus MW2
uacgauucaauuuaac

SEQ ID NO: 4029216 - RNA, 19 nt, Staphylococcus aureus subsp. aureus MW2
uacgauugaguugaaaaua

SEQ ID NO: 4029217 - RNA, 20 nt, Staphylococcus aureus subsp. aureus MW2
uacgauugaguugaaaauaa

SEQ ID NO: 4029218 - RNA, 22 nt, Staphylococcus aureus subsp. aureus MW2
uacgauugggcaacuuuugguc

SEQ ID NO: 4029219 - RNA, 12 nt, Staphylococcus aureus subsp. aureus MW2
uacgauuuucaa

SEQ ID NO: 4029220 - RNA, 15 nt, Staphylococcus aureus subsp. aureus MW2
uacgcaaaaacuugu

SEQ ID NO: 4029221 - RNA, 17 nt, Staphylococcus aureus subsp. aureus MW2
uacgcaaagaaaaacau

SEQ ID NO: 4029222 - RNA, 21 nt, Staphylococcus aureus subsp. aureus MW2
uacgcauuuuaaauaaaaugc

SEQ ID NO: 4029223 - RNA, 17 nt, Staphylococcus aureus subsp. aureus MW2
uacgcccaucaucacug

SEQ ID NO: 4029224 - RNA, 15 nt, Staphylococcus aureus subsp. aureus MW2
uacgccuaaauauuu

SEQ ID NO: 4029225 - RNA, 16 nt, Staphylococcus aureus subsp. aureus MW2
uacgccuucuuuauaa

SEQ ID NO: 4029226 - RNA, 23 nt, Staphylococcus aureus subsp. aureus MW2
uacgccuuggccuacuuuuucaa

SEQ ID NO: 4029227 - RNA, 19 nt, Staphylococcus aureus subsp. aureus MW2
uacgcgcuucaucaaugga

SEQ ID NO: 4029228 - RNA, 15 nt, Staphylococcus aureus subsp. aureus MW2
uacgcucauaugucu

SEQ ID NO: 4029229 - RNA, 21 nt, Staphylococcus aureus subsp. aureus MW2
uacgcuuacuuauauuuuaau

SEQ ID NO: 4029230 - RNA, 15 nt, Staphylococcus aureus subsp. aureus MW2
uacgcuuuuuaaaaa

SEQ ID NO: 4029231 - RNA, 16 nt, Staphylococcus aureus subsp. aureus MW2
uacgcuuuuuaaaaaa

SEQ ID NO: 4029232 - RNA, 13 nt, Staphylococcus aureus subsp. aureus MW2
uacguguguagua

SEQ ID NO: 4029233 - RNA, 16 nt, Staphylococcus aureus subsp. aureus MW2
uacguuauuucaauaa

SEQ ID NO: 4029234 - RNA, 15 nt, Staphylococcus aureus subsp. aureus MW2
uacuucucaauuuag

SEQ ID NO: 4029235 - RNA, 16 nt, Staphylococcus aureus subsp. aureus MW2
uacuucucaucgaauu

SEQ ID NO: 4029236 - RNA, 17 nt, Staphylococcus aureus subsp. aureus MW2
uacuucuccauggcuua

SEQ ID NO: 4029237 - RNA, 18 nt, Staphylococcus aureus subsp. aureus MW2
uacuucucccuuaaauac

SEQ ID NO: 4029238 - RNA, 16 nt, Staphylococcus aureus subsp. aureus MW2
uacuucuuuaaucgcu

SEQ ID NO: 4029239 - RNA, 18 nt, Staphylococcus aureus subsp. aureus MW2
uacuucuuuggucuaaag

SEQ ID NO: 4029240 - RNA, 17 nt, Staphylococcus aureus subsp. aureus MW2
uacuugagcaaguuaua

SEQ ID NO: 4029241 - RNA, 22 nt, Staphylococcus aureus subsp. aureus MW2
uacuugagcaaguuauaucaua

SEQ ID NO: 4029242 - RNA, 16 nt, Staphylococcus aureus subsp. aureus MW2
uacuugcacaccagug

SEQ ID NO: 4029243 - RNA, 22 nt, Staphylococcus aureus subsp. aureus MW2
uacuugccuauuuuuuuauguu

SEQ ID NO: 4029244 - RNA, 19 nt, Staphylococcus aureus subsp. aureus MW2
uacuuggaaaauacuauac

SEQ ID NO: 4029245 - RNA, 17 nt, Staphylococcus aureus subsp. aureus MW2
uacuuguaauuaauaca

SEQ ID NO: 4029246 - RNA, 18 nt, Staphylococcus aureus subsp. aureus MW2
uacuuguaauuaauacau

SEQ ID NO: 4029247 - RNA, 20 nt, Staphylococcus aureus subsp. aureus MW2
uacuuguaauuaauacauca

SEQ ID NO: 4029248 - RNA, 16 nt, Staphylococcus aureus subsp. aureus MW2
uacuugucguauucuu

SEQ ID NO: 4029249 - RNA, 15 nt, Staphylococcus aureus subsp. aureus MW2
uacuuuaaaauugua

SEQ ID NO: 4029250 - RNA, 20 nt, Staphylococcus aureus subsp. aureus MW2
uacuuuaaaauuguauagaa

SEQ ID NO: 4029251 - RNA, 17 nt, Staphylococcus aureus subsp. aureus MW2
uacuuuacauuucucgu

SEQ ID NO: 4029252 - RNA, 18 nt, Staphylococcus aureus subsp. aureus MW2
uacuuuagaaacaccuuu

SEQ ID NO: 4029253 - RNA, 23 nt, Staphylococcus aureus subsp. aureus MW2
uacuuuagaaagugauucccaaa

SEQ ID NO: 4029254 - RNA, 19 nt, Staphylococcus aureus subsp. aureus MW2
uacuuuauuugauaauauu

SEQ ID NO: 4029255 - RNA, 15 nt, Staphylococcus aureus subsp. aureus MW2
uacuuucaaacaaau

SEQ ID NO: 4029256 - RNA, 16 nt, Staphylococcus aureus subsp. aureus MW2
uacuuucaaacaaauc

SEQ ID NO: 4029257 - RNA, 18 nt, Staphylococcus aureus subsp. aureus MW2
uacuuucacuuuuuauau

SEQ ID NO: 4029258 - RNA, 20 nt, Staphylococcus aureus subsp. aureus MW2
uacuuucagucguuaaaaua

SEQ ID NO: 4029259 - RNA, 16 nt, Staphylococcus aureus subsp. aureus MW2
uacuuucugcccacuu

SEQ ID NO: 4029260 - RNA, 20 nt, Staphylococcus aureus subsp. aureus MW2
uacuuucugcccacuuaaua

SEQ ID NO: 4029261 - RNA, 18 nt, Staphylococcus aureus subsp. aureus MW2
uacuuuggaaauuuauua

SEQ ID NO: 4029262 - RNA, 18 nt, Staphylococcus aureus subsp. aureus MW2
uacuuuggacuuuaaagu

SEQ ID NO: 4029263 - RNA, 19 nt, Staphylococcus aureus subsp. aureus MW2
uacuuuggacuuuaaaguu

SEQ ID NO: 4029264 - RNA, 23 nt, Staphylococcus aureus subsp. aureus MW2
uacuuuggcagacguaucaucaa

SEQ ID NO: 4029265 - RNA, 18 nt, Staphylococcus aureus subsp. aureus MW2
uacuuuguucugcuuuuu

SEQ ID NO: 4029266 - RNA, 18 nt, Staphylococcus aureus subsp. aureus MW2
uacuuuucugucuguaaa

SEQ ID NO: 4029267 - RNA, 17 nt, Staphylococcus aureus subsp. aureus MW2
uacuuuucuuuuuacuu

SEQ ID NO: 4029268 - RNA, 15 nt, Staphylococcus aureus subsp. aureus MW2
uacuuuuuauauaau

SEQ ID NO: 4029269 - RNA, 14 nt, Staphylococcus aureus subsp. aureus MW2
uacuuuuucagaau

SEQ ID NO: 4029270 - RNA, 13 nt, Staphylococcus aureus subsp. aureus MW2
uacuuuuuuaaug

SEQ ID NO: 4029271 - RNA, 19 nt, Staphylococcus aureus subsp. aureus MW2
uagaaaaagcaggcaagcu

SEQ ID NO: 4029272 - RNA, 12 nt, Staphylococcus aureus subsp. aureus MW2
uagaaaaaguuu

SEQ ID NO: 4029273 - RNA, 15 nt, Staphylococcus aureus subsp. aureus MW2
uagaaaaauuucaaa

SEQ ID NO: 4029274 - RNA, 18 nt, Staphylococcus aureus subsp. aureus MW2
uagaaaaggcucauuugu

SEQ ID NO: 4029275 - RNA, 19 nt, Staphylococcus aureus subsp. aureus MW2
uagaaaaguaaguaaaaua

SEQ ID NO: 4029276 - RNA, 22 nt, Staphylococcus aureus subsp. aureus MW2
uagaaaauaugacgaucuucau

SEQ ID NO: 4029277 - RNA, 12 nt, Staphylococcus aureus subsp. aureus MW2
uagaaaauuaac

SEQ ID NO: 4029278 - RNA, 16 nt, Staphylococcus aureus subsp. aureus MW2
uagaaacgaaauuaua

SEQ ID NO: 4029279 - RNA, 18 nt, Staphylococcus aureus subsp. aureus MW2
uagaaagugauucccaaa

SEQ ID NO: 4029280 - RNA, 15 nt, Staphylococcus aureus subsp. aureus MW2
uagaaaguuuuauuu

SEQ ID NO: 4029281 - RNA, 17 nt, Staphylococcus aureus subsp. aureus MW2
uagaaauuguaguauuu

SEQ ID NO: 4029282 - RNA, 16 nt, Staphylococcus aureus subsp. aureus MW2
uagaaauugugcuuuu

SEQ ID NO: 4029283 - RNA, 15 nt, Staphylococcus aureus subsp. aureus MW2
uagaacaguuagaaa

SEQ ID NO: 4029284 - RNA, 21 nt, Staphylococcus aureus subsp. aureus MW2
uagaacgaaauaguucaaaau

SEQ ID NO: 4029285 - RNA, 18 nt, Staphylococcus aureus subsp. aureus MW2
uagaagaacaauaauuga

SEQ ID NO: 4029286 - RNA, 22 nt, Staphylococcus aureus subsp. aureus MW2
uagaagaacaauaauugaugaa

SEQ ID NO: 4029287 - RNA, 20 nt, Staphylococcus aureus subsp. aureus MW2
uagaagcaaaagaugaaaau

SEQ ID NO: 4029288 - RNA, 20 nt, Staphylococcus aureus subsp. aureus MW2
uagaagcuggcggaaaguca

SEQ ID NO: 4029289 - RNA, 22 nt, Staphylococcus aureus subsp. aureus MW2
uagaagcuggcggaaagucagc

SEQ ID NO: 4029290 - RNA, 22 nt, Staphylococcus aureus subsp. aureus MW2
uagaagcuggcggaaagucagg

SEQ ID NO: 4029291 - RNA, 23 nt, Staphylococcus aureus subsp. aureus MW2
uagaagguuauuuuuuauggucu

SEQ ID NO: 4029292 - RNA, 14 nt, Staphylococcus aureus subsp. aureus MW2
uagaaguucuuaug

SEQ ID NO: 4029293 - RNA, 13 nt, Staphylococcus aureus subsp. aureus MW2
uagaaguuuagug

SEQ ID NO: 4029294 - RNA, 15 nt, Staphylococcus aureus subsp. aureus MW2
uagaaguuuuuugau

SEQ ID NO: 4029295 - RNA, 23 nt, Staphylococcus aureus subsp. aureus MW2
uagaauaacuugauauuauauaa

SEQ ID NO: 4029296 - RNA, 17 nt, Staphylococcus aureus subsp. aureus MW2
uagaauagucaauuaau

SEQ ID NO: 4029297 - RNA, 18 nt, Staphylococcus aureus subsp. aureus MW2
uagaauagucaauuaaug

SEQ ID NO: 4029298 - RNA, 19 nt, Staphylococcus aureus subsp. aureus MW2
uagaauagucaauuaauga

SEQ ID NO: 4029299 - RNA, 17 nt, Staphylococcus aureus subsp. aureus MW2
uagaauaguuaccaaaa

SEQ ID NO: 4029300 - RNA, 20 nt, Staphylococcus aureus subsp. aureus MW2
uagaaucaaccguuuuauug

SEQ ID NO: 4029301 - RNA, 16 nt, Staphylococcus aureus subsp. aureus MW2
uagaaugauuaaaauu

SEQ ID NO: 4029302 - RNA, 19 nt, Staphylococcus aureus subsp. aureus MW2
uagaaugauuaaaauuaau

SEQ ID NO: 4029303 - RNA, 15 nt, Staphylococcus aureus subsp. aureus MW2
uagaauucauuaauc

SEQ ID NO: 4029304 - RNA, 17 nt, Staphylococcus aureus subsp. aureus MW2
uagaauucuaaaagaau

SEQ ID NO: 4029305 - RNA, 16 nt, Staphylococcus aureus subsp. aureus MW2
uagacaacugcaagug

SEQ ID NO: 4029306 - RNA, 14 nt, Staphylococcus aureus subsp. aureus MW2
uagacauaaaaaaa

SEQ ID NO: 4029307 - RNA, 14 nt, Staphylococcus aureus subsp. aureus MW2
uagacauuaaaaaa

SEQ ID NO: 4029308 - RNA, 16 nt, Staphylococcus aureus subsp. aureus MW2
uagacauuguuaaacu

SEQ ID NO: 4029309 - RNA, 13 nt, Staphylococcus aureus subsp. aureus MW2
uagacuaaaaaac

SEQ ID NO: 4029310 - RNA, 17 nt, Staphylococcus aureus subsp. aureus MW2
uagacuuuauuuuucca

SEQ ID NO: 4029311 - RNA, 13 nt, Staphylococcus aureus subsp. aureus MW2
uagagaaaaaaua

SEQ ID NO: 4029312 - RNA, 13 nt, Staphylococcus aureus subsp. aureus MW2
uagagaacagcag

SEQ ID NO: 4029313 - RNA, 13 nt, Staphylococcus aureus subsp. aureus MW2
uagagaauuucaa

SEQ ID NO: 4029314 - RNA, 14 nt, Staphylococcus aureus subsp. aureus MW2
uagagaauuucaaa

SEQ ID NO: 4029315 - RNA, 21 nt, Staphylococcus aureus subsp. aureus MW2
uagaguuuaggacauugauuu

SEQ ID NO: 4029316 - RNA, 15 nt, Staphylococcus aureus subsp. aureus MW2
uagauaaaucaagaa

SEQ ID NO: 4029317 - RNA, 19 nt, Staphylococcus aureus subsp. aureus MW2
uagauaaaucgauaaaaug

SEQ ID NO: 4029318 - RNA, 12 nt, Staphylococcus aureus subsp. aureus MW2
uagauaauauau

SEQ ID NO: 4029319 - RNA, 12 nt, Staphylococcus aureus subsp. aureus MW2
uagauaaucuca

SEQ ID NO: 4029320 - RNA, 23 nt, Staphylococcus aureus subsp. aureus MW2
uagauaaucucauucuuuaauau

SEQ ID NO: 4029321 - RNA, 13 nt, Staphylococcus aureus subsp. aureus MW2
uagauacauagaa

SEQ ID NO: 4029322 - RNA, 15 nt, Staphylococcus aureus subsp. aureus MW2
uagauaccaaacugc

SEQ ID NO: 4029323 - RNA, 23 nt, Staphylococcus aureus subsp. aureus MW2
uaggaauuguuaauuucaacauu

SEQ ID NO: 4029324 - RNA, 16 nt, Staphylococcus aureus subsp. aureus MW2
uaggaccuacaauuuu

SEQ ID NO: 4029325 - RNA, 18 nt, Staphylococcus aureus subsp. aureus MW2
uaggagagauguauaaaa

SEQ ID NO: 4029326 - RNA, 20 nt, Staphylococcus aureus subsp. aureus MW2
uaggagagauguauaaaacu

SEQ ID NO: 4029327 - RNA, 13 nt, Staphylococcus aureus subsp. aureus MW2
uaggagucuggaa

SEQ ID NO: 4029328 - RNA, 23 nt, Staphylococcus aureus subsp. aureus MW2
uaggauaauuucaauuuggaaau

SEQ ID NO: 4029329 - RNA, 14 nt, Staphylococcus aureus subsp. aureus MW2
uaggaugaaacuuu

SEQ ID NO: 4029330 - RNA, 23 nt, Staphylococcus aureus subsp. aureus MW2
uaggauucgauugguuuaaaaag

SEQ ID NO: 4029331 - RNA, 21 nt, Staphylococcus aureus subsp. aureus MW2
uaggauuguuuuuaagucguu

SEQ ID NO: 4029332 - RNA, 16 nt, Staphylococcus aureus subsp. aureus MW2
uaggcuagauaauaau

SEQ ID NO: 4029333 - RNA, 14 nt, Staphylococcus aureus subsp. aureus MW2
uaggcugaaguuga

SEQ ID NO: 4029334 - RNA, 16 nt, Staphylococcus aureus subsp. aureus MW2
uagggauaauuuuauu

SEQ ID NO: 4029335 - RNA, 17 nt, Staphylococcus aureus subsp. aureus MW2
uaggggcuucuuucuaa

SEQ ID NO: 4029336 - RNA, 23 nt, Staphylococcus aureus subsp. aureus MW2
uaggggcuucuuucuaaaauaac

SEQ ID NO: 4029337 - RNA, 20 nt, Staphylococcus aureus subsp. aureus MW2
uagggguggaaauaugaaaa

SEQ ID NO: 4029338 - RNA, 22 nt, Staphylococcus aureus subsp. aureus MW2
uagggguggaaauaugaaaaga

SEQ ID NO: 4029339 - RNA, 17 nt, Staphylococcus aureus subsp. aureus MW2
uaggguauugaaauaau

SEQ ID NO: 4029340 - RNA, 16 nt, Staphylococcus aureus subsp. aureus MW2
uagguacaacuaaaua

SEQ ID NO: 4029341 - RNA, 15 nt, Staphylococcus aureus subsp. aureus MW2
uagguauaaucauuu

SEQ ID NO: 4029342 - RNA, 21 nt, Staphylococcus aureus subsp. aureus MW2
uaggucaacuguaguggaaga

SEQ ID NO: 4029343 - RNA, 18 nt, Staphylococcus aureus subsp. aureus MW2
uaggucuacgaucaaaau

SEQ ID NO: 4029344 - RNA, 15 nt, Staphylococcus aureus subsp. aureus MW2
uaggugauuauauau

SEQ ID NO: 4029345 - RNA, 20 nt, Staphylococcus aureus subsp. aureus MW2
uagguggcuuuuuuauuuua

SEQ ID NO: 4029346 - RNA, 14 nt, Staphylococcus aureus subsp. aureus MW2
uagguucuucuuuc

SEQ ID NO: 4029347 - RNA, 16 nt, Staphylococcus aureus subsp. aureus MW2
uagguugauuucugcu

SEQ ID NO: 4029348 - RNA, 13 nt, Staphylococcus aureus subsp. aureus MW2
uagguuuaauuuu

SEQ ID NO: 4029349 - RNA, 18 nt, Staphylococcus aureus subsp. aureus MW2
uagguuuauuucugaaaa

SEQ ID NO: 4029350 - RNA, 23 nt, Staphylococcus aureus subsp. aureus MW2
uaguaaaauaaauacaauagaaa

SEQ ID NO: 4029351 - RNA, 16 nt, Staphylococcus aureus subsp. aureus MW2
uaguaacgcauaugau

SEQ ID NO: 4029352 - RNA, 20 nt, Staphylococcus aureus subsp. aureus MW2
uaguaacgucugguuuaaug

SEQ ID NO: 4029353 - RNA, 20 nt, Staphylococcus aureus subsp. aureus MW2
uaguaagagcucucguguau

SEQ ID NO: 4029354 - RNA, 19 nt, Staphylococcus aureus subsp. aureus MW2
uaguaauaacaucuaaauu

SEQ ID NO: 4029355 - RNA, 20 nt, Staphylococcus aureus subsp. aureus MW2
uaguaauaacaucuaaauuu

SEQ ID NO: 4029356 - RNA, 16 nt, Staphylococcus aureus subsp. aureus MW2
uaguaauaagacaaua

SEQ ID NO: 4029357 - RNA, 22 nt, Staphylococcus aureus subsp. aureus MW2
uaguaaugaugugaauuggauu

SEQ ID NO: 4029358 - RNA, 18 nt, Staphylococcus aureus subsp. aureus MW2
uaguaccaagcuucauua

SEQ ID NO: 4029359 - RNA, 16 nt, Staphylococcus aureus subsp. aureus MW2
uaguaccaugcucuuu

SEQ ID NO: 4029360 - RNA, 15 nt, Staphylococcus aureus subsp. aureus MW2
uaguacgaaaugcau

SEQ ID NO: 4029361 - RNA, 23 nt, Staphylococcus aureus subsp. aureus MW2
uaguacuaaaccgauuaauauaa

SEQ ID NO: 4029362 - RNA, 16 nt, Staphylococcus aureus subsp. aureus MW2
uaguacuuaauacuaa

SEQ ID NO: 4029363 - RNA, 22 nt, Staphylococcus aureus subsp. aureus MW2
uaguacuuugauaucuacagag

SEQ ID NO: 4029364 - RNA, 22 nt, Staphylococcus aureus subsp. aureus MW2
uaguagacgguaucaucugcau

SEQ ID NO: 4029365 - RNA, 14 nt, Staphylococcus aureus subsp. aureus MW2
uaguagcuagaaca

SEQ ID NO: 4029366 - RNA, 15 nt, Staphylococcus aureus subsp. aureus MW2
uaguagcuugaauag

SEQ ID NO: 4029367 - RNA, 12 nt, Staphylococcus aureus subsp. aureus MW2
uaguaguguauu

SEQ ID NO: 4029368 - RNA, 14 nt, Staphylococcus aureus subsp. aureus MW2
uaguauaaauauca

SEQ ID NO: 4029369 - RNA, 15 nt, Staphylococcus aureus subsp. aureus MW2
uaguauaaauaucau

SEQ ID NO: 4029370 - RNA, 18 nt, Staphylococcus aureus subsp. aureus MW2
uaguaugacaaauuaaaa

SEQ ID NO: 4029371 - RNA, 12 nt, Staphylococcus aureus subsp. aureus MW2
uaguaugacuua

SEQ ID NO: 4029372 - RNA, 13 nt, Staphylococcus aureus subsp. aureus MW2
uaguauguuuuau

SEQ ID NO: 4029373 - RNA, 18 nt, Staphylococcus aureus subsp. aureus MW2
uaguauuaacgcuuauac

SEQ ID NO: 4029374 - RNA, 17 nt, Staphylococcus aureus subsp. aureus MW2
uaguauuaucuuucaua

SEQ ID NO: 4029375 - RNA, 21 nt, Staphylococcus aureus subsp. aureus MW2
uaguauuuuuugccaucaauu

SEQ ID NO: 4029376 - RNA, 17 nt, Staphylococcus aureus subsp. aureus MW2
uagucaggggccccaac

SEQ ID NO: 4029377 - RNA, 18 nt, Staphylococcus aureus subsp. aureus MW2
uagucaggggccccaaca

SEQ ID NO: 4029378 - RNA, 22 nt, Staphylococcus aureus subsp. aureus MW2
uagucaggggccccaacacaga

SEQ ID NO: 4029379 - RNA, 13 nt, Staphylococcus aureus subsp. aureus MW2
uagucauaacgau

SEQ ID NO: 4029380 - RNA, 14 nt, Staphylococcus aureus subsp. aureus MW2
uagucauaauuuag

SEQ ID NO: 4029381 - RNA, 20 nt, Staphylococcus aureus subsp. aureus MW2
uagucauguuuggcauaaua

SEQ ID NO: 4029382 - RNA, 16 nt, Staphylococcus aureus subsp. aureus MW2
uagucauuacaaauca

SEQ ID NO: 4029383 - RNA, 17 nt, Staphylococcus aureus subsp. aureus MW2
uagucauuacaaaucau

SEQ ID NO: 4029384 - RNA, 16 nt, Staphylococcus aureus subsp. aureus MW2
uagucauugaaaauau

SEQ ID NO: 4029385 - RNA, 21 nt, Staphylococcus aureus subsp. aureus MW2
uagucauugaaaauauuuuau

SEQ ID NO: 4029386 - RNA, 18 nt, Staphylococcus aureus subsp. aureus MW2
uagucauuugaugguuua

SEQ ID NO: 4029387 - RNA, 23 nt, Staphylococcus aureus subsp. aureus MW2
uaguccuucuuuacuaaaccuca

SEQ ID NO: 4029388 - RNA, 21 nt, Staphylococcus aureus subsp. aureus MW2
uagucgaagaagauuaugaaa

SEQ ID NO: 4029389 - RNA, 15 nt, Staphylococcus aureus subsp. aureus MW2
uagucggggccccaa

SEQ ID NO: 4029390 - RNA, 16 nt, Staphylococcus aureus subsp. aureus MW2
uagucggggccccaac

SEQ ID NO: 4029391 - RNA, 17 nt, Staphylococcus aureus subsp. aureus MW2
uagucgucgaaaugccu

SEQ ID NO: 4029392 - RNA, 23 nt, Staphylococcus aureus subsp. aureus MW2
uagucuaugaauaauguuuucau

SEQ ID NO: 4029393 - RNA, 16 nt, Staphylococcus aureus subsp. aureus MW2
uagucucguaauaaug

SEQ ID NO: 4029394 - RNA, 15 nt, Staphylococcus aureus subsp. aureus MW2
uagucugcuauuuuu

SEQ ID NO: 4029395 - RNA, 21 nt, Staphylococcus aureus subsp. aureus MW2
uagucuuuuuuaagcuuauca

SEQ ID NO: 4029396 - RNA, 12 nt, Staphylococcus aureus subsp. aureus MW2
uagugaauaaug

SEQ ID NO: 4029397 - RNA, 13 nt, Staphylococcus aureus subsp. aureus MW2
uagugagcguauu

SEQ ID NO: 4029398 - RNA, 22 nt, Staphylococcus aureus subsp. aureus MW2
uagugcucuugcaauagcaaca

SEQ ID NO: 4029399 - RNA, 12 nt, Staphylococcus aureus subsp. aureus MW2
uagugcuuguuu

SEQ ID NO: 4029400 - RNA, 16 nt, Staphylococcus aureus subsp. aureus MW2
uagugucacauuauac

SEQ ID NO: 4029401 - RNA, 18 nt, Staphylococcus aureus subsp. aureus MW2
uaguguucucauuauaau

SEQ ID NO: 4029402 - RNA, 16 nt, Staphylococcus aureus subsp. aureus MW2
uaguuaauauaauuaa

SEQ ID NO: 4029403 - RNA, 18 nt, Staphylococcus aureus subsp. aureus MW2
uaguuauacuacuauuga

SEQ ID NO: 4029404 - RNA, 17 nt, Staphylococcus aureus subsp. aureus MW2
uaguuaugugcuaaucu

SEQ ID NO: 4029405 - RNA, 19 nt, Staphylococcus aureus subsp. aureus MW2
uaguucaaauugaacuucu

SEQ ID NO: 4029406 - RNA, 23 nt, Staphylococcus aureus subsp. aureus MW2
uaguucaaauugaacuucuuuuu

SEQ ID NO: 4029407 - RNA, 20 nt, Staphylococcus aureus subsp. aureus MW2
uaguucacaugaauuuuaau

SEQ ID NO: 4029408 - RNA, 21 nt, Staphylococcus aureus subsp. aureus MW2
uaguucacaugaauuuuaaua

SEQ ID NO: 4029409 - RNA, 17 nt, Staphylococcus aureus subsp. aureus MW2
uaguucuguugauauuu

SEQ ID NO: 4029410 - RNA, 20 nt, Staphylococcus aureus subsp. aureus MW2
uaguugacuguaaaacaaug

SEQ ID NO: 4029411 - RNA, 21 nt, Staphylococcus aureus subsp. aureus MW2
uauaauaauauugaaagauau

SEQ ID NO: 4029412 - RNA, 19 nt, Staphylococcus aureus subsp. aureus MW2
uauaauacaugauauaaau

SEQ ID NO: 4029413 - RNA, 13 nt, Staphylococcus aureus subsp. aureus MW2
uauaauagaaaua

SEQ ID NO: 4029414 - RNA, 14 nt, Staphylococcus aureus subsp. aureus MW2
uauaauagaaauaa

SEQ ID NO: 4029415 - RNA, 15 nt, Staphylococcus aureus subsp. aureus MW2
uauaauauauacaaa

SEQ ID NO: 4029416 - RNA, 17 nt, Staphylococcus aureus subsp. aureus MW2
uauaauauauacaaaua

SEQ ID NO: 4029417 - RNA, 18 nt, Staphylococcus aureus subsp. aureus MW2
uauaauaugugcaugaga

SEQ ID NO: 4029418 - RNA, 17 nt, Staphylococcus aureus subsp. aureus MW2
uauaauauucaauaauu

SEQ ID NO: 4029419 - RNA, 20 nt, Staphylococcus aureus subsp. aureus MW2
uauaaucauuuaaacgaucu

SEQ ID NO: 4029420 - RNA, 16 nt, Staphylococcus aureus subsp. aureus MW2
uauaaucuauaaaugg

SEQ ID NO: 4029421 - RNA, 18 nt, Staphylococcus aureus subsp. aureus MW2
uauaaugaaguuaugaag

SEQ ID NO: 4029422 - RNA, 17 nt, Staphylococcus aureus subsp. aureus MW2
uauaaugaauaaauaau

SEQ ID NO: 4029423 - RNA, 19 nt, Staphylococcus aureus subsp. aureus MW2
uauaaugaauaaauaauuu

SEQ ID NO: 4029424 - RNA, 12 nt, Staphylococcus aureus subsp. aureus MW2
uauaaugauuaa

SEQ ID NO: 4029425 - RNA, 21 nt, Staphylococcus aureus subsp. aureus MW2
uauaaugauugucuuauaaga

SEQ ID NO: 4029426 - RNA, 14 nt, Staphylococcus aureus subsp. aureus MW2
uauaaugauuuaau

SEQ ID NO: 4029427 - RNA, 15 nt, Staphylococcus aureus subsp. aureus MW2
uauaaugauuuaauu

SEQ ID NO: 4029428 - RNA, 16 nt, Staphylococcus aureus subsp. aureus MW2
uauaaugauuuaauuu

SEQ ID NO: 4029429 - RNA, 23 nt, Staphylococcus aureus subsp. aureus MW2
uauaaugccuaauuuguaacccc

SEQ ID NO: 4029430 - RNA, 16 nt, Staphylococcus aureus subsp. aureus MW2
uauaaugguugaauaa

SEQ ID NO: 4029431 - RNA, 15 nt, Staphylococcus aureus subsp. aureus MW2
uauaauguauaaaac

SEQ ID NO: 4029432 - RNA, 13 nt, Staphylococcus aureus subsp. aureus MW2
uauaauuaaacau

SEQ ID NO: 4029433 - RNA, 21 nt, Staphylococcus aureus subsp. aureus MW2
uauaauuaaacauuuagauuu

SEQ ID NO: 4029434 - RNA, 14 nt, Staphylococcus aureus subsp. aureus MW2
uauaauuaaacuaa

SEQ ID NO: 4029435 - RNA, 16 nt, Staphylococcus aureus subsp. aureus MW2
uauaauuaaacuaaua

SEQ ID NO: 4029436 - RNA, 18 nt, Staphylococcus aureus subsp. aureus MW2
uauaauuaaguguauaua

SEQ ID NO: 4029437 - RNA, 13 nt, Staphylococcus aureus subsp. aureus MW2
uauaauuacaagu

SEQ ID NO: 4029438 - RNA, 20 nt, Staphylococcus aureus subsp. aureus MW2
uauaauuacaaguuacauua

SEQ ID NO: 4029439 - RNA, 15 nt, Staphylococcus aureus subsp. aureus MW2
uauaauuauuaaacu

SEQ ID NO: 4029440 - RNA, 16 nt, Staphylococcus aureus subsp. aureus MW2
uauaauuauuuuuaua

SEQ ID NO: 4029441 - RNA, 22 nt, Staphylococcus aureus subsp. aureus MW2
uauaauucgucuguuucauaua

SEQ ID NO: 4029442 - RNA, 11 nt, Staphylococcus aureus subsp. aureus MW2
uauaauucuuc

SEQ ID NO: 4029443 - RNA, 15 nt, Staphylococcus aureus subsp. aureus MW2
uauaauuggcagaua

SEQ ID NO: 4029444 - RNA, 20 nt, Staphylococcus aureus subsp. aureus MW2
uauaauuggcagauagaaug

SEQ ID NO: 4029445 - RNA, 18 nt, Staphylococcus aureus subsp. aureus MW2
uauaauuguaaugcuucu

SEQ ID NO: 4029446 - RNA, 17 nt, Staphylococcus aureus subsp. aureus MW2
uauaauuuaauugguuu

SEQ ID NO: 4029447 - RNA, 15 nt, Staphylococcus aureus subsp. aureus MW2
uauaauuuauaaaaa

SEQ ID NO: 4029448 - RNA, 16 nt, Staphylococcus aureus subsp. aureus MW2
uauaauuuaucuuaau

SEQ ID NO: 4029449 - RNA, 22 nt, Staphylococcus aureus subsp. aureus MW2
uauaauuuauuuagcaucuuua

SEQ ID NO: 4029450 - RNA, 14 nt, Staphylococcus aureus subsp. aureus MW2
uauaauuuguauaa

SEQ ID NO: 4029451 - RNA, 15 nt, Staphylococcus aureus subsp. aureus MW2
uauaauuuuaauauu

SEQ ID NO: 4029452 - RNA, 17 nt, Staphylococcus aureus subsp. aureus MW2
uauaauuuuaauauuau

SEQ ID NO: 4029453 - RNA, 15 nt, Staphylococcus aureus subsp. aureus MW2
uauaauuuuguuuca

SEQ ID NO: 4029454 - RNA, 17 nt, Staphylococcus aureus subsp. aureus MW2
uauaauuuuguuucacu

SEQ ID NO: 4029455 - RNA, 18 nt, Staphylococcus aureus subsp. aureus MW2
uauaauuuuguuucacua

SEQ ID NO: 4029456 - RNA, 20 nt, Staphylococcus aureus subsp. aureus MW2
uauacaaauuuauauuaaau

SEQ ID NO: 4029457 - RNA, 17 nt, Staphylococcus aureus subsp. aureus MW2
uauacaacauguguaug

SEQ ID NO: 4029458 - RNA, 18 nt, Staphylococcus aureus subsp. aureus MW2
uauacaauaguauaaaua

SEQ ID NO: 4029459 - RNA, 21 nt, Staphylococcus aureus subsp. aureus MW2
uauacaauaguauaaauauca

SEQ ID NO: 4029460 - RNA, 18 nt, Staphylococcus aureus subsp. aureus MW2
uauacaauguauuuugau

SEQ ID NO: 4029461 - RNA, 16 nt, Staphylococcus aureus subsp. aureus MW2
uauacacuuacaaaua

SEQ ID NO: 4029462 - RNA, 18 nt, Staphylococcus aureus subsp. aureus MW2
uauacacuuuuugacaua

SEQ ID NO: 4029463 - RNA, 20 nt, Staphylococcus aureus subsp. aureus MW2
uauacagguuuaauaaauuu

SEQ ID NO: 4029464 - RNA, 17 nt, Staphylococcus aureus subsp. aureus MW2
uauacauugauaaauuu

SEQ ID NO: 4029465 - RNA, 17 nt, Staphylococcus aureus subsp. aureus MW2
uauaccauuccaaaaau

SEQ ID NO: 4029466 - RNA, 19 nt, Staphylococcus aureus subsp. aureus MW2
uauacuaaacuuuuuucaa

SEQ ID NO: 4029467 - RNA, 13 nt, Staphylococcus aureus subsp. aureus MW2
uauacuaaauuga

SEQ ID NO: 4029468 - RNA, 15 nt, Staphylococcus aureus subsp. aureus MW2
uauacugaugaaaac

SEQ ID NO: 4029469 - RNA, 19 nt, Staphylococcus aureus subsp. aureus MW2
uauacuugaugaaacugau

SEQ ID NO: 4029470 - RNA, 16 nt, Staphylococcus aureus subsp. aureus MW2
uauacuuuaucuauuu

SEQ ID NO: 4029471 - RNA, 22 nt, Staphylococcus aureus subsp. aureus MW2
uauacuuugagcggaaauauga

SEQ ID NO: 4029472 - RNA, 15 nt, Staphylococcus aureus subsp. aureus MW2
uauacuuuuggucug

SEQ ID NO: 4029473 - RNA, 13 nt, Staphylococcus aureus subsp. aureus MW2
uauacuuuuuaaa

SEQ ID NO: 4029474 - RNA, 16 nt, Staphylococcus aureus subsp. aureus MW2
uauacuuuuuaaauga

SEQ ID NO: 4029475 - RNA, 18 nt, Staphylococcus aureus subsp. aureus MW2
uauacuuuuuaaaugauu

SEQ ID NO: 4029476 - RNA, 11 nt, Staphylococcus aureus subsp. aureus MW2
uauagaaaaag

SEQ ID NO: 4029477 - RNA, 20 nt, Staphylococcus aureus subsp. aureus MW2
uauagaaaaagggcaaaaaa

SEQ ID NO: 4029478 - RNA, 21 nt, Staphylococcus aureus subsp. aureus MW2
uauagaaaaugaguacaacau

SEQ ID NO: 4029479 - RNA, 23 nt, Staphylococcus aureus subsp. aureus MW2
uauagaaaaugaguacaacauag

SEQ ID NO: 4029480 - RNA, 17 nt, Staphylococcus aureus subsp. aureus MW2
uauagaaaccaaaaaau

SEQ ID NO: 4029481 - RNA, 17 nt, Staphylococcus aureus subsp. aureus MW2
uauagaaugauuaaaau

SEQ ID NO: 4029482 - RNA, 19 nt, Staphylococcus aureus subsp. aureus MW2
uauagaaugauuaaaauua

SEQ ID NO: 4029483 - RNA, 17 nt, Staphylococcus aureus subsp. aureus MW2
uauagacauaagcaaag

SEQ ID NO: 4029484 - RNA, 18 nt, Staphylococcus aureus subsp. aureus MW2
uauagacauaagcaaaga

SEQ ID NO: 4029485 - RNA, 22 nt, Staphylococcus aureus subsp. aureus MW2
uauagaggauauuuauucuaag

SEQ ID NO: 4029486 - RNA, 23 nt, Staphylococcus aureus subsp. aureus MW2
uauagaugacuguagaaaacaug

SEQ ID NO: 4029487 - RNA, 19 nt, Staphylococcus aureus subsp. aureus MW2
uauagauggcguaagcagu

SEQ ID NO: 4029488 - RNA, 14 nt, Staphylococcus aureus subsp. aureus MW2
uauagauugccauu

SEQ ID NO: 4029489 - RNA, 18 nt, Staphylococcus aureus subsp. aureus MW2
uauagauuuuauaaaaag

SEQ ID NO: 4029490 - RNA, 20 nt, Staphylococcus aureus subsp. aureus MW2
uauagauuuuguauuagcau

SEQ ID NO: 4029491 - RNA, 21 nt, Staphylococcus aureus subsp. aureus MW2
uauagcaaauugauuaaauaa

SEQ ID NO: 4029492 - RNA, 17 nt, Staphylococcus aureus subsp. aureus MW2
uauagcugugauuugau

SEQ ID NO: 4029493 - RNA, 21 nt, Staphylococcus aureus subsp. aureus MW2
uauaggcccuaacgguagaau

SEQ ID NO: 4029494 - RNA, 19 nt, Staphylococcus aureus subsp. aureus MW2
uauagggcuguuuuuuaau

SEQ ID NO: 4029495 - RNA, 16 nt, Staphylococcus aureus subsp. aureus MW2
uauaguaaaauaaaua

SEQ ID NO: 4029496 - RNA, 15 nt, Staphylococcus aureus subsp. aureus MW2
uauaguaauaaaagu

SEQ ID NO: 4029497 - RNA, 18 nt, Staphylococcus aureus subsp. aureus MW2
uauaguaauagcuauauu

SEQ ID NO: 4029498 - RNA, 23 nt, Staphylococcus aureus subsp. aureus MW2
uauaguacuuacgaauagaaaau

SEQ ID NO: 4029499 - RNA, 23 nt, Staphylococcus aureus subsp. aureus MW2
uauaguaggguauugaaauaaua

SEQ ID NO: 4029500 - RNA, 22 nt, Staphylococcus aureus subsp. aureus MW2
uaucaaguaugcgccauacaua

SEQ ID NO: 4029501 - RNA, 17 nt, Staphylococcus aureus subsp. aureus MW2
uaucaauagaugaaaau

SEQ ID NO: 4029502 - RNA, 22 nt, Staphylococcus aureus subsp. aureus MW2
uaucaauagaugaaaauuuaau

SEQ ID NO: 4029503 - RNA, 18 nt, Staphylococcus aureus subsp. aureus MW2
uaucaauugaaugaagua

SEQ ID NO: 4029504 - RNA, 14 nt, Staphylococcus aureus subsp. aureus MW2
uaucaauuucuauu

SEQ ID NO: 4029505 - RNA, 18 nt, Staphylococcus aureus subsp. aureus MW2
uaucacaacacauaaauu

SEQ ID NO: 4029506 - RNA, 17 nt, Staphylococcus aureus subsp. aureus MW2
uaucacaacaguauuaa

SEQ ID NO: 4029507 - RNA, 15 nt, Staphylococcus aureus subsp. aureus MW2
uaucaccauaaaaau

SEQ ID NO: 4029508 - RNA, 15 nt, Staphylococcus aureus subsp. aureus MW2
uaucaccuaauugaa

SEQ ID NO: 4029509 - RNA, 16 nt, Staphylococcus aureus subsp. aureus MW2
uaucaccuucaaacuu

SEQ ID NO: 4029510 - RNA, 18 nt, Staphylococcus aureus subsp. aureus MW2
uaucacuaauauauuuag

SEQ ID NO: 4029511 - RNA, 20 nt, Staphylococcus aureus subsp. aureus MW2
uaucacuaauauauuuagau

SEQ ID NO: 4029512 - RNA, 14 nt, Staphylococcus aureus subsp. aureus MW2
uaucacugaaugcu

SEQ ID NO: 4029513 - RNA, 18 nt, Staphylococcus aureus subsp. aureus MW2
uaucacuuauuauuuugu

SEQ ID NO: 4029514 - RNA, 17 nt, Staphylococcus aureus subsp. aureus MW2
uaucacuuuucaugaug

SEQ ID NO: 4029515 - RNA, 15 nt, Staphylococcus aureus subsp. aureus MW2
uaucaguagcauauu

SEQ ID NO: 4029516 - RNA, 18 nt, Staphylococcus aureus subsp. aureus MW2
uaucaguccaaucaguuu

SEQ ID NO: 4029517 - RNA, 21 nt, Staphylococcus aureus subsp. aureus MW2
uaucauaauagccgcuucauu

SEQ ID NO: 4029518 - RNA, 15 nt, Staphylococcus aureus subsp. aureus MW2
uaucauaauauugau

SEQ ID NO: 4029519 - RNA, 18 nt, Staphylococcus aureus subsp. aureus MW2
uaucauacuucaaacguu

SEQ ID NO: 4029520 - RNA, 14 nt, Staphylococcus aureus subsp. aureus MW2
uaucauauuacuuc

SEQ ID NO: 4029521 - RNA, 13 nt, Staphylococcus aureus subsp. aureus MW2
uaucauauucaaa

SEQ ID NO: 4029522 - RNA, 14 nt, Staphylococcus aureus subsp. aureus MW2
uaucauauucaaaa

SEQ ID NO: 4029523 - RNA, 16 nt, Staphylococcus aureus subsp. aureus MW2
uaucaucaaaauuuaa

SEQ ID NO: 4029524 - RNA, 23 nt, Staphylococcus aureus subsp. aureus MW2
uaucaucaaucguuaauuuccaa

SEQ ID NO: 4029525 - RNA, 13 nt, Staphylococcus aureus subsp. aureus MW2
uaucaucauacuu

SEQ ID NO: 4029526 - RNA, 19 nt, Staphylococcus aureus subsp. aureus MW2
uaucaucauacuucaauaa

SEQ ID NO: 4029527 - RNA, 16 nt, Staphylococcus aureus subsp. aureus MW2
uaucaucauuuaaaua

SEQ ID NO: 4029528 - RNA, 12 nt, Staphylococcus aureus subsp. aureus MW2
uaucaucuauuc

SEQ ID NO: 4029529 - RNA, 20 nt, Staphylococcus aureus subsp. aureus MW2
uaucaucugcaagugcuuca

SEQ ID NO: 4029530 - RNA, 17 nt, Staphylococcus aureus subsp. aureus MW2
uaucaugaugauaaauu

SEQ ID NO: 4029531 - RNA, 15 nt, Staphylococcus aureus subsp. aureus MW2
uaucaugcaaaauaa

SEQ ID NO: 4029532 - RNA, 13 nt, Staphylococcus aureus subsp. aureus MW2
uaucauuaucaaa

SEQ ID NO: 4029533 - RNA, 18 nt, Staphylococcus aureus subsp. aureus MW2
uaucauuaucaaauaacc

SEQ ID NO: 4029534 - RNA, 20 nt, Staphylococcus aureus subsp. aureus MW2
uaucauuaucaaauaaccua

SEQ ID NO: 4029535 - RNA, 20 nt, Staphylococcus aureus subsp. aureus MW2
uaucauuaugcccgauaauu

SEQ ID NO: 4029536 - RNA, 18 nt, Staphylococcus aureus subsp. aureus MW2
uaucauuauucauacguu

SEQ ID NO: 4029537 - RNA, 21 nt, Staphylococcus aureus subsp. aureus MW2
uaucauuguguccauaaauau

SEQ ID NO: 4029538 - RNA, 22 nt, Staphylococcus aureus subsp. aureus MW2
uaucauuguguccauaaauauu

SEQ ID NO: 4029539 - RNA, 17 nt, Staphylococcus aureus subsp. aureus MW2
uaucauuuaaaauauuu

SEQ ID NO: 4029540 - RNA, 23 nt, Staphylococcus aureus subsp. aureus MW2
uaucauuuaaaauauuuuuucug

SEQ ID NO: 4029541 - RNA, 19 nt, Staphylococcus aureus subsp. aureus MW2
uaucauuucaaauaagaau

SEQ ID NO: 4029542 - RNA, 19 nt, Staphylococcus aureus subsp. aureus MW2
uauccaaggauguuauaaa

SEQ ID NO: 4029543 - RNA, 20 nt, Staphylococcus aureus subsp. aureus MW2
uauccaaggauguuauaaaa

SEQ ID NO: 4029544 - RNA, 21 nt, Staphylococcus aureus subsp. aureus MW2
uauccaaggauguuauaaaau

SEQ ID NO: 4029545 - RNA, 20 nt, Staphylococcus aureus subsp. aureus MW2
uauccauuaugauguagaug

SEQ ID NO: 4029546 - RNA, 21 nt, Staphylococcus aureus subsp. aureus MW2
uauccgaaaauugcuaaaaaa

SEQ ID NO: 4029547 - RNA, 17 nt, Staphylococcus aureus subsp. aureus MW2
uauccucaguauuuaau

SEQ ID NO: 4029548 - RNA, 14 nt, Staphylococcus aureus subsp. aureus MW2
uauccugauuuaau

SEQ ID NO: 4029549 - RNA, 16 nt, Staphylococcus aureus subsp. aureus MW2
uauccuguguaaaaua

SEQ ID NO: 4029550 - RNA, 20 nt, Staphylococcus aureus subsp. aureus MW2
uauccuguuucauaugguga

SEQ ID NO: 4029551 - RNA, 14 nt, Staphylococcus aureus subsp. aureus MW2
uauccuuuaaauca

SEQ ID NO: 4029552 - RNA, 21 nt, Staphylococcus aureus subsp. aureus MW2
uauccuuuugaacguuuacuc

SEQ ID NO: 4029553 - RNA, 15 nt, Staphylococcus aureus subsp. aureus MW2
uauccuuuuugacuc

SEQ ID NO: 4029554 - RNA, 19 nt, Staphylococcus aureus subsp. aureus MW2
uauccuuuuugacucaaaa

SEQ ID NO: 4029555 - RNA, 16 nt, Staphylococcus aureus subsp. aureus MW2
uaucgacuuugucauu

SEQ ID NO: 4029556 - RNA, 13 nt, Staphylococcus aureus subsp. aureus MW2
uaucgauaaaugu

SEQ ID NO: 4029557 - RNA, 17 nt, Staphylococcus aureus subsp. aureus MW2
uaucgauaguucuauau

SEQ ID NO: 4029558 - RNA, 22 nt, Staphylococcus aureus subsp. aureus MW2
uaucgauucgauuauuuagaua

SEQ ID NO: 4029559 - RNA, 19 nt, Staphylococcus aureus subsp. aureus MW2
uaucgccuaaaaauaaaau

SEQ ID NO: 4029560 - RNA, 23 nt, Staphylococcus aureus subsp. aureus MW2
uaucgcgcaucaaaaaugagcau

SEQ ID NO: 4029561 - RNA, 21 nt, Staphylococcus aureus subsp. aureus MW2
uaucgcuuuugaaguuggucc

SEQ ID NO: 4029562 - RNA, 18 nt, Staphylococcus aureus subsp. aureus MW2
uaucgguaauuuuuguaa

SEQ ID NO: 4029563 - RNA, 17 nt, Staphylococcus aureus subsp. aureus MW2
uaucguaaaaaaacguc

SEQ ID NO: 4029564 - RNA, 16 nt, Staphylococcus aureus subsp. aureus MW2
uaucguaaacaacauc

SEQ ID NO: 4029565 - RNA, 20 nt, Staphylococcus aureus subsp. aureus MW2
uaucgucgauuucauuaauu

SEQ ID NO: 4029566 - RNA, 22 nt, Staphylococcus aureus subsp. aureus MW2
uaucgucgauuucauuaauuuu

SEQ ID NO: 4029567 - RNA, 17 nt, Staphylococcus aureus subsp. aureus MW2
uaucgugcguuaaauau

SEQ ID NO: 4029568 - RNA, 15 nt, Staphylococcus aureus subsp. aureus MW2
uaucguuuauugaua

SEQ ID NO: 4029569 - RNA, 16 nt, Staphylococcus aureus subsp. aureus MW2
uaucuaaacaauuccc

SEQ ID NO: 4029570 - RNA, 19 nt, Staphylococcus aureus subsp. aureus MW2
uaucuaaagcuauaaaaaa

SEQ ID NO: 4029571 - RNA, 14 nt, Staphylococcus aureus subsp. aureus MW2
uaucuaaaugugaa

SEQ ID NO: 4029572 - RNA, 15 nt, Staphylococcus aureus subsp. aureus MW2
uaucuaaaugugaaa

SEQ ID NO: 4029573 - RNA, 23 nt, Staphylococcus aureus subsp. aureus MW2
uaucuaaugaucaucuauauuua

SEQ ID NO: 4029574 - RNA, 20 nt, Staphylococcus aureus subsp. aureus MW2
uaucuaaugggucaaugacu

SEQ ID NO: 4029575 - RNA, 13 nt, Staphylococcus aureus subsp. aureus MW2
uaucuaauucugu

SEQ ID NO: 4029576 - RNA, 18 nt, Staphylococcus aureus subsp. aureus MW2
uaucuacaugguuuucac

SEQ ID NO: 4029577 - RNA, 16 nt, Staphylococcus aureus subsp. aureus MW2
uaucuacauuaaagaa

SEQ ID NO: 4029578 - RNA, 16 nt, Staphylococcus aureus subsp. aureus MW2
uaucuaguguucucau

SEQ ID NO: 4029579 - RNA, 13 nt, Staphylococcus aureus subsp. aureus MW2
uaucuauaaaaag

SEQ ID NO: 4029580 - RNA, 14 nt, Staphylococcus aureus subsp. aureus MW2
uaucuauacaauua

SEQ ID NO: 4029581 - RNA, 20 nt, Staphylococcus aureus subsp. aureus MW2
uaucuauacaauuauggaua

SEQ ID NO: 4029582 - RNA, 21 nt, Staphylococcus aureus subsp. aureus MW2
uaucuauaucgucgauuucau

SEQ ID NO: 4029583 - RNA, 19 nt, Staphylococcus aureus subsp. aureus MW2
uaucuauucaaauauaaau

SEQ ID NO: 4029584 - RNA, 15 nt, Staphylococcus aureus subsp. aureus MW2
uaucucaaauauuaa

SEQ ID NO: 4029585 - RNA, 23 nt, Staphylococcus aureus subsp. aureus MW2
uaucuccgcuacaauuauaugua

SEQ ID NO: 4029586 - RNA, 13 nt, Staphylococcus aureus subsp. aureus MW2
uaucugaaaauau

SEQ ID NO: 4029587 - RNA, 19 nt, Staphylococcus aureus subsp. aureus MW2
uaucugaaguagauugaua

SEQ ID NO: 4029588 - RNA, 23 nt, Staphylococcus aureus subsp. aureus MW2
uauguaacaauuuagcaaauauu

SEQ ID NO: 4029589 - RNA, 12 nt, Staphylococcus aureus subsp. aureus MW2
uauguacaauca

SEQ ID NO: 4029590 - RNA, 16 nt, Staphylococcus aureus subsp. aureus MW2
uauguaccaaauuuau

SEQ ID NO: 4029591 - RNA, 21 nt, Staphylococcus aureus subsp. aureus MW2
uauguaccaaauuuauaauuu

SEQ ID NO: 4029592 - RNA, 15 nt, Staphylococcus aureus subsp. aureus MW2
uauguagaauuucuu

SEQ ID NO: 4029593 - RNA, 16 nt, Staphylococcus aureus subsp. aureus MW2
uauguagaauuucuuu

SEQ ID NO: 4029594 - RNA, 14 nt, Staphylococcus aureus subsp. aureus MW2
uauguauaauacau

SEQ ID NO: 4029595 - RNA, 19 nt, Staphylococcus aureus subsp. aureus MW2
uauguauaguguuaauguu

SEQ ID NO: 4029596 - RNA, 14 nt, Staphylococcus aureus subsp. aureus MW2
uauguauaucuuua

SEQ ID NO: 4029597 - RNA, 12 nt, Staphylococcus aureus subsp. aureus MW2
uauguauuaaau

SEQ ID NO: 4029598 - RNA, 20 nt, Staphylococcus aureus subsp. aureus MW2
uaugucaaauugaacuuaua

SEQ ID NO: 4029599 - RNA, 17 nt, Staphylococcus aureus subsp. aureus MW2
uaugucauauacuauau

SEQ ID NO: 4029600 - RNA, 21 nt, Staphylococcus aureus subsp. aureus MW2
uaugucccaaugcugaauaaa

SEQ ID NO: 4029601 - RNA, 21 nt, Staphylococcus aureus subsp. aureus MW2
uaugucuagacuuauuugaau

SEQ ID NO: 4029602 - RNA, 22 nt, Staphylococcus aureus subsp. aureus MW2
uaugucuagacuuauuugaaug

SEQ ID NO: 4029603 - RNA, 21 nt, Staphylococcus aureus subsp. aureus MW2
uaugugcaugagacuuauuca

SEQ ID NO: 4029604 - RNA, 15 nt, Staphylococcus aureus subsp. aureus MW2
uaugugcuuuuguaa

SEQ ID NO: 4029605 - RNA, 20 nt, Staphylococcus aureus subsp. aureus MW2
uaugugguuuugauuaaacu

SEQ ID NO: 4029606 - RNA, 20 nt, Staphylococcus aureus subsp. aureus MW2
uauguguugugauauauagu

SEQ ID NO: 4029607 - RNA, 16 nt, Staphylococcus aureus subsp. aureus MW2
uauguguuguguauca

SEQ ID NO: 4029608 - RNA, 15 nt, Staphylococcus aureus subsp. aureus MW2
uauguuauaaauucu

SEQ ID NO: 4029609 - RNA, 17 nt, Staphylococcus aureus subsp. aureus MW2
uauguucagaaauuuaa

SEQ ID NO: 4029610 - RNA, 21 nt, Staphylococcus aureus subsp. aureus MW2
uauguuccauggaauaaauuu

SEQ ID NO: 4029611 - RNA, 21 nt, Staphylococcus aureus subsp. aureus MW2
uauguugaaagugacacugua

SEQ ID NO: 4029612 - RNA, 21 nt, Staphylococcus aureus subsp. aureus MW2
uauguugucauaccaaauaaa

SEQ ID NO: 4029613 - RNA, 23 nt, Staphylococcus aureus subsp. aureus MW2
uauguuguuucuaaugcucauua

SEQ ID NO: 4029614 - RNA, 16 nt, Staphylococcus aureus subsp. aureus MW2
uauguuuaauguauaa

SEQ ID NO: 4029615 - RNA, 17 nt, Staphylococcus aureus subsp. aureus MW2
uauguuuaauguauaaa

SEQ ID NO: 4029616 - RNA, 17 nt, Staphylococcus aureus subsp. aureus MW2
uauguuuggauaucuuu

SEQ ID NO: 4029617 - RNA, 20 nt, Staphylococcus aureus subsp. aureus MW2
uauguuuuaucaauauuagu

SEQ ID NO: 4029618 - RNA, 12 nt, Staphylococcus aureus subsp. aureus MW2
uauuaaaggaaa

SEQ ID NO: 4029619 - RNA, 21 nt, Staphylococcus aureus subsp. aureus MW2
uauuaaauagaugagaaagua

SEQ ID NO: 4029620 - RNA, 18 nt, Staphylococcus aureus subsp. aureus MW2
uauuaaaucguauauuaa

SEQ ID NO: 4029621 - RNA, 16 nt, Staphylococcus aureus subsp. aureus MW2
uauuaaauuuacaaaa

SEQ ID NO: 4029622 - RNA, 21 nt, Staphylococcus aureus subsp. aureus MW2
uauuaaauuuacaaaaacuau

SEQ ID NO: 4029623 - RNA, 15 nt, Staphylococcus aureus subsp. aureus MW2
uauuaaauuucaaau

SEQ ID NO: 4029624 - RNA, 12 nt, Staphylococcus aureus subsp. aureus MW2
uauuaaccaaca

SEQ ID NO: 4029625 - RNA, 17 nt, Staphylococcus aureus subsp. aureus MW2
uauuaacgaguuuucag

SEQ ID NO: 4029626 - RNA, 20 nt, Staphylococcus aureus subsp. aureus MW2
uauuaacgcuuauacuauau

SEQ ID NO: 4029627 - RNA, 19 nt, Staphylococcus aureus subsp. aureus MW2
uauuaacuuuaauauaagu

SEQ ID NO: 4029628 - RNA, 16 nt, Staphylococcus aureus subsp. aureus MW2
uauuaagacugauuaa

SEQ ID NO: 4029629 - RNA, 22 nt, Staphylococcus aureus subsp. aureus MW2
uauuaaggggguaauacuauau

SEQ ID NO: 4029630 - RNA, 24 nt, Staphylococcus aureus subsp. aureus MW2
uauuaaggggguaauacuauauga

SEQ ID NO: 4029631 - RNA, 16 nt, Staphylococcus aureus subsp. aureus MW2
uauuaaguauaucuuu

SEQ ID NO: 4029632 - RNA, 16 nt, Staphylococcus aureus subsp. aureus MW2
uauuaagugaguuuua

SEQ ID NO: 4029633 - RNA, 12 nt, Staphylococcus aureus subsp. aureus MW2
uauuaauaaagu

SEQ ID NO: 4029634 - RNA, 14 nt, Staphylococcus aureus subsp. aureus MW2
uauuaauauauaua

SEQ ID NO: 4029635 - RNA, 16 nt, Staphylococcus aureus subsp. aureus MW2
uauuaauauugagacu

SEQ ID NO: 4029636 - RNA, 15 nt, Staphylococcus aureus subsp. aureus MW2
uauuaauauuugauu

SEQ ID NO: 4029637 - RNA, 22 nt, Staphylococcus aureus subsp. aureus MW2
uauuaauauuuuuugauauuug

SEQ ID NO: 4029638 - RNA, 22 nt, Staphylococcus aureus subsp. aureus MW2
uauuaauuccucccuuuacuuu

SEQ ID NO: 4029639 - RNA, 13 nt, Staphylococcus aureus subsp. aureus MW2
uauuaauugaaau

SEQ ID NO: 4029640 - RNA, 11 nt, Staphylococcus aureus subsp. aureus MW2
uauuaauuuaa

SEQ ID NO: 4029641 - RNA, 23 nt, Staphylococcus aureus subsp. aureus MW2
uauuaauuuucucaaacuaucuu

SEQ ID NO: 4029642 - RNA, 18 nt, Staphylococcus aureus subsp. aureus MW2
uauuaauuuuucaaaugu

SEQ ID NO: 4029643 - RNA, 14 nt, Staphylococcus aureus subsp. aureus MW2
uauuacaaucaaaa

SEQ ID NO: 4029644 - RNA, 22 nt, Staphylococcus aureus subsp. aureus MW2
uauuaccuuugcuaaauauuau

SEQ ID NO: 4029645 - RNA, 21 nt, Staphylococcus aureus subsp. aureus MW2
uauuacuaaccuauuaaaaua

SEQ ID NO: 4029646 - RNA, 22 nt, Staphylococcus aureus subsp. aureus MW2
uauuacuacauaauuuaucaau

SEQ ID NO: 4029647 - RNA, 19 nt, Staphylococcus aureus subsp. aureus MW2
uauuacuauaaaaaacagc

SEQ ID NO: 4029648 - RNA, 16 nt, Staphylococcus aureus subsp. aureus MW2
uauuacuuauuucuuu

SEQ ID NO: 4029649 - RNA, 20 nt, Staphylococcus aureus subsp. aureus MW2
uauuacuuauuucuuuucau

SEQ ID NO: 4029650 - RNA, 13 nt, Staphylococcus aureus subsp. aureus MW2
uauuacuucucau

SEQ ID NO: 4029651 - RNA, 14 nt, Staphylococcus aureus subsp. aureus MW2
uauuacuugaaaau

SEQ ID NO: 4029652 - RNA, 17 nt, Staphylococcus aureus subsp. aureus MW2
uauuagauacuucuuua

SEQ ID NO: 4029653 - RNA, 14 nt, Staphylococcus aureus subsp. aureus MW2
uauuagauauauuu

SEQ ID NO: 4029654 - RNA, 17 nt, Staphylococcus aureus subsp. aureus MW2
uauuagaucacuauuuu

SEQ ID NO: 4029655 - RNA, 18 nt, Staphylococcus aureus subsp. aureus MW2
uauuagccaauaaaaugu

SEQ ID NO: 4029656 - RNA, 14 nt, Staphylococcus aureus subsp. aureus MW2
uauuagcuuuuuca

SEQ ID NO: 4029657 - RNA, 14 nt, Staphylococcus aureus subsp. aureus MW2
uauuaggauuuacu

SEQ ID NO: 4029658 - RNA, 23 nt, Staphylococcus aureus subsp. aureus MW2
uauuaggccaacguuuugaccaa

SEQ ID NO: 4029659 - RNA, 16 nt, Staphylococcus aureus subsp. aureus MW2
uauuaggcuuaaauau

SEQ ID NO: 4029660 - RNA, 14 nt, Staphylococcus aureus subsp. aureus MW2
uauuaggucauguu

SEQ ID NO: 4029661 - RNA, 22 nt, Staphylococcus aureus subsp. aureus MW2
uauuaggugaaaccauacuaau

SEQ ID NO: 4029662 - RNA, 17 nt, Staphylococcus aureus subsp. aureus MW2
uauuaguuuuuacguuu

SEQ ID NO: 4029663 - RNA, 12 nt, Staphylococcus aureus subsp. aureus MW2
uauuauaaaaua

SEQ ID NO: 4029664 - RNA, 15 nt, Staphylococcus aureus subsp. aureus MW2
uauuauaaaauaaau

SEQ ID NO: 4029665 - RNA, 19 nt, Staphylococcus aureus subsp. aureus MW2
uauuauaaaauaaauauaa

SEQ ID NO: 4029666 - RNA, 23 nt, Staphylococcus aureus subsp. aureus MW2
uauuauaaguugcauauaaaaac

SEQ ID NO: 4029667 - RNA, 18 nt, Staphylococcus aureus subsp. aureus MW2
uauuauaauaaauagacu

SEQ ID NO: 4029668 - RNA, 19 nt, Staphylococcus aureus subsp. aureus MW2
uauuauaauuguucauugg

SEQ ID NO: 4029669 - RNA, 14 nt, Staphylococcus aureus subsp. aureus MW2
uauuauaauuuugu

SEQ ID NO: 4029670 - RNA, 22 nt, Staphylococcus aureus subsp. aureus MW2
uauuauacugcucuuuauauau

SEQ ID NO: 4029671 - RNA, 11 nt, Staphylococcus aureus subsp. aureus MW2
uauuauagaac

SEQ ID NO: 4029672 - RNA, 15 nt, Staphylococcus aureus subsp. aureus MW2
uauuauaguuuagau

SEQ ID NO: 4029673 - RNA, 14 nt, Staphylococcus aureus subsp. aureus MW2
uauuauauaaaagu

SEQ ID NO: 4029674 - RNA, 17 nt, Staphylococcus aureus subsp. aureus MW2
uauuauauggcuuuacu

SEQ ID NO: 4029675 - RNA, 17 nt, Staphylococcus aureus subsp. aureus MW2
uauuauauugaauugaa

SEQ ID NO: 4029676 - RNA, 18 nt, Staphylococcus aureus subsp. aureus MW2
uauuguauuuuauuuauu

SEQ ID NO: 4029677 - RNA, 23 nt, Staphylococcus aureus subsp. aureus MW2
uauugucaaaccccguaggcaua

SEQ ID NO: 4029678 - RNA, 13 nt, Staphylococcus aureus subsp. aureus MW2
uauugucaucaug

SEQ ID NO: 4029679 - RNA, 15 nt, Staphylococcus aureus subsp. aureus MW2
uauugucaucauguu

SEQ ID NO: 4029680 - RNA, 20 nt, Staphylococcus aureus subsp. aureus MW2
uauugucuucucaacaaauc

SEQ ID NO: 4029681 - RNA, 16 nt, Staphylococcus aureus subsp. aureus MW2
uauugugccgcuucua

SEQ ID NO: 4029682 - RNA, 22 nt, Staphylococcus aureus subsp. aureus MW2
uauugugguaaagggggcucuc

SEQ ID NO: 4029683 - RNA, 23 nt, Staphylococcus aureus subsp. aureus MW2
uauuguuccagacuccuaaauua

SEQ ID NO: 4029684 - RNA, 18 nt, Staphylococcus aureus subsp. aureus MW2
uauuguucucuggauugc

SEQ ID NO: 4029685 - RNA, 20 nt, Staphylococcus aureus subsp. aureus MW2
uauuguuugaaaauuaacua

SEQ ID NO: 4029686 - RNA, 19 nt, Staphylococcus aureus subsp. aureus MW2
uauuguuuguuuuuauagu

SEQ ID NO: 4029687 - RNA, 13 nt, Staphylococcus aureus subsp. aureus MW2
uauuuaaaaaaca

SEQ ID NO: 4029688 - RNA, 14 nt, Staphylococcus aureus subsp. aureus MW2
uauuuaaaaaacaa

SEQ ID NO: 4029689 - RNA, 19 nt, Staphylococcus aureus subsp. aureus MW2
uauuuaaaauauuauuuuu

SEQ ID NO: 4029690 - RNA, 12 nt, Staphylococcus aureus subsp. aureus MW2
uauuuaaaauca

SEQ ID NO: 4029691 - RNA, 19 nt, Staphylococcus aureus subsp. aureus MW2
uauuuaaaaugcuuguuca

SEQ ID NO: 4029692 - RNA, 20 nt, Staphylococcus aureus subsp. aureus MW2
uauuuaaaaugcuuguucaa

SEQ ID NO: 4029693 - RNA, 20 nt, Staphylococcus aureus subsp. aureus MW2
uauuuaaacgguaacaaaga

SEQ ID NO: 4029694 - RNA, 21 nt, Staphylococcus aureus subsp. aureus MW2
uauuuaaacuaguaauagaau

SEQ ID NO: 4029695 - RNA, 16 nt, Staphylococcus aureus subsp. aureus MW2
uauuuaaacucauaau

SEQ ID NO: 4029696 - RNA, 21 nt, Staphylococcus aureus subsp. aureus MW2
uauuuaaacucucuaaaaagc

SEQ ID NO: 4029697 - RNA, 21 nt, Staphylococcus aureus subsp. aureus MW2
uauuuaaauagaagaaaagaa

SEQ ID NO: 4029698 - RNA, 18 nt, Staphylococcus aureus subsp. aureus MW2
uauuuaaaucaauauucu

SEQ ID NO: 4029699 - RNA, 14 nt, Staphylococcus aureus subsp. aureus MW2
uauuuaaaugcuuu

SEQ ID NO: 4029700 - RNA, 16 nt, Staphylococcus aureus subsp. aureus MW2
uauuuaaauuuuaagu

SEQ ID NO: 4029701 - RNA, 20 nt, Staphylococcus aureus subsp. aureus MW2
uauuuaacacuucaguuaaa

SEQ ID NO: 4029702 - RNA, 18 nt, Staphylococcus aureus subsp. aureus MW2
uauuuaacgaaaauuaag

SEQ ID NO: 4029703 - RNA, 17 nt, Staphylococcus aureus subsp. aureus MW2
uauuuaauguuucaaau

SEQ ID NO: 4029704 - RNA, 16 nt, Staphylococcus aureus subsp. aureus MW2
uauuuaauuauuccuu

SEQ ID NO: 4029705 - RNA, 19 nt, Staphylococcus aureus subsp. aureus MW2
uauuuaauuuugauauuuu

SEQ ID NO: 4029706 - RNA, 18 nt, Staphylococcus aureus subsp. aureus MW2
uauuuaauuuuuuacuuu

SEQ ID NO: 4029707 - RNA, 22 nt, Staphylococcus aureus subsp. aureus MW2
uauuuacauugccacuuuugug

SEQ ID NO: 4029708 - RNA, 21 nt, Staphylococcus aureus subsp. aureus MW2
uauuuagaaaguuuuauuuaa

SEQ ID NO: 4029709 - RNA, 16 nt, Staphylococcus aureus subsp. aureus MW2
uauuuagaauauuaac

SEQ ID NO: 4029710 - RNA, 15 nt, Staphylococcus aureus subsp. aureus MW2
uauuuauaaacaaua

SEQ ID NO: 4029711 - RNA, 18 nt, Staphylococcus aureus subsp. aureus MW2
uauuuauacuaaauugag

SEQ ID NO: 4029712 - RNA, 17 nt, Staphylococcus aureus subsp. aureus MW2
uauuuauacuauaaaua

SEQ ID NO: 4029713 - RNA, 15 nt, Staphylococcus aureus subsp. aureus MW2
uauuuauauuaaaua

SEQ ID NO: 4029714 - RNA, 15 nt, Staphylococcus aureus subsp. aureus MW2
uauuuaucauacuuc

SEQ ID NO: 4029715 - RNA, 18 nt, Staphylococcus aureus subsp. aureus MW2
uauuuaucucuuucuuca

SEQ ID NO: 4029716 - RNA, 14 nt, Staphylococcus aureus subsp. aureus MW2
uauuuaucuuuaga

SEQ ID NO: 4029717 - RNA, 20 nt, Staphylococcus aureus subsp. aureus MW2
uauuuaugauaauuaauuaa

SEQ ID NO: 4029718 - RNA, 22 nt, Staphylococcus aureus subsp. aureus MW2
uauuuaugauaauuaauuaaaa

SEQ ID NO: 4029719 - RNA, 21 nt, Staphylococcus aureus subsp. aureus MW2
uauuuauguucgauuauucuu

SEQ ID NO: 4029720 - RNA, 11 nt, Staphylococcus aureus subsp. aureus MW2
uauuuauucag

SEQ ID NO: 4029721 - RNA, 23 nt, Staphylococcus aureus subsp. aureus MW2
uauuuauucuaaucuaaauucag

SEQ ID NO: 4029722 - RNA, 18 nt, Staphylococcus aureus subsp. aureus MW2
uauuuauugcgauagaaa

SEQ ID NO: 4029723 - RNA, 12 nt, Staphylococcus aureus subsp. aureus MW2
uauuuauuuaau

SEQ ID NO: 4029724 - RNA, 14 nt, Staphylococcus aureus subsp. aureus MW2
uauuuauuuuaaau

SEQ ID NO: 4029725 - RNA, 15 nt, Staphylococcus aureus subsp. aureus MW2
uauuuauuuuauaau

SEQ ID NO: 4029726 - RNA, 17 nt, Staphylococcus aureus subsp. aureus MW2
uauuuauuuuauaauaa

SEQ ID NO: 4029727 - RNA, 20 nt, Staphylococcus aureus subsp. aureus MW2
uauuucacacagcuucauua

SEQ ID NO: 4029728 - RNA, 17 nt, Staphylococcus aureus subsp. aureus MW2
uauuucacucuacaauc

SEQ ID NO: 4029729 - RNA, 20 nt, Staphylococcus aureus subsp. aureus MW2
uauuucacucuacaauccua

SEQ ID NO: 4029730 - RNA, 21 nt, Staphylococcus aureus subsp. aureus MW2
uauuucacucuacaauccuau

SEQ ID NO: 4029731 - RNA, 16 nt, Staphylococcus aureus subsp. aureus MW2
uauuucagcuuauuaa

SEQ ID NO: 4029732 - RNA, 14 nt, Staphylococcus aureus subsp. aureus MW2
uauuucauuugacu

SEQ ID NO: 4029733 - RNA, 21 nt, Staphylococcus aureus subsp. aureus MW2
uauuuccguuuuagaauuuaa

SEQ ID NO: 4029734 - RNA, 20 nt, Staphylococcus aureus subsp. aureus MW2
uauuucgguuagucuuaauc

SEQ ID NO: 4029735 - RNA, 16 nt, Staphylococcus aureus subsp. aureus MW2
uauuucuaaauuauuu

SEQ ID NO: 4029736 - RNA, 21 nt, Staphylococcus aureus subsp. aureus MW2
uauuucuaaauuauuuauuca

SEQ ID NO: 4029737 - RNA, 22 nt, Staphylococcus aureus subsp. aureus MW2
uauuucugaaaacuuaauagaa

SEQ ID NO: 4029738 - RNA, 16 nt, Staphylococcus aureus subsp. aureus MW2
uauuucuuaccauuua

SEQ ID NO: 4029739 - RNA, 14 nt, Staphylococcus aureus subsp. aureus MW2
uauuugaaaauauu

SEQ ID NO: 4029740 - RNA, 17 nt, Staphylococcus aureus subsp. aureus MW2
uauuugaaagguaagua

SEQ ID NO: 4029741 - RNA, 20 nt, Staphylococcus aureus subsp. aureus MW2
uauuugaaguauuuuccuuc

SEQ ID NO: 4029742 - RNA, 14 nt, Staphylococcus aureus subsp. aureus MW2
uauuugaauacuuu

SEQ ID NO: 4029743 - RNA, 16 nt, Staphylococcus aureus subsp. aureus MW2
uauuugaaugcaaauc

SEQ ID NO: 4029744 - RNA, 22 nt, Staphylococcus aureus subsp. aureus MW2
uauuugaaugcaaaucaaauac

SEQ ID NO: 4029745 - RNA, 15 nt, Staphylococcus aureus subsp. aureus MW2
uauuugauaacaaaa

SEQ ID NO: 4029746 - RNA, 15 nt, Staphylococcus aureus subsp. aureus MW2
uauuugauaauauug

SEQ ID NO: 4029747 - RNA, 13 nt, Staphylococcus aureus subsp. aureus MW2
uauuugauacaac

SEQ ID NO: 4029748 - RNA, 12 nt, Staphylococcus aureus subsp. aureus MW2
uauuugauuaaa

SEQ ID NO: 4029749 - RNA, 15 nt, Staphylococcus aureus subsp. aureus MW2
uauuugauuaaauua

SEQ ID NO: 4029750 - RNA, 17 nt, Staphylococcus aureus subsp. aureus MW2
uauuugauuauguaaau

SEQ ID NO: 4029751 - RNA, 16 nt, Staphylococcus aureus subsp. aureus MW2
uauuugauuauucgua

SEQ ID NO: 4029752 - RNA, 21 nt, Staphylococcus aureus subsp. aureus MW2
uauuugauuauucguauucaa

SEQ ID NO: 4029753 - RNA, 17 nt, Staphylococcus aureus subsp. aureus MW2
uauuugauuauucuuca

SEQ ID NO: 4029754 - RNA, 18 nt, Staphylococcus aureus subsp. aureus MW2
uauuugauuauucuucau

SEQ ID NO: 4029755 - RNA, 14 nt, Staphylococcus aureus subsp. aureus MW2
uauuugcugaauga

SEQ ID NO: 4029756 - RNA, 23 nt, Staphylococcus aureus subsp. aureus MW2
uauuugcugaaugaagcauuuua

SEQ ID NO: 4029757 - RNA, 22 nt, Staphylococcus aureus subsp. aureus MW2
uauuuguguuuuuauuaaucug

SEQ ID NO: 4029758 - RNA, 12 nt, Staphylococcus aureus subsp. aureus MW2
uauuuguuguua

SEQ ID NO: 4029759 - RNA, 17 nt, Staphylococcus aureus subsp. aureus MW2
uauuuuaaaauauuaau

SEQ ID NO: 4029760 - RNA, 20 nt, Staphylococcus aureus subsp. aureus MW2
uauuuuaaaauauuaaucaa

SEQ ID NO: 4029761 - RNA, 18 nt, Staphylococcus aureus subsp. aureus MW2
uauuuuaaauuuuuuaau

SEQ ID NO: 4029762 - RNA, 13 nt, Staphylococcus aureus subsp. aureus MW2
uauuuuaauauuu

SEQ ID NO: 4029763 - RNA, 14 nt, Staphylococcus aureus subsp. aureus MW2
uauuuuacucuuuu

SEQ ID NO: 4029764 - RNA, 20 nt, Staphylococcus aureus subsp. aureus MW2
ucaaauagcccuuuauacaa

SEQ ID NO: 4029765 - RNA, 13 nt, Staphylococcus aureus subsp. aureus MW2
ucaaauauaucua

SEQ ID NO: 4029766 - RNA, 19 nt, Staphylococcus aureus subsp. aureus MW2
ucaaaucaauaucauucau

SEQ ID NO: 4029767 - RNA, 17 nt, Staphylococcus aureus subsp. aureus MW2
ucaaaucauaaguuaaa

SEQ ID NO: 4029768 - RNA, 16 nt, Staphylococcus aureus subsp. aureus MW2
ucaaauccaaaaucuu

SEQ ID NO: 4029769 - RNA, 20 nt, Staphylococcus aureus subsp. aureus MW2
ucaaaugacauuuuaaaucu

SEQ ID NO: 4029770 - RNA, 21 nt, Staphylococcus aureus subsp. aureus MW2
ucaaaugacauuuuaaaucua

SEQ ID NO: 4029771 - RNA, 21 nt, Staphylococcus aureus subsp. aureus MW2
ucaaaugcuuaauaaaaucaa

SEQ ID NO: 4029772 - RNA, 19 nt, Staphylococcus aureus subsp. aureus MW2
ucaaauggagcaacgauac

SEQ ID NO: 4029773 - RNA, 17 nt, Staphylococcus aureus subsp. aureus MW2
ucaaauguaacauuaaa

SEQ ID NO: 4029774 - RNA, 21 nt, Staphylococcus aureus subsp. aureus MW2
ucaaauguaacauuaaaaaua

SEQ ID NO: 4029775 - RNA, 22 nt, Staphylococcus aureus subsp. aureus MW2
ucaaauguugaauguggaacau

SEQ ID NO: 4029776 - RNA, 20 nt, Staphylococcus aureus subsp. aureus MW2
ucaaauuaauuaaaccaaua

SEQ ID NO: 4029777 - RNA, 15 nt, Staphylococcus aureus subsp. aureus MW2
ucaaauuagauaaaa

SEQ ID NO: 4029778 - RNA, 21 nt, Staphylococcus aureus subsp. aureus MW2
ucaaauuagauaaaacaaaac

SEQ ID NO: 4029779 - RNA, 18 nt, Staphylococcus aureus subsp. aureus MW2
ucaaauuauaauuguaau

SEQ ID NO: 4029780 - RNA, 21 nt, Staphylococcus aureus subsp. aureus MW2
ucaaauuauaauuguaaugcu

SEQ ID NO: 4029781 - RNA, 19 nt, Staphylococcus aureus subsp. aureus MW2
ucaaauucgacucaaacaa

SEQ ID NO: 4029782 - RNA, 16 nt, Staphylococcus aureus subsp. aureus MW2
ucaaauugaacuucuu

SEQ ID NO: 4029783 - RNA, 21 nt, Staphylococcus aureus subsp. aureus MW2
ucaaauugcguuguuucauua

SEQ ID NO: 4029784 - RNA, 19 nt, Staphylococcus aureus subsp. aureus MW2
ucaaauuggacuuaugggu

SEQ ID NO: 4029785 - RNA, 23 nt, Staphylococcus aureus subsp. aureus MW2
ucaaauugguuuucaugugucau

SEQ ID NO: 4029786 - RNA, 18 nt, Staphylococcus aureus subsp. aureus MW2
ucaacaaaucuauaaaua

SEQ ID NO: 4029787 - RNA, 13 nt, Staphylococcus aureus subsp. aureus MW2
ucaacaaauuuaa

SEQ ID NO: 4029788 - RNA, 18 nt, Staphylococcus aureus subsp. aureus MW2
ucaacaaauuuaacuuuc

SEQ ID NO: 4029789 - RNA, 18 nt, Staphylococcus aureus subsp. aureus MW2
ucaacaacaaguucuuga

SEQ ID NO: 4029790 - RNA, 22 nt, Staphylococcus aureus subsp. aureus MW2
ucaacacacacaguuuauaaua

SEQ ID NO: 4029791 - RNA, 23 nt, Staphylococcus aureus subsp. aureus MW2
ucaacaccaacaccuaauauuuu

SEQ ID NO: 4029792 - RNA, 20 nt, Staphylococcus aureus subsp. aureus MW2
ucaacacgacguucuucaau

SEQ ID NO: 4029793 - RNA, 22 nt, Staphylococcus aureus subsp. aureus MW2
ucaacacgacguucuucaauua

SEQ ID NO: 4029794 - RNA, 21 nt, Staphylococcus aureus subsp. aureus MW2
ucaacaguaauuuuuaaacaa

SEQ ID NO: 4029795 - RNA, 22 nt, Staphylococcus aureus subsp. aureus MW2
ucaacaguaauuuuuaaacaaa

SEQ ID NO: 4029796 - RNA, 16 nt, Staphylococcus aureus subsp. aureus MW2
ucaacaguuuuaaaga

SEQ ID NO: 4029797 - RNA, 15 nt, Staphylococcus aureus subsp. aureus MW2
ucaacauaacaaagu

SEQ ID NO: 4029798 - RNA, 19 nt, Staphylococcus aureus subsp. aureus MW2
ucaacauaacucaaauauc

SEQ ID NO: 4029799 - RNA, 20 nt, Staphylococcus aureus subsp. aureus MW2
ucaacauaacucaaauaucu

SEQ ID NO: 4029800 - RNA, 21 nt, Staphylococcus aureus subsp. aureus MW2
ucaacauauaaaucauuucgu

SEQ ID NO: 4029801 - RNA, 13 nt, Staphylococcus aureus subsp. aureus MW2
ucaacaucaucuu

SEQ ID NO: 4029802 - RNA, 11 nt, Staphylococcus aureus subsp. aureus MW2
ucaacaucaug

SEQ ID NO: 4029803 - RNA, 20 nt, Staphylococcus aureus subsp. aureus MW2
ucaacauguuccgcuacaaa

SEQ ID NO: 4029804 - RNA, 22 nt, Staphylococcus aureus subsp. aureus MW2
ucaacauguuccgcuacaaaac

SEQ ID NO: 4029805 - RNA, 15 nt, Staphylococcus aureus subsp. aureus MW2
ucaacauuaaaaugu

SEQ ID NO: 4029806 - RNA, 16 nt, Staphylococcus aureus subsp. aureus MW2
ucaacauuaauaaaua

SEQ ID NO: 4029807 - RNA, 18 nt, Staphylococcus aureus subsp. aureus MW2
ucaacauuaauaaauaau

SEQ ID NO: 4029808 - RNA, 17 nt, Staphylococcus aureus subsp. aureus MW2
ucaaccucauuugacau

SEQ ID NO: 4029809 - RNA, 21 nt, Staphylococcus aureus subsp. aureus MW2
ucaaccuguucuuuauuuaaa

SEQ ID NO: 4029810 - RNA, 23 nt, Staphylococcus aureus subsp. aureus MW2
ucaaccuguucuuuauuuaaagg

SEQ ID NO: 4029811 - RNA, 14 nt, Staphylococcus aureus subsp. aureus MW2
ucaacgauugaauu

SEQ ID NO: 4029812 - RNA, 15 nt, Staphylococcus aureus subsp. aureus MW2
ucaacgccauauuua

SEQ ID NO: 4029813 - RNA, 15 nt, Staphylococcus aureus subsp. aureus MW2
ucaacgggaacauca

SEQ ID NO: 4029814 - RNA, 17 nt, Staphylococcus aureus subsp. aureus MW2
ucaacguauaagugaua

SEQ ID NO: 4029815 - RNA, 21 nt, Staphylococcus aureus subsp. aureus MW2
ucaacguauauaaguuaaaau

SEQ ID NO: 4029816 - RNA, 15 nt, Staphylococcus aureus subsp. aureus MW2
ucaacgucaucugcu

SEQ ID NO: 4029817 - RNA, 14 nt, Staphylococcus aureus subsp. aureus MW2
ucaacuaauuuaaa

SEQ ID NO: 4029818 - RNA, 14 nt, Staphylococcus aureus subsp. aureus MW2
ucaacuacugcuaa

SEQ ID NO: 4029819 - RNA, 15 nt, Staphylococcus aureus subsp. aureus MW2
ucaacuacugucaau

SEQ ID NO: 4029820 - RNA, 17 nt, Staphylococcus aureus subsp. aureus MW2
ucaacugcuucacgauu

SEQ ID NO: 4029821 - RNA, 17 nt, Staphylococcus aureus subsp. aureus MW2
ucaacuuagaauuuaca

SEQ ID NO: 4029822 - RNA, 17 nt, Staphylococcus aureus subsp. aureus MW2
ucaacuuauuauuuauc

SEQ ID NO: 4029823 - RNA, 15 nt, Staphylococcus aureus subsp. aureus MW2
ucaacuuguuuccua

SEQ ID NO: 4029824 - RNA, 17 nt, Staphylococcus aureus subsp. aureus MW2
ucaacuuuaaucaaaaa

SEQ ID NO: 4029825 - RNA, 20 nt, Staphylococcus aureus subsp. aureus MW2
ucaacuuucucuaaagguac

SEQ ID NO: 4029826 - RNA, 17 nt, Staphylococcus aureus subsp. aureus MW2
ucaacuuuuuaauaaua

SEQ ID NO: 4029827 - RNA, 15 nt, Staphylococcus aureus subsp. aureus MW2
ucaacuuuuuuaacu

SEQ ID NO: 4029828 - RNA, 16 nt, Staphylococcus aureus subsp. aureus MW2
ucaacuuuuuuaacuu

SEQ ID NO: 4029829 - RNA, 18 nt, Staphylococcus aureus subsp. aureus MW2
ucaacuuuuuuaacuuua

SEQ ID NO: 4029830 - RNA, 22 nt, Staphylococcus aureus subsp. aureus MW2
ucaacuuuuuuaacuuuaacaa

SEQ ID NO: 4029831 - RNA, 15 nt, Staphylococcus aureus subsp. aureus MW2
ucaagaaauucgcaa

SEQ ID NO: 4029832 - RNA, 19 nt, Staphylococcus aureus subsp. aureus MW2
ucaagaaauucgcaagccu

SEQ ID NO: 4029833 - RNA, 15 nt, Staphylococcus aureus subsp. aureus MW2
ucaagaacuuuaaaa

SEQ ID NO: 4029834 - RNA, 12 nt, Staphylococcus aureus subsp. aureus MW2
ucaagaauauaa

SEQ ID NO: 4029835 - RNA, 16 nt, Staphylococcus aureus subsp. aureus MW2
ucaagaauauaaauga

SEQ ID NO: 4029836 - RNA, 19 nt, Staphylococcus aureus subsp. aureus MW2
ucaagaccaaauauuuuau

SEQ ID NO: 4029837 - RNA, 20 nt, Staphylococcus aureus subsp. aureus MW2
ucaagacucccuuuuuaaaa

SEQ ID NO: 4029838 - RNA, 23 nt, Staphylococcus aureus subsp. aureus MW2
ucaagauguuugcaacauauuuu

SEQ ID NO: 4029839 - RNA, 23 nt, Staphylococcus aureus subsp. aureus MW2
ucaagcgcaugcuugaacuuuua

SEQ ID NO: 4029840 - RNA, 16 nt, Staphylococcus aureus subsp. aureus MW2
ucaagcuagcaucaug

SEQ ID NO: 4029841 - RNA, 15 nt, Staphylococcus aureus subsp. aureus MW2
ucaagguguccuuuu

SEQ ID NO: 4029842 - RNA, 16 nt, Staphylococcus aureus subsp. aureus MW2
ucaaguaaauguuuug

SEQ ID NO: 4029843 - RNA, 15 nt, Staphylococcus aureus subsp. aureus MW2
ucaaguaaugauauu

SEQ ID NO: 4029844 - RNA, 18 nt, Staphylococcus aureus subsp. aureus MW2
ucaagucugcauuaauuu

SEQ ID NO: 4029845 - RNA, 20 nt, Staphylococcus aureus subsp. aureus MW2
ucaaguuggugugcaauuaa

SEQ ID NO: 4029846 - RNA, 13 nt, Staphylococcus aureus subsp. aureus MW2
ucaaguuuaaaau

SEQ ID NO: 4029847 - RNA, 13 nt, Staphylococcus aureus subsp. aureus MW2
ucaaguuuugguc

SEQ ID NO: 4029848 - RNA, 19 nt, Staphylococcus aureus subsp. aureus MW2
ucaauaaauaaacaacugc

SEQ ID NO: 4029849 - RNA, 13 nt, Staphylococcus aureus subsp. aureus MW2
ucaauaaauauug

SEQ ID NO: 4029850 - RNA, 11 nt, Staphylococcus aureus subsp. aureus MW2
ucaauaaauug

SEQ ID NO: 4029851 - RNA, 17 nt, Staphylococcus aureus subsp. aureus MW2
ucaauaaauuguuuacu

SEQ ID NO: 4029852 - RNA, 19 nt, Staphylococcus aureus subsp. aureus MW2
ucacauucuugaauaaauu

SEQ ID NO: 4029853 - RNA, 20 nt, Staphylococcus aureus subsp. aureus MW2
ucacauucuugaauaaauuu

SEQ ID NO: 4029854 - RNA, 18 nt, Staphylococcus aureus subsp. aureus MW2
ucacauugccuaaagacu

SEQ ID NO: 4029855 - RNA, 20 nt, Staphylococcus aureus subsp. aureus MW2
ucacauugccuaaagacuuu

SEQ ID NO: 4029856 - RNA, 16 nt, Staphylococcus aureus subsp. aureus MW2
ucacauuuucaaauuu

SEQ ID NO: 4029857 - RNA, 21 nt, Staphylococcus aureus subsp. aureus MW2
ucaccaaguuggcgcaacagc

SEQ ID NO: 4029858 - RNA, 18 nt, Staphylococcus aureus subsp. aureus MW2
ucaccaauccgauucacu

SEQ ID NO: 4029859 - RNA, 20 nt, Staphylococcus aureus subsp. aureus MW2
ucaccagguuuuuuauuuuc

SEQ ID NO: 4029860 - RNA, 13 nt, Staphylococcus aureus subsp. aureus MW2
ucaccauaaaaau

SEQ ID NO: 4029861 - RNA, 19 nt, Staphylococcus aureus subsp. aureus MW2
ucaccauacuaaaacauga

SEQ ID NO: 4029862 - RNA, 17 nt, Staphylococcus aureus subsp. aureus MW2
ucaccaucauauucaac

SEQ ID NO: 4029863 - RNA, 16 nt, Staphylococcus aureus subsp. aureus MW2
ucaccauuuacuucau

SEQ ID NO: 4029864 - RNA, 20 nt, Staphylococcus aureus subsp. aureus MW2
ucaccauuuacuucauaagu

SEQ ID NO: 4029865 - RNA, 20 nt, Staphylococcus aureus subsp. aureus MW2
ucaccauuuuuuacaacguc

SEQ ID NO: 4029866 - RNA, 14 nt, Staphylococcus aureus subsp. aureus MW2
ucaccguaaucuuu

SEQ ID NO: 4029867 - RNA, 20 nt, Staphylococcus aureus subsp. aureus MW2
ucaccguaaucuuuuaacuu

SEQ ID NO: 4029868 - RNA, 20 nt, Staphylococcus aureus subsp. aureus MW2
ucaccuaaaugauuaauaac

SEQ ID NO: 4029869 - RNA, 15 nt, Staphylococcus aureus subsp. aureus MW2
ucaccuacaacacca

SEQ ID NO: 4029870 - RNA, 22 nt, Staphylococcus aureus subsp. aureus MW2
ucaccugcagcauccuuaccuu

SEQ ID NO: 4029871 - RNA, 15 nt, Staphylococcus aureus subsp. aureus MW2
ucaccuuaucaugac

SEQ ID NO: 4029872 - RNA, 23 nt, Staphylococcus aureus subsp. aureus MW2
ucaccuucagggucgugacggaa

SEQ ID NO: 4029873 - RNA, 13 nt, Staphylococcus aureus subsp. aureus MW2
ucaccuucccagu

SEQ ID NO: 4029874 - RNA, 14 nt, Staphylococcus aureus subsp. aureus MW2
ucaccuucccaguc

SEQ ID NO: 4029875 - RNA, 16 nt, Staphylococcus aureus subsp. aureus MW2
ucaccuuuuuuaacuu

SEQ ID NO: 4029876 - RNA, 15 nt, Staphylococcus aureus subsp. aureus MW2
ucacgauaauguaua

SEQ ID NO: 4029877 - RNA, 14 nt, Staphylococcus aureus subsp. aureus MW2
ucacgauauaacau

SEQ ID NO: 4029878 - RNA, 13 nt, Staphylococcus aureus subsp. aureus MW2
ucacgaucuuuaa

SEQ ID NO: 4029879 - RNA, 14 nt, Staphylococcus aureus subsp. aureus MW2
ucacgauuaauaaa

SEQ ID NO: 4029880 - RNA, 20 nt, Staphylococcus aureus subsp. aureus MW2
ucacgauuaauaaaauucua

SEQ ID NO: 4029881 - RNA, 21 nt, Staphylococcus aureus subsp. aureus MW2
ucacgauuacgcucauauguc

SEQ ID NO: 4029882 - RNA, 16 nt, Staphylococcus aureus subsp. aureus MW2
ucacgauuuuuaaaau

SEQ ID NO: 4029883 - RNA, 13 nt, Staphylococcus aureus subsp. aureus MW2
ucacgccauaauc

SEQ ID NO: 4029884 - RNA, 12 nt, Staphylococcus aureus subsp. aureus MW2
ucacgcuaacau

SEQ ID NO: 4029885 - RNA, 14 nt, Staphylococcus aureus subsp. aureus MW2
ucacguaaugaauc

SEQ ID NO: 4029886 - RNA, 20 nt, Staphylococcus aureus subsp. aureus MW2
ucacgugguuucuuuaauug

SEQ ID NO: 4029887 - RNA, 15 nt, Staphylococcus aureus subsp. aureus MW2
ucacguuuuucuuua

SEQ ID NO: 4029888 - RNA, 16 nt, Staphylococcus aureus subsp. aureus MW2
ucacguuuuucuuuaa

SEQ ID NO: 4029889 - RNA, 20 nt, Staphylococcus aureus subsp. aureus MW2
ucacguuuuucuuuaaacgc

SEQ ID NO: 4029890 - RNA, 13 nt, Staphylococcus aureus subsp. aureus MW2
ucacuaaaaauau

SEQ ID NO: 4029891 - RNA, 20 nt, Staphylococcus aureus subsp. aureus MW2
ucacuaaaaaucuauauaac

SEQ ID NO: 4029892 - RNA, 16 nt, Staphylococcus aureus subsp. aureus MW2
ucacuaaaguaaauaa

SEQ ID NO: 4029893 - RNA, 12 nt, Staphylococcus aureus subsp. aureus MW2
ucacuaauauau

SEQ ID NO: 4029894 - RNA, 19 nt, Staphylococcus aureus subsp. aureus MW2
ucacuaaucauuuuuucaa

SEQ ID NO: 4029895 - RNA, 20 nt, Staphylococcus aureus subsp. aureus MW2
ucacuaaucauuuuuucaau

SEQ ID NO: 4029896 - RNA, 17 nt, Staphylococcus aureus subsp. aureus MW2
ucacuaauggauaugau

SEQ ID NO: 4029897 - RNA, 15 nt, Staphylococcus aureus subsp. aureus MW2
ucacuacauuaaaaa

SEQ ID NO: 4029898 - RNA, 15 nt, Staphylococcus aureus subsp. aureus MW2
ucacuagcuaaugca

SEQ ID NO: 4029899 - RNA, 17 nt, Staphylococcus aureus subsp. aureus MW2
ucacuaguguauacaag

SEQ ID NO: 4029900 - RNA, 22 nt, Staphylococcus aureus subsp. aureus MW2
ucacuccucuauuuuaugauuu

SEQ ID NO: 4029901 - RNA, 18 nt, Staphylococcus aureus subsp. aureus MW2
ucacucggcagauguuca

SEQ ID NO: 4029902 - RNA, 19 nt, Staphylococcus aureus subsp. aureus MW2
ucacucuguaauaaagaau

SEQ ID NO: 4029903 - RNA, 19 nt, Staphylococcus aureus subsp. aureus MW2
ucacucuuuaaaucaaaga

SEQ ID NO: 4029904 - RNA, 12 nt, Staphylococcus aureus subsp. aureus MW2
ucacucuuuuag

SEQ ID NO: 4029905 - RNA, 23 nt, Staphylococcus aureus subsp. aureus MW2
ucacugaaugcuaauacuaauca

SEQ ID NO: 4029906 - RNA, 22 nt, Staphylococcus aureus subsp. aureus MW2
ucacugcaaacacaguacaaau

SEQ ID NO: 4029907 - RNA, 16 nt, Staphylococcus aureus subsp. aureus MW2
ucacuguagauucaaa

SEQ ID NO: 4029908 - RNA, 22 nt, Staphylococcus aureus subsp. aureus MW2
ucacuguuaaagauguugaaaa

SEQ ID NO: 4029909 - RNA, 12 nt, Staphylococcus aureus subsp. aureus MW2
ucacuuaauaaa

SEQ ID NO: 4029910 - RNA, 19 nt, Staphylococcus aureus subsp. aureus MW2
ucacuuauagaaugauuaa

SEQ ID NO: 4029911 - RNA, 16 nt, Staphylococcus aureus subsp. aureus MW2
ucacuuauuauuuugu

SEQ ID NO: 4029912 - RNA, 11 nt, Staphylococcus aureus subsp. aureus MW2
ucacuucaacg

SEQ ID NO: 4029913 - RNA, 16 nt, Staphylococcus aureus subsp. aureus MW2
ucacuucuuacugauc

SEQ ID NO: 4029914 - RNA, 15 nt, Staphylococcus aureus subsp. aureus MW2
ucacuuguccuaagu

SEQ ID NO: 4029915 - RNA, 17 nt, Staphylococcus aureus subsp. aureus MW2
ucacuuuauuaaauaac

SEQ ID NO: 4029916 - RNA, 21 nt, Staphylococcus aureus subsp. aureus MW2
ucacuuuuuaaacguacauuu

SEQ ID NO: 4029917 - RNA, 19 nt, Staphylococcus aureus subsp. aureus MW2
ucagaaguuguuuagaaaa

SEQ ID NO: 4029918 - RNA, 17 nt, Staphylococcus aureus subsp. aureus MW2
ucagaaugaacuucucu

SEQ ID NO: 4029919 - RNA, 23 nt, Staphylococcus aureus subsp. aureus MW2
ucagacacgacguuuuuuuaugu

SEQ ID NO: 4029920 - RNA, 15 nt, Staphylococcus aureus subsp. aureus MW2
ucagaugauuuaauu

SEQ ID NO: 4029921 - RNA, 21 nt, Staphylococcus aureus subsp. aureus MW2
ucagaugauuuaauucugguu

SEQ ID NO: 4029922 - RNA, 16 nt, Staphylococcus aureus subsp. aureus MW2
ucagauucaaacguuu

SEQ ID NO: 4029923 - RNA, 17 nt, Staphylococcus aureus subsp. aureus MW2
ucagccacugucaugug

SEQ ID NO: 4029924 - RNA, 16 nt, Staphylococcus aureus subsp. aureus MW2
ucagccauaauaucuu

SEQ ID NO: 4029925 - RNA, 24 nt, Staphylococcus aureus subsp. aureus MW2
ucagcgauaggcgcgaaaugaccu

SEQ ID NO: 4029926 - RNA, 14 nt, Staphylococcus aureus subsp. aureus MW2
ucagcuaaauauuu

SEQ ID NO: 4029927 - RNA, 17 nt, Staphylococcus aureus subsp. aureus MW2
ucagcuaaguuaaauau

SEQ ID NO: 4029928 - RNA, 15 nt, Staphylococcus aureus subsp. aureus MW2
ucagcuaauucgucu

SEQ ID NO: 4029929 - RNA, 15 nt, Staphylococcus aureus subsp. aureus MW2
ucagcuuacaauaau

SEQ ID NO: 4029930 - RNA, 23 nt, Staphylococcus aureus subsp. aureus MW2
ucagcuuacaauaaugugcaagu

SEQ ID NO: 4029931 - RNA, 14 nt, Staphylococcus aureus subsp. aureus MW2
ucagcuuuaauaau

SEQ ID NO: 4029932 - RNA, 15 nt, Staphylococcus aureus subsp. aureus MW2
ucagcuuuaauaaua

SEQ ID NO: 4029933 - RNA, 22 nt, Staphylococcus aureus subsp. aureus MW2
ucagcuuuggcgacauaaauac

SEQ ID NO: 4029934 - RNA, 14 nt, Staphylococcus aureus subsp. aureus MW2
ucagcuuuucuuca

SEQ ID NO: 4029935 - RNA, 16 nt, Staphylococcus aureus subsp. aureus MW2
ucaggaauagauguca

SEQ ID NO: 4029936 - RNA, 16 nt, Staphylococcus aureus subsp. aureus MW2
ucaggaucacguuuuu

SEQ ID NO: 4029937 - RNA, 22 nt, Staphylococcus aureus subsp. aureus MW2
ucaggaucacguuuuucuuuaa

SEQ ID NO: 4029938 - RNA, 23 nt, Staphylococcus aureus subsp. aureus MW2
ucaggaucacguuuuucuuuaaa

SEQ ID NO: 4029939 - RNA, 18 nt, Staphylococcus aureus subsp. aureus MW2
ucaggcuuaauuaauaaa

SEQ ID NO: 4029940 - RNA, 21 nt, Staphylococcus aureus subsp. aureus MW2
ucaggggccccaacacagaga

SEQ ID NO: 4029941 - RNA, 14 nt, Staphylococcus aureus subsp. aureus MW2
ucaucaaacaacau

SEQ ID NO: 4029942 - RNA, 18 nt, Staphylococcus aureus subsp. aureus MW2
ucaucaaacaacaucacu

SEQ ID NO: 4029943 - RNA, 20 nt, Staphylococcus aureus subsp. aureus MW2
ucaucacaaauaaggaaugu

SEQ ID NO: 4029944 - RNA, 20 nt, Staphylococcus aureus subsp. aureus MW2
ucaucaccauacuaaaacau

SEQ ID NO: 4029945 - RNA, 22 nt, Staphylococcus aureus subsp. aureus MW2
ucaucacucgcaaucgagaugu

SEQ ID NO: 4029946 - RNA, 16 nt, Staphylococcus aureus subsp. aureus MW2
ucaucacuuuuuaaac

SEQ ID NO: 4029947 - RNA, 18 nt, Staphylococcus aureus subsp. aureus MW2
ucaucacuuuuuaaacgu

SEQ ID NO: 4029948 - RNA, 16 nt, Staphylococcus aureus subsp. aureus MW2
ucaucaguuguguaau

SEQ ID NO: 4029949 - RNA, 21 nt, Staphylococcus aureus subsp. aureus MW2
ucaucauaaucuacugcuguu

SEQ ID NO: 4029950 - RNA, 13 nt, Staphylococcus aureus subsp. aureus MW2
ucaucaugacuau

SEQ ID NO: 4029951 - RNA, 21 nt, Staphylococcus aureus subsp. aureus MW2
ucaucaugacuauuuuccauc

SEQ ID NO: 4029952 - RNA, 15 nt, Staphylococcus aureus subsp. aureus MW2
ucaucaugauuauuu

SEQ ID NO: 4029953 - RNA, 16 nt, Staphylococcus aureus subsp. aureus MW2
ucaucauggucaacuu

SEQ ID NO: 4029954 - RNA, 13 nt, Staphylococcus aureus subsp. aureus MW2
ucaucauguucua

SEQ ID NO: 4029955 - RNA, 17 nt, Staphylococcus aureus subsp. aureus MW2
ucaucauuaguuuuuaa

SEQ ID NO: 4029956 - RNA, 23 nt, Staphylococcus aureus subsp. aureus MW2
ucaucauuguaaaacaaauuaca

SEQ ID NO: 4029957 - RNA, 16 nt, Staphylococcus aureus subsp. aureus MW2
ucaucauuuaaauauu

SEQ ID NO: 4029958 - RNA, 17 nt, Staphylococcus aureus subsp. aureus MW2
ucaucgaagauguuaaa

SEQ ID NO: 4029959 - RNA, 21 nt, Staphylococcus aureus subsp. aureus MW2
ucaucguucauauauuuuguu

SEQ ID NO: 4029960 - RNA, 13 nt, Staphylococcus aureus subsp. aureus MW2
ucaucguuuacua

SEQ ID NO: 4029961 - RNA, 15 nt, Staphylococcus aureus subsp. aureus MW2
ucaucuaaaaagucu

SEQ ID NO: 4029962 - RNA, 21 nt, Staphylococcus aureus subsp. aureus MW2
ucaucuaaaaugaguuguuca

SEQ ID NO: 4029963 - RNA, 23 nt, Staphylococcus aureus subsp. aureus MW2
ucaucuaacgacccaaauuauau

SEQ ID NO: 4029964 - RNA, 16 nt, Staphylococcus aureus subsp. aureus MW2
ucaucuacuauuuaau

SEQ ID NO: 4029965 - RNA, 21 nt, Staphylococcus aureus subsp. aureus MW2
ucaucuacuauuuaaucuuaa

SEQ ID NO: 4029966 - RNA, 21 nt, Staphylococcus aureus subsp. aureus MW2
ucaucuacuuaaaauaaguau

SEQ ID NO: 4029967 - RNA, 19 nt, Staphylococcus aureus subsp. aureus MW2
ucaucuauauuuaauuuug

SEQ ID NO: 4029968 - RNA, 21 nt, Staphylococcus aureus subsp. aureus MW2
ucaucuauucaaaugauuuua

SEQ ID NO: 4029969 - RNA, 18 nt, Staphylococcus aureus subsp. aureus MW2
ucaucuauuuaauaaugu

SEQ ID NO: 4029970 - RNA, 23 nt, Staphylococcus aureus subsp. aureus MW2
ucaucuauuuaauaauguaucau

SEQ ID NO: 4029971 - RNA, 22 nt, Staphylococcus aureus subsp. aureus MW2
ucaucugaugaggcaauauuaa

SEQ ID NO: 4029972 - RNA, 15 nt, Staphylococcus aureus subsp. aureus MW2
ucaucugguauuuua

SEQ ID NO: 4029973 - RNA, 19 nt, Staphylococcus aureus subsp. aureus MW2
ucaucuggugcaauauuau

SEQ ID NO: 4029974 - RNA, 17 nt, Staphylococcus aureus subsp. aureus MW2
ucaucuguccgauaucu

SEQ ID NO: 4029975 - RNA, 19 nt, Staphylococcus aureus subsp. aureus MW2
ucaucuguccgauuuaaua

SEQ ID NO: 4029976 - RNA, 19 nt, Staphylococcus aureus subsp. aureus MW2
ucaucuguccgauuuuuaa

SEQ ID NO: 4029977 - RNA, 20 nt, Staphylococcus aureus subsp. aureus MW2
ucaucuuaugacugcuuuuu

SEQ ID NO: 4029978 - RNA, 20 nt, Staphylococcus aureus subsp. aureus MW2
ucaucuugcgccuuguucaa

SEQ ID NO: 4029979 - RNA, 13 nt, Staphylococcus aureus subsp. aureus MW2
ucaucuuuaugca

SEQ ID NO: 4029980 - RNA, 17 nt, Staphylococcus aureus subsp. aureus MW2
ucaucuuucaaaugcuu

SEQ ID NO: 4029981 - RNA, 18 nt, Staphylococcus aureus subsp. aureus MW2
ucaucuuucaaaugcuua

SEQ ID NO: 4029982 - RNA, 15 nt, Staphylococcus aureus subsp. aureus MW2
ucaucuuuuucacua

SEQ ID NO: 4029983 - RNA, 18 nt, Staphylococcus aureus subsp. aureus MW2
ucaucuuuuugaaauuuc

SEQ ID NO: 4029984 - RNA, 16 nt, Staphylococcus aureus subsp. aureus MW2
ucaugaauaaauacaa

SEQ ID NO: 4029985 - RNA, 20 nt, Staphylococcus aureus subsp. aureus MW2
ucaugaauaaauacaauguu

SEQ ID NO: 4029986 - RNA, 19 nt, Staphylococcus aureus subsp. aureus MW2
ucaugaccaacagcuucaa

SEQ ID NO: 4029987 - RNA, 15 nt, Staphylococcus aureus subsp. aureus MW2
ucaugcaaaauaaua

SEQ ID NO: 4029988 - RNA, 18 nt, Staphylococcus aureus subsp. aureus MW2
ucaugcacuuuauuaaaa

SEQ ID NO: 4029989 - RNA, 23 nt, Staphylococcus aureus subsp. aureus MW2
ucaugcacuuuauuaaaaauccu

SEQ ID NO: 4029990 - RNA, 13 nt, Staphylococcus aureus subsp. aureus MW2
ucaugcauucuau

SEQ ID NO: 4029991 - RNA, 12 nt, Staphylococcus aureus subsp. aureus MW2
ucaugccuucau

SEQ ID NO: 4029992 - RNA, 14 nt, Staphylococcus aureus subsp. aureus MW2
ucaugcuuuuuaau

SEQ ID NO: 4029993 - RNA, 20 nt, Staphylococcus aureus subsp. aureus MW2
ucauguaacguaaaaaugua

SEQ ID NO: 4029994 - RNA, 20 nt, Staphylococcus aureus subsp. aureus MW2
ucauguaaugcuuaaaaaca

SEQ ID NO: 4029995 - RNA, 18 nt, Staphylococcus aureus subsp. aureus MW2
ucauguacaguuacuuuc

SEQ ID NO: 4029996 - RNA, 22 nt, Staphylococcus aureus subsp. aureus MW2
ucaugugcaagugguaaaaaug

SEQ ID NO: 4029997 - RNA, 21 nt, Staphylococcus aureus subsp. aureus MW2
ucaugugucacaaugaccauu

SEQ ID NO: 4029998 - RNA, 17 nt, Staphylococcus aureus subsp. aureus MW2
ucaugugucauaaucca

SEQ ID NO: 4029999 - RNA, 15 nt, Staphylococcus aureus subsp. aureus MW2
ucauguuauguuuaa

SEQ ID NO: 4030000 - RNA, 21 nt, Staphylococcus aureus subsp. aureus MW2
ucauguucuuauaaaagucag

SEQ ID NO: 4030001 - RNA, 16 nt, Staphylococcus aureus subsp. aureus MW2
ucauguucuuguaauc

SEQ ID NO: 4030002 - RNA, 19 nt, Staphylococcus aureus subsp. aureus MW2
ucauguucuuguaauccua

SEQ ID NO: 4030003 - RNA, 12 nt, Staphylococcus aureus subsp. aureus MW2
ucauguuugauu

SEQ ID NO: 4030004 - RNA, 18 nt, Staphylococcus aureus subsp. aureus MW2
ucauguuuggcauaauaa

SEQ ID NO: 4030005 - RNA, 13 nt, Staphylococcus aureus subsp. aureus MW2
ucauuaaaucuga

SEQ ID NO: 4030006 - RNA, 17 nt, Staphylococcus aureus subsp. aureus MW2
ucauuaagaaaaggcuc

SEQ ID NO: 4030007 - RNA, 14 nt, Staphylococcus aureus subsp. aureus MW2
ucauuacauuuuau

SEQ ID NO: 4030008 - RNA, 22 nt, Staphylococcus aureus subsp. aureus MW2
ucauuagaaaaggcucauuugu

SEQ ID NO: 4030009 - RNA, 18 nt, Staphylococcus aureus subsp. aureus MW2
ucauuagcgcaagagaua

SEQ ID NO: 4030010 - RNA, 15 nt, Staphylococcus aureus subsp. aureus MW2
ucauuaguguagaaa

SEQ ID NO: 4030011 - RNA, 18 nt, Staphylococcus aureus subsp. aureus MW2
ucauuaguguagaaaaua

SEQ ID NO: 4030012 - RNA, 15 nt, Staphylococcus aureus subsp. aureus MW2
ucauuaguuguauca

SEQ ID NO: 4030013 - RNA, 16 nt, Staphylococcus aureus subsp. aureus MW2
ucauuaguuguaucag

SEQ ID NO: 4030014 - RNA, 14 nt, Staphylococcus aureus subsp. aureus MW2
ucauuauaaaaugg

SEQ ID NO: 4030015 - RNA, 16 nt, Staphylococcus aureus subsp. aureus MW2
ucauuauaaugauuuu

SEQ ID NO: 4030016 - RNA, 19 nt, Staphylococcus aureus subsp. aureus MW2
ucauuauagucuuaaacau

SEQ ID NO: 4030017 - RNA, 16 nt, Staphylococcus aureus subsp. aureus MW2
ucauuaucaaauaacc

SEQ ID NO: 4030018 - RNA, 17 nt, Staphylococcus aureus subsp. aureus MW2
ucauuauuguuguauca

SEQ ID NO: 4030019 - RNA, 18 nt, Staphylococcus aureus subsp. aureus MW2
ucauuauuguuguaucau

SEQ ID NO: 4030020 - RNA, 13 nt, Staphylococcus aureus subsp. aureus MW2
ucauuauuuaaau

SEQ ID NO: 4030021 - RNA, 19 nt, Staphylococcus aureus subsp. aureus MW2
ucauuauuuagaauucuaa

SEQ ID NO: 4030022 - RNA, 20 nt, Staphylococcus aureus subsp. aureus MW2
ucauuauuuagaauucuaaa

SEQ ID NO: 4030023 - RNA, 21 nt, Staphylococcus aureus subsp. aureus MW2
ucauuauuugauaaauaaaau

SEQ ID NO: 4030024 - RNA, 14 nt, Staphylococcus aureus subsp. aureus MW2
ucauucagucaaac

SEQ ID NO: 4030025 - RNA, 19 nt, Staphylococcus aureus subsp. aureus MW2
ucauucauguucgaugauu

SEQ ID NO: 4030026 - RNA, 13 nt, Staphylococcus aureus subsp. aureus MW2
ucauugaucgauu

SEQ ID NO: 4030027 - RNA, 13 nt, Staphylococcus aureus subsp. aureus MW2
ucauugaugaugu

SEQ ID NO: 4030028 - RNA, 20 nt, Staphylococcus aureus subsp. aureus MW2
ucauuggauagguaacuaaa

SEQ ID NO: 4030029 - RNA, 14 nt, Staphylococcus aureus subsp. aureus MW2
uccauggaauaaau

SEQ ID NO: 4030030 - RNA, 16 nt, Staphylococcus aureus subsp. aureus MW2
uccauggaauaaauuu

SEQ ID NO: 4030031 - RNA, 14 nt, Staphylococcus aureus subsp. aureus MW2
uccauuagaacuaa

SEQ ID NO: 4030032 - RNA, 22 nt, Staphylococcus aureus subsp. aureus MW2
uccauuagaacuaagaugugca

SEQ ID NO: 4030033 - RNA, 21 nt, Staphylococcus aureus subsp. aureus MW2
uccauuauaaagccugcaacc

SEQ ID NO: 4030034 - RNA, 17 nt, Staphylococcus aureus subsp. aureus MW2
uccauucguauaagaau

SEQ ID NO: 4030035 - RNA, 21 nt, Staphylococcus aureus subsp. aureus MW2
uccauugaucuuuuauaauga

SEQ ID NO: 4030036 - RNA, 13 nt, Staphylococcus aureus subsp. aureus MW2
uccauugcacuau

SEQ ID NO: 4030037 - RNA, 20 nt, Staphylococcus aureus subsp. aureus MW2
uccauugcacuaugcauaau

SEQ ID NO: 4030038 - RNA, 19 nt, Staphylococcus aureus subsp. aureus MW2
uccauuuucuuuuuuuaug

SEQ ID NO: 4030039 - RNA, 20 nt, Staphylococcus aureus subsp. aureus MW2
ucccaacaacauaucauaga

SEQ ID NO: 4030040 - RNA, 21 nt, Staphylococcus aureus subsp. aureus MW2
ucccaaugcugaauaaauaac

SEQ ID NO: 4030041 - RNA, 21 nt, Staphylococcus aureus subsp. aureus MW2
ucccaaugcuugaauuuuauu

SEQ ID NO: 4030042 - RNA, 17 nt, Staphylococcus aureus subsp. aureus MW2
ucccauaacaaaaacau

SEQ ID NO: 4030043 - RNA, 13 nt, Staphylococcus aureus subsp. aureus MW2
ucccauaaugacu

SEQ ID NO: 4030044 - RNA, 17 nt, Staphylococcus aureus subsp. aureus MW2
ucccauucuuugaggug

SEQ ID NO: 4030045 - RNA, 18 nt, Staphylococcus aureus subsp. aureus MW2
ucccauuugccuaaagua

SEQ ID NO: 4030046 - RNA, 14 nt, Staphylococcus aureus subsp. aureus MW2
ucccauuuuuaaaa

SEQ ID NO: 4030047 - RNA, 17 nt, Staphylococcus aureus subsp. aureus MW2
uccccaacccggugcau

SEQ ID NO: 4030048 - RNA, 22 nt, Staphylococcus aureus subsp. aureus MW2
uccccaacccggugcauguugu

SEQ ID NO: 4030049 - RNA, 13 nt, Staphylococcus aureus subsp. aureus MW2
uccccaacuugca

SEQ ID NO: 4030050 - RNA, 17 nt, Staphylococcus aureus subsp. aureus MW2
uccccaauuucucugug

SEQ ID NO: 4030051 - RNA, 19 nt, Staphylococcus aureus subsp. aureus MW2
uccccauuaauuaacaaag

SEQ ID NO: 4030052 - RNA, 19 nt, Staphylococcus aureus subsp. aureus MW2
uccccucuuuucuuuaaaa

SEQ ID NO: 4030053 - RNA, 21 nt, Staphylococcus aureus subsp. aureus MW2
ucccgaaaguuagacuaaaaa

SEQ ID NO: 4030054 - RNA, 15 nt, Staphylococcus aureus subsp. aureus MW2
ucccgcuuaaaauga

SEQ ID NO: 4030055 - RNA, 16 nt, Staphylococcus aureus subsp. aureus MW2
ucccuaucauacauau

SEQ ID NO: 4030056 - RNA, 18 nt, Staphylococcus aureus subsp. aureus MW2
ucccuaucauacauauuu

SEQ ID NO: 4030057 - RNA, 19 nt, Staphylococcus aureus subsp. aureus MW2
ucccuaucauacauauuua

SEQ ID NO: 4030058 - RNA, 23 nt, Staphylococcus aureus subsp. aureus MW2
ucccucuaucaaauuaccauuca

SEQ ID NO: 4030059 - RNA, 14 nt, Staphylococcus aureus subsp. aureus MW2
ucccugaaucagga

SEQ ID NO: 4030060 - RNA, 22 nt, Staphylococcus aureus subsp. aureus MW2
ucccuuaaauacaauuucuuca

SEQ ID NO: 4030061 - RNA, 14 nt, Staphylococcus aureus subsp. aureus MW2
ucccuuaauaauaa

SEQ ID NO: 4030062 - RNA, 17 nt, Staphylococcus aureus subsp. aureus MW2
ucccuuaauaauaagua

SEQ ID NO: 4030063 - RNA, 19 nt, Staphylococcus aureus subsp. aureus MW2
ucccuucaaaguagacauu

SEQ ID NO: 4030064 - RNA, 20 nt, Staphylococcus aureus subsp. aureus MW2
ucccuuuacuuuauaaauua

SEQ ID NO: 4030065 - RNA, 12 nt, Staphylococcus aureus subsp. aureus MW2
ucccuuuuuaaa

SEQ ID NO: 4030066 - RNA, 15 nt, Staphylococcus aureus subsp. aureus MW2
ucccuuuuuaaaaua

SEQ ID NO: 4030067 - RNA, 19 nt, Staphylococcus aureus subsp. aureus MW2
uccgaaaauugcuaaaaaa

SEQ ID NO: 4030068 - RNA, 21 nt, Staphylococcus aureus subsp. aureus MW2
uccgaaaauugcuaaaaaaau

SEQ ID NO: 4030069 - RNA, 14 nt, Staphylococcus aureus subsp. aureus MW2
uccgacugcaccuc

SEQ ID NO: 4030070 - RNA, 19 nt, Staphylococcus aureus subsp. aureus MW2
uccgauaucuuuuaauucu

SEQ ID NO: 4030071 - RNA, 13 nt, Staphylococcus aureus subsp. aureus MW2
uccgaucaugccu

SEQ ID NO: 4030072 - RNA, 16 nt, Staphylococcus aureus subsp. aureus MW2
uccgauuuaauauuga

SEQ ID NO: 4030073 - RNA, 19 nt, Staphylococcus aureus subsp. aureus MW2
uccgauuuugauauaaaaa

SEQ ID NO: 4030074 - RNA, 14 nt, Staphylococcus aureus subsp. aureus MW2
uccgauuuuuucgc

SEQ ID NO: 4030075 - RNA, 16 nt, Staphylococcus aureus subsp. aureus MW2
uccgcacugccuuuuu

SEQ ID NO: 4030076 - RNA, 21 nt, Staphylococcus aureus subsp. aureus MW2
uccgcacugccuuuuuguaau

SEQ ID NO: 4030077 - RNA, 21 nt, Staphylococcus aureus subsp. aureus MW2
uccgccagcuucuuuguuggg

SEQ ID NO: 4030078 - RNA, 19 nt, Staphylococcus aureus subsp. aureus MW2
uccgccagucaucaucaug

SEQ ID NO: 4030079 - RNA, 12 nt, Staphylococcus aureus subsp. aureus MW2
uccggaacaaua

SEQ ID NO: 4030080 - RNA, 16 nt, Staphylococcus aureus subsp. aureus MW2
uccguauuuaccuucu

SEQ ID NO: 4030081 - RNA, 23 nt, Staphylococcus aureus subsp. aureus MW2
uccgucgaauauaauuuuuugac

SEQ ID NO: 4030082 - RNA, 22 nt, Staphylococcus aureus subsp. aureus MW2
uccgucuuuuuuuaugaaaaga

SEQ ID NO: 4030083 - RNA, 16 nt, Staphylococcus aureus subsp. aureus MW2
uccguucgcaucuuug

SEQ ID NO: 4030084 - RNA, 19 nt, Staphylococcus aureus subsp. aureus MW2
uccuaagcaucguaaaaaa

SEQ ID NO: 4030085 - RNA, 15 nt, Staphylococcus aureus subsp. aureus MW2
uccuaauguaauuau

SEQ ID NO: 4030086 - RNA, 20 nt, Staphylococcus aureus subsp. aureus MW2
uccuaauguaauuauugcau

SEQ ID NO: 4030087 - RNA, 22 nt, Staphylococcus aureus subsp. aureus MW2
uccuaauguaauuauugcauca

SEQ ID NO: 4030088 - RNA, 22 nt, Staphylococcus aureus subsp. aureus MW2
uccuacgacacguguaaaaaug

SEQ ID NO: 4030089 - RNA, 23 nt, Staphylococcus aureus subsp. aureus MW2
uccuacgacacguguaaaaauga

SEQ ID NO: 4030090 - RNA, 16 nt, Staphylococcus aureus subsp. aureus MW2
uccuacuccauagaaa

SEQ ID NO: 4030091 - RNA, 21 nt, Staphylococcus aureus subsp. aureus MW2
uccuacuuuucaacuuuaguu

SEQ ID NO: 4030092 - RNA, 20 nt, Staphylococcus aureus subsp. aureus MW2
uccuaucuguaccguauuuu

SEQ ID NO: 4030093 - RNA, 17 nt, Staphylococcus aureus subsp. aureus MW2
uccuauggcgcaauuuu

SEQ ID NO: 4030094 - RNA, 21 nt, Staphylococcus aureus subsp. aureus MW2
uccuauggcgcaauuuuuaac

SEQ ID NO: 4030095 - RNA, 14 nt, Staphylococcus aureus subsp. aureus MW2
uccuauuaauauau

SEQ ID NO: 4030096 - RNA, 15 nt, Staphylococcus aureus subsp. aureus MW2
uccucaguauuuaau

SEQ ID NO: 4030097 - RNA, 18 nt, Staphylococcus aureus subsp. aureus MW2
uccucaguauuuaauguu

SEQ ID NO: 4030098 - RNA, 15 nt, Staphylococcus aureus subsp. aureus MW2
uccucauuaauaaau

SEQ ID NO: 4030099 - RNA, 16 nt, Staphylococcus aureus subsp. aureus MW2
uccucauuaauaaauu

SEQ ID NO: 4030100 - RNA, 13 nt, Staphylococcus aureus subsp. aureus MW2
uccuccaaagcua

SEQ ID NO: 4030101 - RNA, 16 nt, Staphylococcus aureus subsp. aureus MW2
uccuccaaagcuaagu

SEQ ID NO: 4030102 - RNA, 19 nt, Staphylococcus aureus subsp. aureus MW2
uccuccuaccgcuaaaauu

SEQ ID NO: 4030103 - RNA, 17 nt, Staphylococcus aureus subsp. aureus MW2
uccuguguaaaauaaau

SEQ ID NO: 4030104 - RNA, 20 nt, Staphylococcus aureus subsp. aureus MW2
uccuuaaacaaauaaauguc

SEQ ID NO: 4030105 - RNA, 13 nt, Staphylococcus aureus subsp. aureus MW2
uccuuaacuuuau

SEQ ID NO: 4030106 - RNA, 15 nt, Staphylococcus aureus subsp. aureus MW2
uccuuaauacguugc

SEQ ID NO: 4030107 - RNA, 13 nt, Staphylococcus aureus subsp. aureus MW2
uccuuaccuuuua

SEQ ID NO: 4030108 - RNA, 13 nt, Staphylococcus aureus subsp. aureus MW2
uccuuauuuuucg

SEQ ID NO: 4030109 - RNA, 19 nt, Staphylococcus aureus subsp. aureus MW2
uccuucagucuucauguuc

SEQ ID NO: 4030110 - RNA, 22 nt, Staphylococcus aureus subsp. aureus MW2
uccuucgcuaugaccaugauau

SEQ ID NO: 4030111 - RNA, 22 nt, Staphylococcus aureus subsp. aureus MW2
uccuugcucaugagcacaaacu

SEQ ID NO: 4030112 - RNA, 20 nt, Staphylococcus aureus subsp. aureus MW2
uccuuggaaacgauauagac

SEQ ID NO: 4030113 - RNA, 18 nt, Staphylococcus aureus subsp. aureus MW2
uccuugguuauuaaaauu

SEQ ID NO: 4030114 - RNA, 19 nt, Staphylococcus aureus subsp. aureus MW2
uccuugguuauuaaaauua

SEQ ID NO: 4030115 - RNA, 15 nt, Staphylococcus aureus subsp. aureus MW2
uccuuuaagaacaua

SEQ ID NO: 4030116 - RNA, 20 nt, Staphylococcus aureus subsp. aureus MW2
uccuuuaagaacauaaccua

SEQ ID NO: 4030117 - RNA, 23 nt, Staphylococcus aureus subsp. aureus MW2
ucguacguuuagugaaaauacca

SEQ ID NO: 4030118 - RNA, 22 nt, Staphylococcus aureus subsp. aureus MW2
ucguagcaugacauuaaggcuu

SEQ ID NO: 4030119 - RNA, 20 nt, Staphylococcus aureus subsp. aureus MW2
ucguaguaaccuaauucuaa

SEQ ID NO: 4030120 - RNA, 19 nt, Staphylococcus aureus subsp. aureus MW2
ucguauaguacuaaaagua

SEQ ID NO: 4030121 - RNA, 16 nt, Staphylococcus aureus subsp. aureus MW2
ucguauucuuuuaaua

SEQ ID NO: 4030122 - RNA, 21 nt, Staphylococcus aureus subsp. aureus MW2
ucguauugaaaaugagcugaa

SEQ ID NO: 4030123 - RNA, 13 nt, Staphylococcus aureus subsp. aureus MW2
ucguauuucauau

SEQ ID NO: 4030124 - RNA, 13 nt, Staphylococcus aureus subsp. aureus MW2
ucgucaaauucaa

SEQ ID NO: 4030125 - RNA, 15 nt, Staphylococcus aureus subsp. aureus MW2
ucgucacguaaaaua

SEQ ID NO: 4030126 - RNA, 16 nt, Staphylococcus aureus subsp. aureus MW2
ucgucauauuaauauu

SEQ ID NO: 4030127 - RNA, 21 nt, Staphylococcus aureus subsp. aureus MW2
ucgucauauuaauauuuuuug

SEQ ID NO: 4030128 - RNA, 21 nt, Staphylococcus aureus subsp. aureus MW2
ucgucgauuucauuaauuuuu

SEQ ID NO: 4030129 - RNA, 14 nt, Staphylococcus aureus subsp. aureus MW2
ucgucgcuaauaaa

SEQ ID NO: 4030130 - RNA, 15 nt, Staphylococcus aureus subsp. aureus MW2
ucgucgcugauacau

SEQ ID NO: 4030131 - RNA, 18 nt, Staphylococcus aureus subsp. aureus MW2
ucgucucacuuaauaaau

SEQ ID NO: 4030132 - RNA, 19 nt, Staphylococcus aureus subsp. aureus MW2
ucgugaaaagcaguuaaug

SEQ ID NO: 4030133 - RNA, 18 nt, Staphylococcus aureus subsp. aureus MW2
ucguguacgcaaaaacuu

SEQ ID NO: 4030134 - RNA, 22 nt, Staphylococcus aureus subsp. aureus MW2
ucguuaacaaucaguaauaaug

SEQ ID NO: 4030135 - RNA, 21 nt, Staphylococcus aureus subsp. aureus MW2
ucguuaaggaaagcuucauau

SEQ ID NO: 4030136 - RNA, 23 nt, Staphylococcus aureus subsp. aureus MW2
ucguuaccuuuuaaggcagcuaa

SEQ ID NO: 4030137 - RNA, 18 nt, Staphylococcus aureus subsp. aureus MW2
ucguuacuaccuauuaau

SEQ ID NO: 4030138 - RNA, 17 nt, Staphylococcus aureus subsp. aureus MW2
ucguuagaugaaugccu

SEQ ID NO: 4030139 - RNA, 15 nt, Staphylococcus aureus subsp. aureus MW2
ucguucaauuucgau

SEQ ID NO: 4030140 - RNA, 15 nt, Staphylococcus aureus subsp. aureus MW2
ucguucauauauuuu

SEQ ID NO: 4030141 - RNA, 17 nt, Staphylococcus aureus subsp. aureus MW2
ucguucauauauuuugu

SEQ ID NO: 4030142 - RNA, 19 nt, Staphylococcus aureus subsp. aureus MW2
ucguucaucgcuaauacuu

SEQ ID NO: 4030143 - RNA, 20 nt, Staphylococcus aureus subsp. aureus MW2
ucguucaucgcuaauacuuu

SEQ ID NO: 4030144 - RNA, 15 nt, Staphylococcus aureus subsp. aureus MW2
ucguucucuuaaaua

SEQ ID NO: 4030145 - RNA, 14 nt, Staphylococcus aureus subsp. aureus MW2
ucguucuuugauua

SEQ ID NO: 4030146 - RNA, 20 nt, Staphylococcus aureus subsp. aureus MW2
ucguuguacaguaauauuca

SEQ ID NO: 4030147 - RNA, 17 nt, Staphylococcus aureus subsp. aureus MW2
ucguugucacuauugca

SEQ ID NO: 4030148 - RNA, 17 nt, Staphylococcus aureus subsp. aureus MW2
ucguuguugaaauuaaa

SEQ ID NO: 4030149 - RNA, 18 nt, Staphylococcus aureus subsp. aureus MW2
ucguuuacuacaucauaa

SEQ ID NO: 4030150 - RNA, 17 nt, Staphylococcus aureus subsp. aureus MW2
ucguuuauuuuaaauuu

SEQ ID NO: 4030151 - RNA, 13 nt, Staphylococcus aureus subsp. aureus MW2
ucguuuuaauaau

SEQ ID NO: 4030152 - RNA, 13 nt, Staphylococcus aureus subsp. aureus MW2
ucguuuuauuaau

SEQ ID NO: 4030153 - RNA, 16 nt, Staphylococcus aureus subsp. aureus MW2
ucguuuucaacauaau

SEQ ID NO: 4030154 - RNA, 20 nt, Staphylococcus aureus subsp. aureus MW2
ucguuuucaacauaauauuu

SEQ ID NO: 4030155 - RNA, 23 nt, Staphylococcus aureus subsp. aureus MW2
ucguuuucuuaaacgcucuucuu

SEQ ID NO: 4030156 - RNA, 21 nt, Staphylococcus aureus subsp. aureus MW2
ucguuuugcuaaccaucauaa

SEQ ID NO: 4030157 - RNA, 21 nt, Staphylococcus aureus subsp. aureus MW2
ucguuuuuugauuguaauaau

SEQ ID NO: 4030158 - RNA, 14 nt, Staphylococcus aureus subsp. aureus MW2
ucguuuuuuuagcu

SEQ ID NO: 4030159 - RNA, 21 nt, Staphylococcus aureus subsp. aureus MW2
ucuaaaaaaauguugacauac

SEQ ID NO: 4030160 - RNA, 21 nt, Staphylococcus aureus subsp. aureus MW2
ucuaaaaacaaaacgcaauaa

SEQ ID NO: 4030161 - RNA, 16 nt, Staphylococcus aureus subsp. aureus MW2
ucuaaaaacauaaaaa

SEQ ID NO: 4030162 - RNA, 18 nt, Staphylococcus aureus subsp. aureus MW2
ucuaaaaacauaaaaauc

SEQ ID NO: 4030163 - RNA, 13 nt, Staphylococcus aureus subsp. aureus MW2
ucuaaaacauguu

SEQ ID NO: 4030164 - RNA, 16 nt, Staphylococcus aureus subsp. aureus MW2
ucuaaaacggaaauaa

SEQ ID NO: 4030165 - RNA, 16 nt, Staphylococcus aureus subsp. aureus MW2
ucuaaaacuaaaggua

SEQ ID NO: 4030166 - RNA, 16 nt, Staphylococcus aureus subsp. aureus MW2
ucuaaaacuuuuucaa

SEQ ID NO: 4030167 - RNA, 12 nt, Staphylococcus aureus subsp. aureus MW2
ucuaaaauaacu

SEQ ID NO: 4030168 - RNA, 13 nt, Staphylococcus aureus subsp. aureus MW2
ucuaaaauuaacc

SEQ ID NO: 4030169 - RNA, 16 nt, Staphylococcus aureus subsp. aureus MW2
ucuaaaauuaaccauu

SEQ ID NO: 4030170 - RNA, 13 nt, Staphylococcus aureus subsp. aureus MW2
ucuaaacaauucc

SEQ ID NO: 4030171 - RNA, 16 nt, Staphylococcus aureus subsp. aureus MW2
ucuaaacuauaauaau

SEQ ID NO: 4030172 - RNA, 18 nt, Staphylococcus aureus subsp. aureus MW2
ucuaaacuauaauaauug

SEQ ID NO: 4030173 - RNA, 17 nt, Staphylococcus aureus subsp. aureus MW2
ucuaaacuucuauuaau

SEQ ID NO: 4030174 - RNA, 18 nt, Staphylococcus aureus subsp. aureus MW2
ucuaaacuucuauuaaua

SEQ ID NO: 4030175 - RNA, 15 nt, Staphylococcus aureus subsp. aureus MW2
ucuaaagcuauaaaa

SEQ ID NO: 4030176 - RNA, 18 nt, Staphylococcus aureus subsp. aureus MW2
ucuaaauaaaauuaaaac

SEQ ID NO: 4030177 - RNA, 20 nt, Staphylococcus aureus subsp. aureus MW2
ucuaaauauaauagaaauaa

SEQ ID NO: 4030178 - RNA, 23 nt, Staphylococcus aureus subsp. aureus MW2
ucuaaauauaauagaaauaauca

SEQ ID NO: 4030179 - RNA, 13 nt, Staphylococcus aureus subsp. aureus MW2
ucuaaauucuuuu

SEQ ID NO: 4030180 - RNA, 20 nt, Staphylococcus aureus subsp. aureus MW2
ucuaaauucuuuuuguucgg

SEQ ID NO: 4030181 - RNA, 16 nt, Staphylococcus aureus subsp. aureus MW2
ucuaacaucauuaacu

SEQ ID NO: 4030182 - RNA, 21 nt, Staphylococcus aureus subsp. aureus MW2
ucuaacuuguuuauucagaua

SEQ ID NO: 4030183 - RNA, 21 nt, Staphylococcus aureus subsp. aureus MW2
ucuaacuuuaccaauaucaug

SEQ ID NO: 4030184 - RNA, 12 nt, Staphylococcus aureus subsp. aureus MW2
ucuaacuuugua

SEQ ID NO: 4030185 - RNA, 14 nt, Staphylococcus aureus subsp. aureus MW2
ucuaaguaauauaa

SEQ ID NO: 4030186 - RNA, 15 nt, Staphylococcus aureus subsp. aureus MW2
ucuaaguuauuacaa

SEQ ID NO: 4030187 - RNA, 16 nt, Staphylococcus aureus subsp. aureus MW2
ucuaauacauacugau

SEQ ID NO: 4030188 - RNA, 17 nt, Staphylococcus aureus subsp. aureus MW2
ucuaauacauacugauu

SEQ ID NO: 4030189 - RNA, 21 nt, Staphylococcus aureus subsp. aureus MW2
ucuaauacauacugauuaaac

SEQ ID NO: 4030190 - RNA, 18 nt, Staphylococcus aureus subsp. aureus MW2
ucuaauacuucuaacgca

SEQ ID NO: 4030191 - RNA, 18 nt, Staphylococcus aureus subsp. aureus MW2
ucuaauacuuucacuuuu

SEQ ID NO: 4030192 - RNA, 22 nt, Staphylococcus aureus subsp. aureus MW2
ucuaauagcuauauuuaaaauc

SEQ ID NO: 4030193 - RNA, 13 nt, Staphylococcus aureus subsp. aureus MW2
ucuaauauuuugg

SEQ ID NO: 4030194 - RNA, 17 nt, Staphylococcus aureus subsp. aureus MW2
ucuaaugcuaauuuaac

SEQ ID NO: 4030195 - RNA, 20 nt, Staphylococcus aureus subsp. aureus MW2
ucuaaugggucaaugacuga

SEQ ID NO: 4030196 - RNA, 16 nt, Staphylococcus aureus subsp. aureus MW2
ucuaauuacauauacg

SEQ ID NO: 4030197 - RNA, 17 nt, Staphylococcus aureus subsp. aureus MW2
ucuaauuauucaugaau

SEQ ID NO: 4030198 - RNA, 14 nt, Staphylococcus aureus subsp. aureus MW2
ucuaauucaaugau

SEQ ID NO: 4030199 - RNA, 22 nt, Staphylococcus aureus subsp. aureus MW2
ucuaauucaaugauuuuuaaaa

SEQ ID NO: 4030200 - RNA, 14 nt, Staphylococcus aureus subsp. aureus MW2
ucuaauucuucuaa

SEQ ID NO: 4030201 - RNA, 21 nt, Staphylococcus aureus subsp. aureus MW2
ucuaauuguugugcaacauug

SEQ ID NO: 4030202 - RNA, 23 nt, Staphylococcus aureus subsp. aureus MW2
ucuaauuguugugcaacauugau

SEQ ID NO: 4030203 - RNA, 20 nt, Staphylococcus aureus subsp. aureus MW2
ucuaauuugcaaaaucaacc

SEQ ID NO: 4030204 - RNA, 11 nt, Staphylococcus aureus subsp. aureus MW2
ucuaauuuuuc

SEQ ID NO: 4030205 - RNA, 19 nt, Staphylococcus aureus subsp. aureus MW2
ucucauuagcgaaaacuaa

SEQ ID NO: 4030206 - RNA, 21 nt, Staphylococcus aureus subsp. aureus MW2
ucucauuauaaugauuuuuau

SEQ ID NO: 4030207 - RNA, 21 nt, Staphylococcus aureus subsp. aureus MW2
ucucauucuuuaauauaaauu

SEQ ID NO: 4030208 - RNA, 11 nt, Staphylococcus aureus subsp. aureus MW2
ucuccaauacu

SEQ ID NO: 4030209 - RNA, 21 nt, Staphylococcus aureus subsp. aureus MW2
ucuccaauacuuuuuauauaa

SEQ ID NO: 4030210 - RNA, 23 nt, Staphylococcus aureus subsp. aureus MW2
ucuccaguuuucaauuuauuaac

SEQ ID NO: 4030211 - RNA, 14 nt, Staphylococcus aureus subsp. aureus MW2
ucuccauuauaaag

SEQ ID NO: 4030212 - RNA, 13 nt, Staphylococcus aureus subsp. aureus MW2
ucuccauuuaagg

SEQ ID NO: 4030213 - RNA, 23 nt, Staphylococcus aureus subsp. aureus MW2
ucucgauuuuuuuauauuuuaag

SEQ ID NO: 4030214 - RNA, 19 nt, Staphylococcus aureus subsp. aureus MW2
ucucgcauacugucaucuu

SEQ ID NO: 4030215 - RNA, 20 nt, Staphylococcus aureus subsp. aureus MW2
ucucgcuaaauuuauauagu

SEQ ID NO: 4030216 - RNA, 14 nt, Staphylococcus aureus subsp. aureus MW2
ucucguaauaaugu

SEQ ID NO: 4030217 - RNA, 14 nt, Staphylococcus aureus subsp. aureus MW2
ucucgucuuuuguc

SEQ ID NO: 4030218 - RNA, 18 nt, Staphylococcus aureus subsp. aureus MW2
ucucguguaaaaugcaau

SEQ ID NO: 4030219 - RNA, 17 nt, Staphylococcus aureus subsp. aureus MW2
ucucguugcacaacagu

SEQ ID NO: 4030220 - RNA, 14 nt, Staphylococcus aureus subsp. aureus MW2
ucucuaguaucuga

SEQ ID NO: 4030221 - RNA, 17 nt, Staphylococcus aureus subsp. aureus MW2
ucucuaguaucugauac

SEQ ID NO: 4030222 - RNA, 18 nt, Staphylococcus aureus subsp. aureus MW2
ucucuaguaucugauacc

SEQ ID NO: 4030223 - RNA, 14 nt, Staphylococcus aureus subsp. aureus MW2
ucucuauacccuuu

SEQ ID NO: 4030224 - RNA, 22 nt, Staphylococcus aureus subsp. aureus MW2
ucucuaucaguccgcuuuuuca

SEQ ID NO: 4030225 - RNA, 20 nt, Staphylococcus aureus subsp. aureus MW2
ucucuauuaauuuucucaaa

SEQ ID NO: 4030226 - RNA, 17 nt, Staphylococcus aureus subsp. aureus MW2
ucucucgcuaaauuuau

SEQ ID NO: 4030227 - RNA, 19 nt, Staphylococcus aureus subsp. aureus MW2
ucucuuaaauaugaauaau

SEQ ID NO: 4030228 - RNA, 12 nt, Staphylococcus aureus subsp. aureus MW2
ucucuucuggag

SEQ ID NO: 4030229 - RNA, 14 nt, Staphylococcus aureus subsp. aureus MW2
ucucuuuucacgaa

SEQ ID NO: 4030230 - RNA, 16 nt, Staphylococcus aureus subsp. aureus MW2
ucucuuuugauaaauu

SEQ ID NO: 4030231 - RNA, 17 nt, Staphylococcus aureus subsp. aureus MW2
ucugaaaaacuucuuaa

SEQ ID NO: 4030232 - RNA, 15 nt, Staphylococcus aureus subsp. aureus MW2
ucugaaaaauauuua

SEQ ID NO: 4030233 - RNA, 17 nt, Staphylococcus aureus subsp. aureus MW2
ucugaaaaauauuuaaa

SEQ ID NO: 4030234 - RNA, 18 nt, Staphylococcus aureus subsp. aureus MW2
ucugaaaaauauuuaaau

SEQ ID NO: 4030235 - RNA, 14 nt, Staphylococcus aureus subsp. aureus MW2
ucugaaaacuuaau

SEQ ID NO: 4030236 - RNA, 19 nt, Staphylococcus aureus subsp. aureus MW2
ucugaaaacuuaauagaaa

SEQ ID NO: 4030237 - RNA, 22 nt, Staphylococcus aureus subsp. aureus MW2
ucugaaaauaucacugaaugcu

SEQ ID NO: 4030238 - RNA, 19 nt, Staphylococcus aureus subsp. aureus MW2
ucugaaacuuuaauacuac

SEQ ID NO: 4030239 - RNA, 20 nt, Staphylococcus aureus subsp. aureus MW2
ucugaacauaaaaaaauacu

SEQ ID NO: 4030240 - RNA, 22 nt, Staphylococcus aureus subsp. aureus MW2
ucugaagguaauuuaacauuuu

SEQ ID NO: 4030241 - RNA, 12 nt, Staphylococcus aureus subsp. aureus MW2
ucugaaucugaa

SEQ ID NO: 4030242 - RNA, 12 nt, Staphylococcus aureus subsp. aureus MW2
ucugaauuuagg

SEQ ID NO: 4030243 - RNA, 20 nt, Staphylococcus aureus subsp. aureus MW2
ucugaauuuaggaaugaaua

SEQ ID NO: 4030244 - RNA, 20 nt, Staphylococcus aureus subsp. aureus MW2
ucugacauuguugcuaaucu

SEQ ID NO: 4030245 - RNA, 14 nt, Staphylococcus aureus subsp. aureus MW2
ucugacauuuaaag

SEQ ID NO: 4030246 - RNA, 17 nt, Staphylococcus aureus subsp. aureus MW2
ucugacuuuuaaaaaac

SEQ ID NO: 4030247 - RNA, 22 nt, Staphylococcus aureus subsp. aureus MW2
ucugauacagaaccaacaauaa

SEQ ID NO: 4030248 - RNA, 15 nt, Staphylococcus aureus subsp. aureus MW2
ucugaucgacuaauu

SEQ ID NO: 4030249 - RNA, 20 nt, Staphylococcus aureus subsp. aureus MW2
ucugaugaggcaauauuaaa

SEQ ID NO: 4030250 - RNA, 14 nt, Staphylococcus aureus subsp. aureus MW2
ucugauguuuuaua

SEQ ID NO: 4030251 - RNA, 18 nt, Staphylococcus aureus subsp. aureus MW2
ucugauuucacuucuaaa

SEQ ID NO: 4030252 - RNA, 22 nt, Staphylococcus aureus subsp. aureus MW2
ucugauuucacuucuaaaacua

SEQ ID NO: 4030253 - RNA, 13 nt, Staphylococcus aureus subsp. aureus MW2
ucugcgaaaugca

SEQ ID NO: 4030254 - RNA, 18 nt, Staphylococcus aureus subsp. aureus MW2
ucugcggauuaucuaacu

SEQ ID NO: 4030255 - RNA, 16 nt, Staphylococcus aureus subsp. aureus MW2
ucugcuaaucuucuca

SEQ ID NO: 4030256 - RNA, 21 nt, Staphylococcus aureus subsp. aureus MW2
ucugcuaaucuucucauaaaa

SEQ ID NO: 4030257 - RNA, 18 nt, Staphylococcus aureus subsp. aureus MW2
ucugcuagacaaucaucu

SEQ ID NO: 4030258 - RNA, 17 nt, Staphylococcus aureus subsp. aureus MW2
ucugcuauuuuuuuaau

SEQ ID NO: 4030259 - RNA, 17 nt, Staphylococcus aureus subsp. aureus MW2
ucugcucuuuuuguaug

SEQ ID NO: 4030260 - RNA, 17 nt, Staphylococcus aureus subsp. aureus MW2
ucuggaacaauaaucaa

SEQ ID NO: 4030261 - RNA, 20 nt, Staphylococcus aureus subsp. aureus MW2
ucuggagacgaaccauuucc

SEQ ID NO: 4030262 - RNA, 15 nt, Staphylococcus aureus subsp. aureus MW2
ucuggcaaauugccu

SEQ ID NO: 4030263 - RNA, 14 nt, Staphylococcus aureus subsp. aureus MW2
ucugguaaaaaaau

SEQ ID NO: 4030264 - RNA, 14 nt, Staphylococcus aureus subsp. aureus MW2
ucugguaaugcuug

SEQ ID NO: 4030265 - RNA, 22 nt, Staphylococcus aureus subsp. aureus MW2
ucugguauuuuaugacguaauu

SEQ ID NO: 4030266 - RNA, 15 nt, Staphylococcus aureus subsp. aureus MW2
ucuguaccguauuuu

SEQ ID NO: 4030267 - RNA, 16 nt, Staphylococcus aureus subsp. aureus MW2
ucuguacguuuuaaau

SEQ ID NO: 4030268 - RNA, 20 nt, Staphylococcus aureus subsp. aureus MW2
ucuguacguuuuaaauaaau

SEQ ID NO: 4030269 - RNA, 15 nt, Staphylococcus aureus subsp. aureus MW2
ucuguagaaauuggc

SEQ ID NO: 4030270 - RNA, 19 nt, Staphylococcus aureus subsp. aureus MW2
ucuguagcgauaccuuuaa

SEQ ID NO: 4030271 - RNA, 22 nt, Staphylococcus aureus subsp. aureus MW2
ucuguagcgauaccuuuaauau

SEQ ID NO: 4030272 - RNA, 14 nt, Staphylococcus aureus subsp. aureus MW2
ucuguauauccauu

SEQ ID NO: 4030273 - RNA, 20 nt, Staphylococcus aureus subsp. aureus MW2
ucuguauauggcgauaacaa

SEQ ID NO: 4030274 - RNA, 21 nt, Staphylococcus aureus subsp. aureus MW2
ucuguauccucaguauuuaau

SEQ ID NO: 4030275 - RNA, 23 nt, Staphylococcus aureus subsp. aureus MW2
ucuguaucgauucgauuauuuag

SEQ ID NO: 4030276 - RNA, 16 nt, Staphylococcus aureus subsp. aureus MW2
ucuguauuauuauaau

SEQ ID NO: 4030277 - RNA, 14 nt, Staphylococcus aureus subsp. aureus MW2
ucugucaaauugga

SEQ ID NO: 4030278 - RNA, 20 nt, Staphylococcus aureus subsp. aureus MW2
ucugucaaauuggacuuaug

SEQ ID NO: 4030279 - RNA, 13 nt, Staphylococcus aureus subsp. aureus MW2
ucuguccaaaaag

SEQ ID NO: 4030280 - RNA, 16 nt, Staphylococcus aureus subsp. aureus MW2
ucuguccaaaaagguu

SEQ ID NO: 4030281 - RNA, 21 nt, Staphylococcus aureus subsp. aureus MW2
ucuguccgauaucuuuuaauu

SEQ ID NO: 4030282 - RNA, 15 nt, Staphylococcus aureus subsp. aureus MW2
ucuguccgauuuaau

SEQ ID NO: 4030283 - RNA, 16 nt, Staphylococcus aureus subsp. aureus MW2
ucuguccgauuuuuaa

SEQ ID NO: 4030284 - RNA, 16 nt, Staphylococcus aureus subsp. aureus MW2
ucugucuaaaaacaua

SEQ ID NO: 4030285 - RNA, 17 nt, Staphylococcus aureus subsp. aureus MW2
ucugucuaaaaacauaa

SEQ ID NO: 4030286 - RNA, 18 nt, Staphylococcus aureus subsp. aureus MW2
ucugucuaaaaacauaaa

SEQ ID NO: 4030287 - RNA, 20 nt, Staphylococcus aureus subsp. aureus MW2
ucugucuaaaaacauaaaaa

SEQ ID NO: 4030288 - RNA, 19 nt, Staphylococcus aureus subsp. aureus MW2
ucuguuacagguuuuaaaa

SEQ ID NO: 4030289 - RNA, 23 nt, Staphylococcus aureus subsp. aureus MW2
ucuguuacagguuuuaaaauuaa

SEQ ID NO: 4030290 - RNA, 19 nt, Staphylococcus aureus subsp. aureus MW2
ucuguuccucaauaggaau

SEQ ID NO: 4030291 - RNA, 20 nt, Staphylococcus aureus subsp. aureus MW2
ucuguugaagucaauaauuu

SEQ ID NO: 4030292 - RNA, 16 nt, Staphylococcus aureus subsp. aureus MW2
ucuuaaaauaugauuu

SEQ ID NO: 4030293 - RNA, 16 nt, Staphylococcus aureus subsp. aureus MW2
ucuugugaguuaacca

SEQ ID NO: 4030294 - RNA, 14 nt, Staphylococcus aureus subsp. aureus MW2
ucuuguucuaaaaa

SEQ ID NO: 4030295 - RNA, 23 nt, Staphylococcus aureus subsp. aureus MW2
ucuuguucuccgaucaugccuuc

SEQ ID NO: 4030296 - RNA, 21 nt, Staphylococcus aureus subsp. aureus MW2
ucuuguuuagggaaucccaua

SEQ ID NO: 4030297 - RNA, 17 nt, Staphylococcus aureus subsp. aureus MW2
ucuuguuucaaacaaag

SEQ ID NO: 4030298 - RNA, 14 nt, Staphylococcus aureus subsp. aureus MW2
ucuuuaaaaaagga

SEQ ID NO: 4030299 - RNA, 19 nt, Staphylococcus aureus subsp. aureus MW2
ucuuuaaagaaaauuucag

SEQ ID NO: 4030300 - RNA, 17 nt, Staphylococcus aureus subsp. aureus MW2
ucuuuaaagucuuuaau

SEQ ID NO: 4030301 - RNA, 19 nt, Staphylococcus aureus subsp. aureus MW2
ucuuuaacucuugaaacac

SEQ ID NO: 4030302 - RNA, 19 nt, Staphylococcus aureus subsp. aureus MW2
ucuuuaagcccuuccccua

SEQ ID NO: 4030303 - RNA, 15 nt, Staphylococcus aureus subsp. aureus MW2
ucuuuaauacgaauu

SEQ ID NO: 4030304 - RNA, 12 nt, Staphylococcus aureus subsp. aureus MW2
ucuuuaauagcu

SEQ ID NO: 4030305 - RNA, 18 nt, Staphylococcus aureus subsp. aureus MW2
ucuuuaauauaaauuuug

SEQ ID NO: 4030306 - RNA, 15 nt, Staphylococcus aureus subsp. aureus MW2
ucuuuaaugaaagca

SEQ ID NO: 4030307 - RNA, 14 nt, Staphylococcus aureus subsp. aureus MW2
ucuuuacaacagua

SEQ ID NO: 4030308 - RNA, 16 nt, Staphylococcus aureus subsp. aureus MW2
ucuuuaccauauaauu

SEQ ID NO: 4030309 - RNA, 20 nt, Staphylococcus aureus subsp. aureus MW2
ucuuuacgauaaacuaaaaa

SEQ ID NO: 4030310 - RNA, 21 nt, Staphylococcus aureus subsp. aureus MW2
ucuuuacuccaaaguaacaua

SEQ ID NO: 4030311 - RNA, 18 nt, Staphylococcus aureus subsp. aureus MW2
ucuuuacuuguaauuaau

SEQ ID NO: 4030312 - RNA, 20 nt, Staphylococcus aureus subsp. aureus MW2
ucuuuacuuguaauuaauac

SEQ ID NO: 4030313 - RNA, 13 nt, Staphylococcus aureus subsp. aureus MW2
ucuuuagcaaaac

SEQ ID NO: 4030314 - RNA, 21 nt, Staphylococcus aureus subsp. aureus MW2
ucuuuagcaaaacgcauuuca

SEQ ID NO: 4030315 - RNA, 17 nt, Staphylococcus aureus subsp. aureus MW2
ucuuuagcuauuuaaaa

SEQ ID NO: 4030316 - RNA, 13 nt, Staphylococcus aureus subsp. aureus MW2
ucuuuauaacuuu

SEQ ID NO: 4030317 - RNA, 13 nt, Staphylococcus aureus subsp. aureus MW2
ucuuuauauuuau

SEQ ID NO: 4030318 - RNA, 14 nt, Staphylococcus aureus subsp. aureus MW2
ucuuuauauuuauc

SEQ ID NO: 4030319 - RNA, 16 nt, Staphylococcus aureus subsp. aureus MW2
ucuuuaucaagggcuc

SEQ ID NO: 4030320 - RNA, 15 nt, Staphylococcus aureus subsp. aureus MW2
ucuuuauuaauaaau

SEQ ID NO: 4030321 - RNA, 23 nt, Staphylococcus aureus subsp. aureus MW2
ucuuuauugggagcaaucaauac

SEQ ID NO: 4030322 - RNA, 13 nt, Staphylococcus aureus subsp. aureus MW2
ucuuuauuuaaag

SEQ ID NO: 4030323 - RNA, 19 nt, Staphylococcus aureus subsp. aureus MW2
ucuuuauuuuaaacaugaa

SEQ ID NO: 4030324 - RNA, 15 nt, Staphylococcus aureus subsp. aureus MW2
ucuuucaaaugcuua

SEQ ID NO: 4030325 - RNA, 17 nt, Staphylococcus aureus subsp. aureus MW2
ucuuucaacaaaaugcg

SEQ ID NO: 4030326 - RNA, 19 nt, Staphylococcus aureus subsp. aureus MW2
ucuuucaaugcauauucua

SEQ ID NO: 4030327 - RNA, 18 nt, Staphylococcus aureus subsp. aureus MW2
ucuuucaauuaauuuaaa

SEQ ID NO: 4030328 - RNA, 22 nt, Staphylococcus aureus subsp. aureus MW2
ucuuucaauuaauuuaaaugcu

SEQ ID NO: 4030329 - RNA, 23 nt, Staphylococcus aureus subsp. aureus MW2
ucuuucaauuaauuuaaaugcuu

SEQ ID NO: 4030330 - RNA, 19 nt, Staphylococcus aureus subsp. aureus MW2
ucuuucagcuaauucgucu

SEQ ID NO: 4030331 - RNA, 19 nt, Staphylococcus aureus subsp. aureus MW2
ucuuucauaguuauuaaau

SEQ ID NO: 4030332 - RNA, 21 nt, Staphylococcus aureus subsp. aureus MW2
ucuuucgucuuguaaacuucu

SEQ ID NO: 4030333 - RNA, 17 nt, Staphylococcus aureus subsp. aureus MW2
ucuuucuaaaauaacua

SEQ ID NO: 4030334 - RNA, 16 nt, Staphylococcus aureus subsp. aureus MW2
ucuuucuaaguuugaa

SEQ ID NO: 4030335 - RNA, 20 nt, Staphylococcus aureus subsp. aureus MW2
ucuuucuuagugaaucuucu

SEQ ID NO: 4030336 - RNA, 22 nt, Staphylococcus aureus subsp. aureus MW2
ucuuucuuagugaaucuucuaa

SEQ ID NO: 4030337 - RNA, 13 nt, Staphylococcus aureus subsp. aureus MW2
ucuuucuuuucug

SEQ ID NO: 4030338 - RNA, 18 nt, Staphylococcus aureus subsp. aureus MW2
ucuuucuuuuuuacauuu

SEQ ID NO: 4030339 - RNA, 19 nt, Staphylococcus aureus subsp. aureus MW2
ucuuugaacauauuauaaa

SEQ ID NO: 4030340 - RNA, 13 nt, Staphylococcus aureus subsp. aureus MW2
ucuuugacaugug

SEQ ID NO: 4030341 - RNA, 20 nt, Staphylococcus aureus subsp. aureus MW2
ucuuugauaacaauuuuaaa

SEQ ID NO: 4030342 - RNA, 17 nt, Staphylococcus aureus subsp. aureus MW2
ucuuuggucuaaagcuu

SEQ ID NO: 4030343 - RNA, 22 nt, Staphylococcus aureus subsp. aureus MW2
ucuuuggucuaaagcuuauuaa

SEQ ID NO: 4030344 - RNA, 13 nt, Staphylococcus aureus subsp. aureus MW2
ucuuuguaaauuu

SEQ ID NO: 4030345 - RNA, 18 nt, Staphylococcus aureus subsp. aureus MW2
ucuuuguguuugcuuuua

SEQ ID NO: 4030346 - RNA, 19 nt, Staphylococcus aureus subsp. aureus MW2
ucuuuguguuugcuuuuau

SEQ ID NO: 4030347 - RNA, 18 nt, Staphylococcus aureus subsp. aureus MW2
ucuuuguugcaaugcaua

SEQ ID NO: 4030348 - RNA, 16 nt, Staphylococcus aureus subsp. aureus MW2
ucuuuguuuuuaauuu

SEQ ID NO: 4030349 - RNA, 19 nt, Staphylococcus aureus subsp. aureus MW2
ucuuuguuuuuaauuuuua

SEQ ID NO: 4030350 - RNA, 18 nt, Staphylococcus aureus subsp. aureus MW2
ucuuuuaauagaucuuug

SEQ ID NO: 4030351 - RNA, 14 nt, Staphylococcus aureus subsp. aureus MW2
ucuuuuaauauuuu

SEQ ID NO: 4030352 - RNA, 14 nt, Staphylococcus aureus subsp. aureus MW2
ucuuuuaauguuuu

SEQ ID NO: 4030353 - RNA, 15 nt, Staphylococcus aureus subsp. aureus MW2
ucuuuuauacaugua

SEQ ID NO: 4030354 - RNA, 21 nt, Staphylococcus aureus subsp. aureus MW2
ucuuuuauacauguacauuau

SEQ ID NO: 4030355 - RNA, 22 nt, Staphylococcus aureus subsp. aureus MW2
ucuuuuauauuuuuaucaucuu

SEQ ID NO: 4030356 - RNA, 18 nt, Staphylococcus aureus subsp. aureus MW2
ucuuuucacgaauaucuu

SEQ ID NO: 4030357 - RNA, 15 nt, Staphylococcus aureus subsp. aureus MW2
ucuuuucgaaauucu

SEQ ID NO: 4030358 - RNA, 18 nt, Staphylococcus aureus subsp. aureus MW2
ucuuuucgaaauucucug

SEQ ID NO: 4030359 - RNA, 18 nt, Staphylococcus aureus subsp. aureus MW2
ucuuuugaaucuuguuga

SEQ ID NO: 4030360 - RNA, 23 nt, Staphylococcus aureus subsp. aureus MW2
ucuuuugcaaauuggaaaaauaa

SEQ ID NO: 4030361 - RNA, 19 nt, Staphylococcus aureus subsp. aureus MW2
ucuuuugcaccuucaagua

SEQ ID NO: 4030362 - RNA, 21 nt, Staphylococcus aureus subsp. aureus MW2
ucuuuuguuuucacuguuuua

SEQ ID NO: 4030363 - RNA, 13 nt, Staphylococcus aureus subsp. aureus MW2
ucuuuuguuuuua

SEQ ID NO: 4030364 - RNA, 21 nt, Staphylococcus aureus subsp. aureus MW2
ucuuuuuaauauuuuuuucaa

SEQ ID NO: 4030365 - RNA, 15 nt, Staphylococcus aureus subsp. aureus MW2
ucuuuuuaucaugau

SEQ ID NO: 4030366 - RNA, 14 nt, Staphylococcus aureus subsp. aureus MW2
ucuuuuuauuuacu

SEQ ID NO: 4030367 - RNA, 13 nt, Staphylococcus aureus subsp. aureus MW2
ucuuuuuauuuau

SEQ ID NO: 4030368 - RNA, 21 nt, Staphylococcus aureus subsp. aureus MW2
ucuuuuugcguuuuuaaauaa

SEQ ID NO: 4030369 - RNA, 15 nt, Staphylococcus aureus subsp. aureus MW2
ucuuuuuguccccag

SEQ ID NO: 4030370 - RNA, 16 nt, Staphylococcus aureus subsp. aureus MW2
ucuuuuuguuguuuua

SEQ ID NO: 4030371 - RNA, 19 nt, Staphylococcus aureus subsp. aureus MW2
ucuuuuuguuguuuuaauu

SEQ ID NO: 4030372 - RNA, 11 nt, Staphylococcus aureus subsp. aureus MW2
ucuuuuuguuu

SEQ ID NO: 4030373 - RNA, 11 nt, Staphylococcus aureus subsp. aureus MW2
ucuuuuuuaaa

SEQ ID NO: 4030374 - RNA, 13 nt, Staphylococcus aureus subsp. aureus MW2
ucuuuuuuaaaga

SEQ ID NO: 4030375 - RNA, 23 nt, Staphylococcus aureus subsp. aureus MW2
ucuuuuuuaagcuuaucaacgau

SEQ ID NO: 4030376 - RNA, 18 nt, Staphylococcus aureus subsp. aureus MW2
ucuuuuuuacuaaaauca

SEQ ID NO: 4030377 - RNA, 22 nt, Staphylococcus aureus subsp. aureus MW2
ucuuuuuuaugcuuauucugaa

SEQ ID NO: 4030378 - RNA, 15 nt, Staphylococcus aureus subsp. aureus MW2
ucuuuuuucaauguu

SEQ ID NO: 4030379 - RNA, 18 nt, Staphylococcus aureus subsp. aureus MW2
ucuuuuuugcuguauaua

SEQ ID NO: 4030380 - RNA, 22 nt, Staphylococcus aureus subsp. aureus MW2
ucuuuuuuuaauguguaaauuu

SEQ ID NO: 4030381 - RNA, 17 nt, Staphylococcus aureus subsp. aureus MW2
ugaaccuuuacucauau

SEQ ID NO: 4030382 - RNA, 15 nt, Staphylococcus aureus subsp. aureus MW2
ugaacgaaagagaaa

SEQ ID NO: 4030383 - RNA, 16 nt, Staphylococcus aureus subsp. aureus MW2
ugaacgaaagagaaaa

SEQ ID NO: 4030384 - RNA, 20 nt, Staphylococcus aureus subsp. aureus MW2
ugaacgaaagagaaaagcua

SEQ ID NO: 4030385 - RNA, 17 nt, Staphylococcus aureus subsp. aureus MW2
ugaacgagagagaaaag

SEQ ID NO: 4030386 - RNA, 22 nt, Staphylococcus aureus subsp. aureus MW2
ugaacgagagagaaaagcuaga

SEQ ID NO: 4030387 - RNA, 18 nt, Staphylococcus aureus subsp. aureus MW2
ugaacgauaacaauuuau

SEQ ID NO: 4030388 - RNA, 14 nt, Staphylococcus aureus subsp. aureus MW2
ugaacgguagaaua

SEQ ID NO: 4030389 - RNA, 12 nt, Staphylococcus aureus subsp. aureus MW2
ugaacguuuauu

SEQ ID NO: 4030390 - RNA, 13 nt, Staphylococcus aureus subsp. aureus MW2
ugaacuaaaacaa

SEQ ID NO: 4030391 - RNA, 13 nt, Staphylococcus aureus subsp. aureus MW2
ugaacuaaauuga

SEQ ID NO: 4030392 - RNA, 15 nt, Staphylococcus aureus subsp. aureus MW2
ugaacuuuguaucuu

SEQ ID NO: 4030393 - RNA, 12 nt, Staphylococcus aureus subsp. aureus MW2
ugaacuuuuauu

SEQ ID NO: 4030394 - RNA, 19 nt, Staphylococcus aureus subsp. aureus MW2
ugaagaaggaugaguuuaa

SEQ ID NO: 4030395 - RNA, 15 nt, Staphylococcus aureus subsp. aureus MW2
ugaagaauauaaacu

SEQ ID NO: 4030396 - RNA, 18 nt, Staphylococcus aureus subsp. aureus MW2
ugaagaauauaaacuauu

SEQ ID NO: 4030397 - RNA, 19 nt, Staphylococcus aureus subsp. aureus MW2
ugaagaauauaaacuauua

SEQ ID NO: 4030398 - RNA, 20 nt, Staphylococcus aureus subsp. aureus MW2
ugaagaauauaaacuauuaa

SEQ ID NO: 4030399 - RNA, 15 nt, Staphylococcus aureus subsp. aureus MW2
ugaagagaaaauuug

SEQ ID NO: 4030400 - RNA, 16 nt, Staphylococcus aureus subsp. aureus MW2
ugaagagaaaauuugu

SEQ ID NO: 4030401 - RNA, 18 nt, Staphylococcus aureus subsp. aureus MW2
ugaagagcuuuuaguaaa

SEQ ID NO: 4030402 - RNA, 20 nt, Staphylococcus aureus subsp. aureus MW2
ugaagcgcuuggauuuuuug

SEQ ID NO: 4030403 - RNA, 21 nt, Staphylococcus aureus subsp. aureus MW2
ugaagcggguugaagcaauuu

SEQ ID NO: 4030404 - RNA, 23 nt, Staphylococcus aureus subsp. aureus MW2
ugaagcuaaguauauaagcaaag

SEQ ID NO: 4030405 - RNA, 14 nt, Staphylococcus aureus subsp. aureus MW2
ugaagcuaauucau

SEQ ID NO: 4030406 - RNA, 19 nt, Staphylococcus aureus subsp. aureus MW2
ugaagcuagagaaauauag

SEQ ID NO: 4030407 - RNA, 22 nt, Staphylococcus aureus subsp. aureus MW2
ugaaggagauauugucuucuca

SEQ ID NO: 4030408 - RNA, 15 nt, Staphylococcus aureus subsp. aureus MW2
ugaagggacaaugaa

SEQ ID NO: 4030409 - RNA, 15 nt, Staphylococcus aureus subsp. aureus MW2
ugaagguaauuuaac

SEQ ID NO: 4030410 - RNA, 17 nt, Staphylococcus aureus subsp. aureus MW2
ugaaguaauauauaaaa

SEQ ID NO: 4030411 - RNA, 15 nt, Staphylococcus aureus subsp. aureus MW2
ugaaguaaugugcau

SEQ ID NO: 4030412 - RNA, 18 nt, Staphylococcus aureus subsp. aureus MW2
ugaaguaaugugcauugc

SEQ ID NO: 4030413 - RNA, 22 nt, Staphylococcus aureus subsp. aureus MW2
ugaaguaggcugaaguugaagc

SEQ ID NO: 4030414 - RNA, 15 nt, Staphylococcus aureus subsp. aureus MW2
ugaaguauggaaguu

SEQ ID NO: 4030415 - RNA, 17 nt, Staphylococcus aureus subsp. aureus MW2
ugaagucuuucaacaaa

SEQ ID NO: 4030416 - RNA, 20 nt, Staphylococcus aureus subsp. aureus MW2
ugaagucuuucaacaaaaug

SEQ ID NO: 4030417 - RNA, 16 nt, Staphylococcus aureus subsp. aureus MW2
ugaaguuacuauauuu

SEQ ID NO: 4030418 - RNA, 22 nt, Staphylococcus aureus subsp. aureus MW2
ugaaguuuaaucguauuagcca

SEQ ID NO: 4030419 - RNA, 20 nt, Staphylococcus aureus subsp. aureus MW2
ugaaguuugaacaacaucuu

SEQ ID NO: 4030420 - RNA, 14 nt, Staphylococcus aureus subsp. aureus MW2
ugaauaaaaaaaca

SEQ ID NO: 4030421 - RNA, 17 nt, Staphylococcus aureus subsp. aureus MW2
ugaauaaaauauaucuu

SEQ ID NO: 4030422 - RNA, 14 nt, Staphylococcus aureus subsp. aureus MW2
ugaauaaaauugug

SEQ ID NO: 4030423 - RNA, 20 nt, Staphylococcus aureus subsp. aureus MW2
ugaauaaagcuaacauaccu

SEQ ID NO: 4030424 - RNA, 13 nt, Staphylococcus aureus subsp. aureus MW2
ugaauaaauaacu

SEQ ID NO: 4030425 - RNA, 15 nt, Staphylococcus aureus subsp. aureus MW2
ugaauaaauaacuuc

SEQ ID NO: 4030426 - RNA, 12 nt, Staphylococcus aureus subsp. aureus MW2
ugaauaaauugu

SEQ ID NO: 4030427 - RNA, 21 nt, Staphylococcus aureus subsp. aureus MW2
ugaauaauaaacuuaaaagag

SEQ ID NO: 4030428 - RNA, 14 nt, Staphylococcus aureus subsp. aureus MW2
ugaauaauauauuu

SEQ ID NO: 4030429 - RNA, 18 nt, Staphylococcus aureus subsp. aureus MW2
ugaauaauguuuucauug

SEQ ID NO: 4030430 - RNA, 11 nt, Staphylococcus aureus subsp. aureus MW2
ugaauaauucc

SEQ ID NO: 4030431 - RNA, 15 nt, Staphylococcus aureus subsp. aureus MW2
ugaauaauuccagua

SEQ ID NO: 4030432 - RNA, 13 nt, Staphylococcus aureus subsp. aureus MW2
ugaauaauucuuu

SEQ ID NO: 4030433 - RNA, 15 nt, Staphylococcus aureus subsp. aureus MW2
ugaauaauucuuuua

SEQ ID NO: 4030434 - RNA, 14 nt, Staphylococcus aureus subsp. aureus MW2
ugaauaauugagaa

SEQ ID NO: 4030435 - RNA, 14 nt, Staphylococcus aureus subsp. aureus MW2
ugaauacuucuuua

SEQ ID NO: 4030436 - RNA, 17 nt, Staphylococcus aureus subsp. aureus MW2
ugaauacuuuauuugau

SEQ ID NO: 4030437 - RNA, 21 nt, Staphylococcus aureus subsp. aureus MW2
ugaauaguaaucagcuuuuuc

SEQ ID NO: 4030438 - RNA, 15 nt, Staphylococcus aureus subsp. aureus MW2
ugaauauaauuuuaa

SEQ ID NO: 4030439 - RNA, 15 nt, Staphylococcus aureus subsp. aureus MW2
ugaauaugauauuaa

SEQ ID NO: 4030440 - RNA, 17 nt, Staphylococcus aureus subsp. aureus MW2
ugaauauggaaaaugua

SEQ ID NO: 4030441 - RNA, 19 nt, Staphylococcus aureus subsp. aureus MW2
ugaauauguguagugaaaa

SEQ ID NO: 4030442 - RNA, 13 nt, Staphylococcus aureus subsp. aureus MW2
ugaauauuauuca

SEQ ID NO: 4030443 - RNA, 16 nt, Staphylococcus aureus subsp. aureus MW2
ugaauauuauucauaa

SEQ ID NO: 4030444 - RNA, 23 nt, Staphylococcus aureus subsp. aureus MW2
ugaaucaacaguuuuauuaucuu

SEQ ID NO: 4030445 - RNA, 13 nt, Staphylococcus aureus subsp. aureus MW2
ugaaucacauuaa

SEQ ID NO: 4030446 - RNA, 16 nt, Staphylococcus aureus subsp. aureus MW2
ugaaucacauuaacaa

SEQ ID NO: 4030447 - RNA, 17 nt, Staphylococcus aureus subsp. aureus MW2
ugaauccaaauauuaaa

SEQ ID NO: 4030448 - RNA, 16 nt, Staphylococcus aureus subsp. aureus MW2
ugaaucccauaaugac

SEQ ID NO: 4030449 - RNA, 20 nt, Staphylococcus aureus subsp. aureus MW2
ugaaucgaguuugaaauaau

SEQ ID NO: 4030450 - RNA, 18 nt, Staphylococcus aureus subsp. aureus MW2
ugaaucgcauuuaaauau

SEQ ID NO: 4030451 - RNA, 18 nt, Staphylococcus aureus subsp. aureus MW2
ugaaucuaaacuauaaua

SEQ ID NO: 4030452 - RNA, 20 nt, Staphylococcus aureus subsp. aureus MW2
ugaaucuuauuuuguuuuaa

SEQ ID NO: 4030453 - RNA, 23 nt, Staphylococcus aureus subsp. aureus MW2
ugaaucuuauuuuguuuuaaaaa

SEQ ID NO: 4030454 - RNA, 23 nt, Staphylococcus aureus subsp. aureus MW2
ugaaucuuguugaacucugauau

SEQ ID NO: 4030455 - RNA, 13 nt, Staphylococcus aureus subsp. aureus MW2
ugaaugaaccuuu

SEQ ID NO: 4030456 - RNA, 22 nt, Staphylococcus aureus subsp. aureus MW2
ugaaugaaccuuuacucauauu

SEQ ID NO: 4030457 - RNA, 13 nt, Staphylococcus aureus subsp. aureus MW2
ugaaugaagcauu

SEQ ID NO: 4030458 - RNA, 17 nt, Staphylococcus aureus subsp. aureus MW2
ugaaugaagcauuuuau

SEQ ID NO: 4030459 - RNA, 14 nt, Staphylococcus aureus subsp. aureus MW2
ugaaugaaguaaua

SEQ ID NO: 4030460 - RNA, 17 nt, Staphylococcus aureus subsp. aureus MW2
ugaauggagcaugauua

SEQ ID NO: 4030461 - RNA, 16 nt, Staphylococcus aureus subsp. aureus MW2
ugaauggcaaauauga

SEQ ID NO: 4030462 - RNA, 23 nt, Staphylococcus aureus subsp. aureus MW2
ugaauggcaaucuauauaaaugu

SEQ ID NO: 4030463 - RNA, 19 nt, Staphylococcus aureus subsp. aureus MW2
ugaauggcauuuaauacua

SEQ ID NO: 4030464 - RNA, 12 nt, Staphylococcus aureus subsp. aureus MW2
ugaauggcucgu

SEQ ID NO: 4030465 - RNA, 22 nt, Staphylococcus aureus subsp. aureus MW2
ugaauguuaagacauaugcagu

SEQ ID NO: 4030466 - RNA, 17 nt, Staphylococcus aureus subsp. aureus MW2
ugaauguuccucuauau

SEQ ID NO: 4030467 - RNA, 23 nt, Staphylococcus aureus subsp. aureus MW2
ugaauguuggaucggcauuguaa

SEQ ID NO: 4030468 - RNA, 12 nt, Staphylococcus aureus subsp. aureus MW2
ugaauuaaaaaa

SEQ ID NO: 4030469 - RNA, 20 nt, Staphylococcus aureus subsp. aureus MW2
ugaauuaaacugaucaugau

SEQ ID NO: 4030470 - RNA, 16 nt, Staphylococcus aureus subsp. aureus MW2
ugagggacgucaucau

SEQ ID NO: 4030471 - RNA, 13 nt, Staphylococcus aureus subsp. aureus MW2
ugaguacaacaua

SEQ ID NO: 4030472 - RNA, 21 nt, Staphylococcus aureus subsp. aureus MW2
ugaguacuaaucaauacuaaa

SEQ ID NO: 4030473 - RNA, 17 nt, Staphylococcus aureus subsp. aureus MW2
ugaguaggcucuuaaug

SEQ ID NO: 4030474 - RNA, 18 nt, Staphylococcus aureus subsp. aureus MW2
ugaguauauucaaaagga

SEQ ID NO: 4030475 - RNA, 14 nt, Staphylococcus aureus subsp. aureus MW2
ugaguaucaugcuu

SEQ ID NO: 4030476 - RNA, 20 nt, Staphylococcus aureus subsp. aureus MW2
ugaguaucaugcuuuuuaau

SEQ ID NO: 4030477 - RNA, 15 nt, Staphylococcus aureus subsp. aureus MW2
ugaguauccaauacu

SEQ ID NO: 4030478 - RNA, 17 nt, Staphylococcus aureus subsp. aureus MW2
ugaguauuacuugaaaa

SEQ ID NO: 4030479 - RNA, 23 nt, Staphylococcus aureus subsp. aureus MW2
ugagucaauuucuuuaaagucuu

SEQ ID NO: 4030480 - RNA, 19 nt, Staphylococcus aureus subsp. aureus MW2
ugagucauucaaucaucaa

SEQ ID NO: 4030481 - RNA, 22 nt, Staphylococcus aureus subsp. aureus MW2
ugagucuuggacauuguaaaau

SEQ ID NO: 4030482 - RNA, 23 nt, Staphylococcus aureus subsp. aureus MW2
ugagugguuuucuuuauuuuaaa

SEQ ID NO: 4030483 - RNA, 18 nt, Staphylococcus aureus subsp. aureus MW2
ugaguguuucauaaucuc

SEQ ID NO: 4030484 - RNA, 15 nt, Staphylococcus aureus subsp. aureus MW2
ugaguugaaaauaau

SEQ ID NO: 4030485 - RNA, 13 nt, Staphylococcus aureus subsp. aureus MW2
ugaguuguugcaa

SEQ ID NO: 4030486 - RNA, 16 nt, Staphylococcus aureus subsp. aureus MW2
ugaguuuaaucgcauu

SEQ ID NO: 4030487 - RNA, 14 nt, Staphylococcus aureus subsp. aureus MW2
ugaguuuuuuaaaa

SEQ ID NO: 4030488 - RNA, 15 nt, Staphylococcus aureus subsp. aureus MW2
ugaguuuuuuaaaau

SEQ ID NO: 4030489 - RNA, 18 nt, Staphylococcus aureus subsp. aureus MW2
ugaguuuuuuaaaauaau

SEQ ID NO: 4030490 - RNA, 17 nt, Staphylococcus aureus subsp. aureus MW2
ugauaaaaauccuauga

SEQ ID NO: 4030491 - RNA, 21 nt, Staphylococcus aureus subsp. aureus MW2
ugauaaaaggggaaaucauuu

SEQ ID NO: 4030492 - RNA, 13 nt, Staphylococcus aureus subsp. aureus MW2
ugauaaaauaaau

SEQ ID NO: 4030493 - RNA, 15 nt, Staphylococcus aureus subsp. aureus MW2
ugauaaauaaugcau

SEQ ID NO: 4030494 - RNA, 13 nt, Staphylococcus aureus subsp. aureus MW2
ugauaaauagaaa

SEQ ID NO: 4030495 - RNA, 12 nt, Staphylococcus aureus subsp. aureus MW2
ugauaaauuaaa

SEQ ID NO: 4030496 - RNA, 19 nt, Staphylococcus aureus subsp. aureus MW2
ugauaacaauuuuaaaucu

SEQ ID NO: 4030497 - RNA, 23 nt, Staphylococcus aureus subsp. aureus MW2
ugauaacacccgucccauaaaag

SEQ ID NO: 4030498 - RNA, 22 nt, Staphylococcus aureus subsp. aureus MW2
ugauaaccauuaugauuaaucc

SEQ ID NO: 4030499 - RNA, 16 nt, Staphylococcus aureus subsp. aureus MW2
ugauaacgucauucuu

SEQ ID NO: 4030500 - RNA, 15 nt, Staphylococcus aureus subsp. aureus MW2
ugauaagaagugcuu

SEQ ID NO: 4030501 - RNA, 17 nt, Staphylococcus aureus subsp. aureus MW2
ugauaagaagugcuuau

SEQ ID NO: 4030502 - RNA, 13 nt, Staphylococcus aureus subsp. aureus MW2
ugauaaugcaugu

SEQ ID NO: 4030503 - RNA, 23 nt, Staphylococcus aureus subsp. aureus MW2
ugauaaugguugauuugauuuaa

SEQ ID NO: 4030504 - RNA, 18 nt, Staphylococcus aureus subsp. aureus MW2
ugauaauguaaaaugaug

SEQ ID NO: 4030505 - RNA, 19 nt, Staphylococcus aureus subsp. aureus MW2
ugauaauuaaugccauugu

SEQ ID NO: 4030506 - RNA, 22 nt, Staphylococcus aureus subsp. aureus MW2
ugauaauuuuucuucuuuuuua

SEQ ID NO: 4030507 - RNA, 19 nt, Staphylococcus aureus subsp. aureus MW2
ugauacagaaccaacaaua

SEQ ID NO: 4030508 - RNA, 14 nt, Staphylococcus aureus subsp. aureus MW2
ugauacauaaaaug

SEQ ID NO: 4030509 - RNA, 16 nt, Staphylococcus aureus subsp. aureus MW2
ugauacauucuauuaa

SEQ ID NO: 4030510 - RNA, 18 nt, Staphylococcus aureus subsp. aureus MW2
ugauacccgcgauacugc

SEQ ID NO: 4030511 - RNA, 22 nt, Staphylococcus aureus subsp. aureus MW2
ugauacgccuaaauauuuaccu

SEQ ID NO: 4030512 - RNA, 15 nt, Staphylococcus aureus subsp. aureus MW2
ugauagaugauacau

SEQ ID NO: 4030513 - RNA, 17 nt, Staphylococcus aureus subsp. aureus MW2
ugauagcaaugaauuaa

SEQ ID NO: 4030514 - RNA, 20 nt, Staphylococcus aureus subsp. aureus MW2
ugauagcaaugaauuaauag

SEQ ID NO: 4030515 - RNA, 17 nt, Staphylococcus aureus subsp. aureus MW2
ugauagcuaaugcauua

SEQ ID NO: 4030516 - RNA, 15 nt, Staphylococcus aureus subsp. aureus MW2
ugauaguacauuuau

SEQ ID NO: 4030517 - RNA, 22 nt, Staphylococcus aureus subsp. aureus MW2
ugauaguagcuuaaugcaucua

SEQ ID NO: 4030518 - RNA, 23 nt, Staphylococcus aureus subsp. aureus MW2
ugauaguagcuuaaugcaucuau

SEQ ID NO: 4030519 - RNA, 14 nt, Staphylococcus aureus subsp. aureus MW2
ugauagugaauaau

SEQ ID NO: 4030520 - RNA, 22 nt, Staphylococcus aureus subsp. aureus MW2
ugauagugguagccaauaucau

SEQ ID NO: 4030521 - RNA, 20 nt, Staphylococcus aureus subsp. aureus MW2
ugauaguguaugaauggcaa

SEQ ID NO: 4030522 - RNA, 17 nt, Staphylococcus aureus subsp. aureus MW2
ugauaguuucuaaucuu

SEQ ID NO: 4030523 - RNA, 12 nt, Staphylococcus aureus subsp. aureus MW2
ugauauaaaaag

SEQ ID NO: 4030524 - RNA, 23 nt, Staphylococcus aureus subsp. aureus MW2
ugauauaaaaagugaaaguauua

SEQ ID NO: 4030525 - RNA, 19 nt, Staphylococcus aureus subsp. aureus MW2
ugauauaccuugauucauu

SEQ ID NO: 4030526 - RNA, 19 nt, Staphylococcus aureus subsp. aureus MW2
ugauauacgacaaucacag

SEQ ID NO: 4030527 - RNA, 17 nt, Staphylococcus aureus subsp. aureus MW2
ugauauauaaccauagu

SEQ ID NO: 4030528 - RNA, 15 nt, Staphylococcus aureus subsp. aureus MW2
ugauauaugaaauau

SEQ ID NO: 4030529 - RNA, 14 nt, Staphylococcus aureus subsp. aureus MW2
ugauaugugaaaaa

SEQ ID NO: 4030530 - RNA, 18 nt, Staphylococcus aureus subsp. aureus MW2
ugauauguuuccucuuua

SEQ ID NO: 4030531 - RNA, 13 nt, Staphylococcus aureus subsp. aureus MW2
ugauauuaauaua

SEQ ID NO: 4030532 - RNA, 16 nt, Staphylococcus aureus subsp. aureus MW2
ugauauuaauauauuu

SEQ ID NO: 4030533 - RNA, 14 nt, Staphylococcus aureus subsp. aureus MW2
ugauauugaaagug

SEQ ID NO: 4030534 - RNA, 19 nt, Staphylococcus aureus subsp. aureus MW2
ugauauugaucugauuuca

SEQ ID NO: 4030535 - RNA, 14 nt, Staphylococcus aureus subsp. aureus MW2
ugaucaaaaauguu

SEQ ID NO: 4030536 - RNA, 22 nt, Staphylococcus aureus subsp. aureus MW2
ugaucaaaaauguuaucuagua

SEQ ID NO: 4030537 - RNA, 14 nt, Staphylococcus aureus subsp. aureus MW2
ugaucaauuaacac

SEQ ID NO: 4030538 - RNA, 16 nt, Staphylococcus aureus subsp. aureus MW2
ugaucauuauaaaaug

SEQ ID NO: 4030539 - RNA, 18 nt, Staphylococcus aureus subsp. aureus MW2
ugaucgauuguuuauuag

SEQ ID NO: 4030540 - RNA, 16 nt, Staphylococcus aureus subsp. aureus MW2
ugaucgcauguuugua

SEQ ID NO: 4030541 - RNA, 15 nt, Staphylococcus aureus subsp. aureus MW2
ugaucuuuaaauaua

SEQ ID NO: 4030542 - RNA, 16 nt, Staphylococcus aureus subsp. aureus MW2
ugaucuuuaaauauac

SEQ ID NO: 4030543 - RNA, 18 nt, Staphylococcus aureus subsp. aureus MW2
ugaugaacauaccugcau

SEQ ID NO: 4030544 - RNA, 14 nt, Staphylococcus aureus subsp. aureus MW2
ugaugaacuuaaug

SEQ ID NO: 4030545 - RNA, 20 nt, Staphylococcus aureus subsp. aureus MW2
ugaugaaguaguuucauugc

SEQ ID NO: 4030546 - RNA, 18 nt, Staphylococcus aureus subsp. aureus MW2
ugaugaauuguuguacau

SEQ ID NO: 4030547 - RNA, 16 nt, Staphylococcus aureus subsp. aureus MW2
ugaugacaucaauauc

SEQ ID NO: 4030548 - RNA, 22 nt, Staphylococcus aureus subsp. aureus MW2
ugaugagaugaggcgauaaaag

SEQ ID NO: 4030549 - RNA, 17 nt, Staphylococcus aureus subsp. aureus MW2
ugaugaggcaauauuaa

SEQ ID NO: 4030550 - RNA, 14 nt, Staphylococcus aureus subsp. aureus MW2
ugaugauaaauuga

SEQ ID NO: 4030551 - RNA, 19 nt, Staphylococcus aureus subsp. aureus MW2
ugaugauacccgcgauacu

SEQ ID NO: 4030552 - RNA, 20 nt, Staphylococcus aureus subsp. aureus MW2
ugaugauauucauauaucaa

SEQ ID NO: 4030553 - RNA, 16 nt, Staphylococcus aureus subsp. aureus MW2
ugaugcgaaaccuuuc

SEQ ID NO: 4030554 - RNA, 16 nt, Staphylococcus aureus subsp. aureus MW2
ugaugcgcuucuaacu

SEQ ID NO: 4030555 - RNA, 19 nt, Staphylococcus aureus subsp. aureus MW2
ugaugcgcuucuaacucac

SEQ ID NO: 4030556 - RNA, 23 nt, Staphylococcus aureus subsp. aureus MW2
ugaugcuagcuuucuuuuucauc

SEQ ID NO: 4030557 - RNA, 16 nt, Staphylococcus aureus subsp. aureus MW2
ugaugguacuaaaguu

SEQ ID NO: 4030558 - RNA, 21 nt, Staphylococcus aureus subsp. aureus MW2
ugcaaguauagaccauccauu

SEQ ID NO: 4030559 - RNA, 22 nt, Staphylococcus aureus subsp. aureus MW2
ugcaagucguucucuuaaauau

SEQ ID NO: 4030560 - RNA, 17 nt, Staphylococcus aureus subsp. aureus MW2
ugcaaguuggggauggg

SEQ ID NO: 4030561 - RNA, 22 nt, Staphylococcus aureus subsp. aureus MW2
ugcaaguuggggugugggcccc

SEQ ID NO: 4030562 - RNA, 19 nt, Staphylococcus aureus subsp. aureus MW2
ugcaauaacaccaauugaa

SEQ ID NO: 4030563 - RNA, 21 nt, Staphylococcus aureus subsp. aureus MW2
ugcaauaacaccaauugaaua

SEQ ID NO: 4030564 - RNA, 18 nt, Staphylococcus aureus subsp. aureus MW2
ugcaauaauuacuaaccu

SEQ ID NO: 4030565 - RNA, 18 nt, Staphylococcus aureus subsp. aureus MW2
ugcaauacaccuauuaca

SEQ ID NO: 4030566 - RNA, 15 nt, Staphylococcus aureus subsp. aureus MW2
ugcaauacauuaaua

SEQ ID NO: 4030567 - RNA, 15 nt, Staphylococcus aureus subsp. aureus MW2
ugcaauauguaacaa

SEQ ID NO: 4030568 - RNA, 20 nt, Staphylococcus aureus subsp. aureus MW2
ugcaaucguauguaacaauu

SEQ ID NO: 4030569 - RNA, 17 nt, Staphylococcus aureus subsp. aureus MW2
ugcaauggcuaaugacu

SEQ ID NO: 4030570 - RNA, 19 nt, Staphylococcus aureus subsp. aureus MW2
ugcaauuaauguaaugaua

SEQ ID NO: 4030571 - RNA, 18 nt, Staphylococcus aureus subsp. aureus MW2
ugcaauugccuuaucagc

SEQ ID NO: 4030572 - RNA, 11 nt, Staphylococcus aureus subsp. aureus MW2
ugcaauuugua

SEQ ID NO: 4030573 - RNA, 14 nt, Staphylococcus aureus subsp. aureus MW2
ugcaauuuguaaua

SEQ ID NO: 4030574 - RNA, 15 nt, Staphylococcus aureus subsp. aureus MW2
ugcacacauaccuca

SEQ ID NO: 4030575 - RNA, 17 nt, Staphylococcus aureus subsp. aureus MW2
ugcacaguuucaucuuc

SEQ ID NO: 4030576 - RNA, 23 nt, Staphylococcus aureus subsp. aureus MW2
ugcacaucauaauaaaucuaucu

SEQ ID NO: 4030577 - RNA, 18 nt, Staphylococcus aureus subsp. aureus MW2
ugcacauuauuguaaccu

SEQ ID NO: 4030578 - RNA, 18 nt, Staphylococcus aureus subsp. aureus MW2
ugcaccuaacgcuaauga

SEQ ID NO: 4030579 - RNA, 16 nt, Staphylococcus aureus subsp. aureus MW2
ugcaccuguuuuaauu

SEQ ID NO: 4030580 - RNA, 17 nt, Staphylococcus aureus subsp. aureus MW2
ugcaccuuuacaacaua

SEQ ID NO: 4030581 - RNA, 20 nt, Staphylococcus aureus subsp. aureus MW2
ugcacuaauggcacuuaaua

SEQ ID NO: 4030582 - RNA, 23 nt, Staphylococcus aureus subsp. aureus MW2
ugcacuaauggcacuuaauauaa

SEQ ID NO: 4030583 - RNA, 19 nt, Staphylococcus aureus subsp. aureus MW2
ugcacuaugcauaauacca

SEQ ID NO: 4030584 - RNA, 16 nt, Staphylococcus aureus subsp. aureus MW2
ugcacugagcaacaaa

SEQ ID NO: 4030585 - RNA, 16 nt, Staphylococcus aureus subsp. aureus MW2
ugcacugcuaauauua

SEQ ID NO: 4030586 - RNA, 18 nt, Staphylococcus aureus subsp. aureus MW2
ugcacugcuaauauuaga

SEQ ID NO: 4030587 - RNA, 17 nt, Staphylococcus aureus subsp. aureus MW2
ugcacuuacugcugcuu

SEQ ID NO: 4030588 - RNA, 15 nt, Staphylococcus aureus subsp. aureus MW2
ugcagaacguucuaa

SEQ ID NO: 4030589 - RNA, 14 nt, Staphylococcus aureus subsp. aureus MW2
ugcagagaauauag

SEQ ID NO: 4030590 - RNA, 14 nt, Staphylococcus aureus subsp. aureus MW2
ugcagauaauugaa

SEQ ID NO: 4030591 - RNA, 18 nt, Staphylococcus aureus subsp. aureus MW2
ugcagauaauugaaaauc

SEQ ID NO: 4030592 - RNA, 20 nt, Staphylococcus aureus subsp. aureus MW2
ugcagauucuucaccaacuu

SEQ ID NO: 4030593 - RNA, 20 nt, Staphylococcus aureus subsp. aureus MW2
ugcagauugauauaaauuau

SEQ ID NO: 4030594 - RNA, 16 nt, Staphylococcus aureus subsp. aureus MW2
ugcagcuguauaacca

SEQ ID NO: 4030595 - RNA, 19 nt, Staphylococcus aureus subsp. aureus MW2
ugcaggauaacguucacuu

SEQ ID NO: 4030596 - RNA, 19 nt, Staphylococcus aureus subsp. aureus MW2
ugcaggcaucauaucauac

SEQ ID NO: 4030597 - RNA, 21 nt, Staphylococcus aureus subsp. aureus MW2
ugcaggcaucauaucauacca

SEQ ID NO: 4030598 - RNA, 18 nt, Staphylococcus aureus subsp. aureus MW2
ugcagucgcaauggcaau

SEQ ID NO: 4030599 - RNA, 23 nt, Staphylococcus aureus subsp. aureus MW2
ugcagugacuagaggauagacaa

SEQ ID NO: 4030600 - RNA, 15 nt, Staphylococcus aureus subsp. aureus MW2
ugcaguuaaauuaaa

SEQ ID NO: 4030601 - RNA, 22 nt, Staphylococcus aureus subsp. aureus MW2
ugcaguuucaaucgcauuuugu

SEQ ID NO: 4030602 - RNA, 18 nt, Staphylococcus aureus subsp. aureus MW2
ugcauaaaaccuucaauc

SEQ ID NO: 4030603 - RNA, 21 nt, Staphylococcus aureus subsp. aureus MW2
ugcauaaccaaguaauucuuu

SEQ ID NO: 4030604 - RNA, 19 nt, Staphylococcus aureus subsp. aureus MW2
ugcauaauauauuaaaaau

SEQ ID NO: 4030605 - RNA, 17 nt, Staphylococcus aureus subsp. aureus MW2
ugcauacgaauuaaaau

SEQ ID NO: 4030606 - RNA, 15 nt, Staphylococcus aureus subsp. aureus MW2
ugcauagcuaaauaa

SEQ ID NO: 4030607 - RNA, 17 nt, Staphylococcus aureus subsp. aureus MW2
ugcauagcuaaauaaau

SEQ ID NO: 4030608 - RNA, 20 nt, Staphylococcus aureus subsp. aureus MW2
ugcauagcucuugcuaaagu

SEQ ID NO: 4030609 - RNA, 16 nt, Staphylococcus aureus subsp. aureus MW2
ugcauauaaagucaua

SEQ ID NO: 4030610 - RNA, 16 nt, Staphylococcus aureus subsp. aureus MW2
ugcauauauugaggau

SEQ ID NO: 4030611 - RNA, 23 nt, Staphylococcus aureus subsp. aureus MW2
ugcauauguaauacaaaagaggc

SEQ ID NO: 4030612 - RNA, 12 nt, Staphylococcus aureus subsp. aureus MW2
ugcauauucacg

SEQ ID NO: 4030613 - RNA, 14 nt, Staphylococcus aureus subsp. aureus MW2
ugcauauucuaucg

SEQ ID NO: 4030614 - RNA, 23 nt, Staphylococcus aureus subsp. aureus MW2
ugcauauugugccgcuucuacaa

SEQ ID NO: 4030615 - RNA, 17 nt, Staphylococcus aureus subsp. aureus MW2
ugcaucauaauuuccug

SEQ ID NO: 4030616 - RNA, 13 nt, Staphylococcus aureus subsp. aureus MW2
ugcaugacagcaa

SEQ ID NO: 4030617 - RNA, 20 nt, Staphylococcus aureus subsp. aureus MW2
ugcaugacagcaaauuuucu

SEQ ID NO: 4030618 - RNA, 17 nt, Staphylococcus aureus subsp. aureus MW2
ugcaugacgauaaugaa

SEQ ID NO: 4030619 - RNA, 18 nt, Staphylococcus aureus subsp. aureus MW2
ugcaugaugaacuuaaug

SEQ ID NO: 4030620 - RNA, 17 nt, Staphylococcus aureus subsp. aureus MW2
ugcaugcuucucaauuu

SEQ ID NO: 4030621 - RNA, 15 nt, Staphylococcus aureus subsp. aureus MW2
ugcauguacaucuuu

SEQ ID NO: 4030622 - RNA, 19 nt, Staphylococcus aureus subsp. aureus MW2
ugcaugucuuaaauucuua

SEQ ID NO: 4030623 - RNA, 13 nt, Staphylococcus aureus subsp. aureus MW2
ugcaugugaaauu

SEQ ID NO: 4030624 - RNA, 15 nt, Staphylococcus aureus subsp. aureus MW2
ugcauguuuaaauau

SEQ ID NO: 4030625 - RNA, 16 nt, Staphylococcus aureus subsp. aureus MW2
ugcauuacuacaaacu

SEQ ID NO: 4030626 - RNA, 20 nt, Staphylococcus aureus subsp. aureus MW2
ugcauuauuauaauagcuuu

SEQ ID NO: 4030627 - RNA, 22 nt, Staphylococcus aureus subsp. aureus MW2
ugcauugauuucagcaccgaca

SEQ ID NO: 4030628 - RNA, 18 nt, Staphylococcus aureus subsp. aureus MW2
ugcauugcuuuuguuaau

SEQ ID NO: 4030629 - RNA, 21 nt, Staphylococcus aureus subsp. aureus MW2
ugcauuuagaugauucuuauc

SEQ ID NO: 4030630 - RNA, 22 nt, Staphylococcus aureus subsp. aureus MW2
ugcauuuagaugauucuuauca

SEQ ID NO: 4030631 - RNA, 13 nt, Staphylococcus aureus subsp. aureus MW2
ugccaaaaacauu

SEQ ID NO: 4030632 - RNA, 16 nt, Staphylococcus aureus subsp. aureus MW2
ugccaaaguaauaaug

SEQ ID NO: 4030633 - RNA, 17 nt, Staphylococcus aureus subsp. aureus MW2
ugccaauaaaaugcaau

SEQ ID NO: 4030634 - RNA, 15 nt, Staphylococcus aureus subsp. aureus MW2
ugccaauuaauucuu

SEQ ID NO: 4030635 - RNA, 11 nt, Staphylococcus aureus subsp. aureus MW2
ugccauaccug

SEQ ID NO: 4030636 - RNA, 13 nt, Staphylococcus aureus subsp. aureus MW2
ugccauauguuuu

SEQ ID NO: 4030637 - RNA, 16 nt, Staphylococcus aureus subsp. aureus MW2
ugccauauguuuuaga

SEQ ID NO: 4030638 - RNA, 14 nt, Staphylococcus aureus subsp. aureus MW2
ugccaucaauuucu

SEQ ID NO: 4030639 - RNA, 14 nt, Staphylococcus aureus subsp. aureus MW2
ugccaucuuuguaa

SEQ ID NO: 4030640 - RNA, 15 nt, Staphylococcus aureus subsp. aureus MW2
ugccauucauacacu

SEQ ID NO: 4030641 - RNA, 18 nt, Staphylococcus aureus subsp. aureus MW2
ugccauucauuaagcuuu

SEQ ID NO: 4030642 - RNA, 21 nt, Staphylococcus aureus subsp. aureus MW2
ugccauuuuuaaauuacuaua

SEQ ID NO: 4030643 - RNA, 17 nt, Staphylococcus aureus subsp. aureus MW2
ugcccaccauguacauu

SEQ ID NO: 4030644 - RNA, 21 nt, Staphylococcus aureus subsp. aureus MW2
ugcccuagguuuauauaucac

SEQ ID NO: 4030645 - RNA, 19 nt, Staphylococcus aureus subsp. aureus MW2
ugcccucauaaaucaugaa

SEQ ID NO: 4030646 - RNA, 14 nt, Staphylococcus aureus subsp. aureus MW2
ugcuuuaaauauug

SEQ ID NO: 4030647 - RNA, 20 nt, Staphylococcus aureus subsp. aureus MW2
ugcuuuaauauaauuauuaa

SEQ ID NO: 4030648 - RNA, 16 nt, Staphylococcus aureus subsp. aureus MW2
ugcuuuaauuaaaguu

SEQ ID NO: 4030649 - RNA, 17 nt, Staphylococcus aureus subsp. aureus MW2
ugcuuuacuauauucaa

SEQ ID NO: 4030650 - RNA, 18 nt, Staphylococcus aureus subsp. aureus MW2
ugcuuuacuauauucaau

SEQ ID NO: 4030651 - RNA, 19 nt, Staphylococcus aureus subsp. aureus MW2
ugcuuugagcaauaaugcc

SEQ ID NO: 4030652 - RNA, 14 nt, Staphylococcus aureus subsp. aureus MW2
ugcuuugauuucau

SEQ ID NO: 4030653 - RNA, 16 nt, Staphylococcus aureus subsp. aureus MW2
ugcuuugauuucauuu

SEQ ID NO: 4030654 - RNA, 17 nt, Staphylococcus aureus subsp. aureus MW2
ugcuuuggaguuucuuc

SEQ ID NO: 4030655 - RNA, 20 nt, Staphylococcus aureus subsp. aureus MW2
ugcuuuuauagauuuuaaua

SEQ ID NO: 4030656 - RNA, 19 nt, Staphylococcus aureus subsp. aureus MW2
ugcuuuuauuuuuaauguu

SEQ ID NO: 4030657 - RNA, 14 nt, Staphylococcus aureus subsp. aureus MW2
ugcuuuuguuaaua

SEQ ID NO: 4030658 - RNA, 12 nt, Staphylococcus aureus subsp. aureus MW2
ugcuuuuuaaug

SEQ ID NO: 4030659 - RNA, 18 nt, Staphylococcus aureus subsp. aureus MW2
ugcuuuuuauuaugcuuc

SEQ ID NO: 4030660 - RNA, 17 nt, Staphylococcus aureus subsp. aureus MW2
ugcuuuuucaaaaucuu

SEQ ID NO: 4030661 - RNA, 22 nt, Staphylococcus aureus subsp. aureus MW2
ugcuuuuucauaaauauuuaaa

SEQ ID NO: 4030662 - RNA, 12 nt, Staphylococcus aureus subsp. aureus MW2
ugcuuuuuuaaa

SEQ ID NO: 4030663 - RNA, 18 nt, Staphylococcus aureus subsp. aureus MW2
ugcuuuuuuaaauuuaau

SEQ ID NO: 4030664 - RNA, 12 nt, Staphylococcus aureus subsp. aureus MW2
ugcuuuuuuaag

SEQ ID NO: 4030665 - RNA, 22 nt, Staphylococcus aureus subsp. aureus MW2
ugcuuuuuuauucuaauacaaa

SEQ ID NO: 4030666 - RNA, 23 nt, Staphylococcus aureus subsp. aureus MW2
uggaaagacguuuuuuuauaaau

SEQ ID NO: 4030667 - RNA, 16 nt, Staphylococcus aureus subsp. aureus MW2
uggaaaguaauaagua

SEQ ID NO: 4030668 - RNA, 13 nt, Staphylococcus aureus subsp. aureus MW2
uggaaauaugaaa

SEQ ID NO: 4030669 - RNA, 18 nt, Staphylococcus aureus subsp. aureus MW2
uggaaauaugaaaagaga

SEQ ID NO: 4030670 - RNA, 15 nt, Staphylococcus aureus subsp. aureus MW2
uggaaauuuauuaua

SEQ ID NO: 4030671 - RNA, 16 nt, Staphylococcus aureus subsp. aureus MW2
uggaaauuuauuauaa

SEQ ID NO: 4030672 - RNA, 18 nt, Staphylococcus aureus subsp. aureus MW2
uggaaauuuauuauaaaa

SEQ ID NO: 4030673 - RNA, 15 nt, Staphylococcus aureus subsp. aureus MW2
uggaacaccaauaua

SEQ ID NO: 4030674 - RNA, 14 nt, Staphylococcus aureus subsp. aureus MW2
uggaaguauauguu

SEQ ID NO: 4030675 - RNA, 16 nt, Staphylococcus aureus subsp. aureus MW2
uggaaguuguugcuuu

SEQ ID NO: 4030676 - RNA, 18 nt, Staphylococcus aureus subsp. aureus MW2
uggaauaaauuuauaacu

SEQ ID NO: 4030677 - RNA, 21 nt, Staphylococcus aureus subsp. aureus MW2
uggaauaaugaugauacugau

SEQ ID NO: 4030678 - RNA, 19 nt, Staphylococcus aureus subsp. aureus MW2
uggaauacuugucaaaauu

SEQ ID NO: 4030679 - RNA, 11 nt, Staphylococcus aureus subsp. aureus MW2
uggaaugacua

SEQ ID NO: 4030680 - RNA, 14 nt, Staphylococcus aureus subsp. aureus MW2
uggaauuaauuaua

SEQ ID NO: 4030681 - RNA, 22 nt, Staphylococcus aureus subsp. aureus MW2
uggacaaucuuaucguaaucuu

SEQ ID NO: 4030682 - RNA, 21 nt, Staphylococcus aureus subsp. aureus MW2
uggacauauacucuaaaaaag

SEQ ID NO: 4030683 - RNA, 18 nt, Staphylococcus aureus subsp. aureus MW2
uggacauuguaaaaugcu

SEQ ID NO: 4030684 - RNA, 15 nt, Staphylococcus aureus subsp. aureus MW2
uggacggcuacaauu

SEQ ID NO: 4030685 - RNA, 15 nt, Staphylococcus aureus subsp. aureus MW2
uggacugauaauaaa

SEQ ID NO: 4030686 - RNA, 20 nt, Staphylococcus aureus subsp. aureus MW2
uggacuuauggguucaauau

SEQ ID NO: 4030687 - RNA, 16 nt, Staphylococcus aureus subsp. aureus MW2
uggacuuuaaaguuaa

SEQ ID NO: 4030688 - RNA, 23 nt, Staphylococcus aureus subsp. aureus MW2
uggacuuugcuguccaucgucau

SEQ ID NO: 4030689 - RNA, 14 nt, Staphylococcus aureus subsp. aureus MW2
uggauaaaaugaua

SEQ ID NO: 4030690 - RNA, 17 nt, Staphylococcus aureus subsp. aureus MW2
uggauaaaaugauaucu

SEQ ID NO: 4030691 - RNA, 13 nt, Staphylococcus aureus subsp. aureus MW2
uggauaauugcau

SEQ ID NO: 4030692 - RNA, 16 nt, Staphylococcus aureus subsp. aureus MW2
uggauaauugcauuac

SEQ ID NO: 4030693 - RNA, 16 nt, Staphylococcus aureus subsp. aureus MW2
uggauaccuaaagcua

SEQ ID NO: 4030694 - RNA, 15 nt, Staphylococcus aureus subsp. aureus MW2
uggauaugauaacca

SEQ ID NO: 4030695 - RNA, 19 nt, Staphylococcus aureus subsp. aureus MW2
uggauaugcguauauguau

SEQ ID NO: 4030696 - RNA, 22 nt, Staphylococcus aureus subsp. aureus MW2
uggauaugcguauauguauaac

SEQ ID NO: 4030697 - RNA, 23 nt, Staphylococcus aureus subsp. aureus MW2
uggauucaaaugacauuuuaaau

SEQ ID NO: 4030698 - RNA, 15 nt, Staphylococcus aureus subsp. aureus MW2
uggauuccaucucau

SEQ ID NO: 4030699 - RNA, 19 nt, Staphylococcus aureus subsp. aureus MW2
uggauuccaucucauacua

SEQ ID NO: 4030700 - RNA, 13 nt, Staphylococcus aureus subsp. aureus MW2
uggauuuauuggg

SEQ ID NO: 4030701 - RNA, 13 nt, Staphylococcus aureus subsp. aureus MW2
uggauuucuuauu

SEQ ID NO: 4030702 - RNA, 14 nt, Staphylococcus aureus subsp. aureus MW2
uggauuucuuuuua

SEQ ID NO: 4030703 - RNA, 14 nt, Staphylococcus aureus subsp. aureus MW2
uggauuuuaacaag

SEQ ID NO: 4030704 - RNA, 18 nt, Staphylococcus aureus subsp. aureus MW2
uggauuuuaacaagauaa

SEQ ID NO: 4030705 - RNA, 21 nt, Staphylococcus aureus subsp. aureus MW2
uggauuuuaacaagauaacua

SEQ ID NO: 4030706 - RNA, 19 nt, Staphylococcus aureus subsp. aureus MW2
uggauuuuuacaaagugau

SEQ ID NO: 4030707 - RNA, 13 nt, Staphylococcus aureus subsp. aureus MW2
uggauuuuuuggu

SEQ ID NO: 4030708 - RNA, 14 nt, Staphylococcus aureus subsp. aureus MW2
uggcaaauaugagu

SEQ ID NO: 4030709 - RNA, 20 nt, Staphylococcus aureus subsp. aureus MW2
uggcaaccuuuugauguuua

SEQ ID NO: 4030710 - RNA, 23 nt, Staphylococcus aureus subsp. aureus MW2
uggcaacggcacauucauaccga

SEQ ID NO: 4030711 - RNA, 15 nt, Staphylococcus aureus subsp. aureus MW2
uggcaacguucuacu

SEQ ID NO: 4030712 - RNA, 20 nt, Staphylococcus aureus subsp. aureus MW2
uggcaacuaaaauuuguaau

SEQ ID NO: 4030713 - RNA, 21 nt, Staphylococcus aureus subsp. aureus MW2
uggcaauuaaaacuauaauaa

SEQ ID NO: 4030714 - RNA, 16 nt, Staphylococcus aureus subsp. aureus MW2
uggcacauaaaucaau

SEQ ID NO: 4030715 - RNA, 16 nt, Staphylococcus aureus subsp. aureus MW2
uggcaccacauacaua

SEQ ID NO: 4030716 - RNA, 21 nt, Staphylococcus aureus subsp. aureus MW2
uggcaccgccaaaccacucau

SEQ ID NO: 4030717 - RNA, 23 nt, Staphylococcus aureus subsp. aureus MW2
uggcauaaccuguuuuuauuugu

SEQ ID NO: 4030718 - RNA, 23 nt, Staphylococcus aureus subsp. aureus MW2
uggcauaucgauaaauguauuaa

SEQ ID NO: 4030719 - RNA, 18 nt, Staphylococcus aureus subsp. aureus MW2
uggcauuuaauacuaaua

SEQ ID NO: 4030720 - RNA, 20 nt, Staphylococcus aureus subsp. aureus MW2
uggcauuuaauacuaauaac

SEQ ID NO: 4030721 - RNA, 21 nt, Staphylococcus aureus subsp. aureus MW2
uggcgacauuuguaaauauuu

SEQ ID NO: 4030722 - RNA, 18 nt, Staphylococcus aureus subsp. aureus MW2
uggcgcaauuuuuaacaa

SEQ ID NO: 4030723 - RNA, 13 nt, Staphylococcus aureus subsp. aureus MW2
uggcgggccccaa

SEQ ID NO: 4030724 - RNA, 17 nt, Staphylococcus aureus subsp. aureus MW2
uggcggggcccaaacau

SEQ ID NO: 4030725 - RNA, 14 nt, Staphylococcus aureus subsp. aureus MW2
uggcggggccccaa

SEQ ID NO: 4030726 - RNA, 16 nt, Staphylococcus aureus subsp. aureus MW2
uggcgugcuuuucaaa

SEQ ID NO: 4030727 - RNA, 15 nt, Staphylococcus aureus subsp. aureus MW2
uggcguugcaccaag

SEQ ID NO: 4030728 - RNA, 14 nt, Staphylococcus aureus subsp. aureus MW2
uggcuaaugacuuc

SEQ ID NO: 4030729 - RNA, 22 nt, Staphylococcus aureus subsp. aureus MW2
uggcuagucuuuaacuuuaauu

SEQ ID NO: 4030730 - RNA, 17 nt, Staphylococcus aureus subsp. aureus MW2
uggcugcaacaauuugc

SEQ ID NO: 4030731 - RNA, 15 nt, Staphylococcus aureus subsp. aureus MW2
uggcugcaucaauau

SEQ ID NO: 4030732 - RNA, 14 nt, Staphylococcus aureus subsp. aureus MW2
uggcuuaaaucaaa

SEQ ID NO: 4030733 - RNA, 15 nt, Staphylococcus aureus subsp. aureus MW2
uggcuuaaaucaaau

SEQ ID NO: 4030734 - RNA, 14 nt, Staphylococcus aureus subsp. aureus MW2
uggcuuacugucac

SEQ ID NO: 4030735 - RNA, 11 nt, Staphylococcus aureus subsp. aureus MW2
uguaaagacac

SEQ ID NO: 4030736 - RNA, 22 nt, Staphylococcus aureus subsp. aureus MW2
uguaaagcuuuaguuaaauagu

SEQ ID NO: 4030737 - RNA, 14 nt, Staphylococcus aureus subsp. aureus MW2
uguaaauaaaaauu

SEQ ID NO: 4030738 - RNA, 19 nt, Staphylococcus aureus subsp. aureus MW2
uguaaauauaguaauaaaa

SEQ ID NO: 4030739 - RNA, 11 nt, Staphylococcus aureus subsp. aureus MW2
uguaaaugaaa

SEQ ID NO: 4030740 - RNA, 16 nt, Staphylococcus aureus subsp. aureus MW2
uguaaaugaaauaggu

SEQ ID NO: 4030741 - RNA, 14 nt, Staphylococcus aureus subsp. aureus MW2
uguaaaugaaaugg

SEQ ID NO: 4030742 - RNA, 18 nt, Staphylococcus aureus subsp. aureus MW2
uguaaaugaauuuugacg

SEQ ID NO: 4030743 - RNA, 19 nt, Staphylococcus aureus subsp. aureus MW2
uguaaauguuaaauucuaa

SEQ ID NO: 4030744 - RNA, 19 nt, Staphylococcus aureus subsp. aureus MW2
uguaaauugguauaacaau

SEQ ID NO: 4030745 - RNA, 20 nt, Staphylococcus aureus subsp. aureus MW2
uguaaauuuauuuuuaauuu

SEQ ID NO: 4030746 - RNA, 17 nt, Staphylococcus aureus subsp. aureus MW2
uguaaauuuuuaagaag

SEQ ID NO: 4030747 - RNA, 15 nt, Staphylococcus aureus subsp. aureus MW2
uguaacaaaugcgua

SEQ ID NO: 4030748 - RNA, 13 nt, Staphylococcus aureus subsp. aureus MW2
uguaacaauauaa

SEQ ID NO: 4030749 - RNA, 14 nt, Staphylococcus aureus subsp. aureus MW2
uguaacaauauaau

SEQ ID NO: 4030750 - RNA, 17 nt, Staphylococcus aureus subsp. aureus MW2
uguaacaauuuagcaaa

SEQ ID NO: 4030751 - RNA, 14 nt, Staphylococcus aureus subsp. aureus MW2
uguaacacacuuau

SEQ ID NO: 4030752 - RNA, 23 nt, Staphylococcus aureus subsp. aureus MW2
uguaacacacuuauaaucuauaa

SEQ ID NO: 4030753 - RNA, 23 nt, Staphylococcus aureus subsp. aureus MW2
uguaacauuacguucuaauaauu

SEQ ID NO: 4030754 - RNA, 14 nt, Staphylococcus aureus subsp. aureus MW2
uguaacguacaauu

SEQ ID NO: 4030755 - RNA, 15 nt, Staphylococcus aureus subsp. aureus MW2
uguaacguucuuaua

SEQ ID NO: 4030756 - RNA, 21 nt, Staphylococcus aureus subsp. aureus MW2
uguaacuuuagacauaaaaaa

SEQ ID NO: 4030757 - RNA, 15 nt, Staphylococcus aureus subsp. aureus MW2
uguaagacaacaaau

SEQ ID NO: 4030758 - RNA, 14 nt, Staphylococcus aureus subsp. aureus MW2
uguaagcagacuaa

SEQ ID NO: 4030759 - RNA, 22 nt, Staphylococcus aureus subsp. aureus MW2
uguaagcuaucguaaacaacau

SEQ ID NO: 4030760 - RNA, 21 nt, Staphylococcus aureus subsp. aureus MW2
uguaagucgaaaguacccaga

SEQ ID NO: 4030761 - RNA, 12 nt, Staphylococcus aureus subsp. aureus MW2
uguaagucgcuc

SEQ ID NO: 4030762 - RNA, 13 nt, Staphylococcus aureus subsp. aureus MW2
uguaaguuugguu

SEQ ID NO: 4030763 - RNA, 18 nt, Staphylococcus aureus subsp. aureus MW2
uguaaguuugguuucuua

SEQ ID NO: 4030764 - RNA, 18 nt, Staphylococcus aureus subsp. aureus MW2
uguaauaauaaucuuuaa

SEQ ID NO: 4030765 - RNA, 14 nt, Staphylococcus aureus subsp. aureus MW2
uguaauacaagcaa

SEQ ID NO: 4030766 - RNA, 17 nt, Staphylococcus aureus subsp. aureus MW2
uguaauaccuuuacuuu

SEQ ID NO: 4030767 - RNA, 14 nt, Staphylococcus aureus subsp. aureus MW2
uguaauauauuaau

SEQ ID NO: 4030768 - RNA, 15 nt, Staphylococcus aureus subsp. aureus MW2
uguaauaugaaggcu

SEQ ID NO: 4030769 - RNA, 23 nt, Staphylococcus aureus subsp. aureus MW2
uguaaucacuauuuguuguuaua

SEQ ID NO: 4030770 - RNA, 19 nt, Staphylococcus aureus subsp. aureus MW2
uguaaucucguuuuuacau

SEQ ID NO: 4030771 - RNA, 21 nt, Staphylococcus aureus subsp. aureus MW2
uguaaugcuuaaaaacaauau

SEQ ID NO: 4030772 - RNA, 16 nt, Staphylococcus aureus subsp. aureus MW2
uguaaugcuucuucua

SEQ ID NO: 4030773 - RNA, 21 nt, Staphylococcus aureus subsp. aureus MW2
uguaauguuccccugaaaaga

SEQ ID NO: 4030774 - RNA, 17 nt, Staphylococcus aureus subsp. aureus MW2
uguaauuccucuggaac

SEQ ID NO: 4030775 - RNA, 13 nt, Staphylococcus aureus subsp. aureus MW2
uguaauucuugua

SEQ ID NO: 4030776 - RNA, 20 nt, Staphylococcus aureus subsp. aureus MW2
uguaauuuaaauuacaauua

SEQ ID NO: 4030777 - RNA, 23 nt, Staphylococcus aureus subsp. aureus MW2
uguaauuuucacuuucaaugaca

SEQ ID NO: 4030778 - RNA, 23 nt, Staphylococcus aureus subsp. aureus MW2
uguacaaccuuugcuuaaaccuu

SEQ ID NO: 4030779 - RNA, 14 nt, Staphylococcus aureus subsp. aureus MW2
uguacaauuuuuaa

SEQ ID NO: 4030780 - RNA, 16 nt, Staphylococcus aureus subsp. aureus MW2
uguacaauuuuuaaaa

SEQ ID NO: 4030781 - RNA, 18 nt, Staphylococcus aureus subsp. aureus MW2
uguacaauuuuuaaaaac

SEQ ID NO: 4030782 - RNA, 21 nt, Staphylococcus aureus subsp. aureus MW2
uguacacuaucguuuuuauua

SEQ ID NO: 4030783 - RNA, 14 nt, Staphylococcus aureus subsp. aureus MW2
uguacacuuuugau

SEQ ID NO: 4030784 - RNA, 16 nt, Staphylococcus aureus subsp. aureus MW2
uguacaguaauauuca

SEQ ID NO: 4030785 - RNA, 15 nt, Staphylococcus aureus subsp. aureus MW2
uguacauguauaaaa

SEQ ID NO: 4030786 - RNA, 13 nt, Staphylococcus aureus subsp. aureus MW2
uguacauuauuaa

SEQ ID NO: 4030787 - RNA, 19 nt, Staphylococcus aureus subsp. aureus MW2
uguacauugguuuuuacua

SEQ ID NO: 4030788 - RNA, 17 nt, Staphylococcus aureus subsp. aureus MW2
uguacauuguaaauaua

SEQ ID NO: 4030789 - RNA, 14 nt, Staphylococcus aureus subsp. aureus MW2
uguaccaaauuuau

SEQ ID NO: 4030790 - RNA, 19 nt, Staphylococcus aureus subsp. aureus MW2
uguaccaauugauuuugcu

SEQ ID NO: 4030791 - RNA, 19 nt, Staphylococcus aureus subsp. aureus MW2
uguaccaucacuaaaguaa

SEQ ID NO: 4030792 - RNA, 21 nt, Staphylococcus aureus subsp. aureus MW2
uguaccaucacuaaaguaaau

SEQ ID NO: 4030793 - RNA, 16 nt, Staphylococcus aureus subsp. aureus MW2
uguaccguauuuuaau

SEQ ID NO: 4030794 - RNA, 22 nt, Staphylococcus aureus subsp. aureus MW2
uguaccuuuuuauugauauuaa

SEQ ID NO: 4030795 - RNA, 23 nt, Staphylococcus aureus subsp. aureus MW2
uguacgaccagucgcauauuuug

SEQ ID NO: 4030796 - RNA, 16 nt, Staphylococcus aureus subsp. aureus MW2
uguacuuuucuuuuua

SEQ ID NO: 4030797 - RNA, 13 nt, Staphylococcus aureus subsp. aureus MW2
uguagaaaacaug

SEQ ID NO: 4030798 - RNA, 23 nt, Staphylococcus aureus subsp. aureus MW2
uguagaaacacaaggaauauaca

SEQ ID NO: 4030799 - RNA, 22 nt, Staphylococcus aureus subsp. aureus MW2
uguagacaauuguaguaaugaa

SEQ ID NO: 4030800 - RNA, 22 nt, Staphylococcus aureus subsp. aureus MW2
uguagauggacaguuuuuauau

SEQ ID NO: 4030801 - RNA, 18 nt, Staphylococcus aureus subsp. aureus MW2
uguagcaggcaacuuuua

SEQ ID NO: 4030802 - RNA, 21 nt, Staphylococcus aureus subsp. aureus MW2
uguagcaggcaacuuuuauua

SEQ ID NO: 4030803 - RNA, 12 nt, Staphylococcus aureus subsp. aureus MW2
uguagcuccuaa

SEQ ID NO: 4030804 - RNA, 20 nt, Staphylococcus aureus subsp. aureus MW2
uguagcuccuaaagcugcaa

SEQ ID NO: 4030805 - RNA, 17 nt, Staphylococcus aureus subsp. aureus MW2
uguagggggcauuauua

SEQ ID NO: 4030806 - RNA, 16 nt, Staphylococcus aureus subsp. aureus MW2
uguaguacuauaguca

SEQ ID NO: 4030807 - RNA, 21 nt, Staphylococcus aureus subsp. aureus MW2
uguaguuaagauaccuuuuuc

SEQ ID NO: 4030808 - RNA, 20 nt, Staphylococcus aureus subsp. aureus MW2
uguauaaaaaccaguuugau

SEQ ID NO: 4030809 - RNA, 21 nt, Staphylococcus aureus subsp. aureus MW2
uguauaaaagauauaaacauu

SEQ ID NO: 4030810 - RNA, 20 nt, Staphylococcus aureus subsp. aureus MW2
uguauaaagggcuauuugau

SEQ ID NO: 4030811 - RNA, 13 nt, Staphylococcus aureus subsp. aureus MW2
uguauaaauguca

SEQ ID NO: 4030812 - RNA, 23 nt, Staphylococcus aureus subsp. aureus MW2
uguauaacgcuuuguuuuuagua

SEQ ID NO: 4030813 - RNA, 16 nt, Staphylococcus aureus subsp. aureus MW2
uguauaauacaugaua

SEQ ID NO: 4030814 - RNA, 18 nt, Staphylococcus aureus subsp. aureus MW2
uguauaauacaugauaua

SEQ ID NO: 4030815 - RNA, 14 nt, Staphylococcus aureus subsp. aureus MW2
uguauacaaggcau

SEQ ID NO: 4030816 - RNA, 16 nt, Staphylococcus aureus subsp. aureus MW2
uguauaguaacgcaua

SEQ ID NO: 4030817 - RNA, 15 nt, Staphylococcus aureus subsp. aureus MW2
uguauauauauguaa

SEQ ID NO: 4030818 - RNA, 10 nt, Staphylococcus aureus subsp. aureus MW2
uguauaucug

SEQ ID NO: 4030819 - RNA, 20 nt, Staphylococcus aureus subsp. aureus MW2
uguauauggcgauaacaaga

SEQ ID NO: 4030820 - RNA, 21 nt, Staphylococcus aureus subsp. aureus MW2
uguaucaaagucucuaguauc

SEQ ID NO: 4030821 - RNA, 17 nt, Staphylococcus aureus subsp. aureus MW2
uguaucaucauaaucaa

SEQ ID NO: 4030822 - RNA, 13 nt, Staphylococcus aureus subsp. aureus MW2
uguauccucagua

SEQ ID NO: 4030823 - RNA, 19 nt, Staphylococcus aureus subsp. aureus MW2
ugugauuuguuacuucuaa

SEQ ID NO: 4030824 - RNA, 23 nt, Staphylococcus aureus subsp. aureus MW2
ugugauuuuuaauaauuugaaua

SEQ ID NO: 4030825 - RNA, 18 nt, Staphylococcus aureus subsp. aureus MW2
ugugcaaguuggcggggc

SEQ ID NO: 4030826 - RNA, 22 nt, Staphylococcus aureus subsp. aureus MW2
ugugcaauuagaauauauguau

SEQ ID NO: 4030827 - RNA, 23 nt, Staphylococcus aureus subsp. aureus MW2
ugugcaauuagaauauauguaua

SEQ ID NO: 4030828 - RNA, 20 nt, Staphylococcus aureus subsp. aureus MW2
ugugccggcuuuuucuuuug

SEQ ID NO: 4030829 - RNA, 15 nt, Staphylococcus aureus subsp. aureus MW2
ugugccuuucuaaua

SEQ ID NO: 4030830 - RNA, 22 nt, Staphylococcus aureus subsp. aureus MW2
ugugcuuuaaaggcauugugua

SEQ ID NO: 4030831 - RNA, 18 nt, Staphylococcus aureus subsp. aureus MW2
ugugcuuuucgcuuuucu

SEQ ID NO: 4030832 - RNA, 19 nt, Staphylococcus aureus subsp. aureus MW2
ugugcuuuuucauaaauau

SEQ ID NO: 4030833 - RNA, 17 nt, Staphylococcus aureus subsp. aureus MW2
uguggauuuaauuuuua

SEQ ID NO: 4030834 - RNA, 12 nt, Staphylococcus aureus subsp. aureus MW2
ugugggccccaa

SEQ ID NO: 4030835 - RNA, 17 nt, Staphylococcus aureus subsp. aureus MW2
ugugggcguucugcuaa

SEQ ID NO: 4030836 - RNA, 11 nt, Staphylococcus aureus subsp. aureus MW2
ugugguaaaag

SEQ ID NO: 4030837 - RNA, 21 nt, Staphylococcus aureus subsp. aureus MW2
uguguaacauuacguucuaau

SEQ ID NO: 4030838 - RNA, 17 nt, Staphylococcus aureus subsp. aureus MW2
uguguaccuuuuuauug

SEQ ID NO: 4030839 - RNA, 22 nt, Staphylococcus aureus subsp. aureus MW2
uguguacguuucaauguaucaa

SEQ ID NO: 4030840 - RNA, 21 nt, Staphylococcus aureus subsp. aureus MW2
uguguaucaguuauuuuaaua

SEQ ID NO: 4030841 - RNA, 19 nt, Staphylococcus aureus subsp. aureus MW2
uguguucggaauuugcaca

SEQ ID NO: 4030842 - RNA, 20 nt, Staphylococcus aureus subsp. aureus MW2
uguguugaaacugaguucaa

SEQ ID NO: 4030843 - RNA, 21 nt, Staphylococcus aureus subsp. aureus MW2
uguguuucuuuuauuuucaua

SEQ ID NO: 4030844 - RNA, 18 nt, Staphylococcus aureus subsp. aureus MW2
uguuaaaaaauuaaaauc

SEQ ID NO: 4030845 - RNA, 18 nt, Staphylococcus aureus subsp. aureus MW2
uguuaaaauuugaauuga

SEQ ID NO: 4030846 - RNA, 18 nt, Staphylococcus aureus subsp. aureus MW2
uguuaaagauuauuauua

SEQ ID NO: 4030847 - RNA, 15 nt, Staphylococcus aureus subsp. aureus MW2
uguuaaauucuaaaa

SEQ ID NO: 4030848 - RNA, 14 nt, Staphylococcus aureus subsp. aureus MW2
uguuaacugaauuu

SEQ ID NO: 4030849 - RNA, 15 nt, Staphylococcus aureus subsp. aureus MW2
uguuaacugauaaaa

SEQ ID NO: 4030850 - RNA, 16 nt, Staphylococcus aureus subsp. aureus MW2
uguuaacugauaaaag

SEQ ID NO: 4030851 - RNA, 21 nt, Staphylococcus aureus subsp. aureus MW2
uguuaacugauaaaaggggaa

SEQ ID NO: 4030852 - RNA, 14 nt, Staphylococcus aureus subsp. aureus MW2
uguuaagcuacccg

SEQ ID NO: 4030853 - RNA, 11 nt, Staphylococcus aureus subsp. aureus MW2
uguuaauaaug

SEQ ID NO: 4030854 - RNA, 14 nt, Staphylococcus aureus subsp. aureus MW2
uguuaaucaaaauu

SEQ ID NO: 4030855 - RNA, 18 nt, Staphylococcus aureus subsp. aureus MW2
uguuaaucaaaauucuga

SEQ ID NO: 4030856 - RNA, 20 nt, Staphylococcus aureus subsp. aureus MW2
uguuaaugcuucguaaucuu

SEQ ID NO: 4030857 - RNA, 23 nt, Staphylococcus aureus subsp. aureus MW2
uguuaauucaggauggaaugaua

SEQ ID NO: 4030858 - RNA, 13 nt, Staphylococcus aureus subsp. aureus MW2
uguuaauuuaaua

SEQ ID NO: 4030859 - RNA, 16 nt, Staphylococcus aureus subsp. aureus MW2
uguuaauuuaauaauu

SEQ ID NO: 4030860 - RNA, 16 nt, Staphylococcus aureus subsp. aureus MW2
uguuaauuuuuuauua

SEQ ID NO: 4030861 - RNA, 17 nt, Staphylococcus aureus subsp. aureus MW2
uguuaauuuuuuauuaa

SEQ ID NO: 4030862 - RNA, 15 nt, Staphylococcus aureus subsp. aureus MW2
uguuacacaaauuaa

SEQ ID NO: 4030863 - RNA, 17 nt, Staphylococcus aureus subsp. aureus MW2
uguuacacaaauuaaaa

SEQ ID NO: 4030864 - RNA, 11 nt, Staphylococcus aureus subsp. aureus MW2
uguuacauuug

SEQ ID NO: 4030865 - RNA, 18 nt, Staphylococcus aureus subsp. aureus MW2
uguuacuaguuuguaaua

SEQ ID NO: 4030866 - RNA, 23 nt, Staphylococcus aureus subsp. aureus MW2
uguuagaggauggauacuuaaag

SEQ ID NO: 4030867 - RNA, 14 nt, Staphylococcus aureus subsp. aureus MW2
uguuagauuucaaa

SEQ ID NO: 4030868 - RNA, 19 nt, Staphylococcus aureus subsp. aureus MW2
uguuaggagagauguauaa

SEQ ID NO: 4030869 - RNA, 22 nt, Staphylococcus aureus subsp. aureus MW2
uguuaggagagauguauaaaac

SEQ ID NO: 4030870 - RNA, 16 nt, Staphylococcus aureus subsp. aureus MW2
uguuaggggcucuuau

SEQ ID NO: 4030871 - RNA, 11 nt, Staphylococcus aureus subsp. aureus MW2
uguuauaaaau

SEQ ID NO: 4030872 - RNA, 18 nt, Staphylococcus aureus subsp. aureus MW2
uguuauaauuaaguguau

SEQ ID NO: 4030873 - RNA, 21 nt, Staphylococcus aureus subsp. aureus MW2
uguuauaauuaaguguauaua

SEQ ID NO: 4030874 - RNA, 17 nt, Staphylococcus aureus subsp. aureus MW2
uguuauagcguuuaaga

SEQ ID NO: 4030875 - RNA, 15 nt, Staphylococcus aureus subsp. aureus MW2
uguuauaucuaauuc

SEQ ID NO: 4030876 - RNA, 16 nt, Staphylococcus aureus subsp. aureus MW2
uguuauauuaugaaca

SEQ ID NO: 4030877 - RNA, 19 nt, Staphylococcus aureus subsp. aureus MW2
uguuauauuaugaacauga

SEQ ID NO: 4030878 - RNA, 23 nt, Staphylococcus aureus subsp. aureus MW2
uguuauauuggcaguguuugacu

SEQ ID NO: 4030879 - RNA, 20 nt, Staphylococcus aureus subsp. aureus MW2
uguuauauuguauuuuauuu

SEQ ID NO: 4030880 - RNA, 17 nt, Staphylococcus aureus subsp. aureus MW2
uguuauccaaaacauuu

SEQ ID NO: 4030881 - RNA, 14 nt, Staphylococcus aureus subsp. aureus MW2
uguuaugaaguauc

SEQ ID NO: 4030882 - RNA, 15 nt, Staphylococcus aureus subsp. aureus MW2
uguuauugaaugaag

SEQ ID NO: 4030883 - RNA, 22 nt, Staphylococcus aureus subsp. aureus MW2
uguuauugaaugaaguaggcug

SEQ ID NO: 4030884 - RNA, 18 nt, Staphylococcus aureus subsp. aureus MW2
uguuauugaugaucaauu

SEQ ID NO: 4030885 - RNA, 15 nt, Staphylococcus aureus subsp. aureus MW2
uguucaaagacacgg

SEQ ID NO: 4030886 - RNA, 16 nt, Staphylococcus aureus subsp. aureus MW2
uguucaauacuuucag

SEQ ID NO: 4030887 - RNA, 16 nt, Staphylococcus aureus subsp. aureus MW2
uguucaaugauuugau

SEQ ID NO: 4030888 - RNA, 17 nt, Staphylococcus aureus subsp. aureus MW2
uguucaauuguuacuuu

SEQ ID NO: 4030889 - RNA, 16 nt, Staphylococcus aureus subsp. aureus MW2
uguucacauucuugaa

SEQ ID NO: 4030890 - RNA, 22 nt, Staphylococcus aureus subsp. aureus MW2
uguucagaacuacaauucauaa

SEQ ID NO: 4030891 - RNA, 16 nt, Staphylococcus aureus subsp. aureus MW2
uguucaguuguuuuuu

SEQ ID NO: 4030892 - RNA, 19 nt, Staphylococcus aureus subsp. aureus MW2
uguucaguuguuuuuuugu

SEQ ID NO: 4030893 - RNA, 21 nt, Staphylococcus aureus subsp. aureus MW2
uguucaguuguuuuuuuguca

SEQ ID NO: 4030894 - RNA, 23 nt, Staphylococcus aureus subsp. aureus MW2
uguucauaaucauaauaagauuu

SEQ ID NO: 4030895 - RNA, 19 nt, Staphylococcus aureus subsp. aureus MW2
uguuccaaucuuuuuaauu

SEQ ID NO: 4030896 - RNA, 17 nt, Staphylococcus aureus subsp. aureus MW2
uguuccgcuacaaaaca

SEQ ID NO: 4030897 - RNA, 23 nt, Staphylococcus aureus subsp. aureus MW2
uguuccugcuacaacuucuucuc

SEQ ID NO: 4030898 - RNA, 14 nt, Staphylococcus aureus subsp. aureus MW2
uguucuaaugcugc

SEQ ID NO: 4030899 - RNA, 17 nt, Staphylococcus aureus subsp. aureus MW2
uguucucgucuuuuguc

SEQ ID NO: 4030900 - RNA, 16 nt, Staphylococcus aureus subsp. aureus MW2
uguucugcuuuuucuu

SEQ ID NO: 4030901 - RNA, 16 nt, Staphylococcus aureus subsp. aureus MW2
uguucuuaacaauauc

SEQ ID NO: 4030902 - RNA, 21 nt, Staphylococcus aureus subsp. aureus MW2
uguucuucugcauagcgcucu

SEQ ID NO: 4030903 - RNA, 15 nt, Staphylococcus aureus subsp. aureus MW2
uguucuugaaaacaa

SEQ ID NO: 4030904 - RNA, 14 nt, Staphylococcus aureus subsp. aureus MW2
uguucuuuuuuaau

SEQ ID NO: 4030905 - RNA, 14 nt, Staphylococcus aureus subsp. aureus MW2
uguugaaaaugacu

SEQ ID NO: 4030906 - RNA, 20 nt, Staphylococcus aureus subsp. aureus MW2
uguugaaauuaaauucaaau

SEQ ID NO: 4030907 - RNA, 15 nt, Staphylococcus aureus subsp. aureus MW2
uguugaauuuaaaaa

SEQ ID NO: 4030908 - RNA, 17 nt, Staphylococcus aureus subsp. aureus MW2
uguugagaaacuuuuuc

SEQ ID NO: 4030909 - RNA, 22 nt, Staphylococcus aureus subsp. aureus MW2
uguugaggcguuucagaaguug

SEQ ID NO: 4030910 - RNA, 20 nt, Staphylococcus aureus subsp. aureus MW2
uguugaucaugagauaaacg

SEQ ID NO: 4030911 - RNA, 20 nt, Staphylococcus aureus subsp. aureus MW2
uuaaaagaguacauuuauuu

SEQ ID NO: 4030912 - RNA, 22 nt, Staphylococcus aureus subsp. aureus MW2
uuaaaagcaaaggcgcgccaug

SEQ ID NO: 4030913 - RNA, 13 nt, Staphylococcus aureus subsp. aureus MW2
uuaaaagugcaag

SEQ ID NO: 4030914 - RNA, 14 nt, Staphylococcus aureus subsp. aureus MW2
uuaaaauaaaccac

SEQ ID NO: 4030915 - RNA, 11 nt, Staphylococcus aureus subsp. aureus MW2
uuaaaauauua

SEQ ID NO: 4030916 - RNA, 13 nt, Staphylococcus aureus subsp. aureus MW2
uuaaaauauuaau

SEQ ID NO: 4030917 - RNA, 22 nt, Staphylococcus aureus subsp. aureus MW2
uuaaaauauuaaucaauuuauc

SEQ ID NO: 4030918 - RNA, 18 nt, Staphylococcus aureus subsp. aureus MW2
uuaaaauauuauuuuuaa

SEQ ID NO: 4030919 - RNA, 16 nt, Staphylococcus aureus subsp. aureus MW2
uuaaaauauuuaacuu

SEQ ID NO: 4030920 - RNA, 22 nt, Staphylococcus aureus subsp. aureus MW2
uuaaaaugauagcuaaacauuu

SEQ ID NO: 4030921 - RNA, 19 nt, Staphylococcus aureus subsp. aureus MW2
uuaaaaugauaucugacau

SEQ ID NO: 4030922 - RNA, 11 nt, Staphylococcus aureus subsp. aureus MW2
uuaaaaugcuu

SEQ ID NO: 4030923 - RNA, 13 nt, Staphylococcus aureus subsp. aureus MW2
uuaaaauuauuga

SEQ ID NO: 4030924 - RNA, 22 nt, Staphylococcus aureus subsp. aureus MW2
uuaaaauugguuuggauaaaau

SEQ ID NO: 4030925 - RNA, 15 nt, Staphylococcus aureus subsp. aureus MW2
uuaaaauuuaaauau

SEQ ID NO: 4030926 - RNA, 14 nt, Staphylococcus aureus subsp. aureus MW2
uuaaacaaaaauaa

SEQ ID NO: 4030927 - RNA, 13 nt, Staphylococcus aureus subsp. aureus MW2
uuaaacaaaacuu

SEQ ID NO: 4030928 - RNA, 17 nt, Staphylococcus aureus subsp. aureus MW2
uuaaacaaauaaauguc

SEQ ID NO: 4030929 - RNA, 19 nt, Staphylococcus aureus subsp. aureus MW2
uuaaacaagcaucaugaaa

SEQ ID NO: 4030930 - RNA, 19 nt, Staphylococcus aureus subsp. aureus MW2
uuaaacaagccuuaaaaua

SEQ ID NO: 4030931 - RNA, 16 nt, Staphylococcus aureus subsp. aureus MW2
uuaaacaguuuaauuc

SEQ ID NO: 4030932 - RNA, 19 nt, Staphylococcus aureus subsp. aureus MW2
uuaaacauaacaugaccua

SEQ ID NO: 4030933 - RNA, 20 nt, Staphylococcus aureus subsp. aureus MW2
uuaaacauccaauuauguuu

SEQ ID NO: 4030934 - RNA, 16 nt, Staphylococcus aureus subsp. aureus MW2
uuaaacauuuagauuu

SEQ ID NO: 4030935 - RNA, 22 nt, Staphylococcus aureus subsp. aureus MW2
uuaaacauuuuuagaaucaaaa

SEQ ID NO: 4030936 - RNA, 14 nt, Staphylococcus aureus subsp. aureus MW2
uuaaaccuaaugau

SEQ ID NO: 4030937 - RNA, 14 nt, Staphylococcus aureus subsp. aureus MW2
uuaaacguaucauu

SEQ ID NO: 4030938 - RNA, 22 nt, Staphylococcus aureus subsp. aureus MW2
uuaaacgugaauucgaugacuu

SEQ ID NO: 4030939 - RNA, 17 nt, Staphylococcus aureus subsp. aureus MW2
uuaaacuguaaacauuu

SEQ ID NO: 4030940 - RNA, 20 nt, Staphylococcus aureus subsp. aureus MW2
uuaaacuuauuaauuaauag

SEQ ID NO: 4030941 - RNA, 20 nt, Staphylococcus aureus subsp. aureus MW2
uuaaagaaaauaucugaaaa

SEQ ID NO: 4030942 - RNA, 21 nt, Staphylococcus aureus subsp. aureus MW2
uuaaagaaaauaucugaaaaa

SEQ ID NO: 4030943 - RNA, 21 nt, Staphylococcus aureus subsp. aureus MW2
uuaaagaaaauuucaguacca

SEQ ID NO: 4030944 - RNA, 20 nt, Staphylococcus aureus subsp. aureus MW2
uuaaagacugaaccguauaa

SEQ ID NO: 4030945 - RNA, 21 nt, Staphylococcus aureus subsp. aureus MW2
uuaaagagcaauuaaagucaa

SEQ ID NO: 4030946 - RNA, 18 nt, Staphylococcus aureus subsp. aureus MW2
uuaaagauggcugcauca

SEQ ID NO: 4030947 - RNA, 19 nt, Staphylococcus aureus subsp. aureus MW2
uuaaagauggcugcaucaa

SEQ ID NO: 4030948 - RNA, 13 nt, Staphylococcus aureus subsp. aureus MW2
uuaaagauuauua

SEQ ID NO: 4030949 - RNA, 18 nt, Staphylococcus aureus subsp. aureus MW2
uuaaagauuuacccauua

SEQ ID NO: 4030950 - RNA, 15 nt, Staphylococcus aureus subsp. aureus MW2
uuaaagcacauguau

SEQ ID NO: 4030951 - RNA, 15 nt, Staphylococcus aureus subsp. aureus MW2
uuaaagcaucuucaa

SEQ ID NO: 4030952 - RNA, 17 nt, Staphylococcus aureus subsp. aureus MW2
uuaaagcuaucuucaga

SEQ ID NO: 4030953 - RNA, 24 nt, Staphylococcus aureus subsp. aureus MW2
uuaaaggaaaucaauccaucaaua

SEQ ID NO: 4030954 - RNA, 13 nt, Staphylococcus aureus subsp. aureus MW2
uuaaaguaaaaua

SEQ ID NO: 4030955 - RNA, 22 nt, Staphylococcus aureus subsp. aureus MW2
uuaaaguaaaauauacuugaag

SEQ ID NO: 4030956 - RNA, 13 nt, Staphylococcus aureus subsp. aureus MW2
uuaaaguaaccac

SEQ ID NO: 4030957 - RNA, 17 nt, Staphylococcus aureus subsp. aureus MW2
uuaaaguagaaccuaua

SEQ ID NO: 4030958 - RNA, 16 nt, Staphylococcus aureus subsp. aureus MW2
uuaaagucuguauaug

SEQ ID NO: 4030959 - RNA, 22 nt, Staphylococcus aureus subsp. aureus MW2
uuaaagucuguugguuuaucag

SEQ ID NO: 4030960 - RNA, 23 nt, Staphylococcus aureus subsp. aureus MW2
uuaaagucuguugguuuaucagc

SEQ ID NO: 4030961 - RNA, 14 nt, Staphylococcus aureus subsp. aureus MW2
uuaaaguguuucaa

SEQ ID NO: 4030962 - RNA, 22 nt, Staphylococcus aureus subsp. aureus MW2
uuaaaguguuucaacauauuau

SEQ ID NO: 4030963 - RNA, 16 nt, Staphylococcus aureus subsp. aureus MW2
uuaaauaaaaauauug

SEQ ID NO: 4030964 - RNA, 15 nt, Staphylococcus aureus subsp. aureus MW2
uuaaauaaaugacuu

SEQ ID NO: 4030965 - RNA, 20 nt, Staphylococcus aureus subsp. aureus MW2
uuaaauaaauucucuaauuu

SEQ ID NO: 4030966 - RNA, 18 nt, Staphylococcus aureus subsp. aureus MW2
uuaaauaagcuacuaagc

SEQ ID NO: 4030967 - RNA, 15 nt, Staphylococcus aureus subsp. aureus MW2
uuaaauaaugauaaa

SEQ ID NO: 4030968 - RNA, 21 nt, Staphylococcus aureus subsp. aureus MW2
uuaaauacaauuucuucauuu

SEQ ID NO: 4030969 - RNA, 15 nt, Staphylococcus aureus subsp. aureus MW2
uuaaauagaagaaaa

SEQ ID NO: 4030970 - RNA, 21 nt, Staphylococcus aureus subsp. aureus MW2
uuaaauaggugauuauauaua

SEQ ID NO: 4030971 - RNA, 23 nt, Staphylococcus aureus subsp. aureus MW2
uuaaauauaaagacgauuuauua

SEQ ID NO: 4030972 - RNA, 11 nt, Staphylococcus aureus subsp. aureus MW2
uuaaauaucau

SEQ ID NO: 4030973 - RNA, 22 nt, Staphylococcus aureus subsp. aureus MW2
uuaaauaucgacaaauuaaaaa

SEQ ID NO: 4030974 - RNA, 21 nt, Staphylococcus aureus subsp. aureus MW2
uuaaauaugacgcgugaauua

SEQ ID NO: 4030975 - RNA, 13 nt, Staphylococcus aureus subsp. aureus MW2
uuaaauauugucu

SEQ ID NO: 4030976 - RNA, 19 nt, Staphylococcus aureus subsp. aureus MW2
uuaaauauuuaaccuuuaa

SEQ ID NO: 4030977 - RNA, 17 nt, Staphylococcus aureus subsp. aureus MW2
uuaaaucaaagaguaaa

SEQ ID NO: 4030978 - RNA, 23 nt, Staphylococcus aureus subsp. aureus MW2
uuaaaucaaagaguaaaguuaaa

SEQ ID NO: 4030979 - RNA, 19 nt, Staphylococcus aureus subsp. aureus MW2
uuaaaucaacaucaucuuu

SEQ ID NO: 4030980 - RNA, 17 nt, Staphylococcus aureus subsp. aureus MW2
uuaaaucaauauucucu

SEQ ID NO: 4030981 - RNA, 18 nt, Staphylococcus aureus subsp. aureus MW2
uuaaauccgcuuguucaa

SEQ ID NO: 4030982 - RNA, 15 nt, Staphylococcus aureus subsp. aureus MW2
uuaaaucuaauuauu

SEQ ID NO: 4030983 - RNA, 15 nt, Staphylococcus aureus subsp. aureus MW2
uuaaaucuacuuugu

SEQ ID NO: 4030984 - RNA, 15 nt, Staphylococcus aureus subsp. aureus MW2
uuaaaucuauauaaa

SEQ ID NO: 4030985 - RNA, 20 nt, Staphylococcus aureus subsp. aureus MW2
uuaaaucuucaagugccauu

SEQ ID NO: 4030986 - RNA, 21 nt, Staphylococcus aureus subsp. aureus MW2
uuaaaugaugcaguaaaacca

SEQ ID NO: 4030987 - RNA, 16 nt, Staphylococcus aureus subsp. aureus MW2
uuaaaugauuuaauaa

SEQ ID NO: 4030988 - RNA, 22 nt, Staphylococcus aureus subsp. aureus MW2
uuaaaugauuucacuucauaaa

SEQ ID NO: 4030989 - RNA, 18 nt, Staphylococcus aureus subsp. aureus MW2
uuaaaugcauaauauauu

SEQ ID NO: 4030990 - RNA, 20 nt, Staphylococcus aureus subsp. aureus MW2
uuaaaugcccaccauguaca

SEQ ID NO: 4030991 - RNA, 13 nt, Staphylococcus aureus subsp. aureus MW2
uuaaaugcuuuaa

SEQ ID NO: 4030992 - RNA, 21 nt, Staphylococcus aureus subsp. aureus MW2
uuaaauguacauuguaaauau

SEQ ID NO: 4030993 - RNA, 13 nt, Staphylococcus aureus subsp. aureus MW2
uuaaauuaaaaua

SEQ ID NO: 4030994 - RNA, 14 nt, Staphylococcus aureus subsp. aureus MW2
uuaaauuaaaauaa

SEQ ID NO: 4030995 - RNA, 21 nt, Staphylococcus aureus subsp. aureus MW2
uuaaauuacuauauuuaaauu

SEQ ID NO: 4030996 - RNA, 15 nt, Staphylococcus aureus subsp. aureus MW2
uuaaauucauaacaa

SEQ ID NO: 4030997 - RNA, 14 nt, Staphylococcus aureus subsp. aureus MW2
uuaaauucaucuug

SEQ ID NO: 4030998 - RNA, 12 nt, Staphylococcus aureus subsp. aureus MW2
uuaaauucauuu

SEQ ID NO: 4030999 - RNA, 22 nt, Staphylococcus aureus subsp. aureus MW2
uuaauaaauuuaacguuauuca

SEQ ID NO: 4031000 - RNA, 21 nt, Staphylococcus aureus subsp. aureus MW2
uuaauaacauccccaaaaaua

SEQ ID NO: 4031001 - RNA, 19 nt, Staphylococcus aureus subsp. aureus MW2
uuaauaaccauguaaaauu

SEQ ID NO: 4031002 - RNA, 20 nt, Staphylococcus aureus subsp. aureus MW2
uuaauaacccauuuucaaaa

SEQ ID NO: 4031003 - RNA, 17 nt, Staphylococcus aureus subsp. aureus MW2
uuaauaaccgaaauauu

SEQ ID NO: 4031004 - RNA, 16 nt, Staphylococcus aureus subsp. aureus MW2
uuaauaaccuuuaaaa

SEQ ID NO: 4031005 - RNA, 19 nt, Staphylococcus aureus subsp. aureus MW2
uuaauaaccuuuaaaacau

SEQ ID NO: 4031006 - RNA, 21 nt, Staphylococcus aureus subsp. aureus MW2
uuaauaaccuuuaaaacauca

SEQ ID NO: 4031007 - RNA, 20 nt, Staphylococcus aureus subsp. aureus MW2
uuaauaagcauuaauguuca

SEQ ID NO: 4031008 - RNA, 16 nt, Staphylococcus aureus subsp. aureus MW2
uuaauaagcuaauauu

SEQ ID NO: 4031009 - RNA, 13 nt, Staphylococcus aureus subsp. aureus MW2
uuaauaauaagua

SEQ ID NO: 4031010 - RNA, 14 nt, Staphylococcus aureus subsp. aureus MW2
uuaauaaugcuuua

SEQ ID NO: 4031011 - RNA, 13 nt, Staphylococcus aureus subsp. aureus MW2
uuaauaauguaca

SEQ ID NO: 4031012 - RNA, 15 nt, Staphylococcus aureus subsp. aureus MW2
uuaauaauuaaacaa

SEQ ID NO: 4031013 - RNA, 17 nt, Staphylococcus aureus subsp. aureus MW2
uuaauaauuaaacaaaa

SEQ ID NO: 4031014 - RNA, 19 nt, Staphylococcus aureus subsp. aureus MW2
uuaauaauuuguuuuauuu

SEQ ID NO: 4031015 - RNA, 20 nt, Staphylococcus aureus subsp. aureus MW2
uuaauacaagucuuuacucu

SEQ ID NO: 4031016 - RNA, 20 nt, Staphylococcus aureus subsp. aureus MW2
uuaauacaucaauaucuucu

SEQ ID NO: 4031017 - RNA, 22 nt, Staphylococcus aureus subsp. aureus MW2
uuaauaccuaucccuguaaaac

SEQ ID NO: 4031018 - RNA, 18 nt, Staphylococcus aureus subsp. aureus MW2
uuaauacgauaauaacua

SEQ ID NO: 4031019 - RNA, 19 nt, Staphylococcus aureus subsp. aureus MW2
uuaauacgauaauaacuag

SEQ ID NO: 4031020 - RNA, 16 nt, Staphylococcus aureus subsp. aureus MW2
uuaauacguuuaauaa

SEQ ID NO: 4031021 - RNA, 22 nt, Staphylococcus aureus subsp. aureus MW2
uuaauacuaauaacucuucuaa

SEQ ID NO: 4031022 - RNA, 19 nt, Staphylococcus aureus subsp. aureus MW2
uuaauacuaauuuuguaca

SEQ ID NO: 4031023 - RNA, 18 nt, Staphylococcus aureus subsp. aureus MW2
uuaauacuaccguuuuua

SEQ ID NO: 4031024 - RNA, 20 nt, Staphylococcus aureus subsp. aureus MW2
uuaauagagacauuuuaucu

SEQ ID NO: 4031025 - RNA, 16 nt, Staphylococcus aureus subsp. aureus MW2
uuaauagagguauaau

SEQ ID NO: 4031026 - RNA, 18 nt, Staphylococcus aureus subsp. aureus MW2
uuaauagcuuguuuauuu

SEQ ID NO: 4031027 - RNA, 20 nt, Staphylococcus aureus subsp. aureus MW2
uuaauagguuaguaauauau

SEQ ID NO: 4031028 - RNA, 21 nt, Staphylococcus aureus subsp. aureus MW2
uuaauagguuaguaauauauu

SEQ ID NO: 4031029 - RNA, 20 nt, Staphylococcus aureus subsp. aureus MW2
uuaauagguucuucuuucau

SEQ ID NO: 4031030 - RNA, 23 nt, Staphylococcus aureus subsp. aureus MW2
uuaauaguaccgugaaaaguguu

SEQ ID NO: 4031031 - RNA, 17 nt, Staphylococcus aureus subsp. aureus MW2
uuaauaguuuuaauauu

SEQ ID NO: 4031032 - RNA, 14 nt, Staphylococcus aureus subsp. aureus MW2
uuaauauaaaauaa

SEQ ID NO: 4031033 - RNA, 17 nt, Staphylococcus aureus subsp. aureus MW2
uuaauauaaauaucaau

SEQ ID NO: 4031034 - RNA, 22 nt, Staphylococcus aureus subsp. aureus MW2
uuaauauaaauuuugaauuaca

SEQ ID NO: 4031035 - RNA, 14 nt, Staphylococcus aureus subsp. aureus MW2
uuaauauaauuaau

SEQ ID NO: 4031036 - RNA, 14 nt, Staphylococcus aureus subsp. aureus MW2
uuaauauaauuauu

SEQ ID NO: 4031037 - RNA, 23 nt, Staphylococcus aureus subsp. aureus MW2
uuaauauauuuaaacucauaauu

SEQ ID NO: 4031038 - RNA, 14 nt, Staphylococcus aureus subsp. aureus MW2
uuaauauauuuauu

SEQ ID NO: 4031039 - RNA, 23 nt, Staphylococcus aureus subsp. aureus MW2
uuaauaucacgaucuuuaaaguc

SEQ ID NO: 4031040 - RNA, 17 nt, Staphylococcus aureus subsp. aureus MW2
uuaauaucauauucaaa

SEQ ID NO: 4031041 - RNA, 21 nt, Staphylococcus aureus subsp. aureus MW2
uuaauaucauauucaaaauaa

SEQ ID NO: 4031042 - RNA, 16 nt, Staphylococcus aureus subsp. aureus MW2
uuaauaugaacaaaaa

SEQ ID NO: 4031043 - RNA, 19 nt, Staphylococcus aureus subsp. aureus MW2
uuaauaugaacaaaaauaa

SEQ ID NO: 4031044 - RNA, 14 nt, Staphylococcus aureus subsp. aureus MW2
uuaauauuaaauuu

SEQ ID NO: 4031045 - RNA, 15 nt, Staphylococcus aureus subsp. aureus MW2
uuaauauugaauaaa

SEQ ID NO: 4031046 - RNA, 20 nt, Staphylococcus aureus subsp. aureus MW2
uuaauauugaauaaaaaaac

SEQ ID NO: 4031047 - RNA, 22 nt, Staphylococcus aureus subsp. aureus MW2
uuaauauugguuauauauuguc

SEQ ID NO: 4031048 - RNA, 13 nt, Staphylococcus aureus subsp. aureus MW2
uuaauauuuauua

SEQ ID NO: 4031049 - RNA, 18 nt, Staphylococcus aureus subsp. aureus MW2
uuaauauuugauaacaaa

SEQ ID NO: 4031050 - RNA, 14 nt, Staphylococcus aureus subsp. aureus MW2
uuaauauuugauua

SEQ ID NO: 4031051 - RNA, 14 nt, Staphylococcus aureus subsp. aureus MW2
uuaaucaauuuaau

SEQ ID NO: 4031052 - RNA, 15 nt, Staphylococcus aureus subsp. aureus MW2
uuaaucaauuuaucg

SEQ ID NO: 4031053 - RNA, 18 nt, Staphylococcus aureus subsp. aureus MW2
uuaaucagcuauaaaagu

SEQ ID NO: 4031054 - RNA, 19 nt, Staphylococcus aureus subsp. aureus MW2
uuaaucagcuauaaaagua

SEQ ID NO: 4031055 - RNA, 19 nt, Staphylococcus aureus subsp. aureus MW2
uuaaucauacauaugcuau

SEQ ID NO: 4031056 - RNA, 19 nt, Staphylococcus aureus subsp. aureus MW2
uuaaucauuguuuuaaauu

SEQ ID NO: 4031057 - RNA, 20 nt, Staphylococcus aureus subsp. aureus MW2
uuaaucauuguuuuaaauuu

SEQ ID NO: 4031058 - RNA, 19 nt, Staphylococcus aureus subsp. aureus MW2
uuaauccaucuacacccau

SEQ ID NO: 4031059 - RNA, 23 nt, Staphylococcus aureus subsp. aureus MW2
uuaauccgauuuugauauaaaaa

SEQ ID NO: 4031060 - RNA, 18 nt, Staphylococcus aureus subsp. aureus MW2
uuaauccgucuuuuuuua

SEQ ID NO: 4031061 - RNA, 11 nt, Staphylococcus aureus subsp. aureus MW2
uuaaucgcauu

SEQ ID NO: 4031062 - RNA, 16 nt, Staphylococcus aureus subsp. aureus MW2
uuaaucgcucuaaaua

SEQ ID NO: 4031063 - RNA, 17 nt, Staphylococcus aureus subsp. aureus MW2
uuaaucuauauaaaaac

SEQ ID NO: 4031064 - RNA, 23 nt, Staphylococcus aureus subsp. aureus MW2
uuaaucucaugccaaaaacauua

SEQ ID NO: 4031065 - RNA, 23 nt, Staphylococcus aureus subsp. aureus MW2
uuaaugaaucuguagucauagcu

SEQ ID NO: 4031066 - RNA, 18 nt, Staphylococcus aureus subsp. aureus MW2
uuaaugaccuaacuguuu

SEQ ID NO: 4031067 - RNA, 20 nt, Staphylococcus aureus subsp. aureus MW2
uuaaugacuucuuuauauuu

SEQ ID NO: 4031068 - RNA, 15 nt, Staphylococcus aureus subsp. aureus MW2
uuaaugauuuuucau

SEQ ID NO: 4031069 - RNA, 19 nt, Staphylococcus aureus subsp. aureus MW2
uuaaugauuuuucaucaau

SEQ ID NO: 4031070 - RNA, 22 nt, Staphylococcus aureus subsp. aureus MW2
uuaaugcuucaaauguaacauu

SEQ ID NO: 4031071 - RNA, 23 nt, Staphylococcus aureus subsp. aureus MW2
uuaaugggcgugccauuaaaauu

SEQ ID NO: 4031072 - RNA, 16 nt, Staphylococcus aureus subsp. aureus MW2
uuaauguauucuucua

SEQ ID NO: 4031073 - RNA, 21 nt, Staphylococcus aureus subsp. aureus MW2
uuaauguauucuucuaauucu

SEQ ID NO: 4031074 - RNA, 15 nt, Staphylococcus aureus subsp. aureus MW2
uuaaugucacaugua

SEQ ID NO: 4031075 - RNA, 18 nt, Staphylococcus aureus subsp. aureus MW2
uuaaugucacauguacca

SEQ ID NO: 4031076 - RNA, 14 nt, Staphylococcus aureus subsp. aureus MW2
uuaaugugcauauu

SEQ ID NO: 4031077 - RNA, 14 nt, Staphylococcus aureus subsp. aureus MW2
uuaauguuaaacaa

SEQ ID NO: 4031078 - RNA, 13 nt, Staphylococcus aureus subsp. aureus MW2
uuaauguuacauu

SEQ ID NO: 4031079 - RNA, 14 nt, Staphylococcus aureus subsp. aureus MW2
uuaauguuuaauaa

SEQ ID NO: 4031080 - RNA, 16 nt, Staphylococcus aureus subsp. aureus MW2
uuaauguuugaguguu

SEQ ID NO: 4031081 - RNA, 14 nt, Staphylococcus aureus subsp. aureus MW2
uuaauguuugcuuu

SEQ ID NO: 4031082 - RNA, 20 nt, Staphylococcus aureus subsp. aureus MW2
uuaauuaaacuguaaacauu

SEQ ID NO: 4031083 - RNA, 19 nt, Staphylococcus aureus subsp. aureus MW2
uuaauuaaagcaucuucaa

SEQ ID NO: 4031084 - RNA, 20 nt, Staphylococcus aureus subsp. aureus MW2
uuaauuaaagcaucuucaau

SEQ ID NO: 4031085 - RNA, 12 nt, Staphylococcus aureus subsp. aureus MW2
uuaauuaacaaa

SEQ ID NO: 4031086 - RNA, 20 nt, Staphylococcus aureus subsp. aureus MW2
uuaauuaauaauuuaacuaa

SEQ ID NO: 4031087 - RNA, 20 nt, Staphylococcus aureus subsp. aureus MW2
uuacggcauaauuuuuuaau

SEQ ID NO: 4031088 - RNA, 20 nt, Staphylococcus aureus subsp. aureus MW2
uuacguaucuuuacaacagu

SEQ ID NO: 4031089 - RNA, 18 nt, Staphylococcus aureus subsp. aureus MW2
uuacgugaccuuuguaag

SEQ ID NO: 4031090 - RNA, 19 nt, Staphylococcus aureus subsp. aureus MW2
uuacguucuaauaauuuaa

SEQ ID NO: 4031091 - RNA, 13 nt, Staphylococcus aureus subsp. aureus MW2
uuacguugaaugu

SEQ ID NO: 4031092 - RNA, 12 nt, Staphylococcus aureus subsp. aureus MW2
uuacuaaaauau

SEQ ID NO: 4031093 - RNA, 18 nt, Staphylococcus aureus subsp. aureus MW2
uuacuaggaauauaaaac

SEQ ID NO: 4031094 - RNA, 13 nt, Staphylococcus aureus subsp. aureus MW2
uuacuauaaaaaa

SEQ ID NO: 4031095 - RNA, 19 nt, Staphylococcus aureus subsp. aureus MW2
uuacuaucucuucugucua

SEQ ID NO: 4031096 - RNA, 20 nt, Staphylococcus aureus subsp. aureus MW2
uuacuauggcauuauugccu

SEQ ID NO: 4031097 - RNA, 18 nt, Staphylococcus aureus subsp. aureus MW2
uuacucauauugaauacu

SEQ ID NO: 4031098 - RNA, 13 nt, Staphylococcus aureus subsp. aureus MW2
uuacuccuuacaa

SEQ ID NO: 4031099 - RNA, 19 nt, Staphylococcus aureus subsp. aureus MW2
uuacucuacacucaaacaa

SEQ ID NO: 4031100 - RNA, 16 nt, Staphylococcus aureus subsp. aureus MW2
uuacucuuuuuaauau

SEQ ID NO: 4031101 - RNA, 16 nt, Staphylococcus aureus subsp. aureus MW2
uuacugaugaacauac

SEQ ID NO: 4031102 - RNA, 15 nt, Staphylococcus aureus subsp. aureus MW2
uuacuguaaauauga

SEQ ID NO: 4031103 - RNA, 23 nt, Staphylococcus aureus subsp. aureus MW2
uuacuuaaucuggguuguaaucu

SEQ ID NO: 4031104 - RNA, 15 nt, Staphylococcus aureus subsp. aureus MW2
uuacuucauaaguca

SEQ ID NO: 4031105 - RNA, 17 nt, Staphylococcus aureus subsp. aureus MW2
uuacuuccauugcuucu

SEQ ID NO: 4031106 - RNA, 20 nt, Staphylococcus aureus subsp. aureus MW2
uuacuucuaauaguaaugau

SEQ ID NO: 4031107 - RNA, 17 nt, Staphylococcus aureus subsp. aureus MW2
uuacuugcuuuuucaaa

SEQ ID NO: 4031108 - RNA, 21 nt, Staphylococcus aureus subsp. aureus MW2
uuacuugcuuuuucaaauaau

SEQ ID NO: 4031109 - RNA, 12 nt, Staphylococcus aureus subsp. aureus MW2
uuacuuuaacuu

SEQ ID NO: 4031110 - RNA, 16 nt, Staphylococcus aureus subsp. aureus MW2
uuacuuucgcuugcaa

SEQ ID NO: 4031111 - RNA, 11 nt, Staphylococcus aureus subsp. aureus MW2
uuacuuugaaa

SEQ ID NO: 4031112 - RNA, 20 nt, Staphylococcus aureus subsp. aureus MW2
uuagaaaaaaaucuguuucu

SEQ ID NO: 4031113 - RNA, 19 nt, Staphylococcus aureus subsp. aureus MW2
uuagaaaguauuuauuucu

SEQ ID NO: 4031114 - RNA, 18 nt, Staphylococcus aureus subsp. aureus MW2
uuagaagaugauuauucu

SEQ ID NO: 4031115 - RNA, 20 nt, Staphylococcus aureus subsp. aureus MW2
uuagaagaugauuauucucu

SEQ ID NO: 4031116 - RNA, 18 nt, Staphylococcus aureus subsp. aureus MW2
uuagaauaguuaccaaaa

SEQ ID NO: 4031117 - RNA, 13 nt, Staphylococcus aureus subsp. aureus MW2
uuagacauuaaaa

SEQ ID NO: 4031118 - RNA, 18 nt, Staphylococcus aureus subsp. aureus MW2
uuagaccccuaauuaaaa

SEQ ID NO: 4031119 - RNA, 17 nt, Staphylococcus aureus subsp. aureus MW2
uuagacucacuucuuaa

SEQ ID NO: 4031120 - RNA, 18 nt, Staphylococcus aureus subsp. aureus MW2
uuagacucacuucuuaaa

SEQ ID NO: 4031121 - RNA, 19 nt, Staphylococcus aureus subsp. aureus MW2
uuagagccccuuacaacuu

SEQ ID NO: 4031122 - RNA, 15 nt, Staphylococcus aureus subsp. aureus MW2
uuagauaaaaaauac

SEQ ID NO: 4031123 - RNA, 17 nt, Staphylococcus aureus subsp. aureus MW2
uuagauaaaaaauacua

SEQ ID NO: 4031124 - RNA, 13 nt, Staphylococcus aureus subsp. aureus MW2
uuagauaaaacaa

SEQ ID NO: 4031125 - RNA, 14 nt, Staphylococcus aureus subsp. aureus MW2
uuagauaaauuaau

SEQ ID NO: 4031126 - RNA, 21 nt, Staphylococcus aureus subsp. aureus MW2
uuagauacuucuuuagcaaaa

SEQ ID NO: 4031127 - RNA, 16 nt, Staphylococcus aureus subsp. aureus MW2
uuagaucgauguguaa

SEQ ID NO: 4031128 - RNA, 16 nt, Staphylococcus aureus subsp. aureus MW2
uuagaugcauaaaaaa

SEQ ID NO: 4031129 - RNA, 19 nt, Staphylococcus aureus subsp. aureus MW2
uuagaugcauaaaaaaaga

SEQ ID NO: 4031130 - RNA, 20 nt, Staphylococcus aureus subsp. aureus MW2
uuagaugcauaaaaaaagaa

SEQ ID NO: 4031131 - RNA, 14 nt, Staphylococcus aureus subsp. aureus MW2
uuagaugugcgugg

SEQ ID NO: 4031132 - RNA, 18 nt, Staphylococcus aureus subsp. aureus MW2
uuagauucuuuucugaau

SEQ ID NO: 4031133 - RNA, 12 nt, Staphylococcus aureus subsp. aureus MW2
uuagauuuaaaa

SEQ ID NO: 4031134 - RNA, 23 nt, Staphylococcus aureus subsp. aureus MW2
uuagauuucaaacgauuuucaaa

SEQ ID NO: 4031135 - RNA, 14 nt, Staphylococcus aureus subsp. aureus MW2
uuagauuucauaau

SEQ ID NO: 4031136 - RNA, 17 nt, Staphylococcus aureus subsp. aureus MW2
uuagauuuuauauaaaa

SEQ ID NO: 4031137 - RNA, 21 nt, Staphylococcus aureus subsp. aureus MW2
uuagauuuuauauaaaaagaa

SEQ ID NO: 4031138 - RNA, 21 nt, Staphylococcus aureus subsp. aureus MW2
uuagcaaaaauauuuaaacua

SEQ ID NO: 4031139 - RNA, 21 nt, Staphylococcus aureus subsp. aureus MW2
uuagcaaaacgcauuucaugu

SEQ ID NO: 4031140 - RNA, 15 nt, Staphylococcus aureus subsp. aureus MW2
uuagcaaauauuucu

SEQ ID NO: 4031141 - RNA, 13 nt, Staphylococcus aureus subsp. aureus MW2
uuagcaucaaaaa

SEQ ID NO: 4031142 - RNA, 19 nt, Staphylococcus aureus subsp. aureus MW2
uuagcaucuuuaccauaua

SEQ ID NO: 4031143 - RNA, 17 nt, Staphylococcus aureus subsp. aureus MW2
uuagccaaaucuuuaau

SEQ ID NO: 4031144 - RNA, 18 nt, Staphylococcus aureus subsp. aureus MW2
uuagccaauaaaauguca

SEQ ID NO: 4031145 - RNA, 19 nt, Staphylococcus aureus subsp. aureus MW2
uuagccaauaccgaauaau

SEQ ID NO: 4031146 - RNA, 13 nt, Staphylococcus aureus subsp. aureus MW2
uuagccauuucaa

SEQ ID NO: 4031147 - RNA, 19 nt, Staphylococcus aureus subsp. aureus MW2
uuagcgcaccaauuaucaa

SEQ ID NO: 4031148 - RNA, 16 nt, Staphylococcus aureus subsp. aureus MW2
uuagcuaauucacuuu

SEQ ID NO: 4031149 - RNA, 15 nt, Staphylococcus aureus subsp. aureus MW2
uuagcuauuuaaaau

SEQ ID NO: 4031150 - RNA, 15 nt, Staphylococcus aureus subsp. aureus MW2
uuaggaaugaauaaa

SEQ ID NO: 4031151 - RNA, 16 nt, Staphylococcus aureus subsp. aureus MW2
uuaggaaugacauuua

SEQ ID NO: 4031152 - RNA, 18 nt, Staphylococcus aureus subsp. aureus MW2
uuaggaaugauagauuua

SEQ ID NO: 4031153 - RNA, 16 nt, Staphylococcus aureus subsp. aureus MW2
uuaggcauuuuagauu

SEQ ID NO: 4031154 - RNA, 17 nt, Staphylococcus aureus subsp. aureus MW2
uuaggcgcuacaauguu

SEQ ID NO: 4031155 - RNA, 16 nt, Staphylococcus aureus subsp. aureus MW2
uuaggcuuauuaacuu

SEQ ID NO: 4031156 - RNA, 19 nt, Staphylococcus aureus subsp. aureus MW2
uuagguaaaaauuaacaac

SEQ ID NO: 4031157 - RNA, 15 nt, Staphylococcus aureus subsp. aureus MW2
uuagguccuuucaca

SEQ ID NO: 4031158 - RNA, 18 nt, Staphylococcus aureus subsp. aureus MW2
uuagguuaauuaaacaag

SEQ ID NO: 4031159 - RNA, 14 nt, Staphylococcus aureus subsp. aureus MW2
uuagguuacuuauu

SEQ ID NO: 4031160 - RNA, 16 nt, Staphylococcus aureus subsp. aureus MW2
uuagguuuaucauggu

SEQ ID NO: 4031161 - RNA, 22 nt, Staphylococcus aureus subsp. aureus MW2
uuaguaagauuaccuacaauaa

SEQ ID NO: 4031162 - RNA, 15 nt, Staphylococcus aureus subsp. aureus MW2
uuaguaaggaauauu

SEQ ID NO: 4031163 - RNA, 19 nt, Staphylococcus aureus subsp. aureus MW2
uuaguaauaacaucuaaau

SEQ ID NO: 4031164 - RNA, 14 nt, Staphylococcus aureus subsp. aureus MW2
uuaguacaaaauug

SEQ ID NO: 4031165 - RNA, 15 nt, Staphylococcus aureus subsp. aureus MW2
uuaguacaaaauugu

SEQ ID NO: 4031166 - RNA, 20 nt, Staphylococcus aureus subsp. aureus MW2
uuaguacauauguuguuucu

SEQ ID NO: 4031167 - RNA, 14 nt, Staphylococcus aureus subsp. aureus MW2
uuaguacuaaaccg

SEQ ID NO: 4031168 - RNA, 24 nt, Staphylococcus aureus subsp. aureus MW2
uuaguacuaaaccgauuaauauaa

SEQ ID NO: 4031169 - RNA, 18 nt, Staphylococcus aureus subsp. aureus MW2
uuaguacuuaauacuaau

SEQ ID NO: 4031170 - RNA, 20 nt, Staphylococcus aureus subsp. aureus MW2
uuaguagaaaccuuaaaauc

SEQ ID NO: 4031171 - RNA, 21 nt, Staphylococcus aureus subsp. aureus MW2
uuaguauaauuuaucuuaauc

SEQ ID NO: 4031172 - RNA, 19 nt, Staphylococcus aureus subsp. aureus MW2
uuaguaucgauaguucuau

SEQ ID NO: 4031173 - RNA, 14 nt, Staphylococcus aureus subsp. aureus MW2
uuaguaucuauaca

SEQ ID NO: 4031174 - RNA, 17 nt, Staphylococcus aureus subsp. aureus MW2
uuaguauucaaaaaaau

SEQ ID NO: 4031175 - RNA, 23 nt, Staphylococcus aureus subsp. aureus MW2
uuagucaucaaccucauuugaca

SEQ ID NO: 4031176 - RNA, 17 nt, Staphylococcus aureus subsp. aureus MW2
uuaugagcuucuuuaaa

SEQ ID NO: 4031177 - RNA, 11 nt, Staphylococcus aureus subsp. aureus MW2
uuaugauauac

SEQ ID NO: 4031178 - RNA, 21 nt, Staphylococcus aureus subsp. aureus MW2
uuaugauauacgagcuuugcu

SEQ ID NO: 4031179 - RNA, 19 nt, Staphylococcus aureus subsp. aureus MW2
uuaugaucaauaagauuuu

SEQ ID NO: 4031180 - RNA, 14 nt, Staphylococcus aureus subsp. aureus MW2
uuaugaugucaugu

SEQ ID NO: 4031181 - RNA, 19 nt, Staphylococcus aureus subsp. aureus MW2
uuaugauugcuuauuuauu

SEQ ID NO: 4031182 - RNA, 15 nt, Staphylococcus aureus subsp. aureus MW2
uuaugcauauguaau

SEQ ID NO: 4031183 - RNA, 18 nt, Staphylococcus aureus subsp. aureus MW2
uuaugccauucauuaagc

SEQ ID NO: 4031184 - RNA, 17 nt, Staphylococcus aureus subsp. aureus MW2
uuaugcccgauaauucu

SEQ ID NO: 4031185 - RNA, 17 nt, Staphylococcus aureus subsp. aureus MW2
uuaugcggucuaaaugc

SEQ ID NO: 4031186 - RNA, 18 nt, Staphylococcus aureus subsp. aureus MW2
uuauguaccaaauuuaua

SEQ ID NO: 4031187 - RNA, 14 nt, Staphylococcus aureus subsp. aureus MW2
uuauguauaucuuu

SEQ ID NO: 4031188 - RNA, 19 nt, Staphylococcus aureus subsp. aureus MW2
uuauguauuuuuauuuaua

SEQ ID NO: 4031189 - RNA, 12 nt, Staphylococcus aureus subsp. aureus MW2
uuaugugcauca

SEQ ID NO: 4031190 - RNA, 18 nt, Staphylococcus aureus subsp. aureus MW2
uuaugugcuaaucuauuu

SEQ ID NO: 4031191 - RNA, 20 nt, Staphylococcus aureus subsp. aureus MW2
uuauguuauaaauucuaucu

SEQ ID NO: 4031192 - RNA, 16 nt, Staphylococcus aureus subsp. aureus MW2
uuauguucagaacuac

SEQ ID NO: 4031193 - RNA, 24 nt, Staphylococcus aureus subsp. aureus MW2
uuauguugacucuacuagaauaac

SEQ ID NO: 4031194 - RNA, 13 nt, Staphylococcus aureus subsp. aureus MW2
uuauguuuaauuu

SEQ ID NO: 4031195 - RNA, 22 nt, Staphylococcus aureus subsp. aureus MW2
uuauguuuugaagggacaauga

SEQ ID NO: 4031196 - RNA, 17 nt, Staphylococcus aureus subsp. aureus MW2
uuauuaaaauuaaauaa

SEQ ID NO: 4031197 - RNA, 21 nt, Staphylococcus aureus subsp. aureus MW2
uuauuaaaauuaaauaaugau

SEQ ID NO: 4031198 - RNA, 12 nt, Staphylococcus aureus subsp. aureus MW2
uuauuaaaucag

SEQ ID NO: 4031199 - RNA, 18 nt, Staphylococcus aureus subsp. aureus MW2
uuauuaaaucuuuuacua

SEQ ID NO: 4031200 - RNA, 20 nt, Staphylococcus aureus subsp. aureus MW2
uuauuaacaaaagugaaugu

SEQ ID NO: 4031201 - RNA, 12 nt, Staphylococcus aureus subsp. aureus MW2
uuauuaacugua

SEQ ID NO: 4031202 - RNA, 13 nt, Staphylococcus aureus subsp. aureus MW2
uuauuaacugugu

SEQ ID NO: 4031203 - RNA, 12 nt, Staphylococcus aureus subsp. aureus MW2
uuauuaacuuua

SEQ ID NO: 4031204 - RNA, 14 nt, Staphylococcus aureus subsp. aureus MW2
uuauuaacuuuaau

SEQ ID NO: 4031205 - RNA, 22 nt, Staphylococcus aureus subsp. aureus MW2
uuauuaaggggguaauacuaua

SEQ ID NO: 4031206 - RNA, 15 nt, Staphylococcus aureus subsp. aureus MW2
uuauuaaucguucca

SEQ ID NO: 4031207 - RNA, 18 nt, Staphylococcus aureus subsp. aureus MW2
uuauuaaucuguaaugca

SEQ ID NO: 4031208 - RNA, 21 nt, Staphylococcus aureus subsp. aureus MW2
uuauuaaugaagcugugugaa

SEQ ID NO: 4031209 - RNA, 22 nt, Staphylococcus aureus subsp. aureus MW2
uuauuaauucugauuauguuca

SEQ ID NO: 4031210 - RNA, 22 nt, Staphylococcus aureus subsp. aureus MW2
uuauuacaaacauuccucuauu

SEQ ID NO: 4031211 - RNA, 18 nt, Staphylococcus aureus subsp. aureus MW2
uuauuacaaccaacaauu

SEQ ID NO: 4031212 - RNA, 20 nt, Staphylococcus aureus subsp. aureus MW2
uuauuacaaccaacaauugg

SEQ ID NO: 4031213 - RNA, 17 nt, Staphylococcus aureus subsp. aureus MW2
uuauuacaaucaaaaaa

SEQ ID NO: 4031214 - RNA, 16 nt, Staphylococcus aureus subsp. aureus MW2
uuauuaccauaaauuu

SEQ ID NO: 4031215 - RNA, 20 nt, Staphylococcus aureus subsp. aureus MW2
uuauuaccuuugcuaaauau

SEQ ID NO: 4031216 - RNA, 22 nt, Staphylococcus aureus subsp. aureus MW2
uuauuaccuuugcuaaauauua

SEQ ID NO: 4031217 - RNA, 15 nt, Staphylococcus aureus subsp. aureus MW2
uuauuagaaugaaac

SEQ ID NO: 4031218 - RNA, 17 nt, Staphylococcus aureus subsp. aureus MW2
uuauuagauacuucuuu

SEQ ID NO: 4031219 - RNA, 15 nt, Staphylococcus aureus subsp. aureus MW2
uuauuaguauucaaa

SEQ ID NO: 4031220 - RNA, 14 nt, Staphylococcus aureus subsp. aureus MW2
uuauuauaaaauaa

SEQ ID NO: 4031221 - RNA, 14 nt, Staphylococcus aureus subsp. aureus MW2
uuauuauaauagcu

SEQ ID NO: 4031222 - RNA, 13 nt, Staphylococcus aureus subsp. aureus MW2
uuauuauacauag

SEQ ID NO: 4031223 - RNA, 13 nt, Staphylococcus aureus subsp. aureus MW2
uuauuauccaagg

SEQ ID NO: 4031224 - RNA, 15 nt, Staphylococcus aureus subsp. aureus MW2
uuauuaucuuuguaa

SEQ ID NO: 4031225 - RNA, 19 nt, Staphylococcus aureus subsp. aureus MW2
uuauuaucuuuguaaauuu

SEQ ID NO: 4031226 - RNA, 16 nt, Staphylococcus aureus subsp. aureus MW2
uuauuaugaauuauua

SEQ ID NO: 4031227 - RNA, 20 nt, Staphylococcus aureus subsp. aureus MW2
uuauuauguuauaaauucua

SEQ ID NO: 4031228 - RNA, 13 nt, Staphylococcus aureus subsp. aureus MW2
uuauuauugaaau

SEQ ID NO: 4031229 - RNA, 20 nt, Staphylococcus aureus subsp. aureus MW2
uuauuauuuuguauuuuuca

SEQ ID NO: 4031230 - RNA, 13 nt, Staphylococcus aureus subsp. aureus MW2
uuauucaauauuu

SEQ ID NO: 4031231 - RNA, 14 nt, Staphylococcus aureus subsp. aureus MW2
uuauucgaacgaua

SEQ ID NO: 4031232 - RNA, 15 nt, Staphylococcus aureus subsp. aureus MW2
uuauucguauucaaa

SEQ ID NO: 4031233 - RNA, 18 nt, Staphylococcus aureus subsp. aureus MW2
uuauucuaacuuuguaug

SEQ ID NO: 4031234 - RNA, 17 nt, Staphylococcus aureus subsp. aureus MW2
uuauucuaaguuaaaac

SEQ ID NO: 4031235 - RNA, 13 nt, Staphylococcus aureus subsp. aureus MW2
uuauucuaauaca

SEQ ID NO: 4031236 - RNA, 14 nt, Staphylococcus aureus subsp. aureus MW2
uuauucuaauacaa

SEQ ID NO: 4031237 - RNA, 15 nt, Staphylococcus aureus subsp. aureus MW2
uuauucuaauacaaa

SEQ ID NO: 4031238 - RNA, 14 nt, Staphylococcus aureus subsp. aureus MW2
uuauucucuuuauu

SEQ ID NO: 4031239 - RNA, 12 nt, Staphylococcus aureus subsp. aureus MW2
uuauucuuaauu

SEQ ID NO: 4031240 - RNA, 14 nt, Staphylococcus aureus subsp. aureus MW2
uuauucuucacuuu

SEQ ID NO: 4031241 - RNA, 22 nt, Staphylococcus aureus subsp. aureus MW2
uuauucuucacuuucaguagau

SEQ ID NO: 4031242 - RNA, 14 nt, Staphylococcus aureus subsp. aureus MW2
uuauucuuuaauua

SEQ ID NO: 4031243 - RNA, 22 nt, Staphylococcus aureus subsp. aureus MW2
uuauucuuuauauuugugaaug

SEQ ID NO: 4031244 - RNA, 15 nt, Staphylococcus aureus subsp. aureus MW2
uuauugaaaagauaa

SEQ ID NO: 4031245 - RNA, 20 nt, Staphylococcus aureus subsp. aureus MW2
uuauugaaaagauaaacaag

SEQ ID NO: 4031246 - RNA, 15 nt, Staphylococcus aureus subsp. aureus MW2
uuauugaaauuuggu

SEQ ID NO: 4031247 - RNA, 16 nt, Staphylococcus aureus subsp. aureus MW2
uuauugaaauuuggua

SEQ ID NO: 4031248 - RNA, 19 nt, Staphylococcus aureus subsp. aureus MW2
uuauugaaguuuuccuaau

SEQ ID NO: 4031249 - RNA, 23 nt, Staphylococcus aureus subsp. aureus MW2
uuauugacauugcaaaagugguu

SEQ ID NO: 4031250 - RNA, 15 nt, Staphylococcus aureus subsp. aureus MW2
uuauugagaauauuu

SEQ ID NO: 4031251 - RNA, 22 nt, Staphylococcus aureus subsp. aureus MW2
uuauugagaauauuuauuguuu

SEQ ID NO: 4031252 - RNA, 19 nt, Staphylococcus aureus subsp. aureus MW2
uuauugauauuaauauauu

SEQ ID NO: 4031253 - RNA, 23 nt, Staphylococcus aureus subsp. aureus MW2
uuauugccuaacguguuugagau

SEQ ID NO: 4031254 - RNA, 17 nt, Staphylococcus aureus subsp. aureus MW2
uuauugguaggaggcuu

SEQ ID NO: 4031255 - RNA, 20 nt, Staphylococcus aureus subsp. aureus MW2
uuauugguuacuguaguacu

SEQ ID NO: 4031256 - RNA, 17 nt, Staphylococcus aureus subsp. aureus MW2
uuauugguugaaauuaa

SEQ ID NO: 4031257 - RNA, 16 nt, Staphylococcus aureus subsp. aureus MW2
uuauuguaaccugacu

SEQ ID NO: 4031258 - RNA, 17 nt, Staphylococcus aureus subsp. aureus MW2
uuauuguuguaucauca

SEQ ID NO: 4031259 - RNA, 13 nt, Staphylococcus aureus subsp. aureus MW2
uuauuuaaaacuu

SEQ ID NO: 4031260 - RNA, 16 nt, Staphylococcus aureus subsp. aureus MW2
uuauuuaaaacuugua

SEQ ID NO: 4031261 - RNA, 13 nt, Staphylococcus aureus subsp. aureus MW2
uuauuuaacacuu

SEQ ID NO: 4031262 - RNA, 16 nt, Staphylococcus aureus subsp. aureus MW2
uuauuuaaguucuucu

SEQ ID NO: 4031263 - RNA, 15 nt, Staphylococcus aureus subsp. aureus MW2
uuauuuaauaacgaa

SEQ ID NO: 4031264 - RNA, 20 nt, Staphylococcus aureus subsp. aureus MW2
uuauuuaaucguaacauauc

SEQ ID NO: 4031265 - RNA, 18 nt, Staphylococcus aureus subsp. aureus MW2
uucacacagcuucauuaa

SEQ ID NO: 4031266 - RNA, 19 nt, Staphylococcus aureus subsp. aureus MW2
uucacaucuuuagcuauuu

SEQ ID NO: 4031267 - RNA, 17 nt, Staphylococcus aureus subsp. aureus MW2
uucacauucuugaauaa

SEQ ID NO: 4031268 - RNA, 12 nt, Staphylococcus aureus subsp. aureus MW2
uucaccaauuag

SEQ ID NO: 4031269 - RNA, 14 nt, Staphylococcus aureus subsp. aureus MW2
uucaccguaaucuu

SEQ ID NO: 4031270 - RNA, 18 nt, Staphylococcus aureus subsp. aureus MW2
uucaccguaaucuuuuaa

SEQ ID NO: 4031271 - RNA, 21 nt, Staphylococcus aureus subsp. aureus MW2
uucacgaauaucuuaaagaau

SEQ ID NO: 4031272 - RNA, 17 nt, Staphylococcus aureus subsp. aureus MW2
uucacgauauaacauua

SEQ ID NO: 4031273 - RNA, 19 nt, Staphylococcus aureus subsp. aureus MW2
uucacgauuuuuaaaaugc

SEQ ID NO: 4031274 - RNA, 21 nt, Staphylococcus aureus subsp. aureus MW2
uucacgauuuuuaaaaugcuu

SEQ ID NO: 4031275 - RNA, 20 nt, Staphylococcus aureus subsp. aureus MW2
uucacguaauugaguuguug

SEQ ID NO: 4031276 - RNA, 16 nt, Staphylococcus aureus subsp. aureus MW2
uucacuaaaaauauau

SEQ ID NO: 4031277 - RNA, 20 nt, Staphylococcus aureus subsp. aureus MW2
uucacuaaauucaauaaucu

SEQ ID NO: 4031278 - RNA, 21 nt, Staphylococcus aureus subsp. aureus MW2
uucacuaaauucaauaaucuu

SEQ ID NO: 4031279 - RNA, 17 nt, Staphylococcus aureus subsp. aureus MW2
uucacuacauuaaaaau

SEQ ID NO: 4031280 - RNA, 22 nt, Staphylococcus aureus subsp. aureus MW2
uucacuaccauagauuauauua

SEQ ID NO: 4031281 - RNA, 19 nt, Staphylococcus aureus subsp. aureus MW2
uucacuaguguauacaagg

SEQ ID NO: 4031282 - RNA, 14 nt, Staphylococcus aureus subsp. aureus MW2
uucacuguuuuauc

SEQ ID NO: 4031283 - RNA, 12 nt, Staphylococcus aureus subsp. aureus MW2
uucacuucauaa

SEQ ID NO: 4031284 - RNA, 13 nt, Staphylococcus aureus subsp. aureus MW2
uucacuuuaacuu

SEQ ID NO: 4031285 - RNA, 21 nt, Staphylococcus aureus subsp. aureus MW2
uucagaacuacaauucauaag

SEQ ID NO: 4031286 - RNA, 14 nt, Staphylococcus aureus subsp. aureus MW2
uucagaugaauaau

SEQ ID NO: 4031287 - RNA, 22 nt, Staphylococcus aureus subsp. aureus MW2
uucagcaccagaacaauucaau

SEQ ID NO: 4031288 - RNA, 19 nt, Staphylococcus aureus subsp. aureus MW2
uucagcaucuacuaaauca

SEQ ID NO: 4031289 - RNA, 22 nt, Staphylococcus aureus subsp. aureus MW2
uucagcaucuacuaaaucaaau

SEQ ID NO: 4031290 - RNA, 19 nt, Staphylococcus aureus subsp. aureus MW2
uucagcauugggacauaaa

SEQ ID NO: 4031291 - RNA, 15 nt, Staphylococcus aureus subsp. aureus MW2
uucagcauuugcugu

SEQ ID NO: 4031292 - RNA, 21 nt, Staphylococcus aureus subsp. aureus MW2
uucaggaauaucuuucaaauu

SEQ ID NO: 4031293 - RNA, 23 nt, Staphylococcus aureus subsp. aureus MW2
uucagggaaguuacguucuaaua

SEQ ID NO: 4031294 - RNA, 20 nt, Staphylococcus aureus subsp. aureus MW2
uucaggguuuaagauuuuau

SEQ ID NO: 4031295 - RNA, 20 nt, Staphylococcus aureus subsp. aureus MW2
uucaguaacaguauaaauau

SEQ ID NO: 4031296 - RNA, 21 nt, Staphylococcus aureus subsp. aureus MW2
uucaguaacguacuguguaau

SEQ ID NO: 4031297 - RNA, 17 nt, Staphylococcus aureus subsp. aureus MW2
uucaguacgaacaacua

SEQ ID NO: 4031298 - RNA, 21 nt, Staphylococcus aureus subsp. aureus MW2
uucaguacgguuauuuaauaa

SEQ ID NO: 4031299 - RNA, 15 nt, Staphylococcus aureus subsp. aureus MW2
uucaguauacucauc

SEQ ID NO: 4031300 - RNA, 22 nt, Staphylococcus aureus subsp. aureus MW2
uucaguguagacuauaggucuu

SEQ ID NO: 4031301 - RNA, 17 nt, Staphylococcus aureus subsp. aureus MW2
uucaguucaaacagaaa

SEQ ID NO: 4031302 - RNA, 13 nt, Staphylococcus aureus subsp. aureus MW2
uucaguuguuuuu

SEQ ID NO: 4031303 - RNA, 17 nt, Staphylococcus aureus subsp. aureus MW2
uucaguuuucacuaaau

SEQ ID NO: 4031304 - RNA, 16 nt, Staphylococcus aureus subsp. aureus MW2
uucaguuuuguauuca

SEQ ID NO: 4031305 - RNA, 13 nt, Staphylococcus aureus subsp. aureus MW2
uucauaaauauuu

SEQ ID NO: 4031306 - RNA, 13 nt, Staphylococcus aureus subsp. aureus MW2
uucauaaaugcuu

SEQ ID NO: 4031307 - RNA, 19 nt, Staphylococcus aureus subsp. aureus MW2
uucauaagaaaaauguguu

SEQ ID NO: 4031308 - RNA, 22 nt, Staphylococcus aureus subsp. aureus MW2
uucauaagucuuaacaaauuaa

SEQ ID NO: 4031309 - RNA, 15 nt, Staphylococcus aureus subsp. aureus MW2
uucauaaucauaaua

SEQ ID NO: 4031310 - RNA, 14 nt, Staphylococcus aureus subsp. aureus MW2
uucauaauuaauaa

SEQ ID NO: 4031311 - RNA, 14 nt, Staphylococcus aureus subsp. aureus MW2
uucauaauuuguug

SEQ ID NO: 4031312 - RNA, 21 nt, Staphylococcus aureus subsp. aureus MW2
uucauacacuaucauuaucaa

SEQ ID NO: 4031313 - RNA, 22 nt, Staphylococcus aureus subsp. aureus MW2
uucauacacugcacaucauaau

SEQ ID NO: 4031314 - RNA, 14 nt, Staphylococcus aureus subsp. aureus MW2
uucauacacuuuaa

SEQ ID NO: 4031315 - RNA, 18 nt, Staphylococcus aureus subsp. aureus MW2
uucauacacuuuaacaua

SEQ ID NO: 4031316 - RNA, 14 nt, Staphylococcus aureus subsp. aureus MW2
uucauacgcuauug

SEQ ID NO: 4031317 - RNA, 19 nt, Staphylococcus aureus subsp. aureus MW2
uucauacguucaaucgcau

SEQ ID NO: 4031318 - RNA, 14 nt, Staphylococcus aureus subsp. aureus MW2
uucauaguuuaugu

SEQ ID NO: 4031319 - RNA, 15 nt, Staphylococcus aureus subsp. aureus MW2
uucauaguuuaugug

SEQ ID NO: 4031320 - RNA, 13 nt, Staphylococcus aureus subsp. aureus MW2
uucauauaaugcu

SEQ ID NO: 4031321 - RNA, 22 nt, Staphylococcus aureus subsp. aureus MW2
uucauauuuagguaauacauca

SEQ ID NO: 4031322 - RNA, 20 nt, Staphylococcus aureus subsp. aureus MW2
uucaucaaauccaaaaucuu

SEQ ID NO: 4031323 - RNA, 17 nt, Staphylococcus aureus subsp. aureus MW2
uucaucaaguugauaau

SEQ ID NO: 4031324 - RNA, 19 nt, Staphylococcus aureus subsp. aureus MW2
uucaucauaaucuacugcu

SEQ ID NO: 4031325 - RNA, 22 nt, Staphylococcus aureus subsp. aureus MW2
uucaucauauucgccuucuaau

SEQ ID NO: 4031326 - RNA, 23 nt, Staphylococcus aureus subsp. aureus MW2
uucaucgaagauguuaaacuguc

SEQ ID NO: 4031327 - RNA, 19 nt, Staphylococcus aureus subsp. aureus MW2
uucaucgucucacuuaaua

SEQ ID NO: 4031328 - RNA, 20 nt, Staphylococcus aureus subsp. aureus MW2
uucaucgucucacuuaauaa

SEQ ID NO: 4031329 - RNA, 21 nt, Staphylococcus aureus subsp. aureus MW2
uucaucguucauauauuuugu

SEQ ID NO: 4031330 - RNA, 13 nt, Staphylococcus aureus subsp. aureus MW2
uucaucuaaaaag

SEQ ID NO: 4031331 - RNA, 14 nt, Staphylococcus aureus subsp. aureus MW2
uucaucuaaaauua

SEQ ID NO: 4031332 - RNA, 15 nt, Staphylococcus aureus subsp. aureus MW2
uucaucuaaaugaug

SEQ ID NO: 4031333 - RNA, 21 nt, Staphylococcus aureus subsp. aureus MW2
uucaucuggagacgaaccauu

SEQ ID NO: 4031334 - RNA, 22 nt, Staphylococcus aureus subsp. aureus MW2
uucaucugguauuuuaugacgu

SEQ ID NO: 4031335 - RNA, 13 nt, Staphylococcus aureus subsp. aureus MW2
uucaucuuaucaa

SEQ ID NO: 4031336 - RNA, 12 nt, Staphylococcus aureus subsp. aureus MW2
uucaucuucaac

SEQ ID NO: 4031337 - RNA, 12 nt, Staphylococcus aureus subsp. aureus MW2
uucaucuugcaa

SEQ ID NO: 4031338 - RNA, 21 nt, Staphylococcus aureus subsp. aureus MW2
uucaucuugcaaguauuuucu

SEQ ID NO: 4031339 - RNA, 23 nt, Staphylococcus aureus subsp. aureus MW2
uucaucuuuaugcaaaauuaaug

SEQ ID NO: 4031340 - RNA, 12 nt, Staphylococcus aureus subsp. aureus MW2
uucaucuuucaa

SEQ ID NO: 4031341 - RNA, 12 nt, Staphylococcus aureus subsp. aureus MW2
uucaugaacagc

SEQ ID NO: 4031342 - RNA, 14 nt, Staphylococcus aureus subsp. aureus MW2
uucaugaacagcau

SEQ ID NO: 4031343 - RNA, 21 nt, Staphylococcus aureus subsp. aureus MW2
uucaugaauaaauacaauguu

SEQ ID NO: 4031344 - RNA, 13 nt, Staphylococcus aureus subsp. aureus MW2
uucaugaauaauu

SEQ ID NO: 4031345 - RNA, 15 nt, Staphylococcus aureus subsp. aureus MW2
uucauguccaucuuu

SEQ ID NO: 4031346 - RNA, 17 nt, Staphylococcus aureus subsp. aureus MW2
uucaugugucacaauga

SEQ ID NO: 4031347 - RNA, 14 nt, Staphylococcus aureus subsp. aureus MW2
uucauguuuaaaau

SEQ ID NO: 4031348 - RNA, 17 nt, Staphylococcus aureus subsp. aureus MW2
uucauguuugauucuaa

SEQ ID NO: 4031349 - RNA, 21 nt, Staphylococcus aureus subsp. aureus MW2
uucauguuugauucuaaauaa

SEQ ID NO: 4031350 - RNA, 19 nt, Staphylococcus aureus subsp. aureus MW2
uucauuacaaacauaauca

SEQ ID NO: 4031351 - RNA, 21 nt, Staphylococcus aureus subsp. aureus MW2
uucauuauauaauucuucaaa

SEQ ID NO: 4031352 - RNA, 12 nt, Staphylococcus aureus subsp. aureus MW2
uucauuaucauu

SEQ ID NO: 4031353 - RNA, 13 nt, Staphylococcus aureus subsp. aureus MW2
uucuaaucuaaau

SEQ ID NO: 4031354 - RNA, 19 nt, Staphylococcus aureus subsp. aureus MW2
uucuaaugcugcuucuuca

SEQ ID NO: 4031355 - RNA, 14 nt, Staphylococcus aureus subsp. aureus MW2
uucuaauucugaaa

SEQ ID NO: 4031356 - RNA, 15 nt, Staphylococcus aureus subsp. aureus MW2
uucuaauugcacauu

SEQ ID NO: 4031357 - RNA, 19 nt, Staphylococcus aureus subsp. aureus MW2
uucuaauuguuguaauucu

SEQ ID NO: 4031358 - RNA, 21 nt, Staphylococcus aureus subsp. aureus MW2
uucuacaaacaaugcaaguug

SEQ ID NO: 4031359 - RNA, 22 nt, Staphylococcus aureus subsp. aureus MW2
uucuacaacuucauuaguugcc

SEQ ID NO: 4031360 - RNA, 20 nt, Staphylococcus aureus subsp. aureus MW2
uucuacagacaaugcaaguu

SEQ ID NO: 4031361 - RNA, 22 nt, Staphylococcus aureus subsp. aureus MW2
uucuacagcgucaccuaaugcu

SEQ ID NO: 4031362 - RNA, 18 nt, Staphylococcus aureus subsp. aureus MW2
uucuacaggcaaugcaag

SEQ ID NO: 4031363 - RNA, 19 nt, Staphylococcus aureus subsp. aureus MW2
uucuacaggcaaugcaagu

SEQ ID NO: 4031364 - RNA, 16 nt, Staphylococcus aureus subsp. aureus MW2
uucuaccaauaauucc

SEQ ID NO: 4031365 - RNA, 15 nt, Staphylococcus aureus subsp. aureus MW2
uucuacgaauacuaa

SEQ ID NO: 4031366 - RNA, 21 nt, Staphylococcus aureus subsp. aureus MW2
uucuacgaccagaaaauacag

SEQ ID NO: 4031367 - RNA, 16 nt, Staphylococcus aureus subsp. aureus MW2
uucuacugacaaugca

SEQ ID NO: 4031368 - RNA, 21 nt, Staphylococcus aureus subsp. aureus MW2
uucuagcaucgauguuaucga

SEQ ID NO: 4031369 - RNA, 12 nt, Staphylococcus aureus subsp. aureus MW2
uucuagguaaua

SEQ ID NO: 4031370 - RNA, 16 nt, Staphylococcus aureus subsp. aureus MW2
uucuaguagcuugaau

SEQ ID NO: 4031371 - RNA, 16 nt, Staphylococcus aureus subsp. aureus MW2
uucuauacaaugaauu

SEQ ID NO: 4031372 - RNA, 16 nt, Staphylococcus aureus subsp. aureus MW2
uucuauacauuccaaa

SEQ ID NO: 4031373 - RNA, 13 nt, Staphylococcus aureus subsp. aureus MW2
uucuauacuuuua

SEQ ID NO: 4031374 - RNA, 18 nt, Staphylococcus aureus subsp. aureus MW2
uucuauauaguaaaauaa

SEQ ID NO: 4031375 - RNA, 13 nt, Staphylococcus aureus subsp. aureus MW2
uucuaucaaauaa

SEQ ID NO: 4031376 - RNA, 16 nt, Staphylococcus aureus subsp. aureus MW2
uucuaucaaauaauga

SEQ ID NO: 4031377 - RNA, 18 nt, Staphylococcus aureus subsp. aureus MW2
uucuaugcucuacgaagu

SEQ ID NO: 4031378 - RNA, 19 nt, Staphylococcus aureus subsp. aureus MW2
uucuauuaaacauuuuuga

SEQ ID NO: 4031379 - RNA, 13 nt, Staphylococcus aureus subsp. aureus MW2
uucuauuaauaau

SEQ ID NO: 4031380 - RNA, 19 nt, Staphylococcus aureus subsp. aureus MW2
uucuauuauuuuacuuugu

SEQ ID NO: 4031381 - RNA, 14 nt, Staphylococcus aureus subsp. aureus MW2
uucuauuuuauaau

SEQ ID NO: 4031382 - RNA, 15 nt, Staphylococcus aureus subsp. aureus MW2
uucuauuuuucaauu

SEQ ID NO: 4031383 - RNA, 19 nt, Staphylococcus aureus subsp. aureus MW2
uucucaaauuagauaaaac

SEQ ID NO: 4031384 - RNA, 22 nt, Staphylococcus aureus subsp. aureus MW2
uucucacugcuguucuuuuuau

SEQ ID NO: 4031385 - RNA, 12 nt, Staphylococcus aureus subsp. aureus MW2
uucucaguugcc

SEQ ID NO: 4031386 - RNA, 19 nt, Staphylococcus aureus subsp. aureus MW2
uucucaucuauuuaauaau

SEQ ID NO: 4031387 - RNA, 17 nt, Staphylococcus aureus subsp. aureus MW2
uucucauuaaccuuaca

SEQ ID NO: 4031388 - RNA, 13 nt, Staphylococcus aureus subsp. aureus MW2
uucucauugaaau

SEQ ID NO: 4031389 - RNA, 17 nt, Staphylococcus aureus subsp. aureus MW2
uucuccuucaauguuca

SEQ ID NO: 4031390 - RNA, 21 nt, Staphylococcus aureus subsp. aureus MW2
uucuccuucaauguucaauuc

SEQ ID NO: 4031391 - RNA, 17 nt, Staphylococcus aureus subsp. aureus MW2
uucucuaacuuuaccaa

SEQ ID NO: 4031392 - RNA, 19 nt, Staphylococcus aureus subsp. aureus MW2
uucucuaacuuuaccaaua

SEQ ID NO: 4031393 - RNA, 17 nt, Staphylococcus aureus subsp. aureus MW2
uucucuauacccuuuau

SEQ ID NO: 4031394 - RNA, 15 nt, Staphylococcus aureus subsp. aureus MW2
uucucugcuucuaaa

SEQ ID NO: 4031395 - RNA, 22 nt, Staphylococcus aureus subsp. aureus MW2
uucucuuuaccaguaacagcua

SEQ ID NO: 4031396 - RNA, 14 nt, Staphylococcus aureus subsp. aureus MW2
uucugaaaaauauu

SEQ ID NO: 4031397 - RNA, 14 nt, Staphylococcus aureus subsp. aureus MW2
uucugauguuuuau

SEQ ID NO: 4031398 - RNA, 17 nt, Staphylococcus aureus subsp. aureus MW2
uucugcaccuguuuuaa

SEQ ID NO: 4031399 - RNA, 23 nt, Staphylococcus aureus subsp. aureus MW2
uucugcuucgugguuaguaagau

SEQ ID NO: 4031400 - RNA, 10 nt, Staphylococcus aureus subsp. aureus MW2
uucugcuucu

SEQ ID NO: 4031401 - RNA, 19 nt, Staphylococcus aureus subsp. aureus MW2
uucugggaacgcuguuuuu

SEQ ID NO: 4031402 - RNA, 15 nt, Staphylococcus aureus subsp. aureus MW2
uucuggucacuaaug

SEQ ID NO: 4031403 - RNA, 23 nt, Staphylococcus aureus subsp. aureus MW2
uucugugaccaauagaauucauu

SEQ ID NO: 4031404 - RNA, 19 nt, Staphylococcus aureus subsp. aureus MW2
uucuguugcaguuucaauc

SEQ ID NO: 4031405 - RNA, 20 nt, Staphylococcus aureus subsp. aureus MW2
uucuuaaaauaugauuuaaa

SEQ ID NO: 4031406 - RNA, 18 nt, Staphylococcus aureus subsp. aureus MW2
uucuuaaacgcucuucuu

SEQ ID NO: 4031407 - RNA, 22 nt, Staphylococcus aureus subsp. aureus MW2
uucuuaaaucaacaucaucuuu

SEQ ID NO: 4031408 - RNA, 22 nt, Staphylococcus aureus subsp. aureus MW2
uucuuaacaauaucaucuaaau

SEQ ID NO: 4031409 - RNA, 13 nt, Staphylococcus aureus subsp. aureus MW2
uucuuaauuauca

SEQ ID NO: 4031410 - RNA, 19 nt, Staphylococcus aureus subsp. aureus MW2
uucuuaauuauuuauuguu

SEQ ID NO: 4031411 - RNA, 18 nt, Staphylococcus aureus subsp. aureus MW2
uucuuaauuuaaaaauag

SEQ ID NO: 4031412 - RNA, 19 nt, Staphylococcus aureus subsp. aureus MW2
uucuuaauuuaaaaauagu

SEQ ID NO: 4031413 - RNA, 22 nt, Staphylococcus aureus subsp. aureus MW2
uucuuagauuuuauauaaaaag

SEQ ID NO: 4031414 - RNA, 18 nt, Staphylococcus aureus subsp. aureus MW2
uucuuaguuugacaucua

SEQ ID NO: 4031415 - RNA, 12 nt, Staphylococcus aureus subsp. aureus MW2
uucuuauaaaaa

SEQ ID NO: 4031416 - RNA, 13 nt, Staphylococcus aureus subsp. aureus MW2
uucuuauaaaaau

SEQ ID NO: 4031417 - RNA, 14 nt, Staphylococcus aureus subsp. aureus MW2
uucuuauaaaaauc

SEQ ID NO: 4031418 - RNA, 16 nt, Staphylococcus aureus subsp. aureus MW2
uucuuauaaaaaucuu

SEQ ID NO: 4031419 - RNA, 17 nt, Staphylococcus aureus subsp. aureus MW2
uucuuaucauuucaaau

SEQ ID NO: 4031420 - RNA, 21 nt, Staphylococcus aureus subsp. aureus MW2
uucuuaugcaguuuuaauuaa

SEQ ID NO: 4031421 - RNA, 12 nt, Staphylococcus aureus subsp. aureus MW2
uucuuauuugaa

SEQ ID NO: 4031422 - RNA, 16 nt, Staphylococcus aureus subsp. aureus MW2
uucuucaaaaaauaau

SEQ ID NO: 4031423 - RNA, 22 nt, Staphylococcus aureus subsp. aureus MW2
uucuucaaaaaauaauagcaaa

SEQ ID NO: 4031424 - RNA, 15 nt, Staphylococcus aureus subsp. aureus MW2
uucuucaacaauuuc

SEQ ID NO: 4031425 - RNA, 18 nt, Staphylococcus aureus subsp. aureus MW2
uucuucaaccauuuguuc

SEQ ID NO: 4031426 - RNA, 19 nt, Staphylococcus aureus subsp. aureus MW2
uucuucaaccauuuguucu

SEQ ID NO: 4031427 - RNA, 15 nt, Staphylococcus aureus subsp. aureus MW2
uucuucaauuuaaug

SEQ ID NO: 4031428 - RNA, 23 nt, Staphylococcus aureus subsp. aureus MW2
uucuucaccaguuugugguaaug

SEQ ID NO: 4031429 - RNA, 14 nt, Staphylococcus aureus subsp. aureus MW2
uucuucacuaaaaa

SEQ ID NO: 4031430 - RNA, 17 nt, Staphylococcus aureus subsp. aureus MW2
uucuucacuaaaaauau

SEQ ID NO: 4031431 - RNA, 20 nt, Staphylococcus aureus subsp. aureus MW2
uucuucacugcuguuuuuau

SEQ ID NO: 4031432 - RNA, 16 nt, Staphylococcus aureus subsp. aureus MW2
uucuucagguguuuua

SEQ ID NO: 4031433 - RNA, 16 nt, Staphylococcus aureus subsp. aureus MW2
uucuucaguaagcgca

SEQ ID NO: 4031434 - RNA, 17 nt, Staphylococcus aureus subsp. aureus MW2
uucuucaguuaaaucuu

SEQ ID NO: 4031435 - RNA, 19 nt, Staphylococcus aureus subsp. aureus MW2
uucuucaucauauucgccu

SEQ ID NO: 4031436 - RNA, 15 nt, Staphylococcus aureus subsp. aureus MW2
uucuucaucuuuuau

SEQ ID NO: 4031437 - RNA, 17 nt, Staphylococcus aureus subsp. aureus MW2
uucuuccuaaauaauua

SEQ ID NO: 4031438 - RNA, 23 nt, Staphylococcus aureus subsp. aureus MW2
uucuucuaauuuaguuuuaauau

SEQ ID NO: 4031439 - RNA, 23 nt, Staphylococcus aureus subsp. aureus MW2
uucuucuuguuuagggaauccca

SEQ ID NO: 4031440 - RNA, 13 nt, Staphylococcus aureus subsp. aureus MW2
uucuugaaaacaa

SEQ ID NO: 4031441 - RNA, 15 nt, Staphylococcus aureus subsp. aureus MW2
uucuugaaauaaaca

SEQ ID NO: 4031442 - RNA, 15 nt, Staphylococcus aureus subsp. aureus MW2
uugacauauuuuuua

SEQ ID NO: 4031443 - RNA, 15 nt, Staphylococcus aureus subsp. aureus MW2
uugacauuugaccaa

SEQ ID NO: 4031444 - RNA, 17 nt, Staphylococcus aureus subsp. aureus MW2
uugacauuugaccaagu

SEQ ID NO: 4031445 - RNA, 13 nt, Staphylococcus aureus subsp. aureus MW2
uugaccuucaguu

SEQ ID NO: 4031446 - RNA, 23 nt, Staphylococcus aureus subsp. aureus MW2
uugacgccaguggcauuuaaaaa

SEQ ID NO: 4031447 - RNA, 14 nt, Staphylococcus aureus subsp. aureus MW2
uugacuaaguuugu

SEQ ID NO: 4031448 - RNA, 19 nt, Staphylococcus aureus subsp. aureus MW2
uugacugaacgaaaaugcg

SEQ ID NO: 4031449 - RNA, 19 nt, Staphylococcus aureus subsp. aureus MW2
uugacuguaaaacaaugcc

SEQ ID NO: 4031450 - RNA, 17 nt, Staphylococcus aureus subsp. aureus MW2
uugacuuuaauugcucu

SEQ ID NO: 4031451 - RNA, 23 nt, Staphylococcus aureus subsp. aureus MW2
uugagaaaaagguuaauauuaaa

SEQ ID NO: 4031452 - RNA, 14 nt, Staphylococcus aureus subsp. aureus MW2
uugagaaaauuaau

SEQ ID NO: 4031453 - RNA, 22 nt, Staphylococcus aureus subsp. aureus MW2
uugagaaaauuaauagagaaaa

SEQ ID NO: 4031454 - RNA, 22 nt, Staphylococcus aureus subsp. aureus MW2
uugagcaucuugucuaguucga

SEQ ID NO: 4031455 - RNA, 19 nt, Staphylococcus aureus subsp. aureus MW2
uugagcuaaccacaucauu

SEQ ID NO: 4031456 - RNA, 19 nt, Staphylococcus aureus subsp. aureus MW2
uugaguacuaaucaauacu

SEQ ID NO: 4031457 - RNA, 19 nt, Staphylococcus aureus subsp. aureus MW2
uugaguaugguugauuaca

SEQ ID NO: 4031458 - RNA, 21 nt, Staphylococcus aureus subsp. aureus MW2
uugaguguguccaucauuugu

SEQ ID NO: 4031459 - RNA, 12 nt, Staphylococcus aureus subsp. aureus MW2
uugauaaaaaau

SEQ ID NO: 4031460 - RNA, 23 nt, Staphylococcus aureus subsp. aureus MW2
uugauaaaaaggaucuuggccaa

SEQ ID NO: 4031461 - RNA, 16 nt, Staphylococcus aureus subsp. aureus MW2
uugauaaaauaaauaa

SEQ ID NO: 4031462 - RNA, 16 nt, Staphylococcus aureus subsp. aureus MW2
uugauaacaauuuuaa

SEQ ID NO: 4031463 - RNA, 16 nt, Staphylococcus aureus subsp. aureus MW2
uugauaacuauuuaau

SEQ ID NO: 4031464 - RNA, 18 nt, Staphylococcus aureus subsp. aureus MW2
uugauaauguaaaaugau

SEQ ID NO: 4031465 - RNA, 19 nt, Staphylococcus aureus subsp. aureus MW2
uugauaauguaaaaugaug

SEQ ID NO: 4031466 - RNA, 22 nt, Staphylococcus aureus subsp. aureus MW2
uugauacguaaacacuuuagua

SEQ ID NO: 4031467 - RNA, 22 nt, Staphylococcus aureus subsp. aureus MW2
uugauaguaaucucucgcuaaa

SEQ ID NO: 4031468 - RNA, 19 nt, Staphylococcus aureus subsp. aureus MW2
uugauaguagcuuaaugca

SEQ ID NO: 4031469 - RNA, 17 nt, Staphylococcus aureus subsp. aureus MW2
uugauaguuuuauaauu

SEQ ID NO: 4031470 - RNA, 12 nt, Staphylococcus aureus subsp. aureus MW2
uugauauaaaaa

SEQ ID NO: 4031471 - RNA, 23 nt, Staphylococcus aureus subsp. aureus MW2
uugauauaaaaagugaaaguauu

SEQ ID NO: 4031472 - RNA, 23 nt, Staphylococcus aureus subsp. aureus MW2
uugauauagucaaugaauaauga

SEQ ID NO: 4031473 - RNA, 20 nt, Staphylococcus aureus subsp. aureus MW2
uugauauaguuauaugugcu

SEQ ID NO: 4031474 - RNA, 13 nt, Staphylococcus aureus subsp. aureus MW2
uugauauauauuu

SEQ ID NO: 4031475 - RNA, 21 nt, Staphylococcus aureus subsp. aureus MW2
uugauaugguuagaaaaaaau

SEQ ID NO: 4031476 - RNA, 11 nt, Staphylococcus aureus subsp. aureus MW2
uugauauguuu

SEQ ID NO: 4031477 - RNA, 14 nt, Staphylococcus aureus subsp. aureus MW2
uugauauuauauaa

SEQ ID NO: 4031478 - RNA, 13 nt, Staphylococcus aureus subsp. aureus MW2
uugauauuuaccg

SEQ ID NO: 4031479 - RNA, 13 nt, Staphylococcus aureus subsp. aureus MW2
uugauauuucaaa

SEQ ID NO: 4031480 - RNA, 17 nt, Staphylococcus aureus subsp. aureus MW2
uugaucaaaaauguuau

SEQ ID NO: 4031481 - RNA, 18 nt, Staphylococcus aureus subsp. aureus MW2
uugaucagcauuuaaguu

SEQ ID NO: 4031482 - RNA, 18 nt, Staphylococcus aureus subsp. aureus MW2
uugaucgauuguuuauua

SEQ ID NO: 4031483 - RNA, 13 nt, Staphylococcus aureus subsp. aureus MW2
uugaucuuuaaau

SEQ ID NO: 4031484 - RNA, 16 nt, Staphylococcus aureus subsp. aureus MW2
uugaucuuugacaugu

SEQ ID NO: 4031485 - RNA, 12 nt, Staphylococcus aureus subsp. aureus MW2
uugaugaauaaa

SEQ ID NO: 4031486 - RNA, 17 nt, Staphylococcus aureus subsp. aureus MW2
uugaugaucaauuaaca

SEQ ID NO: 4031487 - RNA, 15 nt, Staphylococcus aureus subsp. aureus MW2
uugauguaauucugu

SEQ ID NO: 4031488 - RNA, 15 nt, Staphylococcus aureus subsp. aureus MW2
uugaugucacauaug

SEQ ID NO: 4031489 - RNA, 20 nt, Staphylococcus aureus subsp. aureus MW2
uugauguguugcauuacuau

SEQ ID NO: 4031490 - RNA, 12 nt, Staphylococcus aureus subsp. aureus MW2
uugauuaaacug

SEQ ID NO: 4031491 - RNA, 13 nt, Staphylococcus aureus subsp. aureus MW2
uugauuaaauaaa

SEQ ID NO: 4031492 - RNA, 19 nt, Staphylococcus aureus subsp. aureus MW2
uugauuaacacaauccuuu

SEQ ID NO: 4031493 - RNA, 12 nt, Staphylococcus aureus subsp. aureus MW2
uugauuauguaa

SEQ ID NO: 4031494 - RNA, 15 nt, Staphylococcus aureus subsp. aureus MW2
uugauuauguaaauu

SEQ ID NO: 4031495 - RNA, 19 nt, Staphylococcus aureus subsp. aureus MW2
uugauuauucuuuaauuaa

SEQ ID NO: 4031496 - RNA, 13 nt, Staphylococcus aureus subsp. aureus MW2
uugauucuaaaua

SEQ ID NO: 4031497 - RNA, 16 nt, Staphylococcus aureus subsp. aureus MW2
uugauucuacuucacc

SEQ ID NO: 4031498 - RNA, 20 nt, Staphylococcus aureus subsp. aureus MW2
uugauucuucaccaguuugu

SEQ ID NO: 4031499 - RNA, 17 nt, Staphylococcus aureus subsp. aureus MW2
uugauugaauaugugua

SEQ ID NO: 4031500 - RNA, 15 nt, Staphylococcus aureus subsp. aureus MW2
uugauugauaugguu

SEQ ID NO: 4031501 - RNA, 15 nt, Staphylococcus aureus subsp. aureus MW2
uugauuuaaaauauu

SEQ ID NO: 4031502 - RNA, 17 nt, Staphylococcus aureus subsp. aureus MW2
uugauuuagcauacauu

SEQ ID NO: 4031503 - RNA, 18 nt, Staphylococcus aureus subsp. aureus MW2
uugauuuagcauacauua

SEQ ID NO: 4031504 - RNA, 19 nt, Staphylococcus aureus subsp. aureus MW2
uugauuuugaaucacauua

SEQ ID NO: 4031505 - RNA, 21 nt, Staphylococcus aureus subsp. aureus MW2
uugauuuuuuagacaaauguu

SEQ ID NO: 4031506 - RNA, 15 nt, Staphylococcus aureus subsp. aureus MW2
uugcaaaauuaagag

SEQ ID NO: 4031507 - RNA, 21 nt, Staphylococcus aureus subsp. aureus MW2
uugcaaauagcgauuuuaaag

SEQ ID NO: 4031508 - RNA, 19 nt, Staphylococcus aureus subsp. aureus MW2
uugcacaaagauauguuua

SEQ ID NO: 4031509 - RNA, 21 nt, Staphylococcus aureus subsp. aureus MW2
uugcacaguuucaucuucaac

SEQ ID NO: 4031510 - RNA, 22 nt, Staphylococcus aureus subsp. aureus MW2
uugcacgucuuguaucaacauu

SEQ ID NO: 4031511 - RNA, 16 nt, Staphylococcus aureus subsp. aureus MW2
uugcacuaugcauaau

SEQ ID NO: 4031512 - RNA, 17 nt, Staphylococcus aureus subsp. aureus MW2
uugcacuaugcauaaua

SEQ ID NO: 4031513 - RNA, 11 nt, Staphylococcus aureus subsp. aureus MW2
uugcauaacca

SEQ ID NO: 4031514 - RNA, 19 nt, Staphylococcus aureus subsp. aureus MW2
uugcauacgaauuaaaaua

SEQ ID NO: 4031515 - RNA, 13 nt, Staphylococcus aureus subsp. aureus MW2
uugcauauaaaaa

SEQ ID NO: 4031516 - RNA, 22 nt, Staphylococcus aureus subsp. aureus MW2
uugcauauccuucaaagauuuu

SEQ ID NO: 4031517 - RNA, 14 nt, Staphylococcus aureus subsp. aureus MW2
uugcauugauuuca

SEQ ID NO: 4031518 - RNA, 14 nt, Staphylococcus aureus subsp. aureus MW2
uugcauuguauaug

SEQ ID NO: 4031519 - RNA, 20 nt, Staphylococcus aureus subsp. aureus MW2
uugccaucaauuucuguaau

SEQ ID NO: 4031520 - RNA, 14 nt, Staphylococcus aureus subsp. aureus MW2
uugcccgcuuauug

SEQ ID NO: 4031521 - RNA, 22 nt, Staphylococcus aureus subsp. aureus MW2
uugccuaaaguauuaucuaauu

SEQ ID NO: 4031522 - RNA, 20 nt, Staphylococcus aureus subsp. aureus MW2
uugccuauuuuuuuauguua

SEQ ID NO: 4031523 - RNA, 19 nt, Staphylococcus aureus subsp. aureus MW2
uugccuguagaauuucuuu

SEQ ID NO: 4031524 - RNA, 16 nt, Staphylococcus aureus subsp. aureus MW2
uugccuuuugaauaau

SEQ ID NO: 4031525 - RNA, 19 nt, Staphylococcus aureus subsp. aureus MW2
uugcgaauaccguuucuau

SEQ ID NO: 4031526 - RNA, 22 nt, Staphylococcus aureus subsp. aureus MW2
uugcgauuucuucugcuaacuc

SEQ ID NO: 4031527 - RNA, 20 nt, Staphylococcus aureus subsp. aureus MW2
uugcguuuaauaacauugaa

SEQ ID NO: 4031528 - RNA, 13 nt, Staphylococcus aureus subsp. aureus MW2
uugcuaaaacuaa

SEQ ID NO: 4031529 - RNA, 22 nt, Staphylococcus aureus subsp. aureus MW2
uugcuaaacgcuaaaauuuccu

SEQ ID NO: 4031530 - RNA, 21 nt, Staphylococcus aureus subsp. aureus MW2
uugcuaaccaucauaaauguu

SEQ ID NO: 4031531 - RNA, 21 nt, Staphylococcus aureus subsp. aureus MW2
uugucaaaauugaacuuugua

SEQ ID NO: 4031532 - RNA, 19 nt, Staphylococcus aureus subsp. aureus MW2
uugucaauuuaaagucuuc

SEQ ID NO: 4031533 - RNA, 19 nt, Staphylococcus aureus subsp. aureus MW2
uugucacgauagauuuauc

SEQ ID NO: 4031534 - RNA, 19 nt, Staphylococcus aureus subsp. aureus MW2
uugucacuuggauucaaau

SEQ ID NO: 4031535 - RNA, 18 nt, Staphylococcus aureus subsp. aureus MW2
uugucaucauguucuaau

SEQ ID NO: 4031536 - RNA, 12 nt, Staphylococcus aureus subsp. aureus MW2
uugucaucuuuu

SEQ ID NO: 4031537 - RNA, 11 nt, Staphylococcus aureus subsp. aureus MW2
uugucaugccu

SEQ ID NO: 4031538 - RNA, 14 nt, Staphylococcus aureus subsp. aureus MW2
uugucaugccuuca

SEQ ID NO: 4031539 - RNA, 14 nt, Staphylococcus aureus subsp. aureus MW2
uuguccaugccuua

SEQ ID NO: 4031540 - RNA, 23 nt, Staphylococcus aureus subsp. aureus MW2
uuguccuuuaagaacauaaccua

SEQ ID NO: 4031541 - RNA, 22 nt, Staphylococcus aureus subsp. aureus MW2
uugucguucucguguaaaaugc

SEQ ID NO: 4031542 - RNA, 23 nt, Staphylococcus aureus subsp. aureus MW2
uugucuacaaaguuaaucauaca

SEQ ID NO: 4031543 - RNA, 13 nt, Staphylococcus aureus subsp. aureus MW2
uugucuuuuauau

SEQ ID NO: 4031544 - RNA, 21 nt, Staphylococcus aureus subsp. aureus MW2
uugugacgcggguaauauuuu

SEQ ID NO: 4031545 - RNA, 18 nt, Staphylococcus aureus subsp. aureus MW2
uugugauaauucuucaac

SEQ ID NO: 4031546 - RNA, 23 nt, Staphylococcus aureus subsp. aureus MW2
uugugaugauaauuaaugccauu

SEQ ID NO: 4031547 - RNA, 13 nt, Staphylococcus aureus subsp. aureus MW2
uugugauuuuuug

SEQ ID NO: 4031548 - RNA, 17 nt, Staphylococcus aureus subsp. aureus MW2
uugugcuuuuucauaaa

SEQ ID NO: 4031549 - RNA, 23 nt, Staphylococcus aureus subsp. aureus MW2
uuguggcguaguuugaauuggga

SEQ ID NO: 4031550 - RNA, 20 nt, Staphylococcus aureus subsp. aureus MW2
uugugggcguucugcuaauc

SEQ ID NO: 4031551 - RNA, 19 nt, Staphylococcus aureus subsp. aureus MW2
uugugguaaucauguaaug

SEQ ID NO: 4031552 - RNA, 23 nt, Staphylococcus aureus subsp. aureus MW2
uugugguuguuaauguauuaauu

SEQ ID NO: 4031553 - RNA, 24 nt, Staphylococcus aureus subsp. aureus MW2
uuguguauuuuuauuguuuuggcu

SEQ ID NO: 4031554 - RNA, 13 nt, Staphylococcus aureus subsp. aureus MW2
uuguguugaauca

SEQ ID NO: 4031555 - RNA, 13 nt, Staphylococcus aureus subsp. aureus MW2
uuguguuugcuuu

SEQ ID NO: 4031556 - RNA, 20 nt, Staphylococcus aureus subsp. aureus MW2
uuguguuuuuaauguuugcu

SEQ ID NO: 4031557 - RNA, 18 nt, Staphylococcus aureus subsp. aureus MW2
uuguguuuuuauuaaucu

SEQ ID NO: 4031558 - RNA, 16 nt, Staphylococcus aureus subsp. aureus MW2
uuguuaacgauauugc

SEQ ID NO: 4031559 - RNA, 17 nt, Staphylococcus aureus subsp. aureus MW2
uuguuaacgguuaauaa

SEQ ID NO: 4031560 - RNA, 14 nt, Staphylococcus aureus subsp. aureus MW2
uuguuaauacaugc

SEQ ID NO: 4031561 - RNA, 23 nt, Staphylococcus aureus subsp. aureus MW2
uuguuaauucaacggaacuacua

SEQ ID NO: 4031562 - RNA, 22 nt, Staphylococcus aureus subsp. aureus MW2
uuguuacaagcgcauucucauu

SEQ ID NO: 4031563 - RNA, 14 nt, Staphylococcus aureus subsp. aureus MW2
uuguuacauauugc

SEQ ID NO: 4031564 - RNA, 15 nt, Staphylococcus aureus subsp. aureus MW2
uuguuauaucuaauu

SEQ ID NO: 4031565 - RNA, 16 nt, Staphylococcus aureus subsp. aureus MW2
uuguuauugaaugaag

SEQ ID NO: 4031566 - RNA, 16 nt, Staphylococcus aureus subsp. aureus MW2
uuguucaacuaaauuu

SEQ ID NO: 4031567 - RNA, 17 nt, Staphylococcus aureus subsp. aureus MW2
uuguucaacuaaauuuu

SEQ ID NO: 4031568 - RNA, 22 nt, Staphylococcus aureus subsp. aureus MW2
uuguucaacuaaauuuucuaaa

SEQ ID NO: 4031569 - RNA, 20 nt, Staphylococcus aureus subsp. aureus MW2
uuguucaauucagcaaugag

SEQ ID NO: 4031570 - RNA, 21 nt, Staphylococcus aureus subsp. aureus MW2
uuguucauguuuaaaauaaag

SEQ ID NO: 4031571 - RNA, 12 nt, Staphylococcus aureus subsp. aureus MW2
uuguucggcuuu

SEQ ID NO: 4031572 - RNA, 14 nt, Staphylococcus aureus subsp. aureus MW2
uuguucuaauuguu

SEQ ID NO: 4031573 - RNA, 21 nt, Staphylococcus aureus subsp. aureus MW2
uuguucuccgaucaugccuuc

SEQ ID NO: 4031574 - RNA, 22 nt, Staphylococcus aureus subsp. aureus MW2
uuguugaauaauuaauguuucu

SEQ ID NO: 4031575 - RNA, 16 nt, Staphylococcus aureus subsp. aureus MW2
uuguugauaguaaucu

SEQ ID NO: 4031576 - RNA, 18 nt, Staphylococcus aureus subsp. aureus MW2
uuguugauuuaaaauauu

SEQ ID NO: 4031577 - RNA, 23 nt, Staphylococcus aureus subsp. aureus MW2
uuguuggucuaucgccuaaaaau

SEQ ID NO: 4031578 - RNA, 14 nt, Staphylococcus aureus subsp. aureus MW2
uuguugguuuugca

SEQ ID NO: 4031579 - RNA, 18 nt, Staphylococcus aureus subsp. aureus MW2
uuguugguuuuuaaaagu

SEQ ID NO: 4031580 - RNA, 17 nt, Staphylococcus aureus subsp. aureus MW2
uuguuuaaguuuuucag

SEQ ID NO: 4031581 - RNA, 14 nt, Staphylococcus aureus subsp. aureus MW2
uuguuuaauaacaa

SEQ ID NO: 4031582 - RNA, 13 nt, Staphylococcus aureus subsp. aureus MW2
uuguuuagaaaag

SEQ ID NO: 4031583 - RNA, 12 nt, Staphylococcus aureus subsp. aureus MW2
uuguuucaccag

SEQ ID NO: 4031584 - RNA, 23 nt, Staphylococcus aureus subsp. aureus MW2
uuguuucagacuguggacaaacu

SEQ ID NO: 4031585 - RNA, 22 nt, Staphylococcus aureus subsp. aureus MW2
uuguuugaagugaaaaauuucu

SEQ ID NO: 4031586 - RNA, 18 nt, Staphylococcus aureus subsp. aureus MW2
uuguuuuaacgaagccua

SEQ ID NO: 4031587 - RNA, 23 nt, Staphylococcus aureus subsp. aureus MW2
uuguuuuccaauaauaaaccuaa

SEQ ID NO: 4031588 - RNA, 22 nt, Staphylococcus aureus subsp. aureus MW2
uuuaaaaaacaguguagcacaa

SEQ ID NO: 4031589 - RNA, 13 nt, Staphylococcus aureus subsp. aureus MW2
uuuaaaaaaggaa

SEQ ID NO: 4031590 - RNA, 16 nt, Staphylococcus aureus subsp. aureus MW2
uuuaaaaaauuuaaau

SEQ ID NO: 4031591 - RNA, 18 nt, Staphylococcus aureus subsp. aureus MW2
uuuaaaaaauuuaaauaa

SEQ ID NO: 4031592 - RNA, 13 nt, Staphylococcus aureus subsp. aureus MW2
uuuaaaaaguaau

SEQ ID NO: 4031593 - RNA, 21 nt, Staphylococcus aureus subsp. aureus MW2
uuuaaaaaguaauuaauuccu

SEQ ID NO: 4031594 - RNA, 16 nt, Staphylococcus aureus subsp. aureus MW2
uuuaaaaagucaaaga

SEQ ID NO: 4031595 - RNA, 13 nt, Staphylococcus aureus subsp. aureus MW2
uuuaaaaaguuaa

SEQ ID NO: 4031596 - RNA, 22 nt, Staphylococcus aureus subsp. aureus MW2
uuuaaaaauaaaaaaccaauaa

SEQ ID NO: 4031597 - RNA, 12 nt, Staphylococcus aureus subsp. aureus MW2
uuuaaaaauaca

SEQ ID NO: 4031598 - RNA, 23 nt, Staphylococcus aureus subsp. aureus MW2
uuuaaaaaugauagauucaaaau

SEQ ID NO: 4031599 - RNA, 22 nt, Staphylococcus aureus subsp. aureus MW2
uuuaaaacaaugauuaaaauua

SEQ ID NO: 4031600 - RNA, 22 nt, Staphylococcus aureus subsp. aureus MW2
uuuaaaaggcgaaacauuaaaa

SEQ ID NO: 4031601 - RNA, 11 nt, Staphylococcus aureus subsp. aureus MW2
uuuaaaauacg

SEQ ID NO: 4031602 - RNA, 21 nt, Staphylococcus aureus subsp. aureus MW2
uuuaaaauacgacaccaacau

SEQ ID NO: 4031603 - RNA, 13 nt, Staphylococcus aureus subsp. aureus MW2
uuuaaaauauuau

SEQ ID NO: 4031604 - RNA, 16 nt, Staphylococcus aureus subsp. aureus MW2
uuuaaaaucucauaau

SEQ ID NO: 4031605 - RNA, 18 nt, Staphylococcus aureus subsp. aureus MW2
uuuaaaaucucauaauaa

SEQ ID NO: 4031606 - RNA, 11 nt, Staphylococcus aureus subsp. aureus MW2
uuuaaaaugcu

SEQ ID NO: 4031607 - RNA, 13 nt, Staphylococcus aureus subsp. aureus MW2
uuuaaaauuauca

SEQ ID NO: 4031608 - RNA, 15 nt, Staphylococcus aureus subsp. aureus MW2
uuuaaacaaaaauaa

SEQ ID NO: 4031609 - RNA, 18 nt, Staphylococcus aureus subsp. aureus MW2
uuuaaacauccaauuaug

SEQ ID NO: 4031610 - RNA, 15 nt, Staphylococcus aureus subsp. aureus MW2
uuuaaacucauaauu

SEQ ID NO: 4031611 - RNA, 19 nt, Staphylococcus aureus subsp. aureus MW2
uuuaaacucauaauuuucu

SEQ ID NO: 4031612 - RNA, 16 nt, Staphylococcus aureus subsp. aureus MW2
uuuaaacucguaaauu

SEQ ID NO: 4031613 - RNA, 17 nt, Staphylococcus aureus subsp. aureus MW2
uuuaaacuucguaaaug

SEQ ID NO: 4031614 - RNA, 16 nt, Staphylococcus aureus subsp. aureus MW2
uuuaaagaaaaguuua

SEQ ID NO: 4031615 - RNA, 15 nt, Staphylococcus aureus subsp. aureus MW2
uuuaaagaaaauuuc

SEQ ID NO: 4031616 - RNA, 16 nt, Staphylococcus aureus subsp. aureus MW2
uuuaaaggcauaauaa

SEQ ID NO: 4031617 - RNA, 18 nt, Staphylococcus aureus subsp. aureus MW2
uuuaaauaaaauuguuga

SEQ ID NO: 4031618 - RNA, 15 nt, Staphylococcus aureus subsp. aureus MW2
uuuaaauaaaugacu

SEQ ID NO: 4031619 - RNA, 16 nt, Staphylococcus aureus subsp. aureus MW2
uuuacuauacuuugag

SEQ ID NO: 4031620 - RNA, 15 nt, Staphylococcus aureus subsp. aureus MW2
uuuacuauuaaagga

SEQ ID NO: 4031621 - RNA, 16 nt, Staphylococcus aureus subsp. aureus MW2
uuuacucauauugaau

SEQ ID NO: 4031622 - RNA, 22 nt, Staphylococcus aureus subsp. aureus MW2
uuuacucauauugaauacuucu

SEQ ID NO: 4031623 - RNA, 20 nt, Staphylococcus aureus subsp. aureus MW2
uuuacuccaaaguaacauau

SEQ ID NO: 4031624 - RNA, 15 nt, Staphylococcus aureus subsp. aureus MW2
uuuacugcuucaauc

SEQ ID NO: 4031625 - RNA, 11 nt, Staphylococcus aureus subsp. aureus MW2
uuuacuuaauc

SEQ ID NO: 4031626 - RNA, 12 nt, Staphylococcus aureus subsp. aureus MW2
uuuacuuaaucu

SEQ ID NO: 4031627 - RNA, 21 nt, Staphylococcus aureus subsp. aureus MW2
uuuacuugcuuuuucaaauaa

SEQ ID NO: 4031628 - RNA, 17 nt, Staphylococcus aureus subsp. aureus MW2
uuuacuuuguaauucuu

SEQ ID NO: 4031629 - RNA, 22 nt, Staphylococcus aureus subsp. aureus MW2
uuuagaaucaaccguuuuauug

SEQ ID NO: 4031630 - RNA, 15 nt, Staphylococcus aureus subsp. aureus MW2
uuuagacaauauuuu

SEQ ID NO: 4031631 - RNA, 17 nt, Staphylococcus aureus subsp. aureus MW2
uuuagacauuaaaaaau

SEQ ID NO: 4031632 - RNA, 16 nt, Staphylococcus aureus subsp. aureus MW2
uuuagauauaauaaaa

SEQ ID NO: 4031633 - RNA, 22 nt, Staphylococcus aureus subsp. aureus MW2
uuuagaugcauaaaaaaagaac

SEQ ID NO: 4031634 - RNA, 21 nt, Staphylococcus aureus subsp. aureus MW2
uuuagcaacaguauuugccuu

SEQ ID NO: 4031635 - RNA, 16 nt, Staphylococcus aureus subsp. aureus MW2
uuuagcauauucugca

SEQ ID NO: 4031636 - RNA, 12 nt, Staphylococcus aureus subsp. aureus MW2
uuuagcauugcc

SEQ ID NO: 4031637 - RNA, 13 nt, Staphylococcus aureus subsp. aureus MW2
uuuagccaaugcu

SEQ ID NO: 4031638 - RNA, 17 nt, Staphylococcus aureus subsp. aureus MW2
uuuagccccagcaaaua

SEQ ID NO: 4031639 - RNA, 23 nt, Staphylococcus aureus subsp. aureus MW2
uuuaggacgugccuuaacuucau

SEQ ID NO: 4031640 - RNA, 14 nt, Staphylococcus aureus subsp. aureus MW2
uuuaggcaaauaac

SEQ ID NO: 4031641 - RNA, 19 nt, Staphylococcus aureus subsp. aureus MW2
uuuaggccacacaucaaca

SEQ ID NO: 4031642 - RNA, 22 nt, Staphylococcus aureus subsp. aureus MW2
uuuagguucuucaucuuuuaug

SEQ ID NO: 4031643 - RNA, 14 nt, Staphylococcus aureus subsp. aureus MW2
uuuaguauaaauaa

SEQ ID NO: 4031644 - RNA, 20 nt, Staphylococcus aureus subsp. aureus MW2
uuuaguccuucuuuacuaaa

SEQ ID NO: 4031645 - RNA, 18 nt, Staphylococcus aureus subsp. aureus MW2
uuuagucgguguuuucuu

SEQ ID NO: 4031646 - RNA, 20 nt, Staphylococcus aureus subsp. aureus MW2
uuuaguuaaagugauuuuac

SEQ ID NO: 4031647 - RNA, 15 nt, Staphylococcus aureus subsp. aureus MW2
uuuaguuaaauacaa

SEQ ID NO: 4031648 - RNA, 16 nt, Staphylococcus aureus subsp. aureus MW2
uuuaguuaaauaguaa

SEQ ID NO: 4031649 - RNA, 16 nt, Staphylococcus aureus subsp. aureus MW2
uuuaguuaaguauuuu

SEQ ID NO: 4031650 - RNA, 21 nt, Staphylococcus aureus subsp. aureus MW2
uuuaguucaaagcgauaaagu

SEQ ID NO: 4031651 - RNA, 23 nt, Staphylococcus aureus subsp. aureus MW2
uuuaguuuucguaguaaccuaau

SEQ ID NO: 4031652 - RNA, 13 nt, Staphylococcus aureus subsp. aureus MW2
uuuauaaacaaua

SEQ ID NO: 4031653 - RNA, 18 nt, Staphylococcus aureus subsp. aureus MW2
uuuauaaacaauaaaaaa

SEQ ID NO: 4031654 - RNA, 12 nt, Staphylococcus aureus subsp. aureus MW2
uuuauaaauaaa

SEQ ID NO: 4031655 - RNA, 22 nt, Staphylococcus aureus subsp. aureus MW2
uuuauaaaucuuugauuaugaa

SEQ ID NO: 4031656 - RNA, 12 nt, Staphylococcus aureus subsp. aureus MW2
uuuauaaauuaa

SEQ ID NO: 4031657 - RNA, 14 nt, Staphylococcus aureus subsp. aureus MW2
uuuauaaauuauag

SEQ ID NO: 4031658 - RNA, 18 nt, Staphylococcus aureus subsp. aureus MW2
uuuauaacauuuaagaaa

SEQ ID NO: 4031659 - RNA, 22 nt, Staphylococcus aureus subsp. aureus MW2
uuuauaagccuuuucaaacaua

SEQ ID NO: 4031660 - RNA, 15 nt, Staphylococcus aureus subsp. aureus MW2
uuuauaauaaauuuc

SEQ ID NO: 4031661 - RNA, 18 nt, Staphylococcus aureus subsp. aureus MW2
uuuauaaugauuaaaaau

SEQ ID NO: 4031662 - RNA, 14 nt, Staphylococcus aureus subsp. aureus MW2
uuuauaauuuaauu

SEQ ID NO: 4031663 - RNA, 14 nt, Staphylococcus aureus subsp. aureus MW2
uuuauaauuucuaa

SEQ ID NO: 4031664 - RNA, 13 nt, Staphylococcus aureus subsp. aureus MW2
uuuauacauaaau

SEQ ID NO: 4031665 - RNA, 17 nt, Staphylococcus aureus subsp. aureus MW2
uuuauacuaaauugaga

SEQ ID NO: 4031666 - RNA, 21 nt, Staphylococcus aureus subsp. aureus MW2
uuuauacuauaaauaaaaaua

SEQ ID NO: 4031667 - RNA, 14 nt, Staphylococcus aureus subsp. aureus MW2
uuuauagaaaauua

SEQ ID NO: 4031668 - RNA, 15 nt, Staphylococcus aureus subsp. aureus MW2
uuuauaguaauagcu

SEQ ID NO: 4031669 - RNA, 13 nt, Staphylococcus aureus subsp. aureus MW2
uuuauauaaguga

SEQ ID NO: 4031670 - RNA, 21 nt, Staphylococcus aureus subsp. aureus MW2
uuuauauauaaaaucauuaau

SEQ ID NO: 4031671 - RNA, 22 nt, Staphylococcus aureus subsp. aureus MW2
uuuauaucuuaaguacauaaau

SEQ ID NO: 4031672 - RNA, 13 nt, Staphylococcus aureus subsp. aureus MW2
uuuauaugaugaa

SEQ ID NO: 4031673 - RNA, 20 nt, Staphylococcus aureus subsp. aureus MW2
uuuauauggaauacuacacu

SEQ ID NO: 4031674 - RNA, 14 nt, Staphylococcus aureus subsp. aureus MW2
uuuauauuaaauaa

SEQ ID NO: 4031675 - RNA, 15 nt, Staphylococcus aureus subsp. aureus MW2
uuuauauuaaauaaa

SEQ ID NO: 4031676 - RNA, 16 nt, Staphylococcus aureus subsp. aureus MW2
uuuauauuaaauacua

SEQ ID NO: 4031677 - RNA, 21 nt, Staphylococcus aureus subsp. aureus MW2
uuuauauuaaauacuauauau

SEQ ID NO: 4031678 - RNA, 16 nt, Staphylococcus aureus subsp. aureus MW2
uuuauauuauuucaau

SEQ ID NO: 4031679 - RNA, 13 nt, Staphylococcus aureus subsp. aureus MW2
uuuauauuuauuu

SEQ ID NO: 4031680 - RNA, 15 nt, Staphylococcus aureus subsp. aureus MW2
uuuauauuuuuauca

SEQ ID NO: 4031681 - RNA, 17 nt, Staphylococcus aureus subsp. aureus MW2
uuuauauuuuuaucauc

SEQ ID NO: 4031682 - RNA, 21 nt, Staphylococcus aureus subsp. aureus MW2
uuuauauuuuuuguacauuau

SEQ ID NO: 4031683 - RNA, 17 nt, Staphylococcus aureus subsp. aureus MW2
uuuaucaacaaauuuaa

SEQ ID NO: 4031684 - RNA, 21 nt, Staphylococcus aureus subsp. aureus MW2
uuuaucaauuucuauuucacu

SEQ ID NO: 4031685 - RNA, 21 nt, Staphylococcus aureus subsp. aureus MW2
uuuaucaccauaaaaauagaa

SEQ ID NO: 4031686 - RNA, 14 nt, Staphylococcus aureus subsp. aureus MW2
uuuaucauaucuau

SEQ ID NO: 4031687 - RNA, 19 nt, Staphylococcus aureus subsp. aureus MW2
uuuaucaugaugauaaauu

SEQ ID NO: 4031688 - RNA, 20 nt, Staphylococcus aureus subsp. aureus MW2
uuuaucauuauuugauaaau

SEQ ID NO: 4031689 - RNA, 12 nt, Staphylococcus aureus subsp. aureus MW2
uuuauccaaacc

SEQ ID NO: 4031690 - RNA, 20 nt, Staphylococcus aureus subsp. aureus MW2
uuuauccaaaccaauuuuaa

SEQ ID NO: 4031691 - RNA, 18 nt, Staphylococcus aureus subsp. aureus MW2
uuuauccaaugcauaaaa

SEQ ID NO: 4031692 - RNA, 20 nt, Staphylococcus aureus subsp. aureus MW2
uuuauccgucgaauauaauu

SEQ ID NO: 4031693 - RNA, 16 nt, Staphylococcus aureus subsp. aureus MW2
uuuaucuauaugcaua

SEQ ID NO: 4031694 - RNA, 19 nt, Staphylococcus aureus subsp. aureus MW2
uuuaucuccuaaagguaac

SEQ ID NO: 4031695 - RNA, 22 nt, Staphylococcus aureus subsp. aureus MW2
uuuaucuguagaaacacuuuua

SEQ ID NO: 4031696 - RNA, 11 nt, Staphylococcus aureus subsp. aureus MW2
uuuaugaaaau

SEQ ID NO: 4031697 - RNA, 17 nt, Staphylococcus aureus subsp. aureus MW2
uuuaugauaauaagaau

SEQ ID NO: 4031698 - RNA, 12 nt, Staphylococcus aureus subsp. aureus MW2
uuuaugauuguu

SEQ ID NO: 4031699 - RNA, 22 nt, Staphylococcus aureus subsp. aureus MW2
uuuaugcuuauucugaaaaaua

SEQ ID NO: 4031700 - RNA, 23 nt, Staphylococcus aureus subsp. aureus MW2
uuuauggcguagcugaggauuuu

SEQ ID NO: 4031701 - RNA, 16 nt, Staphylococcus aureus subsp. aureus MW2
uuuaugggauguauuu

SEQ ID NO: 4031702 - RNA, 17 nt, Staphylococcus aureus subsp. aureus MW2
uuuauggugcuaaaaaa

SEQ ID NO: 4031703 - RNA, 21 nt, Staphylococcus aureus subsp. aureus MW2
uuuaugguguggugugaugua

SEQ ID NO: 4031704 - RNA, 14 nt, Staphylococcus aureus subsp. aureus MW2
uuuauuaaagaaac

SEQ ID NO: 4031705 - RNA, 21 nt, Staphylococcus aureus subsp. aureus MW2
uuuauuaauggcaacuaagau

SEQ ID NO: 4031706 - RNA, 12 nt, Staphylococcus aureus subsp. aureus MW2
uuuauuacuuau

SEQ ID NO: 4031707 - RNA, 19 nt, Staphylococcus aureus subsp. aureus MW2
uuuauuagaucacuauuuu

SEQ ID NO: 4031708 - RNA, 21 nt, Staphylococcus aureus subsp. aureus MW2
uuucgacaucuagaugaaauu

SEQ ID NO: 4031709 - RNA, 22 nt, Staphylococcus aureus subsp. aureus MW2
uuucgacguaccaauuagcaug

SEQ ID NO: 4031710 - RNA, 13 nt, Staphylococcus aureus subsp. aureus MW2
uuucgauauuugu

SEQ ID NO: 4031711 - RNA, 17 nt, Staphylococcus aureus subsp. aureus MW2
uuucgauuaauucuucu

SEQ ID NO: 4031712 - RNA, 22 nt, Staphylococcus aureus subsp. aureus MW2
uuucgcuuuucuaauuuuucuu

SEQ ID NO: 4031713 - RNA, 19 nt, Staphylococcus aureus subsp. aureus MW2
uuucggcuagauuuuaaac

SEQ ID NO: 4031714 - RNA, 20 nt, Staphylococcus aureus subsp. aureus MW2
uuucgggaauuuuacguuga

SEQ ID NO: 4031715 - RNA, 14 nt, Staphylococcus aureus subsp. aureus MW2
uuucgucagauuca

SEQ ID NO: 4031716 - RNA, 20 nt, Staphylococcus aureus subsp. aureus MW2
uuucgucuuguaaacuucuu

SEQ ID NO: 4031717 - RNA, 21 nt, Staphylococcus aureus subsp. aureus MW2
uuucgucuuguaaacuucuuu

SEQ ID NO: 4031718 - RNA, 17 nt, Staphylococcus aureus subsp. aureus MW2
uuucguguuccaauuuu

SEQ ID NO: 4031719 - RNA, 17 nt, Staphylococcus aureus subsp. aureus MW2
uuucguucaauuucgau

SEQ ID NO: 4031720 - RNA, 15 nt, Staphylococcus aureus subsp. aureus MW2
uuucuaaaauaacua

SEQ ID NO: 4031721 - RNA, 15 nt, Staphylococcus aureus subsp. aureus MW2
uuucuaaguuuguug

SEQ ID NO: 4031722 - RNA, 15 nt, Staphylococcus aureus subsp. aureus MW2
uuucuaaugcucauu

SEQ ID NO: 4031723 - RNA, 14 nt, Staphylococcus aureus subsp. aureus MW2
uuucuaauuuuucu

SEQ ID NO: 4031724 - RNA, 17 nt, Staphylococcus aureus subsp. aureus MW2
uuucuacagacaaugca

SEQ ID NO: 4031725 - RNA, 21 nt, Staphylococcus aureus subsp. aureus MW2
uuucuacgaauacuaaaaugg

SEQ ID NO: 4031726 - RNA, 17 nt, Staphylococcus aureus subsp. aureus MW2
uuucuacuguauaagug

SEQ ID NO: 4031727 - RNA, 19 nt, Staphylococcus aureus subsp. aureus MW2
uuucuacuguauaagugcu

SEQ ID NO: 4031728 - RNA, 13 nt, Staphylococcus aureus subsp. aureus MW2
uuucuagcuuguu

SEQ ID NO: 4031729 - RNA, 19 nt, Staphylococcus aureus subsp. aureus MW2
uuucuaguuuaacauuacu

SEQ ID NO: 4031730 - RNA, 23 nt, Staphylococcus aureus subsp. aureus MW2
uuucuauaucuauuuaucauacu

SEQ ID NO: 4031731 - RNA, 14 nt, Staphylococcus aureus subsp. aureus MW2
uuucuauauuuuau

SEQ ID NO: 4031732 - RNA, 18 nt, Staphylococcus aureus subsp. aureus MW2
uuucuaucaaaaaaacaa

SEQ ID NO: 4031733 - RNA, 12 nt, Staphylococcus aureus subsp. aureus MW2
uuucuaucaaau

SEQ ID NO: 4031734 - RNA, 20 nt, Staphylococcus aureus subsp. aureus MW2
uuucuaucaaauaaugaaua

SEQ ID NO: 4031735 - RNA, 15 nt, Staphylococcus aureus subsp. aureus MW2
uuucuaucuuguucu

SEQ ID NO: 4031736 - RNA, 14 nt, Staphylococcus aureus subsp. aureus MW2
uuucuauuaauaua

SEQ ID NO: 4031737 - RNA, 18 nt, Staphylococcus aureus subsp. aureus MW2
uuucuauuaauauagaag

SEQ ID NO: 4031738 - RNA, 15 nt, Staphylococcus aureus subsp. aureus MW2
uuucuauuuaaacaa

SEQ ID NO: 4031739 - RNA, 19 nt, Staphylococcus aureus subsp. aureus MW2
uuucucaaacuaucuuaua

SEQ ID NO: 4031740 - RNA, 20 nt, Staphylococcus aureus subsp. aureus MW2
uuucucaaguaacucaagug

SEQ ID NO: 4031741 - RNA, 15 nt, Staphylococcus aureus subsp. aureus MW2
uuucucaaugugaga

SEQ ID NO: 4031742 - RNA, 16 nt, Staphylococcus aureus subsp. aureus MW2
uuucucaaugugagau

SEQ ID NO: 4031743 - RNA, 21 nt, Staphylococcus aureus subsp. aureus MW2
uuucucuauuaauuuucucaa

SEQ ID NO: 4031744 - RNA, 21 nt, Staphylococcus aureus subsp. aureus MW2
uuucugaaaacuuaauagaaa

SEQ ID NO: 4031745 - RNA, 14 nt, Staphylococcus aureus subsp. aureus MW2
uuucuguaccaaau

SEQ ID NO: 4031746 - RNA, 19 nt, Staphylococcus aureus subsp. aureus MW2
uuucugugaccaauagaau

SEQ ID NO: 4031747 - RNA, 18 nt, Staphylococcus aureus subsp. aureus MW2
uuucuuaaacgcucuucu

SEQ ID NO: 4031748 - RNA, 20 nt, Staphylococcus aureus subsp. aureus MW2
uuucuucagaaccuugaaug

SEQ ID NO: 4031749 - RNA, 19 nt, Staphylococcus aureus subsp. aureus MW2
uuucuucauaguucaaauu

SEQ ID NO: 4031750 - RNA, 15 nt, Staphylococcus aureus subsp. aureus MW2
uuucuucauuaucaa

SEQ ID NO: 4031751 - RNA, 21 nt, Staphylococcus aureus subsp. aureus MW2
uuucuucauuuucauuguaug

SEQ ID NO: 4031752 - RNA, 20 nt, Staphylococcus aureus subsp. aureus MW2
uuucuugaaauaaacauauc

SEQ ID NO: 4031753 - RNA, 23 nt, Staphylococcus aureus subsp. aureus MW2
uuucuugaugaauuaaacugauc

SEQ ID NO: 4031754 - RNA, 23 nt, Staphylococcus aureus subsp. aureus MW2
uuucuugccaucaauuucuguaa

SEQ ID NO: 4031755 - RNA, 18 nt, Staphylococcus aureus subsp. aureus MW2
uuucuuuaagcuuucuau

SEQ ID NO: 4031756 - RNA, 15 nt, Staphylococcus aureus subsp. aureus MW2
uuucuuuauuuuaaa

SEQ ID NO: 4031757 - RNA, 22 nt, Staphylococcus aureus subsp. aureus MW2
uuucuuugauaacaauuuuaaa

SEQ ID NO: 4031758 - RNA, 20 nt, Staphylococcus aureus subsp. aureus MW2
uuucuuuuguuuuuauauua

SEQ ID NO: 4031759 - RNA, 19 nt, Staphylococcus aureus subsp. aureus MW2
uuugaaaaaguguuuaaau

SEQ ID NO: 4031760 - RNA, 23 nt, Staphylococcus aureus subsp. aureus MW2
uuugaaaaaguguuuaaaugcua

SEQ ID NO: 4031761 - RNA, 22 nt, Staphylococcus aureus subsp. aureus MW2
uuugaaaggaauguuuaaaaaa

SEQ ID NO: 4031762 - RNA, 13 nt, Staphylococcus aureus subsp. aureus MW2
uuugaaauauacc

SEQ ID NO: 4031763 - RNA, 19 nt, Staphylococcus aureus subsp. aureus MW2
uuugaaauuucgacaucua

SEQ ID NO: 4031764 - RNA, 15 nt, Staphylococcus aureus subsp. aureus MW2
uuugaacauauuaua

SEQ ID NO: 4031765 - RNA, 18 nt, Staphylococcus aureus subsp. aureus MW2
uuugaacgaaagagaaaa

SEQ ID NO: 4031766 - RNA, 20 nt, Staphylococcus aureus subsp. aureus MW2
uuugaacgaaagagaaaagc

SEQ ID NO: 4031767 - RNA, 18 nt, Staphylococcus aureus subsp. aureus MW2
uuugaacgagagagaaaa

SEQ ID NO: 4031768 - RNA, 20 nt, Staphylococcus aureus subsp. aureus MW2
uuugaacgagagagaaaagc

SEQ ID NO: 4031769 - RNA, 16 nt, Staphylococcus aureus subsp. aureus MW2
uuugaacguuuacucu

SEQ ID NO: 4031770 - RNA, 17 nt, Staphylococcus aureus subsp. aureus MW2
uuugaagaauaaaaaag

SEQ ID NO: 4031771 - RNA, 15 nt, Staphylococcus aureus subsp. aureus MW2
uuugaauaccuacag

SEQ ID NO: 4031772 - RNA, 16 nt, Staphylococcus aureus subsp. aureus MW2
uuugaauacuuuauuu

SEQ ID NO: 4031773 - RNA, 14 nt, Staphylococcus aureus subsp. aureus MW2
uuugaauauaaaaa

SEQ ID NO: 4031774 - RNA, 16 nt, Staphylococcus aureus subsp. aureus MW2
uuugaaucuuguugaa

SEQ ID NO: 4031775 - RNA, 21 nt, Staphylococcus aureus subsp. aureus MW2
uuugaaugcaaaucaaauaca

SEQ ID NO: 4031776 - RNA, 13 nt, Staphylococcus aureus subsp. aureus MW2
uuugaauuuaauu

SEQ ID NO: 4031777 - RNA, 20 nt, Staphylococcus aureus subsp. aureus MW2
uuugacauaaaaaaauagcu

SEQ ID NO: 4031778 - RNA, 16 nt, Staphylococcus aureus subsp. aureus MW2
uuugacaucuauuucu

SEQ ID NO: 4031779 - RNA, 18 nt, Staphylococcus aureus subsp. aureus MW2
uuugacuauguuguuuaa

SEQ ID NO: 4031780 - RNA, 16 nt, Staphylococcus aureus subsp. aureus MW2
uuugacuauucucagu

SEQ ID NO: 4031781 - RNA, 18 nt, Staphylococcus aureus subsp. aureus MW2
uuugacuucaguacaauc

SEQ ID NO: 4031782 - RNA, 21 nt, Staphylococcus aureus subsp. aureus MW2
uuugaggugugguguaaagau

SEQ ID NO: 4031783 - RNA, 23 nt, Staphylococcus aureus subsp. aureus MW2
uuugaguauuugccuuuuuuauu

SEQ ID NO: 4031784 - RNA, 21 nt, Staphylococcus aureus subsp. aureus MW2
uuugaguguuuaugaaagucu

SEQ ID NO: 4031785 - RNA, 17 nt, Staphylococcus aureus subsp. aureus MW2
uuugauaguaauaguua

SEQ ID NO: 4031786 - RNA, 22 nt, Staphylococcus aureus subsp. aureus MW2
uuugauauaaaaagugaaagua

SEQ ID NO: 4031787 - RNA, 17 nt, Staphylococcus aureus subsp. aureus MW2
uuugauauaaacuacua

SEQ ID NO: 4031788 - RNA, 14 nt, Staphylococcus aureus subsp. aureus MW2
uuugauauuucaaa

SEQ ID NO: 4031789 - RNA, 20 nt, Staphylococcus aureus subsp. aureus MW2
uuugaucuaaaguacucaag

SEQ ID NO: 4031790 - RNA, 14 nt, Staphylococcus aureus subsp. aureus MW2
uuugaucuuuaaau

SEQ ID NO: 4031791 - RNA, 16 nt, Staphylococcus aureus subsp. aureus MW2
uuugaucuuuaaauau

SEQ ID NO: 4031792 - RNA, 17 nt, Staphylococcus aureus subsp. aureus MW2
uuugaucuuuaaauaua

SEQ ID NO: 4031793 - RNA, 18 nt, Staphylococcus aureus subsp. aureus MW2
uuugaucuuuaaauauac

SEQ ID NO: 4031794 - RNA, 11 nt, Staphylococcus aureus subsp. aureus MW2
uuugaugauuu

SEQ ID NO: 4031795 - RNA, 17 nt, Staphylococcus aureus subsp. aureus MW2
uuugauuaguaaauaua

SEQ ID NO: 4031796 - RNA, 23 nt, Staphylococcus aureus subsp. aureus MW2
uuuuaagugaugaccaauauucu

SEQ ID NO: 4031797 - RNA, 23 nt, Staphylococcus aureus subsp. aureus MW2
uuuuaauagguuaguaauauauu

SEQ ID NO: 4031798 - RNA, 20 nt, Staphylococcus aureus subsp. aureus MW2
uuuuaauaguuuuaauauuu

SEQ ID NO: 4031799 - RNA, 17 nt, Staphylococcus aureus subsp. aureus MW2
uuuuaauauauuuauuu

SEQ ID NO: 4031800 - RNA, 20 nt, Staphylococcus aureus subsp. aureus MW2
uuuuaauauugaaaugagcu

SEQ ID NO: 4031801 - RNA, 22 nt, Staphylococcus aureus subsp. aureus MW2
uuuuaauauuugauaacaaaau

SEQ ID NO: 4031802 - RNA, 16 nt, Staphylococcus aureus subsp. aureus MW2
uuuuaauauuuucauu

SEQ ID NO: 4031803 - RNA, 19 nt, Staphylococcus aureus subsp. aureus MW2
uuuuaaucauuguuuuaaa

SEQ ID NO: 4031804 - RNA, 20 nt, Staphylococcus aureus subsp. aureus MW2
uuuuaaucauuguuuuaaau

SEQ ID NO: 4031805 - RNA, 19 nt, Staphylococcus aureus subsp. aureus MW2
uuuuaaugggcgauaaaag

SEQ ID NO: 4031806 - RNA, 22 nt, Staphylococcus aureus subsp. aureus MW2
uuuuaaugggcgauaaaaguug

SEQ ID NO: 4031807 - RNA, 20 nt, Staphylococcus aureus subsp. aureus MW2
uuuuaauguauucuucuaau

SEQ ID NO: 4031808 - RNA, 15 nt, Staphylococcus aureus subsp. aureus MW2
uuuuaauguuacauu

SEQ ID NO: 4031809 - RNA, 16 nt, Staphylococcus aureus subsp. aureus MW2
uuuuaauuccaaagaa

SEQ ID NO: 4031810 - RNA, 19 nt, Staphylococcus aureus subsp. aureus MW2
uuuuaauuguuuaauaaca

SEQ ID NO: 4031811 - RNA, 23 nt, Staphylococcus aureus subsp. aureus MW2
uuuuacaaaauauggaauuucau

SEQ ID NO: 4031812 - RNA, 18 nt, Staphylococcus aureus subsp. aureus MW2
uuuuacaaacuucacauu

SEQ ID NO: 4031813 - RNA, 19 nt, Staphylococcus aureus subsp. aureus MW2
uuuuacaaagugauuuaaa

SEQ ID NO: 4031814 - RNA, 21 nt, Staphylococcus aureus subsp. aureus MW2
uuuuacaaagugauuuaaaaa

SEQ ID NO: 4031815 - RNA, 13 nt, Staphylococcus aureus subsp. aureus MW2
uuuuacaauuuuu

SEQ ID NO: 4031816 - RNA, 21 nt, Staphylococcus aureus subsp. aureus MW2
uuuuacauugccuaagaacuu

SEQ ID NO: 4031817 - RNA, 22 nt, Staphylococcus aureus subsp. aureus MW2
uuuuaccagcaugaaucgcauu

SEQ ID NO: 4031818 - RNA, 23 nt, Staphylococcus aureus subsp. aureus MW2
uuuuaccuucgcauacuuuuuca

SEQ ID NO: 4031819 - RNA, 14 nt, Staphylococcus aureus subsp. aureus MW2
uuuuaccuuuaauu

SEQ ID NO: 4031820 - RNA, 18 nt, Staphylococcus aureus subsp. aureus MW2
uuuuacgcuuacuuauau

SEQ ID NO: 4031821 - RNA, 19 nt, Staphylococcus aureus subsp. aureus MW2
uuuuacuaggaauauaaaa

SEQ ID NO: 4031822 - RNA, 20 nt, Staphylococcus aureus subsp. aureus MW2
uuuuacuuucaccauuuacu

SEQ ID NO: 4031823 - RNA, 13 nt, Staphylococcus aureus subsp. aureus MW2
uuuuagaaaagga

SEQ ID NO: 4031824 - RNA, 15 nt, Staphylococcus aureus subsp. aureus MW2
uuuuagauuugaaau

SEQ ID NO: 4031825 - RNA, 15 nt, Staphylococcus aureus subsp. aureus MW2
uuuuagcuuguuguu

SEQ ID NO: 4031826 - RNA, 14 nt, Staphylococcus aureus subsp. aureus MW2
uuuuagcuuuugua

SEQ ID NO: 4031827 - RNA, 20 nt, Staphylococcus aureus subsp. aureus MW2
uuuuaggaugcauauauaua

SEQ ID NO: 4031828 - RNA, 17 nt, Staphylococcus aureus subsp. aureus MW2
uuuuaggcauuuuagau

SEQ ID NO: 4031829 - RNA, 15 nt, Staphylococcus aureus subsp. aureus MW2
uuuuagguaauaauu

SEQ ID NO: 4031830 - RNA, 19 nt, Staphylococcus aureus subsp. aureus MW2
uuuuaguaauuuuacaaaa

SEQ ID NO: 4031831 - RNA, 16 nt, Staphylococcus aureus subsp. aureus MW2
uuuuagugacaaacau

SEQ ID NO: 4031832 - RNA, 15 nt, Staphylococcus aureus subsp. aureus MW2
uuuuaguuaaaguga

SEQ ID NO: 4031833 - RNA, 23 nt, Staphylococcus aureus subsp. aureus MW2
uuuuaguuagaaaguauuuauuu

SEQ ID NO: 4031834 - RNA, 18 nt, Staphylococcus aureus subsp. aureus MW2
uuuuaguucacaugaauu

SEQ ID NO: 4031835 - RNA, 17 nt, Staphylococcus aureus subsp. aureus MW2
uuuuaguuguagaguuu

SEQ ID NO: 4031836 - RNA, 11 nt, Staphylococcus aureus subsp. aureus MW2
uuuuauaaaaa

SEQ ID NO: 4031837 - RNA, 14 nt, Staphylococcus aureus subsp. aureus MW2
uuuuauaaaucauu

SEQ ID NO: 4031838 - RNA, 12 nt, Staphylococcus aureus subsp. aureus MW2
uuuuauaaauua

SEQ ID NO: 4031839 - RNA, 13 nt, Staphylococcus aureus subsp. aureus MW2
uuuuauaaauuuu

SEQ ID NO: 4031840 - RNA, 24 nt, Staphylococcus aureus subsp. aureus MW2
uuuuauaaguauucauacgcuauu

SEQ ID NO: 4031841 - RNA, 16 nt, Staphylococcus aureus subsp. aureus MW2
uuuuauaaguuaaaaa

SEQ ID NO: 4031842 - RNA, 16 nt, Staphylococcus aureus subsp. aureus MW2
uuuuauaccaauaauu

SEQ ID NO: 4031843 - RNA, 18 nt, Staphylococcus aureus subsp. aureus MW2
uuuuauagccgccuuuua

SEQ ID NO: 4031844 - RNA, 21 nt, Staphylococcus aureus subsp. aureus MW2
uuuuauauucaacuuauuauu

SEQ ID NO: 4031845 - RNA, 22 nt, Staphylococcus aureus subsp. aureus MW2
uuuuauauugcgaaaaauaauu

SEQ ID NO: 4031846 - RNA, 17 nt, Staphylococcus aureus subsp. aureus MW2
uuuuauauuuaaacucu

SEQ ID NO: 4031847 - RNA, 21 nt, Staphylococcus aureus subsp. aureus MW2
uuuuauauuuaaacucucuaa

SEQ ID NO: 4031848 - RNA, 13 nt, Staphylococcus aureus subsp. aureus MW2
uuuuauauuuuua

SEQ ID NO: 4031849 - RNA, 18 nt, Staphylococcus aureus subsp. aureus MW2
uuuuaucaauauuaguuu

SEQ ID NO: 4031850 - RNA, 19 nt, Staphylococcus aureus subsp. aureus MW2
uuuuaucaucuauucaaau

SEQ ID NO: 4031851 - RNA, 17 nt, Staphylococcus aureus subsp. aureus MW2
uuuuaucauuuuuaauu

SEQ ID NO: 4031852 - RNA, 16 nt, Staphylococcus aureus subsp. aureus MW2
uuuuaucuaaacauuu

SEQ ID NO: 4031853 - RNA, 17 nt, Staphylococcus aureus subsp. aureus MW2
uuuuaucugaaaauauc

SEQ ID NO: 4031854 - RNA, 14 nt, Staphylococcus aureus subsp. aureus MW2
uuuuaucugaaucu

SEQ ID NO: 4031855 - RNA, 17 nt, Staphylococcus aureus subsp. aureus MW2
uuuuaucugaaucugcu

SEQ ID NO: 4031856 - RNA, 15 nt, Staphylococcus aureus subsp. aureus MW2
uuuuaugauuugauu

SEQ ID NO: 4031857 - RNA, 20 nt, Staphylococcus aureus subsp. aureus MW2
uuuuaugucuaguucuugag

SEQ ID NO: 4031858 - RNA, 15 nt, Staphylococcus aureus subsp. aureus MW2
uuuuauguuauaauu

SEQ ID NO: 4031859 - RNA, 21 nt, Staphylococcus aureus subsp. aureus MW2
uuuuauguucagaaauuuaau

SEQ ID NO: 4031860 - RNA, 19 nt, Staphylococcus aureus subsp. aureus MW2
uuuuauguuuaauuugauu

SEQ ID NO: 4031861 - RNA, 14 nt, Staphylococcus aureus subsp. aureus MW2
uuuuauguuuuaau

SEQ ID NO: 4031862 - RNA, 17 nt, Staphylococcus aureus subsp. aureus MW2
uuuuauuaaaucguaua

SEQ ID NO: 4031863 - RNA, 13 nt, Staphylococcus aureus subsp. aureus MW2
uuuuauuaauuaa

SEQ ID NO: 4031864 - RNA, 16 nt, Staphylococcus aureus subsp. aureus MW2
uuuuauuaauuaaaaa

SEQ ID NO: 4031865 - RNA, 19 nt, Staphylococcus aureus subsp. aureus MW2
uuuuauuacuuauuucuuu

SEQ ID NO: 4031866 - RNA, 22 nt, Staphylococcus aureus subsp. aureus MW2
uuuuauuauacacuuuuugaca

SEQ ID NO: 4031867 - RNA, 13 nt, Staphylococcus aureus subsp. aureus MW2
uuuuauuauuaau

SEQ ID NO: 4031868 - RNA, 23 nt, Staphylococcus aureus subsp. aureus MW2
uuuuauucgauaauauaacugca

SEQ ID NO: 4031869 - RNA, 13 nt, Staphylococcus aureus subsp. aureus MW2
uuuuauucuaaua

SEQ ID NO: 4031870 - RNA, 13 nt, Staphylococcus aureus subsp. aureus MW2
uuuuauucuguaa

SEQ ID NO: 4031871 - RNA, 14 nt, Staphylococcus aureus subsp. aureus MW2
uuuuauuuaaaaau

SEQ ID NO: 4031872 - RNA, 16 nt, Staphylococcus aureus subsp. aureus MW2
uuuuauuuaaaaauag

SEQ ID NO: 4031873 - RNA, 13 nt, Staphylococcus aureus subsp. aureus MW2
uuuuauuuaaauu

SEQ ID NO: 4031874 - RNA, 17 nt, Staphylococcus aureus subsp. aureus MW2
uuuuauuuauacuaaau

SEQ ID NO: 4031875 - RNA, 13 nt, Staphylococcus aureus subsp. aureus MW2
uuuuauuuauauu

SEQ ID NO: 4031876 - RNA, 17 nt, Staphylococcus aureus subsp. aureus MW2
uuuuauuuuaauauuuu

SEQ ID NO: 4031877 - RNA, 13 nt, Staphylococcus aureus subsp. aureus MW2
uuuuauuuuuaau

SEQ ID NO: 4031878 - RNA, 16 nt, Staphylococcus aureus subsp. aureus MW2
uuuuauuuuugaaaaa

SEQ ID NO: 4031879 - RNA, 20 nt, Staphylococcus aureus subsp. aureus MW2
uuuuauuuuuuucacuaauu

SEQ ID NO: 4031880 - RNA, 16 nt, Staphylococcus aureus subsp. aureus MW2
uuuucaaaaauagucg

SEQ ID NO: 4031881 - RNA, 20 nt, Staphylococcus aureus subsp. aureus MW2
uuuucaaaaucuuuaucagu

SEQ ID NO: 4031882 - RNA, 21 nt, Staphylococcus aureus subsp. aureus MW2
uuuucaaacauauucauucua

SEQ ID NO: 4031883 - RNA, 18 nt, Staphylococcus aureus subsp. aureus MW2
uuuucaacauaauauuuc

SEQ ID NO: 4031884 - RNA, 13 nt, Staphylococcus aureus subsp. aureus MW2
uuuuuaucaugau

SEQ ID NO: 4031885 - RNA, 12 nt, Staphylococcus aureus subsp. aureus MW2
uuuuuaucaugu

SEQ ID NO: 4031886 - RNA, 20 nt, Staphylococcus aureus subsp. aureus MW2
uuuuuaugcacaaaaaaauc

SEQ ID NO: 4031887 - RNA, 15 nt, Staphylococcus aureus subsp. aureus MW2
uuuuuauuuuacuua

SEQ ID NO: 4031888 - RNA, 14 nt, Staphylococcus aureus subsp. aureus MW2
uuuuucaauucgcu

SEQ ID NO: 4031889 - RNA, 23 nt, Staphylococcus aureus subsp. aureus MW2
uuuuucacuaaucauuuuuucaa

SEQ ID NO: 4031890 - RNA, 20 nt, Staphylococcus aureus subsp. aureus MW2
uuuuucacuuauaacauucu

SEQ ID NO: 4031891 - RNA, 22 nt, Staphylococcus aureus subsp. aureus MW2
uuuuucagcuguccgauuuuuu

SEQ ID NO: 4031892 - RNA, 19 nt, Staphylococcus aureus subsp. aureus MW2
uuuuucauaaauauuuaaa

SEQ ID NO: 4031893 - RNA, 19 nt, Staphylococcus aureus subsp. aureus MW2
uuuuucauaauuaauaaca

SEQ ID NO: 4031894 - RNA, 15 nt, Staphylococcus aureus subsp. aureus MW2
uuuuucauauucaca

SEQ ID NO: 4031895 - RNA, 15 nt, Staphylococcus aureus subsp. aureus MW2
uuuuucguaacauuu

SEQ ID NO: 4031896 - RNA, 13 nt, Staphylococcus aureus subsp. aureus MW2
uuuuucguuguuc

SEQ ID NO: 4031897 - RNA, 22 nt, Staphylococcus aureus subsp. aureus MW2
uuuuucucaaugugagauauaa

SEQ ID NO: 4031898 - RNA, 18 nt, Staphylococcus aureus subsp. aureus MW2
uuuuucuccaguuuucaa

SEQ ID NO: 4031899 - RNA, 13 nt, Staphylococcus aureus subsp. aureus MW2
uuuuugaaaugua

SEQ ID NO: 4031900 - RNA, 17 nt, Staphylococcus aureus subsp. aureus MW2
uuuuugaauaucuaaug

SEQ ID NO: 4031901 - RNA, 17 nt, Staphylococcus aureus subsp. aureus MW2
uuuuugacauauuuuuu

SEQ ID NO: 4031902 - RNA, 17 nt, Staphylococcus aureus subsp. aureus MW2
uuuuugagcacuuaaua

SEQ ID NO: 4031903 - RNA, 18 nt, Staphylococcus aureus subsp. aureus MW2
uuuuugauuuaacugggc

SEQ ID NO: 4031904 - RNA, 12 nt, Staphylococcus aureus subsp. aureus MW2
uuuuugccauca

SEQ ID NO: 4031905 - RNA, 15 nt, Staphylococcus aureus subsp. aureus MW2
uuuuuguaauacauc

SEQ ID NO: 4031906 - RNA, 13 nt, Staphylococcus aureus subsp. aureus MW2
uuuuuguauuuau

SEQ ID NO: 4031907 - RNA, 13 nt, Staphylococcus aureus subsp. aureus MW2
uuuuuuaaaauga

SEQ ID NO: 4031908 - RNA, 12 nt, Staphylococcus aureus subsp. aureus MW2
uuuuuuaaauac

SEQ ID NO: 4031909 - RNA, 17 nt, Staphylococcus aureus subsp. aureus MW2
uuuuuuaauaccaucau

SEQ ID NO: 4031910 - RNA, 18 nt, Staphylococcus aureus subsp. aureus MW2
uuuuuuaaugaaucugua

SEQ ID NO: 4031911 - RNA, 12 nt, Staphylococcus aureus subsp. aureus MW2
uuuuuuauuaau

SEQ ID NO: 4031912 - RNA, 14 nt, Staphylococcus aureus subsp. aureus MW2
uuuuuuauucuaau

SEQ ID NO: 4031913 - RNA, 14 nt, Staphylococcus aureus subsp. aureus MW2
uuuuuuauuugucu

SEQ ID NO: 4031914 - RNA, 23 nt, Staphylococcus aureus subsp. aureus MW2
uuuuuuuauaaguuaaaaaugua

SEQ ID NO: 4031915 - RNA, 12 nt, Staphylococcus aureus subsp. aureus MW2
uuuuuuuauuaa

SEQ ID NO: 4031916 - RNA, 11 nt, Staphylococcus aureus subsp. aureus MW2
uuuuuuuguug

SEQ ID NO: 4031917 - RNA, 16 nt, Staphylococcus aureus subsp. aureus MW2
aaaaaaauuaauguuu

SEQ ID NO: 4031918 - RNA, 18 nt, Staphylococcus aureus subsp. aureus MW2
aaaaaacaaaaaauaauu

SEQ ID NO: 4031919 - RNA, 15 nt, Staphylococcus aureus subsp. aureus MW2
aaaaaaccaauaauc

SEQ ID NO: 4031920 - RNA, 9 nt, Staphylococcus aureus subsp. aureus MW2
aaaaaagga

SEQ ID NO: 4031921 - RNA, 22 nt, Staphylococcus aureus subsp. aureus MW2
aaaaaaggaugaugugaauguu

SEQ ID NO: 4031922 - RNA, 18 nt, Staphylococcus aureus subsp. aureus MW2
aaaaaaucgaacaaauga

SEQ ID NO: 4031923 - RNA, 20 nt, Staphylococcus aureus subsp. aureus MW2
aaaaaaugaagucuuucaac

SEQ ID NO: 4031924 - RNA, 18 nt, Staphylococcus aureus subsp. aureus MW2
aaaaaauggggacauguu

SEQ ID NO: 4031925 - RNA, 16 nt, Staphylococcus aureus subsp. aureus MW2
aaaaaauuaaaaauuu

SEQ ID NO: 4031926 - RNA, 12 nt, Staphylococcus aureus subsp. aureus MW2
aaaaaauuaaua

SEQ ID NO: 4031927 - RNA, 15 nt, Staphylococcus aureus subsp. aureus MW2
aaaaaauuaauaauu

SEQ ID NO: 4031928 - RNA, 16 nt, Staphylococcus aureus subsp. aureus MW2
aaaaaauuuaaauaau

SEQ ID NO: 4031929 - RNA, 12 nt, Staphylococcus aureus subsp. aureus MW2
aaaaacaaaaaa

SEQ ID NO: 4031930 - RNA, 18 nt, Staphylococcus aureus subsp. aureus MW2
aaaaacaaaaaaccgaac

SEQ ID NO: 4031931 - RNA, 14 nt, Staphylococcus aureus subsp. aureus MW2
aaaaacaaaaaaua

SEQ ID NO: 4031932 - RNA, 21 nt, Staphylococcus aureus subsp. aureus MW2
aaaaacaaaacgcaauaacac

SEQ ID NO: 4031933 - RNA, 18 nt, Staphylococcus aureus subsp. aureus MW2
aaaaacaguguagcacaa

SEQ ID NO: 4031934 - RNA, 13 nt, Staphylococcus aureus subsp. aureus MW2
aaaaacauaauca

SEQ ID NO: 4031935 - RNA, 20 nt, Staphylococcus aureus subsp. aureus MW2
aaaaaccaguuugauuaaaa

SEQ ID NO: 4031936 - RNA, 18 nt, Staphylococcus aureus subsp. aureus MW2
aaaaaccgaacaucugaa

SEQ ID NO: 4031937 - RNA, 18 nt, Staphylococcus aureus subsp. aureus MW2
aaaaaccguaauuuuaau

SEQ ID NO: 4031938 - RNA, 20 nt, Staphylococcus aureus subsp. aureus MW2
aaaaacgcuuuuaaaccgug

SEQ ID NO: 4031939 - RNA, 17 nt, Staphylococcus aureus subsp. aureus MW2
aaaaacuucuuaacuug

SEQ ID NO: 4031940 - RNA, 20 nt, Staphylococcus aureus subsp. aureus MW2
aaaaacuucuuaacuugaaa

SEQ ID NO: 4031941 - RNA, 20 nt, Staphylococcus aureus subsp. aureus MW2
aaaaagacaauuucuauuua

SEQ ID NO: 4031942 - RNA, 22 nt, Staphylococcus aureus subsp. aureus MW2
aaaaagacaauuucuauuuaaa

SEQ ID NO: 4031943 - RNA, 18 nt, Staphylococcus aureus subsp. aureus MW2
aaaaagacagcaguagga

SEQ ID NO: 4031944 - RNA, 21 nt, Staphylococcus aureus subsp. aureus MW2
aaaaagacgcuuucuauuuau

SEQ ID NO: 4031945 - RNA, 21 nt, Staphylococcus aureus subsp. aureus MW2
aaaaagacggugaccuuauau

SEQ ID NO: 4031946 - RNA, 17 nt, Staphylococcus aureus subsp. aureus MW2
aaaaagaguuaauaaaa

SEQ ID NO: 4031947 - RNA, 19 nt, Staphylococcus aureus subsp. aureus MW2
aaaaagcaguaagagauuu

SEQ ID NO: 4031948 - RNA, 23 nt, Staphylococcus aureus subsp. aureus MW2
aaaaagcggacugaaagaaaagu

SEQ ID NO: 4031949 - RNA, 15 nt, Staphylococcus aureus subsp. aureus MW2
aaaaagcucaauccu

SEQ ID NO: 4031950 - RNA, 22 nt, Staphylococcus aureus subsp. aureus MW2
aaaaagcugauuucuauuaauu

SEQ ID NO: 4031951 - RNA, 23 nt, Staphylococcus aureus subsp. aureus MW2
aaaaagcugauuucuauuaauua

SEQ ID NO: 4031952 - RNA, 20 nt, Staphylococcus aureus subsp. aureus MW2
aaaaaggaagaacagcacau

SEQ ID NO: 4031953 - RNA, 19 nt, Staphylococcus aureus subsp. aureus MW2
aaaaagggcaaaaaaggau

SEQ ID NO: 4031954 - RNA, 21 nt, Staphylococcus aureus subsp. aureus MW2
aaaaagggcaacacucggaaa

SEQ ID NO: 4031955 - RNA, 18 nt, Staphylococcus aureus subsp. aureus MW2
aaaaagguuaauauuaaa

SEQ ID NO: 4031956 - RNA, 18 nt, Staphylococcus aureus subsp. aureus MW2
aaaaagucccgcuuaaaa

SEQ ID NO: 4031957 - RNA, 23 nt, Staphylococcus aureus subsp. aureus MW2
aaaaagucccgcuuaaaaugauu

SEQ ID NO: 4031958 - RNA, 19 nt, Staphylococcus aureus subsp. aureus MW2
aaaaagugauaauuaaaau

SEQ ID NO: 4031959 - RNA, 11 nt, Staphylococcus aureus subsp. aureus MW2
aaaaauaaaaa

SEQ ID NO: 4031960 - RNA, 16 nt, Staphylococcus aureus subsp. aureus MW2
aaaaauaaaaccgagg

SEQ ID NO: 4031961 - RNA, 12 nt, Staphylococcus aureus subsp. aureus MW2
aaaaauaaacca

SEQ ID NO: 4031962 - RNA, 14 nt, Staphylococcus aureus subsp. aureus MW2
aaaaauaaaccaug

SEQ ID NO: 4031963 - RNA, 14 nt, Staphylococcus aureus subsp. aureus MW2
aaaaauaauagcaa

SEQ ID NO: 4031964 - RNA, 15 nt, Staphylococcus aureus subsp. aureus MW2
aaaaauaauuaugaa

SEQ ID NO: 4031965 - RNA, 19 nt, Staphylococcus aureus subsp. aureus MW2
aaaaauaauuaugaaaagu

SEQ ID NO: 4031966 - RNA, 11 nt, Staphylococcus aureus subsp. aureus MW2
aaaaauaauug

SEQ ID NO: 4031967 - RNA, 12 nt, Staphylococcus aureus subsp. aureus MW2
aaaaauacuuuu

SEQ ID NO: 4031968 - RNA, 14 nt, Staphylococcus aureus subsp. aureus MW2
aaaaauagaaaaaa

SEQ ID NO: 4031969 - RNA, 20 nt, Staphylococcus aureus subsp. aureus MW2
aaaaauagaaaaaacaagau

SEQ ID NO: 4031970 - RNA, 23 nt, Staphylococcus aureus subsp. aureus MW2
aaaaauagcguaauuauuauaau

SEQ ID NO: 4031971 - RNA, 16 nt, Staphylococcus aureus subsp. aureus MW2
aaaaauagcuccucca

SEQ ID NO: 4031972 - RNA, 17 nt, Staphylococcus aureus subsp. aureus MW2
aaaaauaguucuuuaaa

SEQ ID NO: 4031973 - RNA, 12 nt, Staphylococcus aureus subsp. aureus MW2
aaaaauauguau

SEQ ID NO: 4031974 - RNA, 21 nt, Staphylococcus aureus subsp. aureus MW2
aaaaauauguuuaauguauaa

SEQ ID NO: 4031975 - RNA, 14 nt, Staphylococcus aureus subsp. aureus MW2
aaaaauauuuaaac

SEQ ID NO: 4031976 - RNA, 14 nt, Staphylococcus aureus subsp. aureus MW2
aaaaauauuuaaau

SEQ ID NO: 4031977 - RNA, 14 nt, Staphylococcus aureus subsp. aureus MW2
aaaaauauuuacau

SEQ ID NO: 4031978 - RNA, 15 nt, Staphylococcus aureus subsp. aureus MW2
aaaaaucaaagaggc

SEQ ID NO: 4031979 - RNA, 17 nt, Staphylococcus aureus subsp. aureus MW2
aaaaaucacgcuaacau

SEQ ID NO: 4031980 - RNA, 14 nt, Staphylococcus aureus subsp. aureus MW2
aaaaaucauaaaua

SEQ ID NO: 4031981 - RNA, 18 nt, Staphylococcus aureus subsp. aureus MW2
aaaaaucauaaauaacac

SEQ ID NO: 4031982 - RNA, 22 nt, Staphylococcus aureus subsp. aureus MW2
aaaaauccuaugaauaaauugu

SEQ ID NO: 4031983 - RNA, 21 nt, Staphylococcus aureus subsp. aureus MW2
aaaaaucgaacuagacaagau

SEQ ID NO: 4031984 - RNA, 17 nt, Staphylococcus aureus subsp. aureus MW2
aaaaaucuacauaugaa

SEQ ID NO: 4031985 - RNA, 20 nt, Staphylococcus aureus subsp. aureus MW2
aaaaaucuacauaugaaaaa

SEQ ID NO: 4031986 - RNA, 21 nt, Staphylococcus aureus subsp. aureus MW2
aaaaaucuacauaugaaaaau

SEQ ID NO: 4031987 - RNA, 16 nt, Staphylococcus aureus subsp. aureus MW2
aaaaaucuuuugauag

SEQ ID NO: 4031988 - RNA, 21 nt, Staphylococcus aureus subsp. aureus MW2
aaaaaugccgagauuauuaug

SEQ ID NO: 4031989 - RNA, 16 nt, Staphylococcus aureus subsp. aureus MW2
aaaaauggcgaaaaag

SEQ ID NO: 4031990 - RNA, 18 nt, Staphylococcus aureus subsp. aureus MW2
aaaaauggcgaaaaagcu

SEQ ID NO: 4031991 - RNA, 19 nt, Staphylococcus aureus subsp. aureus MW2
aaaaaugucuaaaaaaaug

SEQ ID NO: 4031992 - RNA, 21 nt, Staphylococcus aureus subsp. aureus MW2
aaaaaugucuaaaaaaauguu

SEQ ID NO: 4031993 - RNA, 16 nt, Staphylococcus aureus subsp. aureus MW2
aaaaaugugaccuuau

SEQ ID NO: 4031994 - RNA, 12 nt, Staphylococcus aureus subsp. aureus MW2
aaaaauuaaaaa

SEQ ID NO: 4031995 - RNA, 14 nt, Staphylococcus aureus subsp. aureus MW2
aaaaauuaaaaugu

SEQ ID NO: 4031996 - RNA, 20 nt, Staphylococcus aureus subsp. aureus MW2
aaaaauuccuagcuuuuaug

SEQ ID NO: 4031997 - RNA, 21 nt, Staphylococcus aureus subsp. aureus MW2
aaaaauugauaguagcuuaau

SEQ ID NO: 4031998 - RNA, 22 nt, Staphylococcus aureus subsp. aureus MW2
aaaaauugcuauauuaguauaa

SEQ ID NO: 4031999 - RNA, 12 nt, Staphylococcus aureus subsp. aureus MW2
aaaaauuguaaa

SEQ ID NO: 4032000 - RNA, 23 nt, Staphylococcus aureus subsp. aureus MW2
aaaaauuugcaugaaaauuaaaa

SEQ ID NO: 4032001 - RNA, 16 nt, Staphylococcus aureus subsp. aureus MW2
aaaacaaaaaagagcu

SEQ ID NO: 4032002 - RNA, 16 nt, Staphylococcus aureus subsp. aureus MW2
aaaacaaaaaauaucu

SEQ ID NO: 4032003 - RNA, 15 nt, Staphylococcus aureus subsp. aureus MW2
aaaacaaauguuuua

SEQ ID NO: 4032004 - RNA, 13 nt, Staphylococcus aureus subsp. aureus MW2
aaaacaaauuaca

SEQ ID NO: 4032005 - RNA, 19 nt, Staphylococcus aureus subsp. aureus MW2
aaaacaaauuacacccuuu

SEQ ID NO: 4032006 - RNA, 14 nt, Staphylococcus aureus subsp. aureus MW2
aaaauaaaacaaau

SEQ ID NO: 4032007 - RNA, 22 nt, Staphylococcus aureus subsp. aureus MW2
aaaauaaaaccgaggaaauccu

SEQ ID NO: 4032008 - RNA, 19 nt, Staphylococcus aureus subsp. aureus MW2
aaaauaaaauuaacgagcu

SEQ ID NO: 4032009 - RNA, 13 nt, Staphylococcus aureus subsp. aureus MW2
aaaauaaagaaaa

SEQ ID NO: 4032010 - RNA, 13 nt, Staphylococcus aureus subsp. aureus MW2
aaaauaaauguua

SEQ ID NO: 4032011 - RNA, 21 nt, Staphylococcus aureus subsp. aureus MW2
aaaauaacuaagugaauuauc

SEQ ID NO: 4032012 - RNA, 19 nt, Staphylococcus aureus subsp. aureus MW2
aaaauaacugcuaauuuuu

SEQ ID NO: 4032013 - RNA, 15 nt, Staphylococcus aureus subsp. aureus MW2
aaaauaaguguuguu

SEQ ID NO: 4032014 - RNA, 15 nt, Staphylococcus aureus subsp. aureus MW2
aaaauaauagauaau

SEQ ID NO: 4032015 - RNA, 13 nt, Staphylococcus aureus subsp. aureus MW2
aaaauaauaugaa

SEQ ID NO: 4032016 - RNA, 16 nt, Staphylococcus aureus subsp. aureus MW2
aaaauaauaugaauuu

SEQ ID NO: 4032017 - RNA, 10 nt, Staphylococcus aureus subsp. aureus MW2
aaaauaaugc

SEQ ID NO: 4032018 - RNA, 15 nt, Staphylococcus aureus subsp. aureus MW2
aaaauaaugcaacua

SEQ ID NO: 4032019 - RNA, 18 nt, Staphylococcus aureus subsp. aureus MW2
aaaauaaugcuuauuaaa

SEQ ID NO: 4032020 - RNA, 13 nt, Staphylococcus aureus subsp. aureus MW2
aaaauaauuaaau

SEQ ID NO: 4032021 - RNA, 22 nt, Staphylococcus aureus subsp. aureus MW2
aaaauaauuaugaaaagugaau

SEQ ID NO: 4032022 - RNA, 15 nt, Staphylococcus aureus subsp. aureus MW2
aaaauaauuuaauuu

SEQ ID NO: 4032023 - RNA, 13 nt, Staphylococcus aureus subsp. aureus MW2
aaaauacauaaua

SEQ ID NO: 4032024 - RNA, 14 nt, Staphylococcus aureus subsp. aureus MW2
aaaauacauaauua

SEQ ID NO: 4032025 - RNA, 17 nt, Staphylococcus aureus subsp. aureus MW2
aaaauacauaauuaacu

SEQ ID NO: 4032026 - RNA, 10 nt, Staphylococcus aureus subsp. aureus MW2
aaaauaccaa

SEQ ID NO: 4032027 - RNA, 17 nt, Staphylococcus aureus subsp. aureus MW2
aaaauaccaaauaugac

SEQ ID NO: 4032028 - RNA, 19 nt, Staphylococcus aureus subsp. aureus MW2
aaaauaccaacugcaaaua

SEQ ID NO: 4032029 - RNA, 13 nt, Staphylococcus aureus subsp. aureus MW2
aaaauaccugcaa

SEQ ID NO: 4032030 - RNA, 16 nt, Staphylococcus aureus subsp. aureus MW2
aaaauacgcaaaccaa

SEQ ID NO: 4032031 - RNA, 21 nt, Staphylococcus aureus subsp. aureus MW2
aaaauacgguacagauaggaa

SEQ ID NO: 4032032 - RNA, 21 nt, Staphylococcus aureus subsp. aureus MW2
aaaauacguuuauccuuuaaa

SEQ ID NO: 4032033 - RNA, 14 nt, Staphylococcus aureus subsp. aureus MW2
aaaauacuaagauu

SEQ ID NO: 4032034 - RNA, 19 nt, Staphylococcus aureus subsp. aureus MW2
aaaauacucccuucaacau

SEQ ID NO: 4032035 - RNA, 16 nt, Staphylococcus aureus subsp. aureus MW2
aaaauacuguuuucau

SEQ ID NO: 4032036 - RNA, 15 nt, Staphylococcus aureus subsp. aureus MW2
aaaauagaaaaaaca

SEQ ID NO: 4032037 - RNA, 17 nt, Staphylococcus aureus subsp. aureus MW2
aaaauagaaaaaacaag

SEQ ID NO: 4032038 - RNA, 18 nt, Staphylococcus aureus subsp. aureus MW2
aaaauagaaaaaacaaga

SEQ ID NO: 4032039 - RNA, 13 nt, Staphylococcus aureus subsp. aureus MW2
aaaauagaaaaau

SEQ ID NO: 4032040 - RNA, 20 nt, Staphylococcus aureus subsp. aureus MW2
aaaauagaaaaauuucaaaa

SEQ ID NO: 4032041 - RNA, 22 nt, Staphylococcus aureus subsp. aureus MW2
aaaauagccauaucauauuacu

SEQ ID NO: 4032042 - RNA, 20 nt, Staphylococcus aureus subsp. aureus MW2
aaaauagucggggccccaac

SEQ ID NO: 4032043 - RNA, 23 nt, Staphylococcus aureus subsp. aureus MW2
aaaauagucggggccccaacaca

SEQ ID NO: 4032044 - RNA, 19 nt, Staphylococcus aureus subsp. aureus MW2
aaaauauaucuagccugaa

SEQ ID NO: 4032045 - RNA, 15 nt, Staphylococcus aureus subsp. aureus MW2
aaaauauauuauaaa

SEQ ID NO: 4032046 - RNA, 20 nt, Staphylococcus aureus subsp. aureus MW2
aaaauaucaaaauauaaaau

SEQ ID NO: 4032047 - RNA, 18 nt, Staphylococcus aureus subsp. aureus MW2
aaaauaucaauuuauuau

SEQ ID NO: 4032048 - RNA, 17 nt, Staphylococcus aureus subsp. aureus MW2
aaaauaucugaaaaacc

SEQ ID NO: 4032049 - RNA, 19 nt, Staphylococcus aureus subsp. aureus MW2
aaaauaucugaaaaaccaa

SEQ ID NO: 4032050 - RNA, 17 nt, Staphylococcus aureus subsp. aureus MW2
aaaauaucuuuuuguuu

SEQ ID NO: 4032051 - RNA, 17 nt, Staphylococcus aureus subsp. aureus MW2
aaaauaugacacauaca

SEQ ID NO: 4032052 - RNA, 20 nt, Staphylococcus aureus subsp. aureus MW2
aaaauaugauugcaaauuau

SEQ ID NO: 4032053 - RNA, 15 nt, Staphylococcus aureus subsp. aureus MW2
aaaauaugauuuaaa

SEQ ID NO: 4032054 - RNA, 17 nt, Staphylococcus aureus subsp. aureus MW2
aaaauaugauuuaaaau

SEQ ID NO: 4032055 - RNA, 22 nt, Staphylococcus aureus subsp. aureus MW2
aaaauauuacuaacaaccguuu

SEQ ID NO: 4032056 - RNA, 24 nt, Staphylococcus aureus subsp. aureus MW2
aaaauauuaggugaaaccauacua

SEQ ID NO: 4032057 - RNA, 18 nt, Staphylococcus aureus subsp. aureus MW2
aaaauauuuaaacuagua

SEQ ID NO: 4032058 - RNA, 22 nt, Staphylococcus aureus subsp. aureus MW2
aaaauauuuaaauagaagaaaa

SEQ ID NO: 4032059 - RNA, 15 nt, Staphylococcus aureus subsp. aureus MW2
aaaauauuuuauuau

SEQ ID NO: 4032060 - RNA, 20 nt, Staphylococcus aureus subsp. aureus MW2
aaaauauuuuauuauaauau

SEQ ID NO: 4032061 - RNA, 22 nt, Staphylococcus aureus subsp. aureus MW2
aaaauauuuuauuauaauaucg

SEQ ID NO: 4032062 - RNA, 12 nt, Staphylococcus aureus subsp. aureus MW2
aaaaucaaagag

SEQ ID NO: 4032063 - RNA, 13 nt, Staphylococcus aureus subsp. aureus MW2
aaaaucaaagagg

SEQ ID NO: 4032064 - RNA, 14 nt, Staphylococcus aureus subsp. aureus MW2
aaaaucaaagaggc

SEQ ID NO: 4032065 - RNA, 21 nt, Staphylococcus aureus subsp. aureus MW2
aaaaucaaagaggcuuuaaaa

SEQ ID NO: 4032066 - RNA, 15 nt, Staphylococcus aureus subsp. aureus MW2
aaaaucaacuuuucu

SEQ ID NO: 4032067 - RNA, 16 nt, Staphylococcus aureus subsp. aureus MW2
aaaaucaacuuuucua

SEQ ID NO: 4032068 - RNA, 21 nt, Staphylococcus aureus subsp. aureus MW2
aaaaucaccuuuuuuaacuuu

SEQ ID NO: 4032069 - RNA, 17 nt, Staphylococcus aureus subsp. aureus MW2
aaaaucacgcuaacauu

SEQ ID NO: 4032070 - RNA, 19 nt, Staphylococcus aureus subsp. aureus MW2
aaaaucaguugcuucauaa

SEQ ID NO: 4032071 - RNA, 14 nt, Staphylococcus aureus subsp. aureus MW2
aaaaucauaaauaa

SEQ ID NO: 4032072 - RNA, 23 nt, Staphylococcus aureus subsp. aureus MW2
aaaaucauuaauaauuaaacaaa

SEQ ID NO: 4032073 - RNA, 21 nt, Staphylococcus aureus subsp. aureus MW2
aaaauccuaagcaucguaaaa

SEQ ID NO: 4032074 - RNA, 21 nt, Staphylococcus aureus subsp. aureus MW2
aaaauccuaugaauaaauugu

SEQ ID NO: 4032075 - RNA, 19 nt, Staphylococcus aureus subsp. aureus MW2
aaaaucggauuaacauuau

SEQ ID NO: 4032076 - RNA, 18 nt, Staphylococcus aureus subsp. aureus MW2
aaaaucggcuuucuaagu

SEQ ID NO: 4032077 - RNA, 18 nt, Staphylococcus aureus subsp. aureus MW2
aaaaucguuccaauacuc

SEQ ID NO: 4032078 - RNA, 22 nt, Staphylococcus aureus subsp. aureus MW2
aaaaucuauauaacgcuuuaaa

SEQ ID NO: 4032079 - RNA, 17 nt, Staphylococcus aureus subsp. aureus MW2
aaaaucuuuaacauuug

SEQ ID NO: 4032080 - RNA, 12 nt, Staphylococcus aureus subsp. aureus MW2
aaaaucuuuacu

SEQ ID NO: 4032081 - RNA, 22 nt, Staphylococcus aureus subsp. aureus MW2
aaaaugaagucuuucaacaaaa

SEQ ID NO: 4032082 - RNA, 16 nt, Staphylococcus aureus subsp. aureus MW2
aaaaugaauaauuacu

SEQ ID NO: 4032083 - RNA, 24 nt, Staphylococcus aureus subsp. aureus MW2
aaaaugaauaauuacuaaaauauc

SEQ ID NO: 4032084 - RNA, 19 nt, Staphylococcus aureus subsp. aureus MW2
aaaaugaauguuaagacau

SEQ ID NO: 4032085 - RNA, 22 nt, Staphylococcus aureus subsp. aureus MW2
aaaaugacuaccuguuggcuuu

SEQ ID NO: 4032086 - RNA, 23 nt, Staphylococcus aureus subsp. aureus MW2
aaaaugagcugaacuuucuuuau

SEQ ID NO: 4032087 - RNA, 14 nt, Staphylococcus aureus subsp. aureus MW2
aaaaugaguacaac

SEQ ID NO: 4032088 - RNA, 17 nt, Staphylococcus aureus subsp. aureus MW2
aaaaugaguacaacaua

SEQ ID NO: 4032089 - RNA, 21 nt, Staphylococcus aureus subsp. aureus MW2
aaaaugauagauucaaaauua

SEQ ID NO: 4032090 - RNA, 21 nt, Staphylococcus aureus subsp. aureus MW2
aaaaugauagcuaaacauuuu

SEQ ID NO: 4032091 - RNA, 13 nt, Staphylococcus aureus subsp. aureus MW2
aaaaugauaucug

SEQ ID NO: 4032092 - RNA, 14 nt, Staphylococcus aureus subsp. aureus MW2
aaaaugauuauucu

SEQ ID NO: 4032093 - RNA, 21 nt, Staphylococcus aureus subsp. aureus MW2
aaaaugauucuuaucuuuaau

SEQ ID NO: 4032094 - RNA, 22 nt, Staphylococcus aureus subsp. aureus MW2
aaacaucgauugauaauguaaa

SEQ ID NO: 4032095 - RNA, 16 nt, Staphylococcus aureus subsp. aureus MW2
aaacaugaacaaucag

SEQ ID NO: 4032096 - RNA, 23 nt, Staphylococcus aureus subsp. aureus MW2
aaacaugguuuucuuuuuaucau

SEQ ID NO: 4032097 - RNA, 19 nt, Staphylococcus aureus subsp. aureus MW2
aaacauguacaauuuuuaa

SEQ ID NO: 4032098 - RNA, 15 nt, Staphylococcus aureus subsp. aureus MW2
aaacauguuacccua

SEQ ID NO: 4032099 - RNA, 18 nt, Staphylococcus aureus subsp. aureus MW2
aaacauuauuaagugagu

SEQ ID NO: 4032100 - RNA, 17 nt, Staphylococcus aureus subsp. aureus MW2
aaacauuuagauuucau

SEQ ID NO: 4032101 - RNA, 16 nt, Staphylococcus aureus subsp. aureus MW2
aaacauuuauaaaucu

SEQ ID NO: 4032102 - RNA, 22 nt, Staphylococcus aureus subsp. aureus MW2
aaacauuucgguaugauauuuc

SEQ ID NO: 4032103 - RNA, 18 nt, Staphylococcus aureus subsp. aureus MW2
aaacauuuuuagaaucaa

SEQ ID NO: 4032104 - RNA, 18 nt, Staphylococcus aureus subsp. aureus MW2
aaacauuuuugauuuuaa

SEQ ID NO: 4032105 - RNA, 18 nt, Staphylococcus aureus subsp. aureus MW2
aaaccaaaaauaauuaug

SEQ ID NO: 4032106 - RNA, 14 nt, Staphylococcus aureus subsp. aureus MW2
aaaccaauaauccg

SEQ ID NO: 4032107 - RNA, 20 nt, Staphylococcus aureus subsp. aureus MW2
aaaccaauaauccgagucau

SEQ ID NO: 4032108 - RNA, 13 nt, Staphylococcus aureus subsp. aureus MW2
aaaccaauacgaa

SEQ ID NO: 4032109 - RNA, 13 nt, Staphylococcus aureus subsp. aureus MW2
aaaccaauuuuaa

SEQ ID NO: 4032110 - RNA, 14 nt, Staphylococcus aureus subsp. aureus MW2
aaaccaauuuuaau

SEQ ID NO: 4032111 - RNA, 20 nt, Staphylococcus aureus subsp. aureus MW2
aaaccaauuuuaauaguuuu

SEQ ID NO: 4032112 - RNA, 23 nt, Staphylococcus aureus subsp. aureus MW2
aaaccaauuuuaauaguuuuaau

SEQ ID NO: 4032113 - RNA, 16 nt, Staphylococcus aureus subsp. aureus MW2
aaaccacucauuuuuu

SEQ ID NO: 4032114 - RNA, 12 nt, Staphylococcus aureus subsp. aureus MW2
aaaccaugugua

SEQ ID NO: 4032115 - RNA, 19 nt, Staphylococcus aureus subsp. aureus MW2
aaaccauuaauaaaacugc

SEQ ID NO: 4032116 - RNA, 17 nt, Staphylococcus aureus subsp. aureus MW2
aaaccauugaaugaauc

SEQ ID NO: 4032117 - RNA, 21 nt, Staphylococcus aureus subsp. aureus MW2
aaaccauuuucaagaggacaa

SEQ ID NO: 4032118 - RNA, 21 nt, Staphylococcus aureus subsp. aureus MW2
aaaccgaacaucugaaaaaau

SEQ ID NO: 4032119 - RNA, 18 nt, Staphylococcus aureus subsp. aureus MW2
aaaccgagcgaccguggu

SEQ ID NO: 4032120 - RNA, 23 nt, Staphylococcus aureus subsp. aureus MW2
aaaccgcacuucuauauuaauag

SEQ ID NO: 4032121 - RNA, 20 nt, Staphylococcus aureus subsp. aureus MW2
aaaccguauagucauuacau

SEQ ID NO: 4032122 - RNA, 12 nt, Staphylococcus aureus subsp. aureus MW2
aaaccuaaugau

SEQ ID NO: 4032123 - RNA, 16 nt, Staphylococcus aureus subsp. aureus MW2
aaaccuagggauaauu

SEQ ID NO: 4032124 - RNA, 16 nt, Staphylococcus aureus subsp. aureus MW2
aaaccucaacauuaaa

SEQ ID NO: 4032125 - RNA, 17 nt, Staphylococcus aureus subsp. aureus MW2
aaaccucuaaauaaaau

SEQ ID NO: 4032126 - RNA, 19 nt, Staphylococcus aureus subsp. aureus MW2
aaaccugguggcacgcauu

SEQ ID NO: 4032127 - RNA, 14 nt, Staphylococcus aureus subsp. aureus MW2
aaaccuuacccaaa

SEQ ID NO: 4032128 - RNA, 15 nt, Staphylococcus aureus subsp. aureus MW2
aaacgaaaauacuca

SEQ ID NO: 4032129 - RNA, 16 nt, Staphylococcus aureus subsp. aureus MW2
aaacgagacaucaucu

SEQ ID NO: 4032130 - RNA, 19 nt, Staphylococcus aureus subsp. aureus MW2
aaacgagcuggugagaaau

SEQ ID NO: 4032131 - RNA, 19 nt, Staphylococcus aureus subsp. aureus MW2
aaacgauaagaauuaacaa

SEQ ID NO: 4032132 - RNA, 15 nt, Staphylococcus aureus subsp. aureus MW2
aaacgauauagaccg

SEQ ID NO: 4032133 - RNA, 22 nt, Staphylococcus aureus subsp. aureus MW2
aaacgauugauuaucauaugaa

SEQ ID NO: 4032134 - RNA, 15 nt, Staphylococcus aureus subsp. aureus MW2
aaacgccucaacacu

SEQ ID NO: 4032135 - RNA, 15 nt, Staphylococcus aureus subsp. aureus MW2
aaacgcucuucuucu

SEQ ID NO: 4032136 - RNA, 13 nt, Staphylococcus aureus subsp. aureus MW2
aaacggaaauaac

SEQ ID NO: 4032137 - RNA, 22 nt, Staphylococcus aureus subsp. aureus MW2
aaacgucacuuuauuaaauaac

SEQ ID NO: 4032138 - RNA, 23 nt, Staphylococcus aureus subsp. aureus MW2
aaacgucacuuuauuaaauaacu

SEQ ID NO: 4032139 - RNA, 22 nt, Staphylococcus aureus subsp. aureus MW2
aaacuaaaccgaaguaauaacu

SEQ ID NO: 4032140 - RNA, 18 nt, Staphylococcus aureus subsp. aureus MW2
aaacuaaagguauucuau

SEQ ID NO: 4032141 - RNA, 22 nt, Staphylococcus aureus subsp. aureus MW2
aaacuaauaauuuguaauuccu

SEQ ID NO: 4032142 - RNA, 12 nt, Staphylococcus aureus subsp. aureus MW2
aaacuaauagca

SEQ ID NO: 4032143 - RNA, 15 nt, Staphylococcus aureus subsp. aureus MW2
aaacuacauuugguu

SEQ ID NO: 4032144 - RNA, 15 nt, Staphylococcus aureus subsp. aureus MW2
aaacuacgaauucuc

SEQ ID NO: 4032145 - RNA, 15 nt, Staphylococcus aureus subsp. aureus MW2
aaacuagaaaacaua

SEQ ID NO: 4032146 - RNA, 18 nt, Staphylococcus aureus subsp. aureus MW2
aaacuagcaguaauaugu

SEQ ID NO: 4032147 - RNA, 18 nt, Staphylococcus aureus subsp. aureus MW2
aaacuauaauaaagauua

SEQ ID NO: 4032148 - RNA, 19 nt, Staphylococcus aureus subsp. aureus MW2
aaacuauaauaaagauuau

SEQ ID NO: 4032149 - RNA, 18 nt, Staphylococcus aureus subsp. aureus MW2
aaacuauaauaauuggaa

SEQ ID NO: 4032150 - RNA, 21 nt, Staphylococcus aureus subsp. aureus MW2
aaacuauaauaauuggaauca

SEQ ID NO: 4032151 - RNA, 14 nt, Staphylococcus aureus subsp. aureus MW2
aaacuaucuuauau

SEQ ID NO: 4032152 - RNA, 22 nt, Staphylococcus aureus subsp. aureus MW2
aaacucaaaccuguuuggaaaa

SEQ ID NO: 4032153 - RNA, 23 nt, Staphylococcus aureus subsp. aureus MW2
aaacucauccauugaucuuuuau

SEQ ID NO: 4032154 - RNA, 22 nt, Staphylococcus aureus subsp. aureus MW2
aaacucgcccccguaauaauuu

SEQ ID NO: 4032155 - RNA, 18 nt, Staphylococcus aureus subsp. aureus MW2
aaacucguaaauuuuauc

SEQ ID NO: 4032156 - RNA, 10 nt, Staphylococcus aureus subsp. aureus MW2
aaacucucua

SEQ ID NO: 4032157 - RNA, 22 nt, Staphylococcus aureus subsp. aureus MW2
aaacugaguucaauuaaauuau

SEQ ID NO: 4032158 - RNA, 14 nt, Staphylococcus aureus subsp. aureus MW2
aaacugcaauaauu

SEQ ID NO: 4032159 - RNA, 13 nt, Staphylococcus aureus subsp. aureus MW2
aaacuguaucaac

SEQ ID NO: 4032160 - RNA, 21 nt, Staphylococcus aureus subsp. aureus MW2
aaacuguaucaacauauuuau

SEQ ID NO: 4032161 - RNA, 17 nt, Staphylococcus aureus subsp. aureus MW2
aaacugugcaugacgau

SEQ ID NO: 4032162 - RNA, 13 nt, Staphylococcus aureus subsp. aureus MW2
aaacuuaaaacua

SEQ ID NO: 4032163 - RNA, 13 nt, Staphylococcus aureus subsp. aureus MW2
aaacuuaaaagag

SEQ ID NO: 4032164 - RNA, 14 nt, Staphylococcus aureus subsp. aureus MW2
aaacuuaagaauac

SEQ ID NO: 4032165 - RNA, 22 nt, Staphylococcus aureus subsp. aureus MW2
aaacuuagaacaguuagaaaca

SEQ ID NO: 4032166 - RNA, 21 nt, Staphylococcus aureus subsp. aureus MW2
aaacuuauuaauuaauagaga

SEQ ID NO: 4032167 - RNA, 16 nt, Staphylococcus aureus subsp. aureus MW2
aaacuucuaucacacg

SEQ ID NO: 4032168 - RNA, 13 nt, Staphylococcus aureus subsp. aureus MW2
aaacuucuuguuu

SEQ ID NO: 4032169 - RNA, 22 nt, Staphylococcus aureus subsp. aureus MW2
aaacuucuuguuucaaacaaag

SEQ ID NO: 4032170 - RNA, 10 nt, Staphylococcus aureus subsp. aureus MW2
aaacuucuuu

SEQ ID NO: 4032171 - RNA, 17 nt, Staphylococcus aureus subsp. aureus MW2
aaacuucuuuucuuuga

SEQ ID NO: 4032172 - RNA, 19 nt, Staphylococcus aureus subsp. aureus MW2
aaacuucuuuucuuugaua

SEQ ID NO: 4032173 - RNA, 17 nt, Staphylococcus aureus subsp. aureus MW2
aaacuuucagagauauu

SEQ ID NO: 4032174 - RNA, 17 nt, Staphylococcus aureus subsp. aureus MW2
aaagaaaauaucugaaa

SEQ ID NO: 4032175 - RNA, 14 nt, Staphylococcus aureus subsp. aureus MW2
aaagaaacaugauu

SEQ ID NO: 4032176 - RNA, 18 nt, Staphylococcus aureus subsp. aureus MW2
aaagaaagcuaauaucaa

SEQ ID NO: 4032177 - RNA, 13 nt, Staphylococcus aureus subsp. aureus MW2
aaagaaaucucua

SEQ ID NO: 4032178 - RNA, 22 nt, Staphylococcus aureus subsp. aureus MW2
aaagaacgucgcgaaaacguug

SEQ ID NO: 4032179 - RNA, 23 nt, Staphylococcus aureus subsp. aureus MW2
aaagaacuauguucaauuuaugu

SEQ ID NO: 4032180 - RNA, 21 nt, Staphylococcus aureus subsp. aureus MW2
aaagaagcccccuaauauauc

SEQ ID NO: 4032181 - RNA, 18 nt, Staphylococcus aureus subsp. aureus MW2
aaagaagggaagaguuaa

SEQ ID NO: 4032182 - RNA, 15 nt, Staphylococcus aureus subsp. aureus MW2
aaagugaaaguauua

SEQ ID NO: 4032183 - RNA, 13 nt, Staphylococcus aureus subsp. aureus MW2
aaagugaauauua

SEQ ID NO: 4032184 - RNA, 14 nt, Staphylococcus aureus subsp. aureus MW2
aaagugaauguuuu

SEQ ID NO: 4032185 - RNA, 20 nt, Staphylococcus aureus subsp. aureus MW2
aaagugaguauaaguuuguu

SEQ ID NO: 4032186 - RNA, 14 nt, Staphylococcus aureus subsp. aureus MW2
aaagugauucccaa

SEQ ID NO: 4032187 - RNA, 15 nt, Staphylococcus aureus subsp. aureus MW2
aaaguggccuuuuaa

SEQ ID NO: 4032188 - RNA, 21 nt, Staphylococcus aureus subsp. aureus MW2
aaaguggucguuuauuuuaaa

SEQ ID NO: 4032189 - RNA, 23 nt, Staphylococcus aureus subsp. aureus MW2
aaaguggucguuuauuuuaaauu

SEQ ID NO: 4032190 - RNA, 16 nt, Staphylococcus aureus subsp. aureus MW2
aaagugguuguuccca

SEQ ID NO: 4032191 - RNA, 18 nt, Staphylococcus aureus subsp. aureus MW2
aaagugguuguucccauu

SEQ ID NO: 4032192 - RNA, 15 nt, Staphylococcus aureus subsp. aureus MW2
aaagugguuuuacug

SEQ ID NO: 4032193 - RNA, 21 nt, Staphylococcus aureus subsp. aureus MW2
aaaguguaauguuccccugaa

SEQ ID NO: 4032194 - RNA, 14 nt, Staphylococcus aureus subsp. aureus MW2
aaaguuaaagacua

SEQ ID NO: 4032195 - RNA, 19 nt, Staphylococcus aureus subsp. aureus MW2
aaaguuagacuaaaaaacu

SEQ ID NO: 4032196 - RNA, 20 nt, Staphylococcus aureus subsp. aureus MW2
aaaguuagacuaaaaaacua

SEQ ID NO: 4032197 - RNA, 16 nt, Staphylococcus aureus subsp. aureus MW2
aaaguuagcaaauggu

SEQ ID NO: 4032198 - RNA, 16 nt, Staphylococcus aureus subsp. aureus MW2
aaaguugauaauguaa

SEQ ID NO: 4032199 - RNA, 20 nt, Staphylococcus aureus subsp. aureus MW2
aaaguugguuuuauuaauuc

SEQ ID NO: 4032200 - RNA, 16 nt, Staphylococcus aureus subsp. aureus MW2
aaaguuguauucugaa

SEQ ID NO: 4032201 - RNA, 20 nt, Staphylococcus aureus subsp. aureus MW2
aaaguuguauucugaaacuu

SEQ ID NO: 4032202 - RNA, 18 nt, Staphylococcus aureus subsp. aureus MW2
aaaguuguuuaacuucuu

SEQ ID NO: 4032203 - RNA, 13 nt, Staphylococcus aureus subsp. aureus MW2
aaaguuucuccac

SEQ ID NO: 4032204 - RNA, 15 nt, Staphylococcus aureus subsp. aureus MW2
aaaguuucuccaccu

SEQ ID NO: 4032205 - RNA, 17 nt, Staphylococcus aureus subsp. aureus MW2
aaaguuuggucaccuac

SEQ ID NO: 4032206 - RNA, 15 nt, Staphylococcus aureus subsp. aureus MW2
aaaguuuuauuuaaa

SEQ ID NO: 4032207 - RNA, 17 nt, Staphylococcus aureus subsp. aureus MW2
aaaguuuucauuuaaca

SEQ ID NO: 4032208 - RNA, 18 nt, Staphylococcus aureus subsp. aureus MW2
aaaguuuucauuuaacau

SEQ ID NO: 4032209 - RNA, 22 nt, Staphylococcus aureus subsp. aureus MW2
aaaguuuucauuuaacauguau

SEQ ID NO: 4032210 - RNA, 14 nt, Staphylococcus aureus subsp. aureus MW2
aaauaaaaaagcca

SEQ ID NO: 4032211 - RNA, 16 nt, Staphylococcus aureus subsp. aureus MW2
aaauaaaaauauugcg

SEQ ID NO: 4032212 - RNA, 13 nt, Staphylococcus aureus subsp. aureus MW2
aaauaaaaauuau

SEQ ID NO: 4032213 - RNA, 14 nt, Staphylococcus aureus subsp. aureus MW2
aaauaaaauuaaaa

SEQ ID NO: 4032214 - RNA, 15 nt, Staphylococcus aureus subsp. aureus MW2
aaauaaaauuaaaac

SEQ ID NO: 4032215 - RNA, 12 nt, Staphylococcus aureus subsp. aureus MW2
aaauaaaauuuu

SEQ ID NO: 4032216 - RNA, 19 nt, Staphylococcus aureus subsp. aureus MW2
aaauaaacacaucuaugug

SEQ ID NO: 4032217 - RNA, 16 nt, Staphylococcus aureus subsp. aureus MW2
aaauaaaccacgcaca

SEQ ID NO: 4032218 - RNA, 22 nt, Staphylococcus aureus subsp. aureus MW2
aaauaaacgauugauuaucaua

SEQ ID NO: 4032219 - RNA, 19 nt, Staphylococcus aureus subsp. aureus MW2
aaauaaacucaccaaguuc

SEQ ID NO: 4032220 - RNA, 11 nt, Staphylococcus aureus subsp. aureus MW2
aaauaaauaag

SEQ ID NO: 4032221 - RNA, 14 nt, Staphylococcus aureus subsp. aureus MW2
aaauaaauaagcaa

SEQ ID NO: 4032222 - RNA, 14 nt, Staphylococcus aureus subsp. aureus MW2
aaauaaauauaaaa

SEQ ID NO: 4032223 - RNA, 22 nt, Staphylococcus aureus subsp. aureus MW2
aaauaaaugacuucacauuuau

SEQ ID NO: 4032224 - RNA, 21 nt, Staphylococcus aureus subsp. aureus MW2
aaauaaauuuugcgaaaauau

SEQ ID NO: 4032225 - RNA, 17 nt, Staphylococcus aureus subsp. aureus MW2
aaauaacaaacauuaau

SEQ ID NO: 4032226 - RNA, 19 nt, Staphylococcus aureus subsp. aureus MW2
aaauaaccauucacuuaua

SEQ ID NO: 4032227 - RNA, 20 nt, Staphylococcus aureus subsp. aureus MW2
aaauaaccgcacuuucuauu

SEQ ID NO: 4032228 - RNA, 19 nt, Staphylococcus aureus subsp. aureus MW2
aaauaacgauaccuuuaau

SEQ ID NO: 4032229 - RNA, 19 nt, Staphylococcus aureus subsp. aureus MW2
aaauaacugcuaauuuuuu

SEQ ID NO: 4032230 - RNA, 18 nt, Staphylococcus aureus subsp. aureus MW2
aaauaacuguaaaacauu

SEQ ID NO: 4032231 - RNA, 14 nt, Staphylococcus aureus subsp. aureus MW2
aaauaacuucguuu

SEQ ID NO: 4032232 - RNA, 20 nt, Staphylococcus aureus subsp. aureus MW2
aaauaacuuuuuaaaggacc

SEQ ID NO: 4032233 - RNA, 16 nt, Staphylococcus aureus subsp. aureus MW2
aaauaagugauaaaua

SEQ ID NO: 4032234 - RNA, 18 nt, Staphylococcus aureus subsp. aureus MW2
aaauaaguguuguuuuau

SEQ ID NO: 4032235 - RNA, 22 nt, Staphylococcus aureus subsp. aureus MW2
aaauaauaacccgaacacaaaa

SEQ ID NO: 4032236 - RNA, 14 nt, Staphylococcus aureus subsp. aureus MW2
aaauaauagcaaaa

SEQ ID NO: 4032237 - RNA, 13 nt, Staphylococcus aureus subsp. aureus MW2
aaauaauauaaaa

SEQ ID NO: 4032238 - RNA, 14 nt, Staphylococcus aureus subsp. aureus MW2
aaauaauauaaaac

SEQ ID NO: 4032239 - RNA, 17 nt, Staphylococcus aureus subsp. aureus MW2
aaauaaucccaaccauu

SEQ ID NO: 4032240 - RNA, 15 nt, Staphylococcus aureus subsp. aureus MW2
aaauaaucccuucaa

SEQ ID NO: 4032241 - RNA, 17 nt, Staphylococcus aureus subsp. aureus MW2
aaauaaucgaacagaaa

SEQ ID NO: 4032242 - RNA, 19 nt, Staphylococcus aureus subsp. aureus MW2
aaauaaucgaacagaaaau

SEQ ID NO: 4032243 - RNA, 13 nt, Staphylococcus aureus subsp. aureus MW2
aaauaaucgaaga

SEQ ID NO: 4032244 - RNA, 15 nt, Staphylococcus aureus subsp. aureus MW2
aaauaaucucuucaa

SEQ ID NO: 4032245 - RNA, 16 nt, Staphylococcus aureus subsp. aureus MW2
aaauaaucucuucaau

SEQ ID NO: 4032246 - RNA, 22 nt, Staphylococcus aureus subsp. aureus MW2
aaauaaucucuucaauuuauuu

SEQ ID NO: 4032247 - RNA, 19 nt, Staphylococcus aureus subsp. aureus MW2
aaauaaugcuuauuaaaau

SEQ ID NO: 4032248 - RNA, 22 nt, Staphylococcus aureus subsp. aureus MW2
aaauaauuaaacuuuaugaaaa

SEQ ID NO: 4032249 - RNA, 15 nt, Staphylococcus aureus subsp. aureus MW2
aaauaauuaugaaaa

SEQ ID NO: 4032250 - RNA, 12 nt, Staphylococcus aureus subsp. aureus MW2
aaauaauuuaaa

SEQ ID NO: 4032251 - RNA, 21 nt, Staphylococcus aureus subsp. aureus MW2
aaauaauuuaaaggcauaaua

SEQ ID NO: 4032252 - RNA, 16 nt, Staphylococcus aureus subsp. aureus MW2
aaauacaucaauuucu

SEQ ID NO: 4032253 - RNA, 17 nt, Staphylococcus aureus subsp. aureus MW2
aaauacaucaauuucua

SEQ ID NO: 4032254 - RNA, 15 nt, Staphylococcus aureus subsp. aureus MW2
aaauacaucggaauu

SEQ ID NO: 4032255 - RNA, 16 nt, Staphylococcus aureus subsp. aureus MW2
aaauacaucggaauuc

SEQ ID NO: 4032256 - RNA, 17 nt, Staphylococcus aureus subsp. aureus MW2
aaauaccaaauaugacu

SEQ ID NO: 4032257 - RNA, 22 nt, Staphylococcus aureus subsp. aureus MW2
aaauaccaacugcaaauacacc

SEQ ID NO: 4032258 - RNA, 23 nt, Staphylococcus aureus subsp. aureus MW2
aaauaccagaugaaccaaaaaac

SEQ ID NO: 4032259 - RNA, 18 nt, Staphylococcus aureus subsp. aureus MW2
aaauaccuaccacaauaa

SEQ ID NO: 4032260 - RNA, 16 nt, Staphylococcus aureus subsp. aureus MW2
aaauacgaguguuggu

SEQ ID NO: 4032261 - RNA, 15 nt, Staphylococcus aureus subsp. aureus MW2
aaauacgcaaaccaa

SEQ ID NO: 4032262 - RNA, 16 nt, Staphylococcus aureus subsp. aureus MW2
aaauacgccaaauacu

SEQ ID NO: 4032263 - RNA, 15 nt, Staphylococcus aureus subsp. aureus MW2
aaauacuaagauuag

SEQ ID NO: 4032264 - RNA, 20 nt, Staphylococcus aureus subsp. aureus MW2
aaauacuauacugaugaaaa

SEQ ID NO: 4032265 - RNA, 21 nt, Staphylococcus aureus subsp. aureus MW2
aaauacuaucugacauuuaaa

SEQ ID NO: 4032266 - RNA, 19 nt, Staphylococcus aureus subsp. aureus MW2
aaauacuugaauguaagaa

SEQ ID NO: 4032267 - RNA, 22 nt, Staphylococcus aureus subsp. aureus MW2
aaauacuuguuuaccuaaaucu

SEQ ID NO: 4032268 - RNA, 22 nt, Staphylococcus aureus subsp. aureus MW2
aaauacuuuugcaucacagaua

SEQ ID NO: 4032269 - RNA, 21 nt, Staphylococcus aureus subsp. aureus MW2
aaauacuuuuugaugauuuac

SEQ ID NO: 4032270 - RNA, 19 nt, Staphylococcus aureus subsp. aureus MW2
aaauagaaaaauuucaaaa

SEQ ID NO: 4032271 - RNA, 20 nt, Staphylococcus aureus subsp. aureus MW2
aaauagacugccaauaaaau

SEQ ID NO: 4032272 - RNA, 15 nt, Staphylococcus aureus subsp. aureus MW2
aaauagauaauauau

SEQ ID NO: 4032273 - RNA, 23 nt, Staphylococcus aureus subsp. aureus MW2
aaauagaucgaacugauggaaaa

SEQ ID NO: 4032274 - RNA, 19 nt, Staphylococcus aureus subsp. aureus MW2
aaauagauugaaaaaauaa

SEQ ID NO: 4032275 - RNA, 13 nt, Staphylococcus aureus subsp. aureus MW2
aaauagccuucaa

SEQ ID NO: 4032276 - RNA, 18 nt, Staphylococcus aureus subsp. aureus MW2
aaauagcgauuuuaaaga

SEQ ID NO: 4032277 - RNA, 17 nt, Staphylococcus aureus subsp. aureus MW2
aaauagcguaauuauua

SEQ ID NO: 4032278 - RNA, 20 nt, Staphylococcus aureus subsp. aureus MW2
aaauagcguaauuauuauaa

SEQ ID NO: 4032279 - RNA, 15 nt, Staphylococcus aureus subsp. aureus MW2
aaauagcuauuaaaa

SEQ ID NO: 4032280 - RNA, 16 nt, Staphylococcus aureus subsp. aureus MW2
aaauagcuguuugaua

SEQ ID NO: 4032281 - RNA, 22 nt, Staphylococcus aureus subsp. aureus MW2
aaauaggguaauagaucuaucg

SEQ ID NO: 4032282 - RNA, 18 nt, Staphylococcus aureus subsp. aureus MW2
aaauaggugcuuguaaaa

SEQ ID NO: 4032283 - RNA, 14 nt, Staphylococcus aureus subsp. aureus MW2
aaauaguaagguuu

SEQ ID NO: 4032284 - RNA, 22 nt, Staphylococcus aureus subsp. aureus MW2
aaauaguagacgguaucaucug

SEQ ID NO: 4032285 - RNA, 17 nt, Staphylococcus aureus subsp. aureus MW2
aaauaguucaaaauacu

SEQ ID NO: 4032286 - RNA, 14 nt, Staphylococcus aureus subsp. aureus MW2
aaauaguucuuuaa

SEQ ID NO: 4032287 - RNA, 19 nt, Staphylococcus aureus subsp. aureus MW2
aaauaguucuuuaaauuau

SEQ ID NO: 4032288 - RNA, 16 nt, Staphylococcus aureus subsp. aureus MW2
aaauauaaaauccuaa

SEQ ID NO: 4032289 - RNA, 15 nt, Staphylococcus aureus subsp. aureus MW2
aaauauaaauaaaag

SEQ ID NO: 4032290 - RNA, 12 nt, Staphylococcus aureus subsp. aureus MW2
aaauauaaauuu

SEQ ID NO: 4032291 - RNA, 16 nt, Staphylococcus aureus subsp. aureus MW2
aaauauaaccuaaaaa

SEQ ID NO: 4032292 - RNA, 18 nt, Staphylococcus aureus subsp. aureus MW2
aaauauaauguauaaaac

SEQ ID NO: 4032293 - RNA, 19 nt, Staphylococcus aureus subsp. aureus MW2
aaauauaauguauaaaaca

SEQ ID NO: 4032294 - RNA, 16 nt, Staphylococcus aureus subsp. aureus MW2
aaauauaccaaccaaa

SEQ ID NO: 4032295 - RNA, 19 nt, Staphylococcus aureus subsp. aureus MW2
aaauauaccaaccaaaacc

SEQ ID NO: 4032296 - RNA, 20 nt, Staphylococcus aureus subsp. aureus MW2
aaauauaccaaccaaaacca

SEQ ID NO: 4032297 - RNA, 18 nt, Staphylococcus aureus subsp. aureus MW2
aaauauacuucuauuaaa

SEQ ID NO: 4032298 - RNA, 21 nt, Staphylococcus aureus subsp. aureus MW2
aaauauacuugccuucaaauu

SEQ ID NO: 4032299 - RNA, 21 nt, Staphylococcus aureus subsp. aureus MW2
aaauauagugauugaacaaaa

SEQ ID NO: 4032300 - RNA, 23 nt, Staphylococcus aureus subsp. aureus MW2
aaauauaucuaauacuuucacuu

SEQ ID NO: 4032301 - RNA, 14 nt, Staphylococcus aureus subsp. aureus MW2
aaauauauuauaaa

SEQ ID NO: 4032302 - RNA, 15 nt, Staphylococcus aureus subsp. aureus MW2
aaauauauuauaaaa

SEQ ID NO: 4032303 - RNA, 18 nt, Staphylococcus aureus subsp. aureus MW2
aaauauauuauaaaaaua

SEQ ID NO: 4032304 - RNA, 22 nt, Staphylococcus aureus subsp. aureus MW2
aaauauauugcacauaaaaaau

SEQ ID NO: 4032305 - RNA, 11 nt, Staphylococcus aureus subsp. aureus MW2
aaauauauuug

SEQ ID NO: 4032306 - RNA, 17 nt, Staphylococcus aureus subsp. aureus MW2
aaauauauuuguaguaa

SEQ ID NO: 4032307 - RNA, 12 nt, Staphylococcus aureus subsp. aureus MW2
aaauaucaacag

SEQ ID NO: 4032308 - RNA, 20 nt, Staphylococcus aureus subsp. aureus MW2
aaauaucacuaauauauuua

SEQ ID NO: 4032309 - RNA, 15 nt, Staphylococcus aureus subsp. aureus MW2
aaauaucauaaaugc

SEQ ID NO: 4032310 - RNA, 18 nt, Staphylococcus aureus subsp. aureus MW2
aaauaucaugcaaaacua

SEQ ID NO: 4032311 - RNA, 20 nt, Staphylococcus aureus subsp. aureus MW2
aaauaucccggaauauuaac

SEQ ID NO: 4032312 - RNA, 21 nt, Staphylococcus aureus subsp. aureus MW2
aaauaucccggaauauuaaca

SEQ ID NO: 4032313 - RNA, 19 nt, Staphylococcus aureus subsp. aureus MW2
aaauaucgacaaauuaaaa

SEQ ID NO: 4032314 - RNA, 20 nt, Staphylococcus aureus subsp. aureus MW2
aaauaucgagaggguacacu

SEQ ID NO: 4032315 - RNA, 18 nt, Staphylococcus aureus subsp. aureus MW2
aaauaugaaaagagauuu

SEQ ID NO: 4032316 - RNA, 22 nt, Staphylococcus aureus subsp. aureus MW2
aaauaugacgcgugaauuaaaa

SEQ ID NO: 4032317 - RNA, 16 nt, Staphylococcus aureus subsp. aureus MW2
aaauaugauguuaaaa

SEQ ID NO: 4032318 - RNA, 18 nt, Staphylococcus aureus subsp. aureus MW2
aaauaugauguuaaaaaa

SEQ ID NO: 4032319 - RNA, 13 nt, Staphylococcus aureus subsp. aureus MW2
aaauaugauugaa

SEQ ID NO: 4032320 - RNA, 13 nt, Staphylococcus aureus subsp. aureus MW2
aaauaugauuuaa

SEQ ID NO: 4032321 - RNA, 15 nt, Staphylococcus aureus subsp. aureus MW2
aaauaugauuuaaaa

SEQ ID NO: 4032322 - RNA, 19 nt, Staphylococcus aureus subsp. aureus MW2
aaauaugcacuuuuuauac

SEQ ID NO: 4032323 - RNA, 23 nt, Staphylococcus aureus subsp. aureus MW2
aaauaugcacuuuuuauacauua

SEQ ID NO: 4032324 - RNA, 19 nt, Staphylococcus aureus subsp. aureus MW2
aaauauggaauuucauaua

SEQ ID NO: 4032325 - RNA, 17 nt, Staphylococcus aureus subsp. aureus MW2
aaauauguaaucagguu

SEQ ID NO: 4032326 - RNA, 23 nt, Staphylococcus aureus subsp. aureus MW2
aaauauguauguuuuaucaauau

SEQ ID NO: 4032327 - RNA, 22 nt, Staphylococcus aureus subsp. aureus MW2
aaauauuaauauaaaauaaagu

SEQ ID NO: 4032328 - RNA, 15 nt, Staphylococcus aureus subsp. aureus MW2
aaauauuaauuuaua

SEQ ID NO: 4032329 - RNA, 14 nt, Staphylococcus aureus subsp. aureus MW2
aaauauuauaaaaa

SEQ ID NO: 4032330 - RNA, 17 nt, Staphylococcus aureus subsp. aureus MW2
aaauauuauaaaaagau

SEQ ID NO: 4032331 - RNA, 14 nt, Staphylococcus aureus subsp. aureus MW2
aaauauucuuaucu

SEQ ID NO: 4032332 - RNA, 21 nt, Staphylococcus aureus subsp. aureus MW2
aaauauugauucuagugaaau

SEQ ID NO: 4032333 - RNA, 16 nt, Staphylococcus aureus subsp. aureus MW2
aaauauuggaauacuc

SEQ ID NO: 4032334 - RNA, 20 nt, Staphylococcus aureus subsp. aureus MW2
aaauauuggaauacucuuua

SEQ ID NO: 4032335 - RNA, 22 nt, Staphylococcus aureus subsp. aureus MW2
aaauauuggaauacucuuuaau

SEQ ID NO: 4032336 - RNA, 16 nt, Staphylococcus aureus subsp. aureus MW2
aaauauugguaucucc

SEQ ID NO: 4032337 - RNA, 15 nt, Staphylococcus aureus subsp. aureus MW2
aaauauuuaaaauau

SEQ ID NO: 4032338 - RNA, 16 nt, Staphylococcus aureus subsp. aureus MW2
aaauauuuaaaauauu

SEQ ID NO: 4032339 - RNA, 15 nt, Staphylococcus aureus subsp. aureus MW2
aaauauuuaaacuag

SEQ ID NO: 4032340 - RNA, 13 nt, Staphylococcus aureus subsp. aureus MW2
aaauauuuaaaua

SEQ ID NO: 4032341 - RNA, 18 nt, Staphylococcus aureus subsp. aureus MW2
aaauauuuaaccuuuaaa

SEQ ID NO: 4032342 - RNA, 19 nt, Staphylococcus aureus subsp. aureus MW2
aaauauuuaaccuuuaaaa

SEQ ID NO: 4032343 - RNA, 20 nt, Staphylococcus aureus subsp. aureus MW2
aaauauuuaaccuuuaaaac

SEQ ID NO: 4032344 - RNA, 15 nt, Staphylococcus aureus subsp. aureus MW2
aaauauuuaucuuua

SEQ ID NO: 4032345 - RNA, 15 nt, Staphylococcus aureus subsp. aureus MW2
aaauauuuuaucugu

SEQ ID NO: 4032346 - RNA, 18 nt, Staphylococcus aureus subsp. aureus MW2
aaauauuuuaucuguaaa

SEQ ID NO: 4032347 - RNA, 16 nt, Staphylococcus aureus subsp. aureus MW2
aaauauuuuauuauaa

SEQ ID NO: 4032348 - RNA, 11 nt, Staphylococcus aureus subsp. aureus MW2
aaaucaaagag

SEQ ID NO: 4032349 - RNA, 16 nt, Staphylococcus aureus subsp. aureus MW2
aaaucaaagaguaaag

SEQ ID NO: 4032350 - RNA, 14 nt, Staphylococcus aureus subsp. aureus MW2
aaaucaacaccaac

SEQ ID NO: 4032351 - RNA, 16 nt, Staphylococcus aureus subsp. aureus MW2
aaaucaacaucaucuu

SEQ ID NO: 4032352 - RNA, 14 nt, Staphylococcus aureus subsp. aureus MW2
aaaucaacuuuaau

SEQ ID NO: 4032353 - RNA, 12 nt, Staphylococcus aureus subsp. aureus MW2
aaaucaagaaau

SEQ ID NO: 4032354 - RNA, 12 nt, Staphylococcus aureus subsp. aureus MW2
aaaucaauccau

SEQ ID NO: 4032355 - RNA, 13 nt, Staphylococcus aureus subsp. aureus MW2
aaaucaauccauc

SEQ ID NO: 4032356 - RNA, 21 nt, Staphylococcus aureus subsp. aureus MW2
aaaucaauugaaaaagacaau

SEQ ID NO: 4032357 - RNA, 17 nt, Staphylococcus aureus subsp. aureus MW2
aaaucacauaugauaau

SEQ ID NO: 4032358 - RNA, 16 nt, Staphylococcus aureus subsp. aureus MW2
aaaucacgcuaacauu

SEQ ID NO: 4032359 - RNA, 21 nt, Staphylococcus aureus subsp. aureus MW2
aaaucacucaacugaugaaaa

SEQ ID NO: 4032360 - RNA, 20 nt, Staphylococcus aureus subsp. aureus MW2
aaaugccgagauuauuaugu

SEQ ID NO: 4032361 - RNA, 14 nt, Staphylococcus aureus subsp. aureus MW2
aaaugccucuuuug

SEQ ID NO: 4032362 - RNA, 21 nt, Staphylococcus aureus subsp. aureus MW2
aaaugcgcuuccaauuuaaaa

SEQ ID NO: 4032363 - RNA, 18 nt, Staphylococcus aureus subsp. aureus MW2
aaaugcgcuuguaacaag

SEQ ID NO: 4032364 - RNA, 14 nt, Staphylococcus aureus subsp. aureus MW2
aaaugcuaaaagua

SEQ ID NO: 4032365 - RNA, 18 nt, Staphylococcus aureus subsp. aureus MW2
aaaugcuuaagaaauuuu

SEQ ID NO: 4032366 - RNA, 22 nt, Staphylococcus aureus subsp. aureus MW2
aaaugcuuaauuuguuuuaaau

SEQ ID NO: 4032367 - RNA, 21 nt, Staphylococcus aureus subsp. aureus MW2
aaaugcuucucuauacccuuu

SEQ ID NO: 4032368 - RNA, 21 nt, Staphylococcus aureus subsp. aureus MW2
aaaugcuucugguucuucaau

SEQ ID NO: 4032369 - RNA, 19 nt, Staphylococcus aureus subsp. aureus MW2
aaaugcuuuaaauauuguc

SEQ ID NO: 4032370 - RNA, 12 nt, Staphylococcus aureus subsp. aureus MW2
aaauggagcaac

SEQ ID NO: 4032371 - RNA, 19 nt, Staphylococcus aureus subsp. aureus MW2
aaauggugcgaauaauaau

SEQ ID NO: 4032372 - RNA, 23 nt, Staphylococcus aureus subsp. aureus MW2
aaaugguuuucuuuuucuauaca

SEQ ID NO: 4032373 - RNA, 16 nt, Staphylococcus aureus subsp. aureus MW2
aaauguauuaaacauu

SEQ ID NO: 4032374 - RNA, 21 nt, Staphylococcus aureus subsp. aureus MW2
aaauguccgauuugauaaaaa

SEQ ID NO: 4032375 - RNA, 13 nt, Staphylococcus aureus subsp. aureus MW2
aaaugugaaagac

SEQ ID NO: 4032376 - RNA, 20 nt, Staphylococcus aureus subsp. aureus MW2
aaaugugaaagucauccuac

SEQ ID NO: 4032377 - RNA, 18 nt, Staphylococcus aureus subsp. aureus MW2
aaauguguuaaaauauau

SEQ ID NO: 4032378 - RNA, 21 nt, Staphylococcus aureus subsp. aureus MW2
aaauguuaaagauuauuauua

SEQ ID NO: 4032379 - RNA, 15 nt, Staphylococcus aureus subsp. aureus MW2
aaauguuacacaaau

SEQ ID NO: 4032380 - RNA, 17 nt, Staphylococcus aureus subsp. aureus MW2
aaauguugaauguggaa

SEQ ID NO: 4032381 - RNA, 18 nt, Staphylococcus aureus subsp. aureus MW2
aaauguugacuacucaau

SEQ ID NO: 4032382 - RNA, 15 nt, Staphylococcus aureus subsp. aureus MW2
aaauguuuaacaaua

SEQ ID NO: 4032383 - RNA, 20 nt, Staphylococcus aureus subsp. aureus MW2
aaauguuuacugucaucuuu

SEQ ID NO: 4032384 - RNA, 22 nt, Staphylococcus aureus subsp. aureus MW2
aaauguuuacugucaucuuuau

SEQ ID NO: 4032385 - RNA, 22 nt, Staphylococcus aureus subsp. aureus MW2
aaauguuuauaauaauauugaa

SEQ ID NO: 4032386 - RNA, 19 nt, Staphylococcus aureus subsp. aureus MW2
aaauguuuuguguauuuau

SEQ ID NO: 4032387 - RNA, 18 nt, Staphylococcus aureus subsp. aureus MW2
aaauuaaaaaacaaaacu

SEQ ID NO: 4032388 - RNA, 12 nt, Staphylococcus aureus subsp. aureus MW2
aaauuaaaaaau

SEQ ID NO: 4032389 - RNA, 12 nt, Staphylococcus aureus subsp. aureus MW2
aaauuaaaacag

SEQ ID NO: 4032390 - RNA, 15 nt, Staphylococcus aureus subsp. aureus MW2
aaauuaaaacuuuca

SEQ ID NO: 4032391 - RNA, 20 nt, Staphylococcus aureus subsp. aureus MW2
aaauuaaagcuagaaacaau

SEQ ID NO: 4032392 - RNA, 14 nt, Staphylococcus aureus subsp. aureus MW2
aaauuaaaugcaua

SEQ ID NO: 4032393 - RNA, 19 nt, Staphylococcus aureus subsp. aureus MW2
aaauuaaaugcauaauaua

SEQ ID NO: 4032394 - RNA, 20 nt, Staphylococcus aureus subsp. aureus MW2
aaauuaacuuaaaauuuaaa

SEQ ID NO: 4032395 - RNA, 22 nt, Staphylococcus aureus subsp. aureus MW2
aaauuaacuuaaaauuuaaaua

SEQ ID NO: 4032396 - RNA, 18 nt, Staphylococcus aureus subsp. aureus MW2
aaauuaaguacuauuaaa

SEQ ID NO: 4032397 - RNA, 12 nt, Staphylococcus aureus subsp. aureus MW2
aaauuaauaauu

SEQ ID NO: 4032398 - RNA, 17 nt, Staphylococcus aureus subsp. aureus MW2
aaauuaauaauuuucca

SEQ ID NO: 4032399 - RNA, 19 nt, Staphylococcus aureus subsp. aureus MW2
aaauuaauagagaaaaaau

SEQ ID NO: 4032400 - RNA, 19 nt, Staphylococcus aureus subsp. aureus MW2
aaauuaauaugaacaaaaa

SEQ ID NO: 4032401 - RNA, 15 nt, Staphylococcus aureus subsp. aureus MW2
aaauuaaucacauaa

SEQ ID NO: 4032402 - RNA, 14 nt, Staphylococcus aureus subsp. aureus MW2
aaauuacacccuuu

SEQ ID NO: 4032403 - RNA, 15 nt, Staphylococcus aureus subsp. aureus MW2
aaauuacacccuuua

SEQ ID NO: 4032404 - RNA, 23 nt, Staphylococcus aureus subsp. aureus MW2
aaauuacacccuuuaaauuuaac

SEQ ID NO: 4032405 - RNA, 17 nt, Staphylococcus aureus subsp. aureus MW2
aaauuacgcaaagaaaa

SEQ ID NO: 4032406 - RNA, 18 nt, Staphylococcus aureus subsp. aureus MW2
aaauuacgcaaagaaaaa

SEQ ID NO: 4032407 - RNA, 15 nt, Staphylococcus aureus subsp. aureus MW2
aaauuacuauauuua

SEQ ID NO: 4032408 - RNA, 15 nt, Staphylococcus aureus subsp. aureus MW2
aaauuacuuauucaa

SEQ ID NO: 4032409 - RNA, 16 nt, Staphylococcus aureus subsp. aureus MW2
aaauuacuugaauauu

SEQ ID NO: 4032410 - RNA, 12 nt, Staphylococcus aureus subsp. aureus MW2
aaauuagaauua

SEQ ID NO: 4032411 - RNA, 14 nt, Staphylococcus aureus subsp. aureus MW2
aaauuagauaaaac

SEQ ID NO: 4032412 - RNA, 16 nt, Staphylococcus aureus subsp. aureus MW2
aaauuagauaaaacaa

SEQ ID NO: 4032413 - RNA, 18 nt, Staphylococcus aureus subsp. aureus MW2
aaauuagauaaaacaaaa

SEQ ID NO: 4032414 - RNA, 23 nt, Staphylococcus aureus subsp. aureus MW2
aaauuagcaagugaguaacauuu

SEQ ID NO: 4032415 - RNA, 17 nt, Staphylococcus aureus subsp. aureus MW2
aaauuagccauuucaau

SEQ ID NO: 4032416 - RNA, 21 nt, Staphylococcus aureus subsp. aureus MW2
aaauuagcgauacuuuuaaaa

SEQ ID NO: 4032417 - RNA, 19 nt, Staphylococcus aureus subsp. aureus MW2
aaauuaggcauucaucuaa

SEQ ID NO: 4032418 - RNA, 18 nt, Staphylococcus aureus subsp. aureus MW2
aaauuagucauccaaaga

SEQ ID NO: 4032419 - RNA, 21 nt, Staphylococcus aureus subsp. aureus MW2
aaauuauacgagaauaugauc

SEQ ID NO: 4032420 - RNA, 20 nt, Staphylococcus aureus subsp. aureus MW2
aaauuauagccuucauuugc

SEQ ID NO: 4032421 - RNA, 13 nt, Staphylococcus aureus subsp. aureus MW2
aaauuauauaaau

SEQ ID NO: 4032422 - RNA, 13 nt, Staphylococcus aureus subsp. aureus MW2
aaauuaucauuaa

SEQ ID NO: 4032423 - RNA, 21 nt, Staphylococcus aureus subsp. aureus MW2
aaauuaucuuucaucaaauuc

SEQ ID NO: 4032424 - RNA, 21 nt, Staphylococcus aureus subsp. aureus MW2
aaauuaugauuauuuuucuca

SEQ ID NO: 4032425 - RNA, 13 nt, Staphylococcus aureus subsp. aureus MW2
aaauuauuauuua

SEQ ID NO: 4032426 - RNA, 20 nt, Staphylococcus aureus subsp. aureus MW2
aaauuauugacauugcaaaa

SEQ ID NO: 4032427 - RNA, 23 nt, Staphylococcus aureus subsp. aureus MW2
aaauuauuuauucauuauagucu

SEQ ID NO: 4032428 - RNA, 13 nt, Staphylococcus aureus subsp. aureus MW2
aaauuauuugaua

SEQ ID NO: 4032429 - RNA, 21 nt, Staphylococcus aureus subsp. aureus MW2
aaauuauuugauauuucauuu

SEQ ID NO: 4032430 - RNA, 18 nt, Staphylococcus aureus subsp. aureus MW2
aaauucaacgucaucaaa

SEQ ID NO: 4032431 - RNA, 12 nt, Staphylococcus aureus subsp. aureus MW2
aaauucaucuug

SEQ ID NO: 4032432 - RNA, 17 nt, Staphylococcus aureus subsp. aureus MW2
aaauucauuuguauuaa

SEQ ID NO: 4032433 - RNA, 16 nt, Staphylococcus aureus subsp. aureus MW2
aaauucgcaagccuuc

SEQ ID NO: 4032434 - RNA, 22 nt, Staphylococcus aureus subsp. aureus MW2
aaauucuacaaacaaugcaagu

SEQ ID NO: 4032435 - RNA, 22 nt, Staphylococcus aureus subsp. aureus MW2
aaauucuacaggcaaugcaagu

SEQ ID NO: 4032436 - RNA, 22 nt, Staphylococcus aureus subsp. aureus MW2
aaauucuacaggcaaugcgagu

SEQ ID NO: 4032437 - RNA, 14 nt, Staphylococcus aureus subsp. aureus MW2
aaauucucaauuaa

SEQ ID NO: 4032438 - RNA, 22 nt, Staphylococcus aureus subsp. aureus MW2
aaauucucuaauuucucccguu

SEQ ID NO: 4032439 - RNA, 12 nt, Staphylococcus aureus subsp. aureus MW2
aaauucucugug

SEQ ID NO: 4032440 - RNA, 17 nt, Staphylococcus aureus subsp. aureus MW2
aaauucuuauaaaauaa

SEQ ID NO: 4032441 - RNA, 20 nt, Staphylococcus aureus subsp. aureus MW2
aaauucuuauaaaauaaaaa

SEQ ID NO: 4032442 - RNA, 19 nt, Staphylococcus aureus subsp. aureus MW2
aaauucuuuuacagcaaga

SEQ ID NO: 4032443 - RNA, 13 nt, Staphylococcus aureus subsp. aureus MW2
aaauucuuuugua

SEQ ID NO: 4032444 - RNA, 14 nt, Staphylococcus aureus subsp. aureus MW2
aaauucuuuuguaa

SEQ ID NO: 4032445 - RNA, 13 nt, Staphylococcus aureus subsp. aureus MW2
aaauugaaauuau

SEQ ID NO: 4032446 - RNA, 13 nt, Staphylococcus aureus subsp. aureus MW2
aaauugaacuuug

SEQ ID NO: 4032447 - RNA, 18 nt, Staphylococcus aureus subsp. aureus MW2
aaauugaacuuuguaucu

SEQ ID NO: 4032448 - RNA, 21 nt, Staphylococcus aureus subsp. aureus MW2
aacaauauuaaauuucugaac

SEQ ID NO: 4032449 - RNA, 13 nt, Staphylococcus aureus subsp. aureus MW2
aacaaucagauaa

SEQ ID NO: 4032450 - RNA, 19 nt, Staphylococcus aureus subsp. aureus MW2
aacaaucagauaaguuacu

SEQ ID NO: 4032451 - RNA, 15 nt, Staphylococcus aureus subsp. aureus MW2
aacaaucguuuuaau

SEQ ID NO: 4032452 - RNA, 18 nt, Staphylococcus aureus subsp. aureus MW2
aacaaucuccgguuuaau

SEQ ID NO: 4032453 - RNA, 16 nt, Staphylococcus aureus subsp. aureus MW2
aacaaugcaaguuggc

SEQ ID NO: 4032454 - RNA, 14 nt, Staphylococcus aureus subsp. aureus MW2
aacaauucauuaau

SEQ ID NO: 4032455 - RNA, 16 nt, Staphylococcus aureus subsp. aureus MW2
aacaauucuucaucau

SEQ ID NO: 4032456 - RNA, 18 nt, Staphylococcus aureus subsp. aureus MW2
aacaauugacguguaauc

SEQ ID NO: 4032457 - RNA, 15 nt, Staphylococcus aureus subsp. aureus MW2
aacaauuuauuaaaa

SEQ ID NO: 4032458 - RNA, 12 nt, Staphylococcus aureus subsp. aureus MW2
aacaauuuuaaa

SEQ ID NO: 4032459 - RNA, 22 nt, Staphylococcus aureus subsp. aureus MW2
aacaauuuuaauuuuucauuaa

SEQ ID NO: 4032460 - RNA, 16 nt, Staphylococcus aureus subsp. aureus MW2
aacaauuuuagacuac

SEQ ID NO: 4032461 - RNA, 16 nt, Staphylococcus aureus subsp. aureus MW2
aacaauuuuaucugaa

SEQ ID NO: 4032462 - RNA, 19 nt, Staphylococcus aureus subsp. aureus MW2
aacacaaaaaugaagaaua

SEQ ID NO: 4032463 - RNA, 20 nt, Staphylococcus aureus subsp. aureus MW2
aacacaaggaauauacaaua

SEQ ID NO: 4032464 - RNA, 18 nt, Staphylococcus aureus subsp. aureus MW2
aacacacuguugaaaaug

SEQ ID NO: 4032465 - RNA, 14 nt, Staphylococcus aureus subsp. aureus MW2
aacacagaagcuga

SEQ ID NO: 4032466 - RNA, 18 nt, Staphylococcus aureus subsp. aureus MW2
aacacagagaauuucgaa

SEQ ID NO: 4032467 - RNA, 16 nt, Staphylococcus aureus subsp. aureus MW2
aacacaguacaaauaa

SEQ ID NO: 4032468 - RNA, 17 nt, Staphylococcus aureus subsp. aureus MW2
aacacaguacaaauaac

SEQ ID NO: 4032469 - RNA, 14 nt, Staphylococcus aureus subsp. aureus MW2
aacacauaaauuaa

SEQ ID NO: 4032470 - RNA, 20 nt, Staphylococcus aureus subsp. aureus MW2
aacacauauuccgagaauua

SEQ ID NO: 4032471 - RNA, 11 nt, Staphylococcus aureus subsp. aureus MW2
aacacaucuau

SEQ ID NO: 4032472 - RNA, 19 nt, Staphylococcus aureus subsp. aureus MW2
aacacauucuuauuugaaa

SEQ ID NO: 4032473 - RNA, 14 nt, Staphylococcus aureus subsp. aureus MW2
aacaccaauauuuc

SEQ ID NO: 4032474 - RNA, 14 nt, Staphylococcus aureus subsp. aureus MW2
aacaccaauuaaau

SEQ ID NO: 4032475 - RNA, 12 nt, Staphylococcus aureus subsp. aureus MW2
aacaccaauuga

SEQ ID NO: 4032476 - RNA, 16 nt, Staphylococcus aureus subsp. aureus MW2
aacaccacacagcauu

SEQ ID NO: 4032477 - RNA, 19 nt, Staphylococcus aureus subsp. aureus MW2
aacaccauuauagacauaa

SEQ ID NO: 4032478 - RNA, 22 nt, Staphylococcus aureus subsp. aureus MW2
aacaccauuauagacauaagca

SEQ ID NO: 4032479 - RNA, 16 nt, Staphylococcus aureus subsp. aureus MW2
aacaccccagcuugac

SEQ ID NO: 4032480 - RNA, 19 nt, Staphylococcus aureus subsp. aureus MW2
aacaccccuucucuaaauu

SEQ ID NO: 4032481 - RNA, 20 nt, Staphylococcus aureus subsp. aureus MW2
aacaccgcaaugccacauca

SEQ ID NO: 4032482 - RNA, 14 nt, Staphylococcus aureus subsp. aureus MW2
aacaccuaauauuu

SEQ ID NO: 4032483 - RNA, 22 nt, Staphylococcus aureus subsp. aureus MW2
aacacgaaauugugaacuaaau

SEQ ID NO: 4032484 - RNA, 20 nt, Staphylococcus aureus subsp. aureus MW2
aacacgaacugcauagguaa

SEQ ID NO: 4032485 - RNA, 15 nt, Staphylococcus aureus subsp. aureus MW2
aacacgacaaucgaa

SEQ ID NO: 4032486 - RNA, 22 nt, Staphylococcus aureus subsp. aureus MW2
aacacgacaaucgaauguauug

SEQ ID NO: 4032487 - RNA, 20 nt, Staphylococcus aureus subsp. aureus MW2
aacacgauuugguugaacug

SEQ ID NO: 4032488 - RNA, 21 nt, Staphylococcus aureus subsp. aureus MW2
aacacggucgccaacaguaau

SEQ ID NO: 4032489 - RNA, 22 nt, Staphylococcus aureus subsp. aureus MW2
aacacggucgccaacaguaauu

SEQ ID NO: 4032490 - RNA, 21 nt, Staphylococcus aureus subsp. aureus MW2
aacacguucuugguauuuuuu

SEQ ID NO: 4032491 - RNA, 19 nt, Staphylococcus aureus subsp. aureus MW2
aacacguuuuaagccagca

SEQ ID NO: 4032492 - RNA, 17 nt, Staphylococcus aureus subsp. aureus MW2
aacacuagguacauaaa

SEQ ID NO: 4032493 - RNA, 21 nt, Staphylococcus aureus subsp. aureus MW2
aacacuggcguuaaagcuuuu

SEQ ID NO: 4032494 - RNA, 19 nt, Staphylococcus aureus subsp. aureus MW2
aacacuucguauugaauga

SEQ ID NO: 4032495 - RNA, 18 nt, Staphylococcus aureus subsp. aureus MW2
aacagaaccgaaaauaau

SEQ ID NO: 4032496 - RNA, 19 nt, Staphylococcus aureus subsp. aureus MW2
aacagaaccgaaaauaauc

SEQ ID NO: 4032497 - RNA, 13 nt, Staphylococcus aureus subsp. aureus MW2
aacagacuuuguu

SEQ ID NO: 4032498 - RNA, 21 nt, Staphylococcus aureus subsp. aureus MW2
aacagacuuuguuaaaaaauu

SEQ ID NO: 4032499 - RNA, 20 nt, Staphylococcus aureus subsp. aureus MW2
aacagcacauuuuuaguuag

SEQ ID NO: 4032500 - RNA, 18 nt, Staphylococcus aureus subsp. aureus MW2
aacagcaguaagauuauu

SEQ ID NO: 4032501 - RNA, 18 nt, Staphylococcus aureus subsp. aureus MW2
aacagcgcaucauaacuu

SEQ ID NO: 4032502 - RNA, 14 nt, Staphylococcus aureus subsp. aureus MW2
aacagcuaaaaauu

SEQ ID NO: 4032503 - RNA, 15 nt, Staphylococcus aureus subsp. aureus MW2
aacagcuucaaaauc

SEQ ID NO: 4032504 - RNA, 20 nt, Staphylococcus aureus subsp. aureus MW2
aacagcuuuuucuacaccua

SEQ ID NO: 4032505 - RNA, 20 nt, Staphylococcus aureus subsp. aureus MW2
aacaggcuuagcuaauucau

SEQ ID NO: 4032506 - RNA, 15 nt, Staphylococcus aureus subsp. aureus MW2
aacagguuaucacaa

SEQ ID NO: 4032507 - RNA, 13 nt, Staphylococcus aureus subsp. aureus MW2
aacaguaauuuuu

SEQ ID NO: 4032508 - RNA, 15 nt, Staphylococcus aureus subsp. aureus MW2
aacaguauaaauauu

SEQ ID NO: 4032509 - RNA, 18 nt, Staphylococcus aureus subsp. aureus MW2
aacagucccaaccccuuu

SEQ ID NO: 4032510 - RNA, 20 nt, Staphylococcus aureus subsp. aureus MW2
aacaguggaauacagaugau

SEQ ID NO: 4032511 - RNA, 16 nt, Staphylococcus aureus subsp. aureus MW2
aacaguguagcacaag

SEQ ID NO: 4032512 - RNA, 17 nt, Staphylococcus aureus subsp. aureus MW2
aacaguuagaaacagaa

SEQ ID NO: 4032513 - RNA, 18 nt, Staphylococcus aureus subsp. aureus MW2
aacaguuagaaacagaau

SEQ ID NO: 4032514 - RNA, 20 nt, Staphylococcus aureus subsp. aureus MW2
aacaguuagaaacagaauua

SEQ ID NO: 4032515 - RNA, 21 nt, Staphylococcus aureus subsp. aureus MW2
aacaguuagaaacagaauuau

SEQ ID NO: 4032516 - RNA, 18 nt, Staphylococcus aureus subsp. aureus MW2
aacaguuuuauuaucuuu

SEQ ID NO: 4032517 - RNA, 19 nt, Staphylococcus aureus subsp. aureus MW2
aacaguuuuauuaucuuug

SEQ ID NO: 4032518 - RNA, 12 nt, Staphylococcus aureus subsp. aureus MW2
aacauaaaaaua

SEQ ID NO: 4032519 - RNA, 14 nt, Staphylococcus aureus subsp. aureus MW2
aacauaaaaauauu

SEQ ID NO: 4032520 - RNA, 17 nt, Staphylococcus aureus subsp. aureus MW2
aacauaaaaauauucaa

SEQ ID NO: 4032521 - RNA, 18 nt, Staphylococcus aureus subsp. aureus MW2
aacauaauaauaauacaa

SEQ ID NO: 4032522 - RNA, 23 nt, Staphylococcus aureus subsp. aureus MW2
aacauaauaauaauacaauuuua

SEQ ID NO: 4032523 - RNA, 13 nt, Staphylococcus aureus subsp. aureus MW2
aacauaauauuuc

SEQ ID NO: 4032524 - RNA, 15 nt, Staphylococcus aureus subsp. aureus MW2
aacauaauauuuuga

SEQ ID NO: 4032525 - RNA, 13 nt, Staphylococcus aureus subsp. aureus MW2
aacauaaucauaa

SEQ ID NO: 4032526 - RNA, 22 nt, Staphylococcus aureus subsp. aureus MW2
aacauagaagcuggcggaaagu

SEQ ID NO: 4032527 - RNA, 24 nt, Staphylococcus aureus subsp. aureus MW2
aacauagaagcuggcggaaaguca

SEQ ID NO: 4032528 - RNA, 15 nt, Staphylococcus aureus subsp. aureus MW2
aacauagagaauuuc

SEQ ID NO: 4032529 - RNA, 21 nt, Staphylococcus aureus subsp. aureus MW2
aacauagcuuaauaauuaaua

SEQ ID NO: 4032530 - RNA, 15 nt, Staphylococcus aureus subsp. aureus MW2
aacauauaaaucauu

SEQ ID NO: 4032531 - RNA, 15 nt, Staphylococcus aureus subsp. aureus MW2
aacauauagauaucu

SEQ ID NO: 4032532 - RNA, 16 nt, Staphylococcus aureus subsp. aureus MW2
aacauauuauaaaagu

SEQ ID NO: 4032533 - RNA, 13 nt, Staphylococcus aureus subsp. aureus MW2
aacauauuauaua

SEQ ID NO: 4032534 - RNA, 23 nt, Staphylococcus aureus subsp. aureus MW2
aacauauucaguauauguauaga

SEQ ID NO: 4032535 - RNA, 14 nt, Staphylococcus aureus subsp. aureus MW2
aacauauucauaau

SEQ ID NO: 4032536 - RNA, 18 nt, Staphylococcus aureus subsp. aureus MW2
aacauauucauaauaucg

SEQ ID NO: 4032537 - RNA, 14 nt, Staphylococcus aureus subsp. aureus MW2
aaccguauuauuag

SEQ ID NO: 4032538 - RNA, 15 nt, Staphylococcus aureus subsp. aureus MW2
aaccguuauauauua

SEQ ID NO: 4032539 - RNA, 14 nt, Staphylococcus aureus subsp. aureus MW2
aaccuaaaaacaaa

SEQ ID NO: 4032540 - RNA, 18 nt, Staphylococcus aureus subsp. aureus MW2
aaccuaaaaacagcagua

SEQ ID NO: 4032541 - RNA, 20 nt, Staphylococcus aureus subsp. aureus MW2
aaccuaaagauaauauuaaa

SEQ ID NO: 4032542 - RNA, 23 nt, Staphylococcus aureus subsp. aureus MW2
aaccuaaucugccguguuuugua

SEQ ID NO: 4032543 - RNA, 12 nt, Staphylococcus aureus subsp. aureus MW2
aaccuacaauau

SEQ ID NO: 4032544 - RNA, 18 nt, Staphylococcus aureus subsp. aureus MW2
aaccuaccuauuugauua

SEQ ID NO: 4032545 - RNA, 19 nt, Staphylococcus aureus subsp. aureus MW2
aaccuaccuauuugauuaa

SEQ ID NO: 4032546 - RNA, 23 nt, Staphylococcus aureus subsp. aureus MW2
aaccuagggauaauuuuauugac

SEQ ID NO: 4032547 - RNA, 14 nt, Staphylococcus aureus subsp. aureus MW2
aaccuauauuaagc

SEQ ID NO: 4032548 - RNA, 20 nt, Staphylococcus aureus subsp. aureus MW2
aaccuauuaaaauaaaccac

SEQ ID NO: 4032549 - RNA, 13 nt, Staphylococcus aureus subsp. aureus MW2
aaccuauuaauua

SEQ ID NO: 4032550 - RNA, 18 nt, Staphylococcus aureus subsp. aureus MW2
aaccucuaaauaaaauua

SEQ ID NO: 4032551 - RNA, 21 nt, Staphylococcus aureus subsp. aureus MW2
aaccugacuuuccgccagcuu

SEQ ID NO: 4032552 - RNA, 22 nt, Staphylococcus aureus subsp. aureus MW2
aaccugucuuaauucauuccaa

SEQ ID NO: 4032553 - RNA, 13 nt, Staphylococcus aureus subsp. aureus MW2
aaccuucaguaac

SEQ ID NO: 4032554 - RNA, 13 nt, Staphylococcus aureus subsp. aureus MW2
aaccuugauuuaa

SEQ ID NO: 4032555 - RNA, 20 nt, Staphylococcus aureus subsp. aureus MW2
aaccuugauuuaauuuuuaa

SEQ ID NO: 4032556 - RNA, 11 nt, Staphylococcus aureus subsp. aureus MW2
aaccuuuaaaa

SEQ ID NO: 4032557 - RNA, 16 nt, Staphylococcus aureus subsp. aureus MW2
aaccuuugcuaaauca

SEQ ID NO: 4032558 - RNA, 15 nt, Staphylococcus aureus subsp. aureus MW2
aaccuuuucaaacua

SEQ ID NO: 4032559 - RNA, 15 nt, Staphylococcus aureus subsp. aureus MW2
aacgaaaauuaagau

SEQ ID NO: 4032560 - RNA, 20 nt, Staphylococcus aureus subsp. aureus MW2
aacgaaaauuaagaugaaau

SEQ ID NO: 4032561 - RNA, 21 nt, Staphylococcus aureus subsp. aureus MW2
aacgaaaauuaagaugaaaua

SEQ ID NO: 4032562 - RNA, 23 nt, Staphylococcus aureus subsp. aureus MW2
aacgaaaauuaagaugaaauacu

SEQ ID NO: 4032563 - RNA, 18 nt, Staphylococcus aureus subsp. aureus MW2
aacgaaggucuacuaaau

SEQ ID NO: 4032564 - RNA, 23 nt, Staphylococcus aureus subsp. aureus MW2
aacgaaggucuacuaaauaacua

SEQ ID NO: 4032565 - RNA, 21 nt, Staphylococcus aureus subsp. aureus MW2
aacgaagucagucaauucaaa

SEQ ID NO: 4032566 - RNA, 17 nt, Staphylococcus aureus subsp. aureus MW2
aacgaauguuccuuguu

SEQ ID NO: 4032567 - RNA, 22 nt, Staphylococcus aureus subsp. aureus MW2
aacgacaacuugaacuaaaaca

SEQ ID NO: 4032568 - RNA, 18 nt, Staphylococcus aureus subsp. aureus MW2
aacgacaugaaaguuguu

SEQ ID NO: 4032569 - RNA, 17 nt, Staphylococcus aureus subsp. aureus MW2
aacgagagagaaaagcu

SEQ ID NO: 4032570 - RNA, 18 nt, Staphylococcus aureus subsp. aureus MW2
aacgagagagaaaagcua

SEQ ID NO: 4032571 - RNA, 17 nt, Staphylococcus aureus subsp. aureus MW2
aacgagcuggugagaaa

SEQ ID NO: 4032572 - RNA, 22 nt, Staphylococcus aureus subsp. aureus MW2
aacgagcuggugagaaauugaa

SEQ ID NO: 4032573 - RNA, 21 nt, Staphylococcus aureus subsp. aureus MW2
aacgauaacaauuuauuaaaa

SEQ ID NO: 4032574 - RNA, 15 nt, Staphylococcus aureus subsp. aureus MW2
aacgauaccaaauau

SEQ ID NO: 4032575 - RNA, 20 nt, Staphylococcus aureus subsp. aureus MW2
aacgauaccuuuaauaauau

SEQ ID NO: 4032576 - RNA, 18 nt, Staphylococcus aureus subsp. aureus MW2
aacgauagacauugagau

SEQ ID NO: 4032577 - RNA, 23 nt, Staphylococcus aureus subsp. aureus MW2
aacgauagauucugauacagaac

SEQ ID NO: 4032578 - RNA, 13 nt, Staphylococcus aureus subsp. aureus MW2
aacgauauuuuaa

SEQ ID NO: 4032579 - RNA, 17 nt, Staphylococcus aureus subsp. aureus MW2
aacgaugcuacuuaaag

SEQ ID NO: 4032580 - RNA, 22 nt, Staphylococcus aureus subsp. aureus MW2
aacgcaagcauaucuuuaucau

SEQ ID NO: 4032581 - RNA, 21 nt, Staphylococcus aureus subsp. aureus MW2
aacgcaccuggcacaaaugcu

SEQ ID NO: 4032582 - RNA, 20 nt, Staphylococcus aureus subsp. aureus MW2
aacgcaucacggccuucuuu

SEQ ID NO: 4032583 - RNA, 13 nt, Staphylococcus aureus subsp. aureus MW2
aacgcauuucaug

SEQ ID NO: 4032584 - RNA, 16 nt, Staphylococcus aureus subsp. aureus MW2
aacgccgaauaaucca

SEQ ID NO: 4032585 - RNA, 18 nt, Staphylococcus aureus subsp. aureus MW2
aacgccucaacacuuucu

SEQ ID NO: 4032586 - RNA, 21 nt, Staphylococcus aureus subsp. aureus MW2
aacgcuuauacuauauaauaa

SEQ ID NO: 4032587 - RNA, 13 nt, Staphylococcus aureus subsp. aureus MW2
aacgcuuuaaauc

SEQ ID NO: 4032588 - RNA, 20 nt, Staphylococcus aureus subsp. aureus MW2
aacgcuuuguuuuuaguaau

SEQ ID NO: 4032589 - RNA, 14 nt, Staphylococcus aureus subsp. aureus MW2
aacggaaauaacca

SEQ ID NO: 4032590 - RNA, 15 nt, Staphylococcus aureus subsp. aureus MW2
aacgggaacaucaua

SEQ ID NO: 4032591 - RNA, 20 nt, Staphylococcus aureus subsp. aureus MW2
aacgguacagauaagaauau

SEQ ID NO: 4032592 - RNA, 14 nt, Staphylococcus aureus subsp. aureus MW2
aacgguagaauaaa

SEQ ID NO: 4032593 - RNA, 16 nt, Staphylococcus aureus subsp. aureus MW2
aacgguagaauaaaag

SEQ ID NO: 4032594 - RNA, 16 nt, Staphylococcus aureus subsp. aureus MW2
aacguaaacaugguuc

SEQ ID NO: 4032595 - RNA, 17 nt, Staphylococcus aureus subsp. aureus MW2
aacguacauuuuuauga

SEQ ID NO: 4032596 - RNA, 21 nt, Staphylococcus aureus subsp. aureus MW2
aacguacuguguaauaccaau

SEQ ID NO: 4032597 - RNA, 18 nt, Staphylococcus aureus subsp. aureus MW2
aacguauauaaguuaaaa

SEQ ID NO: 4032598 - RNA, 12 nt, Staphylococcus aureus subsp. aureus MW2
aacgucacuuua

SEQ ID NO: 4032599 - RNA, 18 nt, Staphylococcus aureus subsp. aureus MW2
aacguuauucguuaacaa

SEQ ID NO: 4032600 - RNA, 20 nt, Staphylococcus aureus subsp. aureus MW2
aacguuauucguuaacaauc

SEQ ID NO: 4032601 - RNA, 16 nt, Staphylococcus aureus subsp. aureus MW2
aacguuauuuucaaua

SEQ ID NO: 4032602 - RNA, 19 nt, Staphylococcus aureus subsp. aureus MW2
aacguucaaucguuucuuc

SEQ ID NO: 4032603 - RNA, 20 nt, Staphylococcus aureus subsp. aureus MW2
aacguucaaucguuucuucc

SEQ ID NO: 4032604 - RNA, 17 nt, Staphylococcus aureus subsp. aureus MW2
aacguugaguauuacuu

SEQ ID NO: 4032605 - RNA, 23 nt, Staphylococcus aureus subsp. aureus MW2
aacguugccauacccauauuaaa

SEQ ID NO: 4032606 - RNA, 15 nt, Staphylococcus aureus subsp. aureus MW2
aacguuuauuuuuau

SEQ ID NO: 4032607 - RNA, 13 nt, Staphylococcus aureus subsp. aureus MW2
aacguuugaaaaa

SEQ ID NO: 4032608 - RNA, 13 nt, Staphylococcus aureus subsp. aureus MW2
aacguuuucacuu

SEQ ID NO: 4032609 - RNA, 14 nt, Staphylococcus aureus subsp. aureus MW2
aacuaaaacaauaa

SEQ ID NO: 4032610 - RNA, 20 nt, Staphylococcus aureus subsp. aureus MW2
aacuaaagguauucuauuuu

SEQ ID NO: 4032611 - RNA, 23 nt, Staphylococcus aureus subsp. aureus MW2
aacuaaaucaccauuuuuuacaa

SEQ ID NO: 4032612 - RNA, 15 nt, Staphylococcus aureus subsp. aureus MW2
aacuaagauauuuag

SEQ ID NO: 4032613 - RNA, 15 nt, Staphylococcus aureus subsp. aureus MW2
aacuaauaauuugua

SEQ ID NO: 4032614 - RNA, 17 nt, Staphylococcus aureus subsp. aureus MW2
aacuaauagcauuugua

SEQ ID NO: 4032615 - RNA, 13 nt, Staphylococcus aureus subsp. aureus MW2
aacuaauuuaaag

SEQ ID NO: 4032616 - RNA, 16 nt, Staphylococcus aureus subsp. aureus MW2
aacuaauuuaaagcau

SEQ ID NO: 4032617 - RNA, 13 nt, Staphylococcus aureus subsp. aureus MW2
aacuacaauucau

SEQ ID NO: 4032618 - RNA, 18 nt, Staphylococcus aureus subsp. aureus MW2
aacuacaauucauaagaa

SEQ ID NO: 4032619 - RNA, 23 nt, Staphylococcus aureus subsp. aureus MW2
aacuacaauucauaagaaaaaug

SEQ ID NO: 4032620 - RNA, 22 nt, Staphylococcus aureus subsp. aureus MW2
aacuacacacguagaaagaugu

SEQ ID NO: 4032621 - RNA, 20 nt, Staphylococcus aureus subsp. aureus MW2
aacuacgauaccggcaacug

SEQ ID NO: 4032622 - RNA, 23 nt, Staphylococcus aureus subsp. aureus MW2
aacuacgcauuuuaaauaaaaug

SEQ ID NO: 4032623 - RNA, 16 nt, Staphylococcus aureus subsp. aureus MW2
aacuacugcaacacca

SEQ ID NO: 4032624 - RNA, 16 nt, Staphylococcus aureus subsp. aureus MW2
aacuacugcuaaaaua

SEQ ID NO: 4032625 - RNA, 19 nt, Staphylococcus aureus subsp. aureus MW2
aacuuugucuguauuauua

SEQ ID NO: 4032626 - RNA, 13 nt, Staphylococcus aureus subsp. aureus MW2
aacuuuuacuuuc

SEQ ID NO: 4032627 - RNA, 13 nt, Staphylococcus aureus subsp. aureus MW2
aacuuuuuuaacu

SEQ ID NO: 4032628 - RNA, 14 nt, Staphylococcus aureus subsp. aureus MW2
aacuuuuuuaacuu

SEQ ID NO: 4032629 - RNA, 15 nt, Staphylococcus aureus subsp. aureus MW2
aacuuuuuuaacuuu

SEQ ID NO: 4032630 - RNA, 21 nt, Staphylococcus aureus subsp. aureus MW2
aagaaaaagugauaauuaaaa

SEQ ID NO: 4032631 - RNA, 22 nt, Staphylococcus aureus subsp. aureus MW2
aagaaaaagugauaauuaaaau

SEQ ID NO: 4032632 - RNA, 21 nt, Staphylococcus aureus subsp. aureus MW2
aagaaaaauguguuaaaauau

SEQ ID NO: 4032633 - RNA, 24 nt, Staphylococcus aureus subsp. aureus MW2
aagaaaaauguguuaaaauauauu

SEQ ID NO: 4032634 - RNA, 21 nt, Staphylococcus aureus subsp. aureus MW2
aagaaaaauuuucuugguuug

SEQ ID NO: 4032635 - RNA, 22 nt, Staphylococcus aureus subsp. aureus MW2
aagaaaacagguuaucacaaca

SEQ ID NO: 4032636 - RNA, 13 nt, Staphylococcus aureus subsp. aureus MW2
aagaaaauacuaa

SEQ ID NO: 4032637 - RNA, 16 nt, Staphylococcus aureus subsp. aureus MW2
aagaaaucaacaacuu

SEQ ID NO: 4032638 - RNA, 12 nt, Staphylococcus aureus subsp. aureus MW2
aagaaauuuuuu

SEQ ID NO: 4032639 - RNA, 15 nt, Staphylococcus aureus subsp. aureus MW2
aagaacuugcuuuuc

SEQ ID NO: 4032640 - RNA, 15 nt, Staphylococcus aureus subsp. aureus MW2
aagaacuuuaaaaau

SEQ ID NO: 4032641 - RNA, 18 nt, Staphylococcus aureus subsp. aureus MW2
aagaagauuaugaaaaca

SEQ ID NO: 4032642 - RNA, 22 nt, Staphylococcus aureus subsp. aureus MW2
aagaagauuaugaaaacauuau

SEQ ID NO: 4032643 - RNA, 22 nt, Staphylococcus aureus subsp. aureus MW2
aagaagcuggcggaaagucagg

SEQ ID NO: 4032644 - RNA, 19 nt, Staphylococcus aureus subsp. aureus MW2
aagaaggaugaguuuaaaa

SEQ ID NO: 4032645 - RNA, 21 nt, Staphylococcus aureus subsp. aureus MW2
aagaaggaugaguuuaaaaau

SEQ ID NO: 4032646 - RNA, 18 nt, Staphylococcus aureus subsp. aureus MW2
aagaagucgaauucaccu

SEQ ID NO: 4032647 - RNA, 19 nt, Staphylococcus aureus subsp. aureus MW2
aagaauaaaaaaguugauu

SEQ ID NO: 4032648 - RNA, 15 nt, Staphylococcus aureus subsp. aureus MW2
aagaauacaaauauu

SEQ ID NO: 4032649 - RNA, 15 nt, Staphylococcus aureus subsp. aureus MW2
aagaauauaacgaau

SEQ ID NO: 4032650 - RNA, 21 nt, Staphylococcus aureus subsp. aureus MW2
aagaauccuaugccaaauaac

SEQ ID NO: 4032651 - RNA, 16 nt, Staphylococcus aureus subsp. aureus MW2
aagaaugauuuauaaa

SEQ ID NO: 4032652 - RNA, 19 nt, Staphylococcus aureus subsp. aureus MW2
aagaaugcaccaacaauag

SEQ ID NO: 4032653 - RNA, 17 nt, Staphylococcus aureus subsp. aureus MW2
aagaaugcgaagauuuu

SEQ ID NO: 4032654 - RNA, 18 nt, Staphylococcus aureus subsp. aureus MW2
aagaauguuucauaugca

SEQ ID NO: 4032655 - RNA, 22 nt, Staphylococcus aureus subsp. aureus MW2
aagaauuaacaacaaauauaau

SEQ ID NO: 4032656 - RNA, 21 nt, Staphylococcus aureus subsp. aureus MW2
aagaauuaauucgccuaaaug

SEQ ID NO: 4032657 - RNA, 19 nt, Staphylococcus aureus subsp. aureus MW2
aagaauuauucaaguaaaa

SEQ ID NO: 4032658 - RNA, 17 nt, Staphylococcus aureus subsp. aureus MW2
aagaauuguugaucaug

SEQ ID NO: 4032659 - RNA, 16 nt, Staphylococcus aureus subsp. aureus MW2
aagacagguuacuuuu

SEQ ID NO: 4032660 - RNA, 19 nt, Staphylococcus aureus subsp. aureus MW2
aagacauaaacaauaauuu

SEQ ID NO: 4032661 - RNA, 20 nt, Staphylococcus aureus subsp. aureus MW2
aagacauacagucaauacaa

SEQ ID NO: 4032662 - RNA, 12 nt, Staphylococcus aureus subsp. aureus MW2
aagacauaugca

SEQ ID NO: 4032663 - RNA, 16 nt, Staphylococcus aureus subsp. aureus MW2
aagaccaaauauuuua

SEQ ID NO: 4032664 - RNA, 22 nt, Staphylococcus aureus subsp. aureus MW2
aagaccaaauauuuuaucugua

SEQ ID NO: 4032665 - RNA, 13 nt, Staphylococcus aureus subsp. aureus MW2
aagaccauuuuau

SEQ ID NO: 4032666 - RNA, 19 nt, Staphylococcus aureus subsp. aureus MW2
aagaccauuuuauauuuua

SEQ ID NO: 4032667 - RNA, 20 nt, Staphylococcus aureus subsp. aureus MW2
aagaccauuuuauauuuuag

SEQ ID NO: 4032668 - RNA, 19 nt, Staphylococcus aureus subsp. aureus MW2
aagaccguauuuuuuuaua

SEQ ID NO: 4032669 - RNA, 15 nt, Staphylococcus aureus subsp. aureus MW2
aagaccuucuaaaau

SEQ ID NO: 4032670 - RNA, 18 nt, Staphylococcus aureus subsp. aureus MW2
aagaccuucuaaaaucgu

SEQ ID NO: 4032671 - RNA, 22 nt, Staphylococcus aureus subsp. aureus MW2
aagacgauuuauuaguuuuuac

SEQ ID NO: 4032672 - RNA, 16 nt, Staphylococcus aureus subsp. aureus MW2
aagacucaauuucauu

SEQ ID NO: 4032673 - RNA, 12 nt, Staphylococcus aureus subsp. aureus MW2
aagacuucccua

SEQ ID NO: 4032674 - RNA, 21 nt, Staphylococcus aureus subsp. aureus MW2
aagacuuggugcccaaguuuc

SEQ ID NO: 4032675 - RNA, 13 nt, Staphylococcus aureus subsp. aureus MW2
aagagaaaagcua

SEQ ID NO: 4032676 - RNA, 17 nt, Staphylococcus aureus subsp. aureus MW2
aagagaauauaaaauaa

SEQ ID NO: 4032677 - RNA, 15 nt, Staphylococcus aureus subsp. aureus MW2
aagagauaagaaaau

SEQ ID NO: 4032678 - RNA, 21 nt, Staphylococcus aureus subsp. aureus MW2
aagagauacugguuaguaaaa

SEQ ID NO: 4032679 - RNA, 18 nt, Staphylococcus aureus subsp. aureus MW2
aagagauuuuuuugaaaa

SEQ ID NO: 4032680 - RNA, 14 nt, Staphylococcus aureus subsp. aureus MW2
aagagcaauuaaag

SEQ ID NO: 4032681 - RNA, 22 nt, Staphylococcus aureus subsp. aureus MW2
aagagcuuuuaguaaauaauuu

SEQ ID NO: 4032682 - RNA, 15 nt, Staphylococcus aureus subsp. aureus MW2
aagaggcaggaauga

SEQ ID NO: 4032683 - RNA, 19 nt, Staphylococcus aureus subsp. aureus MW2
aagagguauacaguuaugc

SEQ ID NO: 4032684 - RNA, 13 nt, Staphylococcus aureus subsp. aureus MW2
aagaggucuccaa

SEQ ID NO: 4032685 - RNA, 19 nt, Staphylococcus aureus subsp. aureus MW2
aagaggucuccaauacuuu

SEQ ID NO: 4032686 - RNA, 16 nt, Staphylococcus aureus subsp. aureus MW2
aagaguaaaguuaaaa

SEQ ID NO: 4032687 - RNA, 20 nt, Staphylococcus aureus subsp. aureus MW2
aagaguaaaguuaaaagcuu

SEQ ID NO: 4032688 - RNA, 16 nt, Staphylococcus aureus subsp. aureus MW2
aagaguuaauaaaauu

SEQ ID NO: 4032689 - RNA, 15 nt, Staphylococcus aureus subsp. aureus MW2
aagauaaacaagcca

SEQ ID NO: 4032690 - RNA, 23 nt, Staphylococcus aureus subsp. aureus MW2
aagauaaauaaaaggcauucuuc

SEQ ID NO: 4032691 - RNA, 14 nt, Staphylococcus aureus subsp. aureus MW2
aagauaauauuaaa

SEQ ID NO: 4032692 - RNA, 12 nt, Staphylococcus aureus subsp. aureus MW2
aagauacaccaa

SEQ ID NO: 4032693 - RNA, 21 nt, Staphylococcus aureus subsp. aureus MW2
aagauacguugauguaauucu

SEQ ID NO: 4032694 - RNA, 22 nt, Staphylococcus aureus subsp. aureus MW2
aagauagagcccuuagcaauau

SEQ ID NO: 4032695 - RNA, 17 nt, Staphylococcus aureus subsp. aureus MW2
aagauaguuugagaaaa

SEQ ID NO: 4032696 - RNA, 15 nt, Staphylococcus aureus subsp. aureus MW2
aagauauaaacauuu

SEQ ID NO: 4032697 - RNA, 13 nt, Staphylococcus aureus subsp. aureus MW2
aagauauaagaaa

SEQ ID NO: 4032698 - RNA, 19 nt, Staphylococcus aureus subsp. aureus MW2
aagauauaagaaaaagacg

SEQ ID NO: 4032699 - RNA, 18 nt, Staphylococcus aureus subsp. aureus MW2
aagauauuuccaaauuga

SEQ ID NO: 4032700 - RNA, 19 nt, Staphylococcus aureus subsp. aureus MW2
aagauauuucuguuuuccu

SEQ ID NO: 4032701 - RNA, 21 nt, Staphylococcus aureus subsp. aureus MW2
aagaucacacgacauguaggu

SEQ ID NO: 4032702 - RNA, 19 nt, Staphylococcus aureus subsp. aureus MW2
aagaugauuauucucuuua

SEQ ID NO: 4032703 - RNA, 21 nt, Staphylococcus aureus subsp. aureus MW2
aagaugauuauucucuuuauu

SEQ ID NO: 4032704 - RNA, 21 nt, Staphylococcus aureus subsp. aureus MW2
aagaugcuuuaauuaaaguua

SEQ ID NO: 4032705 - RNA, 18 nt, Staphylococcus aureus subsp. aureus MW2
aagaugguuuuguuuugc

SEQ ID NO: 4032706 - RNA, 15 nt, Staphylococcus aureus subsp. aureus MW2
aagauguauaugaau

SEQ ID NO: 4032707 - RNA, 16 nt, Staphylococcus aureus subsp. aureus MW2
aagauguguugaaacu

SEQ ID NO: 4032708 - RNA, 16 nt, Staphylococcus aureus subsp. aureus MW2
aagauguugaaaagua

SEQ ID NO: 4032709 - RNA, 21 nt, Staphylococcus aureus subsp. aureus MW2
aagauguuugcaacauauuuu

SEQ ID NO: 4032710 - RNA, 20 nt, Staphylococcus aureus subsp. aureus MW2
aagauuagaugauauuuaac

SEQ ID NO: 4032711 - RNA, 19 nt, Staphylococcus aureus subsp. aureus MW2
aagauuagcuaugaacgaa

SEQ ID NO: 4032712 - RNA, 16 nt, Staphylococcus aureus subsp. aureus MW2
aagauuaugaaaacau

SEQ ID NO: 4032713 - RNA, 16 nt, Staphylococcus aureus subsp. aureus MW2
aagucauuaaauguac

SEQ ID NO: 4032714 - RNA, 16 nt, Staphylococcus aureus subsp. aureus MW2
aagucauuuucauuca

SEQ ID NO: 4032715 - RNA, 12 nt, Staphylococcus aureus subsp. aureus MW2
aaguccaauaca

SEQ ID NO: 4032716 - RNA, 17 nt, Staphylococcus aureus subsp. aureus MW2
aaguccggcugaaggga

SEQ ID NO: 4032717 - RNA, 12 nt, Staphylococcus aureus subsp. aureus MW2
aagucgaaagua

SEQ ID NO: 4032718 - RNA, 20 nt, Staphylococcus aureus subsp. aureus MW2
aagucgcucuagacauuaca

SEQ ID NO: 4032719 - RNA, 22 nt, Staphylococcus aureus subsp. aureus MW2
aagucguucucuuaaauaugaa

SEQ ID NO: 4032720 - RNA, 18 nt, Staphylococcus aureus subsp. aureus MW2
aagucuaauguuggaaaa

SEQ ID NO: 4032721 - RNA, 16 nt, Staphylococcus aureus subsp. aureus MW2
aagucucauuaucacc

SEQ ID NO: 4032722 - RNA, 17 nt, Staphylococcus aureus subsp. aureus MW2
aagucucuugucauuuc

SEQ ID NO: 4032723 - RNA, 20 nt, Staphylococcus aureus subsp. aureus MW2
aagucugcugguaacucuuc

SEQ ID NO: 4032724 - RNA, 16 nt, Staphylococcus aureus subsp. aureus MW2
aagucuguauauggcg

SEQ ID NO: 4032725 - RNA, 16 nt, Staphylococcus aureus subsp. aureus MW2
aagucuguugguuuau

SEQ ID NO: 4032726 - RNA, 21 nt, Staphylococcus aureus subsp. aureus MW2
aagucuucaucuuuaaagaaa

SEQ ID NO: 4032727 - RNA, 17 nt, Staphylococcus aureus subsp. aureus MW2
aagucuuucaacaaaau

SEQ ID NO: 4032728 - RNA, 20 nt, Staphylococcus aureus subsp. aureus MW2
aagugaaaguauuagauaua

SEQ ID NO: 4032729 - RNA, 17 nt, Staphylococcus aureus subsp. aureus MW2
aagugaaaucauuuaaa

SEQ ID NO: 4032730 - RNA, 18 nt, Staphylococcus aureus subsp. aureus MW2
aagugaaaucauuuaaau

SEQ ID NO: 4032731 - RNA, 16 nt, Staphylococcus aureus subsp. aureus MW2
aagugaaguuguauaa

SEQ ID NO: 4032732 - RNA, 19 nt, Staphylococcus aureus subsp. aureus MW2
aagugaauaauugagaaaa

SEQ ID NO: 4032733 - RNA, 18 nt, Staphylococcus aureus subsp. aureus MW2
aagugacaucguugcuuu

SEQ ID NO: 4032734 - RNA, 14 nt, Staphylococcus aureus subsp. aureus MW2
aagugacuuaauau

SEQ ID NO: 4032735 - RNA, 14 nt, Staphylococcus aureus subsp. aureus MW2
aagugauaauuaaa

SEQ ID NO: 4032736 - RNA, 15 nt, Staphylococcus aureus subsp. aureus MW2
aagugaugaccaaua

SEQ ID NO: 4032737 - RNA, 19 nt, Staphylococcus aureus subsp. aureus MW2
aagugaugaccaauauucu

SEQ ID NO: 4032738 - RNA, 19 nt, Staphylococcus aureus subsp. aureus MW2
aagugcagauguugguuca

SEQ ID NO: 4032739 - RNA, 23 nt, Staphylococcus aureus subsp. aureus MW2
aagugcgguuuaaucuauauaua

SEQ ID NO: 4032740 - RNA, 23 nt, Staphylococcus aureus subsp. aureus MW2
aagugcuaagagguauacaguua

SEQ ID NO: 4032741 - RNA, 20 nt, Staphylococcus aureus subsp. aureus MW2
aagugcuugauuaacauuuu

SEQ ID NO: 4032742 - RNA, 15 nt, Staphylococcus aureus subsp. aureus MW2
aagugggaaacauuu

SEQ ID NO: 4032743 - RNA, 14 nt, Staphylococcus aureus subsp. aureus MW2
aagugggauaugaa

SEQ ID NO: 4032744 - RNA, 17 nt, Staphylococcus aureus subsp. aureus MW2
aagugguaaaaaugaac

SEQ ID NO: 4032745 - RNA, 19 nt, Staphylococcus aureus subsp. aureus MW2
aaguguagccaaauaaauu

SEQ ID NO: 4032746 - RNA, 21 nt, Staphylococcus aureus subsp. aureus MW2
aaguguagccaaauaaauuuu

SEQ ID NO: 4032747 - RNA, 14 nt, Staphylococcus aureus subsp. aureus MW2
aaguguauauagua

SEQ ID NO: 4032748 - RNA, 15 nt, Staphylococcus aureus subsp. aureus MW2
aaguguuaaugucuu

SEQ ID NO: 4032749 - RNA, 14 nt, Staphylococcus aureus subsp. aureus MW2
aaguguuauaaaua

SEQ ID NO: 4032750 - RNA, 19 nt, Staphylococcus aureus subsp. aureus MW2
aaguguugaccauuaucaa

SEQ ID NO: 4032751 - RNA, 20 nt, Staphylococcus aureus subsp. aureus MW2
aaguguuucaacauauuaua

SEQ ID NO: 4032752 - RNA, 12 nt, Staphylococcus aureus subsp. aureus MW2
aaguuaaaaccu

SEQ ID NO: 4032753 - RNA, 19 nt, Staphylococcus aureus subsp. aureus MW2
aaguuaaaauugguuugga

SEQ ID NO: 4032754 - RNA, 18 nt, Staphylococcus aureus subsp. aureus MW2
aaguuaacuauaacaaua

SEQ ID NO: 4032755 - RNA, 18 nt, Staphylococcus aureus subsp. aureus MW2
aaguuaagucgccuaacu

SEQ ID NO: 4032756 - RNA, 15 nt, Staphylococcus aureus subsp. aureus MW2
aaguuaaucagaaaa

SEQ ID NO: 4032757 - RNA, 20 nt, Staphylococcus aureus subsp. aureus MW2
aaguuaaucagaaaagcagu

SEQ ID NO: 4032758 - RNA, 17 nt, Staphylococcus aureus subsp. aureus MW2
aaguuaauuauguauuu

SEQ ID NO: 4032759 - RNA, 15 nt, Staphylococcus aureus subsp. aureus MW2
aaguuacgauaucau

SEQ ID NO: 4032760 - RNA, 22 nt, Staphylococcus aureus subsp. aureus MW2
aaguuacgauaucauacgcaac

SEQ ID NO: 4032761 - RNA, 19 nt, Staphylococcus aureus subsp. aureus MW2
aaguuagacuaaaaaacua

SEQ ID NO: 4032762 - RNA, 18 nt, Staphylococcus aureus subsp. aureus MW2
aaguuaggcgacuuaacu

SEQ ID NO: 4032763 - RNA, 12 nt, Staphylococcus aureus subsp. aureus MW2
aaguuauaucau

SEQ ID NO: 4032764 - RNA, 21 nt, Staphylococcus aureus subsp. aureus MW2
aaguuauaucauaacuuaacu

SEQ ID NO: 4032765 - RNA, 20 nt, Staphylococcus aureus subsp. aureus MW2
aaguuaugaagggaaaaaau

SEQ ID NO: 4032766 - RNA, 19 nt, Staphylococcus aureus subsp. aureus MW2
aaguuauuuaaguucuucu

SEQ ID NO: 4032767 - RNA, 23 nt, Staphylococcus aureus subsp. aureus MW2
aaguucaaccauaugacuuuuua

SEQ ID NO: 4032768 - RNA, 15 nt, Staphylococcus aureus subsp. aureus MW2
aaguucuuaggcaau

SEQ ID NO: 4032769 - RNA, 23 nt, Staphylococcus aureus subsp. aureus MW2
aaguucuuaugcaguuuuaauua

SEQ ID NO: 4032770 - RNA, 22 nt, Staphylococcus aureus subsp. aureus MW2
aaguucuucugcuucagccaua

SEQ ID NO: 4032771 - RNA, 22 nt, Staphylococcus aureus subsp. aureus MW2
aaguugaagccaguugaaguug

SEQ ID NO: 4032772 - RNA, 22 nt, Staphylococcus aureus subsp. aureus MW2
aaguugaagcggguugaagcaa

SEQ ID NO: 4032773 - RNA, 15 nt, Staphylococcus aureus subsp. aureus MW2
aaguugacaauacaa

SEQ ID NO: 4032774 - RNA, 13 nt, Staphylococcus aureus subsp. aureus MW2
aaguugauaacua

SEQ ID NO: 4032775 - RNA, 21 nt, Staphylococcus aureus subsp. aureus MW2
aaguugauaacuauuuaauua

SEQ ID NO: 4032776 - RNA, 14 nt, Staphylococcus aureus subsp. aureus MW2
aaguugauuaaaag

SEQ ID NO: 4032777 - RNA, 17 nt, Staphylococcus aureus subsp. aureus MW2
aaguugcacauuauaaa

SEQ ID NO: 4032778 - RNA, 16 nt, Staphylococcus aureus subsp. aureus MW2
aaguugcauauaaaaa

SEQ ID NO: 4032779 - RNA, 18 nt, Staphylococcus aureus subsp. aureus MW2
aaguugcugaauaaaaua

SEQ ID NO: 4032780 - RNA, 14 nt, Staphylococcus aureus subsp. aureus MW2
aaguugcuuagcuu

SEQ ID NO: 4032781 - RNA, 21 nt, Staphylococcus aureus subsp. aureus MW2
aaguuggcggggcccaaacau

SEQ ID NO: 4032782 - RNA, 19 nt, Staphylococcus aureus subsp. aureus MW2
aaguuggcggggccccaac

SEQ ID NO: 4032783 - RNA, 21 nt, Staphylococcus aureus subsp. aureus MW2
aaguuggggaugggccccaac

SEQ ID NO: 4032784 - RNA, 21 nt, Staphylococcus aureus subsp. aureus MW2
aaguuggggugugggccccaa

SEQ ID NO: 4032785 - RNA, 18 nt, Staphylococcus aureus subsp. aureus MW2
aaguugguccaaaucgug

SEQ ID NO: 4032786 - RNA, 14 nt, Staphylococcus aureus subsp. aureus MW2
aaguuggugugcaa

SEQ ID NO: 4032787 - RNA, 16 nt, Staphylococcus aureus subsp. aureus MW2
aaguuguacuucuuug

SEQ ID NO: 4032788 - RNA, 16 nt, Staphylococcus aureus subsp. aureus MW2
aaguuguauaaaaaug

SEQ ID NO: 4032789 - RNA, 19 nt, Staphylococcus aureus subsp. aureus MW2
aaguuguggucuaaccauc

SEQ ID NO: 4032790 - RNA, 15 nt, Staphylococcus aureus subsp. aureus MW2
aaguuguugauuuaa

SEQ ID NO: 4032791 - RNA, 17 nt, Staphylococcus aureus subsp. aureus MW2
aaguuguugauuuaaaa

SEQ ID NO: 4032792 - RNA, 16 nt, Staphylococcus aureus subsp. aureus MW2
aaguuguuucuccagu

SEQ ID NO: 4032793 - RNA, 14 nt, Staphylococcus aureus subsp. aureus MW2
aaguuuaaaauacg

SEQ ID NO: 4032794 - RNA, 23 nt, Staphylococcus aureus subsp. aureus MW2
aaguuuaaucguauuagccaaua

SEQ ID NO: 4032795 - RNA, 18 nt, Staphylococcus aureus subsp. aureus MW2
aaguuuaggucaguccau

SEQ ID NO: 4032796 - RNA, 16 nt, Staphylococcus aureus subsp. aureus MW2
aaguuuauacuuaaua

SEQ ID NO: 4032797 - RNA, 22 nt, Staphylococcus aureus subsp. aureus MW2
aaguuucgcugcuacaccaccu

SEQ ID NO: 4032798 - RNA, 18 nt, Staphylococcus aureus subsp. aureus MW2
aaguuugaaggagauauu

SEQ ID NO: 4032799 - RNA, 17 nt, Staphylococcus aureus subsp. aureus MW2
aaguuugauagaugaua

SEQ ID NO: 4032800 - RNA, 20 nt, Staphylococcus aureus subsp. aureus MW2
aaguuugucuuugaacauau

SEQ ID NO: 4032801 - RNA, 16 nt, Staphylococcus aureus subsp. aureus MW2
aauaauagcaaaauua

SEQ ID NO: 4032802 - RNA, 13 nt, Staphylococcus aureus subsp. aureus MW2
aauaauauaaaaa

SEQ ID NO: 4032803 - RNA, 19 nt, Staphylococcus aureus subsp. aureus MW2
aauaauauaaaaacaaaag

SEQ ID NO: 4032804 - RNA, 20 nt, Staphylococcus aureus subsp. aureus MW2
aauaauauaaauaaaagcca

SEQ ID NO: 4032805 - RNA, 16 nt, Staphylococcus aureus subsp. aureus MW2
aauaauaucaccuuuu

SEQ ID NO: 4032806 - RNA, 11 nt, Staphylococcus aureus subsp. aureus MW2
aauaaucacuu

SEQ ID NO: 4032807 - RNA, 15 nt, Staphylococcus aureus subsp. aureus MW2
aauaauccaagauau

SEQ ID NO: 4032808 - RNA, 15 nt, Staphylococcus aureus subsp. aureus MW2
aauaauccaccuaaa

SEQ ID NO: 4032809 - RNA, 19 nt, Staphylococcus aureus subsp. aureus MW2
aauaauccaccuaaaaagu

SEQ ID NO: 4032810 - RNA, 22 nt, Staphylococcus aureus subsp. aureus MW2
aauaauccaccuaaaaaguacu

SEQ ID NO: 4032811 - RNA, 21 nt, Staphylococcus aureus subsp. aureus MW2
aauaauccagucacaaacaag

SEQ ID NO: 4032812 - RNA, 23 nt, Staphylococcus aureus subsp. aureus MW2
aauaaucccaaccauucuaccag

SEQ ID NO: 4032813 - RNA, 18 nt, Staphylococcus aureus subsp. aureus MW2
aauaauccgagucauacu

SEQ ID NO: 4032814 - RNA, 18 nt, Staphylococcus aureus subsp. aureus MW2
aauaaucgaacagaaaau

SEQ ID NO: 4032815 - RNA, 18 nt, Staphylococcus aureus subsp. aureus MW2
aauaaucgguaauuacuu

SEQ ID NO: 4032816 - RNA, 20 nt, Staphylococcus aureus subsp. aureus MW2
aauaaucgguaauuacuugu

SEQ ID NO: 4032817 - RNA, 21 nt, Staphylococcus aureus subsp. aureus MW2
aauaaucuuuaacauuuauuu

SEQ ID NO: 4032818 - RNA, 20 nt, Staphylococcus aureus subsp. aureus MW2
aauaaugacaaauuaucacu

SEQ ID NO: 4032819 - RNA, 17 nt, Staphylococcus aureus subsp. aureus MW2
aauaaugacgagaauua

SEQ ID NO: 4032820 - RNA, 18 nt, Staphylococcus aureus subsp. aureus MW2
aauaaugacugacacuuu

SEQ ID NO: 4032821 - RNA, 20 nt, Staphylococcus aureus subsp. aureus MW2
aauaaugauauauuacauca

SEQ ID NO: 4032822 - RNA, 18 nt, Staphylococcus aureus subsp. aureus MW2
aauaaugaugauacugau

SEQ ID NO: 4032823 - RNA, 17 nt, Staphylococcus aureus subsp. aureus MW2
aauaaugcuuauuaaaa

SEQ ID NO: 4032824 - RNA, 19 nt, Staphylococcus aureus subsp. aureus MW2
aauaaugcuuauuaaaauu

SEQ ID NO: 4032825 - RNA, 15 nt, Staphylococcus aureus subsp. aureus MW2
aauaaugugaaaaau

SEQ ID NO: 4032826 - RNA, 17 nt, Staphylococcus aureus subsp. aureus MW2
aauaauguuuccauuua

SEQ ID NO: 4032827 - RNA, 23 nt, Staphylococcus aureus subsp. aureus MW2
aauaauguuuccugauauuucaa

SEQ ID NO: 4032828 - RNA, 14 nt, Staphylococcus aureus subsp. aureus MW2
aauaauuaaacaaa

SEQ ID NO: 4032829 - RNA, 20 nt, Staphylococcus aureus subsp. aureus MW2
aauaauuaaacaaaacuuaa

SEQ ID NO: 4032830 - RNA, 12 nt, Staphylococcus aureus subsp. aureus MW2
aauaauuaaaua

SEQ ID NO: 4032831 - RNA, 16 nt, Staphylococcus aureus subsp. aureus MW2
aauaauuacuaaaaua

SEQ ID NO: 4032832 - RNA, 18 nt, Staphylococcus aureus subsp. aureus MW2
aauaauuacuaaccuaaa

SEQ ID NO: 4032833 - RNA, 23 nt, Staphylococcus aureus subsp. aureus MW2
aauaauuagauuuaaaaugucau

SEQ ID NO: 4032834 - RNA, 22 nt, Staphylococcus aureus subsp. aureus MW2
aauaauuagucauugaaaauau

SEQ ID NO: 4032835 - RNA, 18 nt, Staphylococcus aureus subsp. aureus MW2
aauaauucccuaggaaau

SEQ ID NO: 4032836 - RNA, 16 nt, Staphylococcus aureus subsp. aureus MW2
aauaauugagaaaaag

SEQ ID NO: 4032837 - RNA, 14 nt, Staphylococcus aureus subsp. aureus MW2
aauaauugaugaaa

SEQ ID NO: 4032838 - RNA, 19 nt, Staphylococcus aureus subsp. aureus MW2
aauaauugcuuuagaaagu

SEQ ID NO: 4032839 - RNA, 18 nt, Staphylococcus aureus subsp. aureus MW2
aauaauuggaaucaucuu

SEQ ID NO: 4032840 - RNA, 20 nt, Staphylococcus aureus subsp. aureus MW2
aauaauuggaaucaucuuuu

SEQ ID NO: 4032841 - RNA, 11 nt, Staphylococcus aureus subsp. aureus MW2
aauaauugucc

SEQ ID NO: 4032842 - RNA, 20 nt, Staphylococcus aureus subsp. aureus MW2
aauaauuuaauguugcaaaa

SEQ ID NO: 4032843 - RNA, 14 nt, Staphylococcus aureus subsp. aureus MW2
aauacaaaaauaua

SEQ ID NO: 4032844 - RNA, 16 nt, Staphylococcus aureus subsp. aureus MW2
aauacaaauauuaagu

SEQ ID NO: 4032845 - RNA, 13 nt, Staphylococcus aureus subsp. aureus MW2
aauacaaccauca

SEQ ID NO: 4032846 - RNA, 16 nt, Staphylococcus aureus subsp. aureus MW2
aauacaagucuuuacu

SEQ ID NO: 4032847 - RNA, 22 nt, Staphylococcus aureus subsp. aureus MW2
aauacaauuuagguuaauuaaa

SEQ ID NO: 4032848 - RNA, 21 nt, Staphylococcus aureus subsp. aureus MW2
aauacaauuucuucauuuuca

SEQ ID NO: 4032849 - RNA, 15 nt, Staphylococcus aureus subsp. aureus MW2
aauacaauuuuagca

SEQ ID NO: 4032850 - RNA, 21 nt, Staphylococcus aureus subsp. aureus MW2
aauacacgaucaguugaguca

SEQ ID NO: 4032851 - RNA, 18 nt, Staphylococcus aureus subsp. aureus MW2
aauacaguuguaccaaug

SEQ ID NO: 4032852 - RNA, 13 nt, Staphylococcus aureus subsp. aureus MW2
aauacauacugau

SEQ ID NO: 4032853 - RNA, 16 nt, Staphylococcus aureus subsp. aureus MW2
aauacauacugauuaa

SEQ ID NO: 4032854 - RNA, 17 nt, Staphylococcus aureus subsp. aureus MW2
aauacauacugauuaaa

SEQ ID NO: 4032855 - RNA, 21 nt, Staphylococcus aureus subsp. aureus MW2
aauacauacugauuaaacugu

SEQ ID NO: 4032856 - RNA, 14 nt, Staphylococcus aureus subsp. aureus MW2
aauacaucaucaag

SEQ ID NO: 4032857 - RNA, 16 nt, Staphylococcus aureus subsp. aureus MW2
aauacauccauacuuc

SEQ ID NO: 4032858 - RNA, 11 nt, Staphylococcus aureus subsp. aureus MW2
aauacaucuaa

SEQ ID NO: 4032859 - RNA, 14 nt, Staphylococcus aureus subsp. aureus MW2
aauacaugauauaa

SEQ ID NO: 4032860 - RNA, 15 nt, Staphylococcus aureus subsp. aureus MW2
aauacauuuugcucu

SEQ ID NO: 4032861 - RNA, 22 nt, Staphylococcus aureus subsp. aureus MW2
aauaccaacugucgguucaucu

SEQ ID NO: 4032862 - RNA, 14 nt, Staphylococcus aureus subsp. aureus MW2
aauaccaauugcuu

SEQ ID NO: 4032863 - RNA, 16 nt, Staphylococcus aureus subsp. aureus MW2
aauaccacuuaaucgu

SEQ ID NO: 4032864 - RNA, 17 nt, Staphylococcus aureus subsp. aureus MW2
aauaccauaauuaaaua

SEQ ID NO: 4032865 - RNA, 13 nt, Staphylococcus aureus subsp. aureus MW2
aauaccaucaucg

SEQ ID NO: 4032866 - RNA, 16 nt, Staphylococcus aureus subsp. aureus MW2
aauaccccaaauagug

SEQ ID NO: 4032867 - RNA, 18 nt, Staphylococcus aureus subsp. aureus MW2
aauaccgccuacuguuuc

SEQ ID NO: 4032868 - RNA, 23 nt, Staphylococcus aureus subsp. aureus MW2
aauaccuaucccuguaaaaccau

SEQ ID NO: 4032869 - RNA, 17 nt, Staphylococcus aureus subsp. aureus MW2
aauaccuccccaacuua

SEQ ID NO: 4032870 - RNA, 16 nt, Staphylococcus aureus subsp. aureus MW2
aauaccugcaacuuuu

SEQ ID NO: 4032871 - RNA, 20 nt, Staphylococcus aureus subsp. aureus MW2
aauaccuuugccguauuuca

SEQ ID NO: 4032872 - RNA, 15 nt, Staphylococcus aureus subsp. aureus MW2
aauaccuuuuucuaa

SEQ ID NO: 4032873 - RNA, 13 nt, Staphylococcus aureus subsp. aureus MW2
aauacgaguguug

SEQ ID NO: 4032874 - RNA, 21 nt, Staphylococcus aureus subsp. aureus MW2
aauacgaguguuuuaaucuua

SEQ ID NO: 4032875 - RNA, 19 nt, Staphylococcus aureus subsp. aureus MW2
aauacguggcucuaaaaac

SEQ ID NO: 4032876 - RNA, 23 nt, Staphylococcus aureus subsp. aureus MW2
aauacguuuauccuuuaaaucau

SEQ ID NO: 4032877 - RNA, 14 nt, Staphylococcus aureus subsp. aureus MW2
aauacuaaaaugga

SEQ ID NO: 4032878 - RNA, 14 nt, Staphylococcus aureus subsp. aureus MW2
aauacuaauaacuc

SEQ ID NO: 4032879 - RNA, 14 nt, Staphylococcus aureus subsp. aureus MW2
aauacuaaucaaag

SEQ ID NO: 4032880 - RNA, 18 nt, Staphylococcus aureus subsp. aureus MW2
aauacuaaucaaagaaaa

SEQ ID NO: 4032881 - RNA, 15 nt, Staphylococcus aureus subsp. aureus MW2
aauacuaauuuugua

SEQ ID NO: 4032882 - RNA, 19 nt, Staphylococcus aureus subsp. aureus MW2
aauacuaauuuuguacaua

SEQ ID NO: 4032883 - RNA, 21 nt, Staphylococcus aureus subsp. aureus MW2
aauacuacacuccccuuauca

SEQ ID NO: 4032884 - RNA, 22 nt, Staphylococcus aureus subsp. aureus MW2
aauacuacacuccccuuaucaa

SEQ ID NO: 4032885 - RNA, 20 nt, Staphylococcus aureus subsp. aureus MW2
aauacuaccguuuuuauaua

SEQ ID NO: 4032886 - RNA, 12 nt, Staphylococcus aureus subsp. aureus MW2
aauacuaguaau

SEQ ID NO: 4032887 - RNA, 14 nt, Staphylococcus aureus subsp. aureus MW2
aauacuauacugau

SEQ ID NO: 4032888 - RNA, 14 nt, Staphylococcus aureus subsp. aureus MW2
aauacuauaugaaa

SEQ ID NO: 4032889 - RNA, 19 nt, Staphylococcus aureus subsp. aureus MW2
aauacuauaugaaaagaga

SEQ ID NO: 4032890 - RNA, 23 nt, Staphylococcus aureus subsp. aureus MW2
aauauauagcacgcuuauugaaa

SEQ ID NO: 4032891 - RNA, 21 nt, Staphylococcus aureus subsp. aureus MW2
aauauauccugccaauauauu

SEQ ID NO: 4032892 - RNA, 23 nt, Staphylococcus aureus subsp. aureus MW2
aauauauccugccaauauauuca

SEQ ID NO: 4032893 - RNA, 20 nt, Staphylococcus aureus subsp. aureus MW2
aauauaugaauaagucuaau

SEQ ID NO: 4032894 - RNA, 20 nt, Staphylococcus aureus subsp. aureus MW2
aauauauuaaaaaucaaaau

SEQ ID NO: 4032895 - RNA, 13 nt, Staphylococcus aureus subsp. aureus MW2
aauauauuaacaa

SEQ ID NO: 4032896 - RNA, 22 nt, Staphylococcus aureus subsp. aureus MW2
aauauauuaacaacuuuauuau

SEQ ID NO: 4032897 - RNA, 13 nt, Staphylococcus aureus subsp. aureus MW2
aauauauuauaaa

SEQ ID NO: 4032898 - RNA, 17 nt, Staphylococcus aureus subsp. aureus MW2
aauauauuauaaaaaua

SEQ ID NO: 4032899 - RNA, 22 nt, Staphylococcus aureus subsp. aureus MW2
aauauauucggcaaaagauguu

SEQ ID NO: 4032900 - RNA, 19 nt, Staphylococcus aureus subsp. aureus MW2
aauauauuuaaacucauaa

SEQ ID NO: 4032901 - RNA, 16 nt, Staphylococcus aureus subsp. aureus MW2
aauauauuuauuuuug

SEQ ID NO: 4032902 - RNA, 13 nt, Staphylococcus aureus subsp. aureus MW2
aauaucaaaauau

SEQ ID NO: 4032903 - RNA, 14 nt, Staphylococcus aureus subsp. aureus MW2
aauaucaagauguu

SEQ ID NO: 4032904 - RNA, 17 nt, Staphylococcus aureus subsp. aureus MW2
aauaucacuaauauauu

SEQ ID NO: 4032905 - RNA, 17 nt, Staphylococcus aureus subsp. aureus MW2
aauaucauaaaugcaua

SEQ ID NO: 4032906 - RNA, 18 nt, Staphylococcus aureus subsp. aureus MW2
aauaucauaccguacaaa

SEQ ID NO: 4032907 - RNA, 23 nt, Staphylococcus aureus subsp. aureus MW2
aauaucauauucaaaauaacuua

SEQ ID NO: 4032908 - RNA, 15 nt, Staphylococcus aureus subsp. aureus MW2
aauaucauauuugaa

SEQ ID NO: 4032909 - RNA, 19 nt, Staphylococcus aureus subsp. aureus MW2
aauaucauauuugaauacu

SEQ ID NO: 4032910 - RNA, 22 nt, Staphylococcus aureus subsp. aureus MW2
aauaucaucauuuaaauauuuc

SEQ ID NO: 4032911 - RNA, 12 nt, Staphylococcus aureus subsp. aureus MW2
aauauccaaaau

SEQ ID NO: 4032912 - RNA, 18 nt, Staphylococcus aureus subsp. aureus MW2
aauauccugcaguugauu

SEQ ID NO: 4032913 - RNA, 17 nt, Staphylococcus aureus subsp. aureus MW2
aauaucgacuuuucuau

SEQ ID NO: 4032914 - RNA, 16 nt, Staphylococcus aureus subsp. aureus MW2
aauaucuaaacaauuc

SEQ ID NO: 4032915 - RNA, 14 nt, Staphylococcus aureus subsp. aureus MW2
aauaucuaaagauu

SEQ ID NO: 4032916 - RNA, 20 nt, Staphylococcus aureus subsp. aureus MW2
aauaucuaaagauuucaguu

SEQ ID NO: 4032917 - RNA, 13 nt, Staphylococcus aureus subsp. aureus MW2
aauaucuaauucu

SEQ ID NO: 4032918 - RNA, 16 nt, Staphylococcus aureus subsp. aureus MW2
aauaucugaaaaacca

SEQ ID NO: 4032919 - RNA, 22 nt, Staphylococcus aureus subsp. aureus MW2
aauaucuucuucuaaccacuuc

SEQ ID NO: 4032920 - RNA, 22 nt, Staphylococcus aureus subsp. aureus MW2
aauaucuugucauggcaagauu

SEQ ID NO: 4032921 - RNA, 18 nt, Staphylococcus aureus subsp. aureus MW2
aauaucuuuuaauguuuu

SEQ ID NO: 4032922 - RNA, 20 nt, Staphylococcus aureus subsp. aureus MW2
aauaucuuuuaauguuuuag

SEQ ID NO: 4032923 - RNA, 13 nt, Staphylococcus aureus subsp. aureus MW2
aauaugaacaaaa

SEQ ID NO: 4032924 - RNA, 17 nt, Staphylococcus aureus subsp. aureus MW2
aauaugaacaaaaauaa

SEQ ID NO: 4032925 - RNA, 22 nt, Staphylococcus aureus subsp. aureus MW2
aauaugaacaaaaauaaaaacu

SEQ ID NO: 4032926 - RNA, 20 nt, Staphylococcus aureus subsp. aureus MW2
aauaugacgaucuucaugaa

SEQ ID NO: 4032927 - RNA, 18 nt, Staphylococcus aureus subsp. aureus MW2
aauaugauaacucguaau

SEQ ID NO: 4032928 - RNA, 14 nt, Staphylococcus aureus subsp. aureus MW2
aauaugauauuaag

SEQ ID NO: 4032929 - RNA, 21 nt, Staphylococcus aureus subsp. aureus MW2
aauaugaucuaacaucauuaa

SEQ ID NO: 4032930 - RNA, 17 nt, Staphylococcus aureus subsp. aureus MW2
aauaugauguuaaaaaa

SEQ ID NO: 4032931 - RNA, 17 nt, Staphylococcus aureus subsp. aureus MW2
aauaugauuaauaaagu

SEQ ID NO: 4032932 - RNA, 13 nt, Staphylococcus aureus subsp. aureus MW2
aauaugcuaugua

SEQ ID NO: 4032933 - RNA, 18 nt, Staphylococcus aureus subsp. aureus MW2
aauauggaauuucauaua

SEQ ID NO: 4032934 - RNA, 17 nt, Staphylococcus aureus subsp. aureus MW2
aauauguaaucagguuu

SEQ ID NO: 4032935 - RNA, 17 nt, Staphylococcus aureus subsp. aureus MW2
aauaugugcaugagacu

SEQ ID NO: 4032936 - RNA, 21 nt, Staphylococcus aureus subsp. aureus MW2
aauauguggcgcucuuauaaa

SEQ ID NO: 4032937 - RNA, 23 nt, Staphylococcus aureus subsp. aureus MW2
aauauguggcgcucuuauaaaga

SEQ ID NO: 4032938 - RNA, 13 nt, Staphylococcus aureus subsp. aureus MW2
aauauguuaauuu

SEQ ID NO: 4032939 - RNA, 11 nt, Staphylococcus aureus subsp. aureus MW2
aauauuaaaau

SEQ ID NO: 4032940 - RNA, 12 nt, Staphylococcus aureus subsp. aureus MW2
aauauuaaaauc

SEQ ID NO: 4032941 - RNA, 18 nt, Staphylococcus aureus subsp. aureus MW2
aauauuaaaauuaaaacu

SEQ ID NO: 4032942 - RNA, 14 nt, Staphylococcus aureus subsp. aureus MW2
aauauuaaauucau

SEQ ID NO: 4032943 - RNA, 16 nt, Staphylococcus aureus subsp. aureus MW2
aauauuaaauucaucu

SEQ ID NO: 4032944 - RNA, 21 nt, Staphylococcus aureus subsp. aureus MW2
aauauuaaauucaucuugcaa

SEQ ID NO: 4032945 - RNA, 22 nt, Staphylococcus aureus subsp. aureus MW2
aauauuaagauguauaugaauu

SEQ ID NO: 4032946 - RNA, 18 nt, Staphylococcus aureus subsp. aureus MW2
aauauuaauaaaguguaa

SEQ ID NO: 4032947 - RNA, 17 nt, Staphylococcus aureus subsp. aureus MW2
aauauuaaucaauuuau

SEQ ID NO: 4032948 - RNA, 19 nt, Staphylococcus aureus subsp. aureus MW2
aauauuacuuuaucucauu

SEQ ID NO: 4032949 - RNA, 22 nt, Staphylococcus aureus subsp. aureus MW2
aauauuagucauuugaugguuu

SEQ ID NO: 4032950 - RNA, 16 nt, Staphylococcus aureus subsp. aureus MW2
aauauuauaaaaagau

SEQ ID NO: 4032951 - RNA, 18 nt, Staphylococcus aureus subsp. aureus MW2
aauauuauaaaaagauau

SEQ ID NO: 4032952 - RNA, 19 nt, Staphylococcus aureus subsp. aureus MW2
aauauuauaaaaagauaua

SEQ ID NO: 4032953 - RNA, 20 nt, Staphylococcus aureus subsp. aureus MW2
aauauuauaaaaagauauaa

SEQ ID NO: 4032954 - RNA, 18 nt, Staphylococcus aureus subsp. aureus MW2
aauauuauucauaauaua

SEQ ID NO: 4032955 - RNA, 16 nt, Staphylococcus aureus subsp. aureus MW2
aauauucaauaauuca

SEQ ID NO: 4032956 - RNA, 19 nt, Staphylococcus aureus subsp. aureus MW2
aauauucaauaauucauca

SEQ ID NO: 4032957 - RNA, 20 nt, Staphylococcus aureus subsp. aureus MW2
aauauucgauacauaaaaca

SEQ ID NO: 4032958 - RNA, 19 nt, Staphylococcus aureus subsp. aureus MW2
aauauucguagcaugacau

SEQ ID NO: 4032959 - RNA, 18 nt, Staphylococcus aureus subsp. aureus MW2
aauauugaauaaaaaaac

SEQ ID NO: 4032960 - RNA, 19 nt, Staphylococcus aureus subsp. aureus MW2
aauauugaauaaaaaaaca

SEQ ID NO: 4032961 - RNA, 15 nt, Staphylococcus aureus subsp. aureus MW2
aauauugauaucgaa

SEQ ID NO: 4032962 - RNA, 14 nt, Staphylococcus aureus subsp. aureus MW2
aauauugaugaaua

SEQ ID NO: 4032963 - RNA, 15 nt, Staphylococcus aureus subsp. aureus MW2
aauauugaugaauaa

SEQ ID NO: 4032964 - RNA, 20 nt, Staphylococcus aureus subsp. aureus MW2
aauauugauucuagugaaau

SEQ ID NO: 4032965 - RNA, 15 nt, Staphylococcus aureus subsp. aureus MW2
aauauugguuauaua

SEQ ID NO: 4032966 - RNA, 15 nt, Staphylococcus aureus subsp. aureus MW2
aauauuguauugauc

SEQ ID NO: 4032967 - RNA, 20 nt, Staphylococcus aureus subsp. aureus MW2
aauauugucuucauuaacau

SEQ ID NO: 4032968 - RNA, 13 nt, Staphylococcus aureus subsp. aureus MW2
aauauuuaaaaaa

SEQ ID NO: 4032969 - RNA, 15 nt, Staphylococcus aureus subsp. aureus MW2
aauauuuaaaaaaca

SEQ ID NO: 4032970 - RNA, 16 nt, Staphylococcus aureus subsp. aureus MW2
aauauuuaaaaaacaa

SEQ ID NO: 4032971 - RNA, 18 nt, Staphylococcus aureus subsp. aureus MW2
aauauuuaaaaaacaaau

SEQ ID NO: 4032972 - RNA, 17 nt, Staphylococcus aureus subsp. aureus MW2
aauauuuaaaauauuau

SEQ ID NO: 4032973 - RNA, 17 nt, Staphylococcus aureus subsp. aureus MW2
aauauuuaaacuaguaa

SEQ ID NO: 4032974 - RNA, 13 nt, Staphylococcus aureus subsp. aureus MW2
aauauuuaaauag

SEQ ID NO: 4032975 - RNA, 16 nt, Staphylococcus aureus subsp. aureus MW2
aauauuuaaauuuuaa

SEQ ID NO: 4032976 - RNA, 21 nt, Staphylococcus aureus subsp. aureus MW2
aauauuuacauugccacuuuu

SEQ ID NO: 4032977 - RNA, 21 nt, Staphylococcus aureus subsp. aureus MW2
aauauuuagauuggucaaacu

SEQ ID NO: 4032978 - RNA, 17 nt, Staphylococcus aureus subsp. aureus MW2
aauccuuuguuuguaag

SEQ ID NO: 4032979 - RNA, 12 nt, Staphylococcus aureus subsp. aureus MW2
aaucgaaaauau

SEQ ID NO: 4032980 - RNA, 16 nt, Staphylococcus aureus subsp. aureus MW2
aaucgaaaauaucaau

SEQ ID NO: 4032981 - RNA, 15 nt, Staphylococcus aureus subsp. aureus MW2
aaucgaacagaaaau

SEQ ID NO: 4032982 - RNA, 21 nt, Staphylococcus aureus subsp. aureus MW2
aaucgacuuuuacaaucauca

SEQ ID NO: 4032983 - RNA, 17 nt, Staphylococcus aureus subsp. aureus MW2
aaucgagugauucagga

SEQ ID NO: 4032984 - RNA, 17 nt, Staphylococcus aureus subsp. aureus MW2
aaucgaguuugaaauaa

SEQ ID NO: 4032985 - RNA, 15 nt, Staphylococcus aureus subsp. aureus MW2
aaucgauauaaugaa

SEQ ID NO: 4032986 - RNA, 20 nt, Staphylococcus aureus subsp. aureus MW2
aaucgauauaaugaaguuau

SEQ ID NO: 4032987 - RNA, 21 nt, Staphylococcus aureus subsp. aureus MW2
aaucgauuaagaaugcaccaa

SEQ ID NO: 4032988 - RNA, 14 nt, Staphylococcus aureus subsp. aureus MW2
aaucgauugguaaa

SEQ ID NO: 4032989 - RNA, 15 nt, Staphylococcus aureus subsp. aureus MW2
aaucgcauuuaaaua

SEQ ID NO: 4032990 - RNA, 17 nt, Staphylococcus aureus subsp. aureus MW2
aaucgcauuuaaauaua

SEQ ID NO: 4032991 - RNA, 14 nt, Staphylococcus aureus subsp. aureus MW2
aaucgccauugucc

SEQ ID NO: 4032992 - RNA, 15 nt, Staphylococcus aureus subsp. aureus MW2
aaucgccuacuauaa

SEQ ID NO: 4032993 - RNA, 15 nt, Staphylococcus aureus subsp. aureus MW2
aaucgccuuguuuau

SEQ ID NO: 4032994 - RNA, 16 nt, Staphylococcus aureus subsp. aureus MW2
aaucggaauaaaauaa

SEQ ID NO: 4032995 - RNA, 18 nt, Staphylococcus aureus subsp. aureus MW2
aaucggaauaaaauaaau

SEQ ID NO: 4032996 - RNA, 17 nt, Staphylococcus aureus subsp. aureus MW2
aaucgguacgaagugca

SEQ ID NO: 4032997 - RNA, 14 nt, Staphylococcus aureus subsp. aureus MW2
aaucguauauuaaa

SEQ ID NO: 4032998 - RNA, 21 nt, Staphylococcus aureus subsp. aureus MW2
aaucguauuagccaauaaaau

SEQ ID NO: 4032999 - RNA, 20 nt, Staphylococcus aureus subsp. aureus MW2
aaucgucauauuaauauuuu

SEQ ID NO: 4033000 - RNA, 18 nt, Staphylococcus aureus subsp. aureus MW2
aaucgugcccauaugauu

SEQ ID NO: 4033001 - RNA, 14 nt, Staphylococcus aureus subsp. aureus MW2
aaucguuaaaacac

SEQ ID NO: 4033002 - RNA, 23 nt, Staphylococcus aureus subsp. aureus MW2
aaucguuaauuuccaauaucuuc

SEQ ID NO: 4033003 - RNA, 15 nt, Staphylococcus aureus subsp. aureus MW2
aaucguugaaaaaua

SEQ ID NO: 4033004 - RNA, 19 nt, Staphylococcus aureus subsp. aureus MW2
aaucguuguggcuuuuuau

SEQ ID NO: 4033005 - RNA, 14 nt, Staphylococcus aureus subsp. aureus MW2
aaucuaaaaaucca

SEQ ID NO: 4033006 - RNA, 22 nt, Staphylococcus aureus subsp. aureus MW2
aaucuaaaaauccauucaucgu

SEQ ID NO: 4033007 - RNA, 16 nt, Staphylococcus aureus subsp. aureus MW2
aaucuaaacuauaaua

SEQ ID NO: 4033008 - RNA, 15 nt, Staphylococcus aureus subsp. aureus MW2
aaucuaaauguaaaa

SEQ ID NO: 4033009 - RNA, 19 nt, Staphylococcus aureus subsp. aureus MW2
aaucuaaauguaaaaucau

SEQ ID NO: 4033010 - RNA, 17 nt, Staphylococcus aureus subsp. aureus MW2
aaucuaauccugguaua

SEQ ID NO: 4033011 - RNA, 12 nt, Staphylococcus aureus subsp. aureus MW2
aaucuacaauau

SEQ ID NO: 4033012 - RNA, 13 nt, Staphylococcus aureus subsp. aureus MW2
aaucuauaaauau

SEQ ID NO: 4033013 - RNA, 14 nt, Staphylococcus aureus subsp. aureus MW2
aaucuauaaauauc

SEQ ID NO: 4033014 - RNA, 15 nt, Staphylococcus aureus subsp. aureus MW2
aaucuauaaauauca

SEQ ID NO: 4033015 - RNA, 14 nt, Staphylococcus aureus subsp. aureus MW2
aaucuauaauacau

SEQ ID NO: 4033016 - RNA, 15 nt, Staphylococcus aureus subsp. aureus MW2
aaucuauaccauucc

SEQ ID NO: 4033017 - RNA, 21 nt, Staphylococcus aureus subsp. aureus MW2
aaucuauauaaaguugacaau

SEQ ID NO: 4033018 - RNA, 14 nt, Staphylococcus aureus subsp. aureus MW2
aaucuauugcaaua

SEQ ID NO: 4033019 - RNA, 19 nt, Staphylococcus aureus subsp. aureus MW2
aaucuauuuucugccauaa

SEQ ID NO: 4033020 - RNA, 12 nt, Staphylococcus aureus subsp. aureus MW2
aaucucaaaauu

SEQ ID NO: 4033021 - RNA, 15 nt, Staphylococcus aureus subsp. aureus MW2
aaucucaugccaaaa

SEQ ID NO: 4033022 - RNA, 21 nt, Staphylococcus aureus subsp. aureus MW2
aaucucaugccaaaaacauua

SEQ ID NO: 4033023 - RNA, 17 nt, Staphylococcus aureus subsp. aureus MW2
aaucuccauuagaacua

SEQ ID NO: 4033024 - RNA, 22 nt, Staphylococcus aureus subsp. aureus MW2
aaucuccauuuaaggauuuccu

SEQ ID NO: 4033025 - RNA, 15 nt, Staphylococcus aureus subsp. aureus MW2
aaucuccgguuuaau

SEQ ID NO: 4033026 - RNA, 16 nt, Staphylococcus aureus subsp. aureus MW2
aaucucuuuacaccau

SEQ ID NO: 4033027 - RNA, 19 nt, Staphylococcus aureus subsp. aureus MW2
aaucucuuuagaugagauu

SEQ ID NO: 4033028 - RNA, 17 nt, Staphylococcus aureus subsp. aureus MW2
aaucugaagguaauuua

SEQ ID NO: 4033029 - RNA, 20 nt, Staphylococcus aureus subsp. aureus MW2
aaucugaagguaauuuaaca

SEQ ID NO: 4033030 - RNA, 15 nt, Staphylococcus aureus subsp. aureus MW2
aaucugauucauuaa

SEQ ID NO: 4033031 - RNA, 20 nt, Staphylococcus aureus subsp. aureus MW2
aaucugcaacgauuuuaaaa

SEQ ID NO: 4033032 - RNA, 13 nt, Staphylococcus aureus subsp. aureus MW2
aaucuguaaugca

SEQ ID NO: 4033033 - RNA, 17 nt, Staphylococcus aureus subsp. aureus MW2
aaucuguuuaaauuuaa

SEQ ID NO: 4033034 - RNA, 21 nt, Staphylococcus aureus subsp. aureus MW2
aaucuguuuaaauuuaaaaga

SEQ ID NO: 4033035 - RNA, 17 nt, Staphylococcus aureus subsp. aureus MW2
aaucuuaguacaaaauu

SEQ ID NO: 4033036 - RNA, 18 nt, Staphylococcus aureus subsp. aureus MW2
aaucuuaguacaaaauug

SEQ ID NO: 4033037 - RNA, 21 nt, Staphylococcus aureus subsp. aureus MW2
aaucuuaugaugucauguauu

SEQ ID NO: 4033038 - RNA, 23 nt, Staphylococcus aureus subsp. aureus MW2
aaucuuauuuuguuuuaaaaaac

SEQ ID NO: 4033039 - RNA, 22 nt, Staphylococcus aureus subsp. aureus MW2
aaucuucaagugccauuuuuaa

SEQ ID NO: 4033040 - RNA, 17 nt, Staphylococcus aureus subsp. aureus MW2
aaucuucaucuaaaaag

SEQ ID NO: 4033041 - RNA, 17 nt, Staphylococcus aureus subsp. aureus MW2
aaucuucauuaauuaca

SEQ ID NO: 4033042 - RNA, 18 nt, Staphylococcus aureus subsp. aureus MW2
aaucuucuaauuaagaau

SEQ ID NO: 4033043 - RNA, 23 nt, Staphylococcus aureus subsp. aureus MW2
aaucuucuccaaucaucauuaaa

SEQ ID NO: 4033044 - RNA, 16 nt, Staphylococcus aureus subsp. aureus MW2
aaucuucuuuagcuau

SEQ ID NO: 4033045 - RNA, 21 nt, Staphylococcus aureus subsp. aureus MW2
aaucuugaugauauucauaua

SEQ ID NO: 4033046 - RNA, 20 nt, Staphylococcus aureus subsp. aureus MW2
aaucuugauuauauuuuucu

SEQ ID NO: 4033047 - RNA, 17 nt, Staphylococcus aureus subsp. aureus MW2
aaucuuggugauagucu

SEQ ID NO: 4033048 - RNA, 17 nt, Staphylococcus aureus subsp. aureus MW2
aaucuuguucuaauugu

SEQ ID NO: 4033049 - RNA, 19 nt, Staphylococcus aureus subsp. aureus MW2
aaucuuguugaacucugau

SEQ ID NO: 4033050 - RNA, 18 nt, Staphylococcus aureus subsp. aureus MW2
aaucuuguuggauuuuaa

SEQ ID NO: 4033051 - RNA, 22 nt, Staphylococcus aureus subsp. aureus MW2
aaucuuguuggauuuuaacaag

SEQ ID NO: 4033052 - RNA, 19 nt, Staphylococcus aureus subsp. aureus MW2
aaucuuguuuucauuuaaa

SEQ ID NO: 4033053 - RNA, 14 nt, Staphylococcus aureus subsp. aureus MW2
aaucuuuaucaguu

SEQ ID NO: 4033054 - RNA, 21 nt, Staphylococcus aureus subsp. aureus MW2
aaucuuucuagacguauucaa

SEQ ID NO: 4033055 - RNA, 12 nt, Staphylococcus aureus subsp. aureus MW2
aaucuuuuaacu

SEQ ID NO: 4033056 - RNA, 13 nt, Staphylococcus aureus subsp. aureus MW2
aaucuuuuaacuu

SEQ ID NO: 4033057 - RNA, 21 nt, Staphylococcus aureus subsp. aureus MW2
aaugaaaagcuuguuacaagc

SEQ ID NO: 4033058 - RNA, 23 nt, Staphylococcus aureus subsp. aureus MW2
aaugaaagcaccuaaaauagaaa

SEQ ID NO: 4033059 - RNA, 20 nt, Staphylococcus aureus subsp. aureus MW2
aaugaaaugaaguauggaag

SEQ ID NO: 4033060 - RNA, 18 nt, Staphylococcus aureus subsp. aureus MW2
aaugaaccagcuaaccaa

SEQ ID NO: 4033061 - RNA, 23 nt, Staphylococcus aureus subsp. aureus MW2
aaugaaccuuuacucauauugaa

SEQ ID NO: 4033062 - RNA, 14 nt, Staphylococcus aureus subsp. aureus MW2
aaugaagaauacaa

SEQ ID NO: 4033063 - RNA, 19 nt, Staphylococcus aureus subsp. aureus MW2
aaugaagaauacaaauauu

SEQ ID NO: 4033064 - RNA, 21 nt, Staphylococcus aureus subsp. aureus MW2
aaugaagcauuuuauuuuuaa

SEQ ID NO: 4033065 - RNA, 17 nt, Staphylococcus aureus subsp. aureus MW2
aaugaagcuaaguauau

SEQ ID NO: 4033066 - RNA, 20 nt, Staphylococcus aureus subsp. aureus MW2
aaugguugauuugauuuaaa

SEQ ID NO: 4033067 - RNA, 14 nt, Staphylococcus aureus subsp. aureus MW2
aaugguuucaaaau

SEQ ID NO: 4033068 - RNA, 24 nt, Staphylococcus aureus subsp. aureus MW2
aauguaaaaucauuaauaauuaaa

SEQ ID NO: 4033069 - RNA, 20 nt, Staphylococcus aureus subsp. aureus MW2
aauguaaaaugaugauuuaa

SEQ ID NO: 4033070 - RNA, 21 nt, Staphylococcus aureus subsp. aureus MW2
aauguaaaaugaugauuuaaa

SEQ ID NO: 4033071 - RNA, 21 nt, Staphylococcus aureus subsp. aureus MW2
aauguaacauuaaaaauaaaa

SEQ ID NO: 4033072 - RNA, 21 nt, Staphylococcus aureus subsp. aureus MW2
aauguaagcaacauaugauuu

SEQ ID NO: 4033073 - RNA, 21 nt, Staphylococcus aureus subsp. aureus MW2
aauguaauuauugcaucauaa

SEQ ID NO: 4033074 - RNA, 21 nt, Staphylococcus aureus subsp. aureus MW2
aauguacauuguaaauauagu

SEQ ID NO: 4033075 - RNA, 21 nt, Staphylococcus aureus subsp. aureus MW2
aauguaguuaagauaccuuuu

SEQ ID NO: 4033076 - RNA, 13 nt, Staphylococcus aureus subsp. aureus MW2
aauguaucaccua

SEQ ID NO: 4033077 - RNA, 13 nt, Staphylococcus aureus subsp. aureus MW2
aauguaucauuuc

SEQ ID NO: 4033078 - RNA, 15 nt, Staphylococcus aureus subsp. aureus MW2
aauguauuaaacauu

SEQ ID NO: 4033079 - RNA, 14 nt, Staphylococcus aureus subsp. aureus MW2
aauguauucaguca

SEQ ID NO: 4033080 - RNA, 19 nt, Staphylococcus aureus subsp. aureus MW2
aauguauucagucaguaaa

SEQ ID NO: 4033081 - RNA, 22 nt, Staphylococcus aureus subsp. aureus MW2
aauguauucuucuaauucugaa

SEQ ID NO: 4033082 - RNA, 21 nt, Staphylococcus aureus subsp. aureus MW2
aauguauugcuauaagaacua

SEQ ID NO: 4033083 - RNA, 22 nt, Staphylococcus aureus subsp. aureus MW2
aauguauuuugaucugugcuug

SEQ ID NO: 4033084 - RNA, 22 nt, Staphylococcus aureus subsp. aureus MW2
aauguccgauuugauaaaaaau

SEQ ID NO: 4033085 - RNA, 22 nt, Staphylococcus aureus subsp. aureus MW2
aaugucgaucuaacaauugcag

SEQ ID NO: 4033086 - RNA, 14 nt, Staphylococcus aureus subsp. aureus MW2
aaugucguauaugu

SEQ ID NO: 4033087 - RNA, 16 nt, Staphylococcus aureus subsp. aureus MW2
aaugucucuuuucacg

SEQ ID NO: 4033088 - RNA, 15 nt, Staphylococcus aureus subsp. aureus MW2
aaugucuuacuuguc

SEQ ID NO: 4033089 - RNA, 14 nt, Staphylococcus aureus subsp. aureus MW2
aaugucuucauaau

SEQ ID NO: 4033090 - RNA, 15 nt, Staphylococcus aureus subsp. aureus MW2
aaugugaccuuaugu

SEQ ID NO: 4033091 - RNA, 15 nt, Staphylococcus aureus subsp. aureus MW2
aaugugaugauuaau

SEQ ID NO: 4033092 - RNA, 23 nt, Staphylococcus aureus subsp. aureus MW2
aaugugauuuucuuucauaaauu

SEQ ID NO: 4033093 - RNA, 18 nt, Staphylococcus aureus subsp. aureus MW2
aaugugcaaguuggggug

SEQ ID NO: 4033094 - RNA, 15 nt, Staphylococcus aureus subsp. aureus MW2
aaugugccuuuuguu

SEQ ID NO: 4033095 - RNA, 19 nt, Staphylococcus aureus subsp. aureus MW2
aaugugcgaccuuucauag

SEQ ID NO: 4033096 - RNA, 21 nt, Staphylococcus aureus subsp. aureus MW2
aauguggaacaugauucauga

SEQ ID NO: 4033097 - RNA, 14 nt, Staphylococcus aureus subsp. aureus MW2
aauguguaugguuu

SEQ ID NO: 4033098 - RNA, 22 nt, Staphylococcus aureus subsp. aureus MW2
aauguguaugguuuuguacaua

SEQ ID NO: 4033099 - RNA, 23 nt, Staphylococcus aureus subsp. aureus MW2
aauguguaugguuuuguacauau

SEQ ID NO: 4033100 - RNA, 21 nt, Staphylococcus aureus subsp. aureus MW2
aauguguggauuuaauuuuua

SEQ ID NO: 4033101 - RNA, 14 nt, Staphylococcus aureus subsp. aureus MW2
aauguguuaauacu

SEQ ID NO: 4033102 - RNA, 23 nt, Staphylococcus aureus subsp. aureus MW2
aauguguuaauacuucauauccu

SEQ ID NO: 4033103 - RNA, 23 nt, Staphylococcus aureus subsp. aureus MW2
aauguguuaaucaacguauauaa

SEQ ID NO: 4033104 - RNA, 17 nt, Staphylococcus aureus subsp. aureus MW2
aauguuaaagauuauua

SEQ ID NO: 4033105 - RNA, 16 nt, Staphylococcus aureus subsp. aureus MW2
aauguuaaauucuaaa

SEQ ID NO: 4033106 - RNA, 17 nt, Staphylococcus aureus subsp. aureus MW2
aauguuaacugcaaacu

SEQ ID NO: 4033107 - RNA, 19 nt, Staphylococcus aureus subsp. aureus MW2
aauguuaagacauaugcag

SEQ ID NO: 4033108 - RNA, 14 nt, Staphylococcus aureus subsp. aureus MW2
aauguuaauaauga

SEQ ID NO: 4033109 - RNA, 19 nt, Staphylococcus aureus subsp. aureus MW2
aauguuacacaaauuaaaa

SEQ ID NO: 4033110 - RNA, 21 nt, Staphylococcus aureus subsp. aureus MW2
aauguuacacaaauuaaaacu

SEQ ID NO: 4033111 - RNA, 15 nt, Staphylococcus aureus subsp. aureus MW2
aauguuacauuugaa

SEQ ID NO: 4033112 - RNA, 12 nt, Staphylococcus aureus subsp. aureus MW2
aauguuagauuu

SEQ ID NO: 4033113 - RNA, 15 nt, Staphylococcus aureus subsp. aureus MW2
aauguuagauuucaa

SEQ ID NO: 4033114 - RNA, 18 nt, Staphylococcus aureus subsp. aureus MW2
aauguuagauuucaaacg

SEQ ID NO: 4033115 - RNA, 14 nt, Staphylococcus aureus subsp. aureus MW2
aauguuaucuugcu

SEQ ID NO: 4033116 - RNA, 24 nt, Staphylococcus aureus subsp. aureus MW2
aauguuaucuugcuuauugauaua

SEQ ID NO: 4033117 - RNA, 22 nt, Staphylococcus aureus subsp. aureus MW2
aauguuauugcuuauuuuugua

SEQ ID NO: 4033118 - RNA, 15 nt, Staphylococcus aureus subsp. aureus MW2
aauguucaauuuaua

SEQ ID NO: 4033119 - RNA, 20 nt, Staphylococcus aureus subsp. aureus MW2
aauguuccuuguuuuaaacu

SEQ ID NO: 4033120 - RNA, 11 nt, Staphylococcus aureus subsp. aureus MW2
aauguugaaug

SEQ ID NO: 4033121 - RNA, 14 nt, Staphylococcus aureus subsp. aureus MW2
aauguuuaaaaaac

SEQ ID NO: 4033122 - RNA, 22 nt, Staphylococcus aureus subsp. aureus MW2
aauguuuauaauaauauugaaa

SEQ ID NO: 4033123 - RNA, 14 nt, Staphylococcus aureus subsp. aureus MW2
aauguuucaaauuu

SEQ ID NO: 4033124 - RNA, 18 nt, Staphylococcus aureus subsp. aureus MW2
aauguuucaaauuuauac

SEQ ID NO: 4033125 - RNA, 13 nt, Staphylococcus aureus subsp. aureus MW2
aauguuucuccua

SEQ ID NO: 4033126 - RNA, 12 nt, Staphylococcus aureus subsp. aureus MW2
aauguuugcuuu

SEQ ID NO: 4033127 - RNA, 16 nt, Staphylococcus aureus subsp. aureus MW2
aauguuuuggaaaaau

SEQ ID NO: 4033128 - RNA, 14 nt, Staphylococcus aureus subsp. aureus MW2
aauuaaaaaacaau

SEQ ID NO: 4033129 - RNA, 13 nt, Staphylococcus aureus subsp. aureus MW2
aauuaaaaacacc

SEQ ID NO: 4033130 - RNA, 13 nt, Staphylococcus aureus subsp. aureus MW2
aauuaaaaauuuc

SEQ ID NO: 4033131 - RNA, 11 nt, Staphylococcus aureus subsp. aureus MW2
aauuaaaacag

SEQ ID NO: 4033132 - RNA, 17 nt, Staphylococcus aureus subsp. aureus MW2
aauuaaaacagcaaaua

SEQ ID NO: 4033133 - RNA, 12 nt, Staphylococcus aureus subsp. aureus MW2
aauuaaaauaac

SEQ ID NO: 4033134 - RNA, 20 nt, Staphylococcus aureus subsp. aureus MW2
aauuaaaauaagauauauaa

SEQ ID NO: 4033135 - RNA, 13 nt, Staphylococcus aureus subsp. aureus MW2
aauuaaaauguua

SEQ ID NO: 4033136 - RNA, 21 nt, Staphylococcus aureus subsp. aureus MW2
aauuaaacaaaacuuaaaaua

SEQ ID NO: 4033137 - RNA, 21 nt, Staphylococcus aureus subsp. aureus MW2
aauuaaacaagccuuaaaaua

SEQ ID NO: 4033138 - RNA, 13 nt, Staphylococcus aureus subsp. aureus MW2
aauuaaacauuua

SEQ ID NO: 4033139 - RNA, 18 nt, Staphylococcus aureus subsp. aureus MW2
aauuaaagauuaaaauau

SEQ ID NO: 4033140 - RNA, 13 nt, Staphylococcus aureus subsp. aureus MW2
aauuaaauaauga

SEQ ID NO: 4033141 - RNA, 17 nt, Staphylococcus aureus subsp. aureus MW2
aauuaaauauuuaaccu

SEQ ID NO: 4033142 - RNA, 16 nt, Staphylococcus aureus subsp. aureus MW2
aauuaaaucuucaagu

SEQ ID NO: 4033143 - RNA, 23 nt, Staphylococcus aureus subsp. aureus MW2
aauuaaaugcauaauauauuaaa

SEQ ID NO: 4033144 - RNA, 13 nt, Staphylococcus aureus subsp. aureus MW2
aauuaaauguuua

SEQ ID NO: 4033145 - RNA, 14 nt, Staphylococcus aureus subsp. aureus MW2
aauuaaauucaaau

SEQ ID NO: 4033146 - RNA, 17 nt, Staphylococcus aureus subsp. aureus MW2
aauuaacaacaaauaua

SEQ ID NO: 4033147 - RNA, 11 nt, Staphylococcus aureus subsp. aureus MW2
aauuaacaaua

SEQ ID NO: 4033148 - RNA, 12 nt, Staphylococcus aureus subsp. aureus MW2
aauuaacaauau

SEQ ID NO: 4033149 - RNA, 19 nt, Staphylococcus aureus subsp. aureus MW2
aauuaacacucagauuuua

SEQ ID NO: 4033150 - RNA, 18 nt, Staphylococcus aureus subsp. aureus MW2
aauuaaccuugauuuaau

SEQ ID NO: 4033151 - RNA, 23 nt, Staphylococcus aureus subsp. aureus MW2
aauuaaccuugauuuaauuuuua

SEQ ID NO: 4033152 - RNA, 20 nt, Staphylococcus aureus subsp. aureus MW2
aauuaacuagugccucuuuu

SEQ ID NO: 4033153 - RNA, 22 nt, Staphylococcus aureus subsp. aureus MW2
aauuaacuuaaaauuuaaauau

SEQ ID NO: 4033154 - RNA, 21 nt, Staphylococcus aureus subsp. aureus MW2
aauuccuggugcaauaauaaa

SEQ ID NO: 4033155 - RNA, 15 nt, Staphylococcus aureus subsp. aureus MW2
aauucgccaucuuuu

SEQ ID NO: 4033156 - RNA, 21 nt, Staphylococcus aureus subsp. aureus MW2
aauucgccuaaaugguuuuga

SEQ ID NO: 4033157 - RNA, 22 nt, Staphylococcus aureus subsp. aureus MW2
aauucgccuaaaugguuuugaa

SEQ ID NO: 4033158 - RNA, 17 nt, Staphylococcus aureus subsp. aureus MW2
aauucgucuguuucaua

SEQ ID NO: 4033159 - RNA, 19 nt, Staphylococcus aureus subsp. aureus MW2
aauucgucuguuucauaua

SEQ ID NO: 4033160 - RNA, 13 nt, Staphylococcus aureus subsp. aureus MW2
aauucguuucacu

SEQ ID NO: 4033161 - RNA, 14 nt, Staphylococcus aureus subsp. aureus MW2
aauucuaaaagaau

SEQ ID NO: 4033162 - RNA, 16 nt, Staphylococcus aureus subsp. aureus MW2
aauucuaaaagaauua

SEQ ID NO: 4033163 - RNA, 14 nt, Staphylococcus aureus subsp. aureus MW2
aauucuaacugcaa

SEQ ID NO: 4033164 - RNA, 21 nt, Staphylococcus aureus subsp. aureus MW2
aauucuaagucuuuugaaguu

SEQ ID NO: 4033165 - RNA, 23 nt, Staphylococcus aureus subsp. aureus MW2
aauucuaagucuuuugaaguuug

SEQ ID NO: 4033166 - RNA, 13 nt, Staphylococcus aureus subsp. aureus MW2
aauucuacagaca

SEQ ID NO: 4033167 - RNA, 21 nt, Staphylococcus aureus subsp. aureus MW2
aauucuagucaggggccccaa

SEQ ID NO: 4033168 - RNA, 18 nt, Staphylococcus aureus subsp. aureus MW2
aauucucuaacuuuacca

SEQ ID NO: 4033169 - RNA, 17 nt, Staphylococcus aureus subsp. aureus MW2
aauucugaaaucaguuu

SEQ ID NO: 4033170 - RNA, 16 nt, Staphylococcus aureus subsp. aureus MW2
aauucugauuauguuc

SEQ ID NO: 4033171 - RNA, 17 nt, Staphylococcus aureus subsp. aureus MW2
aauucuggauuaaaccc

SEQ ID NO: 4033172 - RNA, 20 nt, Staphylococcus aureus subsp. aureus MW2
aauucugguuuaaugagcuu

SEQ ID NO: 4033173 - RNA, 20 nt, Staphylococcus aureus subsp. aureus MW2
aauucuguuucaaagcuguc

SEQ ID NO: 4033174 - RNA, 15 nt, Staphylococcus aureus subsp. aureus MW2
aauucuuaaaaagca

SEQ ID NO: 4033175 - RNA, 23 nt, Staphylococcus aureus subsp. aureus MW2
aauucuuaaucgagugauucagg

SEQ ID NO: 4033176 - RNA, 15 nt, Staphylococcus aureus subsp. aureus MW2
aauucuuauaaaaua

SEQ ID NO: 4033177 - RNA, 16 nt, Staphylococcus aureus subsp. aureus MW2
aauucuucaaauuuaa

SEQ ID NO: 4033178 - RNA, 23 nt, Staphylococcus aureus subsp. aureus MW2
aauucuucaaauuuaacguguaa

SEQ ID NO: 4033179 - RNA, 16 nt, Staphylococcus aureus subsp. aureus MW2
aauucuucaaccauuu

SEQ ID NO: 4033180 - RNA, 21 nt, Staphylococcus aureus subsp. aureus MW2
aauucuucaauuucauuuuug

SEQ ID NO: 4033181 - RNA, 22 nt, Staphylococcus aureus subsp. aureus MW2
aauucuucaucaauaacuauaa

SEQ ID NO: 4033182 - RNA, 19 nt, Staphylococcus aureus subsp. aureus MW2
aauucuucaucaugacuau

SEQ ID NO: 4033183 - RNA, 16 nt, Staphylococcus aureus subsp. aureus MW2
aauucuucaucuucuu

SEQ ID NO: 4033184 - RNA, 12 nt, Staphylococcus aureus subsp. aureus MW2
aauucuucuuca

SEQ ID NO: 4033185 - RNA, 15 nt, Staphylococcus aureus subsp. aureus MW2
aauucuuuaccauuc

SEQ ID NO: 4033186 - RNA, 20 nt, Staphylococcus aureus subsp. aureus MW2
aauucuuuaccauucaaccu

SEQ ID NO: 4033187 - RNA, 20 nt, Staphylococcus aureus subsp. aureus MW2
aauucuuuauguuggggccu

SEQ ID NO: 4033188 - RNA, 22 nt, Staphylococcus aureus subsp. aureus MW2
aauucuuucuuuuuuacauuua

SEQ ID NO: 4033189 - RNA, 16 nt, Staphylococcus aureus subsp. aureus MW2
aauucuuuuagaauuc

SEQ ID NO: 4033190 - RNA, 13 nt, Staphylococcus aureus subsp. aureus MW2
aauucuuuuguaa

SEQ ID NO: 4033191 - RNA, 15 nt, Staphylococcus aureus subsp. aureus MW2
aauucuuuuguaauu

SEQ ID NO: 4033192 - RNA, 21 nt, Staphylococcus aureus subsp. aureus MW2
aauucuuuuucagcuaauugu

SEQ ID NO: 4033193 - RNA, 23 nt, Staphylococcus aureus subsp. aureus MW2
aauucuuuuucagcuaauugucg

SEQ ID NO: 4033194 - RNA, 12 nt, Staphylococcus aureus subsp. aureus MW2
aauugaaaugau

SEQ ID NO: 4033195 - RNA, 13 nt, Staphylococcus aureus subsp. aureus MW2
aauugaaaugaua

SEQ ID NO: 4033196 - RNA, 17 nt, Staphylococcus aureus subsp. aureus MW2
aauugaaaugauaaaaa

SEQ ID NO: 4033197 - RNA, 12 nt, Staphylococcus aureus subsp. aureus MW2
aauugaaauuau

SEQ ID NO: 4033198 - RNA, 22 nt, Staphylococcus aureus subsp. aureus MW2
aauugaaggccauuuuuauuua

SEQ ID NO: 4033199 - RNA, 19 nt, Staphylococcus aureus subsp. aureus MW2
aauugaaucguauugaaaa

SEQ ID NO: 4033200 - RNA, 14 nt, Staphylococcus aureus subsp. aureus MW2
aauugaauuaaauc

SEQ ID NO: 4033201 - RNA, 15 nt, Staphylococcus aureus subsp. aureus MW2
aauugaauuaaaucu

SEQ ID NO: 4033202 - RNA, 22 nt, Staphylococcus aureus subsp. aureus MW2
aauugacuuacauuuuaauaaa

SEQ ID NO: 4033203 - RNA, 19 nt, Staphylococcus aureus subsp. aureus MW2
aauugacuuuaauugcucu

SEQ ID NO: 4033204 - RNA, 16 nt, Staphylococcus aureus subsp. aureus MW2
aauugagaaguauuau

SEQ ID NO: 4033205 - RNA, 19 nt, Staphylococcus aureus subsp. aureus MW2
aauugagaaguauuaugau

SEQ ID NO: 4033206 - RNA, 18 nt, Staphylococcus aureus subsp. aureus MW2
aauugauaguagcuuaau

SEQ ID NO: 4033207 - RNA, 21 nt, Staphylococcus aureus subsp. aureus MW2
aauugaucagcauuuaaguua

SEQ ID NO: 4033208 - RNA, 13 nt, Staphylococcus aureus subsp. aureus MW2
aauugauugcucu

SEQ ID NO: 4033209 - RNA, 21 nt, Staphylococcus aureus subsp. aureus MW2
aauugauugcucuaagcauuc

SEQ ID NO: 4033210 - RNA, 20 nt, Staphylococcus aureus subsp. aureus MW2
aauugauuguggugaaauaa

SEQ ID NO: 4033211 - RNA, 13 nt, Staphylococcus aureus subsp. aureus MW2
aauugauuuugaa

SEQ ID NO: 4033212 - RNA, 22 nt, Staphylococcus aureus subsp. aureus MW2
aauugcacauuuaaacuucgua

SEQ ID NO: 4033213 - RNA, 23 nt, Staphylococcus aureus subsp. aureus MW2
aauugcacgucuuguaucaacau

SEQ ID NO: 4033214 - RNA, 21 nt, Staphylococcus aureus subsp. aureus MW2
aauugcaugucuuaaauucuu

SEQ ID NO: 4033215 - RNA, 22 nt, Staphylococcus aureus subsp. aureus MW2
aauugcaugucuuaaauucuua

SEQ ID NO: 4033216 - RNA, 18 nt, Staphylococcus aureus subsp. aureus MW2
aauugcauuacuacaaac

SEQ ID NO: 4033217 - RNA, 23 nt, Staphylococcus aureus subsp. aureus MW2
aauugcauuacuacaaacuugau

SEQ ID NO: 4033218 - RNA, 14 nt, Staphylococcus aureus subsp. aureus MW2
aauugcuaaaucau

SEQ ID NO: 4033219 - RNA, 20 nt, Staphylococcus aureus subsp. aureus MW2
aauugcuauauuaguauaau

SEQ ID NO: 4033220 - RNA, 17 nt, Staphylococcus aureus subsp. aureus MW2
aauugcucuuuaacaau

SEQ ID NO: 4033221 - RNA, 18 nt, Staphylococcus aureus subsp. aureus MW2
aauugcucuuuaacaaug

SEQ ID NO: 4033222 - RNA, 21 nt, Staphylococcus aureus subsp. aureus MW2
aauugcuugaaauuauuauuu

SEQ ID NO: 4033223 - RNA, 13 nt, Staphylococcus aureus subsp. aureus MW2
aauugcuuguucu

SEQ ID NO: 4033224 - RNA, 20 nt, Staphylococcus aureus subsp. aureus MW2
aauugcuuuuucuuaauuau

SEQ ID NO: 4033225 - RNA, 18 nt, Staphylococcus aureus subsp. aureus MW2
aauuggauaauuucuucu

SEQ ID NO: 4033226 - RNA, 16 nt, Staphylococcus aureus subsp. aureus MW2
aauuggauuaaauacg

SEQ ID NO: 4033227 - RNA, 22 nt, Staphylococcus aureus subsp. aureus MW2
aauuggcuccccaauuucucug

SEQ ID NO: 4033228 - RNA, 22 nt, Staphylococcus aureus subsp. aureus MW2
aauugguauaacaauuuuagac

SEQ ID NO: 4033229 - RNA, 23 nt, Staphylococcus aureus subsp. aureus MW2
aauuggucgucauaccuauaaau

SEQ ID NO: 4033230 - RNA, 16 nt, Staphylococcus aureus subsp. aureus MW2
aauuguaaucuauuuu

SEQ ID NO: 4033231 - RNA, 18 nt, Staphylococcus aureus subsp. aureus MW2
aauuguagauccaauucc

SEQ ID NO: 4033232 - RNA, 22 nt, Staphylococcus aureus subsp. aureus MW2
aauuguauuaaucaaauauuuu

SEQ ID NO: 4033233 - RNA, 15 nt, Staphylococcus aureus subsp. aureus MW2
aauuguauuauuauu

SEQ ID NO: 4033234 - RNA, 12 nt, Staphylococcus aureus subsp. aureus MW2
aauuguauuuuc

SEQ ID NO: 4033235 - RNA, 23 nt, Staphylococcus aureus subsp. aureus MW2
aauugucguucucguguaaaaug

SEQ ID NO: 4033236 - RNA, 20 nt, Staphylococcus aureus subsp. aureus MW2
aauugucuagguuagaauua

SEQ ID NO: 4033237 - RNA, 16 nt, Staphylococcus aureus subsp. aureus MW2
aauuguguuucuuuua

SEQ ID NO: 4033238 - RNA, 20 nt, Staphylococcus aureus subsp. aureus MW2
aauuguuaaucccguuauau

SEQ ID NO: 4033239 - RNA, 14 nt, Staphylococcus aureus subsp. aureus MW2
aauuguuaauuuca

SEQ ID NO: 4033240 - RNA, 19 nt, Staphylococcus aureus subsp. aureus MW2
aauuguucuaauacaccaa

SEQ ID NO: 4033241 - RNA, 17 nt, Staphylococcus aureus subsp. aureus MW2
aauuguucucgucuuuu

SEQ ID NO: 4033242 - RNA, 13 nt, Staphylococcus aureus subsp. aureus MW2
aauuuguaauucc

SEQ ID NO: 4033243 - RNA, 14 nt, Staphylococcus aureus subsp. aureus MW2
aauuuguaauuccu

SEQ ID NO: 4033244 - RNA, 15 nt, Staphylococcus aureus subsp. aureus MW2
aauuuguaauuuaaa

SEQ ID NO: 4033245 - RNA, 17 nt, Staphylococcus aureus subsp. aureus MW2
aauuuguauuuaaaauc

SEQ ID NO: 4033246 - RNA, 14 nt, Staphylococcus aureus subsp. aureus MW2
aauuuuaaguuaau

SEQ ID NO: 4033247 - RNA, 19 nt, Staphylococcus aureus subsp. aureus MW2
aauuuuaauuuuucauuaa

SEQ ID NO: 4033248 - RNA, 20 nt, Staphylococcus aureus subsp. aureus MW2
aauuuuacaaaaugaugaaa

SEQ ID NO: 4033249 - RNA, 12 nt, Staphylococcus aureus subsp. aureus MW2
aauuuuaccaug

SEQ ID NO: 4033250 - RNA, 16 nt, Staphylococcus aureus subsp. aureus MW2
aauuuuaccauguuuu

SEQ ID NO: 4033251 - RNA, 22 nt, Staphylococcus aureus subsp. aureus MW2
aauuuuaccuucgcauacuuuu

SEQ ID NO: 4033252 - RNA, 23 nt, Staphylococcus aureus subsp. aureus MW2
aauuuuagcaguguguaucucuu

SEQ ID NO: 4033253 - RNA, 17 nt, Staphylococcus aureus subsp. aureus MW2
aauuuuauaauaaggca

SEQ ID NO: 4033254 - RNA, 13 nt, Staphylococcus aureus subsp. aureus MW2
aauuuuauauauc

SEQ ID NO: 4033255 - RNA, 16 nt, Staphylococcus aureus subsp. aureus MW2
aauuuuaucaauuucu

SEQ ID NO: 4033256 - RNA, 17 nt, Staphylococcus aureus subsp. aureus MW2
aauuuuauuagguaaua

SEQ ID NO: 4033257 - RNA, 14 nt, Staphylococcus aureus subsp. aureus MW2
aauuuuauuauuaa

SEQ ID NO: 4033258 - RNA, 22 nt, Staphylococcus aureus subsp. aureus MW2
aauuuuauuauuaaucguucca

SEQ ID NO: 4033259 - RNA, 18 nt, Staphylococcus aureus subsp. aureus MW2
aauuuucagcaucuacua

SEQ ID NO: 4033260 - RNA, 12 nt, Staphylococcus aureus subsp. aureus MW2
aauuuucaucau

SEQ ID NO: 4033261 - RNA, 18 nt, Staphylococcus aureus subsp. aureus MW2
aauuuucaucauuaaacc

SEQ ID NO: 4033262 - RNA, 21 nt, Staphylococcus aureus subsp. aureus MW2
aauuuuccuuucaauaauaaa

SEQ ID NO: 4033263 - RNA, 16 nt, Staphylococcus aureus subsp. aureus MW2
aauuuucuaaagauau

SEQ ID NO: 4033264 - RNA, 17 nt, Staphylococcus aureus subsp. aureus MW2
aauuuucuaaagauaua

SEQ ID NO: 4033265 - RNA, 22 nt, Staphylococcus aureus subsp. aureus MW2
aauuuucucaaacuaucuuaua

SEQ ID NO: 4033266 - RNA, 14 nt, Staphylococcus aureus subsp. aureus MW2
aauuuugagacaaa

SEQ ID NO: 4033267 - RNA, 16 nt, Staphylococcus aureus subsp. aureus MW2
aauuuugagacaaaaa

SEQ ID NO: 4033268 - RNA, 19 nt, Staphylococcus aureus subsp. aureus MW2
aauuuugauuuaccuucau

SEQ ID NO: 4033269 - RNA, 21 nt, Staphylococcus aureus subsp. aureus MW2
aauuuuguacauaaaaauaag

SEQ ID NO: 4033270 - RNA, 16 nt, Staphylococcus aureus subsp. aureus MW2
aauuuuguuuucuuug

SEQ ID NO: 4033271 - RNA, 18 nt, Staphylococcus aureus subsp. aureus MW2
aauuuuuaaaaaaauaau

SEQ ID NO: 4033272 - RNA, 15 nt, Staphylococcus aureus subsp. aureus MW2
aauuuuuaaacaaaa

SEQ ID NO: 4033273 - RNA, 19 nt, Staphylococcus aureus subsp. aureus MW2
aauuuuuaaaucuacaaua

SEQ ID NO: 4033274 - RNA, 14 nt, Staphylococcus aureus subsp. aureus MW2
aauuuuuaacaaaa

SEQ ID NO: 4033275 - RNA, 21 nt, Staphylococcus aureus subsp. aureus MW2
aauuuuuaacaaaauauacua

SEQ ID NO: 4033276 - RNA, 18 nt, Staphylococcus aureus subsp. aureus MW2
aauuuuuaugcauuauag

SEQ ID NO: 4033277 - RNA, 19 nt, Staphylococcus aureus subsp. aureus MW2
aauuuuuaugcauuauaga

SEQ ID NO: 4033278 - RNA, 13 nt, Staphylococcus aureus subsp. aureus MW2
aauuuuucauuaa

SEQ ID NO: 4033279 - RNA, 19 nt, Staphylococcus aureus subsp. aureus MW2
aauuuuucauuaauacaag

SEQ ID NO: 4033280 - RNA, 15 nt, Staphylococcus aureus subsp. aureus MW2
aauuuuucuucuuuu

SEQ ID NO: 4033281 - RNA, 21 nt, Staphylococcus aureus subsp. aureus MW2
aauuuuucuucuuuuuuaucu

SEQ ID NO: 4033282 - RNA, 13 nt, Staphylococcus aureus subsp. aureus MW2
aauuuuucuuuaa

SEQ ID NO: 4033283 - RNA, 23 nt, Staphylococcus aureus subsp. aureus MW2
aauuuuuggaaugguauagauuu

SEQ ID NO: 4033284 - RNA, 19 nt, Staphylococcus aureus subsp. aureus MW2
aauuuuuguaauacaucua

SEQ ID NO: 4033285 - RNA, 12 nt, Staphylococcus aureus subsp. aureus MW2
aauuuuuuaugu

SEQ ID NO: 4033286 - RNA, 16 nt, Staphylococcus aureus subsp. aureus MW2
aauuuuuuauuaagac

SEQ ID NO: 4033287 - RNA, 13 nt, Staphylococcus aureus subsp. aureus MW2
aauuuuuucguua

SEQ ID NO: 4033288 - RNA, 12 nt, Staphylococcus aureus subsp. aureus MW2
aauuuuuuuaau

SEQ ID NO: 4033289 - RNA, 15 nt, Staphylococcus aureus subsp. aureus MW2
aauuuuuuucauaau

SEQ ID NO: 4033290 - RNA, 22 nt, Staphylococcus aureus subsp. aureus MW2
acaaaaaauaauuuaauuuuuu

SEQ ID NO: 4033291 - RNA, 13 nt, Staphylococcus aureus subsp. aureus MW2
acaaaaaauuauc

SEQ ID NO: 4033292 - RNA, 16 nt, Staphylococcus aureus subsp. aureus MW2
acaaaaacuauuuuuu

SEQ ID NO: 4033293 - RNA, 16 nt, Staphylococcus aureus subsp. aureus MW2
acaaaaauaaaaccga

SEQ ID NO: 4033294 - RNA, 17 nt, Staphylococcus aureus subsp. aureus MW2
acaaaaauauagcuauu

SEQ ID NO: 4033295 - RNA, 13 nt, Staphylococcus aureus subsp. aureus MW2
acaaaaaugaaga

SEQ ID NO: 4033296 - RNA, 12 nt, Staphylococcus aureus subsp. aureus MW2
acaaaacauauu

SEQ ID NO: 4033297 - RNA, 10 nt, Staphylococcus aureus subsp. aureus MW2
acaaaagaaa

SEQ ID NO: 4033298 - RNA, 17 nt, Staphylococcus aureus subsp. aureus MW2
acaaaagaaaguuaauu

SEQ ID NO: 4033299 - RNA, 11 nt, Staphylococcus aureus subsp. aureus MW2
acaaaagcaac

SEQ ID NO: 4033300 - RNA, 22 nt, Staphylococcus aureus subsp. aureus MW2
acaaaagcaacuguaaaugaaa

SEQ ID NO: 4033301 - RNA, 16 nt, Staphylococcus aureus subsp. aureus MW2
acaaaagugaauguuu

SEQ ID NO: 4033302 - RNA, 16 nt, Staphylococcus aureus subsp. aureus MW2
acaaaauaacauguuu

SEQ ID NO: 4033303 - RNA, 15 nt, Staphylococcus aureus subsp. aureus MW2
acaaaaucaccuuuu

SEQ ID NO: 4033304 - RNA, 10 nt, Staphylococcus aureus subsp. aureus MW2
acaaaaugau

SEQ ID NO: 4033305 - RNA, 22 nt, Staphylococcus aureus subsp. aureus MW2
acaaaaugcguaucaauauuca

SEQ ID NO: 4033306 - RNA, 18 nt, Staphylococcus aureus subsp. aureus MW2
acaaaauugucucacuug

SEQ ID NO: 4033307 - RNA, 22 nt, Staphylococcus aureus subsp. aureus MW2
acaaaauugucucacuuguccu

SEQ ID NO: 4033308 - RNA, 16 nt, Staphylococcus aureus subsp. aureus MW2
acaaaccaauuuuaau

SEQ ID NO: 4033309 - RNA, 15 nt, Staphylococcus aureus subsp. aureus MW2
acaaacugauuuuuu

SEQ ID NO: 4033310 - RNA, 13 nt, Staphylococcus aureus subsp. aureus MW2
acaaagaaauuaa

SEQ ID NO: 4033311 - RNA, 22 nt, Staphylococcus aureus subsp. aureus MW2
acaaagaagcccccuaauauau

SEQ ID NO: 4033312 - RNA, 14 nt, Staphylococcus aureus subsp. aureus MW2
acaaagaagcuggc

SEQ ID NO: 4033313 - RNA, 13 nt, Staphylococcus aureus subsp. aureus MW2
acaaagauauguu

SEQ ID NO: 4033314 - RNA, 17 nt, Staphylococcus aureus subsp. aureus MW2
acaaagauauguuuaua

SEQ ID NO: 4033315 - RNA, 21 nt, Staphylococcus aureus subsp. aureus MW2
acaaagcuuguaaucauacca

SEQ ID NO: 4033316 - RNA, 16 nt, Staphylococcus aureus subsp. aureus MW2
acaaagugauuuaaaa

SEQ ID NO: 4033317 - RNA, 20 nt, Staphylococcus aureus subsp. aureus MW2
acaaaguuaaucauacauau

SEQ ID NO: 4033318 - RNA, 18 nt, Staphylococcus aureus subsp. aureus MW2
acaaauaaaaaaaccguu

SEQ ID NO: 4033319 - RNA, 12 nt, Staphylococcus aureus subsp. aureus MW2
acaaauaaaagc

SEQ ID NO: 4033320 - RNA, 21 nt, Staphylococcus aureus subsp. aureus MW2
acaaauaaaagcaacaaauau

SEQ ID NO: 4033321 - RNA, 14 nt, Staphylococcus aureus subsp. aureus MW2
acaaauaacaccga

SEQ ID NO: 4033322 - RNA, 18 nt, Staphylococcus aureus subsp. aureus MW2
acaaauacaguuaucacc

SEQ ID NO: 4033323 - RNA, 19 nt, Staphylococcus aureus subsp. aureus MW2
acaaauacaguuaucaccg

SEQ ID NO: 4033324 - RNA, 12 nt, Staphylococcus aureus subsp. aureus MW2
acaaauauguaa

SEQ ID NO: 4033325 - RNA, 14 nt, Staphylococcus aureus subsp. aureus MW2
acaaauauuucuaa

SEQ ID NO: 4033326 - RNA, 19 nt, Staphylococcus aureus subsp. aureus MW2
acaaaucgauuaauuauaa

SEQ ID NO: 4033327 - RNA, 13 nt, Staphylococcus aureus subsp. aureus MW2
acaaaucuauaaa

SEQ ID NO: 4033328 - RNA, 19 nt, Staphylococcus aureus subsp. aureus MW2
acaaaucuuuuaaauuuag

SEQ ID NO: 4033329 - RNA, 16 nt, Staphylococcus aureus subsp. aureus MW2
acaaaugcuacaucaa

SEQ ID NO: 4033330 - RNA, 17 nt, Staphylococcus aureus subsp. aureus MW2
acaaaugcuacaucaau

SEQ ID NO: 4033331 - RNA, 15 nt, Staphylococcus aureus subsp. aureus MW2
acaaugcagcuguau

SEQ ID NO: 4033332 - RNA, 13 nt, Staphylococcus aureus subsp. aureus MW2
acaauguauuacc

SEQ ID NO: 4033333 - RNA, 15 nt, Staphylococcus aureus subsp. aureus MW2
acaauuaaagugaau

SEQ ID NO: 4033334 - RNA, 16 nt, Staphylococcus aureus subsp. aureus MW2
acaauuaaagugaaua

SEQ ID NO: 4033335 - RNA, 13 nt, Staphylococcus aureus subsp. aureus MW2
acaauuaauuacu

SEQ ID NO: 4033336 - RNA, 15 nt, Staphylococcus aureus subsp. aureus MW2
acaauuauaauaaaa

SEQ ID NO: 4033337 - RNA, 16 nt, Staphylococcus aureus subsp. aureus MW2
acaauucauaagaaaa

SEQ ID NO: 4033338 - RNA, 17 nt, Staphylococcus aureus subsp. aureus MW2
acaauucauaagaaaaa

SEQ ID NO: 4033339 - RNA, 14 nt, Staphylococcus aureus subsp. aureus MW2
acaauucauuaaua

SEQ ID NO: 4033340 - RNA, 13 nt, Staphylococcus aureus subsp. aureus MW2
acaauugcagaga

SEQ ID NO: 4033341 - RNA, 21 nt, Staphylococcus aureus subsp. aureus MW2
acaauugguuguuucaauuca

SEQ ID NO: 4033342 - RNA, 22 nt, Staphylococcus aureus subsp. aureus MW2
acaauuguauaaugugcgucac

SEQ ID NO: 4033343 - RNA, 14 nt, Staphylococcus aureus subsp. aureus MW2
acaauuuaaaaagc

SEQ ID NO: 4033344 - RNA, 15 nt, Staphylococcus aureus subsp. aureus MW2
acaauuuaaaaagca

SEQ ID NO: 4033345 - RNA, 16 nt, Staphylococcus aureus subsp. aureus MW2
acaauuuaaaaagcag

SEQ ID NO: 4033346 - RNA, 14 nt, Staphylococcus aureus subsp. aureus MW2
acaauuuaaauuaa

SEQ ID NO: 4033347 - RNA, 17 nt, Staphylococcus aureus subsp. aureus MW2
acaauuuaaauuaagua

SEQ ID NO: 4033348 - RNA, 15 nt, Staphylococcus aureus subsp. aureus MW2
acaauuuagaugagu

SEQ ID NO: 4033349 - RNA, 20 nt, Staphylococcus aureus subsp. aureus MW2
acaauuuagcaaauauuucu

SEQ ID NO: 4033350 - RNA, 17 nt, Staphylococcus aureus subsp. aureus MW2
acaauuuauuaaaacga

SEQ ID NO: 4033351 - RNA, 13 nt, Staphylococcus aureus subsp. aureus MW2
acaauuucgcuua

SEQ ID NO: 4033352 - RNA, 24 nt, Staphylococcus aureus subsp. aureus MW2
acaauuucuauuuaaacaagaaaa

SEQ ID NO: 4033353 - RNA, 15 nt, Staphylococcus aureus subsp. aureus MW2
acaauuuuaucugaa

SEQ ID NO: 4033354 - RNA, 20 nt, Staphylococcus aureus subsp. aureus MW2
acaauuuuaucugaaucugc

SEQ ID NO: 4033355 - RNA, 22 nt, Staphylococcus aureus subsp. aureus MW2
acaauuuuccuuucaauaauaa

SEQ ID NO: 4033356 - RNA, 16 nt, Staphylococcus aureus subsp. aureus MW2
acaauuuucucauuaa

SEQ ID NO: 4033357 - RNA, 18 nt, Staphylococcus aureus subsp. aureus MW2
acacaaaggauauugaaa

SEQ ID NO: 4033358 - RNA, 23 nt, Staphylococcus aureus subsp. aureus MW2
acacaaauaaaagcaacaaauau

SEQ ID NO: 4033359 - RNA, 22 nt, Staphylococcus aureus subsp. aureus MW2
acacaaauuuuuuggaaacaug

SEQ ID NO: 4033360 - RNA, 23 nt, Staphylococcus aureus subsp. aureus MW2
acacaauaccuguccaaauaaau

SEQ ID NO: 4033361 - RNA, 14 nt, Staphylococcus aureus subsp. aureus MW2
acacagaagcuggc

SEQ ID NO: 4033362 - RNA, 15 nt, Staphylococcus aureus subsp. aureus MW2
acacagaagcuggcg

SEQ ID NO: 4033363 - RNA, 21 nt, Staphylococcus aureus subsp. aureus MW2
acacagaagcuggcggaaagu

SEQ ID NO: 4033364 - RNA, 13 nt, Staphylococcus aureus subsp. aureus MW2
acacagagaaauu

SEQ ID NO: 4033365 - RNA, 16 nt, Staphylococcus aureus subsp. aureus MW2
acacagcuucauuaau

SEQ ID NO: 4033366 - RNA, 21 nt, Staphylococcus aureus subsp. aureus MW2
acacagguaaauuuaaaauaa

SEQ ID NO: 4033367 - RNA, 22 nt, Staphylococcus aureus subsp. aureus MW2
acacagguaaauuuaaaauaau

SEQ ID NO: 4033368 - RNA, 16 nt, Staphylococcus aureus subsp. aureus MW2
acacaguaauucuuaa

SEQ ID NO: 4033369 - RNA, 14 nt, Staphylococcus aureus subsp. aureus MW2
acacaguacaaaua

SEQ ID NO: 4033370 - RNA, 15 nt, Staphylococcus aureus subsp. aureus MW2
acacaguacaaauaa

SEQ ID NO: 4033371 - RNA, 18 nt, Staphylococcus aureus subsp. aureus MW2
acacauauaguuguauca

SEQ ID NO: 4033372 - RNA, 21 nt, Staphylococcus aureus subsp. aureus MW2
acacaucaugacauuaaucau

SEQ ID NO: 4033373 - RNA, 21 nt, Staphylococcus aureus subsp. aureus MW2
acacauguacguuuuuuuaaa

SEQ ID NO: 4033374 - RNA, 20 nt, Staphylococcus aureus subsp. aureus MW2
acacauguauucaacugcgu

SEQ ID NO: 4033375 - RNA, 23 nt, Staphylococcus aureus subsp. aureus MW2
acacauuauugaaguuuuccuaa

SEQ ID NO: 4033376 - RNA, 17 nt, Staphylococcus aureus subsp. aureus MW2
acacauucuuauuugaa

SEQ ID NO: 4033377 - RNA, 13 nt, Staphylococcus aureus subsp. aureus MW2
acaccaacauauu

SEQ ID NO: 4033378 - RNA, 15 nt, Staphylococcus aureus subsp. aureus MW2
acaccaauauaaaca

SEQ ID NO: 4033379 - RNA, 13 nt, Staphylococcus aureus subsp. aureus MW2
acaccagauauca

SEQ ID NO: 4033380 - RNA, 18 nt, Staphylococcus aureus subsp. aureus MW2
acacccauuugucuuaau

SEQ ID NO: 4033381 - RNA, 22 nt, Staphylococcus aureus subsp. aureus MW2
acaccgcaaugccacaucauag

SEQ ID NO: 4033382 - RNA, 13 nt, Staphylococcus aureus subsp. aureus MW2
acaccuacaaaua

SEQ ID NO: 4033383 - RNA, 14 nt, Staphylococcus aureus subsp. aureus MW2
acaccuucaauauc

SEQ ID NO: 4033384 - RNA, 19 nt, Staphylococcus aureus subsp. aureus MW2
acacgcauuacuuuagaaa

SEQ ID NO: 4033385 - RNA, 21 nt, Staphylococcus aureus subsp. aureus MW2
acacgcgguaaaacgaaguca

SEQ ID NO: 4033386 - RNA, 17 nt, Staphylococcus aureus subsp. aureus MW2
acacguguaaaaaugau

SEQ ID NO: 4033387 - RNA, 23 nt, Staphylococcus aureus subsp. aureus MW2
acacguucuugguauuuuuuaaa

SEQ ID NO: 4033388 - RNA, 19 nt, Staphylococcus aureus subsp. aureus MW2
acacuaaaaccuauuccua

SEQ ID NO: 4033389 - RNA, 21 nt, Staphylococcus aureus subsp. aureus MW2
acacuacgcugaugaaugauu

SEQ ID NO: 4033390 - RNA, 21 nt, Staphylococcus aureus subsp. aureus MW2
acacuagucuuuuuauuuuaa

SEQ ID NO: 4033391 - RNA, 22 nt, Staphylococcus aureus subsp. aureus MW2
acacuaucauuaucaaauaacc

SEQ ID NO: 4033392 - RNA, 16 nt, Staphylococcus aureus subsp. aureus MW2
acacucggaaacaugu

SEQ ID NO: 4033393 - RNA, 15 nt, Staphylococcus aureus subsp. aureus MW2
acacugcacaucaua

SEQ ID NO: 4033394 - RNA, 14 nt, Staphylococcus aureus subsp. aureus MW2
acacugccaauaua

SEQ ID NO: 4033395 - RNA, 17 nt, Staphylococcus aureus subsp. aureus MW2
acacugccaauauaaca

SEQ ID NO: 4033396 - RNA, 18 nt, Staphylococcus aureus subsp. aureus MW2
acacuggcguuaaagcuu

SEQ ID NO: 4033397 - RNA, 14 nt, Staphylococcus aureus subsp. aureus MW2
acacuguugaaaau

SEQ ID NO: 4033398 - RNA, 22 nt, Staphylococcus aureus subsp. aureus MW2
acacuguuuuauaaaugaauua

SEQ ID NO: 4033399 - RNA, 20 nt, Staphylococcus aureus subsp. aureus MW2
acacuucguauugaaugaau

SEQ ID NO: 4033400 - RNA, 21 nt, Staphylococcus aureus subsp. aureus MW2
acacuucguauugaaugaauu

SEQ ID NO: 4033401 - RNA, 16 nt, Staphylococcus aureus subsp. aureus MW2
acacuugcuaaaacua

SEQ ID NO: 4033402 - RNA, 14 nt, Staphylococcus aureus subsp. aureus MW2
acacuuuaaauaca

SEQ ID NO: 4033403 - RNA, 16 nt, Staphylococcus aureus subsp. aureus MW2
acacuuuaguauuaua

SEQ ID NO: 4033404 - RNA, 12 nt, Staphylococcus aureus subsp. aureus MW2
acagaaaacaaa

SEQ ID NO: 4033405 - RNA, 12 nt, Staphylococcus aureus subsp. aureus MW2
acagaaaugaua

SEQ ID NO: 4033406 - RNA, 14 nt, Staphylococcus aureus subsp. aureus MW2
acagaauuucauca

SEQ ID NO: 4033407 - RNA, 15 nt, Staphylococcus aureus subsp. aureus MW2
acagacaaugcaagu

SEQ ID NO: 4033408 - RNA, 22 nt, Staphylococcus aureus subsp. aureus MW2
acagagaaucaauuauugaaaa

SEQ ID NO: 4033409 - RNA, 15 nt, Staphylococcus aureus subsp. aureus MW2
acagaguugucauuc

SEQ ID NO: 4033410 - RNA, 15 nt, Staphylococcus aureus subsp. aureus MW2
acagauaaagcuucg

SEQ ID NO: 4033411 - RNA, 20 nt, Staphylococcus aureus subsp. aureus MW2
acagcaauucacuuauacau

SEQ ID NO: 4033412 - RNA, 22 nt, Staphylococcus aureus subsp. aureus MW2
acagcaauucacuuauacaugu

SEQ ID NO: 4033413 - RNA, 22 nt, Staphylococcus aureus subsp. aureus MW2
acagcacauuuuuaguuagaaa

SEQ ID NO: 4033414 - RNA, 17 nt, Staphylococcus aureus subsp. aureus MW2
acagcacgagacaauaa

SEQ ID NO: 4033415 - RNA, 22 nt, Staphylococcus aureus subsp. aureus MW2
acagcaguaagacgauuucaau

SEQ ID NO: 4033416 - RNA, 17 nt, Staphylococcus aureus subsp. aureus MW2
acagcaguaagauuauu

SEQ ID NO: 4033417 - RNA, 21 nt, Staphylococcus aureus subsp. aureus MW2
acagcuaaggcugauucaaaa

SEQ ID NO: 4033418 - RNA, 15 nt, Staphylococcus aureus subsp. aureus MW2
acagcuacaaauaau

SEQ ID NO: 4033419 - RNA, 22 nt, Staphylococcus aureus subsp. aureus MW2
acaucgauugauaauguaaaau

SEQ ID NO: 4033420 - RNA, 19 nt, Staphylococcus aureus subsp. aureus MW2
acaucgcauaauaucuuac

SEQ ID NO: 4033421 - RNA, 14 nt, Staphylococcus aureus subsp. aureus MW2
acaucggaauucaa

SEQ ID NO: 4033422 - RNA, 22 nt, Staphylococcus aureus subsp. aureus MW2
acaucguugcuuuuauuuuuaa

SEQ ID NO: 4033423 - RNA, 19 nt, Staphylococcus aureus subsp. aureus MW2
acaucuaagugauauacga

SEQ ID NO: 4033424 - RNA, 22 nt, Staphylococcus aureus subsp. aureus MW2
acaucuagaugaaauuguguug

SEQ ID NO: 4033425 - RNA, 15 nt, Staphylococcus aureus subsp. aureus MW2
acaucuauccuuguu

SEQ ID NO: 4033426 - RNA, 14 nt, Staphylococcus aureus subsp. aureus MW2
acaucugaaaaaau

SEQ ID NO: 4033427 - RNA, 15 nt, Staphylococcus aureus subsp. aureus MW2
acaucugaaucugaa

SEQ ID NO: 4033428 - RNA, 17 nt, Staphylococcus aureus subsp. aureus MW2
acaucuguagguuuaau

SEQ ID NO: 4033429 - RNA, 20 nt, Staphylococcus aureus subsp. aureus MW2
acaucuucguaugaguucuu

SEQ ID NO: 4033430 - RNA, 20 nt, Staphylococcus aureus subsp. aureus MW2
acaucuucuucaucauauuc

SEQ ID NO: 4033431 - RNA, 20 nt, Staphylococcus aureus subsp. aureus MW2
acaucuuuaagcucuuaauc

SEQ ID NO: 4033432 - RNA, 17 nt, Staphylococcus aureus subsp. aureus MW2
acaucuuuuguuguuuu

SEQ ID NO: 4033433 - RNA, 20 nt, Staphylococcus aureus subsp. aureus MW2
acaucuuuuuaaaaggugug

SEQ ID NO: 4033434 - RNA, 15 nt, Staphylococcus aureus subsp. aureus MW2
acaucuuuuucaccu

SEQ ID NO: 4033435 - RNA, 15 nt, Staphylococcus aureus subsp. aureus MW2
acaucuuuuugauaa

SEQ ID NO: 4033436 - RNA, 14 nt, Staphylococcus aureus subsp. aureus MW2
acaugaaauuaauc

SEQ ID NO: 4033437 - RNA, 16 nt, Staphylococcus aureus subsp. aureus MW2
acaugacauucauuua

SEQ ID NO: 4033438 - RNA, 20 nt, Staphylococcus aureus subsp. aureus MW2
acaugauacugaaauuucau

SEQ ID NO: 4033439 - RNA, 14 nt, Staphylococcus aureus subsp. aureus MW2
acaugauauaaaua

SEQ ID NO: 4033440 - RNA, 15 nt, Staphylococcus aureus subsp. aureus MW2
acaugauucaugaua

SEQ ID NO: 4033441 - RNA, 19 nt, Staphylococcus aureus subsp. aureus MW2
acaugcaccuuuacaacau

SEQ ID NO: 4033442 - RNA, 19 nt, Staphylococcus aureus subsp. aureus MW2
acaugcuuggacauauacu

SEQ ID NO: 4033443 - RNA, 18 nt, Staphylococcus aureus subsp. aureus MW2
acaugggcaaucacuccu

SEQ ID NO: 4033444 - RNA, 22 nt, Staphylococcus aureus subsp. aureus MW2
acaugguugauucgauaugaau

SEQ ID NO: 4033445 - RNA, 16 nt, Staphylococcus aureus subsp. aureus MW2
acaugguuuucaccag

SEQ ID NO: 4033446 - RNA, 13 nt, Staphylococcus aureus subsp. aureus MW2
acauguaaugaau

SEQ ID NO: 4033447 - RNA, 13 nt, Staphylococcus aureus subsp. aureus MW2
acauguacauuau

SEQ ID NO: 4033448 - RNA, 20 nt, Staphylococcus aureus subsp. aureus MW2
acauguauuggccaaacaac

SEQ ID NO: 4033449 - RNA, 18 nt, Staphylococcus aureus subsp. aureus MW2
acauguauuuaguaucau

SEQ ID NO: 4033450 - RNA, 12 nt, Staphylococcus aureus subsp. aureus MW2
acaugugaaaua

SEQ ID NO: 4033451 - RNA, 10 nt, Staphylococcus aureus subsp. aureus MW2
acauguucac

SEQ ID NO: 4033452 - RNA, 16 nt, Staphylococcus aureus subsp. aureus MW2
acauguugauaaaaag

SEQ ID NO: 4033453 - RNA, 16 nt, Staphylococcus aureus subsp. aureus MW2
acauguuucuagauau

SEQ ID NO: 4033454 - RNA, 20 nt, Staphylococcus aureus subsp. aureus MW2
acauguuucuagauaugccu

SEQ ID NO: 4033455 - RNA, 17 nt, Staphylococcus aureus subsp. aureus MW2
acauguuuggaugaaca

SEQ ID NO: 4033456 - RNA, 20 nt, Staphylococcus aureus subsp. aureus MW2
acauguuuggaugaacaaaa

SEQ ID NO: 4033457 - RNA, 19 nt, Staphylococcus aureus subsp. aureus MW2
acauuaaaauaauuaaaua

SEQ ID NO: 4033458 - RNA, 15 nt, Staphylococcus aureus subsp. aureus MW2
acauuaaaaugauau

SEQ ID NO: 4033459 - RNA, 21 nt, Staphylococcus aureus subsp. aureus MW2
acauuaaacauauuuuuugau

SEQ ID NO: 4033460 - RNA, 16 nt, Staphylococcus aureus subsp. aureus MW2
acauuaagcuaugcuu

SEQ ID NO: 4033461 - RNA, 14 nt, Staphylococcus aureus subsp. aureus MW2
acauuaaguuaaac

SEQ ID NO: 4033462 - RNA, 12 nt, Staphylococcus aureus subsp. aureus MW2
acauuaauauaa

SEQ ID NO: 4033463 - RNA, 19 nt, Staphylococcus aureus subsp. aureus MW2
acauuaaugauagcaauga

SEQ ID NO: 4033464 - RNA, 22 nt, Staphylococcus aureus subsp. aureus MW2
acauuaaugauagcaaugaauu

SEQ ID NO: 4033465 - RNA, 15 nt, Staphylococcus aureus subsp. aureus MW2
acauuacaucuuuaa

SEQ ID NO: 4033466 - RNA, 15 nt, Staphylococcus aureus subsp. aureus MW2
acauuacauuuagua

SEQ ID NO: 4033467 - RNA, 17 nt, Staphylococcus aureus subsp. aureus MW2
acauuacguaucuuuac

SEQ ID NO: 4033468 - RNA, 17 nt, Staphylococcus aureus subsp. aureus MW2
acauuagcaugauaaag

SEQ ID NO: 4033469 - RNA, 15 nt, Staphylococcus aureus subsp. aureus MW2
acauuagcauuaaau

SEQ ID NO: 4033470 - RNA, 20 nt, Staphylococcus aureus subsp. aureus MW2
acauuaggauguucagcuaa

SEQ ID NO: 4033471 - RNA, 19 nt, Staphylococcus aureus subsp. aureus MW2
acauuaguuugaucauuua

SEQ ID NO: 4033472 - RNA, 21 nt, Staphylococcus aureus subsp. aureus MW2
acauuaguuugaucauuuacu

SEQ ID NO: 4033473 - RNA, 20 nt, Staphylococcus aureus subsp. aureus MW2
acauuauuguaaguuggcuu

SEQ ID NO: 4033474 - RNA, 12 nt, Staphylococcus aureus subsp. aureus MW2
acauuauuuaua

SEQ ID NO: 4033475 - RNA, 19 nt, Staphylococcus aureus subsp. aureus MW2
acauuauuuauauuuagaa

SEQ ID NO: 4033476 - RNA, 16 nt, Staphylococcus aureus subsp. aureus MW2
acauucacauuauuua

SEQ ID NO: 4033477 - RNA, 19 nt, Staphylococcus aureus subsp. aureus MW2
acauucacauuauuuaaac

SEQ ID NO: 4033478 - RNA, 20 nt, Staphylococcus aureus subsp. aureus MW2
acauucagugcaaugauagc

SEQ ID NO: 4033479 - RNA, 20 nt, Staphylococcus aureus subsp. aureus MW2
acauucauaccgaagaaacu

SEQ ID NO: 4033480 - RNA, 22 nt, Staphylococcus aureus subsp. aureus MW2
acauucauaccgaagaaacuaa

SEQ ID NO: 4033481 - RNA, 17 nt, Staphylococcus aureus subsp. aureus MW2
acauucauuuaguuaaa

SEQ ID NO: 4033482 - RNA, 21 nt, Staphylococcus aureus subsp. aureus MW2
acauucauuuaguuaaauaca

SEQ ID NO: 4033483 - RNA, 19 nt, Staphylococcus aureus subsp. aureus MW2
acauuccaaaaccgaaaau

SEQ ID NO: 4033484 - RNA, 22 nt, Staphylococcus aureus subsp. aureus MW2
acauuccaaaaccgaaaauacc

SEQ ID NO: 4033485 - RNA, 16 nt, Staphylococcus aureus subsp. aureus MW2
acauuccucuauugua

SEQ ID NO: 4033486 - RNA, 23 nt, Staphylococcus aureus subsp. aureus MW2
acauucuaacuacggaaguggua

SEQ ID NO: 4033487 - RNA, 18 nt, Staphylococcus aureus subsp. aureus MW2
acauucuauacuuuuaau

SEQ ID NO: 4033488 - RNA, 12 nt, Staphylococcus aureus subsp. aureus MW2
acauucuaugua

SEQ ID NO: 4033489 - RNA, 14 nt, Staphylococcus aureus subsp. aureus MW2
acauucuucaaaaa

SEQ ID NO: 4033490 - RNA, 19 nt, Staphylococcus aureus subsp. aureus MW2
acauucuucaaaaaauaau

SEQ ID NO: 4033491 - RNA, 18 nt, Staphylococcus aureus subsp. aureus MW2
acauucuugaauaaauuu

SEQ ID NO: 4033492 - RNA, 18 nt, Staphylococcus aureus subsp. aureus MW2
acauugaaaggaacauuu

SEQ ID NO: 4033493 - RNA, 18 nt, Staphylococcus aureus subsp. aureus MW2
acauugagauuaucuuua

SEQ ID NO: 4033494 - RNA, 15 nt, Staphylococcus aureus subsp. aureus MW2
acauugauaaauuuu

SEQ ID NO: 4033495 - RNA, 20 nt, Staphylococcus aureus subsp. aureus MW2
acauugauuucuguaccaaa

SEQ ID NO: 4033496 - RNA, 17 nt, Staphylococcus aureus subsp. aureus MW2
acauuggauuacuucca

SEQ ID NO: 4033497 - RNA, 18 nt, Staphylococcus aureus subsp. aureus MW2
acauuggauuacuuccau

SEQ ID NO: 4033498 - RNA, 15 nt, Staphylococcus aureus subsp. aureus MW2
acauugguuuuuacu

SEQ ID NO: 4033499 - RNA, 15 nt, Staphylococcus aureus subsp. aureus MW2
acauuguaaaaugcu

SEQ ID NO: 4033500 - RNA, 22 nt, Staphylococcus aureus subsp. aureus MW2
acauuguaaaaugcucccuuca

SEQ ID NO: 4033501 - RNA, 22 nt, Staphylococcus aureus subsp. aureus MW2
acauuuaagaaacgucuuaauu

SEQ ID NO: 4033502 - RNA, 23 nt, Staphylococcus aureus subsp. aureus MW2
acauuuacacgucuaauuuuaau

SEQ ID NO: 4033503 - RNA, 18 nt, Staphylococcus aureus subsp. aureus MW2
acauuuacuuaagaacua

SEQ ID NO: 4033504 - RNA, 15 nt, Staphylococcus aureus subsp. aureus MW2
acauuuagauuucau

SEQ ID NO: 4033505 - RNA, 14 nt, Staphylococcus aureus subsp. aureus MW2
acauuuauuuucaa

SEQ ID NO: 4033506 - RNA, 15 nt, Staphylococcus aureus subsp. aureus MW2
acauuucaauugcau

SEQ ID NO: 4033507 - RNA, 17 nt, Staphylococcus aureus subsp. aureus MW2
accccaacuugcacauu

SEQ ID NO: 4033508 - RNA, 15 nt, Staphylococcus aureus subsp. aureus MW2
accccauuuuaaagu

SEQ ID NO: 4033509 - RNA, 13 nt, Staphylococcus aureus subsp. aureus MW2
accccuaauuaaa

SEQ ID NO: 4033510 - RNA, 15 nt, Staphylococcus aureus subsp. aureus MW2
accccuaauuaaaau

SEQ ID NO: 4033511 - RNA, 21 nt, Staphylococcus aureus subsp. aureus MW2
accccuccuggugcugcacca

SEQ ID NO: 4033512 - RNA, 13 nt, Staphylococcus aureus subsp. aureus MW2
accccuuuauuuu

SEQ ID NO: 4033513 - RNA, 21 nt, Staphylococcus aureus subsp. aureus MW2
accccuuuguuugaagugaaa

SEQ ID NO: 4033514 - RNA, 13 nt, Staphylococcus aureus subsp. aureus MW2
accgaaaauaccu

SEQ ID NO: 4033515 - RNA, 16 nt, Staphylococcus aureus subsp. aureus MW2
accgaauaauuuugau

SEQ ID NO: 4033516 - RNA, 17 nt, Staphylococcus aureus subsp. aureus MW2
accgcaaugccacauca

SEQ ID NO: 4033517 - RNA, 19 nt, Staphylococcus aureus subsp. aureus MW2
accgcacuucuauauuaau

SEQ ID NO: 4033518 - RNA, 19 nt, Staphylococcus aureus subsp. aureus MW2
accgccaacuaauguuaaa

SEQ ID NO: 4033519 - RNA, 16 nt, Staphylococcus aureus subsp. aureus MW2
accgcuuaauucuuca

SEQ ID NO: 4033520 - RNA, 19 nt, Staphylococcus aureus subsp. aureus MW2
accgcuucucgccuaauua

SEQ ID NO: 4033521 - RNA, 18 nt, Staphylococcus aureus subsp. aureus MW2
accgcuucuuuuaaguua

SEQ ID NO: 4033522 - RNA, 16 nt, Staphylococcus aureus subsp. aureus MW2
accguaacauauguac

SEQ ID NO: 4033523 - RNA, 22 nt, Staphylococcus aureus subsp. aureus MW2
accguaaucuuuuaacuuuccg

SEQ ID NO: 4033524 - RNA, 13 nt, Staphylococcus aureus subsp. aureus MW2
accguaauuuuaa

SEQ ID NO: 4033525 - RNA, 15 nt, Staphylococcus aureus subsp. aureus MW2
accgucaaacuuaaa

SEQ ID NO: 4033526 - RNA, 19 nt, Staphylococcus aureus subsp. aureus MW2
accgucaaacuuaaaacua

SEQ ID NO: 4033527 - RNA, 20 nt, Staphylococcus aureus subsp. aureus MW2
accgucuucucuaucaguau

SEQ ID NO: 4033528 - RNA, 19 nt, Staphylococcus aureus subsp. aureus MW2
accguguuguugaauaauu

SEQ ID NO: 4033529 - RNA, 14 nt, Staphylococcus aureus subsp. aureus MW2
accuaaaaacagca

SEQ ID NO: 4033530 - RNA, 18 nt, Staphylococcus aureus subsp. aureus MW2
accuaaaauacccauuuu

SEQ ID NO: 4033531 - RNA, 19 nt, Staphylococcus aureus subsp. aureus MW2
accuaaaugauuaauaaca

SEQ ID NO: 4033532 - RNA, 21 nt, Staphylococcus aureus subsp. aureus MW2
accuaaaugauuaauaacaua

SEQ ID NO: 4033533 - RNA, 16 nt, Staphylococcus aureus subsp. aureus MW2
accuaacgcuaaugau

SEQ ID NO: 4033534 - RNA, 23 nt, Staphylococcus aureus subsp. aureus MW2
accuaauauauuacuaaccuauu

SEQ ID NO: 4033535 - RNA, 20 nt, Staphylococcus aureus subsp. aureus MW2
accuaauucgccaucuuuuu

SEQ ID NO: 4033536 - RNA, 19 nt, Staphylococcus aureus subsp. aureus MW2
accuacaacaccaauugaa

SEQ ID NO: 4033537 - RNA, 23 nt, Staphylococcus aureus subsp. aureus MW2
accuacaauuuuccuuucaauaa

SEQ ID NO: 4033538 - RNA, 21 nt, Staphylococcus aureus subsp. aureus MW2
accuacacgaccaagacgaac

SEQ ID NO: 4033539 - RNA, 17 nt, Staphylococcus aureus subsp. aureus MW2
accuacacggucccaag

SEQ ID NO: 4033540 - RNA, 21 nt, Staphylococcus aureus subsp. aureus MW2
accuacgauucgaaauaggua

SEQ ID NO: 4033541 - RNA, 19 nt, Staphylococcus aureus subsp. aureus MW2
accuacuuugauauguuuc

SEQ ID NO: 4033542 - RNA, 19 nt, Staphylococcus aureus subsp. aureus MW2
accuagggauaauuuuauu

SEQ ID NO: 4033543 - RNA, 16 nt, Staphylococcus aureus subsp. aureus MW2
accuaugguuacccuu

SEQ ID NO: 4033544 - RNA, 16 nt, Staphylococcus aureus subsp. aureus MW2
accuauuaauaucaua

SEQ ID NO: 4033545 - RNA, 17 nt, Staphylococcus aureus subsp. aureus MW2
accuauuccuaauaaau

SEQ ID NO: 4033546 - RNA, 17 nt, Staphylococcus aureus subsp. aureus MW2
accuauuccuauuacua

SEQ ID NO: 4033547 - RNA, 14 nt, Staphylococcus aureus subsp. aureus MW2
accuauuugcugaa

SEQ ID NO: 4033548 - RNA, 17 nt, Staphylococcus aureus subsp. aureus MW2
accuauuuuuugagcac

SEQ ID NO: 4033549 - RNA, 20 nt, Staphylococcus aureus subsp. aureus MW2
accucauccgccaauuaaaa

SEQ ID NO: 4033550 - RNA, 19 nt, Staphylococcus aureus subsp. aureus MW2
accucggauaccaaaacuc

SEQ ID NO: 4033551 - RNA, 23 nt, Staphylococcus aureus subsp. aureus MW2
accucuaaguucaccuaaaugau

SEQ ID NO: 4033552 - RNA, 13 nt, Staphylococcus aureus subsp. aureus MW2
accugacuuuccg

SEQ ID NO: 4033553 - RNA, 14 nt, Staphylococcus aureus subsp. aureus MW2
accugauaauacaa

SEQ ID NO: 4033554 - RNA, 17 nt, Staphylococcus aureus subsp. aureus MW2
accugcgccuucuuuuu

SEQ ID NO: 4033555 - RNA, 20 nt, Staphylococcus aureus subsp. aureus MW2
accugcucuuuccacagcuu

SEQ ID NO: 4033556 - RNA, 17 nt, Staphylococcus aureus subsp. aureus MW2
accuggcacaaaugcua

SEQ ID NO: 4033557 - RNA, 18 nt, Staphylococcus aureus subsp. aureus MW2
accuggucguacuuucaa

SEQ ID NO: 4033558 - RNA, 20 nt, Staphylococcus aureus subsp. aureus MW2
accugucuuaauucauucca

SEQ ID NO: 4033559 - RNA, 12 nt, Staphylococcus aureus subsp. aureus MW2
accugugauaac

SEQ ID NO: 4033560 - RNA, 12 nt, Staphylococcus aureus subsp. aureus MW2
accuguuaaugu

SEQ ID NO: 4033561 - RNA, 23 nt, Staphylococcus aureus subsp. aureus MW2
accuguuuuaauugggucuuuau

SEQ ID NO: 4033562 - RNA, 13 nt, Staphylococcus aureus subsp. aureus MW2
accuuaauaauga

SEQ ID NO: 4033563 - RNA, 16 nt, Staphylococcus aureus subsp. aureus MW2
accuuaauaaugaauu

SEQ ID NO: 4033564 - RNA, 18 nt, Staphylococcus aureus subsp. aureus MW2
accuuaauaaugaauucu

SEQ ID NO: 4033565 - RNA, 22 nt, Staphylococcus aureus subsp. aureus MW2
accuuaauaggauaugcuaaac

SEQ ID NO: 4033566 - RNA, 15 nt, Staphylococcus aureus subsp. aureus MW2
accuuacccaaaaaa

SEQ ID NO: 4033567 - RNA, 20 nt, Staphylococcus aureus subsp. aureus MW2
accuuacccaaaaaauugua

SEQ ID NO: 4033568 - RNA, 17 nt, Staphylococcus aureus subsp. aureus MW2
accuuacuacucauuau

SEQ ID NO: 4033569 - RNA, 22 nt, Staphylococcus aureus subsp. aureus MW2
accuuauauuuuauuuaaaaau

SEQ ID NO: 4033570 - RNA, 16 nt, Staphylococcus aureus subsp. aureus MW2
accuuaucaugacaca

SEQ ID NO: 4033571 - RNA, 19 nt, Staphylococcus aureus subsp. aureus MW2
accuucaguuucuacugua

SEQ ID NO: 4033572 - RNA, 12 nt, Staphylococcus aureus subsp. aureus MW2
accuucaucuuu

SEQ ID NO: 4033573 - RNA, 19 nt, Staphylococcus aureus subsp. aureus MW2
accuucuauauugggacuu

SEQ ID NO: 4033574 - RNA, 16 nt, Staphylococcus aureus subsp. aureus MW2
accuugaaugauauua

SEQ ID NO: 4033575 - RNA, 18 nt, Staphylococcus aureus subsp. aureus MW2
accuugaaugauauuaac

SEQ ID NO: 4033576 - RNA, 20 nt, Staphylococcus aureus subsp. aureus MW2
accuugauuuaauuuuuaau

SEQ ID NO: 4033577 - RNA, 20 nt, Staphylococcus aureus subsp. aureus MW2
accuuguucuuuacuccaaa

SEQ ID NO: 4033578 - RNA, 19 nt, Staphylococcus aureus subsp. aureus MW2
accuuguuucaagcuuaau

SEQ ID NO: 4033579 - RNA, 15 nt, Staphylococcus aureus subsp. aureus MW2
accuuuaaaacauca

SEQ ID NO: 4033580 - RNA, 17 nt, Staphylococcus aureus subsp. aureus MW2
accuuuagacaauauuu

SEQ ID NO: 4033581 - RNA, 14 nt, Staphylococcus aureus subsp. aureus MW2
accuuuauuauuua

SEQ ID NO: 4033582 - RNA, 14 nt, Staphylococcus aureus subsp. aureus MW2
accuuucgauaaac

SEQ ID NO: 4033583 - RNA, 22 nt, Staphylococcus aureus subsp. aureus MW2
accuuucgcgacuucauuacaa

SEQ ID NO: 4033584 - RNA, 23 nt, Staphylococcus aureus subsp. aureus MW2
accuuugccaacaccauuauaga

SEQ ID NO: 4033585 - RNA, 18 nt, Staphylococcus aureus subsp. aureus MW2
accuuugcuaaauauuau

SEQ ID NO: 4033586 - RNA, 19 nt, Staphylococcus aureus subsp. aureus MW2
accuuugcuaaauauuaua

SEQ ID NO: 4033587 - RNA, 20 nt, Staphylococcus aureus subsp. aureus MW2
accuuugcuaaauauuauaa

SEQ ID NO: 4033588 - RNA, 21 nt, Staphylococcus aureus subsp. aureus MW2
accuuuuuauugauauuaaua

SEQ ID NO: 4033589 - RNA, 17 nt, Staphylococcus aureus subsp. aureus MW2
accuuuuuuaacuuuaa

SEQ ID NO: 4033590 - RNA, 19 nt, Staphylococcus aureus subsp. aureus MW2
accuuuuuuaacuuuaaca

SEQ ID NO: 4033591 - RNA, 12 nt, Staphylococcus aureus subsp. aureus MW2
acgaaaagucag

SEQ ID NO: 4033592 - RNA, 21 nt, Staphylococcus aureus subsp. aureus MW2
acgaaaauuaagaugaaauac

SEQ ID NO: 4033593 - RNA, 14 nt, Staphylococcus aureus subsp. aureus MW2
acgaaagagaaaag

SEQ ID NO: 4033594 - RNA, 17 nt, Staphylococcus aureus subsp. aureus MW2
acgaaagagaaaagcua

SEQ ID NO: 4033595 - RNA, 17 nt, Staphylococcus aureus subsp. aureus MW2
acguucagguaauguuu

SEQ ID NO: 4033596 - RNA, 23 nt, Staphylococcus aureus subsp. aureus MW2
acguucuugguauuuuuuaaaug

SEQ ID NO: 4033597 - RNA, 21 nt, Staphylococcus aureus subsp. aureus MW2
acguugaauguuccucuauau

SEQ ID NO: 4033598 - RNA, 23 nt, Staphylococcus aureus subsp. aureus MW2
acguugguuuaaaaauugauauu

SEQ ID NO: 4033599 - RNA, 21 nt, Staphylococcus aureus subsp. aureus MW2
acguuguaauaguaaguacga

SEQ ID NO: 4033600 - RNA, 18 nt, Staphylococcus aureus subsp. aureus MW2
acguuuccaauccauuaa

SEQ ID NO: 4033601 - RNA, 14 nt, Staphylococcus aureus subsp. aureus MW2
acguuugaaaaauu

SEQ ID NO: 4033602 - RNA, 17 nt, Staphylococcus aureus subsp. aureus MW2
acguuuuagacauaaaa

SEQ ID NO: 4033603 - RNA, 17 nt, Staphylococcus aureus subsp. aureus MW2
acguuuucacuucgcca

SEQ ID NO: 4033604 - RNA, 14 nt, Staphylococcus aureus subsp. aureus MW2
acguuuugaccaau

SEQ ID NO: 4033605 - RNA, 15 nt, Staphylococcus aureus subsp. aureus MW2
acguuuuuuuauaaa

SEQ ID NO: 4033606 - RNA, 15 nt, Staphylococcus aureus subsp. aureus MW2
acuaaaaauauauuu

SEQ ID NO: 4033607 - RNA, 16 nt, Staphylococcus aureus subsp. aureus MW2
acuaaaaauauauuuc

SEQ ID NO: 4033608 - RNA, 19 nt, Staphylococcus aureus subsp. aureus MW2
acuaaaacaaauucauauu

SEQ ID NO: 4033609 - RNA, 21 nt, Staphylococcus aureus subsp. aureus MW2
acuaaaaguggccuuuuaaac

SEQ ID NO: 4033610 - RNA, 17 nt, Staphylococcus aureus subsp. aureus MW2
acuaaaauuuguaauuu

SEQ ID NO: 4033611 - RNA, 15 nt, Staphylococcus aureus subsp. aureus MW2
acuaaaccauugaau

SEQ ID NO: 4033612 - RNA, 21 nt, Staphylococcus aureus subsp. aureus MW2
acuaaaccgauuaauauaaua

SEQ ID NO: 4033613 - RNA, 16 nt, Staphylococcus aureus subsp. aureus MW2
acuaaacgauaaauua

SEQ ID NO: 4033614 - RNA, 17 nt, Staphylococcus aureus subsp. aureus MW2
acuaaaggaauuucaaa

SEQ ID NO: 4033615 - RNA, 11 nt, Staphylococcus aureus subsp. aureus MW2
acuaaaucaaa

SEQ ID NO: 4033616 - RNA, 13 nt, Staphylococcus aureus subsp. aureus MW2
acuaaaucaaauu

SEQ ID NO: 4033617 - RNA, 12 nt, Staphylococcus aureus subsp. aureus MW2
acuaaaugaauu

SEQ ID NO: 4033618 - RNA, 22 nt, Staphylococcus aureus subsp. aureus MW2
acuaaaugaauugcuuguucuu

SEQ ID NO: 4033619 - RNA, 22 nt, Staphylococcus aureus subsp. aureus MW2
acuaaauugagaaguauuauga

SEQ ID NO: 4033620 - RNA, 20 nt, Staphylococcus aureus subsp. aureus MW2
acuaacauguuauugcuuau

SEQ ID NO: 4033621 - RNA, 16 nt, Staphylococcus aureus subsp. aureus MW2
acuaaccuauuaaaau

SEQ ID NO: 4033622 - RNA, 22 nt, Staphylococcus aureus subsp. aureus MW2
acuaacguaaaggcgauauuug

SEQ ID NO: 4033623 - RNA, 17 nt, Staphylococcus aureus subsp. aureus MW2
acuaagaccaugagaaa

SEQ ID NO: 4033624 - RNA, 14 nt, Staphylococcus aureus subsp. aureus MW2
acuaagauauauug

SEQ ID NO: 4033625 - RNA, 21 nt, Staphylococcus aureus subsp. aureus MW2
acuaagauaucuggauuaacu

SEQ ID NO: 4033626 - RNA, 20 nt, Staphylococcus aureus subsp. aureus MW2
acuaagauauuuaguacaua

SEQ ID NO: 4033627 - RNA, 16 nt, Staphylococcus aureus subsp. aureus MW2
acuaagaugacugaac

SEQ ID NO: 4033628 - RNA, 19 nt, Staphylococcus aureus subsp. aureus MW2
acuaaguaaccaagucuaa

SEQ ID NO: 4033629 - RNA, 21 nt, Staphylococcus aureus subsp. aureus MW2
acuaaguauguauaguguuaa

SEQ ID NO: 4033630 - RNA, 18 nt, Staphylococcus aureus subsp. aureus MW2
acuaaguuuguuuucuuu

SEQ ID NO: 4033631 - RNA, 17 nt, Staphylococcus aureus subsp. aureus MW2
acuaauaacucuucuaa

SEQ ID NO: 4033632 - RNA, 16 nt, Staphylococcus aureus subsp. aureus MW2
acuaauaauuuguaau

SEQ ID NO: 4033633 - RNA, 13 nt, Staphylococcus aureus subsp. aureus MW2
acuaauauauuaa

SEQ ID NO: 4033634 - RNA, 17 nt, Staphylococcus aureus subsp. aureus MW2
acuaauaugauugguuu

SEQ ID NO: 4033635 - RNA, 14 nt, Staphylococcus aureus subsp. aureus MW2
acuaauauuuaaaa

SEQ ID NO: 4033636 - RNA, 20 nt, Staphylococcus aureus subsp. aureus MW2
acuaauauuuaaaaaacaaa

SEQ ID NO: 4033637 - RNA, 16 nt, Staphylococcus aureus subsp. aureus MW2
acuaaucaaagaaaaa

SEQ ID NO: 4033638 - RNA, 18 nt, Staphylococcus aureus subsp. aureus MW2
acuaaucaaauuagucau

SEQ ID NO: 4033639 - RNA, 14 nt, Staphylococcus aureus subsp. aureus MW2
acuaaucaauacua

SEQ ID NO: 4033640 - RNA, 13 nt, Staphylococcus aureus subsp. aureus MW2
acuaaucauuuuu

SEQ ID NO: 4033641 - RNA, 18 nt, Staphylococcus aureus subsp. aureus MW2
acuaaucauuuuuucaau

SEQ ID NO: 4033642 - RNA, 18 nt, Staphylococcus aureus subsp. aureus MW2
acuaaucguuguggcuuu

SEQ ID NO: 4033643 - RNA, 16 nt, Staphylococcus aureus subsp. aureus MW2
acuaaugauaguacau

SEQ ID NO: 4033644 - RNA, 19 nt, Staphylococcus aureus subsp. aureus MW2
acuaaugucgcacuauaaa

SEQ ID NO: 4033645 - RNA, 11 nt, Staphylococcus aureus subsp. aureus MW2
acuaauuaaag

SEQ ID NO: 4033646 - RNA, 18 nt, Staphylococcus aureus subsp. aureus MW2
acuaauuuaaagcaucau

SEQ ID NO: 4033647 - RNA, 21 nt, Staphylococcus aureus subsp. aureus MW2
acuacacacguagaaagaugu

SEQ ID NO: 4033648 - RNA, 19 nt, Staphylococcus aureus subsp. aureus MW2
acuacacuccccuuaucaa

SEQ ID NO: 4033649 - RNA, 18 nt, Staphylococcus aureus subsp. aureus MW2
acuacagugcaugaugaa

SEQ ID NO: 4033650 - RNA, 15 nt, Staphylococcus aureus subsp. aureus MW2
acuacgcauuuuaaa

SEQ ID NO: 4033651 - RNA, 17 nt, Staphylococcus aureus subsp. aureus MW2
acuacgcauuuuaaaua

SEQ ID NO: 4033652 - RNA, 15 nt, Staphylococcus aureus subsp. aureus MW2
acuacuauugauauu

SEQ ID NO: 4033653 - RNA, 21 nt, Staphylococcus aureus subsp. aureus MW2
acuacucccccguaguauaua

SEQ ID NO: 4033654 - RNA, 19 nt, Staphylococcus aureus subsp. aureus MW2
acuacugucucaucuucua

SEQ ID NO: 4033655 - RNA, 14 nt, Staphylococcus aureus subsp. aureus MW2
acuacuuaauuaau

SEQ ID NO: 4033656 - RNA, 19 nt, Staphylococcus aureus subsp. aureus MW2
acuagcaacaucuuuuguu

SEQ ID NO: 4033657 - RNA, 21 nt, Staphylococcus aureus subsp. aureus MW2
acuagcauuagcaaauauuau

SEQ ID NO: 4033658 - RNA, 14 nt, Staphylococcus aureus subsp. aureus MW2
acuagggguuuuua

SEQ ID NO: 4033659 - RNA, 20 nt, Staphylococcus aureus subsp. aureus MW2
acuaguaaaucaaagaugac

SEQ ID NO: 4033660 - RNA, 22 nt, Staphylococcus aureus subsp. aureus MW2
acuaguaauagaauagucaauu

SEQ ID NO: 4033661 - RNA, 23 nt, Staphylococcus aureus subsp. aureus MW2
acuaguauccuuuauaaauaaac

SEQ ID NO: 4033662 - RNA, 16 nt, Staphylococcus aureus subsp. aureus MW2
acuaguguauacaagg

SEQ ID NO: 4033663 - RNA, 18 nt, Staphylococcus aureus subsp. aureus MW2
acuaguguauacaaggca

SEQ ID NO: 4033664 - RNA, 19 nt, Staphylococcus aureus subsp. aureus MW2
acuaguguauacaaggcau

SEQ ID NO: 4033665 - RNA, 23 nt, Staphylococcus aureus subsp. aureus MW2
acuaguuuggagaauuuauugac

SEQ ID NO: 4033666 - RNA, 19 nt, Staphylococcus aureus subsp. aureus MW2
acuaguuuguaauaauuaa

SEQ ID NO: 4033667 - RNA, 15 nt, Staphylococcus aureus subsp. aureus MW2
acuauaaaaaacagc

SEQ ID NO: 4033668 - RNA, 16 nt, Staphylococcus aureus subsp. aureus MW2
acuauaaaaaacagca

SEQ ID NO: 4033669 - RNA, 13 nt, Staphylococcus aureus subsp. aureus MW2
acuauaaauaaaa

SEQ ID NO: 4033670 - RNA, 15 nt, Staphylococcus aureus subsp. aureus MW2
acuauaaauaaaaau

SEQ ID NO: 4033671 - RNA, 19 nt, Staphylococcus aureus subsp. aureus MW2
acuauaaccuauuaaaucu

SEQ ID NO: 4033672 - RNA, 14 nt, Staphylococcus aureus subsp. aureus MW2
acuauaauaauuaa

SEQ ID NO: 4033673 - RNA, 20 nt, Staphylococcus aureus subsp. aureus MW2
acuauaauaauuaacugcgg

SEQ ID NO: 4033674 - RNA, 16 nt, Staphylococcus aureus subsp. aureus MW2
acuauaauaauuggaa

SEQ ID NO: 4033675 - RNA, 12 nt, Staphylococcus aureus subsp. aureus MW2
acuauacgcaau

SEQ ID NO: 4033676 - RNA, 21 nt, Staphylococcus aureus subsp. aureus MW2
acuauauucaaugauuaguaa

SEQ ID NO: 4033677 - RNA, 22 nt, Staphylococcus aureus subsp. aureus MW2
acuauauucaauuuaauagaca

SEQ ID NO: 4033678 - RNA, 14 nt, Staphylococcus aureus subsp. aureus MW2
acuauauuuauuag

SEQ ID NO: 4033679 - RNA, 14 nt, Staphylococcus aureus subsp. aureus MW2
acuaucuauaauac

SEQ ID NO: 4033680 - RNA, 15 nt, Staphylococcus aureus subsp. aureus MW2
acuaucuucaucaua

SEQ ID NO: 4033681 - RNA, 21 nt, Staphylococcus aureus subsp. aureus MW2
acuaugcaaaugaaauucuuu

SEQ ID NO: 4033682 - RNA, 16 nt, Staphylococcus aureus subsp. aureus MW2
acuauguucaauuuau

SEQ ID NO: 4033683 - RNA, 15 nt, Staphylococcus aureus subsp. aureus MW2
acugucaucuuuaua

SEQ ID NO: 4033684 - RNA, 16 nt, Staphylococcus aureus subsp. aureus MW2
acugucgcucauccuc

SEQ ID NO: 4033685 - RNA, 16 nt, Staphylococcus aureus subsp. aureus MW2
acugucgguucaucua

SEQ ID NO: 4033686 - RNA, 15 nt, Staphylococcus aureus subsp. aureus MW2
acugucucaucuucu

SEQ ID NO: 4033687 - RNA, 19 nt, Staphylococcus aureus subsp. aureus MW2
acugugauauuaauugaaa

SEQ ID NO: 4033688 - RNA, 22 nt, Staphylococcus aureus subsp. aureus MW2
acugugauauuaauugaaaaac

SEQ ID NO: 4033689 - RNA, 22 nt, Staphylococcus aureus subsp. aureus MW2
acuguucuuucgucuuguaaac

SEQ ID NO: 4033690 - RNA, 16 nt, Staphylococcus aureus subsp. aureus MW2
acuguugacauuugac

SEQ ID NO: 4033691 - RNA, 15 nt, Staphylococcus aureus subsp. aureus MW2
acuguuggaauaccu

SEQ ID NO: 4033692 - RNA, 16 nt, Staphylococcus aureus subsp. aureus MW2
acuguuggaauaccuu

SEQ ID NO: 4033693 - RNA, 21 nt, Staphylococcus aureus subsp. aureus MW2
acuguuucacguaaugaauca

SEQ ID NO: 4033694 - RNA, 18 nt, Staphylococcus aureus subsp. aureus MW2
acuguuuuauuaugaauu

SEQ ID NO: 4033695 - RNA, 15 nt, Staphylococcus aureus subsp. aureus MW2
acuuaaaaaugaaau

SEQ ID NO: 4033696 - RNA, 20 nt, Staphylococcus aureus subsp. aureus MW2
acuuaaaauaaguauuuuuu

SEQ ID NO: 4033697 - RNA, 12 nt, Staphylococcus aureus subsp. aureus MW2
acuuaaaauuua

SEQ ID NO: 4033698 - RNA, 13 nt, Staphylococcus aureus subsp. aureus MW2
acuuaaaauuuaa

SEQ ID NO: 4033699 - RNA, 15 nt, Staphylococcus aureus subsp. aureus MW2
acuuaaagauuuacc

SEQ ID NO: 4033700 - RNA, 21 nt, Staphylococcus aureus subsp. aureus MW2
acuuaaauaucgacaaauuaa

SEQ ID NO: 4033701 - RNA, 23 nt, Staphylococcus aureus subsp. aureus MW2
acuuaaauaucgacaaauuaaaa

SEQ ID NO: 4033702 - RNA, 14 nt, Staphylococcus aureus subsp. aureus MW2
acuuaacaucuuuu

SEQ ID NO: 4033703 - RNA, 13 nt, Staphylococcus aureus subsp. aureus MW2
acuuaaccauuua

SEQ ID NO: 4033704 - RNA, 15 nt, Staphylococcus aureus subsp. aureus MW2
acuuaaccauuuaaa

SEQ ID NO: 4033705 - RNA, 16 nt, Staphylococcus aureus subsp. aureus MW2
acuuaaccauuuaaaa

SEQ ID NO: 4033706 - RNA, 15 nt, Staphylococcus aureus subsp. aureus MW2
acuuaacuuaagcuc

SEQ ID NO: 4033707 - RNA, 16 nt, Staphylococcus aureus subsp. aureus MW2
acuuaacuuguguuau

SEQ ID NO: 4033708 - RNA, 13 nt, Staphylococcus aureus subsp. aureus MW2
acuuaauaaccau

SEQ ID NO: 4033709 - RNA, 18 nt, Staphylococcus aureus subsp. aureus MW2
acuuaauacuaauuuugu

SEQ ID NO: 4033710 - RNA, 16 nt, Staphylococcus aureus subsp. aureus MW2
acuuaaucguucccau

SEQ ID NO: 4033711 - RNA, 17 nt, Staphylococcus aureus subsp. aureus MW2
acuuaaugcuucaaaug

SEQ ID NO: 4033712 - RNA, 22 nt, Staphylococcus aureus subsp. aureus MW2
acuuaauuaauaauuuaacuaa

SEQ ID NO: 4033713 - RNA, 13 nt, Staphylococcus aureus subsp. aureus MW2
acuuacaaauaua

SEQ ID NO: 4033714 - RNA, 22 nt, Staphylococcus aureus subsp. aureus MW2
acuuacaaauauuguggaaaac

SEQ ID NO: 4033715 - RNA, 13 nt, Staphylococcus aureus subsp. aureus MW2
acuuacaagucua

SEQ ID NO: 4033716 - RNA, 13 nt, Staphylococcus aureus subsp. aureus MW2
acuuacauuacau

SEQ ID NO: 4033717 - RNA, 23 nt, Staphylococcus aureus subsp. aureus MW2
acuuaccaugaugagauaaaauc

SEQ ID NO: 4033718 - RNA, 19 nt, Staphylococcus aureus subsp. aureus MW2
acuuaccgcugcuuuuacu

SEQ ID NO: 4033719 - RNA, 18 nt, Staphylococcus aureus subsp. aureus MW2
acuuacugugaaaauacc

SEQ ID NO: 4033720 - RNA, 20 nt, Staphylococcus aureus subsp. aureus MW2
acuuacugugaaaauaccaa

SEQ ID NO: 4033721 - RNA, 15 nt, Staphylococcus aureus subsp. aureus MW2
acuuagaugugcgug

SEQ ID NO: 4033722 - RNA, 19 nt, Staphylococcus aureus subsp. aureus MW2
acuuagcaaucucuuuaga

SEQ ID NO: 4033723 - RNA, 20 nt, Staphylococcus aureus subsp. aureus MW2
acuuagggugacucaaugaa

SEQ ID NO: 4033724 - RNA, 15 nt, Staphylococcus aureus subsp. aureus MW2
acuuauaacugauaa

SEQ ID NO: 4033725 - RNA, 13 nt, Staphylococcus aureus subsp. aureus MW2
acuuauaauauua

SEQ ID NO: 4033726 - RNA, 14 nt, Staphylococcus aureus subsp. aureus MW2
acuuauuaauuaau

SEQ ID NO: 4033727 - RNA, 15 nt, Staphylococcus aureus subsp. aureus MW2
acuuauuaauuaaua

SEQ ID NO: 4033728 - RNA, 21 nt, Staphylococcus aureus subsp. aureus MW2
acuuauuaauuaauagagaca

SEQ ID NO: 4033729 - RNA, 15 nt, Staphylococcus aureus subsp. aureus MW2
acuuauuauuuugua

SEQ ID NO: 4033730 - RNA, 18 nt, Staphylococcus aureus subsp. aureus MW2
acuuauucuucacuuuca

SEQ ID NO: 4033731 - RNA, 14 nt, Staphylococcus aureus subsp. aureus MW2
acuuauuucuuuuc

SEQ ID NO: 4033732 - RNA, 15 nt, Staphylococcus aureus subsp. aureus MW2
acuuauuugaaugca

SEQ ID NO: 4033733 - RNA, 18 nt, Staphylococcus aureus subsp. aureus MW2
acuuauuugaaugcaaau

SEQ ID NO: 4033734 - RNA, 17 nt, Staphylococcus aureus subsp. aureus MW2
acuucaaagcaucuaau

SEQ ID NO: 4033735 - RNA, 23 nt, Staphylococcus aureus subsp. aureus MW2
acuucaauugucguuuaauaaua

SEQ ID NO: 4033736 - RNA, 19 nt, Staphylococcus aureus subsp. aureus MW2
acuucacauuuauccuuua

SEQ ID NO: 4033737 - RNA, 13 nt, Staphylococcus aureus subsp. aureus MW2
acuucauaaguca

SEQ ID NO: 4033738 - RNA, 17 nt, Staphylococcus aureus subsp. aureus MW2
acuucauaagucacagu

SEQ ID NO: 4033739 - RNA, 15 nt, Staphylococcus aureus subsp. aureus MW2
acuucauauaaugcu

SEQ ID NO: 4033740 - RNA, 18 nt, Staphylococcus aureus subsp. aureus MW2
acuucauauccuucauua

SEQ ID NO: 4033741 - RNA, 16 nt, Staphylococcus aureus subsp. aureus MW2
acuucaucacucgcaa

SEQ ID NO: 4033742 - RNA, 21 nt, Staphylococcus aureus subsp. aureus MW2
acuucaucuguccgauuuaau

SEQ ID NO: 4033743 - RNA, 18 nt, Staphylococcus aureus subsp. aureus MW2
acuuccugcuuuuuuuau

SEQ ID NO: 4033744 - RNA, 21 nt, Staphylococcus aureus subsp. aureus MW2
acuucgccaagccauuuuucu

SEQ ID NO: 4033745 - RNA, 23 nt, Staphylococcus aureus subsp. aureus MW2
acuucgccaagccauuuuucuuu

SEQ ID NO: 4033746 - RNA, 19 nt, Staphylococcus aureus subsp. aureus MW2
acuucguuuuaccgcgugu

SEQ ID NO: 4033747 - RNA, 16 nt, Staphylococcus aureus subsp. aureus MW2
acuucuaauuugcaaa

SEQ ID NO: 4033748 - RNA, 17 nt, Staphylococcus aureus subsp. aureus MW2
acuucuaauuugcaaaa

SEQ ID NO: 4033749 - RNA, 22 nt, Staphylococcus aureus subsp. aureus MW2
acuucuaauuugcaaaaucaac

SEQ ID NO: 4033750 - RNA, 16 nt, Staphylococcus aureus subsp. aureus MW2
acuucuauuaauaauu

SEQ ID NO: 4033751 - RNA, 16 nt, Staphylococcus aureus subsp. aureus MW2
acuucucaauuuagua

SEQ ID NO: 4033752 - RNA, 17 nt, Staphylococcus aureus subsp. aureus MW2
acuucucaauuuaguau

SEQ ID NO: 4033753 - RNA, 14 nt, Staphylococcus aureus subsp. aureus MW2
acuucucuuugaac

SEQ ID NO: 4033754 - RNA, 15 nt, Staphylococcus aureus subsp. aureus MW2
acuucucuuugaacg

SEQ ID NO: 4033755 - RNA, 20 nt, Staphylococcus aureus subsp. aureus MW2
acuucucuuugaacgaaaga

SEQ ID NO: 4033756 - RNA, 16 nt, Staphylococcus aureus subsp. aureus MW2
acuucugguucuucac

SEQ ID NO: 4033757 - RNA, 19 nt, Staphylococcus aureus subsp. aureus MW2
acuucuuaaaauaugauuu

SEQ ID NO: 4033758 - RNA, 22 nt, Staphylococcus aureus subsp. aureus MW2
acuucuuaaaauaugauuuaaa

SEQ ID NO: 4033759 - RNA, 18 nt, Staphylococcus aureus subsp. aureus MW2
acuucuuaacuugaaaug

SEQ ID NO: 4033760 - RNA, 17 nt, Staphylococcus aureus subsp. aureus MW2
acuucuuguucgauaau

SEQ ID NO: 4033761 - RNA, 21 nt, Staphylococcus aureus subsp. aureus MW2
acuucuuuagcaaaacgcauu

SEQ ID NO: 4033762 - RNA, 16 nt, Staphylococcus aureus subsp. aureus MW2
acuucuuuauauuuau

SEQ ID NO: 4033763 - RNA, 18 nt, Staphylococcus aureus subsp. aureus MW2
acuucuuuauauuuauca

SEQ ID NO: 4033764 - RNA, 22 nt, Staphylococcus aureus subsp. aureus MW2
acuucuuuucuuugauaacaau

SEQ ID NO: 4033765 - RNA, 16 nt, Staphylococcus aureus subsp. aureus MW2
acuucuuuuguuuuac

SEQ ID NO: 4033766 - RNA, 17 nt, Staphylococcus aureus subsp. aureus MW2
acuucuuuuuuguaucu

SEQ ID NO: 4033767 - RNA, 16 nt, Staphylococcus aureus subsp. aureus MW2
acuugaacuaaaacaa

SEQ ID NO: 4033768 - RNA, 17 nt, Staphylococcus aureus subsp. aureus MW2
acuugaauaauucuuuu

SEQ ID NO: 4033769 - RNA, 18 nt, Staphylococcus aureus subsp. aureus MW2
acuugaauaccuuuuauu

SEQ ID NO: 4033770 - RNA, 13 nt, Staphylococcus aureus subsp. aureus MW2
acuugauaucauc

SEQ ID NO: 4033771 - RNA, 13 nt, Staphylococcus aureus subsp. aureus MW2
acuugauauuaua

SEQ ID NO: 4033772 - RNA, 22 nt, Staphylococcus aureus subsp. aureus MW2
agaaaagcagucgaacaaugau

SEQ ID NO: 4033773 - RNA, 18 nt, Staphylococcus aureus subsp. aureus MW2
agaaaaggauuauaggua

SEQ ID NO: 4033774 - RNA, 20 nt, Staphylococcus aureus subsp. aureus MW2
agaaaaguaaguaaaauaaa

SEQ ID NO: 4033775 - RNA, 23 nt, Staphylococcus aureus subsp. aureus MW2
agaaaaguuacuuacgccaauca

SEQ ID NO: 4033776 - RNA, 14 nt, Staphylococcus aureus subsp. aureus MW2
agaaaauacagauu

SEQ ID NO: 4033777 - RNA, 12 nt, Staphylococcus aureus subsp. aureus MW2
agaaaauacauu

SEQ ID NO: 4033778 - RNA, 13 nt, Staphylococcus aureus subsp. aureus MW2
agaaaauaucauu

SEQ ID NO: 4033779 - RNA, 14 nt, Staphylococcus aureus subsp. aureus MW2
agaaaauaucauuu

SEQ ID NO: 4033780 - RNA, 22 nt, Staphylococcus aureus subsp. aureus MW2
agaaaaucguuauaaguacaaa

SEQ ID NO: 4033781 - RNA, 15 nt, Staphylococcus aureus subsp. aureus MW2
agaaaaugaguacaa

SEQ ID NO: 4033782 - RNA, 18 nt, Staphylococcus aureus subsp. aureus MW2
agaaaaugaguacaacau

SEQ ID NO: 4033783 - RNA, 21 nt, Staphylococcus aureus subsp. aureus MW2
agaaaauuaauagagaaaaaa

SEQ ID NO: 4033784 - RNA, 22 nt, Staphylococcus aureus subsp. aureus MW2
agaaacaaugcgaagaaaucau

SEQ ID NO: 4033785 - RNA, 16 nt, Staphylococcus aureus subsp. aureus MW2
agaaacacaaggaaua

SEQ ID NO: 4033786 - RNA, 20 nt, Staphylococcus aureus subsp. aureus MW2
agaaacacaaggaauauaca

SEQ ID NO: 4033787 - RNA, 16 nt, Staphylococcus aureus subsp. aureus MW2
agaaacacauaugcag

SEQ ID NO: 4033788 - RNA, 11 nt, Staphylococcus aureus subsp. aureus MW2
agaaacacuuu

SEQ ID NO: 4033789 - RNA, 16 nt, Staphylococcus aureus subsp. aureus MW2
agaaacagcaguaaga

SEQ ID NO: 4033790 - RNA, 14 nt, Staphylococcus aureus subsp. aureus MW2
agaaacgaaauuau

SEQ ID NO: 4033791 - RNA, 20 nt, Staphylococcus aureus subsp. aureus MW2
agaaagcgucuuuuuauacu

SEQ ID NO: 4033792 - RNA, 14 nt, Staphylococcus aureus subsp. aureus MW2
agaaaguaaaaguu

SEQ ID NO: 4033793 - RNA, 17 nt, Staphylococcus aureus subsp. aureus MW2
agaaaguuuuauuuaaa

SEQ ID NO: 4033794 - RNA, 15 nt, Staphylococcus aureus subsp. aureus MW2
agaaauaaucacauu

SEQ ID NO: 4033795 - RNA, 16 nt, Staphylococcus aureus subsp. aureus MW2
agaaauaaucacauua

SEQ ID NO: 4033796 - RNA, 13 nt, Staphylococcus aureus subsp. aureus MW2
agaaauauaguaa

SEQ ID NO: 4033797 - RNA, 21 nt, Staphylococcus aureus subsp. aureus MW2
agaaauauaguaacagacuuu

SEQ ID NO: 4033798 - RNA, 22 nt, Staphylococcus aureus subsp. aureus MW2
agaaaucagcuuuucuucaacu

SEQ ID NO: 4033799 - RNA, 23 nt, Staphylococcus aureus subsp. aureus MW2
agaaaucagcuuuucuucaacua

SEQ ID NO: 4033800 - RNA, 15 nt, Staphylococcus aureus subsp. aureus MW2
agaaauguaugacau

SEQ ID NO: 4033801 - RNA, 19 nt, Staphylococcus aureus subsp. aureus MW2
agaaauguaugacauaaac

SEQ ID NO: 4033802 - RNA, 22 nt, Staphylococcus aureus subsp. aureus MW2
agaaauguuaacgauagacauu

SEQ ID NO: 4033803 - RNA, 18 nt, Staphylococcus aureus subsp. aureus MW2
agaaauuagaaccaucau

SEQ ID NO: 4033804 - RNA, 16 nt, Staphylococcus aureus subsp. aureus MW2
agaaauucuacaaaca

SEQ ID NO: 4033805 - RNA, 17 nt, Staphylococcus aureus subsp. aureus MW2
agaaauucuacaaacaa

SEQ ID NO: 4033806 - RNA, 16 nt, Staphylococcus aureus subsp. aureus MW2
agaaauugaauucucg

SEQ ID NO: 4033807 - RNA, 17 nt, Staphylococcus aureus subsp. aureus MW2
agaaauuguaguauuuu

SEQ ID NO: 4033808 - RNA, 20 nt, Staphylococcus aureus subsp. aureus MW2
agaaauuguguuucuuuuau

SEQ ID NO: 4033809 - RNA, 21 nt, Staphylococcus aureus subsp. aureus MW2
agaaauuguguuucuuuuauu

SEQ ID NO: 4033810 - RNA, 21 nt, Staphylococcus aureus subsp. aureus MW2
agaaauuuaauauuguuaauu

SEQ ID NO: 4033811 - RNA, 17 nt, Staphylococcus aureus subsp. aureus MW2
agaaauuugauuuucaa

SEQ ID NO: 4033812 - RNA, 14 nt, Staphylococcus aureus subsp. aureus MW2
agaacaagaauuau

SEQ ID NO: 4033813 - RNA, 15 nt, Staphylococcus aureus subsp. aureus MW2
agaacaagaauuaug

SEQ ID NO: 4033814 - RNA, 20 nt, Staphylococcus aureus subsp. aureus MW2
agaacaucaucauguuuauu

SEQ ID NO: 4033815 - RNA, 22 nt, Staphylococcus aureus subsp. aureus MW2
agaacaugauacugaaauuuca

SEQ ID NO: 4033816 - RNA, 14 nt, Staphylococcus aureus subsp. aureus MW2
agaaccaacaauaa

SEQ ID NO: 4033817 - RNA, 21 nt, Staphylococcus aureus subsp. aureus MW2
agaaccuugaaugauauuaac

SEQ ID NO: 4033818 - RNA, 15 nt, Staphylococcus aureus subsp. aureus MW2
agaacguucauauau

SEQ ID NO: 4033819 - RNA, 15 nt, Staphylococcus aureus subsp. aureus MW2
agaacguucuaaggu

SEQ ID NO: 4033820 - RNA, 23 nt, Staphylococcus aureus subsp. aureus MW2
agaacuaagaugugcaucccgaa

SEQ ID NO: 4033821 - RNA, 18 nt, Staphylococcus aureus subsp. aureus MW2
agaacuaauggcaacgau

SEQ ID NO: 4033822 - RNA, 13 nt, Staphylococcus aureus subsp. aureus MW2
agaacuacaauuc

SEQ ID NO: 4033823 - RNA, 19 nt, Staphylococcus aureus subsp. aureus MW2
agaacuaucgauacuaaac

SEQ ID NO: 4033824 - RNA, 19 nt, Staphylococcus aureus subsp. aureus MW2
agaagcaaaagaugaaaau

SEQ ID NO: 4033825 - RNA, 15 nt, Staphylococcus aureus subsp. aureus MW2
agaagcugacgaaaa

SEQ ID NO: 4033826 - RNA, 19 nt, Staphylococcus aureus subsp. aureus MW2
agaagcugacgaaaaguca

SEQ ID NO: 4033827 - RNA, 17 nt, Staphylococcus aureus subsp. aureus MW2
agaagcuggcggaaagu

SEQ ID NO: 4033828 - RNA, 19 nt, Staphylococcus aureus subsp. aureus MW2
agaagcuggcggaaaguca

SEQ ID NO: 4033829 - RNA, 20 nt, Staphylococcus aureus subsp. aureus MW2
agaagcuggcggaaagucag

SEQ ID NO: 4033830 - RNA, 23 nt, Staphylococcus aureus subsp. aureus MW2
agaagucugaugucgaaaauagc

SEQ ID NO: 4033831 - RNA, 14 nt, Staphylococcus aureus subsp. aureus MW2
agaaguucuuaugc

SEQ ID NO: 4033832 - RNA, 19 nt, Staphylococcus aureus subsp. aureus MW2
agaaguuguuuagaaaagu

SEQ ID NO: 4033833 - RNA, 12 nt, Staphylococcus aureus subsp. aureus MW2
agaauaaaaggc

SEQ ID NO: 4033834 - RNA, 14 nt, Staphylococcus aureus subsp. aureus MW2
agaauaaacuuuau

SEQ ID NO: 4033835 - RNA, 20 nt, Staphylococcus aureus subsp. aureus MW2
agaauaacgucauauguuuu

SEQ ID NO: 4033836 - RNA, 14 nt, Staphylococcus aureus subsp. aureus MW2
agaauacaaauauu

SEQ ID NO: 4033837 - RNA, 16 nt, Staphylococcus aureus subsp. aureus MW2
agaauacaaauauuaa

SEQ ID NO: 4033838 - RNA, 17 nt, Staphylococcus aureus subsp. aureus MW2
agaauacaaauauuaag

SEQ ID NO: 4033839 - RNA, 16 nt, Staphylococcus aureus subsp. aureus MW2
agaauacuaaaagugu

SEQ ID NO: 4033840 - RNA, 16 nt, Staphylococcus aureus subsp. aureus MW2
agaauaguuaccaaaa

SEQ ID NO: 4033841 - RNA, 18 nt, Staphylococcus aureus subsp. aureus MW2
agaauaguuaccaaaauu

SEQ ID NO: 4033842 - RNA, 21 nt, Staphylococcus aureus subsp. aureus MW2
agaauaguuaccaaaauuuga

SEQ ID NO: 4033843 - RNA, 13 nt, Staphylococcus aureus subsp. aureus MW2
agaauauaaaaua

SEQ ID NO: 4033844 - RNA, 17 nt, Staphylococcus aureus subsp. aureus MW2
agaauauaaacuauuaa

SEQ ID NO: 4033845 - RNA, 20 nt, Staphylococcus aureus subsp. aureus MW2
agaauauaaacuauuaaauc

SEQ ID NO: 4033846 - RNA, 20 nt, Staphylococcus aureus subsp. aureus MW2
agaauaugaucuaacaucau

SEQ ID NO: 4033847 - RNA, 23 nt, Staphylococcus aureus subsp. aureus MW2
agaauaugaucuaacaucauuaa

SEQ ID NO: 4033848 - RNA, 18 nt, Staphylococcus aureus subsp. aureus MW2
agaaucaaccguuuuauu

SEQ ID NO: 4033849 - RNA, 19 nt, Staphylococcus aureus subsp. aureus MW2
agaaucaauuauugaaaac

SEQ ID NO: 4033850 - RNA, 17 nt, Staphylococcus aureus subsp. aureus MW2
agaaucagcuaaauauu

SEQ ID NO: 4033851 - RNA, 13 nt, Staphylococcus aureus subsp. aureus MW2
agaaucaucuaaa

SEQ ID NO: 4033852 - RNA, 20 nt, Staphylococcus aureus subsp. aureus MW2
agaauccuaugccaaauaac

SEQ ID NO: 4033853 - RNA, 16 nt, Staphylococcus aureus subsp. aureus MW2
agaaucguaacggcau

SEQ ID NO: 4033854 - RNA, 14 nt, Staphylococcus aureus subsp. aureus MW2
agaaucuccauuua

SEQ ID NO: 4033855 - RNA, 15 nt, Staphylococcus aureus subsp. aureus MW2
agaaucuccauuuaa

SEQ ID NO: 4033856 - RNA, 20 nt, Staphylococcus aureus subsp. aureus MW2
agaaugaaaccguauuauua

SEQ ID NO: 4033857 - RNA, 22 nt, Staphylococcus aureus subsp. aureus MW2
agaaugaaaccguauuauuagu

SEQ ID NO: 4033858 - RNA, 18 nt, Staphylococcus aureus subsp. aureus MW2
agaaugaacuucucuuag

SEQ ID NO: 4033859 - RNA, 19 nt, Staphylococcus aureus subsp. aureus MW2
agaaugacaccuaauacca

SEQ ID NO: 4033860 - RNA, 12 nt, Staphylococcus aureus subsp. aureus MW2
agauaaaucauc

SEQ ID NO: 4033861 - RNA, 16 nt, Staphylococcus aureus subsp. aureus MW2
agauaaauuaauauga

SEQ ID NO: 4033862 - RNA, 15 nt, Staphylococcus aureus subsp. aureus MW2
agauaacuagcaaau

SEQ ID NO: 4033863 - RNA, 17 nt, Staphylococcus aureus subsp. aureus MW2
agauaaguaauaauaua

SEQ ID NO: 4033864 - RNA, 23 nt, Staphylococcus aureus subsp. aureus MW2
agauaaguaguggauaaucacaa

SEQ ID NO: 4033865 - RNA, 16 nt, Staphylococcus aureus subsp. aureus MW2
agauaaguuacuagca

SEQ ID NO: 4033866 - RNA, 14 nt, Staphylococcus aureus subsp. aureus MW2
agauaauuauuucu

SEQ ID NO: 4033867 - RNA, 19 nt, Staphylococcus aureus subsp. aureus MW2
agauaauuuuuaacaucau

SEQ ID NO: 4033868 - RNA, 20 nt, Staphylococcus aureus subsp. aureus MW2
agauaauuuuuaacaucauu

SEQ ID NO: 4033869 - RNA, 21 nt, Staphylococcus aureus subsp. aureus MW2
agauaauuuuuaacaucauuu

SEQ ID NO: 4033870 - RNA, 16 nt, Staphylococcus aureus subsp. aureus MW2
agauaccaaacugccu

SEQ ID NO: 4033871 - RNA, 18 nt, Staphylococcus aureus subsp. aureus MW2
agauacguugauguaauu

SEQ ID NO: 4033872 - RNA, 22 nt, Staphylococcus aureus subsp. aureus MW2
agauacugcuucuacccuugca

SEQ ID NO: 4033873 - RNA, 20 nt, Staphylococcus aureus subsp. aureus MW2
agauacugguuaguaaaauu

SEQ ID NO: 4033874 - RNA, 23 nt, Staphylococcus aureus subsp. aureus MW2
agauacuucaguacgguuauuua

SEQ ID NO: 4033875 - RNA, 16 nt, Staphylococcus aureus subsp. aureus MW2
agauacuucuuuagca

SEQ ID NO: 4033876 - RNA, 22 nt, Staphylococcus aureus subsp. aureus MW2
agauagacuuucuugaugaauu

SEQ ID NO: 4033877 - RNA, 17 nt, Staphylococcus aureus subsp. aureus MW2
agauagauaaaucaaga

SEQ ID NO: 4033878 - RNA, 15 nt, Staphylococcus aureus subsp. aureus MW2
agauaggaaacuuaa

SEQ ID NO: 4033879 - RNA, 20 nt, Staphylococcus aureus subsp. aureus MW2
agauaggaaacuuaaauauu

SEQ ID NO: 4033880 - RNA, 21 nt, Staphylococcus aureus subsp. aureus MW2
agauagguuuauuucugaaaa

SEQ ID NO: 4033881 - RNA, 17 nt, Staphylococcus aureus subsp. aureus MW2
agauaguuugagaaaau

SEQ ID NO: 4033882 - RNA, 17 nt, Staphylococcus aureus subsp. aureus MW2
agauauaaacauuuaua

SEQ ID NO: 4033883 - RNA, 22 nt, Staphylococcus aureus subsp. aureus MW2
agauauaauaaaaacagcagug

SEQ ID NO: 4033884 - RNA, 20 nt, Staphylococcus aureus subsp. aureus MW2
agauauauuaauauuugauu

SEQ ID NO: 4033885 - RNA, 15 nt, Staphylococcus aureus subsp. aureus MW2
agauauauuugaaag

SEQ ID NO: 4033886 - RNA, 22 nt, Staphylococcus aureus subsp. aureus MW2
agauaucuuaaucuaaaaauag

SEQ ID NO: 4033887 - RNA, 13 nt, Staphylococcus aureus subsp. aureus MW2
agauaugccuaua

SEQ ID NO: 4033888 - RNA, 18 nt, Staphylococcus aureus subsp. aureus MW2
agauauuucuguuuuccu

SEQ ID NO: 4033889 - RNA, 20 nt, Staphylococcus aureus subsp. aureus MW2
agauauuucuguuuuccuuu

SEQ ID NO: 4033890 - RNA, 14 nt, Staphylococcus aureus subsp. aureus MW2
agaucaauaucacu

SEQ ID NO: 4033891 - RNA, 21 nt, Staphylococcus aureus subsp. aureus MW2
agaucaauaucacuaucagcu

SEQ ID NO: 4033892 - RNA, 22 nt, Staphylococcus aureus subsp. aureus MW2
agauccaccguuaaaauauaug

SEQ ID NO: 4033893 - RNA, 21 nt, Staphylococcus aureus subsp. aureus MW2
agaucuuuguaugcaucaguu

SEQ ID NO: 4033894 - RNA, 13 nt, Staphylococcus aureus subsp. aureus MW2
agaugaauaaugu

SEQ ID NO: 4033895 - RNA, 21 nt, Staphylococcus aureus subsp. aureus MW2
agaugaaugccuaauuuugug

SEQ ID NO: 4033896 - RNA, 22 nt, Staphylococcus aureus subsp. aureus MW2
agaugacugaaccaauccaaua

SEQ ID NO: 4033897 - RNA, 13 nt, Staphylococcus aureus subsp. aureus MW2
agaugagaaagua

SEQ ID NO: 4033898 - RNA, 16 nt, Staphylococcus aureus subsp. aureus MW2
agaugaggcgauaaaa

SEQ ID NO: 4033899 - RNA, 15 nt, Staphylococcus aureus subsp. aureus MW2
agaugauaacgucau

SEQ ID NO: 4033900 - RNA, 19 nt, Staphylococcus aureus subsp. aureus MW2
agaugauaacgucauucuu

SEQ ID NO: 4033901 - RNA, 16 nt, Staphylococcus aureus subsp. aureus MW2
agaugauacauucuau

SEQ ID NO: 4033902 - RNA, 15 nt, Staphylococcus aureus subsp. aureus MW2
agaugauauuacaua

SEQ ID NO: 4033903 - RNA, 15 nt, Staphylococcus aureus subsp. aureus MW2
agaugaugcuucgca

SEQ ID NO: 4033904 - RNA, 16 nt, Staphylococcus aureus subsp. aureus MW2
agaugauucuuaucau

SEQ ID NO: 4033905 - RNA, 13 nt, Staphylococcus aureus subsp. aureus MW2
agaugcauaaaaa

SEQ ID NO: 4033906 - RNA, 15 nt, Staphylococcus aureus subsp. aureus MW2
agaugcauaaaaaaa

SEQ ID NO: 4033907 - RNA, 15 nt, Staphylococcus aureus subsp. aureus MW2
agaugcuaauguaau

SEQ ID NO: 4033908 - RNA, 18 nt, Staphylococcus aureus subsp. aureus MW2
agaugcucaaugcauuuc

SEQ ID NO: 4033909 - RNA, 17 nt, Staphylococcus aureus subsp. aureus MW2
agaugcuuuaauuaaag

SEQ ID NO: 4033910 - RNA, 22 nt, Staphylococcus aureus subsp. aureus MW2
agauggacaguuuuuauauuaa

SEQ ID NO: 4033911 - RNA, 17 nt, Staphylococcus aureus subsp. aureus MW2
agauggcugcaucaaua

SEQ ID NO: 4033912 - RNA, 17 nt, Staphylococcus aureus subsp. aureus MW2
agauguauaaaacuaau

SEQ ID NO: 4033913 - RNA, 16 nt, Staphylococcus aureus subsp. aureus MW2
agauguugaugaagua

SEQ ID NO: 4033914 - RNA, 21 nt, Staphylococcus aureus subsp. aureus MW2
agauguugguucaucaaacaa

SEQ ID NO: 4033915 - RNA, 15 nt, Staphylococcus aureus subsp. aureus MW2
agauuauauuaucau

SEQ ID NO: 4033916 - RNA, 21 nt, Staphylococcus aureus subsp. aureus MW2
agauuaugaaaacauuauuaa

SEQ ID NO: 4033917 - RNA, 15 nt, Staphylococcus aureus subsp. aureus MW2
agauuaugacaacau

SEQ ID NO: 4033918 - RNA, 16 nt, Staphylococcus aureus subsp. aureus MW2
agauuauugaaauuug

SEQ ID NO: 4033919 - RNA, 18 nt, Staphylococcus aureus subsp. aureus MW2
agauuauugguugaaauu

SEQ ID NO: 4033920 - RNA, 22 nt, Staphylococcus aureus subsp. aureus MW2
agauuauugguugaaauuaauu

SEQ ID NO: 4033921 - RNA, 23 nt, Staphylococcus aureus subsp. aureus MW2
agauuauuuaaaacuuguaaauu

SEQ ID NO: 4033922 - RNA, 16 nt, Staphylococcus aureus subsp. aureus MW2
agauuauuuucaauua

SEQ ID NO: 4033923 - RNA, 18 nt, Staphylococcus aureus subsp. aureus MW2
agauucaaacguuuucac

SEQ ID NO: 4033924 - RNA, 20 nt, Staphylococcus aureus subsp. aureus MW2
agauucaaacguuuucacuu

SEQ ID NO: 4033925 - RNA, 15 nt, Staphylococcus aureus subsp. aureus MW2
agauucaaauugguu

SEQ ID NO: 4033926 - RNA, 17 nt, Staphylococcus aureus subsp. aureus MW2
agauucaauuaaugcau

SEQ ID NO: 4033927 - RNA, 18 nt, Staphylococcus aureus subsp. aureus MW2
agauucacuguauaaaua

SEQ ID NO: 4033928 - RNA, 14 nt, Staphylococcus aureus subsp. aureus MW2
agauucauauuuau

SEQ ID NO: 4033929 - RNA, 16 nt, Staphylococcus aureus subsp. aureus MW2
agauugaaaaaauaac

SEQ ID NO: 4033930 - RNA, 18 nt, Staphylococcus aureus subsp. aureus MW2
agauugaguguaugcaua

SEQ ID NO: 4033931 - RNA, 21 nt, Staphylococcus aureus subsp. aureus MW2
agauugauauaaauuaucaga

SEQ ID NO: 4033932 - RNA, 18 nt, Staphylococcus aureus subsp. aureus MW2
agauugauaucccuaaca

SEQ ID NO: 4033933 - RNA, 21 nt, Staphylococcus aureus subsp. aureus MW2
agauugcuuuuucguuaaaug

SEQ ID NO: 4033934 - RNA, 15 nt, Staphylococcus aureus subsp. aureus MW2
agauuggaagggcau

SEQ ID NO: 4033935 - RNA, 18 nt, Staphylococcus aureus subsp. aureus MW2
agauugugacaauuuaaa

SEQ ID NO: 4033936 - RNA, 21 nt, Staphylococcus aureus subsp. aureus MW2
agauugugacaauuuaaauua

SEQ ID NO: 4033937 - RNA, 23 nt, Staphylococcus aureus subsp. aureus MW2
agauuuaaacauccaauuauguu

SEQ ID NO: 4033938 - RNA, 12 nt, Staphylococcus aureus subsp. aureus MW2
agauuuaacaau

SEQ ID NO: 4033939 - RNA, 22 nt, Staphylococcus aureus subsp. aureus MW2
agauuuaccucuugauaaaaua

SEQ ID NO: 4033940 - RNA, 13 nt, Staphylococcus aureus subsp. aureus MW2
agauuugaaauuu

SEQ ID NO: 4033941 - RNA, 14 nt, Staphylococcus aureus subsp. aureus MW2
agauuugaaauuua

SEQ ID NO: 4033942 - RNA, 15 nt, Staphylococcus aureus subsp. aureus MW2
agauuugaaauuuau

SEQ ID NO: 4033943 - RNA, 19 nt, Staphylococcus aureus subsp. aureus MW2
agauuugaaauuuauuaua

SEQ ID NO: 4033944 - RNA, 16 nt, Staphylococcus aureus subsp. aureus MW2
agauuuguauuuugcg

SEQ ID NO: 4033945 - RNA, 14 nt, Staphylococcus aureus subsp. aureus MW2
agauuuuauauaaa

SEQ ID NO: 4033946 - RNA, 17 nt, Staphylococcus aureus subsp. aureus MW2
agauuuuguauuagcau

SEQ ID NO: 4033947 - RNA, 23 nt, Staphylococcus aureus subsp. aureus MW2
agauuuuguugaaacuguaucaa

SEQ ID NO: 4033948 - RNA, 22 nt, Staphylococcus aureus subsp. aureus MW2
agcggaaauaugauugaaugaa

SEQ ID NO: 4033949 - RNA, 18 nt, Staphylococcus aureus subsp. aureus MW2
agcggacugaaagaaaag

SEQ ID NO: 4033950 - RNA, 14 nt, Staphylococcus aureus subsp. aureus MW2
agcguaauggauua

SEQ ID NO: 4033951 - RNA, 19 nt, Staphylococcus aureus subsp. aureus MW2
agcguagcauuauuuaaag

SEQ ID NO: 4033952 - RNA, 22 nt, Staphylococcus aureus subsp. aureus MW2
agcguagcgaaaguaucuauga

SEQ ID NO: 4033953 - RNA, 15 nt, Staphylococcus aureus subsp. aureus MW2
agcuaacauaccuaa

SEQ ID NO: 4033954 - RNA, 13 nt, Staphylococcus aureus subsp. aureus MW2
agcuaaccaaaua

SEQ ID NO: 4033955 - RNA, 16 nt, Staphylococcus aureus subsp. aureus MW2
agcuaaccacaucauu

SEQ ID NO: 4033956 - RNA, 18 nt, Staphylococcus aureus subsp. aureus MW2
agcuaacucuuuguauaa

SEQ ID NO: 4033957 - RNA, 22 nt, Staphylococcus aureus subsp. aureus MW2
agcuaaguauauaagcaaagac

SEQ ID NO: 4033958 - RNA, 13 nt, Staphylococcus aureus subsp. aureus MW2
agcuaaguuaaau

SEQ ID NO: 4033959 - RNA, 18 nt, Staphylococcus aureus subsp. aureus MW2
agcuaaugcaacuaaaac

SEQ ID NO: 4033960 - RNA, 19 nt, Staphylococcus aureus subsp. aureus MW2
agcuaauucauauucaaau

SEQ ID NO: 4033961 - RNA, 21 nt, Staphylococcus aureus subsp. aureus MW2
agcuaauuucuaauacauacu

SEQ ID NO: 4033962 - RNA, 16 nt, Staphylococcus aureus subsp. aureus MW2
agcuagcaaucccauu

SEQ ID NO: 4033963 - RNA, 18 nt, Staphylococcus aureus subsp. aureus MW2
agcuagcaucauguuggu

SEQ ID NO: 4033964 - RNA, 22 nt, Staphylococcus aureus subsp. aureus MW2
agcuauagaaaugauagggcau

SEQ ID NO: 4033965 - RNA, 23 nt, Staphylococcus aureus subsp. aureus MW2
agcuauauuuuuguauuuauguu

SEQ ID NO: 4033966 - RNA, 13 nt, Staphylococcus aureus subsp. aureus MW2
agcuaucaacgau

SEQ ID NO: 4033967 - RNA, 17 nt, Staphylococcus aureus subsp. aureus MW2
agcuaucuucagauucc

SEQ ID NO: 4033968 - RNA, 13 nt, Staphylococcus aureus subsp. aureus MW2
agcuaugaacgaa

SEQ ID NO: 4033969 - RNA, 22 nt, Staphylococcus aureus subsp. aureus MW2
agcuaugcuuuuuuuacaauau

SEQ ID NO: 4033970 - RNA, 22 nt, Staphylococcus aureus subsp. aureus MW2
agcuauucauagaccuaugaau

SEQ ID NO: 4033971 - RNA, 16 nt, Staphylococcus aureus subsp. aureus MW2
agcuauuuaaaauuau

SEQ ID NO: 4033972 - RNA, 16 nt, Staphylococcus aureus subsp. aureus MW2
agcuccuccaaagcua

SEQ ID NO: 4033973 - RNA, 23 nt, Staphylococcus aureus subsp. aureus MW2
agcucuuaaucuauaaauuauuu

SEQ ID NO: 4033974 - RNA, 15 nt, Staphylococcus aureus subsp. aureus MW2
agcucuucaaauuua

SEQ ID NO: 4033975 - RNA, 17 nt, Staphylococcus aureus subsp. aureus MW2
agcucuugcuaaagugu

SEQ ID NO: 4033976 - RNA, 18 nt, Staphylococcus aureus subsp. aureus MW2
agcucuuuuuugauuuaa

SEQ ID NO: 4033977 - RNA, 20 nt, Staphylococcus aureus subsp. aureus MW2
agcucuuuuuuguuauaucu

SEQ ID NO: 4033978 - RNA, 16 nt, Staphylococcus aureus subsp. aureus MW2
agcugaacguaaguuu

SEQ ID NO: 4033979 - RNA, 18 nt, Staphylococcus aureus subsp. aureus MW2
agcugacgaaaagucagc

SEQ ID NO: 4033980 - RNA, 20 nt, Staphylococcus aureus subsp. aureus MW2
agcugacgaaaagucagcuu

SEQ ID NO: 4033981 - RNA, 19 nt, Staphylococcus aureus subsp. aureus MW2
agcugauuucuaucaaaua

SEQ ID NO: 4033982 - RNA, 13 nt, Staphylococcus aureus subsp. aureus MW2
agcugauuuuuca

SEQ ID NO: 4033983 - RNA, 22 nt, Staphylococcus aureus subsp. aureus MW2
agcugccaaaaugguuaaaauc

SEQ ID NO: 4033984 - RNA, 21 nt, Staphylococcus aureus subsp. aureus MW2
agcugcuucucuuugaacgaa

SEQ ID NO: 4033985 - RNA, 21 nt, Staphylococcus aureus subsp. aureus MW2
agcugcuucucuuugaacgag

SEQ ID NO: 4033986 - RNA, 14 nt, Staphylococcus aureus subsp. aureus MW2
agcuggcggaaagu

SEQ ID NO: 4033987 - RNA, 18 nt, Staphylococcus aureus subsp. aureus MW2
agcuggcggaaagucagg

SEQ ID NO: 4033988 - RNA, 18 nt, Staphylococcus aureus subsp. aureus MW2
agcugucaacuugucuac

SEQ ID NO: 4033989 - RNA, 16 nt, Staphylococcus aureus subsp. aureus MW2
agcugucauaccuuuu

SEQ ID NO: 4033990 - RNA, 15 nt, Staphylococcus aureus subsp. aureus MW2
agcugugugaaauau

SEQ ID NO: 4033991 - RNA, 21 nt, Staphylococcus aureus subsp. aureus MW2
agcuuaaauagugcuuuuuca

SEQ ID NO: 4033992 - RNA, 19 nt, Staphylococcus aureus subsp. aureus MW2
agcuuaauaaauuguauga

SEQ ID NO: 4033993 - RNA, 20 nt, Staphylococcus aureus subsp. aureus MW2
agcuuaaugcaucuaugacu

SEQ ID NO: 4033994 - RNA, 15 nt, Staphylococcus aureus subsp. aureus MW2
agcuuacaauaaugu

SEQ ID NO: 4033995 - RNA, 18 nt, Staphylococcus aureus subsp. aureus MW2
agcuuacaauaaugugca

SEQ ID NO: 4033996 - RNA, 18 nt, Staphylococcus aureus subsp. aureus MW2
agcuuacuucauauaagu

SEQ ID NO: 4033997 - RNA, 22 nt, Staphylococcus aureus subsp. aureus MW2
agcuuauuaagcuugaaacaag

SEQ ID NO: 4033998 - RNA, 13 nt, Staphylococcus aureus subsp. aureus MW2
agcuucauauuua

SEQ ID NO: 4033999 - RNA, 15 nt, Staphylococcus aureus subsp. aureus MW2
agcuucuaaguaaua

SEQ ID NO: 4034000 - RNA, 19 nt, Staphylococcus aureus subsp. aureus MW2
agcuucuauguuggggccc

SEQ ID NO: 4034001 - RNA, 20 nt, Staphylococcus aureus subsp. aureus MW2
agcuucuauguuggggcccc

SEQ ID NO: 4034002 - RNA, 15 nt, Staphylococcus aureus subsp. aureus MW2
agcuucuuuaacaau

SEQ ID NO: 4034003 - RNA, 15 nt, Staphylococcus aureus subsp. aureus MW2
agcuugaauaauaua

SEQ ID NO: 4034004 - RNA, 16 nt, Staphylococcus aureus subsp. aureus MW2
agcuugaauaauauau

SEQ ID NO: 4034005 - RNA, 18 nt, Staphylococcus aureus subsp. aureus MW2
agcuugaauaauauauuu

SEQ ID NO: 4034006 - RNA, 19 nt, Staphylococcus aureus subsp. aureus MW2
agcuugaauaauauauuua

SEQ ID NO: 4034007 - RNA, 17 nt, Staphylococcus aureus subsp. aureus MW2
agcuugccuacuuuuuu

SEQ ID NO: 4034008 - RNA, 17 nt, Staphylococcus aureus subsp. aureus MW2
agcuuguucaauacuuu

SEQ ID NO: 4034009 - RNA, 20 nt, Staphylococcus aureus subsp. aureus MW2
agcuuuaauuuaucauuauu

SEQ ID NO: 4034010 - RNA, 17 nt, Staphylococcus aureus subsp. aureus MW2
agcuuuauaaaacgcuu

SEQ ID NO: 4034011 - RNA, 19 nt, Staphylococcus aureus subsp. aureus MW2
agcuuuaugugguuuugau

SEQ ID NO: 4034012 - RNA, 13 nt, Staphylococcus aureus subsp. aureus MW2
agcuuucuaucuu

SEQ ID NO: 4034013 - RNA, 21 nt, Staphylococcus aureus subsp. aureus MW2
agcuuucuaucuuguucuucu

SEQ ID NO: 4034014 - RNA, 18 nt, Staphylococcus aureus subsp. aureus MW2
agcuuugcucauagauga

SEQ ID NO: 4034015 - RNA, 20 nt, Staphylococcus aureus subsp. aureus MW2
agcuuugcugcuuuuccauu

SEQ ID NO: 4034016 - RNA, 17 nt, Staphylococcus aureus subsp. aureus MW2
agcuuuguuagcaucug

SEQ ID NO: 4034017 - RNA, 15 nt, Staphylococcus aureus subsp. aureus MW2
agcuuuucauuuuua

SEQ ID NO: 4034018 - RNA, 13 nt, Staphylococcus aureus subsp. aureus MW2
agcuuuucuugaa

SEQ ID NO: 4034019 - RNA, 14 nt, Staphylococcus aureus subsp. aureus MW2
aggaaaauaaaaac

SEQ ID NO: 4034020 - RNA, 13 nt, Staphylococcus aureus subsp. aureus MW2
aggaaacuuaaau

SEQ ID NO: 4034021 - RNA, 16 nt, Staphylococcus aureus subsp. aureus MW2
aggaaagccauuaaac

SEQ ID NO: 4034022 - RNA, 22 nt, Staphylococcus aureus subsp. aureus MW2
aggaaauacguggcucuaaaaa

SEQ ID NO: 4034023 - RNA, 18 nt, Staphylococcus aureus subsp. aureus MW2
aggaauaauuuuaaaaau

SEQ ID NO: 4034024 - RNA, 21 nt, Staphylococcus aureus subsp. aureus MW2
aggaauaauuuuaaaaauaaa

SEQ ID NO: 4034025 - RNA, 17 nt, Staphylococcus aureus subsp. aureus MW2
aggaauagcuacaauua

SEQ ID NO: 4034026 - RNA, 14 nt, Staphylococcus aureus subsp. aureus MW2
aggaauauaaaacu

SEQ ID NO: 4034027 - RNA, 15 nt, Staphylococcus aureus subsp. aureus MW2
aggaauauaaaacug

SEQ ID NO: 4034028 - RNA, 17 nt, Staphylococcus aureus subsp. aureus MW2
aggaauaucuuucaaau

SEQ ID NO: 4034029 - RNA, 18 nt, Staphylococcus aureus subsp. aureus MW2
aggaauaucuuucaaauu

SEQ ID NO: 4034030 - RNA, 15 nt, Staphylococcus aureus subsp. aureus MW2
aggaauccaaagcug

SEQ ID NO: 4034031 - RNA, 20 nt, Staphylococcus aureus subsp. aureus MW2
aggaauucuacagaaguggu

SEQ ID NO: 4034032 - RNA, 22 nt, Staphylococcus aureus subsp. aureus MW2
aggaauucuacagaaguggugc

SEQ ID NO: 4034033 - RNA, 12 nt, Staphylococcus aureus subsp. aureus MW2
aggaauuucaaa

SEQ ID NO: 4034034 - RNA, 16 nt, Staphylococcus aureus subsp. aureus MW2
aggaccacucaauucu

SEQ ID NO: 4034035 - RNA, 15 nt, Staphylococcus aureus subsp. aureus MW2
aggagucuggaacaa

SEQ ID NO: 4034036 - RNA, 20 nt, Staphylococcus aureus subsp. aureus MW2
aguaaguagaagcaaaagau

SEQ ID NO: 4034037 - RNA, 18 nt, Staphylococcus aureus subsp. aureus MW2
aguaaguuguacuucuuu

SEQ ID NO: 4034038 - RNA, 21 nt, Staphylococcus aureus subsp. aureus MW2
aguaauaaaagucgauaaaua

SEQ ID NO: 4034039 - RNA, 22 nt, Staphylococcus aureus subsp. aureus MW2
aguaauaaaagucgauaaauau

SEQ ID NO: 4034040 - RNA, 18 nt, Staphylococcus aureus subsp. aureus MW2
aguaauaauauaaauaaa

SEQ ID NO: 4034041 - RNA, 21 nt, Staphylococcus aureus subsp. aureus MW2
aguaauaauggcaauuaaaac

SEQ ID NO: 4034042 - RNA, 23 nt, Staphylococcus aureus subsp. aureus MW2
aguaauaauggcaauuaaaacua

SEQ ID NO: 4034043 - RNA, 16 nt, Staphylococcus aureus subsp. aureus MW2
aguaauauauaaaagu

SEQ ID NO: 4034044 - RNA, 22 nt, Staphylococcus aureus subsp. aureus MW2
aguaauauguugcuuaucaaca

SEQ ID NO: 4034045 - RNA, 19 nt, Staphylococcus aureus subsp. aureus MW2
aguaauccccgaagcacag

SEQ ID NO: 4034046 - RNA, 22 nt, Staphylococcus aureus subsp. aureus MW2
aguaauccccgaagcacagaaa

SEQ ID NO: 4034047 - RNA, 19 nt, Staphylococcus aureus subsp. aureus MW2
aguaauucuucaucuucuu

SEQ ID NO: 4034048 - RNA, 22 nt, Staphylococcus aureus subsp. aureus MW2
aguaauuuaauagguucuucuu

SEQ ID NO: 4034049 - RNA, 13 nt, Staphylococcus aureus subsp. aureus MW2
aguaauuucucua

SEQ ID NO: 4034050 - RNA, 19 nt, Staphylococcus aureus subsp. aureus MW2
aguaauuuuacaaaaugau

SEQ ID NO: 4034051 - RNA, 15 nt, Staphylococcus aureus subsp. aureus MW2
aguaauuuuuaaaca

SEQ ID NO: 4034052 - RNA, 18 nt, Staphylococcus aureus subsp. aureus MW2
aguaauuuuuaaacaaaa

SEQ ID NO: 4034053 - RNA, 20 nt, Staphylococcus aureus subsp. aureus MW2
aguaauuuuuaaacaaaaau

SEQ ID NO: 4034054 - RNA, 22 nt, Staphylococcus aureus subsp. aureus MW2
aguacaacaguugcaccuaaac

SEQ ID NO: 4034055 - RNA, 12 nt, Staphylococcus aureus subsp. aureus MW2
aguacaauaaua

SEQ ID NO: 4034056 - RNA, 22 nt, Staphylococcus aureus subsp. aureus MW2
aguacaauccugaagagaaaau

SEQ ID NO: 4034057 - RNA, 16 nt, Staphylococcus aureus subsp. aureus MW2
aguacagcgguuugua

SEQ ID NO: 4034058 - RNA, 22 nt, Staphylococcus aureus subsp. aureus MW2
aguacagcgguuuguaugauaa

SEQ ID NO: 4034059 - RNA, 19 nt, Staphylococcus aureus subsp. aureus MW2
aguaccauguuuuuuaagu

SEQ ID NO: 4034060 - RNA, 16 nt, Staphylococcus aureus subsp. aureus MW2
aguacccagaaugcga

SEQ ID NO: 4034061 - RNA, 16 nt, Staphylococcus aureus subsp. aureus MW2
aguacgaaaugcauug

SEQ ID NO: 4034062 - RNA, 15 nt, Staphylococcus aureus subsp. aureus MW2
aguacgaacaacuaa

SEQ ID NO: 4034063 - RNA, 23 nt, Staphylococcus aureus subsp. aureus MW2
aguacgcaauuuaauauuauaag

SEQ ID NO: 4034064 - RNA, 18 nt, Staphylococcus aureus subsp. aureus MW2
aguacgcuguaauccauu

SEQ ID NO: 4034065 - RNA, 19 nt, Staphylococcus aureus subsp. aureus MW2
aguacgcuguaauccauuc

SEQ ID NO: 4034066 - RNA, 16 nt, Staphylococcus aureus subsp. aureus MW2
aguacgguuauuuaau

SEQ ID NO: 4034067 - RNA, 23 nt, Staphylococcus aureus subsp. aureus MW2
aguacuuacgaauagaaaauaau

SEQ ID NO: 4034068 - RNA, 14 nt, Staphylococcus aureus subsp. aureus MW2
aguacuugaaacau

SEQ ID NO: 4034069 - RNA, 23 nt, Staphylococcus aureus subsp. aureus MW2
aguacuuggaaaauacuauacug

SEQ ID NO: 4034070 - RNA, 16 nt, Staphylococcus aureus subsp. aureus MW2
aguacuuuaaaauugu

SEQ ID NO: 4034071 - RNA, 17 nt, Staphylococcus aureus subsp. aureus MW2
aguagaaccuauauuaa

SEQ ID NO: 4034072 - RNA, 16 nt, Staphylococcus aureus subsp. aureus MW2
aguagacauugaaagg

SEQ ID NO: 4034073 - RNA, 16 nt, Staphylococcus aureus subsp. aureus MW2
aguagcuagaacagau

SEQ ID NO: 4034074 - RNA, 15 nt, Staphylococcus aureus subsp. aureus MW2
aguagcucaaaacaa

SEQ ID NO: 4034075 - RNA, 17 nt, Staphylococcus aureus subsp. aureus MW2
aguagcucaaaacaauu

SEQ ID NO: 4034076 - RNA, 18 nt, Staphylococcus aureus subsp. aureus MW2
aguaguuaucuaaugauc

SEQ ID NO: 4034077 - RNA, 20 nt, Staphylococcus aureus subsp. aureus MW2
aguauaaaccgccaacuaau

SEQ ID NO: 4034078 - RNA, 16 nt, Staphylococcus aureus subsp. aureus MW2
aguauaaacguccaaa

SEQ ID NO: 4034079 - RNA, 14 nt, Staphylococcus aureus subsp. aureus MW2
aguauaaaugcagc

SEQ ID NO: 4034080 - RNA, 15 nt, Staphylococcus aureus subsp. aureus MW2
aguauaaaugcagcu

SEQ ID NO: 4034081 - RNA, 16 nt, Staphylococcus aureus subsp. aureus MW2
aguauaauuuucuguc

SEQ ID NO: 4034082 - RNA, 21 nt, Staphylococcus aureus subsp. aureus MW2
aguauagcgcagcaaaugcuu

SEQ ID NO: 4034083 - RNA, 15 nt, Staphylococcus aureus subsp. aureus MW2
aguauauaagcaaag

SEQ ID NO: 4034084 - RNA, 17 nt, Staphylococcus aureus subsp. aureus MW2
aguauauaucaaauaca

SEQ ID NO: 4034085 - RNA, 13 nt, Staphylococcus aureus subsp. aureus MW2
aguauauaugacu

SEQ ID NO: 4034086 - RNA, 13 nt, Staphylococcus aureus subsp. aureus MW2
aguauauuuuaac

SEQ ID NO: 4034087 - RNA, 22 nt, Staphylococcus aureus subsp. aureus MW2
aguaucauuguguccauaaaua

SEQ ID NO: 4034088 - RNA, 23 nt, Staphylococcus aureus subsp. aureus MW2
aguaucauuguguccauaaauau

SEQ ID NO: 4034089 - RNA, 16 nt, Staphylococcus aureus subsp. aureus MW2
aguauccugauuuaau

SEQ ID NO: 4034090 - RNA, 19 nt, Staphylococcus aureus subsp. aureus MW2
aguauccuuuauaaauaaa

SEQ ID NO: 4034091 - RNA, 22 nt, Staphylococcus aureus subsp. aureus MW2
aguauccuuuauaaauaaacau

SEQ ID NO: 4034092 - RNA, 18 nt, Staphylococcus aureus subsp. aureus MW2
aguaucuauacaauuaug

SEQ ID NO: 4034093 - RNA, 18 nt, Staphylococcus aureus subsp. aureus MW2
aguaucucaaauauuaau

SEQ ID NO: 4034094 - RNA, 14 nt, Staphylococcus aureus subsp. aureus MW2
aguaucucauuuuu

SEQ ID NO: 4034095 - RNA, 18 nt, Staphylococcus aureus subsp. aureus MW2
aguaugacuuaccuaaua

SEQ ID NO: 4034096 - RNA, 19 nt, Staphylococcus aureus subsp. aureus MW2
aguauggaauaaaugguuu

SEQ ID NO: 4034097 - RNA, 18 nt, Staphylococcus aureus subsp. aureus MW2
aguauggcgaaauguuuu

SEQ ID NO: 4034098 - RNA, 23 nt, Staphylococcus aureus subsp. aureus MW2
aguauuaacgcuuauacuauaua

SEQ ID NO: 4034099 - RNA, 23 nt, Staphylococcus aureus subsp. aureus MW2
aguauuauagccuauccauucaa

SEQ ID NO: 4034100 - RNA, 14 nt, Staphylococcus aureus subsp. aureus MW2
aguauuaucuuuca

SEQ ID NO: 4034101 - RNA, 15 nt, Staphylococcus aureus subsp. aureus MW2
aguauuaugauugcu

SEQ ID NO: 4034102 - RNA, 21 nt, Staphylococcus aureus subsp. aureus MW2
aguauugccguuauuuucaau

SEQ ID NO: 4034103 - RNA, 15 nt, Staphylococcus aureus subsp. aureus MW2
aguauuuaauguuuu

SEQ ID NO: 4034104 - RNA, 17 nt, Staphylococcus aureus subsp. aureus MW2
aguauuugaaguauuuu

SEQ ID NO: 4034105 - RNA, 22 nt, Staphylococcus aureus subsp. aureus MW2
aguauuuuugcguuaauaauuu

SEQ ID NO: 4034106 - RNA, 17 nt, Staphylococcus aureus subsp. aureus MW2
aguauuuuuuuauguuc

SEQ ID NO: 4034107 - RNA, 19 nt, Staphylococcus aureus subsp. aureus MW2
agucaacaucguauucuuu

SEQ ID NO: 4034108 - RNA, 21 nt, Staphylococcus aureus subsp. aureus MW2
agucaaugacuuaacaucuuu

SEQ ID NO: 4034109 - RNA, 15 nt, Staphylococcus aureus subsp. aureus MW2
agucaauuuuuucau

SEQ ID NO: 4034110 - RNA, 21 nt, Staphylococcus aureus subsp. aureus MW2
agucaccugcuuuuuauuauu

SEQ ID NO: 4034111 - RNA, 16 nt, Staphylococcus aureus subsp. aureus MW2
agucagcauacaauaa

SEQ ID NO: 4034112 - RNA, 19 nt, Staphylococcus aureus subsp. aureus MW2
agucagcauacaauaaugu

SEQ ID NO: 4034113 - RNA, 18 nt, Staphylococcus aureus subsp. aureus MW2
agucagcuuacaauaaug

SEQ ID NO: 4034114 - RNA, 13 nt, Staphylococcus aureus subsp. aureus MW2
agucaggggcccc

SEQ ID NO: 4034115 - RNA, 14 nt, Staphylococcus aureus subsp. aureus MW2
agucaggggcccca

SEQ ID NO: 4034116 - RNA, 19 nt, Staphylococcus aureus subsp. aureus MW2
agucaggggccccaacaca

SEQ ID NO: 4034117 - RNA, 22 nt, Staphylococcus aureus subsp. aureus MW2
agucaggggccccaacacagag

SEQ ID NO: 4034118 - RNA, 16 nt, Staphylococcus aureus subsp. aureus MW2
agucagguuacaauaa

SEQ ID NO: 4034119 - RNA, 17 nt, Staphylococcus aureus subsp. aureus MW2
agucauaaauauaaaau

SEQ ID NO: 4034120 - RNA, 15 nt, Staphylococcus aureus subsp. aureus MW2
agucauaauuuagaa

SEQ ID NO: 4034121 - RNA, 17 nt, Staphylococcus aureus subsp. aureus MW2
agucauacacaaugauu

SEQ ID NO: 4034122 - RNA, 19 nt, Staphylococcus aureus subsp. aureus MW2
agucaucaaccucauuuga

SEQ ID NO: 4034123 - RNA, 10 nt, Staphylococcus aureus subsp. aureus MW2
agucaucauc

SEQ ID NO: 4034124 - RNA, 14 nt, Staphylococcus aureus subsp. aureus MW2
aguuaccaaaauuu

SEQ ID NO: 4034125 - RNA, 17 nt, Staphylococcus aureus subsp. aureus MW2
aguuaccuacuacauuc

SEQ ID NO: 4034126 - RNA, 20 nt, Staphylococcus aureus subsp. aureus MW2
aguuaccucgaguuuauucg

SEQ ID NO: 4034127 - RNA, 17 nt, Staphylococcus aureus subsp. aureus MW2
aguuaccuuugccaaca

SEQ ID NO: 4034128 - RNA, 21 nt, Staphylococcus aureus subsp. aureus MW2
aguuaccuuugccaacaccau

SEQ ID NO: 4034129 - RNA, 15 nt, Staphylococcus aureus subsp. aureus MW2
aguuacuuacgccaa

SEQ ID NO: 4034130 - RNA, 21 nt, Staphylococcus aureus subsp. aureus MW2
aguuacuuacgccaaucacaa

SEQ ID NO: 4034131 - RNA, 18 nt, Staphylococcus aureus subsp. aureus MW2
aguuagaagaugauuauu

SEQ ID NO: 4034132 - RNA, 15 nt, Staphylococcus aureus subsp. aureus MW2
aguuauaucauaacu

SEQ ID NO: 4034133 - RNA, 18 nt, Staphylococcus aureus subsp. aureus MW2
aguuauaucauaacuuaa

SEQ ID NO: 4034134 - RNA, 14 nt, Staphylococcus aureus subsp. aureus MW2
aguuauauuguuaa

SEQ ID NO: 4034135 - RNA, 19 nt, Staphylococcus aureus subsp. aureus MW2
aguuaugaagggaaaaaau

SEQ ID NO: 4034136 - RNA, 14 nt, Staphylococcus aureus subsp. aureus MW2
aguuauuuaaguuc

SEQ ID NO: 4034137 - RNA, 15 nt, Staphylococcus aureus subsp. aureus MW2
aguuauuuaaguucu

SEQ ID NO: 4034138 - RNA, 15 nt, Staphylococcus aureus subsp. aureus MW2
aguucaaaauacuca

SEQ ID NO: 4034139 - RNA, 14 nt, Staphylococcus aureus subsp. aureus MW2
aguucaaacagaaa

SEQ ID NO: 4034140 - RNA, 19 nt, Staphylococcus aureus subsp. aureus MW2
aguucaacagggguuuuua

SEQ ID NO: 4034141 - RNA, 13 nt, Staphylococcus aureus subsp. aureus MW2
aguucacaugaau

SEQ ID NO: 4034142 - RNA, 21 nt, Staphylococcus aureus subsp. aureus MW2
aguucaccguaaucuuuuaac

SEQ ID NO: 4034143 - RNA, 15 nt, Staphylococcus aureus subsp. aureus MW2
aguucagcguuaucu

SEQ ID NO: 4034144 - RNA, 16 nt, Staphylococcus aureus subsp. aureus MW2
aguucaggaucaagug

SEQ ID NO: 4034145 - RNA, 18 nt, Staphylococcus aureus subsp. aureus MW2
aguucaggaucaagugca

SEQ ID NO: 4034146 - RNA, 19 nt, Staphylococcus aureus subsp. aureus MW2
aguucaucuggugcaauau

SEQ ID NO: 4034147 - RNA, 15 nt, Staphylococcus aureus subsp. aureus MW2
aguucuauauaauuu

SEQ ID NO: 4034148 - RNA, 16 nt, Staphylococcus aureus subsp. aureus MW2
aguucuauguauaaua

SEQ ID NO: 4034149 - RNA, 20 nt, Staphylococcus aureus subsp. aureus MW2
aguucuuaugcaguuuuaau

SEQ ID NO: 4034150 - RNA, 21 nt, Staphylococcus aureus subsp. aureus MW2
aguucuugauuggcacaguca

SEQ ID NO: 4034151 - RNA, 13 nt, Staphylococcus aureus subsp. aureus MW2
aguucuuuuugau

SEQ ID NO: 4034152 - RNA, 21 nt, Staphylococcus aureus subsp. aureus MW2
aguugaaaaccucuuuuuguu

SEQ ID NO: 4034153 - RNA, 14 nt, Staphylococcus aureus subsp. aureus MW2
aguugaaaauaauc

SEQ ID NO: 4034154 - RNA, 21 nt, Staphylococcus aureus subsp. aureus MW2
aguugaaaauaaucgaacaga

SEQ ID NO: 4034155 - RNA, 22 nt, Staphylococcus aureus subsp. aureus MW2
aguugaagccccuggugauuca

SEQ ID NO: 4034156 - RNA, 17 nt, Staphylococcus aureus subsp. aureus MW2
aguugaagcggguugaa

SEQ ID NO: 4034157 - RNA, 22 nt, Staphylococcus aureus subsp. aureus MW2
aguugaagcuaauucauauuca

SEQ ID NO: 4034158 - RNA, 15 nt, Staphylococcus aureus subsp. aureus MW2
aguugacaauacaaa

SEQ ID NO: 4034159 - RNA, 17 nt, Staphylococcus aureus subsp. aureus MW2
aguugagucaauuucuu

SEQ ID NO: 4034160 - RNA, 14 nt, Staphylococcus aureus subsp. aureus MW2
aguugauaacuauu

SEQ ID NO: 4034161 - RNA, 21 nt, Staphylococcus aureus subsp. aureus MW2
aguugauugcaugacagcaaa

SEQ ID NO: 4034162 - RNA, 22 nt, Staphylococcus aureus subsp. aureus MW2
aguugauuuaagauuuaauaaa

SEQ ID NO: 4034163 - RNA, 15 nt, Staphylococcus aureus subsp. aureus MW2
aguugcacauuauaa

SEQ ID NO: 4034164 - RNA, 21 nt, Staphylococcus aureus subsp. aureus MW2
aguugcacauuauaaagcugc

SEQ ID NO: 4034165 - RNA, 16 nt, Staphylococcus aureus subsp. aureus MW2
aguugcccgauuuuaa

SEQ ID NO: 4034166 - RNA, 16 nt, Staphylococcus aureus subsp. aureus MW2
aguugcugaauaaaau

SEQ ID NO: 4034167 - RNA, 16 nt, Staphylococcus aureus subsp. aureus MW2
aguuggcggggcccca

SEQ ID NO: 4034168 - RNA, 17 nt, Staphylococcus aureus subsp. aureus MW2
aguuggcggggccccaa

SEQ ID NO: 4034169 - RNA, 21 nt, Staphylococcus aureus subsp. aureus MW2
aguuggcugauagaugaaaau

SEQ ID NO: 4034170 - RNA, 18 nt, Staphylococcus aureus subsp. aureus MW2
aguuggggaugggcccca

SEQ ID NO: 4034171 - RNA, 19 nt, Staphylococcus aureus subsp. aureus MW2
aguuggggugugggcccca

SEQ ID NO: 4034172 - RNA, 14 nt, Staphylococcus aureus subsp. aureus MW2
aguugguaucgauu

SEQ ID NO: 4034173 - RNA, 14 nt, Staphylococcus aureus subsp. aureus MW2
aguugguuuagaca

SEQ ID NO: 4034174 - RNA, 22 nt, Staphylococcus aureus subsp. aureus MW2
aguugguuuuauuaauucugau

SEQ ID NO: 4034175 - RNA, 19 nt, Staphylococcus aureus subsp. aureus MW2
aguuguacuacuugauucu

SEQ ID NO: 4034176 - RNA, 23 nt, Staphylococcus aureus subsp. aureus MW2
aguuguggucuaaccaucucaac

SEQ ID NO: 4034177 - RNA, 20 nt, Staphylococcus aureus subsp. aureus MW2
aguugugguuguuaauguau

SEQ ID NO: 4034178 - RNA, 14 nt, Staphylococcus aureus subsp. aureus MW2
aguuguguaauaaa

SEQ ID NO: 4034179 - RNA, 16 nt, Staphylococcus aureus subsp. aureus MW2
aguuguugauuuaaaa

SEQ ID NO: 4034180 - RNA, 13 nt, Staphylococcus aureus subsp. aureus MW2
aguuguugcaaau

SEQ ID NO: 4034181 - RNA, 14 nt, Staphylococcus aureus subsp. aureus MW2
aguuguuucuccag

SEQ ID NO: 4034182 - RNA, 14 nt, Staphylococcus aureus subsp. aureus MW2
aguuuaacauuacu

SEQ ID NO: 4034183 - RNA, 13 nt, Staphylococcus aureus subsp. aureus MW2
aguuuaaucgcau

SEQ ID NO: 4034184 - RNA, 20 nt, Staphylococcus aureus subsp. aureus MW2
aguuuacgaucauaaauauu

SEQ ID NO: 4034185 - RNA, 17 nt, Staphylococcus aureus subsp. aureus MW2
aguuuacggggugcuuu

SEQ ID NO: 4034186 - RNA, 23 nt, Staphylococcus aureus subsp. aureus MW2
aguuuacggggugcuuuuuaugu

SEQ ID NO: 4034187 - RNA, 17 nt, Staphylococcus aureus subsp. aureus MW2
aguuuagguugauuucu

SEQ ID NO: 4034188 - RNA, 17 nt, Staphylococcus aureus subsp. aureus MW2
aguuucaacuuuugaug

SEQ ID NO: 4034189 - RNA, 22 nt, Staphylococcus aureus subsp. aureus MW2
aguuucaucaaguauaaauguu

SEQ ID NO: 4034190 - RNA, 22 nt, Staphylococcus aureus subsp. aureus MW2
aguuuccauaaauaaaaugcua

SEQ ID NO: 4034191 - RNA, 22 nt, Staphylococcus aureus subsp. aureus MW2
aguuugaucauaauucaguguu

SEQ ID NO: 4034192 - RNA, 16 nt, Staphylococcus aureus subsp. aureus MW2
aguuuggagaauuuau

SEQ ID NO: 4034193 - RNA, 17 nt, Staphylococcus aureus subsp. aureus MW2
aguuuguccuuuaagaa

SEQ ID NO: 4034194 - RNA, 18 nt, Staphylococcus aureus subsp. aureus MW2
aguuuguuggucuuucuu

SEQ ID NO: 4034195 - RNA, 16 nt, Staphylococcus aureus subsp. aureus MW2
aguuuguuucuaaauu

SEQ ID NO: 4034196 - RNA, 20 nt, Staphylococcus aureus subsp. aureus MW2
aguuuguuucuaaauucuuu

SEQ ID NO: 4034197 - RNA, 13 nt, Staphylococcus aureus subsp. aureus MW2
aguuuuauaagaa

SEQ ID NO: 4034198 - RNA, 16 nt, Staphylococcus aureus subsp. aureus MW2
aguuuucuucacugcu

SEQ ID NO: 4034199 - RNA, 19 nt, Staphylococcus aureus subsp. aureus MW2
aguuuugaagaauaaaaaa

SEQ ID NO: 4034200 - RNA, 15 nt, Staphylococcus aureus subsp. aureus MW2
aguuuuguauucagg

SEQ ID NO: 4034201 - RNA, 22 nt, Staphylococcus aureus subsp. aureus MW2
aguuuuugguagcauuuuagau

SEQ ID NO: 4034202 - RNA, 13 nt, Staphylococcus aureus subsp. aureus MW2
aguuuuuuaaaau

SEQ ID NO: 4034203 - RNA, 21 nt, Staphylococcus aureus subsp. aureus MW2
aguuuuuuaaaauaaugauau

SEQ ID NO: 4034204 - RNA, 15 nt, Staphylococcus aureus subsp. aureus MW2
aguuuuuuuauaagc

SEQ ID NO: 4034205 - RNA, 12 nt, Staphylococcus aureus subsp. aureus MW2
auaaaaaaagaa

SEQ ID NO: 4034206 - RNA, 14 nt, Staphylococcus aureus subsp. aureus MW2
auaaaaaaagagac

SEQ ID NO: 4034207 - RNA, 22 nt, Staphylococcus aureus subsp. aureus MW2
auaaaaaaauagcuccuccaaa

SEQ ID NO: 4034208 - RNA, 17 nt, Staphylococcus aureus subsp. aureus MW2
auaaaaaaccaagugca

SEQ ID NO: 4034209 - RNA, 12 nt, Staphylococcus aureus subsp. aureus MW2
auaaaaaagcca

SEQ ID NO: 4034210 - RNA, 12 nt, Staphylococcus aureus subsp. aureus MW2
auaaaaaaguug

SEQ ID NO: 4034211 - RNA, 12 nt, Staphylococcus aureus subsp. aureus MW2
auaaaaaauacu

SEQ ID NO: 4034212 - RNA, 14 nt, Staphylococcus aureus subsp. aureus MW2
auaaaaaauacuaa

SEQ ID NO: 4034213 - RNA, 21 nt, Staphylococcus aureus subsp. aureus MW2
auaaauaauuucggauuaucu

SEQ ID NO: 4034214 - RNA, 19 nt, Staphylococcus aureus subsp. aureus MW2
auaaauacaauagaaauaa

SEQ ID NO: 4034215 - RNA, 21 nt, Staphylococcus aureus subsp. aureus MW2
auaaauaccgucuucucuauc

SEQ ID NO: 4034216 - RNA, 22 nt, Staphylococcus aureus subsp. aureus MW2
auaaauaucaauuguugcaaaa

SEQ ID NO: 4034217 - RNA, 17 nt, Staphylococcus aureus subsp. aureus MW2
auaaauaugauguuaaa

SEQ ID NO: 4034218 - RNA, 20 nt, Staphylococcus aureus subsp. aureus MW2
auaaauaugauguuaaaaaa

SEQ ID NO: 4034219 - RNA, 18 nt, Staphylococcus aureus subsp. aureus MW2
auaaauauggauuuugaa

SEQ ID NO: 4034220 - RNA, 12 nt, Staphylococcus aureus subsp. aureus MW2
auaaauauuaaa

SEQ ID NO: 4034221 - RNA, 16 nt, Staphylococcus aureus subsp. aureus MW2
auaaauauuaaauuca

SEQ ID NO: 4034222 - RNA, 15 nt, Staphylococcus aureus subsp. aureus MW2
auaaauauuaagcgu

SEQ ID NO: 4034223 - RNA, 13 nt, Staphylococcus aureus subsp. aureus MW2
auaaauauuggaa

SEQ ID NO: 4034224 - RNA, 14 nt, Staphylococcus aureus subsp. aureus MW2
auaaauauuguguu

SEQ ID NO: 4034225 - RNA, 14 nt, Staphylococcus aureus subsp. aureus MW2
auaaauauuuaaaa

SEQ ID NO: 4034226 - RNA, 19 nt, Staphylococcus aureus subsp. aureus MW2
auaaauauuuaaaauauua

SEQ ID NO: 4034227 - RNA, 13 nt, Staphylococcus aureus subsp. aureus MW2
auaaaucaacuua

SEQ ID NO: 4034228 - RNA, 16 nt, Staphylococcus aureus subsp. aureus MW2
auaaaucaacuuaaau

SEQ ID NO: 4034229 - RNA, 17 nt, Staphylococcus aureus subsp. aureus MW2
auaaaucaauauucuau

SEQ ID NO: 4034230 - RNA, 18 nt, Staphylococcus aureus subsp. aureus MW2
auaaaucacgccauaauc

SEQ ID NO: 4034231 - RNA, 19 nt, Staphylococcus aureus subsp. aureus MW2
auaaaucauacgagaaauu

SEQ ID NO: 4034232 - RNA, 13 nt, Staphylococcus aureus subsp. aureus MW2
auaaaucaucauu

SEQ ID NO: 4034233 - RNA, 15 nt, Staphylococcus aureus subsp. aureus MW2
auaaaucaugaaauu

SEQ ID NO: 4034234 - RNA, 17 nt, Staphylococcus aureus subsp. aureus MW2
auaaaucaugaaauuaa

SEQ ID NO: 4034235 - RNA, 18 nt, Staphylococcus aureus subsp. aureus MW2
auaaauccaaugaugaau

SEQ ID NO: 4034236 - RNA, 14 nt, Staphylococcus aureus subsp. aureus MW2
auaaaucuaauacu

SEQ ID NO: 4034237 - RNA, 19 nt, Staphylococcus aureus subsp. aureus MW2
auaaaucuaauacuuucaa

SEQ ID NO: 4034238 - RNA, 16 nt, Staphylococcus aureus subsp. aureus MW2
auaaaucuuugauuau

SEQ ID NO: 4034239 - RNA, 19 nt, Staphylococcus aureus subsp. aureus MW2
auaaaugaauuauuuaaaa

SEQ ID NO: 4034240 - RNA, 17 nt, Staphylococcus aureus subsp. aureus MW2
auaaaugacugaauuaa

SEQ ID NO: 4034241 - RNA, 18 nt, Staphylococcus aureus subsp. aureus MW2
auaaaugacuucacauuu

SEQ ID NO: 4034242 - RNA, 22 nt, Staphylococcus aureus subsp. aureus MW2
auaaaugauuucuucauuauca

SEQ ID NO: 4034243 - RNA, 23 nt, Staphylococcus aureus subsp. aureus MW2
auaaaugauuucuucauuaucaa

SEQ ID NO: 4034244 - RNA, 16 nt, Staphylococcus aureus subsp. aureus MW2
auaaaugcauacgcag

SEQ ID NO: 4034245 - RNA, 13 nt, Staphylococcus aureus subsp. aureus MW2
auaaaugucacug

SEQ ID NO: 4034246 - RNA, 21 nt, Staphylococcus aureus subsp. aureus MW2
auaaaugucacugcaaacaca

SEQ ID NO: 4034247 - RNA, 16 nt, Staphylococcus aureus subsp. aureus MW2
auaaaugucauaguau

SEQ ID NO: 4034248 - RNA, 19 nt, Staphylococcus aureus subsp. aureus MW2
auaaauguuaaagauuauu

SEQ ID NO: 4034249 - RNA, 15 nt, Staphylococcus aureus subsp. aureus MW2
auaaauguuagauuu

SEQ ID NO: 4034250 - RNA, 23 nt, Staphylococcus aureus subsp. aureus MW2
auaaauguuagauuucaaacgau

SEQ ID NO: 4034251 - RNA, 19 nt, Staphylococcus aureus subsp. aureus MW2
auaaauguuauugcuuauu

SEQ ID NO: 4034252 - RNA, 16 nt, Staphylococcus aureus subsp. aureus MW2
auaaauguuuauaucu

SEQ ID NO: 4034253 - RNA, 19 nt, Staphylococcus aureus subsp. aureus MW2
auaaauuaaaugcaauaca

SEQ ID NO: 4034254 - RNA, 15 nt, Staphylococcus aureus subsp. aureus MW2
auaaauuaauaugaa

SEQ ID NO: 4034255 - RNA, 15 nt, Staphylococcus aureus subsp. aureus MW2
auaaauuagaugaaa

SEQ ID NO: 4034256 - RNA, 17 nt, Staphylococcus aureus subsp. aureus MW2
auaaauuagaugaaaug

SEQ ID NO: 4034257 - RNA, 15 nt, Staphylococcus aureus subsp. aureus MW2
auaaauuagccauuu

SEQ ID NO: 4034258 - RNA, 18 nt, Staphylococcus aureus subsp. aureus MW2
auaaauuagccauuucaa

SEQ ID NO: 4034259 - RNA, 19 nt, Staphylococcus aureus subsp. aureus MW2
auaaauuagccauuucaau

SEQ ID NO: 4034260 - RNA, 14 nt, Staphylococcus aureus subsp. aureus MW2
auaaauuauuuuug

SEQ ID NO: 4034261 - RNA, 18 nt, Staphylococcus aureus subsp. aureus MW2
auaaauucucuaauuucu

SEQ ID NO: 4034262 - RNA, 19 nt, Staphylococcus aureus subsp. aureus MW2
auaaauucucuuggauagu

SEQ ID NO: 4034263 - RNA, 21 nt, Staphylococcus aureus subsp. aureus MW2
auaaauugaguuuuuuaaaau

SEQ ID NO: 4034264 - RNA, 13 nt, Staphylococcus aureus subsp. aureus MW2
auaaauugauauu

SEQ ID NO: 4034265 - RNA, 21 nt, Staphylococcus aureus subsp. aureus MW2
auaaauugguucuauaauaaa

SEQ ID NO: 4034266 - RNA, 19 nt, Staphylococcus aureus subsp. aureus MW2
auaaauuguaauauauuaa

SEQ ID NO: 4034267 - RNA, 17 nt, Staphylococcus aureus subsp. aureus MW2
auaaauuguaugaauaa

SEQ ID NO: 4034268 - RNA, 20 nt, Staphylococcus aureus subsp. aureus MW2
auaaauuguaugaauaauau

SEQ ID NO: 4034269 - RNA, 20 nt, Staphylococcus aureus subsp. aureus MW2
auaaauuuaacguuauucau

SEQ ID NO: 4034270 - RNA, 22 nt, Staphylococcus aureus subsp. aureus MW2
auaaauuuaacguuauucauuu

SEQ ID NO: 4034271 - RNA, 22 nt, Staphylococcus aureus subsp. aureus MW2
auaaauuuagauauaauaaaaa

SEQ ID NO: 4034272 - RNA, 14 nt, Staphylococcus aureus subsp. aureus MW2
auaaauuuauauau

SEQ ID NO: 4034273 - RNA, 21 nt, Staphylococcus aureus subsp. aureus MW2
auaaauuucaagguauacaca

SEQ ID NO: 4034274 - RNA, 17 nt, Staphylococcus aureus subsp. aureus MW2
auaaauuuugaauuaca

SEQ ID NO: 4034275 - RNA, 19 nt, Staphylococcus aureus subsp. aureus MW2
auaaauuuugaauuacaga

SEQ ID NO: 4034276 - RNA, 15 nt, Staphylococcus aureus subsp. aureus MW2
auaaauuuugagaaa

SEQ ID NO: 4034277 - RNA, 17 nt, Staphylococcus aureus subsp. aureus MW2
auaaauuuugagaaaau

SEQ ID NO: 4034278 - RNA, 19 nt, Staphylococcus aureus subsp. aureus MW2
auaaauuuugcgaaaauau

SEQ ID NO: 4034279 - RNA, 18 nt, Staphylococcus aureus subsp. aureus MW2
auaaauuuuuaguuaaag

SEQ ID NO: 4034280 - RNA, 18 nt, Staphylococcus aureus subsp. aureus MW2
auaacaaaauuaaauaug

SEQ ID NO: 4034281 - RNA, 16 nt, Staphylococcus aureus subsp. aureus MW2
auaacaaccuauuaau

SEQ ID NO: 4034282 - RNA, 14 nt, Staphylococcus aureus subsp. aureus MW2
auaacaagaaguaa

SEQ ID NO: 4034283 - RNA, 17 nt, Staphylococcus aureus subsp. aureus MW2
auaacaagaaguaaugu

SEQ ID NO: 4034284 - RNA, 20 nt, Staphylococcus aureus subsp. aureus MW2
auaacaaguauaaaugcagc

SEQ ID NO: 4034285 - RNA, 22 nt, Staphylococcus aureus subsp. aureus MW2
auaacaauagugacuuuuauaa

SEQ ID NO: 4034286 - RNA, 22 nt, Staphylococcus aureus subsp. aureus MW2
auaacaaugcagcuguauuuaa

SEQ ID NO: 4034287 - RNA, 13 nt, Staphylococcus aureus subsp. aureus MW2
auaacaauuuuaa

SEQ ID NO: 4034288 - RNA, 14 nt, Staphylococcus aureus subsp. aureus MW2
auaacaauuuuaaa

SEQ ID NO: 4034289 - RNA, 20 nt, Staphylococcus aureus subsp. aureus MW2
auaacacaucaugacauuaa

SEQ ID NO: 4034290 - RNA, 21 nt, Staphylococcus aureus subsp. aureus MW2
auaacacaucaugacauuaau

SEQ ID NO: 4034291 - RNA, 15 nt, Staphylococcus aureus subsp. aureus MW2
auaacaccaauuaaa

SEQ ID NO: 4034292 - RNA, 15 nt, Staphylococcus aureus subsp. aureus MW2
auaacaccauaacac

SEQ ID NO: 4034293 - RNA, 20 nt, Staphylococcus aureus subsp. aureus MW2
auaacacccgucccauaaaa

SEQ ID NO: 4034294 - RNA, 18 nt, Staphylococcus aureus subsp. aureus MW2
auaacagcuacaaauaau

SEQ ID NO: 4034295 - RNA, 15 nt, Staphylococcus aureus subsp. aureus MW2
auaacauaagaaaaa

SEQ ID NO: 4034296 - RNA, 16 nt, Staphylococcus aureus subsp. aureus MW2
auaacauaagaaaaag

SEQ ID NO: 4034297 - RNA, 20 nt, Staphylococcus aureus subsp. aureus MW2
auaacauaagaaaaagcagu

SEQ ID NO: 4034298 - RNA, 21 nt, Staphylococcus aureus subsp. aureus MW2
auaacauccccuucuugagca

SEQ ID NO: 4034299 - RNA, 13 nt, Staphylococcus aureus subsp. aureus MW2
auaacaucuaaau

SEQ ID NO: 4034300 - RNA, 15 nt, Staphylococcus aureus subsp. aureus MW2
auaacaucuaaauuu

SEQ ID NO: 4034301 - RNA, 14 nt, Staphylococcus aureus subsp. aureus MW2
auaauaccaauugc

SEQ ID NO: 4034302 - RNA, 23 nt, Staphylococcus aureus subsp. aureus MW2
auaauaccuucaauugacauuaa

SEQ ID NO: 4034303 - RNA, 17 nt, Staphylococcus aureus subsp. aureus MW2
auaauacuguuuaaaua

SEQ ID NO: 4034304 - RNA, 16 nt, Staphylococcus aureus subsp. aureus MW2
auaauagcaaaauuau

SEQ ID NO: 4034305 - RNA, 20 nt, Staphylococcus aureus subsp. aureus MW2
auaauagccgcuucauugau

SEQ ID NO: 4034306 - RNA, 17 nt, Staphylococcus aureus subsp. aureus MW2
auaauaggcuagauaau

SEQ ID NO: 4034307 - RNA, 20 nt, Staphylococcus aureus subsp. aureus MW2
auaauaggcuagauaauaau

SEQ ID NO: 4034308 - RNA, 21 nt, Staphylococcus aureus subsp. aureus MW2
auaauaguuuacggggugcuu

SEQ ID NO: 4034309 - RNA, 17 nt, Staphylococcus aureus subsp. aureus MW2
auaauauaaaaacaaaa

SEQ ID NO: 4034310 - RNA, 21 nt, Staphylococcus aureus subsp. aureus MW2
auaauauaaaacgauaagaau

SEQ ID NO: 4034311 - RNA, 13 nt, Staphylococcus aureus subsp. aureus MW2
auaauauaaauaa

SEQ ID NO: 4034312 - RNA, 16 nt, Staphylococcus aureus subsp. aureus MW2
auaauauaaauaaaag

SEQ ID NO: 4034313 - RNA, 16 nt, Staphylococcus aureus subsp. aureus MW2
auaauauauacaaaua

SEQ ID NO: 4034314 - RNA, 18 nt, Staphylococcus aureus subsp. aureus MW2
auaauauauacaaauaaa

SEQ ID NO: 4034315 - RNA, 19 nt, Staphylococcus aureus subsp. aureus MW2
auaauauauacaaauaaac

SEQ ID NO: 4034316 - RNA, 13 nt, Staphylococcus aureus subsp. aureus MW2
auaauauauuaaa

SEQ ID NO: 4034317 - RNA, 13 nt, Staphylococcus aureus subsp. aureus MW2
auaauauauuaac

SEQ ID NO: 4034318 - RNA, 13 nt, Staphylococcus aureus subsp. aureus MW2
auaauauauuuag

SEQ ID NO: 4034319 - RNA, 22 nt, Staphylococcus aureus subsp. aureus MW2
auaauaucaccuuuuuuaagau

SEQ ID NO: 4034320 - RNA, 19 nt, Staphylococcus aureus subsp. aureus MW2
auaauaugccaaaguaaua

SEQ ID NO: 4034321 - RNA, 15 nt, Staphylococcus aureus subsp. aureus MW2
auaauauugaaagau

SEQ ID NO: 4034322 - RNA, 17 nt, Staphylococcus aureus subsp. aureus MW2
auaauauugaaagauau

SEQ ID NO: 4034323 - RNA, 17 nt, Staphylococcus aureus subsp. aureus MW2
auaauauugaugaauaa

SEQ ID NO: 4034324 - RNA, 14 nt, Staphylococcus aureus subsp. aureus MW2
auaaucaacaugug

SEQ ID NO: 4034325 - RNA, 22 nt, Staphylococcus aureus subsp. aureus MW2
auaaucaagucugcauuaauuu

SEQ ID NO: 4034326 - RNA, 22 nt, Staphylococcus aureus subsp. aureus MW2
auaaucacaauacgaaaccaaa

SEQ ID NO: 4034327 - RNA, 21 nt, Staphylococcus aureus subsp. aureus MW2
auaaucacuuggcgacauuug

SEQ ID NO: 4034328 - RNA, 16 nt, Staphylococcus aureus subsp. aureus MW2
auaaucauaaugagac

SEQ ID NO: 4034329 - RNA, 15 nt, Staphylococcus aureus subsp. aureus MW2
auaauccaagauaua

SEQ ID NO: 4034330 - RNA, 21 nt, Staphylococcus aureus subsp. aureus MW2
auaauccaagauauauaacua

SEQ ID NO: 4034331 - RNA, 16 nt, Staphylococcus aureus subsp. aureus MW2
auaauccaccuaaaaa

SEQ ID NO: 4034332 - RNA, 17 nt, Staphylococcus aureus subsp. aureus MW2
auaauccauucuucuug

SEQ ID NO: 4034333 - RNA, 19 nt, Staphylococcus aureus subsp. aureus MW2
auaauccauucuucuuguu

SEQ ID NO: 4034334 - RNA, 20 nt, Staphylococcus aureus subsp. aureus MW2
auaaucccaaccauucuacc

SEQ ID NO: 4034335 - RNA, 16 nt, Staphylococcus aureus subsp. aureus MW2
auaaucgaacagaaaa

SEQ ID NO: 4034336 - RNA, 19 nt, Staphylococcus aureus subsp. aureus MW2
auaaucgguaauuacuugu

SEQ ID NO: 4034337 - RNA, 19 nt, Staphylococcus aureus subsp. aureus MW2
auaaucguauucauaucau

SEQ ID NO: 4034338 - RNA, 14 nt, Staphylococcus aureus subsp. aureus MW2
auaaucguuaaaac

SEQ ID NO: 4034339 - RNA, 13 nt, Staphylococcus aureus subsp. aureus MW2
auaaucuacugcu

SEQ ID NO: 4034340 - RNA, 15 nt, Staphylococcus aureus subsp. aureus MW2
auaaucuacugcugu

SEQ ID NO: 4034341 - RNA, 18 nt, Staphylococcus aureus subsp. aureus MW2
auaaucucauucuuuaau

SEQ ID NO: 4034342 - RNA, 19 nt, Staphylococcus aureus subsp. aureus MW2
auaaucucauucuuuaaua

SEQ ID NO: 4034343 - RNA, 21 nt, Staphylococcus aureus subsp. aureus MW2
auaaucucauucuuuaauaua

SEQ ID NO: 4034344 - RNA, 19 nt, Staphylococcus aureus subsp. aureus MW2
auaaucuuacugcuuuuuu

SEQ ID NO: 4034345 - RNA, 17 nt, Staphylococcus aureus subsp. aureus MW2
auaaucuuuauuaauaa

SEQ ID NO: 4034346 - RNA, 16 nt, Staphylococcus aureus subsp. aureus MW2
auaaucuuuuuuacua

SEQ ID NO: 4034347 - RNA, 16 nt, Staphylococcus aureus subsp. aureus MW2
auaaugaaguuaugaa

SEQ ID NO: 4034348 - RNA, 14 nt, Staphylococcus aureus subsp. aureus MW2
auaaugaauaguaa

SEQ ID NO: 4034349 - RNA, 15 nt, Staphylococcus aureus subsp. aureus MW2
auaaugaauaguaau

SEQ ID NO: 4034350 - RNA, 15 nt, Staphylococcus aureus subsp. aureus MW2
auaaugacaaauuau

SEQ ID NO: 4034351 - RNA, 19 nt, Staphylococcus aureus subsp. aureus MW2
auaaugacaaauuaucacu

SEQ ID NO: 4034352 - RNA, 15 nt, Staphylococcus aureus subsp. aureus MW2
auaaugacuauaaca

SEQ ID NO: 4034353 - RNA, 14 nt, Staphylococcus aureus subsp. aureus MW2
auaaugauaaauua

SEQ ID NO: 4034354 - RNA, 14 nt, Staphylococcus aureus subsp. aureus MW2
auaaugauuaaaaa

SEQ ID NO: 4034355 - RNA, 22 nt, Staphylococcus aureus subsp. aureus MW2
auaaugauuaaaaaucaaagag

SEQ ID NO: 4034356 - RNA, 15 nt, Staphylococcus aureus subsp. aureus MW2
auaaugauuuaauuu

SEQ ID NO: 4034357 - RNA, 14 nt, Staphylococcus aureus subsp. aureus MW2
auaaugauuuuuau

SEQ ID NO: 4034358 - RNA, 22 nt, Staphylococcus aureus subsp. aureus MW2
auaaugccaccguggaauuuac

SEQ ID NO: 4034359 - RNA, 19 nt, Staphylococcus aureus subsp. aureus MW2
auaaugcuacuauuaaaua

SEQ ID NO: 4034360 - RNA, 11 nt, Staphylococcus aureus subsp. aureus MW2
auaaugcuuua

SEQ ID NO: 4034361 - RNA, 14 nt, Staphylococcus aureus subsp. aureus MW2
auaauggacgguau

SEQ ID NO: 4034362 - RNA, 14 nt, Staphylococcus aureus subsp. aureus MW2
auaauggcaauuaa

SEQ ID NO: 4034363 - RNA, 20 nt, Staphylococcus aureus subsp. aureus MW2
auaaugguugaauaacacua

SEQ ID NO: 4034364 - RNA, 14 nt, Staphylococcus aureus subsp. aureus MW2
auaaugguuucaaa

SEQ ID NO: 4034365 - RNA, 15 nt, Staphylococcus aureus subsp. aureus MW2
auaaugguuucaaaa

SEQ ID NO: 4034366 - RNA, 16 nt, Staphylococcus aureus subsp. aureus MW2
auaaugguuucaaaau

SEQ ID NO: 4034367 - RNA, 13 nt, Staphylococcus aureus subsp. aureus MW2
auaauguacacuu

SEQ ID NO: 4034368 - RNA, 16 nt, Staphylococcus aureus subsp. aureus MW2
auaauguacauguaua

SEQ ID NO: 4034369 - RNA, 16 nt, Staphylococcus aureus subsp. aureus MW2
auaauguauaaaacag

SEQ ID NO: 4034370 - RNA, 22 nt, Staphylococcus aureus subsp. aureus MW2
auaauguauaaaacagaauuuc

SEQ ID NO: 4034371 - RNA, 16 nt, Staphylococcus aureus subsp. aureus MW2
auaaugugaaaaaucu

SEQ ID NO: 4034372 - RNA, 14 nt, Staphylococcus aureus subsp. aureus MW2
auaauguucccuua

SEQ ID NO: 4034373 - RNA, 14 nt, Staphylococcus aureus subsp. aureus MW2
auaauguuuccauu

SEQ ID NO: 4034374 - RNA, 20 nt, Staphylococcus aureus subsp. aureus MW2
auaauguuuccugauauuuc

SEQ ID NO: 4034375 - RNA, 22 nt, Staphylococcus aureus subsp. aureus MW2
auaauuaaacauuuagauuuca

SEQ ID NO: 4034376 - RNA, 18 nt, Staphylococcus aureus subsp. aureus MW2
auaauuaaacuaauagca

SEQ ID NO: 4034377 - RNA, 12 nt, Staphylococcus aureus subsp. aureus MW2
auaauuaaacuu

SEQ ID NO: 4034378 - RNA, 20 nt, Staphylococcus aureus subsp. aureus MW2
auaauuaaacuuuaugaaaa

SEQ ID NO: 4034379 - RNA, 21 nt, Staphylococcus aureus subsp. aureus MW2
auaauuaaacuuuaugaaaau

SEQ ID NO: 4034380 - RNA, 11 nt, Staphylococcus aureus subsp. aureus MW2
auaauuaaaua

SEQ ID NO: 4034381 - RNA, 16 nt, Staphylococcus aureus subsp. aureus MW2
auaauuaaauaaaaau

SEQ ID NO: 4034382 - RNA, 14 nt, Staphylococcus aureus subsp. aureus MW2
auaauuaaauaacu

SEQ ID NO: 4034383 - RNA, 14 nt, Staphylococcus aureus subsp. aureus MW2
auaauuaaauauaa

SEQ ID NO: 4034384 - RNA, 23 nt, Staphylococcus aureus subsp. aureus MW2
auaauuaacugcggcaugcgauu

SEQ ID NO: 4034385 - RNA, 17 nt, Staphylococcus aureus subsp. aureus MW2
auaauuaaguguauaua

SEQ ID NO: 4034386 - RNA, 14 nt, Staphylococcus aureus subsp. aureus MW2
auaauuaauaacau

SEQ ID NO: 4034387 - RNA, 13 nt, Staphylococcus aureus subsp. aureus MW2
auaauuaauguuu

SEQ ID NO: 4034388 - RNA, 15 nt, Staphylococcus aureus subsp. aureus MW2
auaauuaauuaugcc

SEQ ID NO: 4034389 - RNA, 19 nt, Staphylococcus aureus subsp. aureus MW2
auaauuaauuuuguaauua

SEQ ID NO: 4034390 - RNA, 13 nt, Staphylococcus aureus subsp. aureus MW2
auaccaacugucg

SEQ ID NO: 4034391 - RNA, 18 nt, Staphylococcus aureus subsp. aureus MW2
auaccacacuuuaaacaa

SEQ ID NO: 4034392 - RNA, 19 nt, Staphylococcus aureus subsp. aureus MW2
auaccacacuuuaaacaag

SEQ ID NO: 4034393 - RNA, 23 nt, Staphylococcus aureus subsp. aureus MW2
auaccacaucgcauaauaucuua

SEQ ID NO: 4034394 - RNA, 14 nt, Staphylococcus aureus subsp. aureus MW2
auaccacuuaaucg

SEQ ID NO: 4034395 - RNA, 19 nt, Staphylococcus aureus subsp. aureus MW2
auaccacuugaauacuuuu

SEQ ID NO: 4034396 - RNA, 22 nt, Staphylococcus aureus subsp. aureus MW2
auaccacuugaauacuuuuuaa

SEQ ID NO: 4034397 - RNA, 19 nt, Staphylococcus aureus subsp. aureus MW2
auaccaguggaaauuaugu

SEQ ID NO: 4034398 - RNA, 22 nt, Staphylococcus aureus subsp. aureus MW2
auaccagugggcuccaaacaua

SEQ ID NO: 4034399 - RNA, 16 nt, Staphylococcus aureus subsp. aureus MW2
auaccaucaucgauau

SEQ ID NO: 4034400 - RNA, 16 nt, Staphylococcus aureus subsp. aureus MW2
auaccauuccaaaaau

SEQ ID NO: 4034401 - RNA, 18 nt, Staphylococcus aureus subsp. aureus MW2
auacccaauauuaaucca

SEQ ID NO: 4034402 - RNA, 18 nt, Staphylococcus aureus subsp. aureus MW2
auacccgcgauacugcca

SEQ ID NO: 4034403 - RNA, 17 nt, Staphylococcus aureus subsp. aureus MW2
auacccuacuauauauc

SEQ ID NO: 4034404 - RNA, 13 nt, Staphylococcus aureus subsp. aureus MW2
auaccgaauaauu

SEQ ID NO: 4034405 - RNA, 21 nt, Staphylococcus aureus subsp. aureus MW2
auaccgaauaauuuugauaua

SEQ ID NO: 4034406 - RNA, 22 nt, Staphylococcus aureus subsp. aureus MW2
auaccguacaaagguaauagaa

SEQ ID NO: 4034407 - RNA, 17 nt, Staphylococcus aureus subsp. aureus MW2
auaccuaaaauacccau

SEQ ID NO: 4034408 - RNA, 16 nt, Staphylococcus aureus subsp. aureus MW2
auaccuaccacaauaa

SEQ ID NO: 4034409 - RNA, 20 nt, Staphylococcus aureus subsp. aureus MW2
auaccuauuggcauuagcuu

SEQ ID NO: 4034410 - RNA, 21 nt, Staphylococcus aureus subsp. aureus MW2
auaccuguccaaauaaauaua

SEQ ID NO: 4034411 - RNA, 13 nt, Staphylococcus aureus subsp. aureus MW2
auaccuugaacau

SEQ ID NO: 4034412 - RNA, 15 nt, Staphylococcus aureus subsp. aureus MW2
auaccuuuaauaucu

SEQ ID NO: 4034413 - RNA, 16 nt, Staphylococcus aureus subsp. aureus MW2
auaccuuuaauaucua

SEQ ID NO: 4034414 - RNA, 21 nt, Staphylococcus aureus subsp. aureus MW2
auaccuuuaauaucuaauucu

SEQ ID NO: 4034415 - RNA, 19 nt, Staphylococcus aureus subsp. aureus MW2
auaccuuuacuuucauuac

SEQ ID NO: 4034416 - RNA, 21 nt, Staphylococcus aureus subsp. aureus MW2
auaccuuuuaauuuaguuaua

SEQ ID NO: 4034417 - RNA, 17 nt, Staphylococcus aureus subsp. aureus MW2
auacgaaaccaaaaaua

SEQ ID NO: 4034418 - RNA, 20 nt, Staphylococcus aureus subsp. aureus MW2
auacgaauuucauaguuauc

SEQ ID NO: 4034419 - RNA, 13 nt, Staphylococcus aureus subsp. aureus MW2
auacgacaaucac

SEQ ID NO: 4034420 - RNA, 13 nt, Staphylococcus aureus subsp. aureus MW2
auacgacaccaac

SEQ ID NO: 4034421 - RNA, 20 nt, Staphylococcus aureus subsp. aureus MW2
auacgacauuuuuagacauu

SEQ ID NO: 4034422 - RNA, 17 nt, Staphylococcus aureus subsp. aureus MW2
auacgagcuuugcucau

SEQ ID NO: 4034423 - RNA, 15 nt, Staphylococcus aureus subsp. aureus MW2
auacgaguguuuuaa

SEQ ID NO: 4034424 - RNA, 19 nt, Staphylococcus aureus subsp. aureus MW2
auacgauaauaacuagaac

SEQ ID NO: 4034425 - RNA, 16 nt, Staphylococcus aureus subsp. aureus MW2
auacgauuuguucaau

SEQ ID NO: 4034426 - RNA, 22 nt, Staphylococcus aureus subsp. aureus MW2
auacgcaaucauuguaaaugau

SEQ ID NO: 4034427 - RNA, 18 nt, Staphylococcus aureus subsp. aureus MW2
auacgccuaaauauuuac

SEQ ID NO: 4034428 - RNA, 23 nt, Staphylococcus aureus subsp. aureus MW2
auacgcgcuucaucaauggaucu

SEQ ID NO: 4034429 - RNA, 20 nt, Staphylococcus aureus subsp. aureus MW2
auacguggcucuaaaaacaa

SEQ ID NO: 4034430 - RNA, 20 nt, Staphylococcus aureus subsp. aureus MW2
auacguuauuucaauaauaa

SEQ ID NO: 4034431 - RNA, 17 nt, Staphylococcus aureus subsp. aureus MW2
auacguuuaauaauggu

SEQ ID NO: 4034432 - RNA, 16 nt, Staphylococcus aureus subsp. aureus MW2
auacguuuauaucuua

SEQ ID NO: 4034433 - RNA, 23 nt, Staphylococcus aureus subsp. aureus MW2
auacguuuauccuuuaaaucauu

SEQ ID NO: 4034434 - RNA, 12 nt, Staphylococcus aureus subsp. aureus MW2
auacuaaaacau

SEQ ID NO: 4034435 - RNA, 12 nt, Staphylococcus aureus subsp. aureus MW2
auacuaaaaugg

SEQ ID NO: 4034436 - RNA, 18 nt, Staphylococcus aureus subsp. aureus MW2
auacuaaaauggauuuua

SEQ ID NO: 4034437 - RNA, 13 nt, Staphylococcus aureus subsp. aureus MW2
auacuaaauugag

SEQ ID NO: 4034438 - RNA, 16 nt, Staphylococcus aureus subsp. aureus MW2
auacuaaauugagaag

SEQ ID NO: 4034439 - RNA, 17 nt, Staphylococcus aureus subsp. aureus MW2
auacuaaauugagaagu

SEQ ID NO: 4034440 - RNA, 15 nt, Staphylococcus aureus subsp. aureus MW2
auacuaaauuugaaa

SEQ ID NO: 4034441 - RNA, 13 nt, Staphylococcus aureus subsp. aureus MW2
auacuaacaauua

SEQ ID NO: 4034442 - RNA, 19 nt, Staphylococcus aureus subsp. aureus MW2
auacuaacguaaaggcgau

SEQ ID NO: 4034443 - RNA, 18 nt, Staphylococcus aureus subsp. aureus MW2
auacuaauaucuucuuua

SEQ ID NO: 4034444 - RNA, 19 nt, Staphylococcus aureus subsp. aureus MW2
auacuaauaucuucuuuau

SEQ ID NO: 4034445 - RNA, 19 nt, Staphylococcus aureus subsp. aureus MW2
auacuaaucaaagaaaaag

SEQ ID NO: 4034446 - RNA, 15 nt, Staphylococcus aureus subsp. aureus MW2
auacuaauuuuguac

SEQ ID NO: 4034447 - RNA, 18 nt, Staphylococcus aureus subsp. aureus MW2
auacuaauuuuguacaua

SEQ ID NO: 4034448 - RNA, 17 nt, Staphylococcus aureus subsp. aureus MW2
auacuacuguugacauu

SEQ ID NO: 4034449 - RNA, 16 nt, Staphylococcus aureus subsp. aureus MW2
auacuagcaauucaca

SEQ ID NO: 4034450 - RNA, 15 nt, Staphylococcus aureus subsp. aureus MW2
auacuauaaauaaaa

SEQ ID NO: 4034451 - RNA, 13 nt, Staphylococcus aureus subsp. aureus MW2
auacuauacugau

SEQ ID NO: 4034452 - RNA, 13 nt, Staphylococcus aureus subsp. aureus MW2
auacuauauaaua

SEQ ID NO: 4034453 - RNA, 16 nt, Staphylococcus aureus subsp. aureus MW2
auacuauauaauaauu

SEQ ID NO: 4034454 - RNA, 16 nt, Staphylococcus aureus subsp. aureus MW2
auacuauaugucuuau

SEQ ID NO: 4034455 - RNA, 21 nt, Staphylococcus aureus subsp. aureus MW2
auacuauaugucuuaucaauu

SEQ ID NO: 4034456 - RNA, 19 nt, Staphylococcus aureus subsp. aureus MW2
auacuaucugacauuuaaa

SEQ ID NO: 4034457 - RNA, 13 nt, Staphylococcus aureus subsp. aureus MW2
auacucaauaaaa

SEQ ID NO: 4034458 - RNA, 21 nt, Staphylococcus aureus subsp. aureus MW2
auacucaucuguccgauaucu

SEQ ID NO: 4034459 - RNA, 23 nt, Staphylococcus aureus subsp. aureus MW2
auacucauguaacguaaaaaugu

SEQ ID NO: 4034460 - RNA, 22 nt, Staphylococcus aureus subsp. aureus MW2
auacucgguacuucgcccuucc

SEQ ID NO: 4034461 - RNA, 14 nt, Staphylococcus aureus subsp. aureus MW2
auacucuaaaaaag

SEQ ID NO: 4034462 - RNA, 16 nt, Staphylococcus aureus subsp. aureus MW2
auacucuaacuuacca

SEQ ID NO: 4034463 - RNA, 21 nt, Staphylococcus aureus subsp. aureus MW2
auacugagucauucaaucauc

SEQ ID NO: 4034464 - RNA, 22 nt, Staphylococcus aureus subsp. aureus MW2
auacugaugaaaacuuaaaaau

SEQ ID NO: 4034465 - RNA, 23 nt, Staphylococcus aureus subsp. aureus MW2
auacugaugguguugcauuagau

SEQ ID NO: 4034466 - RNA, 16 nt, Staphylococcus aureus subsp. aureus MW2
auacugccauauguuu

SEQ ID NO: 4034467 - RNA, 19 nt, Staphylococcus aureus subsp. aureus MW2
auacugccauauguuuuag

SEQ ID NO: 4034468 - RNA, 14 nt, Staphylococcus aureus subsp. aureus MW2
auacuguauuuaua

SEQ ID NO: 4034469 - RNA, 15 nt, Staphylococcus aureus subsp. aureus MW2
auacugucaucuuuc

SEQ ID NO: 4034470 - RNA, 19 nt, Staphylococcus aureus subsp. aureus MW2
auacuguuuaaauaaaauu

SEQ ID NO: 4034471 - RNA, 16 nt, Staphylococcus aureus subsp. aureus MW2
auacuuaauauaguua

SEQ ID NO: 4034472 - RNA, 14 nt, Staphylococcus aureus subsp. aureus MW2
auacuuaauuuaaa

SEQ ID NO: 4034473 - RNA, 17 nt, Staphylococcus aureus subsp. aureus MW2
auacuucaccaucuuua

SEQ ID NO: 4034474 - RNA, 19 nt, Staphylococcus aureus subsp. aureus MW2
auacuucuauuuuauaaua

SEQ ID NO: 4034475 - RNA, 15 nt, Staphylococcus aureus subsp. aureus MW2
auacuucuuuagcaa

SEQ ID NO: 4034476 - RNA, 23 nt, Staphylococcus aureus subsp. aureus MW2
auacuugaagcaucgauuuauua

SEQ ID NO: 4034477 - RNA, 19 nt, Staphylococcus aureus subsp. aureus MW2
auacuugccuucaaauucu

SEQ ID NO: 4034478 - RNA, 23 nt, Staphylococcus aureus subsp. aureus MW2
auaguuuacggggugcuuuuuau

SEQ ID NO: 4034479 - RNA, 16 nt, Staphylococcus aureus subsp. aureus MW2
auaguuucaaugccuu

SEQ ID NO: 4034480 - RNA, 18 nt, Staphylococcus aureus subsp. aureus MW2
auaguuugagaaaauuaa

SEQ ID NO: 4034481 - RNA, 15 nt, Staphylococcus aureus subsp. aureus MW2
auaguuuuauaagaa

SEQ ID NO: 4034482 - RNA, 18 nt, Staphylococcus aureus subsp. aureus MW2
auauaaaaacaaaagaaa

SEQ ID NO: 4034483 - RNA, 13 nt, Staphylococcus aureus subsp. aureus MW2
auauaaaaacugu

SEQ ID NO: 4034484 - RNA, 21 nt, Staphylococcus aureus subsp. aureus MW2
auauaaaaagaagaucccuca

SEQ ID NO: 4034485 - RNA, 15 nt, Staphylococcus aureus subsp. aureus MW2
auauaaaaagugaaa

SEQ ID NO: 4034486 - RNA, 19 nt, Staphylococcus aureus subsp. aureus MW2
auauaaaacgauaagaauu

SEQ ID NO: 4034487 - RNA, 19 nt, Staphylococcus aureus subsp. aureus MW2
auauaaaacggacaaguuu

SEQ ID NO: 4034488 - RNA, 20 nt, Staphylococcus aureus subsp. aureus MW2
auauaaaaucauuaauaauu

SEQ ID NO: 4034489 - RNA, 15 nt, Staphylococcus aureus subsp. aureus MW2
auauaaacuauuaaa

SEQ ID NO: 4034490 - RNA, 20 nt, Staphylococcus aureus subsp. aureus MW2
auauaaacuauuaaaucauu

SEQ ID NO: 4034491 - RNA, 17 nt, Staphylococcus aureus subsp. aureus MW2
auauaaaggaauagcua

SEQ ID NO: 4034492 - RNA, 21 nt, Staphylococcus aureus subsp. aureus MW2
auauaaaggaauagcuacaau

SEQ ID NO: 4034493 - RNA, 17 nt, Staphylococcus aureus subsp. aureus MW2
auauaaauaaaagccaa

SEQ ID NO: 4034494 - RNA, 14 nt, Staphylococcus aureus subsp. aureus MW2
auauaaauagguca

SEQ ID NO: 4034495 - RNA, 14 nt, Staphylococcus aureus subsp. aureus MW2
auauaaauaucaau

SEQ ID NO: 4034496 - RNA, 17 nt, Staphylococcus aureus subsp. aureus MW2
auauaaauuaucagaau

SEQ ID NO: 4034497 - RNA, 23 nt, Staphylococcus aureus subsp. aureus MW2
auauaacauguauauggcauuaa

SEQ ID NO: 4034498 - RNA, 17 nt, Staphylococcus aureus subsp. aureus MW2
auauaacauuaaaauga

SEQ ID NO: 4034499 - RNA, 20 nt, Staphylococcus aureus subsp. aureus MW2
auauaaccauaguaacaaaa

SEQ ID NO: 4034500 - RNA, 17 nt, Staphylococcus aureus subsp. aureus MW2
auauaaccgugaugaug

SEQ ID NO: 4034501 - RNA, 22 nt, Staphylococcus aureus subsp. aureus MW2
auauaaccgugaugaugugcaa

SEQ ID NO: 4034502 - RNA, 16 nt, Staphylococcus aureus subsp. aureus MW2
auauaaccuauuucau

SEQ ID NO: 4034503 - RNA, 21 nt, Staphylococcus aureus subsp. aureus MW2
auauaacuauggucaucaauu

SEQ ID NO: 4034504 - RNA, 20 nt, Staphylococcus aureus subsp. aureus MW2
auauaagaauuguugaucau

SEQ ID NO: 4034505 - RNA, 19 nt, Staphylococcus aureus subsp. aureus MW2
auauaagauucauauuuau

SEQ ID NO: 4034506 - RNA, 13 nt, Staphylococcus aureus subsp. aureus MW2
auauaagcaaaga

SEQ ID NO: 4034507 - RNA, 22 nt, Staphylococcus aureus subsp. aureus MW2
auauaagcaaagacaaaagcaa

SEQ ID NO: 4034508 - RNA, 19 nt, Staphylococcus aureus subsp. aureus MW2
auauaaggcgcucucuuuu

SEQ ID NO: 4034509 - RNA, 16 nt, Staphylococcus aureus subsp. aureus MW2
auauaaguauaaugau

SEQ ID NO: 4034510 - RNA, 13 nt, Staphylococcus aureus subsp. aureus MW2
auauaauagaaau

SEQ ID NO: 4034511 - RNA, 15 nt, Staphylococcus aureus subsp. aureus MW2
auauaaugauuuaau

SEQ ID NO: 4034512 - RNA, 22 nt, Staphylococcus aureus subsp. aureus MW2
auauaaugcugauaauuuuucu

SEQ ID NO: 4034513 - RNA, 19 nt, Staphylococcus aureus subsp. aureus MW2
auauaauggcacugcaauc

SEQ ID NO: 4034514 - RNA, 19 nt, Staphylococcus aureus subsp. aureus MW2
auauaaugguucuaaaaua

SEQ ID NO: 4034515 - RNA, 21 nt, Staphylococcus aureus subsp. aureus MW2
auauaaugguugaauaacacu

SEQ ID NO: 4034516 - RNA, 16 nt, Staphylococcus aureus subsp. aureus MW2
auauaauguauaaaac

SEQ ID NO: 4034517 - RNA, 22 nt, Staphylococcus aureus subsp. aureus MW2
auauaauguauaaaacagaauu

SEQ ID NO: 4034518 - RNA, 14 nt, Staphylococcus aureus subsp. aureus MW2
auauaauuaaacau

SEQ ID NO: 4034519 - RNA, 15 nt, Staphylococcus aureus subsp. aureus MW2
auauaauuaaacauu

SEQ ID NO: 4034520 - RNA, 17 nt, Staphylococcus aureus subsp. aureus MW2
auauaauuaauuuugua

SEQ ID NO: 4034521 - RNA, 15 nt, Staphylococcus aureus subsp. aureus MW2
auauaauuauuaaac

SEQ ID NO: 4034522 - RNA, 23 nt, Staphylococcus aureus subsp. aureus MW2
auauaauucgucuguuucauaua

SEQ ID NO: 4034523 - RNA, 19 nt, Staphylococcus aureus subsp. aureus MW2
auauaauucuuguuugauu

SEQ ID NO: 4034524 - RNA, 13 nt, Staphylococcus aureus subsp. aureus MW2
auauaauuuauuu

SEQ ID NO: 4034525 - RNA, 18 nt, Staphylococcus aureus subsp. aureus MW2
auauaauuuuaauauuau

SEQ ID NO: 4034526 - RNA, 16 nt, Staphylococcus aureus subsp. aureus MW2
auauacaaauaaacac

SEQ ID NO: 4034527 - RNA, 17 nt, Staphylococcus aureus subsp. aureus MW2
auauacaaauuuauauu

SEQ ID NO: 4034528 - RNA, 17 nt, Staphylococcus aureus subsp. aureus MW2
auauacauuuacauauu

SEQ ID NO: 4034529 - RNA, 13 nt, Staphylococcus aureus subsp. aureus MW2
auauaccaaccaa

SEQ ID NO: 4034530 - RNA, 14 nt, Staphylococcus aureus subsp. aureus MW2
auauaccaaccaaa

SEQ ID NO: 4034531 - RNA, 19 nt, Staphylococcus aureus subsp. aureus MW2
auauaccuugauucauuuc

SEQ ID NO: 4034532 - RNA, 16 nt, Staphylococcus aureus subsp. aureus MW2
auauacgaauccucau

SEQ ID NO: 4034533 - RNA, 15 nt, Staphylococcus aureus subsp. aureus MW2
auauacgacauuuuu

SEQ ID NO: 4034534 - RNA, 20 nt, Staphylococcus aureus subsp. aureus MW2
auauacgacauuuuuagaca

SEQ ID NO: 4034535 - RNA, 21 nt, Staphylococcus aureus subsp. aureus MW2
auauacgacauuuuuagacau

SEQ ID NO: 4034536 - RNA, 17 nt, Staphylococcus aureus subsp. aureus MW2
auauacgagacauuucu

SEQ ID NO: 4034537 - RNA, 20 nt, Staphylococcus aureus subsp. aureus MW2
auauacguugauuaacacau

SEQ ID NO: 4034538 - RNA, 21 nt, Staphylococcus aureus subsp. aureus MW2
auauacguugauuaacacauu

SEQ ID NO: 4034539 - RNA, 14 nt, Staphylococcus aureus subsp. aureus MW2
auauacuagcaauu

SEQ ID NO: 4034540 - RNA, 16 nt, Staphylococcus aureus subsp. aureus MW2
auauacuuaauuuaaa

SEQ ID NO: 4034541 - RNA, 12 nt, Staphylococcus aureus subsp. aureus MW2
auauacuugaag

SEQ ID NO: 4034542 - RNA, 18 nt, Staphylococcus aureus subsp. aureus MW2
auauacuugccuucaaau

SEQ ID NO: 4034543 - RNA, 17 nt, Staphylococcus aureus subsp. aureus MW2
auauacuuguucaacaa

SEQ ID NO: 4034544 - RNA, 23 nt, Staphylococcus aureus subsp. aureus MW2
auauagaaaaugaguacaacaua

SEQ ID NO: 4034545 - RNA, 14 nt, Staphylococcus aureus subsp. aureus MW2
auauagaaggggac

SEQ ID NO: 4034546 - RNA, 13 nt, Staphylococcus aureus subsp. aureus MW2
auauagagaaaag

SEQ ID NO: 4034547 - RNA, 14 nt, Staphylococcus aureus subsp. aureus MW2
auauagagaaaagg

SEQ ID NO: 4034548 - RNA, 13 nt, Staphylococcus aureus subsp. aureus MW2
auauagauuaaac

SEQ ID NO: 4034549 - RNA, 19 nt, Staphylococcus aureus subsp. aureus MW2
auauagcggugucaauauu

SEQ ID NO: 4034550 - RNA, 14 nt, Staphylococcus aureus subsp. aureus MW2
auauaguaaaauaa

SEQ ID NO: 4034551 - RNA, 23 nt, Staphylococcus aureus subsp. aureus MW2
auauaguaacagacuuuguuaaa

SEQ ID NO: 4034552 - RNA, 22 nt, Staphylococcus aureus subsp. aureus MW2
auauaguacuuacgaauagaaa

SEQ ID NO: 4034553 - RNA, 21 nt, Staphylococcus aureus subsp. aureus MW2
auauaguaggguauugaaaua

SEQ ID NO: 4034554 - RNA, 17 nt, Staphylococcus aureus subsp. aureus MW2
auauagucuaugaauaa

SEQ ID NO: 4034555 - RNA, 14 nt, Staphylococcus aureus subsp. aureus MW2
auauagugauugaa

SEQ ID NO: 4034556 - RNA, 14 nt, Staphylococcus aureus subsp. aureus MW2
auauaguuauaugu

SEQ ID NO: 4034557 - RNA, 11 nt, Staphylococcus aureus subsp. aureus MW2
auauauaaaag

SEQ ID NO: 4034558 - RNA, 19 nt, Staphylococcus aureus subsp. aureus MW2
auauauaaaaucauuaaua

SEQ ID NO: 4034559 - RNA, 16 nt, Staphylococcus aureus subsp. aureus MW2
auauauaacaaguaca

SEQ ID NO: 4034560 - RNA, 13 nt, Staphylococcus aureus subsp. aureus MW2
auauauaaccaua

SEQ ID NO: 4034561 - RNA, 15 nt, Staphylococcus aureus subsp. aureus MW2
auauauaaugaaggu

SEQ ID NO: 4034562 - RNA, 18 nt, Staphylococcus aureus subsp. aureus MW2
auauauacaaauaaacac

SEQ ID NO: 4034563 - RNA, 12 nt, Staphylococcus aureus subsp. aureus MW2
auauauauuuaa

SEQ ID NO: 4034564 - RNA, 13 nt, Staphylococcus aureus subsp. aureus MW2
auauauauuuaaa

SEQ ID NO: 4034565 - RNA, 14 nt, Staphylococcus aureus subsp. aureus MW2
auauauauuuaaau

SEQ ID NO: 4034566 - RNA, 13 nt, Staphylococcus aureus subsp. aureus MW2
auauaucacaaca

SEQ ID NO: 4034567 - RNA, 12 nt, Staphylococcus aureus subsp. aureus MW2
auauguaaauga

SEQ ID NO: 4034568 - RNA, 15 nt, Staphylococcus aureus subsp. aureus MW2
auauguaaaugaaau

SEQ ID NO: 4034569 - RNA, 16 nt, Staphylococcus aureus subsp. aureus MW2
auauguaaaugaaaua

SEQ ID NO: 4034570 - RNA, 14 nt, Staphylococcus aureus subsp. aureus MW2
auauguauaacaau

SEQ ID NO: 4034571 - RNA, 22 nt, Staphylococcus aureus subsp. aureus MW2
auaugucucucuuucuuauuca

SEQ ID NO: 4034572 - RNA, 12 nt, Staphylococcus aureus subsp. aureus MW2
auaugugagcaa

SEQ ID NO: 4034573 - RNA, 22 nt, Staphylococcus aureus subsp. aureus MW2
auaugugcuuuuguaaauuaca

SEQ ID NO: 4034574 - RNA, 20 nt, Staphylococcus aureus subsp. aureus MW2
auauguggcacucauaaccg

SEQ ID NO: 4034575 - RNA, 20 nt, Staphylococcus aureus subsp. aureus MW2
auauguggcgcucuuauaaa

SEQ ID NO: 4034576 - RNA, 19 nt, Staphylococcus aureus subsp. aureus MW2
auaugugguggcuauauaa

SEQ ID NO: 4034577 - RNA, 19 nt, Staphylococcus aureus subsp. aureus MW2
auauguguaugauagaaua

SEQ ID NO: 4034578 - RNA, 15 nt, Staphylococcus aureus subsp. aureus MW2
auauguguguugcuu

SEQ ID NO: 4034579 - RNA, 21 nt, Staphylococcus aureus subsp. aureus MW2
auauguguguugcuuugauuu

SEQ ID NO: 4034580 - RNA, 16 nt, Staphylococcus aureus subsp. aureus MW2
auauguguuaacugau

SEQ ID NO: 4034581 - RNA, 17 nt, Staphylococcus aureus subsp. aureus MW2
auauguguuucuagcuu

SEQ ID NO: 4034582 - RNA, 23 nt, Staphylococcus aureus subsp. aureus MW2
auauguugcuuaucaacagcuuc

SEQ ID NO: 4034583 - RNA, 15 nt, Staphylococcus aureus subsp. aureus MW2
auauguuuaauguau

SEQ ID NO: 4034584 - RNA, 19 nt, Staphylococcus aureus subsp. aureus MW2
auauguuuggauaucuuug

SEQ ID NO: 4034585 - RNA, 22 nt, Staphylococcus aureus subsp. aureus MW2
auauguuuuauaauaaauguca

SEQ ID NO: 4034586 - RNA, 21 nt, Staphylococcus aureus subsp. aureus MW2
auauuaaaauuaaaacuuuca

SEQ ID NO: 4034587 - RNA, 23 nt, Staphylococcus aureus subsp. aureus MW2
auauuaaacacgcgguaaaacga

SEQ ID NO: 4034588 - RNA, 13 nt, Staphylococcus aureus subsp. aureus MW2
auauuaaauaaag

SEQ ID NO: 4034589 - RNA, 12 nt, Staphylococcus aureus subsp. aureus MW2
auauuaaauuca

SEQ ID NO: 4034590 - RNA, 13 nt, Staphylococcus aureus subsp. aureus MW2
auauuaaauuucu

SEQ ID NO: 4034591 - RNA, 14 nt, Staphylococcus aureus subsp. aureus MW2
auauuaacaccaga

SEQ ID NO: 4034592 - RNA, 15 nt, Staphylococcus aureus subsp. aureus MW2
auauuaacaccagau

SEQ ID NO: 4034593 - RNA, 13 nt, Staphylococcus aureus subsp. aureus MW2
auauuaacuguac

SEQ ID NO: 4034594 - RNA, 17 nt, Staphylococcus aureus subsp. aureus MW2
auauuaauauaaaauaa

SEQ ID NO: 4034595 - RNA, 15 nt, Staphylococcus aureus subsp. aureus MW2
auauuaauauauuua

SEQ ID NO: 4034596 - RNA, 19 nt, Staphylococcus aureus subsp. aureus MW2
auauuaauauguuaauuua

SEQ ID NO: 4034597 - RNA, 12 nt, Staphylococcus aureus subsp. aureus MW2
auauuaauauuu

SEQ ID NO: 4034598 - RNA, 17 nt, Staphylococcus aureus subsp. aureus MW2
auauuaauauuugauua

SEQ ID NO: 4034599 - RNA, 13 nt, Staphylococcus aureus subsp. aureus MW2
auauuaaucaauu

SEQ ID NO: 4034600 - RNA, 15 nt, Staphylococcus aureus subsp. aureus MW2
auauuaaucaauuua

SEQ ID NO: 4034601 - RNA, 16 nt, Staphylococcus aureus subsp. aureus MW2
auauuaauccacaaau

SEQ ID NO: 4034602 - RNA, 15 nt, Staphylococcus aureus subsp. aureus MW2
auauuaauuuauaau

SEQ ID NO: 4034603 - RNA, 13 nt, Staphylococcus aureus subsp. aureus MW2
auauuacauauaa

SEQ ID NO: 4034604 - RNA, 19 nt, Staphylococcus aureus subsp. aureus MW2
auauuacuucucaucgaau

SEQ ID NO: 4034605 - RNA, 19 nt, Staphylococcus aureus subsp. aureus MW2
auauuacuuuggaaauuua

SEQ ID NO: 4034606 - RNA, 19 nt, Staphylococcus aureus subsp. aureus MW2
auauuagauaucuuaaucu

SEQ ID NO: 4034607 - RNA, 18 nt, Staphylococcus aureus subsp. aureus MW2
auauuaggccaacguuuu

SEQ ID NO: 4034608 - RNA, 15 nt, Staphylococcus aureus subsp. aureus MW2
auauuauaaaaagau

SEQ ID NO: 4034609 - RNA, 15 nt, Staphylococcus aureus subsp. aureus MW2
auauuauauauauuc

SEQ ID NO: 4034610 - RNA, 16 nt, Staphylococcus aureus subsp. aureus MW2
auauuauauuuugaau

SEQ ID NO: 4034611 - RNA, 23 nt, Staphylococcus aureus subsp. aureus MW2
auauuauauuuugaaucaguaua

SEQ ID NO: 4034612 - RNA, 16 nt, Staphylococcus aureus subsp. aureus MW2
auauuaugaacaugaa

SEQ ID NO: 4034613 - RNA, 21 nt, Staphylococcus aureus subsp. aureus MW2
auauuaugaacaugaaauuaa

SEQ ID NO: 4034614 - RNA, 18 nt, Staphylococcus aureus subsp. aureus MW2
auauuaugccauucauua

SEQ ID NO: 4034615 - RNA, 17 nt, Staphylococcus aureus subsp. aureus MW2
auauuauucauaauaua

SEQ ID NO: 4034616 - RNA, 13 nt, Staphylococcus aureus subsp. aureus MW2
auauuauuucaau

SEQ ID NO: 4034617 - RNA, 12 nt, Staphylococcus aureus subsp. aureus MW2
auauuauuuuua

SEQ ID NO: 4034618 - RNA, 14 nt, Staphylococcus aureus subsp. aureus MW2
auauuauuuuuaag

SEQ ID NO: 4034619 - RNA, 14 nt, Staphylococcus aureus subsp. aureus MW2
auauucaaaauaac

SEQ ID NO: 4034620 - RNA, 14 nt, Staphylococcus aureus subsp. aureus MW2
auauucaaauuuac

SEQ ID NO: 4034621 - RNA, 16 nt, Staphylococcus aureus subsp. aureus MW2
auauucaaauuuacca

SEQ ID NO: 4034622 - RNA, 19 nt, Staphylococcus aureus subsp. aureus MW2
auauucaacuuauuauuua

SEQ ID NO: 4034623 - RNA, 12 nt, Staphylococcus aureus subsp. aureus MW2
auauucaaugaa

SEQ ID NO: 4034624 - RNA, 14 nt, Staphylococcus aureus subsp. aureus MW2
auauucaaugaauu

SEQ ID NO: 4034625 - RNA, 20 nt, Staphylococcus aureus subsp. aureus MW2
auauucaccuacaacaccaa

SEQ ID NO: 4034626 - RNA, 16 nt, Staphylococcus aureus subsp. aureus MW2
auauucaguauaugua

SEQ ID NO: 4034627 - RNA, 15 nt, Staphylococcus aureus subsp. aureus MW2
auauucaucauauau

SEQ ID NO: 4034628 - RNA, 16 nt, Staphylococcus aureus subsp. aureus MW2
auauucauucuagcau

SEQ ID NO: 4034629 - RNA, 22 nt, Staphylococcus aureus subsp. aureus MW2
auauuccuuacuaaguaaccaa

SEQ ID NO: 4034630 - RNA, 20 nt, Staphylococcus aureus subsp. aureus MW2
auauucgauacauaaaacau

SEQ ID NO: 4034631 - RNA, 23 nt, Staphylococcus aureus subsp. aureus MW2
auauucgcgaacguuauuuucaa

SEQ ID NO: 4034632 - RNA, 15 nt, Staphylococcus aureus subsp. aureus MW2
auauucgcuuaaaaa

SEQ ID NO: 4034633 - RNA, 16 nt, Staphylococcus aureus subsp. aureus MW2
auauucgcuuaaaaac

SEQ ID NO: 4034634 - RNA, 19 nt, Staphylococcus aureus subsp. aureus MW2
auauucggauccaaucuaa

SEQ ID NO: 4034635 - RNA, 13 nt, Staphylococcus aureus subsp. aureus MW2
auauucguuacaa

SEQ ID NO: 4034636 - RNA, 14 nt, Staphylococcus aureus subsp. aureus MW2
auauucuaaaaaau

SEQ ID NO: 4034637 - RNA, 18 nt, Staphylococcus aureus subsp. aureus MW2
auauucuaauugcacauu

SEQ ID NO: 4034638 - RNA, 18 nt, Staphylococcus aureus subsp. aureus MW2
auauucuacaugaaucaa

SEQ ID NO: 4034639 - RNA, 15 nt, Staphylococcus aureus subsp. aureus MW2
auauucucugcuucu

SEQ ID NO: 4034640 - RNA, 17 nt, Staphylococcus aureus subsp. aureus MW2
auauucugcaccuguuu

SEQ ID NO: 4034641 - RNA, 20 nt, Staphylococcus aureus subsp. aureus MW2
auauucugcaccuguuuuaa

SEQ ID NO: 4034642 - RNA, 17 nt, Staphylococcus aureus subsp. aureus MW2
auauugaaaacacguau

SEQ ID NO: 4034643 - RNA, 22 nt, Staphylococcus aureus subsp. aureus MW2
auauugaaaugagcuuaaguua

SEQ ID NO: 4034644 - RNA, 19 nt, Staphylococcus aureus subsp. aureus MW2
auauugaauaaaaaaacac

SEQ ID NO: 4034645 - RNA, 16 nt, Staphylococcus aureus subsp. aureus MW2
auauugaauugaaaaa

SEQ ID NO: 4034646 - RNA, 23 nt, Staphylococcus aureus subsp. aureus MW2
auauugagaauauuaagauguau

SEQ ID NO: 4034647 - RNA, 19 nt, Staphylococcus aureus subsp. aureus MW2
auauugagacuauuauaau

SEQ ID NO: 4034648 - RNA, 16 nt, Staphylococcus aureus subsp. aureus MW2
auauugcaaaaauaau

SEQ ID NO: 4034649 - RNA, 14 nt, Staphylococcus aureus subsp. aureus MW2
auauugcguuuaau

SEQ ID NO: 4034650 - RNA, 21 nt, Staphylococcus aureus subsp. aureus MW2
auauuggcaguucugaaacau

SEQ ID NO: 4034651 - RNA, 23 nt, Staphylococcus aureus subsp. aureus MW2
auauuggcaguucugaaacauuu

SEQ ID NO: 4034652 - RNA, 21 nt, Staphylococcus aureus subsp. aureus MW2
auauugguaucuccaauauuu

SEQ ID NO: 4034653 - RNA, 15 nt, Staphylococcus aureus subsp. aureus MW2
auauuguaaucacua

SEQ ID NO: 4034654 - RNA, 19 nt, Staphylococcus aureus subsp. aureus MW2
auauuguagggaguauugu

SEQ ID NO: 4034655 - RNA, 16 nt, Staphylococcus aureus subsp. aureus MW2
auauuuaaaaaacaaa

SEQ ID NO: 4034656 - RNA, 16 nt, Staphylococcus aureus subsp. aureus MW2
aucaauauaauuuggu

SEQ ID NO: 4034657 - RNA, 19 nt, Staphylococcus aureus subsp. aureus MW2
aucaauaucacuaucagcu

SEQ ID NO: 4034658 - RNA, 19 nt, Staphylococcus aureus subsp. aureus MW2
aucaauaugaccuuuaugu

SEQ ID NO: 4034659 - RNA, 12 nt, Staphylococcus aureus subsp. aureus MW2
aucaauccauca

SEQ ID NO: 4034660 - RNA, 17 nt, Staphylococcus aureus subsp. aureus MW2
aucaaucgcuuuagcaa

SEQ ID NO: 4034661 - RNA, 22 nt, Staphylococcus aureus subsp. aureus MW2
aucaaucgcuuuagcaauugaa

SEQ ID NO: 4034662 - RNA, 23 nt, Staphylococcus aureus subsp. aureus MW2
aucaaucgcuuuagcaauugaau

SEQ ID NO: 4034663 - RNA, 13 nt, Staphylococcus aureus subsp. aureus MW2
aucaauuagccaa

SEQ ID NO: 4034664 - RNA, 16 nt, Staphylococcus aureus subsp. aureus MW2
aucaauuuauuauuaa

SEQ ID NO: 4034665 - RNA, 22 nt, Staphylococcus aureus subsp. aureus MW2
aucaauuuauuauuaacuguac

SEQ ID NO: 4034666 - RNA, 22 nt, Staphylococcus aureus subsp. aureus MW2
aucaauuucgacuccauuagcu

SEQ ID NO: 4034667 - RNA, 18 nt, Staphylococcus aureus subsp. aureus MW2
aucaauuucuauuucacu

SEQ ID NO: 4034668 - RNA, 17 nt, Staphylococcus aureus subsp. aureus MW2
aucaauuucuguaauaa

SEQ ID NO: 4034669 - RNA, 19 nt, Staphylococcus aureus subsp. aureus MW2
aucaauuucuguaauaaua

SEQ ID NO: 4034670 - RNA, 15 nt, Staphylococcus aureus subsp. aureus MW2
aucacaacacauaaa

SEQ ID NO: 4034671 - RNA, 23 nt, Staphylococcus aureus subsp. aureus MW2
aucacaauacgaaaccaaaaaua

SEQ ID NO: 4034672 - RNA, 18 nt, Staphylococcus aureus subsp. aureus MW2
aucacaauauaacaucaa

SEQ ID NO: 4034673 - RNA, 20 nt, Staphylococcus aureus subsp. aureus MW2
aucacacgcauacaggaaau

SEQ ID NO: 4034674 - RNA, 17 nt, Staphylococcus aureus subsp. aureus MW2
aucacagcaauaauaau

SEQ ID NO: 4034675 - RNA, 18 nt, Staphylococcus aureus subsp. aureus MW2
aucacaguuauauauuac

SEQ ID NO: 4034676 - RNA, 13 nt, Staphylococcus aureus subsp. aureus MW2
aucacaucauacc

SEQ ID NO: 4034677 - RNA, 15 nt, Staphylococcus aureus subsp. aureus MW2
aucaccauaaaaaua

SEQ ID NO: 4034678 - RNA, 15 nt, Staphylococcus aureus subsp. aureus MW2
aucacgaucuuuaaa

SEQ ID NO: 4034679 - RNA, 15 nt, Staphylococcus aureus subsp. aureus MW2
aucacgauuucagca

SEQ ID NO: 4034680 - RNA, 23 nt, Staphylococcus aureus subsp. aureus MW2
aucacgauuuucaaguaaugaua

SEQ ID NO: 4034681 - RNA, 15 nt, Staphylococcus aureus subsp. aureus MW2
aucacgccauaaucu

SEQ ID NO: 4034682 - RNA, 22 nt, Staphylococcus aureus subsp. aureus MW2
aucacgccauaaucuucauuaa

SEQ ID NO: 4034683 - RNA, 19 nt, Staphylococcus aureus subsp. aureus MW2
aucacgugguuucuuuaau

SEQ ID NO: 4034684 - RNA, 20 nt, Staphylococcus aureus subsp. aureus MW2
aucacgugguuucuuuaauu

SEQ ID NO: 4034685 - RNA, 15 nt, Staphylococcus aureus subsp. aureus MW2
aucacguuuuucuuu

SEQ ID NO: 4034686 - RNA, 19 nt, Staphylococcus aureus subsp. aureus MW2
aucacguuuuucuuuaaac

SEQ ID NO: 4034687 - RNA, 13 nt, Staphylococcus aureus subsp. aureus MW2
aucacuauauuuc

SEQ ID NO: 4034688 - RNA, 16 nt, Staphylococcus aureus subsp. aureus MW2
aucacuauauuucaca

SEQ ID NO: 4034689 - RNA, 19 nt, Staphylococcus aureus subsp. aureus MW2
aucacuauauuucacacag

SEQ ID NO: 4034690 - RNA, 13 nt, Staphylococcus aureus subsp. aureus MW2
aucacuauuuuag

SEQ ID NO: 4034691 - RNA, 16 nt, Staphylococcus aureus subsp. aureus MW2
aucacucaacauauua

SEQ ID NO: 4034692 - RNA, 20 nt, Staphylococcus aureus subsp. aureus MW2
aucacucggcagauguucag

SEQ ID NO: 4034693 - RNA, 21 nt, Staphylococcus aureus subsp. aureus MW2
aucacugaaugcuaauacuaa

SEQ ID NO: 4034694 - RNA, 23 nt, Staphylococcus aureus subsp. aureus MW2
aucacugaaugcuaauacuaauc

SEQ ID NO: 4034695 - RNA, 17 nt, Staphylococcus aureus subsp. aureus MW2
aucacuucugaaaauaa

SEQ ID NO: 4034696 - RNA, 18 nt, Staphylococcus aureus subsp. aureus MW2
aucacuucugaaaauaac

SEQ ID NO: 4034697 - RNA, 21 nt, Staphylococcus aureus subsp. aureus MW2
aucacuugcuguugcaauaaa

SEQ ID NO: 4034698 - RNA, 17 nt, Staphylococcus aureus subsp. aureus MW2
aucacuugguaaaacau

SEQ ID NO: 4034699 - RNA, 21 nt, Staphylococcus aureus subsp. aureus MW2
aucacuuuaggguucauugcu

SEQ ID NO: 4034700 - RNA, 16 nt, Staphylococcus aureus subsp. aureus MW2
aucagacuaaaaugaa

SEQ ID NO: 4034701 - RNA, 19 nt, Staphylococcus aureus subsp. aureus MW2
aucagcaccgccugaaaua

SEQ ID NO: 4034702 - RNA, 22 nt, Staphylococcus aureus subsp. aureus MW2
aucagcauuaaucguauuuuua

SEQ ID NO: 4034703 - RNA, 23 nt, Staphylococcus aureus subsp. aureus MW2
aucagcauuuaaguuaucuaaac

SEQ ID NO: 4034704 - RNA, 15 nt, Staphylococcus aureus subsp. aureus MW2
aucagcuaaauauuu

SEQ ID NO: 4034705 - RNA, 17 nt, Staphylococcus aureus subsp. aureus MW2
aucagcuauaaaaguac

SEQ ID NO: 4034706 - RNA, 13 nt, Staphylococcus aureus subsp. aureus MW2
aucagcuuuucuu

SEQ ID NO: 4034707 - RNA, 14 nt, Staphylococcus aureus subsp. aureus MW2
aucagcuuuucuuc

SEQ ID NO: 4034708 - RNA, 23 nt, Staphylococcus aureus subsp. aureus MW2
aucaggcuuuauuguugugcuuu

SEQ ID NO: 4034709 - RNA, 21 nt, Staphylococcus aureus subsp. aureus MW2
aucaguaacauguaaugaauc

SEQ ID NO: 4034710 - RNA, 16 nt, Staphylococcus aureus subsp. aureus MW2
aucaguauaaucagca

SEQ ID NO: 4034711 - RNA, 20 nt, Staphylococcus aureus subsp. aureus MW2
aucaguauaaucagcaaugu

SEQ ID NO: 4034712 - RNA, 18 nt, Staphylococcus aureus subsp. aureus MW2
aucagucauucacauaca

SEQ ID NO: 4034713 - RNA, 23 nt, Staphylococcus aureus subsp. aureus MW2
aucagucucuaaaacuuuuucaa

SEQ ID NO: 4034714 - RNA, 23 nt, Staphylococcus aureus subsp. aureus MW2
aucaguuaggaugaaaaagugga

SEQ ID NO: 4034715 - RNA, 12 nt, Staphylococcus aureus subsp. aureus MW2
aucaguuauuuu

SEQ ID NO: 4034716 - RNA, 16 nt, Staphylococcus aureus subsp. aureus MW2
aucaguuauuuuaaua

SEQ ID NO: 4034717 - RNA, 16 nt, Staphylococcus aureus subsp. aureus MW2
aucaguugagucaauu

SEQ ID NO: 4034718 - RNA, 16 nt, Staphylococcus aureus subsp. aureus MW2
aucaguuguguaauaa

SEQ ID NO: 4034719 - RNA, 12 nt, Staphylococcus aureus subsp. aureus MW2
aucauaaauaua

SEQ ID NO: 4034720 - RNA, 17 nt, Staphylococcus aureus subsp. aureus MW2
aucauaaauauuuucug

SEQ ID NO: 4034721 - RNA, 24 nt, Staphylococcus aureus subsp. aureus MW2
aucauaaauauuuucugcgauaua

SEQ ID NO: 4034722 - RNA, 18 nt, Staphylococcus aureus subsp. aureus MW2
aucauaacuuaacucuau

SEQ ID NO: 4034723 - RNA, 17 nt, Staphylococcus aureus subsp. aureus MW2
aucauaaucauaaaaau

SEQ ID NO: 4034724 - RNA, 13 nt, Staphylococcus aureus subsp. aureus MW2
aucauaauuaaau

SEQ ID NO: 4034725 - RNA, 15 nt, Staphylococcus aureus subsp. aureus MW2
aucauacauauuuau

SEQ ID NO: 4034726 - RNA, 18 nt, Staphylococcus aureus subsp. aureus MW2
aucauacauauuuauauu

SEQ ID NO: 4034727 - RNA, 13 nt, Staphylococcus aureus subsp. aureus MW2
aucauacgagaaa

SEQ ID NO: 4034728 - RNA, 16 nt, Staphylococcus aureus subsp. aureus MW2
aucauacgagaaauua

SEQ ID NO: 4034729 - RNA, 15 nt, Staphylococcus aureus subsp. aureus MW2
aucauacuucaauaa

SEQ ID NO: 4034730 - RNA, 16 nt, Staphylococcus aureus subsp. aureus MW2
aucauagcauuaagau

SEQ ID NO: 4034731 - RNA, 23 nt, Staphylococcus aureus subsp. aureus MW2
aucauauaaugguugaauaacac

SEQ ID NO: 4034732 - RNA, 16 nt, Staphylococcus aureus subsp. aureus MW2
aucauauauucauuga

SEQ ID NO: 4034733 - RNA, 12 nt, Staphylococcus aureus subsp. aureus MW2
aucauaucauac

SEQ ID NO: 4034734 - RNA, 16 nt, Staphylococcus aureus subsp. aureus MW2
aucaucaaaauuuaau

SEQ ID NO: 4034735 - RNA, 21 nt, Staphylococcus aureus subsp. aureus MW2
aucaucaccauacuaaaacau

SEQ ID NO: 4034736 - RNA, 17 nt, Staphylococcus aureus subsp. aureus MW2
aucaucauguuuauuag

SEQ ID NO: 4034737 - RNA, 16 nt, Staphylococcus aureus subsp. aureus MW2
aucaucgcaaaaacau

SEQ ID NO: 4034738 - RNA, 18 nt, Staphylococcus aureus subsp. aureus MW2
aucaucgcaaaaacauaa

SEQ ID NO: 4034739 - RNA, 20 nt, Staphylococcus aureus subsp. aureus MW2
aucaucgcaaaaacauaauc

SEQ ID NO: 4034740 - RNA, 14 nt, Staphylococcus aureus subsp. aureus MW2
aucaucgccagcau

SEQ ID NO: 4034741 - RNA, 17 nt, Staphylococcus aureus subsp. aureus MW2
aucaucgccagcauuac

SEQ ID NO: 4034742 - RNA, 19 nt, Staphylococcus aureus subsp. aureus MW2
aucaucguauuucauauau

SEQ ID NO: 4034743 - RNA, 21 nt, Staphylococcus aureus subsp. aureus MW2
aucaucuaaaugguuaucuaa

SEQ ID NO: 4034744 - RNA, 17 nt, Staphylococcus aureus subsp. aureus MW2
auccucauuaauaaauu

SEQ ID NO: 4034745 - RNA, 18 nt, Staphylococcus aureus subsp. aureus MW2
auccucauuaugagaucc

SEQ ID NO: 4034746 - RNA, 24 nt, Staphylococcus aureus subsp. aureus MW2
auccugauuuaauguuaaacaaua

SEQ ID NO: 4034747 - RNA, 16 nt, Staphylococcus aureus subsp. aureus MW2
auccugccaauauauu

SEQ ID NO: 4034748 - RNA, 17 nt, Staphylococcus aureus subsp. aureus MW2
auccugccaauauauuc

SEQ ID NO: 4034749 - RNA, 22 nt, Staphylococcus aureus subsp. aureus MW2
auccuguguaaaauaaaucaua

SEQ ID NO: 4034750 - RNA, 15 nt, Staphylococcus aureus subsp. aureus MW2
auccuuaacuuuauc

SEQ ID NO: 4034751 - RNA, 20 nt, Staphylococcus aureus subsp. aureus MW2
auccuuaccuuuuaaaccug

SEQ ID NO: 4034752 - RNA, 16 nt, Staphylococcus aureus subsp. aureus MW2
auccuuugcucaccuu

SEQ ID NO: 4034753 - RNA, 13 nt, Staphylococcus aureus subsp. aureus MW2
auccuuuggacuc

SEQ ID NO: 4034754 - RNA, 19 nt, Staphylococcus aureus subsp. aureus MW2
auccuuuuugacucaaaau

SEQ ID NO: 4034755 - RNA, 22 nt, Staphylococcus aureus subsp. aureus MW2
auccuuuuugacucaaaaucuu

SEQ ID NO: 4034756 - RNA, 15 nt, Staphylococcus aureus subsp. aureus MW2
aucgaaaauuucagg

SEQ ID NO: 4034757 - RNA, 20 nt, Staphylococcus aureus subsp. aureus MW2
aucgaaagguaacugcuuug

SEQ ID NO: 4034758 - RNA, 18 nt, Staphylococcus aureus subsp. aureus MW2
aucgaacaaaugaaaaag

SEQ ID NO: 4034759 - RNA, 14 nt, Staphylococcus aureus subsp. aureus MW2
aucgaauucauuug

SEQ ID NO: 4034760 - RNA, 23 nt, Staphylococcus aureus subsp. aureus MW2
aucgacuaauuuuucuuucaggc

SEQ ID NO: 4034761 - RNA, 14 nt, Staphylococcus aureus subsp. aureus MW2
aucgacuuuucuau

SEQ ID NO: 4034762 - RNA, 13 nt, Staphylococcus aureus subsp. aureus MW2
aucgauaaaaugu

SEQ ID NO: 4034763 - RNA, 23 nt, Staphylococcus aureus subsp. aureus MW2
aucgaucgguauuuucauuuuag

SEQ ID NO: 4034764 - RNA, 18 nt, Staphylococcus aureus subsp. aureus MW2
aucgauuaguuuuugguu

SEQ ID NO: 4034765 - RNA, 17 nt, Staphylococcus aureus subsp. aureus MW2
aucgcaccgucaaacuu

SEQ ID NO: 4034766 - RNA, 17 nt, Staphylococcus aureus subsp. aureus MW2
aucgcauguuuguaaau

SEQ ID NO: 4034767 - RNA, 16 nt, Staphylococcus aureus subsp. aureus MW2
aucgcauuuaaauaua

SEQ ID NO: 4034768 - RNA, 15 nt, Staphylococcus aureus subsp. aureus MW2
aucgccaaucuauug

SEQ ID NO: 4034769 - RNA, 24 nt, Staphylococcus aureus subsp. aureus MW2
aucgccaugacguauacaaauuga

SEQ ID NO: 4034770 - RNA, 14 nt, Staphylococcus aureus subsp. aureus MW2
aucgccuaaaaaua

SEQ ID NO: 4034771 - RNA, 15 nt, Staphylococcus aureus subsp. aureus MW2
aucgccuaaaaauaa

SEQ ID NO: 4034772 - RNA, 18 nt, Staphylococcus aureus subsp. aureus MW2
aucgccuaaaaauaaaau

SEQ ID NO: 4034773 - RNA, 24 nt, Staphylococcus aureus subsp. aureus MW2
aucgccucugcuagacaaucaucu

SEQ ID NO: 4034774 - RNA, 19 nt, Staphylococcus aureus subsp. aureus MW2
aucgccuuguuuauuuuua

SEQ ID NO: 4034775 - RNA, 14 nt, Staphylococcus aureus subsp. aureus MW2
aucgcgauuauuac

SEQ ID NO: 4034776 - RNA, 16 nt, Staphylococcus aureus subsp. aureus MW2
aucgcgcaucaaaaau

SEQ ID NO: 4034777 - RNA, 15 nt, Staphylococcus aureus subsp. aureus MW2
aucgcuaauacuuua

SEQ ID NO: 4034778 - RNA, 14 nt, Staphylococcus aureus subsp. aureus MW2
aucgcuugcuucuu

SEQ ID NO: 4034779 - RNA, 16 nt, Staphylococcus aureus subsp. aureus MW2
aucgcuugcuucuuuc

SEQ ID NO: 4034780 - RNA, 14 nt, Staphylococcus aureus subsp. aureus MW2
aucggacagcugaa

SEQ ID NO: 4034781 - RNA, 14 nt, Staphylococcus aureus subsp. aureus MW2
aucguaaaaaacaa

SEQ ID NO: 4034782 - RNA, 15 nt, Staphylococcus aureus subsp. aureus MW2
aucguaaaaaacaaa

SEQ ID NO: 4034783 - RNA, 19 nt, Staphylococcus aureus subsp. aureus MW2
aucguaaacacuauaaaag

SEQ ID NO: 4034784 - RNA, 21 nt, Staphylococcus aureus subsp. aureus MW2
aucguagcaccagcacaucaa

SEQ ID NO: 4034785 - RNA, 21 nt, Staphylococcus aureus subsp. aureus MW2
aucguauugaaaaugagcuga

SEQ ID NO: 4034786 - RNA, 22 nt, Staphylococcus aureus subsp. aureus MW2
aucguauugcucgccucaaaug

SEQ ID NO: 4034787 - RNA, 14 nt, Staphylococcus aureus subsp. aureus MW2
aucgucauauuaau

SEQ ID NO: 4034788 - RNA, 18 nt, Staphylococcus aureus subsp. aureus MW2
aucgucauauuaauauuu

SEQ ID NO: 4034789 - RNA, 22 nt, Staphylococcus aureus subsp. aureus MW2
aucgucauauuaauauuuuuug

SEQ ID NO: 4034790 - RNA, 13 nt, Staphylococcus aureus subsp. aureus MW2
aucgucaucacuu

SEQ ID NO: 4034791 - RNA, 18 nt, Staphylococcus aureus subsp. aureus MW2
aucgucaucacuuuuuaa

SEQ ID NO: 4034792 - RNA, 16 nt, Staphylococcus aureus subsp. aureus MW2
aucgucuccaacuuua

SEQ ID NO: 4034793 - RNA, 20 nt, Staphylococcus aureus subsp. aureus MW2
aucgucuccaacuuuaaaug

SEQ ID NO: 4034794 - RNA, 16 nt, Staphylococcus aureus subsp. aureus MW2
aucgugcccauaugau

SEQ ID NO: 4034795 - RNA, 20 nt, Staphylococcus aureus subsp. aureus MW2
aucguguauuauugaaacua

SEQ ID NO: 4034796 - RNA, 14 nt, Staphylococcus aureus subsp. aureus MW2
aucguuaaggaaag

SEQ ID NO: 4034797 - RNA, 17 nt, Staphylococcus aureus subsp. aureus MW2
aucguuaaggaaagcuu

SEQ ID NO: 4034798 - RNA, 21 nt, Staphylococcus aureus subsp. aureus MW2
aucguuaauaaaccuacaaua

SEQ ID NO: 4034799 - RNA, 22 nt, Staphylococcus aureus subsp. aureus MW2
aucguuaauaaaccuacaauau

SEQ ID NO: 4034800 - RNA, 20 nt, Staphylococcus aureus subsp. aureus MW2
aucguuaauuuccaauaucu

SEQ ID NO: 4034801 - RNA, 19 nt, Staphylococcus aureus subsp. aureus MW2
aucguuauaaguacaaaua

SEQ ID NO: 4034802 - RNA, 14 nt, Staphylococcus aureus subsp. aureus MW2
aucguucccauucu

SEQ ID NO: 4034803 - RNA, 19 nt, Staphylococcus aureus subsp. aureus MW2
aucguugcuuuuauuuuua

SEQ ID NO: 4034804 - RNA, 18 nt, Staphylococcus aureus subsp. aureus MW2
aucguuuacuacaucaua

SEQ ID NO: 4034805 - RNA, 22 nt, Staphylococcus aureus subsp. aureus MW2
aucuaaaaugaguuguucagau

SEQ ID NO: 4034806 - RNA, 13 nt, Staphylococcus aureus subsp. aureus MW2
aucuaaaauuggu

SEQ ID NO: 4034807 - RNA, 17 nt, Staphylococcus aureus subsp. aureus MW2
aucuaaagcuauaaaaa

SEQ ID NO: 4034808 - RNA, 17 nt, Staphylococcus aureus subsp. aureus MW2
aucuaaauaguuuuuca

SEQ ID NO: 4034809 - RNA, 21 nt, Staphylococcus aureus subsp. aureus MW2
aucuaaaugaucuuuguagcc

SEQ ID NO: 4034810 - RNA, 21 nt, Staphylococcus aureus subsp. aureus MW2
aucuaaaugcacuagcaacau

SEQ ID NO: 4034811 - RNA, 17 nt, Staphylococcus aureus subsp. aureus MW2
aucuaacaucauuaacu

SEQ ID NO: 4034812 - RNA, 16 nt, Staphylococcus aureus subsp. aureus MW2
aucuaacuggaaauga

SEQ ID NO: 4034813 - RNA, 13 nt, Staphylococcus aureus subsp. aureus MW2
aucuaauaaauau

SEQ ID NO: 4034814 - RNA, 23 nt, Staphylococcus aureus subsp. aureus MW2
aucuaaugcaacuugaucauuau

SEQ ID NO: 4034815 - RNA, 20 nt, Staphylococcus aureus subsp. aureus MW2
aucuaaugggucaaugacug

SEQ ID NO: 4034816 - RNA, 12 nt, Staphylococcus aureus subsp. aureus MW2
aucuaauuuuuc

SEQ ID NO: 4034817 - RNA, 13 nt, Staphylococcus aureus subsp. aureus MW2
aucuaauuuuucc

SEQ ID NO: 4034818 - RNA, 14 nt, Staphylococcus aureus subsp. aureus MW2
aucuaauuuuucca

SEQ ID NO: 4034819 - RNA, 14 nt, Staphylococcus aureus subsp. aureus MW2
aucuacaauauuaa

SEQ ID NO: 4034820 - RNA, 19 nt, Staphylococcus aureus subsp. aureus MW2
aucuacagagaaucaauua

SEQ ID NO: 4034821 - RNA, 22 nt, Staphylococcus aureus subsp. aureus MW2
aucuacagagaaucaauuauug

SEQ ID NO: 4034822 - RNA, 20 nt, Staphylococcus aureus subsp. aureus MW2
aucuacauaauuugaauuag

SEQ ID NO: 4034823 - RNA, 19 nt, Staphylococcus aureus subsp. aureus MW2
aucuacauaugaaaaaugu

SEQ ID NO: 4034824 - RNA, 19 nt, Staphylococcus aureus subsp. aureus MW2
aucuacaucaaauuuuucg

SEQ ID NO: 4034825 - RNA, 12 nt, Staphylococcus aureus subsp. aureus MW2
aucuacuaaauc

SEQ ID NO: 4034826 - RNA, 13 nt, Staphylococcus aureus subsp. aureus MW2
aucuacuuaaaau

SEQ ID NO: 4034827 - RNA, 14 nt, Staphylococcus aureus subsp. aureus MW2
aucuacuuaaaaua

SEQ ID NO: 4034828 - RNA, 15 nt, Staphylococcus aureus subsp. aureus MW2
aucuagaugaaauug

SEQ ID NO: 4034829 - RNA, 19 nt, Staphylococcus aureus subsp. aureus MW2
aucuagccugaaauagaaa

SEQ ID NO: 4034830 - RNA, 14 nt, Staphylococcus aureus subsp. aureus MW2
aucuauaaaaagaa

SEQ ID NO: 4034831 - RNA, 23 nt, Staphylococcus aureus subsp. aureus MW2
aucuauaaaaagaauaugauauu

SEQ ID NO: 4034832 - RNA, 16 nt, Staphylococcus aureus subsp. aureus MW2
aucuuuaaagucaaca

SEQ ID NO: 4034833 - RNA, 21 nt, Staphylococcus aureus subsp. aureus MW2
aucuuuaaauauacuucuauu

SEQ ID NO: 4034834 - RNA, 12 nt, Staphylococcus aureus subsp. aureus MW2
aucuuuaacucu

SEQ ID NO: 4034835 - RNA, 13 nt, Staphylococcus aureus subsp. aureus MW2
aucuuuaagcucu

SEQ ID NO: 4034836 - RNA, 15 nt, Staphylococcus aureus subsp. aureus MW2
aucuuuaauuucauu

SEQ ID NO: 4034837 - RNA, 22 nt, Staphylococcus aureus subsp. aureus MW2
aucuuuacgauaaacuaaaaag

SEQ ID NO: 4034838 - RNA, 21 nt, Staphylococcus aureus subsp. aureus MW2
aucuuuagagacuuauuuuau

SEQ ID NO: 4034839 - RNA, 20 nt, Staphylococcus aureus subsp. aureus MW2
aucuuuagcuauuuaaaauu

SEQ ID NO: 4034840 - RNA, 11 nt, Staphylococcus aureus subsp. aureus MW2
aucuuuauaaa

SEQ ID NO: 4034841 - RNA, 18 nt, Staphylococcus aureus subsp. aureus MW2
aucuuuauaaaauuguaa

SEQ ID NO: 4034842 - RNA, 12 nt, Staphylococcus aureus subsp. aureus MW2
aucuuuauacac

SEQ ID NO: 4034843 - RNA, 13 nt, Staphylococcus aureus subsp. aureus MW2
aucuuuauacaca

SEQ ID NO: 4034844 - RNA, 19 nt, Staphylococcus aureus subsp. aureus MW2
aucuuuauuugauucuuca

SEQ ID NO: 4034845 - RNA, 19 nt, Staphylococcus aureus subsp. aureus MW2
aucuuuauuuuuuaucauu

SEQ ID NO: 4034846 - RNA, 11 nt, Staphylococcus aureus subsp. aureus MW2
aucuuucaaag

SEQ ID NO: 4034847 - RNA, 15 nt, Staphylococcus aureus subsp. aureus MW2
aucuuucaaaugcuu

SEQ ID NO: 4034848 - RNA, 13 nt, Staphylococcus aureus subsp. aureus MW2
aucuuucacaauu

SEQ ID NO: 4034849 - RNA, 17 nt, Staphylococcus aureus subsp. aureus MW2
aucuuucacaauuguau

SEQ ID NO: 4034850 - RNA, 22 nt, Staphylococcus aureus subsp. aureus MW2
aucuuucacaauuguauaaugu

SEQ ID NO: 4034851 - RNA, 15 nt, Staphylococcus aureus subsp. aureus MW2
aucuuucuuuguguu

SEQ ID NO: 4034852 - RNA, 11 nt, Staphylococcus aureus subsp. aureus MW2
aucuuugauaa

SEQ ID NO: 4034853 - RNA, 19 nt, Staphylococcus aureus subsp. aureus MW2
aucuuuguaaauuuuuaag

SEQ ID NO: 4034854 - RNA, 20 nt, Staphylococcus aureus subsp. aureus MW2
aucuuuguaaccuaaaaaca

SEQ ID NO: 4034855 - RNA, 22 nt, Staphylococcus aureus subsp. aureus MW2
aucuuuguuuucaaacuuuuca

SEQ ID NO: 4034856 - RNA, 14 nt, Staphylococcus aureus subsp. aureus MW2
aucuuuuaaauuua

SEQ ID NO: 4034857 - RNA, 17 nt, Staphylococcus aureus subsp. aureus MW2
aucuuuuaauucuuaau

SEQ ID NO: 4034858 - RNA, 18 nt, Staphylococcus aureus subsp. aureus MW2
aucuuuuacuaaaugaau

SEQ ID NO: 4034859 - RNA, 12 nt, Staphylococcus aureus subsp. aureus MW2
aucuuuuagcuu

SEQ ID NO: 4034860 - RNA, 11 nt, Staphylococcus aureus subsp. aureus MW2
aucuuuuaugg

SEQ ID NO: 4034861 - RNA, 19 nt, Staphylococcus aureus subsp. aureus MW2
aucuuuugguuuaucuguu

SEQ ID NO: 4034862 - RNA, 17 nt, Staphylococcus aureus subsp. aureus MW2
aucuuuuucacuaauca

SEQ ID NO: 4034863 - RNA, 22 nt, Staphylococcus aureus subsp. aureus MW2
aucuuuuuuacuaaaaucacuu

SEQ ID NO: 4034864 - RNA, 20 nt, Staphylococcus aureus subsp. aureus MW2
augaaaaagaguuaauaaaa

SEQ ID NO: 4034865 - RNA, 23 nt, Staphylococcus aureus subsp. aureus MW2
augaaaaagauucggaaaauaug

SEQ ID NO: 4034866 - RNA, 13 nt, Staphylococcus aureus subsp. aureus MW2
augaaaaaguaaa

SEQ ID NO: 4034867 - RNA, 16 nt, Staphylococcus aureus subsp. aureus MW2
augaaaacagguggaa

SEQ ID NO: 4034868 - RNA, 18 nt, Staphylococcus aureus subsp. aureus MW2
augaaaacuuaaaaauga

SEQ ID NO: 4034869 - RNA, 16 nt, Staphylococcus aureus subsp. aureus MW2
augaaaagagauuuuu

SEQ ID NO: 4034870 - RNA, 17 nt, Staphylococcus aureus subsp. aureus MW2
augaaaagagauuuuuu

SEQ ID NO: 4034871 - RNA, 22 nt, Staphylococcus aureus subsp. aureus MW2
augaaaagguuagauggauugu

SEQ ID NO: 4034872 - RNA, 16 nt, Staphylococcus aureus subsp. aureus MW2
augaaagcaccuaaaa

SEQ ID NO: 4034873 - RNA, 17 nt, Staphylococcus aureus subsp. aureus MW2
augaaagcaccuaaaau

SEQ ID NO: 4034874 - RNA, 20 nt, Staphylococcus aureus subsp. aureus MW2
augaaagcaccuaaaauaga

SEQ ID NO: 4034875 - RNA, 21 nt, Staphylococcus aureus subsp. aureus MW2
augaaagucuuuaaccaaaau

SEQ ID NO: 4034876 - RNA, 22 nt, Staphylococcus aureus subsp. aureus MW2
augaaauaacaauagugacuuu

SEQ ID NO: 4034877 - RNA, 18 nt, Staphylococcus aureus subsp. aureus MW2
augaacaaaaauaaaaac

SEQ ID NO: 4034878 - RNA, 18 nt, Staphylococcus aureus subsp. aureus MW2
augaacaaaauaacaugu

SEQ ID NO: 4034879 - RNA, 13 nt, Staphylococcus aureus subsp. aureus MW2
augaaccaaaaaa

SEQ ID NO: 4034880 - RNA, 21 nt, Staphylococcus aureus subsp. aureus MW2
augaaccagcuaaccaaauaa

SEQ ID NO: 4034881 - RNA, 22 nt, Staphylococcus aureus subsp. aureus MW2
augaaccagcuaaccaaauaau

SEQ ID NO: 4034882 - RNA, 23 nt, Staphylococcus aureus subsp. aureus MW2
augaaccauuuaacucaccuuua

SEQ ID NO: 4034883 - RNA, 16 nt, Staphylococcus aureus subsp. aureus MW2
augaacgaaucuauaa

SEQ ID NO: 4034884 - RNA, 24 nt, Staphylococcus aureus subsp. aureus MW2
augaacucacaacagugcucuaug

SEQ ID NO: 4034885 - RNA, 14 nt, Staphylococcus aureus subsp. aureus MW2
augaagaauacaaa

SEQ ID NO: 4034886 - RNA, 19 nt, Staphylococcus aureus subsp. aureus MW2
augaagaggucuccaauac

SEQ ID NO: 4034887 - RNA, 21 nt, Staphylococcus aureus subsp. aureus MW2
augaagaggucuccaauacuu

SEQ ID NO: 4034888 - RNA, 14 nt, Staphylococcus aureus subsp. aureus MW2
augaagcauuuuau

SEQ ID NO: 4034889 - RNA, 19 nt, Staphylococcus aureus subsp. aureus MW2
augaaggcuuuuuguuuug

SEQ ID NO: 4034890 - RNA, 21 nt, Staphylococcus aureus subsp. aureus MW2
augaaggcuuuuuguuuugaa

SEQ ID NO: 4034891 - RNA, 21 nt, Staphylococcus aureus subsp. aureus MW2
augaauaauuacuaaaauauc

SEQ ID NO: 4034892 - RNA, 20 nt, Staphylococcus aureus subsp. aureus MW2
augaauaucacucggcagau

SEQ ID NO: 4034893 - RNA, 19 nt, Staphylococcus aureus subsp. aureus MW2
augaaucaaaucaauauca

SEQ ID NO: 4034894 - RNA, 22 nt, Staphylococcus aureus subsp. aureus MW2
augaaucagaugauuuaauucu

SEQ ID NO: 4034895 - RNA, 17 nt, Staphylococcus aureus subsp. aureus MW2
augaauccaaauauuaa

SEQ ID NO: 4034896 - RNA, 20 nt, Staphylococcus aureus subsp. aureus MW2
augaauccaaauauuaaaaa

SEQ ID NO: 4034897 - RNA, 19 nt, Staphylococcus aureus subsp. aureus MW2
augaaucccauaaugacua

SEQ ID NO: 4034898 - RNA, 20 nt, Staphylococcus aureus subsp. aureus MW2
augaaucgauauaaugaagu

SEQ ID NO: 4034899 - RNA, 17 nt, Staphylococcus aureus subsp. aureus MW2
augaaucgcauuuaaau

SEQ ID NO: 4034900 - RNA, 21 nt, Staphylococcus aureus subsp. aureus MW2
augaaucgcauuuaaauauaa

SEQ ID NO: 4034901 - RNA, 14 nt, Staphylococcus aureus subsp. aureus MW2
augaaugaaaucag

SEQ ID NO: 4034902 - RNA, 15 nt, Staphylococcus aureus subsp. aureus MW2
augaaugccuaauuu

SEQ ID NO: 4034903 - RNA, 19 nt, Staphylococcus aureus subsp. aureus MW2
augaaugccuaauuuugug

SEQ ID NO: 4034904 - RNA, 21 nt, Staphylococcus aureus subsp. aureus MW2
augaaugccuaauuuugugaa

SEQ ID NO: 4034905 - RNA, 19 nt, Staphylococcus aureus subsp. aureus MW2
augaauggagcaugauuac

SEQ ID NO: 4034906 - RNA, 16 nt, Staphylococcus aureus subsp. aureus MW2
augaauguuaagacau

SEQ ID NO: 4034907 - RNA, 18 nt, Staphylococcus aureus subsp. aureus MW2
augaauuauuuaaaaugc

SEQ ID NO: 4034908 - RNA, 19 nt, Staphylococcus aureus subsp. aureus MW2
augaauucauuuuaucuau

SEQ ID NO: 4034909 - RNA, 23 nt, Staphylococcus aureus subsp. aureus MW2
augaauucuauccuaagcauaaa

SEQ ID NO: 4034910 - RNA, 20 nt, Staphylococcus aureus subsp. aureus MW2
augaauuuacuccuuacaau

SEQ ID NO: 4034911 - RNA, 19 nt, Staphylococcus aureus subsp. aureus MW2
augaauuuagcaucaaaaa

SEQ ID NO: 4034912 - RNA, 19 nt, Staphylococcus aureus subsp. aureus MW2
augaauuucuaauuuagua

SEQ ID NO: 4034913 - RNA, 14 nt, Staphylococcus aureus subsp. aureus MW2
augaauuuucauca

SEQ ID NO: 4034914 - RNA, 15 nt, Staphylococcus aureus subsp. aureus MW2
augaauuuucaucau

SEQ ID NO: 4034915 - RNA, 15 nt, Staphylococcus aureus subsp. aureus MW2
augacaaauuaucac

SEQ ID NO: 4034916 - RNA, 22 nt, Staphylococcus aureus subsp. aureus MW2
augacaagagacugaagagcuu

SEQ ID NO: 4034917 - RNA, 15 nt, Staphylococcus aureus subsp. aureus MW2
augacaguaaucaaa

SEQ ID NO: 4034918 - RNA, 14 nt, Staphylococcus aureus subsp. aureus MW2
augacaucaauauc

SEQ ID NO: 4034919 - RNA, 16 nt, Staphylococcus aureus subsp. aureus MW2
augacaucaauaucuu

SEQ ID NO: 4034920 - RNA, 22 nt, Staphylococcus aureus subsp. aureus MW2
augauuuauuaacucaugcuga

SEQ ID NO: 4034921 - RNA, 12 nt, Staphylococcus aureus subsp. aureus MW2
augauuucacuu

SEQ ID NO: 4034922 - RNA, 18 nt, Staphylococcus aureus subsp. aureus MW2
augauuucacuucauaaa

SEQ ID NO: 4034923 - RNA, 19 nt, Staphylococcus aureus subsp. aureus MW2
augauuugauauuucaaau

SEQ ID NO: 4034924 - RNA, 12 nt, Staphylococcus aureus subsp. aureus MW2
augauuugauuu

SEQ ID NO: 4034925 - RNA, 18 nt, Staphylococcus aureus subsp. aureus MW2
augauuuuuaaaaauaca

SEQ ID NO: 4034926 - RNA, 19 nt, Staphylococcus aureus subsp. aureus MW2
augcaacuuauaauauuaa

SEQ ID NO: 4034927 - RNA, 23 nt, Staphylococcus aureus subsp. aureus MW2
augcaaguuggcggggccccaac

SEQ ID NO: 4034928 - RNA, 14 nt, Staphylococcus aureus subsp. aureus MW2
augcaauacauuaa

SEQ ID NO: 4034929 - RNA, 15 nt, Staphylococcus aureus subsp. aureus MW2
augcaauugaccaac

SEQ ID NO: 4034930 - RNA, 17 nt, Staphylococcus aureus subsp. aureus MW2
augcaccuuuacaacau

SEQ ID NO: 4034931 - RNA, 18 nt, Staphylococcus aureus subsp. aureus MW2
augcacgaaugguucuuc

SEQ ID NO: 4034932 - RNA, 21 nt, Staphylococcus aureus subsp. aureus MW2
augcacuuuauuaaaaauccu

SEQ ID NO: 4034933 - RNA, 19 nt, Staphylococcus aureus subsp. aureus MW2
augcacuuuuuauacauua

SEQ ID NO: 4034934 - RNA, 14 nt, Staphylococcus aureus subsp. aureus MW2
augcagauucuuca

SEQ ID NO: 4034935 - RNA, 13 nt, Staphylococcus aureus subsp. aureus MW2
augcagcuguauu

SEQ ID NO: 4034936 - RNA, 15 nt, Staphylococcus aureus subsp. aureus MW2
augcaguaaaaccaa

SEQ ID NO: 4034937 - RNA, 20 nt, Staphylococcus aureus subsp. aureus MW2
augcaguuuuaauuaaacug

SEQ ID NO: 4034938 - RNA, 14 nt, Staphylococcus aureus subsp. aureus MW2
augcauaauauauu

SEQ ID NO: 4034939 - RNA, 18 nt, Staphylococcus aureus subsp. aureus MW2
augcauaauauauuaaaa

SEQ ID NO: 4034940 - RNA, 13 nt, Staphylococcus aureus subsp. aureus MW2
augcauauauaua

SEQ ID NO: 4034941 - RNA, 15 nt, Staphylococcus aureus subsp. aureus MW2
augcauauucaucau

SEQ ID NO: 4034942 - RNA, 21 nt, Staphylococcus aureus subsp. aureus MW2
augcaucaacagauacuucag

SEQ ID NO: 4034943 - RNA, 13 nt, Staphylococcus aureus subsp. aureus MW2
augcaucgguauc

SEQ ID NO: 4034944 - RNA, 23 nt, Staphylococcus aureus subsp. aureus MW2
augcaucgguaucgaauguuuca

SEQ ID NO: 4034945 - RNA, 17 nt, Staphylococcus aureus subsp. aureus MW2
augcaugcgcaaaagcg

SEQ ID NO: 4034946 - RNA, 20 nt, Staphylococcus aureus subsp. aureus MW2
augcaugcuucucaauuugu

SEQ ID NO: 4034947 - RNA, 15 nt, Staphylococcus aureus subsp. aureus MW2
augcaugugaaauua

SEQ ID NO: 4034948 - RNA, 12 nt, Staphylococcus aureus subsp. aureus MW2
augcauugagca

SEQ ID NO: 4034949 - RNA, 23 nt, Staphylococcus aureus subsp. aureus MW2
augccaaauaacguuaauauaau

SEQ ID NO: 4034950 - RNA, 22 nt, Staphylococcus aureus subsp. aureus MW2
augccaacacguuuuaagccag

SEQ ID NO: 4034951 - RNA, 16 nt, Staphylococcus aureus subsp. aureus MW2
augccaauuaauucuu

SEQ ID NO: 4034952 - RNA, 12 nt, Staphylococcus aureus subsp. aureus MW2
augccacaucau

SEQ ID NO: 4034953 - RNA, 18 nt, Staphylococcus aureus subsp. aureus MW2
augccagaugcaaugaua

SEQ ID NO: 4034954 - RNA, 19 nt, Staphylococcus aureus subsp. aureus MW2
augccagcuucuaacaaau

SEQ ID NO: 4034955 - RNA, 17 nt, Staphylococcus aureus subsp. aureus MW2
augccauaccugcaccu

SEQ ID NO: 4034956 - RNA, 21 nt, Staphylococcus aureus subsp. aureus MW2
augccaucuuuguaaccuaaa

SEQ ID NO: 4034957 - RNA, 16 nt, Staphylococcus aureus subsp. aureus MW2
augccauuguuaucca

SEQ ID NO: 4034958 - RNA, 19 nt, Staphylococcus aureus subsp. aureus MW2
augcccaaccacgauaucu

SEQ ID NO: 4034959 - RNA, 23 nt, Staphylococcus aureus subsp. aureus MW2
augccugccccuuagucauguuu

SEQ ID NO: 4034960 - RNA, 20 nt, Staphylococcus aureus subsp. aureus MW2
augccuuaugucauauacua

SEQ ID NO: 4034961 - RNA, 19 nt, Staphylococcus aureus subsp. aureus MW2
augccuugucuauuguaaa

SEQ ID NO: 4034962 - RNA, 12 nt, Staphylococcus aureus subsp. aureus MW2
augccuuuaaag

SEQ ID NO: 4034963 - RNA, 22 nt, Staphylococcus aureus subsp. aureus MW2
augccuuuuauuuaucuuuuaa

SEQ ID NO: 4034964 - RNA, 13 nt, Staphylococcus aureus subsp. aureus MW2
augcgauuacagu

SEQ ID NO: 4034965 - RNA, 15 nt, Staphylococcus aureus subsp. aureus MW2
augcgauuacagugu

SEQ ID NO: 4034966 - RNA, 16 nt, Staphylococcus aureus subsp. aureus MW2
augcgauucucauuua

SEQ ID NO: 4034967 - RNA, 22 nt, Staphylococcus aureus subsp. aureus MW2
augcgauucucauuuacuugau

SEQ ID NO: 4034968 - RNA, 13 nt, Staphylococcus aureus subsp. aureus MW2
augcgcaaaagcg

SEQ ID NO: 4034969 - RNA, 17 nt, Staphylococcus aureus subsp. aureus MW2
augcgcuuguaacaagc

SEQ ID NO: 4034970 - RNA, 15 nt, Staphylococcus aureus subsp. aureus MW2
augcguaucaauauu

SEQ ID NO: 4034971 - RNA, 20 nt, Staphylococcus aureus subsp. aureus MW2
augcguaucgagagauuaug

SEQ ID NO: 4034972 - RNA, 16 nt, Staphylococcus aureus subsp. aureus MW2
augcuaauuuaacugc

SEQ ID NO: 4034973 - RNA, 18 nt, Staphylococcus aureus subsp. aureus MW2
augcuagaaaguaaugcu

SEQ ID NO: 4034974 - RNA, 19 nt, Staphylococcus aureus subsp. aureus MW2
augcuagcuuucuuuuuca

SEQ ID NO: 4034975 - RNA, 23 nt, Staphylococcus aureus subsp. aureus MW2
augcuagcuuucuuuuucaucuu

SEQ ID NO: 4034976 - RNA, 16 nt, Staphylococcus aureus subsp. aureus MW2
augcuauaaguauuuu

SEQ ID NO: 4034977 - RNA, 13 nt, Staphylococcus aureus subsp. aureus MW2
augcuauauccag

SEQ ID NO: 4034978 - RNA, 22 nt, Staphylococcus aureus subsp. aureus MW2
augcucaucuacuuaaaauaag

SEQ ID NO: 4034979 - RNA, 21 nt, Staphylococcus aureus subsp. aureus MW2
augcucccuucaaaguuuuca

SEQ ID NO: 4034980 - RNA, 15 nt, Staphylococcus aureus subsp. aureus MW2
augcucguauagaaa

SEQ ID NO: 4034981 - RNA, 17 nt, Staphylococcus aureus subsp. aureus MW2
augcugaauaaauaacu

SEQ ID NO: 4034982 - RNA, 17 nt, Staphylococcus aureus subsp. aureus MW2
augcugauaauuuuucu

SEQ ID NO: 4034983 - RNA, 20 nt, Staphylococcus aureus subsp. aureus MW2
augcugcaagucucauaucu

SEQ ID NO: 4034984 - RNA, 21 nt, Staphylococcus aureus subsp. aureus MW2
augcugcuucuucagguguuu

SEQ ID NO: 4034985 - RNA, 15 nt, Staphylococcus aureus subsp. aureus MW2
augcuuaaaaacaau

SEQ ID NO: 4034986 - RNA, 23 nt, Staphylococcus aureus subsp. aureus MW2
augcuuauucugaaaaauauuua

SEQ ID NO: 4034987 - RNA, 15 nt, Staphylococcus aureus subsp. aureus MW2
augcuucaaagucaa

SEQ ID NO: 4034988 - RNA, 22 nt, Staphylococcus aureus subsp. aureus MW2
augcuucgcacaacugcauaua

SEQ ID NO: 4034989 - RNA, 15 nt, Staphylococcus aureus subsp. aureus MW2
augcuucuaacugaa

SEQ ID NO: 4034990 - RNA, 22 nt, Staphylococcus aureus subsp. aureus MW2
augcuucuaacugaauuaaagc

SEQ ID NO: 4034991 - RNA, 21 nt, Staphylococcus aureus subsp. aureus MW2
augcuucugguucuucaauau

SEQ ID NO: 4034992 - RNA, 15 nt, Staphylococcus aureus subsp. aureus MW2
augcuugaauguuug

SEQ ID NO: 4034993 - RNA, 17 nt, Staphylococcus aureus subsp. aureus MW2
augcuuggacauauacu

SEQ ID NO: 4034994 - RNA, 22 nt, Staphylococcus aureus subsp. aureus MW2
augcuuguacaaaaaauuguaa

SEQ ID NO: 4034995 - RNA, 22 nt, Staphylococcus aureus subsp. aureus MW2
augcuuuaggugaguuaccaua

SEQ ID NO: 4034996 - RNA, 20 nt, Staphylococcus aureus subsp. aureus MW2
augcuuuaugugcagcuuga

SEQ ID NO: 4034997 - RNA, 20 nt, Staphylococcus aureus subsp. aureus MW2
augcuuucaaauacacagau

SEQ ID NO: 4034998 - RNA, 18 nt, Staphylococcus aureus subsp. aureus MW2
augcuuucaucuuuuuca

SEQ ID NO: 4034999 - RNA, 15 nt, Staphylococcus aureus subsp. aureus MW2
augcuuuugaucuaa

SEQ ID NO: 4035000 - RNA, 16 nt, Staphylococcus aureus subsp. aureus MW2
augcuuuuuugaaaug

SEQ ID NO: 4035001 - RNA, 13 nt, Staphylococcus aureus subsp. aureus MW2
auggaaaaguuuu

SEQ ID NO: 4035002 - RNA, 15 nt, Staphylococcus aureus subsp. aureus MW2
auggaaaaguuuuuu

SEQ ID NO: 4035003 - RNA, 17 nt, Staphylococcus aureus subsp. aureus MW2
auggaaaauauauuaua

SEQ ID NO: 4035004 - RNA, 20 nt, Staphylococcus aureus subsp. aureus MW2
auggaaaguugguuuuauua

SEQ ID NO: 4035005 - RNA, 18 nt, Staphylococcus aureus subsp. aureus MW2
auggaaguuguugcuuug

SEQ ID NO: 4035006 - RNA, 21 nt, Staphylococcus aureus subsp. aureus MW2
auggaaguuguugcuuuggua

SEQ ID NO: 4035007 - RNA, 16 nt, Staphylococcus aureus subsp. aureus MW2
auggaaucauuuucuu

SEQ ID NO: 4035008 - RNA, 16 nt, Staphylococcus aureus subsp. aureus MW2
auggacaguuuuuaua

SEQ ID NO: 4035009 - RNA, 13 nt, Staphylococcus aureus subsp. aureus MW2
auggauauucaau

SEQ ID NO: 4035010 - RNA, 16 nt, Staphylococcus aureus subsp. aureus MW2
auggaugaauauauug

SEQ ID NO: 4035011 - RNA, 22 nt, Staphylococcus aureus subsp. aureus MW2
auggauuacagcguacuaaaga

SEQ ID NO: 4035012 - RNA, 14 nt, Staphylococcus aureus subsp. aureus MW2
auggauuucuuauu

SEQ ID NO: 4035013 - RNA, 15 nt, Staphylococcus aureus subsp. aureus MW2
auggcacaucagaua

SEQ ID NO: 4035014 - RNA, 18 nt, Staphylococcus aureus subsp. aureus MW2
auggcauuuaauacuaau

SEQ ID NO: 4035015 - RNA, 18 nt, Staphylococcus aureus subsp. aureus MW2
auggcgcaauuuuuaaca

SEQ ID NO: 4035016 - RNA, 21 nt, Staphylococcus aureus subsp. aureus MW2
auggcgcaauuuuuaacaaaa

SEQ ID NO: 4035017 - RNA, 20 nt, Staphylococcus aureus subsp. aureus MW2
auggcuagucuuuaacuuua

SEQ ID NO: 4035018 - RNA, 19 nt, Staphylococcus aureus subsp. aureus MW2
auggcuauguuuacgccaa

SEQ ID NO: 4035019 - RNA, 17 nt, Staphylococcus aureus subsp. aureus MW2
auggcugcaucaauaug

SEQ ID NO: 4035020 - RNA, 20 nt, Staphylococcus aureus subsp. aureus MW2
auggcugcaucaauaugacc

SEQ ID NO: 4035021 - RNA, 15 nt, Staphylococcus aureus subsp. aureus MW2
auggcuuaaaucaaa

SEQ ID NO: 4035022 - RNA, 17 nt, Staphylococcus aureus subsp. aureus MW2
auggcuuaaaucaaaug

SEQ ID NO: 4035023 - RNA, 22 nt, Staphylococcus aureus subsp. aureus MW2
auggcuuagguuuaauuuuaaa

SEQ ID NO: 4035024 - RNA, 16 nt, Staphylococcus aureus subsp. aureus MW2
augggaauuuagggaa

SEQ ID NO: 4035025 - RNA, 16 nt, Staphylococcus aureus subsp. aureus MW2
augggauggugguuau

SEQ ID NO: 4035026 - RNA, 12 nt, Staphylococcus aureus subsp. aureus MW2
augggccccaac

SEQ ID NO: 4035027 - RNA, 17 nt, Staphylococcus aureus subsp. aureus MW2
augggccccaacacaga

SEQ ID NO: 4035028 - RNA, 17 nt, Staphylococcus aureus subsp. aureus MW2
auggggacauguucacu

SEQ ID NO: 4035029 - RNA, 21 nt, Staphylococcus aureus subsp. aureus MW2
auggguaaggugauugaacaa

SEQ ID NO: 4035030 - RNA, 18 nt, Staphylococcus aureus subsp. aureus MW2
augguaaguauaauuaaa

SEQ ID NO: 4035031 - RNA, 17 nt, Staphylococcus aureus subsp. aureus MW2
augguacuaaaguugca

SEQ ID NO: 4035032 - RNA, 19 nt, Staphylococcus aureus subsp. aureus MW2
augguaguuagguaaaaau

SEQ ID NO: 4035033 - RNA, 20 nt, Staphylococcus aureus subsp. aureus MW2
augguaguuagguaaaaauu

SEQ ID NO: 4035034 - RNA, 21 nt, Staphylococcus aureus subsp. aureus MW2
augguaucuaaaugugaaaga

SEQ ID NO: 4035035 - RNA, 22 nt, Staphylococcus aureus subsp. aureus MW2
augguaucuuuaauuucauuua

SEQ ID NO: 4035036 - RNA, 19 nt, Staphylococcus aureus subsp. aureus MW2
auggucuuuuaauauuuuc

SEQ ID NO: 4035037 - RNA, 18 nt, Staphylococcus aureus subsp. aureus MW2
auggugcuaaaaaauuug

SEQ ID NO: 4035038 - RNA, 12 nt, Staphylococcus aureus subsp. aureus MW2
augguguggugu

SEQ ID NO: 4035039 - RNA, 14 nt, Staphylococcus aureus subsp. aureus MW2
augguguugcauua

SEQ ID NO: 4035040 - RNA, 17 nt, Staphylococcus aureus subsp. aureus MW2
augguuacccuuuuuca

SEQ ID NO: 4035041 - RNA, 22 nt, Staphylococcus aureus subsp. aureus MW2
augguuacccuuuuucaaagau

SEQ ID NO: 4035042 - RNA, 13 nt, Staphylococcus aureus subsp. aureus MW2
augguuaucacuu

SEQ ID NO: 4035043 - RNA, 15 nt, Staphylococcus aureus subsp. aureus MW2
augguuauggugugu

SEQ ID NO: 4035044 - RNA, 20 nt, Staphylococcus aureus subsp. aureus MW2
augguugaauaacacuagaa

SEQ ID NO: 4035045 - RNA, 23 nt, Staphylococcus aureus subsp. aureus MW2
augguugauuuuggaugaagcgg

SEQ ID NO: 4035046 - RNA, 22 nt, Staphylococcus aureus subsp. aureus MW2
augguuuuguuuugcucuuuaa

SEQ ID NO: 4035047 - RNA, 13 nt, Staphylococcus aureus subsp. aureus MW2
auguaaaaucauu

SEQ ID NO: 4035048 - RNA, 20 nt, Staphylococcus aureus subsp. aureus MW2
auguaaaaucauuaauaauu

SEQ ID NO: 4035049 - RNA, 15 nt, Staphylococcus aureus subsp. aureus MW2
auguaaaauuagcaa

SEQ ID NO: 4035050 - RNA, 16 nt, Staphylococcus aureus subsp. aureus MW2
auguaaauaaaaauua

SEQ ID NO: 4035051 - RNA, 22 nt, Staphylococcus aureus subsp. aureus MW2
auguaaaucgugcuguuaucau

SEQ ID NO: 4035052 - RNA, 22 nt, Staphylococcus aureus subsp. aureus MW2
auguaaauugguauaacaauuu

SEQ ID NO: 4035053 - RNA, 16 nt, Staphylococcus aureus subsp. aureus MW2
auguaacaauuuagca

SEQ ID NO: 4035054 - RNA, 21 nt, Staphylococcus aureus subsp. aureus MW2
auguaacagugugaaauaaua

SEQ ID NO: 4035055 - RNA, 22 nt, Staphylococcus aureus subsp. aureus MW2
auguaacauaaagcuguuuauu

SEQ ID NO: 4035056 - RNA, 19 nt, Staphylococcus aureus subsp. aureus MW2
auguaacauuaaaaauaaa

SEQ ID NO: 4035057 - RNA, 12 nt, Staphylococcus aureus subsp. aureus MW2
auguaacuuguc

SEQ ID NO: 4035058 - RNA, 17 nt, Staphylococcus aureus subsp. aureus MW2
auguaacuuuagacaua

SEQ ID NO: 4035059 - RNA, 19 nt, Staphylococcus aureus subsp. aureus MW2
auguaagcuaucguaaaca

SEQ ID NO: 4035060 - RNA, 15 nt, Staphylococcus aureus subsp. aureus MW2
auguaauacaaaaga

SEQ ID NO: 4035061 - RNA, 17 nt, Staphylococcus aureus subsp. aureus MW2
auguaaucauuauagca

SEQ ID NO: 4035062 - RNA, 17 nt, Staphylococcus aureus subsp. aureus MW2
auguaaugaaucaaauc

SEQ ID NO: 4035063 - RNA, 21 nt, Staphylococcus aureus subsp. aureus MW2
auguacaaccuuugcuuaaac

SEQ ID NO: 4035064 - RNA, 23 nt, Staphylococcus aureus subsp. aureus MW2
auguacacuuuugauuguuuaaa

SEQ ID NO: 4035065 - RNA, 17 nt, Staphylococcus aureus subsp. aureus MW2
auguacauguauaaaag

SEQ ID NO: 4035066 - RNA, 14 nt, Staphylococcus aureus subsp. aureus MW2
auguaccaaauuua

SEQ ID NO: 4035067 - RNA, 20 nt, Staphylococcus aureus subsp. aureus MW2
auguaccaaauuuauaauuu

SEQ ID NO: 4035068 - RNA, 22 nt, Staphylococcus aureus subsp. aureus MW2
auguaccacucauaaucaaguc

SEQ ID NO: 4035069 - RNA, 23 nt, Staphylococcus aureus subsp. aureus MW2
auguaccgaauccuucaucaaua

SEQ ID NO: 4035070 - RNA, 14 nt, Staphylococcus aureus subsp. aureus MW2
auguagcaauuuuc

SEQ ID NO: 4035071 - RNA, 19 nt, Staphylococcus aureus subsp. aureus MW2
auguaggcgccauaaucau

SEQ ID NO: 4035072 - RNA, 13 nt, Staphylococcus aureus subsp. aureus MW2
auguauaauacau

SEQ ID NO: 4035073 - RNA, 22 nt, Staphylococcus aureus subsp. aureus MW2
auguauaauacaugauauaaau

SEQ ID NO: 4035074 - RNA, 19 nt, Staphylococcus aureus subsp. aureus MW2
auguauaucgacaccauuu

SEQ ID NO: 4035075 - RNA, 15 nt, Staphylococcus aureus subsp. aureus MW2
auguauaucuuuauu

SEQ ID NO: 4035076 - RNA, 21 nt, Staphylococcus aureus subsp. aureus MW2
auguauaugaauuuuauaaau

SEQ ID NO: 4035077 - RNA, 22 nt, Staphylococcus aureus subsp. aureus MW2
auguauaugaauuuuauaaauu

SEQ ID NO: 4035078 - RNA, 21 nt, Staphylococcus aureus subsp. aureus MW2
auguaugcuuguacaaaaaau

SEQ ID NO: 4035079 - RNA, 20 nt, Staphylococcus aureus subsp. aureus MW2
auguauguuuuaucaauauu

SEQ ID NO: 4035080 - RNA, 18 nt, Staphylococcus aureus subsp. aureus MW2
auguauuauagauuacgc

SEQ ID NO: 4035081 - RNA, 17 nt, Staphylococcus aureus subsp. aureus MW2
auguauucuuagauauu

SEQ ID NO: 4035082 - RNA, 13 nt, Staphylococcus aureus subsp. aureus MW2
auguauugcuaua

SEQ ID NO: 4035083 - RNA, 17 nt, Staphylococcus aureus subsp. aureus MW2
auguauugcuauaagaa

SEQ ID NO: 4035084 - RNA, 14 nt, Staphylococcus aureus subsp. aureus MW2
auguauuuauuacu

SEQ ID NO: 4035085 - RNA, 17 nt, Staphylococcus aureus subsp. aureus MW2
auguauuuuuauuuaua

SEQ ID NO: 4035086 - RNA, 12 nt, Staphylococcus aureus subsp. aureus MW2
auguauuuuuca

SEQ ID NO: 4035087 - RNA, 24 nt, Staphylococcus aureus subsp. aureus MW2
augucaaaucggcuauacauugau

SEQ ID NO: 4035088 - RNA, 14 nt, Staphylococcus aureus subsp. aureus MW2
augucacauaugac

SEQ ID NO: 4035089 - RNA, 16 nt, Staphylococcus aureus subsp. aureus MW2
augucacauaugacuu

SEQ ID NO: 4035090 - RNA, 23 nt, Staphylococcus aureus subsp. aureus MW2
augucacauguaccacauuuucc

SEQ ID NO: 4035091 - RNA, 18 nt, Staphylococcus aureus subsp. aureus MW2
augucacugcaaacacag

SEQ ID NO: 4035092 - RNA, 23 nt, Staphylococcus aureus subsp. aureus MW2
augucacugcaaacacaguacaa

SEQ ID NO: 4035093 - RNA, 18 nt, Staphylococcus aureus subsp. aureus MW2
augucaguuuugaagaau

SEQ ID NO: 4035094 - RNA, 16 nt, Staphylococcus aureus subsp. aureus MW2
augucauagccuauuu

SEQ ID NO: 4035095 - RNA, 18 nt, Staphylococcus aureus subsp. aureus MW2
augucaucuugacacaau

SEQ ID NO: 4035096 - RNA, 18 nt, Staphylococcus aureus subsp. aureus MW2
auuaaaauaauuaaacuu

SEQ ID NO: 4035097 - RNA, 12 nt, Staphylococcus aureus subsp. aureus MW2
auuaaaaugaua

SEQ ID NO: 4035098 - RNA, 21 nt, Staphylococcus aureus subsp. aureus MW2
auuaaaaugauaucugacauu

SEQ ID NO: 4035099 - RNA, 13 nt, Staphylococcus aureus subsp. aureus MW2
auuaaaaugcuuu

SEQ ID NO: 4035100 - RNA, 18 nt, Staphylococcus aureus subsp. aureus MW2
auuaaaauguuaauaaug

SEQ ID NO: 4035101 - RNA, 21 nt, Staphylococcus aureus subsp. aureus MW2
auuaaaauuacgguuugcuuu

SEQ ID NO: 4035102 - RNA, 22 nt, Staphylococcus aureus subsp. aureus MW2
auuaaacaaguugauaacuauu

SEQ ID NO: 4035103 - RNA, 20 nt, Staphylococcus aureus subsp. aureus MW2
auuaaacauuuagauuucau

SEQ ID NO: 4035104 - RNA, 20 nt, Staphylococcus aureus subsp. aureus MW2
auuaaaccuaaucugccgug

SEQ ID NO: 4035105 - RNA, 17 nt, Staphylococcus aureus subsp. aureus MW2
auuaaacgcaauuaacc

SEQ ID NO: 4035106 - RNA, 10 nt, Staphylococcus aureus subsp. aureus MW2
auuaaacugc

SEQ ID NO: 4035107 - RNA, 20 nt, Staphylococcus aureus subsp. aureus MW2
auuaaacuuaagaauacaug

SEQ ID NO: 4035108 - RNA, 17 nt, Staphylococcus aureus subsp. aureus MW2
auuaaagaaacaugauu

SEQ ID NO: 4035109 - RNA, 20 nt, Staphylococcus aureus subsp. aureus MW2
auuaaagcaucgaacaaucg

SEQ ID NO: 4035110 - RNA, 20 nt, Staphylococcus aureus subsp. aureus MW2
auuaaagcaucuucaauauu

SEQ ID NO: 4035111 - RNA, 20 nt, Staphylococcus aureus subsp. aureus MW2
auuaaagcuaucuucagauu

SEQ ID NO: 4035112 - RNA, 16 nt, Staphylococcus aureus subsp. aureus MW2
auuaaaggaaaucaau

SEQ ID NO: 4035113 - RNA, 21 nt, Staphylococcus aureus subsp. aureus MW2
auuaaaggaaaucaauccauc

SEQ ID NO: 4035114 - RNA, 15 nt, Staphylococcus aureus subsp. aureus MW2
auuaaagugaauauu

SEQ ID NO: 4035115 - RNA, 15 nt, Staphylococcus aureus subsp. aureus MW2
auuaaaguugauuuu

SEQ ID NO: 4035116 - RNA, 20 nt, Staphylococcus aureus subsp. aureus MW2
auuaaauacgccaaauacua

SEQ ID NO: 4035117 - RNA, 14 nt, Staphylococcus aureus subsp. aureus MW2
auuaaauauacuuu

SEQ ID NO: 4035118 - RNA, 19 nt, Staphylococcus aureus subsp. aureus MW2
auuaaauauuuagauuggu

SEQ ID NO: 4035119 - RNA, 18 nt, Staphylococcus aureus subsp. aureus MW2
auuaaaucugauucauua

SEQ ID NO: 4035120 - RNA, 16 nt, Staphylococcus aureus subsp. aureus MW2
auuaaaucuuuauaaa

SEQ ID NO: 4035121 - RNA, 19 nt, Staphylococcus aureus subsp. aureus MW2
auuaaaugaugcaguaaaa

SEQ ID NO: 4035122 - RNA, 17 nt, Staphylococcus aureus subsp. aureus MW2
auuaaaugcaauacauu

SEQ ID NO: 4035123 - RNA, 22 nt, Staphylococcus aureus subsp. aureus MW2
auuaaaugcauaauauauuaaa

SEQ ID NO: 4035124 - RNA, 20 nt, Staphylococcus aureus subsp. aureus MW2
auuaaauguuuacgaaguuc

SEQ ID NO: 4035125 - RNA, 16 nt, Staphylococcus aureus subsp. aureus MW2
auuaaauucaaaucug

SEQ ID NO: 4035126 - RNA, 21 nt, Staphylococcus aureus subsp. aureus MW2
auuaaauucaucuugcaagua

SEQ ID NO: 4035127 - RNA, 13 nt, Staphylococcus aureus subsp. aureus MW2
auuaaauuucaaa

SEQ ID NO: 4035128 - RNA, 16 nt, Staphylococcus aureus subsp. aureus MW2
auuaacaacaaauaua

SEQ ID NO: 4035129 - RNA, 22 nt, Staphylococcus aureus subsp. aureus MW2
auuaacaaggccugcaucaccu

SEQ ID NO: 4035130 - RNA, 22 nt, Staphylococcus aureus subsp. aureus MW2
auuaacacauucuuauuugaaa

SEQ ID NO: 4035131 - RNA, 21 nt, Staphylococcus aureus subsp. aureus MW2
auuaacaccagauaucauaau

SEQ ID NO: 4035132 - RNA, 22 nt, Staphylococcus aureus subsp. aureus MW2
auuaacacgaacugcauaggua

SEQ ID NO: 4035133 - RNA, 12 nt, Staphylococcus aureus subsp. aureus MW2
auuaacaucaug

SEQ ID NO: 4035134 - RNA, 14 nt, Staphylococcus aureus subsp. aureus MW2
auuaacauuaucca

SEQ ID NO: 4035135 - RNA, 20 nt, Staphylococcus aureus subsp. aureus MW2
auuaaccauuucuuuuuuca

SEQ ID NO: 4035136 - RNA, 14 nt, Staphylococcus aureus subsp. aureus MW2
auuaaccccuucaa

SEQ ID NO: 4035137 - RNA, 15 nt, Staphylococcus aureus subsp. aureus MW2
auuaaccccuucaaa

SEQ ID NO: 4035138 - RNA, 16 nt, Staphylococcus aureus subsp. aureus MW2
auuaacgauuaauaua

SEQ ID NO: 4035139 - RNA, 18 nt, Staphylococcus aureus subsp. aureus MW2
auuaacgucaacagcaua

SEQ ID NO: 4035140 - RNA, 23 nt, Staphylococcus aureus subsp. aureus MW2
auuaacucaggcugggacauaaa

SEQ ID NO: 4035141 - RNA, 20 nt, Staphylococcus aureus subsp. aureus MW2
auuaacuguguauggcauaa

SEQ ID NO: 4035142 - RNA, 22 nt, Staphylococcus aureus subsp. aureus MW2
auuaacuguuagacuugguuac

SEQ ID NO: 4035143 - RNA, 18 nt, Staphylococcus aureus subsp. aureus MW2
auuaacuuaaaauuuaaa

SEQ ID NO: 4035144 - RNA, 22 nt, Staphylococcus aureus subsp. aureus MW2
auuaacuuaaaauuuaaauauu

SEQ ID NO: 4035145 - RNA, 15 nt, Staphylococcus aureus subsp. aureus MW2
auuaagaaaaucauu

SEQ ID NO: 4035146 - RNA, 17 nt, Staphylococcus aureus subsp. aureus MW2
auuaagacugauuaauu

SEQ ID NO: 4035147 - RNA, 19 nt, Staphylococcus aureus subsp. aureus MW2
auuaagaugaaauacuuga

SEQ ID NO: 4035148 - RNA, 17 nt, Staphylococcus aureus subsp. aureus MW2
auuaagauguauaugaa

SEQ ID NO: 4035149 - RNA, 19 nt, Staphylococcus aureus subsp. aureus MW2
auuaagauguauaugaauu

SEQ ID NO: 4035150 - RNA, 16 nt, Staphylococcus aureus subsp. aureus MW2
auuaaggcuuuaguag

SEQ ID NO: 4035151 - RNA, 17 nt, Staphylococcus aureus subsp. aureus MW2
auuaaguaauagcaacc

SEQ ID NO: 4035152 - RNA, 17 nt, Staphylococcus aureus subsp. aureus MW2
auuaaguacuuuuacaa

SEQ ID NO: 4035153 - RNA, 20 nt, Staphylococcus aureus subsp. aureus MW2
auuaaguacuuuuacaaacu

SEQ ID NO: 4035154 - RNA, 20 nt, Staphylococcus aureus subsp. aureus MW2
auuaaguguauauaguagga

SEQ ID NO: 4035155 - RNA, 15 nt, Staphylococcus aureus subsp. aureus MW2
auuaaguucuuaggc

SEQ ID NO: 4035156 - RNA, 18 nt, Staphylococcus aureus subsp. aureus MW2
auuaauaacauccccaaa

SEQ ID NO: 4035157 - RNA, 20 nt, Staphylococcus aureus subsp. aureus MW2
auuaauaagugcuguuacuu

SEQ ID NO: 4035158 - RNA, 17 nt, Staphylococcus aureus subsp. aureus MW2
auuaauauaaauaucaa

SEQ ID NO: 4035159 - RNA, 15 nt, Staphylococcus aureus subsp. aureus MW2
auuaauauauauacc

SEQ ID NO: 4035160 - RNA, 15 nt, Staphylococcus aureus subsp. aureus MW2
auuaauauauuuaaa

SEQ ID NO: 4035161 - RNA, 18 nt, Staphylococcus aureus subsp. aureus MW2
auuaauauugagacuauu

SEQ ID NO: 4035162 - RNA, 16 nt, Staphylococcus aureus subsp. aureus MW2
auuaauccacaaauaa

SEQ ID NO: 4035163 - RNA, 18 nt, Staphylococcus aureus subsp. aureus MW2
auuaauccacaaauaaca

SEQ ID NO: 4035164 - RNA, 16 nt, Staphylococcus aureus subsp. aureus MW2
auuaauccgucuuuuu

SEQ ID NO: 4035165 - RNA, 14 nt, Staphylococcus aureus subsp. aureus MW2
auuaaucguauuuu

SEQ ID NO: 4035166 - RNA, 16 nt, Staphylococcus aureus subsp. aureus MW2
auuaaugaaauaccua

SEQ ID NO: 4035167 - RNA, 12 nt, Staphylococcus aureus subsp. aureus MW2
auuaaugauuca

SEQ ID NO: 4035168 - RNA, 21 nt, Staphylococcus aureus subsp. aureus MW2
auuaaugauucaccguaugau

SEQ ID NO: 4035169 - RNA, 20 nt, Staphylococcus aureus subsp. aureus MW2
auuaaugcucuauauaucca

SEQ ID NO: 4035170 - RNA, 17 nt, Staphylococcus aureus subsp. aureus MW2
auuaauggcaacuaaga

SEQ ID NO: 4035171 - RNA, 15 nt, Staphylococcus aureus subsp. aureus MW2
auuaaugguauugau

SEQ ID NO: 4035172 - RNA, 14 nt, Staphylococcus aureus subsp. aureus MW2
auuaauguaaugau

SEQ ID NO: 4035173 - RNA, 23 nt, Staphylococcus aureus subsp. aureus MW2
auuaaugucacauguaccacauu

SEQ ID NO: 4035174 - RNA, 20 nt, Staphylococcus aureus subsp. aureus MW2
auuaauguuucuucaauugu

SEQ ID NO: 4035175 - RNA, 22 nt, Staphylococcus aureus subsp. aureus MW2
auuaauuacuuucauuguaaau

SEQ ID NO: 4035176 - RNA, 20 nt, Staphylococcus aureus subsp. aureus MW2
auuaauuaucauaaauauaa

SEQ ID NO: 4035177 - RNA, 15 nt, Staphylococcus aureus subsp. aureus MW2
auuaauucugauuau

SEQ ID NO: 4035178 - RNA, 15 nt, Staphylococcus aureus subsp. aureus MW2
auuaauucuuugaaa

SEQ ID NO: 4035179 - RNA, 16 nt, Staphylococcus aureus subsp. aureus MW2
auuaauucuuugaaaa

SEQ ID NO: 4035180 - RNA, 17 nt, Staphylococcus aureus subsp. aureus MW2
auuaauugaaaaaccaa

SEQ ID NO: 4035181 - RNA, 17 nt, Staphylococcus aureus subsp. aureus MW2
auuaauuggauuaaaua

SEQ ID NO: 4035182 - RNA, 20 nt, Staphylococcus aureus subsp. aureus MW2
auuaauuuaaaaaugauaga

SEQ ID NO: 4035183 - RNA, 13 nt, Staphylococcus aureus subsp. aureus MW2
auuaauuugauaa

SEQ ID NO: 4035184 - RNA, 19 nt, Staphylococcus aureus subsp. aureus MW2
auuaguaauuuuuaaaucu

SEQ ID NO: 4035185 - RNA, 15 nt, Staphylococcus aureus subsp. aureus MW2
auuaguauaauuuau

SEQ ID NO: 4035186 - RNA, 13 nt, Staphylococcus aureus subsp. aureus MW2
auuaguaugacuu

SEQ ID NO: 4035187 - RNA, 19 nt, Staphylococcus aureus subsp. aureus MW2
auuaguaugacuuaccuaa

SEQ ID NO: 4035188 - RNA, 15 nt, Staphylococcus aureus subsp. aureus MW2
auuagucaucaaccu

SEQ ID NO: 4035189 - RNA, 20 nt, Staphylococcus aureus subsp. aureus MW2
auuaguucuguugauauuuc

SEQ ID NO: 4035190 - RNA, 14 nt, Staphylococcus aureus subsp. aureus MW2
auuauaaaauaaau

SEQ ID NO: 4035191 - RNA, 12 nt, Staphylococcus aureus subsp. aureus MW2
auuauaaauaca

SEQ ID NO: 4035192 - RNA, 20 nt, Staphylococcus aureus subsp. aureus MW2
auuauaaauacaugagccuu

SEQ ID NO: 4035193 - RNA, 18 nt, Staphylococcus aureus subsp. aureus MW2
auuauaacgugcuuuuuu

SEQ ID NO: 4035194 - RNA, 21 nt, Staphylococcus aureus subsp. aureus MW2
auuauaaguugcauauaaaaa

SEQ ID NO: 4035195 - RNA, 16 nt, Staphylococcus aureus subsp. aureus MW2
auuauaaugauuuuua

SEQ ID NO: 4035196 - RNA, 17 nt, Staphylococcus aureus subsp. aureus MW2
auuauaauuguaaugcu

SEQ ID NO: 4035197 - RNA, 14 nt, Staphylococcus aureus subsp. aureus MW2
auuauaauuguuca

SEQ ID NO: 4035198 - RNA, 13 nt, Staphylococcus aureus subsp. aureus MW2
auuauacacuuuu

SEQ ID NO: 4035199 - RNA, 17 nt, Staphylococcus aureus subsp. aureus MW2
auuauacugcucuuuau

SEQ ID NO: 4035200 - RNA, 15 nt, Staphylococcus aureus subsp. aureus MW2
auuauacuuuacauu

SEQ ID NO: 4035201 - RNA, 21 nt, Staphylococcus aureus subsp. aureus MW2
auuauacuuuacauuucucgu

SEQ ID NO: 4035202 - RNA, 21 nt, Staphylococcus aureus subsp. aureus MW2
auuauagaugacuguagaaaa

SEQ ID NO: 4035203 - RNA, 23 nt, Staphylococcus aureus subsp. aureus MW2
auuauagcagguggcauccauau

SEQ ID NO: 4035204 - RNA, 16 nt, Staphylococcus aureus subsp. aureus MW2
auuauagguauaagaa

SEQ ID NO: 4035205 - RNA, 18 nt, Staphylococcus aureus subsp. aureus MW2
auuauagucuuaaacaua

SEQ ID NO: 4035206 - RNA, 20 nt, Staphylococcus aureus subsp. aureus MW2
auuauagucuuaaacauaac

SEQ ID NO: 4035207 - RNA, 22 nt, Staphylococcus aureus subsp. aureus MW2
auuauaguuuagauucacugua

SEQ ID NO: 4035208 - RNA, 19 nt, Staphylococcus aureus subsp. aureus MW2
auuauauacucaccacauu

SEQ ID NO: 4035209 - RNA, 13 nt, Staphylococcus aureus subsp. aureus MW2
auuauauauauua

SEQ ID NO: 4035210 - RNA, 15 nt, Staphylococcus aureus subsp. aureus MW2
auuauauauauuaaa

SEQ ID NO: 4035211 - RNA, 13 nt, Staphylococcus aureus subsp. aureus MW2
auuaucaacuuua

SEQ ID NO: 4035212 - RNA, 22 nt, Staphylococcus aureus subsp. aureus MW2
auuaucaacuuuauaaccuaaa

SEQ ID NO: 4035213 - RNA, 21 nt, Staphylococcus aureus subsp. aureus MW2
auuaucaccuucaaacuuuca

SEQ ID NO: 4035214 - RNA, 15 nt, Staphylococcus aureus subsp. aureus MW2
auuaucauaaauaua

SEQ ID NO: 4035215 - RNA, 19 nt, Staphylococcus aureus subsp. aureus MW2
auuaucauaugaacaauua

SEQ ID NO: 4035216 - RNA, 14 nt, Staphylococcus aureus subsp. aureus MW2
auuaucauuaaauu

SEQ ID NO: 4035217 - RNA, 14 nt, Staphylococcus aureus subsp. aureus MW2
auuaucauuacaga

SEQ ID NO: 4035218 - RNA, 23 nt, Staphylococcus aureus subsp. aureus MW2
auuauccaaggauguuauaaaau

SEQ ID NO: 4035219 - RNA, 14 nt, Staphylococcus aureus subsp. aureus MW2
auuauccuacugcu

SEQ ID NO: 4035220 - RNA, 14 nt, Staphylococcus aureus subsp. aureus MW2
auuaucuaaagaaa

SEQ ID NO: 4035221 - RNA, 15 nt, Staphylococcus aureus subsp. aureus MW2
auuaucuaacucaua

SEQ ID NO: 4035222 - RNA, 14 nt, Staphylococcus aureus subsp. aureus MW2
auuaucuauccauu

SEQ ID NO: 4035223 - RNA, 14 nt, Staphylococcus aureus subsp. aureus MW2
auuaucuguaauua

SEQ ID NO: 4035224 - RNA, 18 nt, Staphylococcus aureus subsp. aureus MW2
auuaucuuaagucaucaa

SEQ ID NO: 4035225 - RNA, 14 nt, Staphylococcus aureus subsp. aureus MW2
auuaucuuuaaauu

SEQ ID NO: 4035226 - RNA, 17 nt, Staphylococcus aureus subsp. aureus MW2
auuaucuuuaaauuaca

SEQ ID NO: 4035227 - RNA, 22 nt, Staphylococcus aureus subsp. aureus MW2
auuaucuuuaaauuacaauuaa

SEQ ID NO: 4035228 - RNA, 12 nt, Staphylococcus aureus subsp. aureus MW2
auuaucuuuacg

SEQ ID NO: 4035229 - RNA, 22 nt, Staphylococcus aureus subsp. aureus MW2
auuaucuuucaucaaauucuca

SEQ ID NO: 4035230 - RNA, 18 nt, Staphylococcus aureus subsp. aureus MW2
auuaucuuuguaaauuuu

SEQ ID NO: 4035231 - RNA, 13 nt, Staphylococcus aureus subsp. aureus MW2
auuaugaacagau

SEQ ID NO: 4035232 - RNA, 22 nt, Staphylococcus aureus subsp. aureus MW2
auuaugauacgcuuuuuaaaaa

SEQ ID NO: 4035233 - RNA, 19 nt, Staphylococcus aureus subsp. aureus MW2
auuaugauugcuuauuuau

SEQ ID NO: 4035234 - RNA, 23 nt, Staphylococcus aureus subsp. aureus MW2
auuaugcccgauaauucuaacuu

SEQ ID NO: 4035235 - RNA, 19 nt, Staphylococcus aureus subsp. aureus MW2
auuaugccuuugauuuuac

SEQ ID NO: 4035236 - RNA, 16 nt, Staphylococcus aureus subsp. aureus MW2
auuauguaaaaaauau

SEQ ID NO: 4035237 - RNA, 22 nt, Staphylococcus aureus subsp. aureus MW2
auuauguaaaaaauaucuuguc

SEQ ID NO: 4035238 - RNA, 18 nt, Staphylococcus aureus subsp. aureus MW2
auuauguaauucuagcgu

SEQ ID NO: 4035239 - RNA, 17 nt, Staphylococcus aureus subsp. aureus MW2
auuauguaccaaauuua

SEQ ID NO: 4035240 - RNA, 19 nt, Staphylococcus aureus subsp. aureus MW2
auuauguauuuuuauuuau

SEQ ID NO: 4035241 - RNA, 13 nt, Staphylococcus aureus subsp. aureus MW2
auuaugugacaua

SEQ ID NO: 4035242 - RNA, 18 nt, Staphylococcus aureus subsp. aureus MW2
auuaugugucuuccaauc

SEQ ID NO: 4035243 - RNA, 13 nt, Staphylococcus aureus subsp. aureus MW2
auuauuaaaucaa

SEQ ID NO: 4035244 - RNA, 18 nt, Staphylococcus aureus subsp. aureus MW2
auuauuaacuguaccugc

SEQ ID NO: 4035245 - RNA, 15 nt, Staphylococcus aureus subsp. aureus MW2
auuauuauaauaaau

SEQ ID NO: 4035246 - RNA, 19 nt, Staphylococcus aureus subsp. aureus MW2
auuauuaugccuuugauuu

SEQ ID NO: 4035247 - RNA, 20 nt, Staphylococcus aureus subsp. aureus MW2
auuauuauucuaacuuugua

SEQ ID NO: 4035248 - RNA, 15 nt, Staphylococcus aureus subsp. aureus MW2
auuauuauuuaaauu

SEQ ID NO: 4035249 - RNA, 18 nt, Staphylococcus aureus subsp. aureus MW2
auuauucaaguaaaacau

SEQ ID NO: 4035250 - RNA, 14 nt, Staphylococcus aureus subsp. aureus MW2
auuauucguauuca

SEQ ID NO: 4035251 - RNA, 21 nt, Staphylococcus aureus subsp. aureus MW2
auuauucucucauuuguauag

SEQ ID NO: 4035252 - RNA, 19 nt, Staphylococcus aureus subsp. aureus MW2
auuauucuuaauuuaaaaa

SEQ ID NO: 4035253 - RNA, 19 nt, Staphylococcus aureus subsp. aureus MW2
auuauucuuuaauuaaauc

SEQ ID NO: 4035254 - RNA, 16 nt, Staphylococcus aureus subsp. aureus MW2
auuauucuuuauauuu

SEQ ID NO: 4035255 - RNA, 11 nt, Staphylococcus aureus subsp. aureus MW2
auuauucuuuc

SEQ ID NO: 4035256 - RNA, 18 nt, Staphylococcus aureus subsp. aureus MW2
auuauucuuucauagaaa

SEQ ID NO: 4035257 - RNA, 12 nt, Staphylococcus aureus subsp. aureus MW2
auuauugaaacu

SEQ ID NO: 4035258 - RNA, 18 nt, Staphylococcus aureus subsp. aureus MW2
auuauugaaacuaauaau

SEQ ID NO: 4035259 - RNA, 20 nt, Staphylococcus aureus subsp. aureus MW2
auuauugaaaucgauacuaa

SEQ ID NO: 4035260 - RNA, 22 nt, Staphylococcus aureus subsp. aureus MW2
auuauugaaaucgauacuaaua

SEQ ID NO: 4035261 - RNA, 13 nt, Staphylococcus aureus subsp. aureus MW2
auuauugaaauuu

SEQ ID NO: 4035262 - RNA, 12 nt, Staphylococcus aureus subsp. aureus MW2
auuauugaaguu

SEQ ID NO: 4035263 - RNA, 18 nt, Staphylococcus aureus subsp. aureus MW2
auuauugagaauauuuau

SEQ ID NO: 4035264 - RNA, 17 nt, Staphylococcus aureus subsp. aureus MW2
auuauugguugaaauua

SEQ ID NO: 4035265 - RNA, 18 nt, Staphylococcus aureus subsp. aureus MW2
auuauugucaucauguuc

SEQ ID NO: 4035266 - RNA, 14 nt, Staphylococcus aureus subsp. aureus MW2
auuauuuaaaacuu

SEQ ID NO: 4035267 - RNA, 14 nt, Staphylococcus aureus subsp. aureus MW2
auuauuuaaaaugc

SEQ ID NO: 4035268 - RNA, 16 nt, Staphylococcus aureus subsp. aureus MW2
auuauuuaaauuuuca

SEQ ID NO: 4035269 - RNA, 23 nt, Staphylococcus aureus subsp. aureus MW2
auuauuuagaauucuaaaagaau

SEQ ID NO: 4035270 - RNA, 21 nt, Staphylococcus aureus subsp. aureus MW2
auuauuuagauaaaaaauacu

SEQ ID NO: 4035271 - RNA, 16 nt, Staphylococcus aureus subsp. aureus MW2
auuauuuauucauuau

SEQ ID NO: 4035272 - RNA, 22 nt, Staphylococcus aureus subsp. aureus MW2
auuauuucaucggcuaagccau

SEQ ID NO: 4035273 - RNA, 23 nt, Staphylococcus aureus subsp. aureus MW2
auucuauguagcaggcaacuuuu

SEQ ID NO: 4035274 - RNA, 11 nt, Staphylococcus aureus subsp. aureus MW2
auucuauuuuu

SEQ ID NO: 4035275 - RNA, 15 nt, Staphylococcus aureus subsp. aureus MW2
auucucagucucuuu

SEQ ID NO: 4035276 - RNA, 20 nt, Staphylococcus aureus subsp. aureus MW2
auucucagucucuuugaagg

SEQ ID NO: 4035277 - RNA, 22 nt, Staphylococcus aureus subsp. aureus MW2
auucuccaacucuaacagcuua

SEQ ID NO: 4035278 - RNA, 14 nt, Staphylococcus aureus subsp. aureus MW2
auucuccuuuuguu

SEQ ID NO: 4035279 - RNA, 23 nt, Staphylococcus aureus subsp. aureus MW2
auucuccuuuuguuucaaauuuu

SEQ ID NO: 4035280 - RNA, 14 nt, Staphylococcus aureus subsp. aureus MW2
auucucgauuuuuu

SEQ ID NO: 4035281 - RNA, 17 nt, Staphylococcus aureus subsp. aureus MW2
auucucgauuuuuuuau

SEQ ID NO: 4035282 - RNA, 14 nt, Staphylococcus aureus subsp. aureus MW2
auucucgguuuuuu

SEQ ID NO: 4035283 - RNA, 17 nt, Staphylococcus aureus subsp. aureus MW2
auucucuaacuuuacca

SEQ ID NO: 4035284 - RNA, 22 nt, Staphylococcus aureus subsp. aureus MW2
auucucuuuauugggagcaauc

SEQ ID NO: 4035285 - RNA, 14 nt, Staphylococcus aureus subsp. aureus MW2
auucugaaaaauau

SEQ ID NO: 4035286 - RNA, 17 nt, Staphylococcus aureus subsp. aureus MW2
auucugaaaucaguuuu

SEQ ID NO: 4035287 - RNA, 18 nt, Staphylococcus aureus subsp. aureus MW2
auucugcaccuguuuuaa

SEQ ID NO: 4035288 - RNA, 14 nt, Staphylococcus aureus subsp. aureus MW2
auucuggaugguua

SEQ ID NO: 4035289 - RNA, 15 nt, Staphylococcus aureus subsp. aureus MW2
auucuuaauuuaaaa

SEQ ID NO: 4035290 - RNA, 14 nt, Staphylococcus aureus subsp. aureus MW2
auucuuagauauua

SEQ ID NO: 4035291 - RNA, 15 nt, Staphylococcus aureus subsp. aureus MW2
auucuuagauauuau

SEQ ID NO: 4035292 - RNA, 23 nt, Staphylococcus aureus subsp. aureus MW2
auucuuauaaaauaaaaaagcca

SEQ ID NO: 4035293 - RNA, 22 nt, Staphylococcus aureus subsp. aureus MW2
auucuuaucauuucaaauaaga

SEQ ID NO: 4035294 - RNA, 14 nt, Staphylococcus aureus subsp. aureus MW2
auucuucaccaacu

SEQ ID NO: 4035295 - RNA, 18 nt, Staphylococcus aureus subsp. aureus MW2
auucuucaccaguuugug

SEQ ID NO: 4035296 - RNA, 22 nt, Staphylococcus aureus subsp. aureus MW2
auucuucaucaauaacuauaau

SEQ ID NO: 4035297 - RNA, 12 nt, Staphylococcus aureus subsp. aureus MW2
auucuucauuua

SEQ ID NO: 4035298 - RNA, 14 nt, Staphylococcus aureus subsp. aureus MW2
auucuugaauaaau

SEQ ID NO: 4035299 - RNA, 18 nt, Staphylococcus aureus subsp. aureus MW2
auucuugaauaaauuuua

SEQ ID NO: 4035300 - RNA, 19 nt, Staphylococcus aureus subsp. aureus MW2
auucuugaauaaauuuuau

SEQ ID NO: 4035301 - RNA, 15 nt, Staphylococcus aureus subsp. aureus MW2
auucuuggcguauuu

SEQ ID NO: 4035302 - RNA, 16 nt, Staphylococcus aureus subsp. aureus MW2
auucuuggcguauuuu

SEQ ID NO: 4035303 - RNA, 18 nt, Staphylococcus aureus subsp. aureus MW2
auucuugguuuuuuagau

SEQ ID NO: 4035304 - RNA, 18 nt, Staphylococcus aureus subsp. aureus MW2
auucuuguuugauuuuag

SEQ ID NO: 4035305 - RNA, 15 nt, Staphylococcus aureus subsp. aureus MW2
auucuuuaauuaaau

SEQ ID NO: 4035306 - RNA, 23 nt, Staphylococcus aureus subsp. aureus MW2
auucuuuaccuuuaccaguauca

SEQ ID NO: 4035307 - RNA, 23 nt, Staphylococcus aureus subsp. aureus MW2
auucuuuauagaaaccaaaaaau

SEQ ID NO: 4035308 - RNA, 18 nt, Staphylococcus aureus subsp. aureus MW2
auucuuucuuuuuuacau

SEQ ID NO: 4035309 - RNA, 19 nt, Staphylococcus aureus subsp. aureus MW2
auucuuugagguguggugu

SEQ ID NO: 4035310 - RNA, 19 nt, Staphylococcus aureus subsp. aureus MW2
auucuuuguauuuauacua

SEQ ID NO: 4035311 - RNA, 21 nt, Staphylococcus aureus subsp. aureus MW2
auucuuuuaauagaucuuugu

SEQ ID NO: 4035312 - RNA, 14 nt, Staphylococcus aureus subsp. aureus MW2
auucuuuucaagaa

SEQ ID NO: 4035313 - RNA, 16 nt, Staphylococcus aureus subsp. aureus MW2
auucuuuuucaaaaua

SEQ ID NO: 4035314 - RNA, 17 nt, Staphylococcus aureus subsp. aureus MW2
auucuuuuucaaaauac

SEQ ID NO: 4035315 - RNA, 18 nt, Staphylococcus aureus subsp. aureus MW2
auucuuuuucaaaauacg

SEQ ID NO: 4035316 - RNA, 23 nt, Staphylococcus aureus subsp. aureus MW2
auugaaaaaauaacuguaaaaca

SEQ ID NO: 4035317 - RNA, 21 nt, Staphylococcus aureus subsp. aureus MW2
auugaaaaagacaauuucuau

SEQ ID NO: 4035318 - RNA, 17 nt, Staphylococcus aureus subsp. aureus MW2
auugaaaauauuuuauu

SEQ ID NO: 4035319 - RNA, 14 nt, Staphylococcus aureus subsp. aureus MW2
auugaaacuaauaa

SEQ ID NO: 4035320 - RNA, 13 nt, Staphylococcus aureus subsp. aureus MW2
auugaaagauauu

SEQ ID NO: 4035321 - RNA, 18 nt, Staphylococcus aureus subsp. aureus MW2
auugaaagauauuucugu

SEQ ID NO: 4035322 - RNA, 14 nt, Staphylococcus aureus subsp. aureus MW2
auugaaaugagcuu

SEQ ID NO: 4035323 - RNA, 15 nt, Staphylococcus aureus subsp. aureus MW2
auugaaaugauaaaa

SEQ ID NO: 4035324 - RNA, 15 nt, Staphylococcus aureus subsp. aureus MW2
auugaaaugauagau

SEQ ID NO: 4035325 - RNA, 21 nt, Staphylococcus aureus subsp. aureus MW2
auugaaauuauccuacugcug

SEQ ID NO: 4035326 - RNA, 15 nt, Staphylococcus aureus subsp. aureus MW2
auugaagaauauaaa

SEQ ID NO: 4035327 - RNA, 22 nt, Staphylococcus aureus subsp. aureus MW2
auugaagaauauaaacuauuaa

SEQ ID NO: 4035328 - RNA, 15 nt, Staphylococcus aureus subsp. aureus MW2
auugaauaaaaaaac

SEQ ID NO: 4035329 - RNA, 13 nt, Staphylococcus aureus subsp. aureus MW2
auugaauaugugu

SEQ ID NO: 4035330 - RNA, 13 nt, Staphylococcus aureus subsp. aureus MW2
auugaaucaaaua

SEQ ID NO: 4035331 - RNA, 12 nt, Staphylococcus aureus subsp. aureus MW2
auugaaugaagu

SEQ ID NO: 4035332 - RNA, 20 nt, Staphylococcus aureus subsp. aureus MW2
auugaaugaaguaggcugaa

SEQ ID NO: 4035333 - RNA, 14 nt, Staphylococcus aureus subsp. aureus MW2
auugaauugaaaaa

SEQ ID NO: 4035334 - RNA, 21 nt, Staphylococcus aureus subsp. aureus MW2
auugaauuguagauccaauuc

SEQ ID NO: 4035335 - RNA, 23 nt, Staphylococcus aureus subsp. aureus MW2
auugaauuguagauccaauuccu

SEQ ID NO: 4035336 - RNA, 18 nt, Staphylococcus aureus subsp. aureus MW2
auugacuuacauuuuaau

SEQ ID NO: 4035337 - RNA, 23 nt, Staphylococcus aureus subsp. aureus MW2
auugacuuacauuuuaauaaaau

SEQ ID NO: 4035338 - RNA, 14 nt, Staphylococcus aureus subsp. aureus MW2
auugaguaucaugc

SEQ ID NO: 4035339 - RNA, 14 nt, Staphylococcus aureus subsp. aureus MW2
auugaguuguugca

SEQ ID NO: 4035340 - RNA, 15 nt, Staphylococcus aureus subsp. aureus MW2
auugaguuuuuuaaa

SEQ ID NO: 4035341 - RNA, 17 nt, Staphylococcus aureus subsp. aureus MW2
auugauagauagaaauu

SEQ ID NO: 4035342 - RNA, 14 nt, Staphylococcus aureus subsp. aureus MW2
auugauaucccuaa

SEQ ID NO: 4035343 - RNA, 22 nt, Staphylococcus aureus subsp. aureus MW2
auugauaugguuagaaaaaaau

SEQ ID NO: 4035344 - RNA, 16 nt, Staphylococcus aureus subsp. aureus MW2
auugauauuaauauau

SEQ ID NO: 4035345 - RNA, 12 nt, Staphylococcus aureus subsp. aureus MW2
auugaucugauu

SEQ ID NO: 4035346 - RNA, 15 nt, Staphylococcus aureus subsp. aureus MW2
auugaugaauaaaua

SEQ ID NO: 4035347 - RNA, 13 nt, Staphylococcus aureus subsp. aureus MW2
auugaugacugcu

SEQ ID NO: 4035348 - RNA, 18 nt, Staphylococcus aureus subsp. aureus MW2
auugaugucacauaugac

SEQ ID NO: 4035349 - RNA, 16 nt, Staphylococcus aureus subsp. aureus MW2
auugauucuagugaaa

SEQ ID NO: 4035350 - RNA, 19 nt, Staphylococcus aureus subsp. aureus MW2
auugauugcucuaagcauu

SEQ ID NO: 4035351 - RNA, 17 nt, Staphylococcus aureus subsp. aureus MW2
auugauuucagcaccga

SEQ ID NO: 4035352 - RNA, 21 nt, Staphylococcus aureus subsp. aureus MW2
auugauuucuguaccaaauuu

SEQ ID NO: 4035353 - RNA, 22 nt, Staphylococcus aureus subsp. aureus MW2
auugauuugggcgcuuuuuaau

SEQ ID NO: 4035354 - RNA, 21 nt, Staphylococcus aureus subsp. aureus MW2
auugcaacgcaucacaaaauu

SEQ ID NO: 4035355 - RNA, 19 nt, Staphylococcus aureus subsp. aureus MW2
auugcaaugcuaucaugcc

SEQ ID NO: 4035356 - RNA, 21 nt, Staphylococcus aureus subsp. aureus MW2
auugcacuaugcauaauacca

SEQ ID NO: 4035357 - RNA, 22 nt, Staphylococcus aureus subsp. aureus MW2
auugcacuaugcauaauaccaa

SEQ ID NO: 4035358 - RNA, 23 nt, Staphylococcus aureus subsp. aureus MW2
auugcacuaugcauaauaccaau

SEQ ID NO: 4035359 - RNA, 14 nt, Staphylococcus aureus subsp. aureus MW2
auugcacuuacugc

SEQ ID NO: 4035360 - RNA, 23 nt, Staphylococcus aureus subsp. aureus MW2
auugcagguaaacggaauaacuu

SEQ ID NO: 4035361 - RNA, 13 nt, Staphylococcus aureus subsp. aureus MW2
auuuaaauuuuca

SEQ ID NO: 4035362 - RNA, 17 nt, Staphylococcus aureus subsp. aureus MW2
auuuaacauuuuuuuca

SEQ ID NO: 4035363 - RNA, 21 nt, Staphylococcus aureus subsp. aureus MW2
auuuaacgucuaccucuagga

SEQ ID NO: 4035364 - RNA, 17 nt, Staphylococcus aureus subsp. aureus MW2
auuuaacuaugaaauug

SEQ ID NO: 4035365 - RNA, 17 nt, Staphylococcus aureus subsp. aureus MW2
auuuaacucaacuuaaa

SEQ ID NO: 4035366 - RNA, 19 nt, Staphylococcus aureus subsp. aureus MW2
auuuaacugggcaacuuuu

SEQ ID NO: 4035367 - RNA, 16 nt, Staphylococcus aureus subsp. aureus MW2
auuuaagaaacgucuu

SEQ ID NO: 4035368 - RNA, 23 nt, Staphylococcus aureus subsp. aureus MW2
auuuaagaaugcgaagauuuuua

SEQ ID NO: 4035369 - RNA, 14 nt, Staphylococcus aureus subsp. aureus MW2
auuuaagauuuaau

SEQ ID NO: 4035370 - RNA, 23 nt, Staphylococcus aureus subsp. aureus MW2
auuuaaggauaaugguuucaaaa

SEQ ID NO: 4035371 - RNA, 14 nt, Staphylococcus aureus subsp. aureus MW2
auuuaaguucuucu

SEQ ID NO: 4035372 - RNA, 13 nt, Staphylococcus aureus subsp. aureus MW2
auuuaauaacgaa

SEQ ID NO: 4035373 - RNA, 15 nt, Staphylococcus aureus subsp. aureus MW2
auuuaauaaguuaau

SEQ ID NO: 4035374 - RNA, 20 nt, Staphylococcus aureus subsp. aureus MW2
auuuaauaaguuaauguaau

SEQ ID NO: 4035375 - RNA, 13 nt, Staphylococcus aureus subsp. aureus MW2
auuuaauaaugcu

SEQ ID NO: 4035376 - RNA, 13 nt, Staphylococcus aureus subsp. aureus MW2
auuuaauagacau

SEQ ID NO: 4035377 - RNA, 19 nt, Staphylococcus aureus subsp. aureus MW2
auuuaauaucacgaucuuu

SEQ ID NO: 4035378 - RNA, 19 nt, Staphylococcus aureus subsp. aureus MW2
auuuaauauugaauaaaaa

SEQ ID NO: 4035379 - RNA, 15 nt, Staphylococcus aureus subsp. aureus MW2
auuuaauauuguuaa

SEQ ID NO: 4035380 - RNA, 18 nt, Staphylococcus aureus subsp. aureus MW2
auuuaauucugguuuaau

SEQ ID NO: 4035381 - RNA, 18 nt, Staphylococcus aureus subsp. aureus MW2
auuuaauuuguuauacca

SEQ ID NO: 4035382 - RNA, 18 nt, Staphylococcus aureus subsp. aureus MW2
auuuaauuuuaauaacca

SEQ ID NO: 4035383 - RNA, 18 nt, Staphylococcus aureus subsp. aureus MW2
auuuacagcgauuguuaa

SEQ ID NO: 4035384 - RNA, 18 nt, Staphylococcus aureus subsp. aureus MW2
auuuaccgucuuaugaua

SEQ ID NO: 4035385 - RNA, 15 nt, Staphylococcus aureus subsp. aureus MW2
auuuaccuucaucuu

SEQ ID NO: 4035386 - RNA, 21 nt, Staphylococcus aureus subsp. aureus MW2
auuuaccuucaucuuuuuuau

SEQ ID NO: 4035387 - RNA, 20 nt, Staphylococcus aureus subsp. aureus MW2
auuuacggcauaauuuuuua

SEQ ID NO: 4035388 - RNA, 15 nt, Staphylococcus aureus subsp. aureus MW2
auuuacuugauuaga

SEQ ID NO: 4035389 - RNA, 22 nt, Staphylococcus aureus subsp. aureus MW2
auuuacuugauuagauuugugu

SEQ ID NO: 4035390 - RNA, 19 nt, Staphylococcus aureus subsp. aureus MW2
auuuagaagauuagaugau

SEQ ID NO: 4035391 - RNA, 18 nt, Staphylococcus aureus subsp. aureus MW2
auuuagaauaaacuuuau

SEQ ID NO: 4035392 - RNA, 20 nt, Staphylococcus aureus subsp. aureus MW2
auuuagaauaaacuuuaugg

SEQ ID NO: 4035393 - RNA, 19 nt, Staphylococcus aureus subsp. aureus MW2
auuuagaauucuaaaagaa

SEQ ID NO: 4035394 - RNA, 20 nt, Staphylococcus aureus subsp. aureus MW2
auuuagaauucuaaaagaau

SEQ ID NO: 4035395 - RNA, 20 nt, Staphylococcus aureus subsp. aureus MW2
auuuagacuuggauaaaaau

SEQ ID NO: 4035396 - RNA, 20 nt, Staphylococcus aureus subsp. aureus MW2
auuuagauagcggauuuauu

SEQ ID NO: 4035397 - RNA, 17 nt, Staphylococcus aureus subsp. aureus MW2
auuuagauauaauaaaa

SEQ ID NO: 4035398 - RNA, 17 nt, Staphylococcus aureus subsp. aureus MW2
auuuagaugauucuuau

SEQ ID NO: 4035399 - RNA, 22 nt, Staphylococcus aureus subsp. aureus MW2
auuuagaugcauaaaaaaagaa

SEQ ID NO: 4035400 - RNA, 18 nt, Staphylococcus aureus subsp. aureus MW2
auuuagauuggucaaacu

SEQ ID NO: 4035401 - RNA, 17 nt, Staphylococcus aureus subsp. aureus MW2
auuuagauuuauaacga

SEQ ID NO: 4035402 - RNA, 23 nt, Staphylococcus aureus subsp. aureus MW2
auuuagcauacauuaagcuaugc

SEQ ID NO: 4035403 - RNA, 19 nt, Staphylococcus aureus subsp. aureus MW2
auuuagcaucaaaaauaaa

SEQ ID NO: 4035404 - RNA, 19 nt, Staphylococcus aureus subsp. aureus MW2
auuuaggaguauccugauu

SEQ ID NO: 4035405 - RNA, 18 nt, Staphylococcus aureus subsp. aureus MW2
auuuaggcaugucaaauc

SEQ ID NO: 4035406 - RNA, 15 nt, Staphylococcus aureus subsp. aureus MW2
auuuagguuaauuaa

SEQ ID NO: 4035407 - RNA, 19 nt, Staphylococcus aureus subsp. aureus MW2
auuuagguuaauuaaacaa

SEQ ID NO: 4035408 - RNA, 17 nt, Staphylococcus aureus subsp. aureus MW2
auuuaguacauagaccu

SEQ ID NO: 4035409 - RNA, 18 nt, Staphylococcus aureus subsp. aureus MW2
auuuaguacucaauguua

SEQ ID NO: 4035410 - RNA, 17 nt, Staphylococcus aureus subsp. aureus MW2
auuuaguaucuauacaa

SEQ ID NO: 4035411 - RNA, 13 nt, Staphylococcus aureus subsp. aureus MW2
auuuaguuaaaua

SEQ ID NO: 4035412 - RNA, 15 nt, Staphylococcus aureus subsp. aureus MW2
auuuaguuaaauaca

SEQ ID NO: 4035413 - RNA, 17 nt, Staphylococcus aureus subsp. aureus MW2
auuuaguuagcccuauu

SEQ ID NO: 4035414 - RNA, 17 nt, Staphylococcus aureus subsp. aureus MW2
auuuaguuggacaaauu

SEQ ID NO: 4035415 - RNA, 14 nt, Staphylococcus aureus subsp. aureus MW2
auuuaguuuuaaua

SEQ ID NO: 4035416 - RNA, 18 nt, Staphylococcus aureus subsp. aureus MW2
auuuauaacauuuaagaa

SEQ ID NO: 4035417 - RNA, 13 nt, Staphylococcus aureus subsp. aureus MW2
auuuauaacuuag

SEQ ID NO: 4035418 - RNA, 16 nt, Staphylococcus aureus subsp. aureus MW2
auuuauaaugauuaaa

SEQ ID NO: 4035419 - RNA, 14 nt, Staphylococcus aureus subsp. aureus MW2
auuuauagcaucaa

SEQ ID NO: 4035420 - RNA, 16 nt, Staphylococcus aureus subsp. aureus MW2
auuuauauuaaauaaa

SEQ ID NO: 4035421 - RNA, 20 nt, Staphylococcus aureus subsp. aureus MW2
auuuauauuccauuucaaau

SEQ ID NO: 4035422 - RNA, 15 nt, Staphylococcus aureus subsp. aureus MW2
auuuauauuuagaau

SEQ ID NO: 4035423 - RNA, 17 nt, Staphylococcus aureus subsp. aureus MW2
auuuauauuuuuuguac

SEQ ID NO: 4035424 - RNA, 17 nt, Staphylococcus aureus subsp. aureus MW2
auuuaucaauuucuauu

SEQ ID NO: 4035425 - RNA, 18 nt, Staphylococcus aureus subsp. aureus MW2
auuuaucaauuucuauuu

SEQ ID NO: 4035426 - RNA, 15 nt, Staphylococcus aureus subsp. aureus MW2
auuuaucauuauuua

SEQ ID NO: 4035427 - RNA, 16 nt, Staphylococcus aureus subsp. aureus MW2
auuuauccugaccaag

SEQ ID NO: 4035428 - RNA, 19 nt, Staphylococcus aureus subsp. aureus MW2
auuuaucgagaacaucauc

SEQ ID NO: 4035429 - RNA, 22 nt, Staphylococcus aureus subsp. aureus MW2
auuuaucgcgauuauuaccaua

SEQ ID NO: 4035430 - RNA, 20 nt, Staphylococcus aureus subsp. aureus MW2
auuuaucugcgaaaugcauu

SEQ ID NO: 4035431 - RNA, 21 nt, Staphylococcus aureus subsp. aureus MW2
auuuaucuuuagagacuuauu

SEQ ID NO: 4035432 - RNA, 19 nt, Staphylococcus aureus subsp. aureus MW2
auuuaugugcaaucaugcu

SEQ ID NO: 4035433 - RNA, 17 nt, Staphylococcus aureus subsp. aureus MW2
auuuauguguuggcuuu

SEQ ID NO: 4035434 - RNA, 21 nt, Staphylococcus aureus subsp. aureus MW2
auuuauguguugugauauaua

SEQ ID NO: 4035435 - RNA, 22 nt, Staphylococcus aureus subsp. aureus MW2
auuuauguucgauuauucuuaa

SEQ ID NO: 4035436 - RNA, 15 nt, Staphylococcus aureus subsp. aureus MW2
auuuauuaacucaug

SEQ ID NO: 4035437 - RNA, 14 nt, Staphylococcus aureus subsp. aureus MW2
auuuauuaguuuuu

SEQ ID NO: 4035438 - RNA, 15 nt, Staphylococcus aureus subsp. aureus MW2
auuuauuauaaaaua

SEQ ID NO: 4035439 - RNA, 14 nt, Staphylococcus aureus subsp. aureus MW2
auuuauuauuacca

SEQ ID NO: 4035440 - RNA, 16 nt, Staphylococcus aureus subsp. aureus MW2
auuuauuguuuuuaaa

SEQ ID NO: 4035441 - RNA, 17 nt, Staphylococcus aureus subsp. aureus MW2
auuuauuuauaaaauaa

SEQ ID NO: 4035442 - RNA, 20 nt, Staphylococcus aureus subsp. aureus MW2
auuuauuuauaaaauaaaau

SEQ ID NO: 4035443 - RNA, 21 nt, Staphylococcus aureus subsp. aureus MW2
auuuauuuauaaaauaaaaug

SEQ ID NO: 4035444 - RNA, 19 nt, Staphylococcus aureus subsp. aureus MW2
auuuauuucgucgucccac

SEQ ID NO: 4035445 - RNA, 23 nt, Staphylococcus aureus subsp. aureus MW2
auuuauuucuuuuugucauuaau

SEQ ID NO: 4035446 - RNA, 13 nt, Staphylococcus aureus subsp. aureus MW2
auuuauuuuaaau

SEQ ID NO: 4035447 - RNA, 14 nt, Staphylococcus aureus subsp. aureus MW2
auuuauuuugauua

SEQ ID NO: 4035448 - RNA, 12 nt, Staphylococcus aureus subsp. aureus MW2
auuuauuuuuga

SEQ ID NO: 4035449 - RNA, 18 nt, Staphylococcus aureus subsp. aureus MW2
auuuggaauacuuuucuu

SEQ ID NO: 4035450 - RNA, 15 nt, Staphylococcus aureus subsp. aureus MW2
auuuggcguaaugau

SEQ ID NO: 4035451 - RNA, 20 nt, Staphylococcus aureus subsp. aureus MW2
auuugggucguuagaugaau

SEQ ID NO: 4035452 - RNA, 23 nt, Staphylococcus aureus subsp. aureus MW2
auuugguggagaaccauauuuac

SEQ ID NO: 4035453 - RNA, 16 nt, Staphylococcus aureus subsp. aureus MW2
auuugguuaauacguu

SEQ ID NO: 4035454 - RNA, 15 nt, Staphylococcus aureus subsp. aureus MW2
auuuguaaauauuuu

SEQ ID NO: 4035455 - RNA, 18 nt, Staphylococcus aureus subsp. aureus MW2
auuuguaaauauuuuuua

SEQ ID NO: 4035456 - RNA, 21 nt, Staphylococcus aureus subsp. aureus MW2
auuuguaaccccauuuuaaag

SEQ ID NO: 4035457 - RNA, 13 nt, Staphylococcus aureus subsp. aureus MW2
auuuguaauacaa

SEQ ID NO: 4035458 - RNA, 14 nt, Staphylococcus aureus subsp. aureus MW2
auuuguaauacaag

SEQ ID NO: 4035459 - RNA, 24 nt, Staphylococcus aureus subsp. aureus MW2
auuuguaauuccucuggaacuuua

SEQ ID NO: 4035460 - RNA, 21 nt, Staphylococcus aureus subsp. aureus MW2
auuuguagcuugaauaauaua

SEQ ID NO: 4035461 - RNA, 22 nt, Staphylococcus aureus subsp. aureus MW2
auuuguagcuugaauaauauau

SEQ ID NO: 4035462 - RNA, 17 nt, Staphylococcus aureus subsp. aureus MW2
auuuguaguaaguagaa

SEQ ID NO: 4035463 - RNA, 17 nt, Staphylococcus aureus subsp. aureus MW2
auuuguauagauuguau

SEQ ID NO: 4035464 - RNA, 15 nt, Staphylococcus aureus subsp. aureus MW2
auuuguauuauaugg

SEQ ID NO: 4035465 - RNA, 19 nt, Staphylococcus aureus subsp. aureus MW2
auuugucauaauagauaau

SEQ ID NO: 4035466 - RNA, 22 nt, Staphylococcus aureus subsp. aureus MW2
auuugucauaauagauaaugca

SEQ ID NO: 4035467 - RNA, 19 nt, Staphylococcus aureus subsp. aureus MW2
auuugugguaaucauguaa

SEQ ID NO: 4035468 - RNA, 15 nt, Staphylococcus aureus subsp. aureus MW2
auuuguguauaaaug

SEQ ID NO: 4035469 - RNA, 14 nt, Staphylococcus aureus subsp. aureus MW2
auuuguuaaauuca

SEQ ID NO: 4035470 - RNA, 18 nt, Staphylococcus aureus subsp. aureus MW2
auuuguuaauuuaauaau

SEQ ID NO: 4035471 - RNA, 19 nt, Staphylococcus aureus subsp. aureus MW2
auuuguuaauuuaauaauu

SEQ ID NO: 4035472 - RNA, 13 nt, Staphylococcus aureus subsp. aureus MW2
auuuguugauagu

SEQ ID NO: 4035473 - RNA, 13 nt, Staphylococcus aureus subsp. aureus MW2
auuuguuuuaaau

SEQ ID NO: 4035474 - RNA, 16 nt, Staphylococcus aureus subsp. aureus MW2
auuuguuuuaaauacu

SEQ ID NO: 4035475 - RNA, 16 nt, Staphylococcus aureus subsp. aureus MW2
auuuuaaaagauaaau

SEQ ID NO: 4035476 - RNA, 14 nt, Staphylococcus aureus subsp. aureus MW2
auuuuaaacaugaa

SEQ ID NO: 4035477 - RNA, 17 nt, Staphylococcus aureus subsp. aureus MW2
auuuuaaauaaaaugca

SEQ ID NO: 4035478 - RNA, 21 nt, Staphylococcus aureus subsp. aureus MW2
auuuuaaauauugauauaaaa

SEQ ID NO: 4035479 - RNA, 12 nt, Staphylococcus aureus subsp. aureus MW2
auuuuaaaucuu

SEQ ID NO: 4035480 - RNA, 15 nt, Staphylococcus aureus subsp. aureus MW2
auuuuaaauuuaauu

SEQ ID NO: 4035481 - RNA, 13 nt, Staphylococcus aureus subsp. aureus MW2
auuuuaaauuuuu

SEQ ID NO: 4035482 - RNA, 14 nt, Staphylococcus aureus subsp. aureus MW2
auuuuaacaaguga

SEQ ID NO: 4035483 - RNA, 13 nt, Staphylococcus aureus subsp. aureus MW2
auuuuaacuuaua

SEQ ID NO: 4035484 - RNA, 15 nt, Staphylococcus aureus subsp. aureus MW2
auuuuaacuuauaua

SEQ ID NO: 4035485 - RNA, 14 nt, Staphylococcus aureus subsp. aureus MW2
auuuuaacuuuaua

SEQ ID NO: 4035486 - RNA, 19 nt, Staphylococcus aureus subsp. aureus MW2
auuuuaauaaaaucaucuu

SEQ ID NO: 4035487 - RNA, 15 nt, Staphylococcus aureus subsp. aureus MW2
auuuuaauaacaagu

SEQ ID NO: 4035488 - RNA, 20 nt, Staphylococcus aureus subsp. aureus MW2
auuuuaauagguuaguaaua

SEQ ID NO: 4035489 - RNA, 17 nt, Staphylococcus aureus subsp. aureus MW2
auuuuaauaguuuuaau

SEQ ID NO: 4035490 - RNA, 15 nt, Staphylococcus aureus subsp. aureus MW2
auuuuaauauuaugu

SEQ ID NO: 4035491 - RNA, 21 nt, Staphylococcus aureus subsp. aureus MW2
auuuuaauauugaaaugagcu

SEQ ID NO: 4035492 - RNA, 17 nt, Staphylococcus aureus subsp. aureus MW2
auuuuaauuuuucauua

SEQ ID NO: 4035493 - RNA, 18 nt, Staphylococcus aureus subsp. aureus MW2
auuuuacaaaauauggaa

SEQ ID NO: 4035494 - RNA, 16 nt, Staphylococcus aureus subsp. aureus MW2
auuuuacaaucaacuu

SEQ ID NO: 4035495 - RNA, 14 nt, Staphylococcus aureus subsp. aureus MW2
auuuuaccaucaau

SEQ ID NO: 4035496 - RNA, 23 nt, Staphylococcus aureus subsp. aureus MW2
auuuuaccuguuucuauauuaau

SEQ ID NO: 4035497 - RNA, 23 nt, Staphylococcus aureus subsp. aureus MW2
auuuuaccuugagcagcaucaau

SEQ ID NO: 4035498 - RNA, 18 nt, Staphylococcus aureus subsp. aureus MW2
auuuuacgcuuacuuaua

SEQ ID NO: 4035499 - RNA, 19 nt, Staphylococcus aureus subsp. aureus MW2
auuuuacgcuuacuuauau

SEQ ID NO: 4035500 - RNA, 16 nt, Staphylococcus aureus subsp. aureus MW2
auuuuacgcuuuuucu

SEQ ID NO: 4035501 - RNA, 21 nt, Staphylococcus aureus subsp. aureus MW2
auuuuacuugaauauagcugu

SEQ ID NO: 4035502 - RNA, 15 nt, Staphylococcus aureus subsp. aureus MW2
auuuuaggcauuuua

SEQ ID NO: 4035503 - RNA, 18 nt, Staphylococcus aureus subsp. aureus MW2
auuuuaggccacacauca

SEQ ID NO: 4035504 - RNA, 15 nt, Staphylococcus aureus subsp. aureus MW2
auuuuaguacuuaau

SEQ ID NO: 4035505 - RNA, 18 nt, Staphylococcus aureus subsp. aureus MW2
auuuuaguacuuaauacu

SEQ ID NO: 4035506 - RNA, 22 nt, Staphylococcus aureus subsp. aureus MW2
auuuuaguucacaugaauuuua

SEQ ID NO: 4035507 - RNA, 12 nt, Staphylococcus aureus subsp. aureus MW2
auuuuauaaaaa

SEQ ID NO: 4035508 - RNA, 18 nt, Staphylococcus aureus subsp. aureus MW2
auuuuauauaaaaagaag

SEQ ID NO: 4035509 - RNA, 12 nt, Staphylococcus aureus subsp. aureus MW2
auuuuauauuuu

SEQ ID NO: 4035510 - RNA, 23 nt, Staphylococcus aureus subsp. aureus MW2
auuuuauccaaaccaauuuuaac

SEQ ID NO: 4035511 - RNA, 16 nt, Staphylococcus aureus subsp. aureus MW2
auuuuaucuaaacauu

SEQ ID NO: 4035512 - RNA, 23 nt, Staphylococcus aureus subsp. aureus MW2
auuuuaucuaaagcuauaaaaaa

SEQ ID NO: 4035513 - RNA, 15 nt, Staphylococcus aureus subsp. aureus MW2
auuuuaucugaaaau

SEQ ID NO: 4035514 - RNA, 16 nt, Staphylococcus aureus subsp. aureus MW2
auuuuaucugaaaaua

SEQ ID NO: 4035515 - RNA, 18 nt, Staphylococcus aureus subsp. aureus MW2
auuuuaucugaaucugcu

SEQ ID NO: 4035516 - RNA, 15 nt, Staphylococcus aureus subsp. aureus MW2
auuuuaugaaucgaa

SEQ ID NO: 4035517 - RNA, 15 nt, Staphylococcus aureus subsp. aureus MW2
auuuuaugauuugau

SEQ ID NO: 4035518 - RNA, 16 nt, Staphylococcus aureus subsp. aureus MW2
auuuuaugauuugauu

SEQ ID NO: 4035519 - RNA, 18 nt, Staphylococcus aureus subsp. aureus MW2
auuuuauguccagccauu

SEQ ID NO: 4035520 - RNA, 19 nt, Staphylococcus aureus subsp. aureus MW2
auuuuauuagaucacuauu

SEQ ID NO: 4035521 - RNA, 21 nt, Staphylococcus aureus subsp. aureus MW2
auuuuauuagguaauacuuuu

SEQ ID NO: 4035522 - RNA, 14 nt, Staphylococcus aureus subsp. aureus MW2
auuuuauuauaaua

SEQ ID NO: 4035523 - RNA, 13 nt, Staphylococcus aureus subsp. aureus MW2
auuuuauucuuca

SEQ ID NO: 4035524 - RNA, 20 nt, Staphylococcus aureus subsp. aureus MW2
auuuuauugaguaucaugcu

SEQ ID NO: 4035525 - RNA, 15 nt, Staphylococcus aureus subsp. aureus MW2
auuuuauuuaaaaau

SEQ ID NO: 4035526 - RNA, 20 nt, Staphylococcus aureus subsp. aureus MW2
auuuuauuuugugcuuuuuu

SEQ ID NO: 4035527 - RNA, 19 nt, Staphylococcus aureus subsp. aureus MW2
auuuuauuuuuuagcacau

SEQ ID NO: 4035528 - RNA, 20 nt, Staphylococcus aureus subsp. aureus MW2
auuuuauuuuuuagcacauc

SEQ ID NO: 4035529 - RNA, 11 nt, Staphylococcus aureus subsp. aureus MW2
auuuucaaaac

SEQ ID NO: 4035530 - RNA, 19 nt, Staphylococcus aureus subsp. aureus MW2
auuuucaaagcugccaaaa

SEQ ID NO: 4035531 - RNA, 23 nt, Staphylococcus aureus subsp. aureus MW2
auuuucaaauuucuaacuuguuu

SEQ ID NO: 4035532 - RNA, 19 nt, Staphylococcus aureus subsp. aureus MW2
auuuucaagaccaaauauu

SEQ ID NO: 4035533 - RNA, 20 nt, Staphylococcus aureus subsp. aureus MW2
auuuucaaguaaugauauua

SEQ ID NO: 4035534 - RNA, 16 nt, Staphylococcus aureus subsp. aureus MW2
auuuucaauaaaaaug

SEQ ID NO: 4035535 - RNA, 16 nt, Staphylococcus aureus subsp. aureus MW2
auuuucaauaaauuuu

SEQ ID NO: 4035536 - RNA, 18 nt, Staphylococcus aureus subsp. aureus MW2
auuuucaauaaauuuuau

SEQ ID NO: 4035537 - RNA, 21 nt, Staphylococcus aureus subsp. aureus MW2
auuuucaauaaauuuuauaua

SEQ ID NO: 4035538 - RNA, 15 nt, Staphylococcus aureus subsp. aureus MW2
auuuuuuagcacauc

SEQ ID NO: 4035539 - RNA, 12 nt, Staphylococcus aureus subsp. aureus MW2
auuuuuugauau

SEQ ID NO: 4035540 - RNA, 12 nt, Staphylococcus aureus subsp. aureus MW2
auuuuuuuaaau

SEQ ID NO: 4035541 - RNA, 21 nt, Staphylococcus aureus subsp. aureus MW2
auuuuuuuaaaucuauauaaa

SEQ ID NO: 4035542 - RNA, 13 nt, Staphylococcus aureus subsp. aureus MW2
auuuuuuuagaag

SEQ ID NO: 4035543 - RNA, 16 nt, Staphylococcus aureus subsp. aureus MW2
auuuuuuuauguuaua

SEQ ID NO: 4035544 - RNA, 18 nt, Staphylococcus aureus subsp. aureus MW2
auuuuuuuccaagcauca

SEQ ID NO: 4035545 - RNA, 21 nt, Staphylococcus aureus subsp. aureus MW2
auuuuuuucguaacauuuaaa

SEQ ID NO: 4035546 - RNA, 21 nt, Staphylococcus aureus subsp. aureus MW2
auuuuuuuguugguuuuuaaa

SEQ ID NO: 4035547 - RNA, 23 nt, Staphylococcus aureus subsp. aureus MW2
auuuuuuuguugguuuuuaaaag

SEQ ID NO: 4035548 - RNA, 18 nt, Staphylococcus aureus subsp. aureus MW2
caaaaaaacaaaaaauaa

SEQ ID NO: 4035549 - RNA, 19 nt, Staphylococcus aureus subsp. aureus MW2
caaaaaaacaaaaaauaau

SEQ ID NO: 4035550 - RNA, 12 nt, Staphylococcus aureus subsp. aureus MW2
caaaaaauaaua

SEQ ID NO: 4035551 - RNA, 21 nt, Staphylococcus aureus subsp. aureus MW2
caaaaaauaauagcaaaauua

SEQ ID NO: 4035552 - RNA, 13 nt, Staphylococcus aureus subsp. aureus MW2
caaacguuguuca

SEQ ID NO: 4035553 - RNA, 15 nt, Staphylococcus aureus subsp. aureus MW2
caaacuugauucaau

SEQ ID NO: 4035554 - RNA, 17 nt, Staphylococcus aureus subsp. aureus MW2
caaacuuuucaauauua

SEQ ID NO: 4035555 - RNA, 20 nt, Staphylococcus aureus subsp. aureus MW2
caaagaaagcuaauaucaau

SEQ ID NO: 4035556 - RNA, 18 nt, Staphylococcus aureus subsp. aureus MW2
caaagaaauguaugacau

SEQ ID NO: 4035557 - RNA, 15 nt, Staphylococcus aureus subsp. aureus MW2
caaagacauacaguc

SEQ ID NO: 4035558 - RNA, 19 nt, Staphylococcus aureus subsp. aureus MW2
caaagacauacagucaaua

SEQ ID NO: 4035559 - RNA, 22 nt, Staphylococcus aureus subsp. aureus MW2
caaagacauacagucaauacaa

SEQ ID NO: 4035560 - RNA, 17 nt, Staphylococcus aureus subsp. aureus MW2
caaagacuaaaaagaag

SEQ ID NO: 4035561 - RNA, 16 nt, Staphylococcus aureus subsp. aureus MW2
caaagacucaauuuca

SEQ ID NO: 4035562 - RNA, 17 nt, Staphylococcus aureus subsp. aureus MW2
caaagaggaacagugga

SEQ ID NO: 4035563 - RNA, 18 nt, Staphylococcus aureus subsp. aureus MW2
caaagaggcuuuaaaauu

SEQ ID NO: 4035564 - RNA, 17 nt, Staphylococcus aureus subsp. aureus MW2
caaagauacaccaauau

SEQ ID NO: 4035565 - RNA, 17 nt, Staphylococcus aureus subsp. aureus MW2
caaagaugauacccaau

SEQ ID NO: 4035566 - RNA, 19 nt, Staphylococcus aureus subsp. aureus MW2
caaagauuccuguaacaag

SEQ ID NO: 4035567 - RNA, 19 nt, Staphylococcus aureus subsp. aureus MW2
caaagcaucuaauccccaa

SEQ ID NO: 4035568 - RNA, 20 nt, Staphylococcus aureus subsp. aureus MW2
caaagccuucuaucucuuua

SEQ ID NO: 4035569 - RNA, 20 nt, Staphylococcus aureus subsp. aureus MW2
caaagcuuguaaucauacca

SEQ ID NO: 4035570 - RNA, 16 nt, Staphylococcus aureus subsp. aureus MW2
caaaggauauugaaaa

SEQ ID NO: 4035571 - RNA, 14 nt, Staphylococcus aureus subsp. aureus MW2
caaaggcuucaugu

SEQ ID NO: 4035572 - RNA, 17 nt, Staphylococcus aureus subsp. aureus MW2
caaagggcgaaauggau

SEQ ID NO: 4035573 - RNA, 22 nt, Staphylococcus aureus subsp. aureus MW2
caaaguaacauaugcaaguaua

SEQ ID NO: 4035574 - RNA, 20 nt, Staphylococcus aureus subsp. aureus MW2
caaaguaccaucucuauuuu

SEQ ID NO: 4035575 - RNA, 13 nt, Staphylococcus aureus subsp. aureus MW2
caaaguuaaucau

SEQ ID NO: 4035576 - RNA, 19 nt, Staphylococcus aureus subsp. aureus MW2
caaaguuuauacuuaauau

SEQ ID NO: 4035577 - RNA, 14 nt, Staphylococcus aureus subsp. aureus MW2
caaauaaaacgcuu

SEQ ID NO: 4035578 - RNA, 12 nt, Staphylococcus aureus subsp. aureus MW2
caaauaaaauca

SEQ ID NO: 4035579 - RNA, 19 nt, Staphylococcus aureus subsp. aureus MW2
caaauaaaaucauaacgac

SEQ ID NO: 4035580 - RNA, 20 nt, Staphylococcus aureus subsp. aureus MW2
caaauaaacacccaauaauu

SEQ ID NO: 4035581 - RNA, 21 nt, Staphylococcus aureus subsp. aureus MW2
caaauaaacacccaauaauug

SEQ ID NO: 4035582 - RNA, 14 nt, Staphylococcus aureus subsp. aureus MW2
caaauaaauauaaa

SEQ ID NO: 4035583 - RNA, 15 nt, Staphylococcus aureus subsp. aureus MW2
caaauaaauguccga

SEQ ID NO: 4035584 - RNA, 15 nt, Staphylococcus aureus subsp. aureus MW2
caaauaacaaacauu

SEQ ID NO: 4035585 - RNA, 15 nt, Staphylococcus aureus subsp. aureus MW2
caaauaacguuaaua

SEQ ID NO: 4035586 - RNA, 18 nt, Staphylococcus aureus subsp. aureus MW2
caaauaaggaauguauuu

SEQ ID NO: 4035587 - RNA, 20 nt, Staphylococcus aureus subsp. aureus MW2
caaauaaggaauguauuuuu

SEQ ID NO: 4035588 - RNA, 23 nt, Staphylococcus aureus subsp. aureus MW2
caaauaaggaauguauuuuucau

SEQ ID NO: 4035589 - RNA, 13 nt, Staphylococcus aureus subsp. aureus MW2
caaauaauauaaa

SEQ ID NO: 4035590 - RNA, 19 nt, Staphylococcus aureus subsp. aureus MW2
caaauaaugugaaaaaucu

SEQ ID NO: 4035591 - RNA, 13 nt, Staphylococcus aureus subsp. aureus MW2
caaauaaugugca

SEQ ID NO: 4035592 - RNA, 17 nt, Staphylococcus aureus subsp. aureus MW2
caaauacaguuaucacc

SEQ ID NO: 4035593 - RNA, 18 nt, Staphylococcus aureus subsp. aureus MW2
caaauacaguuaucaccg

SEQ ID NO: 4035594 - RNA, 14 nt, Staphylococcus aureus subsp. aureus MW2
caaauacaguugua

SEQ ID NO: 4035595 - RNA, 19 nt, Staphylococcus aureus subsp. aureus MW2
caaauacgaguguuuuaau

SEQ ID NO: 4035596 - RNA, 15 nt, Staphylococcus aureus subsp. aureus MW2
caaauagacaccaaa

SEQ ID NO: 4035597 - RNA, 18 nt, Staphylococcus aureus subsp. aureus MW2
caaauagcgauuuuaaag

SEQ ID NO: 4035598 - RNA, 21 nt, Staphylococcus aureus subsp. aureus MW2
caaauaguuaagauuuuaacu

SEQ ID NO: 4035599 - RNA, 14 nt, Staphylococcus aureus subsp. aureus MW2
caaauaguucaaau

SEQ ID NO: 4035600 - RNA, 21 nt, Staphylococcus aureus subsp. aureus MW2
caaauauaauguauaaaacag

SEQ ID NO: 4035601 - RNA, 15 nt, Staphylococcus aureus subsp. aureus MW2
caaauauuaauuuau

SEQ ID NO: 4035602 - RNA, 18 nt, Staphylococcus aureus subsp. aureus MW2
caaauauuauuaaaucaa

SEQ ID NO: 4035603 - RNA, 15 nt, Staphylococcus aureus subsp. aureus MW2
caaauauuucuaaac

SEQ ID NO: 4035604 - RNA, 16 nt, Staphylococcus aureus subsp. aureus MW2
caaauauuuuaucugu

SEQ ID NO: 4035605 - RNA, 14 nt, Staphylococcus aureus subsp. aureus MW2
caaaucaauaccaa

SEQ ID NO: 4035606 - RNA, 15 nt, Staphylococcus aureus subsp. aureus MW2
caaaucaauaccaac

SEQ ID NO: 4035607 - RNA, 15 nt, Staphylococcus aureus subsp. aureus MW2
caaaucaauaucauu

SEQ ID NO: 4035608 - RNA, 23 nt, Staphylococcus aureus subsp. aureus MW2
caaaucgauuaauuauaaguagu

SEQ ID NO: 4035609 - RNA, 16 nt, Staphylococcus aureus subsp. aureus MW2
caaaucggaauaaaau

SEQ ID NO: 4035610 - RNA, 19 nt, Staphylococcus aureus subsp. aureus MW2
caaaucggaauaaaauaaa

SEQ ID NO: 4035611 - RNA, 14 nt, Staphylococcus aureus subsp. aureus MW2
caaaucuuuuaaau

SEQ ID NO: 4035612 - RNA, 18 nt, Staphylococcus aureus subsp. aureus MW2
caaaugaaaaaguaaaau

SEQ ID NO: 4035613 - RNA, 15 nt, Staphylococcus aureus subsp. aureus MW2
caaaugcaauaggau

SEQ ID NO: 4035614 - RNA, 17 nt, Staphylococcus aureus subsp. aureus MW2
caaaugugaaagucauc

SEQ ID NO: 4035615 - RNA, 19 nt, Staphylococcus aureus subsp. aureus MW2
caaauguguaaacuagaca

SEQ ID NO: 4035616 - RNA, 16 nt, Staphylococcus aureus subsp. aureus MW2
caaauuaaaaaacaau

SEQ ID NO: 4035617 - RNA, 16 nt, Staphylococcus aureus subsp. aureus MW2
caaauuacaaauuauc

SEQ ID NO: 4035618 - RNA, 20 nt, Staphylococcus aureus subsp. aureus MW2
caaauuacacccuuuaaauu

SEQ ID NO: 4035619 - RNA, 11 nt, Staphylococcus aureus subsp. aureus MW2
caaauuacuua

SEQ ID NO: 4035620 - RNA, 22 nt, Staphylococcus aureus subsp. aureus MW2
caaauuacuuauucaaauguuu

SEQ ID NO: 4035621 - RNA, 17 nt, Staphylococcus aureus subsp. aureus MW2
caaauuagauaaaacaa

SEQ ID NO: 4035622 - RNA, 20 nt, Staphylococcus aureus subsp. aureus MW2
caaauuagauaaaacaaaac

SEQ ID NO: 4035623 - RNA, 21 nt, Staphylococcus aureus subsp. aureus MW2
caaauuagucauccaaagaaa

SEQ ID NO: 4035624 - RNA, 23 nt, Staphylococcus aureus subsp. aureus MW2
caaauuauaauuguaaugcuucu

SEQ ID NO: 4035625 - RNA, 15 nt, Staphylococcus aureus subsp. aureus MW2
caaauuaucauuaaa

SEQ ID NO: 4035626 - RNA, 12 nt, Staphylococcus aureus subsp. aureus MW2
caaauucaaauu

SEQ ID NO: 4035627 - RNA, 15 nt, Staphylococcus aureus subsp. aureus MW2
caaauucauuuguau

SEQ ID NO: 4035628 - RNA, 22 nt, Staphylococcus aureus subsp. aureus MW2
caaauucauuuguauuaauuug

SEQ ID NO: 4035629 - RNA, 19 nt, Staphylococcus aureus subsp. aureus MW2
caaauucgacucaaacaau

SEQ ID NO: 4035630 - RNA, 16 nt, Staphylococcus aureus subsp. aureus MW2
caaauucuaugagaau

SEQ ID NO: 4035631 - RNA, 15 nt, Staphylococcus aureus subsp. aureus MW2
caaauugaacuucuu

SEQ ID NO: 4035632 - RNA, 13 nt, Staphylococcus aureus subsp. aureus MW2
caaauugcaaugg

SEQ ID NO: 4035633 - RNA, 17 nt, Staphylococcus aureus subsp. aureus MW2
caaauugccuuucauuu

SEQ ID NO: 4035634 - RNA, 20 nt, Staphylococcus aureus subsp. aureus MW2
caaauugcguuguuucauua

SEQ ID NO: 4035635 - RNA, 19 nt, Staphylococcus aureus subsp. aureus MW2
caaauuggaaaaauaaaua

SEQ ID NO: 4035636 - RNA, 23 nt, Staphylococcus aureus subsp. aureus MW2
caaauuggauaauuucuucuucu

SEQ ID NO: 4035637 - RNA, 19 nt, Staphylococcus aureus subsp. aureus MW2
caaauuuaggcaugucaaa

SEQ ID NO: 4035638 - RNA, 13 nt, Staphylococcus aureus subsp. aureus MW2
caaauuuauauua

SEQ ID NO: 4035639 - RNA, 16 nt, Staphylococcus aureus subsp. aureus MW2
caaauuuauauuaaau

SEQ ID NO: 4035640 - RNA, 18 nt, Staphylococcus aureus subsp. aureus MW2
caaauuuauauuaaauaa

SEQ ID NO: 4035641 - RNA, 13 nt, Staphylococcus aureus subsp. aureus N315
aaaaaacaaauau

SEQ ID NO: 4035642 - RNA, 14 nt, Staphylococcus aureus subsp. aureus N315
aaaaaacaguguag

SEQ ID NO: 4035643 - RNA, 12 nt, Staphylococcus aureus subsp. aureus N315
aaaaaauaauag

SEQ ID NO: 4035644 - RNA, 12 nt, Staphylococcus aureus subsp. aureus N315
aaaaaaugaugc

SEQ ID NO: 4035645 - RNA, 12 nt, Staphylococcus aureus subsp. aureus N315
aaaaaauggauu

SEQ ID NO: 4035646 - RNA, 16 nt, Staphylococcus aureus subsp. aureus N315
aaaaaauuaaaaauuu

SEQ ID NO: 4035647 - RNA, 13 nt, Staphylococcus aureus subsp. aureus N315
aaaaaauuguaua

SEQ ID NO: 4035648 - RNA, 16 nt, Staphylococcus aureus subsp. aureus N315
aaaaaauuuaaauaau

SEQ ID NO: 4035649 - RNA, 17 nt, Staphylococcus aureus subsp. aureus N315
aaaaaauuuaauguuuu

SEQ ID NO: 4035650 - RNA, 12 nt, Staphylococcus aureus subsp. aureus N315
aaaaacaaaaaa

SEQ ID NO: 4035651 - RNA, 16 nt, Staphylococcus aureus subsp. aureus N315
aaaaacaaauauuaga

SEQ ID NO: 4035652 - RNA, 19 nt, Staphylococcus aureus subsp. aureus N315
aaaaacaccuucguuuaaa

SEQ ID NO: 4035653 - RNA, 23 nt, Staphylococcus aureus subsp. aureus N315
aaaaacaccuucguuuaaauuca

SEQ ID NO: 4035654 - RNA, 16 nt, Staphylococcus aureus subsp. aureus N315
aaaaacagcaguaaga

SEQ ID NO: 4035655 - RNA, 18 nt, Staphylococcus aureus subsp. aureus N315
aaaaacaguguagcacaa

SEQ ID NO: 4035656 - RNA, 14 nt, Staphylococcus aureus subsp. aureus N315
aaaaacaguuacaa

SEQ ID NO: 4035657 - RNA, 13 nt, Staphylococcus aureus subsp. aureus N315
aaaaacauaaaaa

SEQ ID NO: 4035658 - RNA, 14 nt, Staphylococcus aureus subsp. aureus N315
aaaaacauaaaaau

SEQ ID NO: 4035659 - RNA, 20 nt, Staphylococcus aureus subsp. aureus N315
aaaaacaucuacaucaaauu

SEQ ID NO: 4035660 - RNA, 18 nt, Staphylococcus aureus subsp. aureus N315
aaaaaccgaacaucugaa

SEQ ID NO: 4035661 - RNA, 21 nt, Staphylococcus aureus subsp. aureus N315
aaaaaccgaacaucugaaaaa

SEQ ID NO: 4035662 - RNA, 18 nt, Staphylococcus aureus subsp. aureus N315
aaaaaccguaauuuuaau

SEQ ID NO: 4035663 - RNA, 17 nt, Staphylococcus aureus subsp. aureus N315
aaaaaccugaaacaaau

SEQ ID NO: 4035664 - RNA, 15 nt, Staphylococcus aureus subsp. aureus N315
aaaaacgcuuuuaaa

SEQ ID NO: 4035665 - RNA, 19 nt, Staphylococcus aureus subsp. aureus N315
aaaaacuguaaaucaucau

SEQ ID NO: 4035666 - RNA, 17 nt, Staphylococcus aureus subsp. aureus N315
aaaaacuucuuaacuug

SEQ ID NO: 4035667 - RNA, 11 nt, Staphylococcus aureus subsp. aureus N315
aaaaagaaaau

SEQ ID NO: 4035668 - RNA, 13 nt, Staphylococcus aureus subsp. aureus N315
aaaaagaaaauua

SEQ ID NO: 4035669 - RNA, 13 nt, Staphylococcus aureus subsp. aureus N315
aaaaagaucauua

SEQ ID NO: 4035670 - RNA, 15 nt, Staphylococcus aureus subsp. aureus N315
aaaaagaugaaaaag

SEQ ID NO: 4035671 - RNA, 23 nt, Staphylococcus aureus subsp. aureus N315
aaaaagcggacugaaagaaaagu

SEQ ID NO: 4035672 - RNA, 20 nt, Staphylococcus aureus subsp. aureus N315
aaaaaggaagaacagcacau

SEQ ID NO: 4035673 - RNA, 22 nt, Staphylococcus aureus subsp. aureus N315
aaaaaggaugaugugaauguuu

SEQ ID NO: 4035674 - RNA, 18 nt, Staphylococcus aureus subsp. aureus N315
aaaaagucccgcuuaaaa

SEQ ID NO: 4035675 - RNA, 20 nt, Staphylococcus aureus subsp. aureus N315
aaaaagugaaaguauuagau

SEQ ID NO: 4035676 - RNA, 18 nt, Staphylococcus aureus subsp. aureus N315
aaaaagugauaauuaaaa

SEQ ID NO: 4035677 - RNA, 19 nt, Staphylococcus aureus subsp. aureus N315
aaaaagugauaauuaaaau

SEQ ID NO: 4035678 - RNA, 13 nt, Staphylococcus aureus subsp. aureus N315
aaaaaguuuaaag

SEQ ID NO: 4035679 - RNA, 11 nt, Staphylococcus aureus subsp. aureus N315
aaaaauaaaaa

SEQ ID NO: 4035680 - RNA, 12 nt, Staphylococcus aureus subsp. aureus N315
aaaaauaaaucu

SEQ ID NO: 4035681 - RNA, 14 nt, Staphylococcus aureus subsp. aureus N315
aaaaauaaaucucc

SEQ ID NO: 4035682 - RNA, 20 nt, Staphylococcus aureus subsp. aureus N315
aaaaauaacuguaaaacauu

SEQ ID NO: 4035683 - RNA, 14 nt, Staphylococcus aureus subsp. aureus N315
aaaaauaauagcaa

SEQ ID NO: 4035684 - RNA, 15 nt, Staphylococcus aureus subsp. aureus N315
aaaaauaauagcaaa

SEQ ID NO: 4035685 - RNA, 17 nt, Staphylococcus aureus subsp. aureus N315
aaaaauaauagcaaaau

SEQ ID NO: 4035686 - RNA, 14 nt, Staphylococcus aureus subsp. aureus N315
aaaaauaauuaaau

SEQ ID NO: 4035687 - RNA, 15 nt, Staphylococcus aureus subsp. aureus N315
aaaaauaauuaugaa

SEQ ID NO: 4035688 - RNA, 19 nt, Staphylococcus aureus subsp. aureus N315
aaaaauaauuaugaaaagu

SEQ ID NO: 4035689 - RNA, 21 nt, Staphylococcus aureus subsp. aureus N315
aaaaauacguuuaauguauaa

SEQ ID NO: 4035690 - RNA, 12 nt, Staphylococcus aureus subsp. aureus N315
aaaaauacuuuu

SEQ ID NO: 4035691 - RNA, 12 nt, Staphylococcus aureus subsp. aureus N315
aaaaauaguaaa

SEQ ID NO: 4035692 - RNA, 12 nt, Staphylococcus aureus subsp. aureus N315
aaaaauauccug

SEQ ID NO: 4035693 - RNA, 14 nt, Staphylococcus aureus subsp. aureus N315
aaaaauauugaaua

SEQ ID NO: 4035694 - RNA, 13 nt, Staphylococcus aureus subsp. aureus N315
aaaaauauuuaaa

SEQ ID NO: 4035695 - RNA, 10 nt, Staphylococcus aureus subsp. aureus N315
aaaaaucaaa

SEQ ID NO: 4035696 - RNA, 15 nt, Staphylococcus aureus subsp. aureus N315
aaaaaucaaagaggc

SEQ ID NO: 4035697 - RNA, 17 nt, Staphylococcus aureus subsp. aureus N315
aaaagauauaaacauuu

SEQ ID NO: 4035698 - RNA, 18 nt, Staphylococcus aureus subsp. aureus N315
aaaagaugaaaaucuuua

SEQ ID NO: 4035699 - RNA, 15 nt, Staphylococcus aureus subsp. aureus N315
aaaagauuagaugau

SEQ ID NO: 4035700 - RNA, 21 nt, Staphylococcus aureus subsp. aureus N315
aaaagauuagaugauauuuaa

SEQ ID NO: 4035701 - RNA, 17 nt, Staphylococcus aureus subsp. aureus N315
aaaagauucggaaaaua

SEQ ID NO: 4035702 - RNA, 20 nt, Staphylococcus aureus subsp. aureus N315
aaaagcacuagccguuauuu

SEQ ID NO: 4035703 - RNA, 16 nt, Staphylococcus aureus subsp. aureus N315
aaaagcagcaguaaga

SEQ ID NO: 4035704 - RNA, 13 nt, Staphylococcus aureus subsp. aureus N315
aaaagcaucuuua

SEQ ID NO: 4035705 - RNA, 23 nt, Staphylococcus aureus subsp. aureus N315
aaaagcaugauacucaauaaaau

SEQ ID NO: 4035706 - RNA, 15 nt, Staphylococcus aureus subsp. aureus N315
aaaagccaacacauu

SEQ ID NO: 4035707 - RNA, 13 nt, Staphylococcus aureus subsp. aureus N315
aaaagccaccuau

SEQ ID NO: 4035708 - RNA, 22 nt, Staphylococcus aureus subsp. aureus N315
aaaagccucuaaugauuaaaaa

SEQ ID NO: 4035709 - RNA, 23 nt, Staphylococcus aureus subsp. aureus N315
aaaagccucuaaugauuaaaaau

SEQ ID NO: 4035710 - RNA, 14 nt, Staphylococcus aureus subsp. aureus N315
aaaagcuaaagagu

SEQ ID NO: 4035711 - RNA, 22 nt, Staphylococcus aureus subsp. aureus N315
aaaagcucggcacaccauuuua

SEQ ID NO: 4035712 - RNA, 18 nt, Staphylococcus aureus subsp. aureus N315
aaaagcugauuucuauca

SEQ ID NO: 4035713 - RNA, 18 nt, Staphylococcus aureus subsp. aureus N315
aaaagcuguaguuucaac

SEQ ID NO: 4035714 - RNA, 12 nt, Staphylococcus aureus subsp. aureus N315
aaaaggaaaaac

SEQ ID NO: 4035715 - RNA, 20 nt, Staphylococcus aureus subsp. aureus N315
aaaaggaaaaacuuuucaug

SEQ ID NO: 4035716 - RNA, 21 nt, Staphylococcus aureus subsp. aureus N315
aaaaggaugaugugaauguuu

SEQ ID NO: 4035717 - RNA, 17 nt, Staphylococcus aureus subsp. aureus N315
aaaaguaaguaaaauaa

SEQ ID NO: 4035718 - RNA, 17 nt, Staphylococcus aureus subsp. aureus N315
aaaaguaauuaaauacu

SEQ ID NO: 4035719 - RNA, 24 nt, Staphylococcus aureus subsp. aureus N315
aaaaguacuaacccaacgaugaaa

SEQ ID NO: 4035720 - RNA, 22 nt, Staphylococcus aureus subsp. aureus N315
aaaaguacuuuaaaauuguaua

SEQ ID NO: 4035721 - RNA, 19 nt, Staphylococcus aureus subsp. aureus N315
aaaaguauaaauauaaaaa

SEQ ID NO: 4035722 - RNA, 14 nt, Staphylococcus aureus subsp. aureus N315
aaaaguauuacuuu

SEQ ID NO: 4035723 - RNA, 19 nt, Staphylococcus aureus subsp. aureus N315
aaaagucccgcuuaaaaug

SEQ ID NO: 4035724 - RNA, 23 nt, Staphylococcus aureus subsp. aureus N315
aaaagugaaaguauuagauauau

SEQ ID NO: 4035725 - RNA, 23 nt, Staphylococcus aureus subsp. aureus N315
aaaagugcaaguccaaauaauau

SEQ ID NO: 4035726 - RNA, 17 nt, Staphylococcus aureus subsp. aureus N315
aaaagugcgauuaucag

SEQ ID NO: 4035727 - RNA, 13 nt, Staphylococcus aureus subsp. aureus N315
aaaaguguaaugu

SEQ ID NO: 4035728 - RNA, 15 nt, Staphylococcus aureus subsp. aureus N315
aaaaguguaauguuc

SEQ ID NO: 4035729 - RNA, 20 nt, Staphylococcus aureus subsp. aureus N315
aaaaguguuaaugucuucau

SEQ ID NO: 4035730 - RNA, 19 nt, Staphylococcus aureus subsp. aureus N315
aaaaguguugacuuuauca

SEQ ID NO: 4035731 - RNA, 22 nt, Staphylococcus aureus subsp. aureus N315
aaaaguguugacuuuaucaauu

SEQ ID NO: 4035732 - RNA, 17 nt, Staphylococcus aureus subsp. aureus N315
aaaaguguuuaaaugcu

SEQ ID NO: 4035733 - RNA, 20 nt, Staphylococcus aureus subsp. aureus N315
aaaaguuaggcgacuuaacu

SEQ ID NO: 4035734 - RNA, 17 nt, Staphylococcus aureus subsp. aureus N315
aaaaguugauuaaaagu

SEQ ID NO: 4035735 - RNA, 19 nt, Staphylococcus aureus subsp. aureus N315
aaaaguuguaauuuaaaau

SEQ ID NO: 4035736 - RNA, 13 nt, Staphylococcus aureus subsp. aureus N315
aaaaguuuaaagu

SEQ ID NO: 4035737 - RNA, 20 nt, Staphylococcus aureus subsp. aureus N315
aaaaguuuaagucaguccau

SEQ ID NO: 4035738 - RNA, 12 nt, Staphylococcus aureus subsp. aureus N315
aaaauaaaaaau

SEQ ID NO: 4035739 - RNA, 13 nt, Staphylococcus aureus subsp. aureus N315
aaaauaaaaacca

SEQ ID NO: 4035740 - RNA, 15 nt, Staphylococcus aureus subsp. aureus N315
aaaauaaaaaugccg

SEQ ID NO: 4035741 - RNA, 14 nt, Staphylococcus aureus subsp. aureus N315
aaaauaaaacaaau

SEQ ID NO: 4035742 - RNA, 17 nt, Staphylococcus aureus subsp. aureus N315
aaaauaaaaugcaaaga

SEQ ID NO: 4035743 - RNA, 19 nt, Staphylococcus aureus subsp. aureus N315
aaaauaaaauuaacgagcu

SEQ ID NO: 4035744 - RNA, 19 nt, Staphylococcus aureus subsp. aureus N315
aaaauaaccgcuuaauucu

SEQ ID NO: 4035745 - RNA, 21 nt, Staphylococcus aureus subsp. aureus N315
aaaauaacuaagugaauuauc

SEQ ID NO: 4035746 - RNA, 19 nt, Staphylococcus aureus subsp. aureus N315
aaaauaacugcuaauuuuu

SEQ ID NO: 4035747 - RNA, 16 nt, Staphylococcus aureus subsp. aureus N315
aaaauaauaugaauuu

SEQ ID NO: 4035748 - RNA, 15 nt, Staphylococcus aureus subsp. aureus N315
aaaauacaaauuaca

SEQ ID NO: 4035749 - RNA, 17 nt, Staphylococcus aureus subsp. aureus N315
aaaauacauaauuaacu

SEQ ID NO: 4035750 - RNA, 19 nt, Staphylococcus aureus subsp. aureus N315
aaaauacauaauuaacuuu

SEQ ID NO: 4035751 - RNA, 16 nt, Staphylococcus aureus subsp. aureus N315
aaaauacgauuuguuc

SEQ ID NO: 4035752 - RNA, 16 nt, Staphylococcus aureus subsp. aureus N315
aaaauacgcaaaccaa

SEQ ID NO: 4035753 - RNA, 16 nt, Staphylococcus aureus subsp. aureus N315
aaaauacuauacugau

SEQ ID NO: 4035754 - RNA, 19 nt, Staphylococcus aureus subsp. aureus N315
aaaauacucccuucaacau

SEQ ID NO: 4035755 - RNA, 14 nt, Staphylococcus aureus subsp. aureus N315
aaaauagaaaaauu

SEQ ID NO: 4035756 - RNA, 19 nt, Staphylococcus aureus subsp. aureus N315
aaaauagaaaaauuucaaa

SEQ ID NO: 4035757 - RNA, 20 nt, Staphylococcus aureus subsp. aureus N315
aaaauagaaaaauuucaaaa

SEQ ID NO: 4035758 - RNA, 13 nt, Staphylococcus aureus subsp. aureus N315
aaaauagaaagaa

SEQ ID NO: 4035759 - RNA, 15 nt, Staphylococcus aureus subsp. aureus N315
aaaauagauugaaaa

SEQ ID NO: 4035760 - RNA, 23 nt, Staphylococcus aureus subsp. aureus N315
aaaauagccauauucauauuacu

SEQ ID NO: 4035761 - RNA, 15 nt, Staphylococcus aureus subsp. aureus N315
aaaauagcuauuaaa

SEQ ID NO: 4035762 - RNA, 16 nt, Staphylococcus aureus subsp. aureus N315
aaaauagcuauuaaaa

SEQ ID NO: 4035763 - RNA, 20 nt, Staphylococcus aureus subsp. aureus N315
aaaauagcuauuaaaauaga

SEQ ID NO: 4035764 - RNA, 20 nt, Staphylococcus aureus subsp. aureus N315
aaaauaguaaagugaaauaa

SEQ ID NO: 4035765 - RNA, 23 nt, Staphylococcus aureus subsp. aureus N315
aaaauagucggggccccaacaca

SEQ ID NO: 4035766 - RNA, 21 nt, Staphylococcus aureus subsp. aureus N315
aaaauaguucuuuaaauuaua

SEQ ID NO: 4035767 - RNA, 24 nt, Staphylococcus aureus subsp. aureus N315
aaaauaguucuuuaaauuauauac

SEQ ID NO: 4035768 - RNA, 21 nt, Staphylococcus aureus subsp. aureus N315
aaaauauagcuauuacuauaa

SEQ ID NO: 4035769 - RNA, 11 nt, Staphylococcus aureus subsp. aureus N315
aaaauauauuu

SEQ ID NO: 4035770 - RNA, 13 nt, Staphylococcus aureus subsp. aureus N315
aaaauaucaucaa

SEQ ID NO: 4035771 - RNA, 17 nt, Staphylococcus aureus subsp. aureus N315
aaaauaucugaaaaacc

SEQ ID NO: 4035772 - RNA, 17 nt, Staphylococcus aureus subsp. aureus N315
aaaauaucuuuuuguuu

SEQ ID NO: 4035773 - RNA, 17 nt, Staphylococcus aureus subsp. aureus N315
aaaauaugacacauaca

SEQ ID NO: 4035774 - RNA, 20 nt, Staphylococcus aureus subsp. aureus N315
aaaauaugauugcaaauuau

SEQ ID NO: 4035775 - RNA, 15 nt, Staphylococcus aureus subsp. aureus N315
aaaauaugauuuaaa

SEQ ID NO: 4035776 - RNA, 22 nt, Staphylococcus aureus subsp. aureus N315
aaaauauuacuaacaaccguuu

SEQ ID NO: 4035777 - RNA, 19 nt, Staphylococcus aureus subsp. aureus N315
aaaauauugcguuuaauuu

SEQ ID NO: 4035778 - RNA, 14 nt, Staphylococcus aureus subsp. aureus N315
aaaauauuuacauu

SEQ ID NO: 4035779 - RNA, 21 nt, Staphylococcus aureus subsp. aureus N315
aaaaucaaagaggcuuuaaaa

SEQ ID NO: 4035780 - RNA, 21 nt, Staphylococcus aureus subsp. aureus N315
aaaaucaaauugacgcauuaa

SEQ ID NO: 4035781 - RNA, 16 nt, Staphylococcus aureus subsp. aureus N315
aaaaucaacuuuucua

SEQ ID NO: 4035782 - RNA, 18 nt, Staphylococcus aureus subsp. aureus N315
aaaaucacgcuaacauuc

SEQ ID NO: 4035783 - RNA, 16 nt, Staphylococcus aureus subsp. aureus N315
aaaaucaucauuauac

SEQ ID NO: 4035784 - RNA, 19 nt, Staphylococcus aureus subsp. aureus N315
aaacauugcuuaacuuccu

SEQ ID NO: 4035785 - RNA, 16 nt, Staphylococcus aureus subsp. aureus N315
aaacauuuauauagau

SEQ ID NO: 4035786 - RNA, 13 nt, Staphylococcus aureus subsp. aureus N315
aaacauuuuauac

SEQ ID NO: 4035787 - RNA, 23 nt, Staphylococcus aureus subsp. aureus N315
aaacauuuugugacuuuguucau

SEQ ID NO: 4035788 - RNA, 13 nt, Staphylococcus aureus subsp. aureus N315
aaacauuuuugaa

SEQ ID NO: 4035789 - RNA, 14 nt, Staphylococcus aureus subsp. aureus N315
aaaccaaaagaaau

SEQ ID NO: 4035790 - RNA, 13 nt, Staphylococcus aureus subsp. aureus N315
aaaccaauauuuc

SEQ ID NO: 4035791 - RNA, 17 nt, Staphylococcus aureus subsp. aureus N315
aaaccaaugauuguuaa

SEQ ID NO: 4035792 - RNA, 19 nt, Staphylococcus aureus subsp. aureus N315
aaaccauaaguaaaacugc

SEQ ID NO: 4035793 - RNA, 17 nt, Staphylococcus aureus subsp. aureus N315
aaaccauugaaugaauc

SEQ ID NO: 4035794 - RNA, 18 nt, Staphylococcus aureus subsp. aureus N315
aaaccgagaaucuccauu

SEQ ID NO: 4035795 - RNA, 22 nt, Staphylococcus aureus subsp. aureus N315
aaaccgccaacuaauguuaaaa

SEQ ID NO: 4035796 - RNA, 20 nt, Staphylococcus aureus subsp. aureus N315
aaaccguauagucauuacau

SEQ ID NO: 4035797 - RNA, 23 nt, Staphylococcus aureus subsp. aureus N315
aaaccgugagggacgucaucaug

SEQ ID NO: 4035798 - RNA, 16 nt, Staphylococcus aureus subsp. aureus N315
aaaccguuauauauua

SEQ ID NO: 4035799 - RNA, 12 nt, Staphylococcus aureus subsp. aureus N315
aaaccuaacaua

SEQ ID NO: 4035800 - RNA, 15 nt, Staphylococcus aureus subsp. aureus N315
aaaccuaaucuacca

SEQ ID NO: 4035801 - RNA, 17 nt, Staphylococcus aureus subsp. aureus N315
aaaccuaaugcuuuaau

SEQ ID NO: 4035802 - RNA, 16 nt, Staphylococcus aureus subsp. aureus N315
aaaccuagggauaauu

SEQ ID NO: 4035803 - RNA, 17 nt, Staphylococcus aureus subsp. aureus N315
aaaccucuaaauaaaau

SEQ ID NO: 4035804 - RNA, 17 nt, Staphylococcus aureus subsp. aureus N315
aaaccugggacauuaau

SEQ ID NO: 4035805 - RNA, 17 nt, Staphylococcus aureus subsp. aureus N315
aaaccuuacccaaaaaa

SEQ ID NO: 4035806 - RNA, 18 nt, Staphylococcus aureus subsp. aureus N315
aaaccuuuucaaauuaua

SEQ ID NO: 4035807 - RNA, 17 nt, Staphylococcus aureus subsp. aureus N315
aaacgacauuguuuagu

SEQ ID NO: 4035808 - RNA, 19 nt, Staphylococcus aureus subsp. aureus N315
aaacgacucauuauaaaug

SEQ ID NO: 4035809 - RNA, 16 nt, Staphylococcus aureus subsp. aureus N315
aaacgagacaucaucu

SEQ ID NO: 4035810 - RNA, 15 nt, Staphylococcus aureus subsp. aureus N315
aaacgauaauaauaa

SEQ ID NO: 4035811 - RNA, 13 nt, Staphylococcus aureus subsp. aureus N315
aaacgauacugcu

SEQ ID NO: 4035812 - RNA, 15 nt, Staphylococcus aureus subsp. aureus N315
aaacgauauagaccg

SEQ ID NO: 4035813 - RNA, 22 nt, Staphylococcus aureus subsp. aureus N315
aaacgauauagaccguugaaau

SEQ ID NO: 4035814 - RNA, 22 nt, Staphylococcus aureus subsp. aureus N315
aaacgauugauuaucauaugaa

SEQ ID NO: 4035815 - RNA, 21 nt, Staphylococcus aureus subsp. aureus N315
aaacgcaauacgaauaucugu

SEQ ID NO: 4035816 - RNA, 21 nt, Staphylococcus aureus subsp. aureus N315
aaacgcacuaucaaugacauc

SEQ ID NO: 4035817 - RNA, 19 nt, Staphylococcus aureus subsp. aureus N315
aaacgcacuauuuuuauaa

SEQ ID NO: 4035818 - RNA, 14 nt, Staphylococcus aureus subsp. aureus N315
aaacgccuuuccau

SEQ ID NO: 4035819 - RNA, 13 nt, Staphylococcus aureus subsp. aureus N315
aaacggaaauaac

SEQ ID NO: 4035820 - RNA, 12 nt, Staphylococcus aureus subsp. aureus N315
aaacggagcaac

SEQ ID NO: 4035821 - RNA, 22 nt, Staphylococcus aureus subsp. aureus N315
aaacguccaaacacaaauaaag

SEQ ID NO: 4035822 - RNA, 22 nt, Staphylococcus aureus subsp. aureus N315
aaacgugcaaauaaaaaaguua

SEQ ID NO: 4035823 - RNA, 18 nt, Staphylococcus aureus subsp. aureus N315
aaacguugaguauuacuu

SEQ ID NO: 4035824 - RNA, 14 nt, Staphylococcus aureus subsp. aureus N315
aaacuaaauuaaaa

SEQ ID NO: 4035825 - RNA, 16 nt, Staphylococcus aureus subsp. aureus N315
aaacuaaauuaaaagu

SEQ ID NO: 4035826 - RNA, 12 nt, Staphylococcus aureus subsp. aureus N315
aaacuaauagca

SEQ ID NO: 4035827 - RNA, 13 nt, Staphylococcus aureus subsp. aureus N315
aaacuagcaguaa

SEQ ID NO: 4035828 - RNA, 18 nt, Staphylococcus aureus subsp. aureus N315
aaacuagcaguaauaugu

SEQ ID NO: 4035829 - RNA, 21 nt, Staphylococcus aureus subsp. aureus N315
aaacuauaauaauuggaauca

SEQ ID NO: 4035830 - RNA, 14 nt, Staphylococcus aureus subsp. aureus N315
aaacuaucuacacc

SEQ ID NO: 4035831 - RNA, 15 nt, Staphylococcus aureus subsp. aureus N315
aaacuaucugauuaa

SEQ ID NO: 4035832 - RNA, 22 nt, Staphylococcus aureus subsp. aureus N315
aaacuauuaucgaagaaacauu

SEQ ID NO: 4035833 - RNA, 14 nt, Staphylococcus aureus subsp. aureus N315
aaacuauuuuaaaa

SEQ ID NO: 4035834 - RNA, 23 nt, Staphylococcus aureus subsp. aureus N315
aaacucauaccaaaaacauuaac

SEQ ID NO: 4035835 - RNA, 20 nt, Staphylococcus aureus subsp. aureus N315
aaacucaugcauaagaaaua

SEQ ID NO: 4035836 - RNA, 14 nt, Staphylococcus aureus subsp. aureus N315
aaacucauuuauaa

SEQ ID NO: 4035837 - RNA, 20 nt, Staphylococcus aureus subsp. aureus N315
aaacucauuuauaaacauug

SEQ ID NO: 4035838 - RNA, 22 nt, Staphylococcus aureus subsp. aureus N315
aaacucgcccccguaauaauuu

SEQ ID NO: 4035839 - RNA, 22 nt, Staphylococcus aureus subsp. aureus N315
aaacucguaaauuuuaucuaaa

SEQ ID NO: 4035840 - RNA, 10 nt, Staphylococcus aureus subsp. aureus N315
aaacucucua

SEQ ID NO: 4035841 - RNA, 22 nt, Staphylococcus aureus subsp. aureus N315
aaacugaguucaauuaaauuau

SEQ ID NO: 4035842 - RNA, 20 nt, Staphylococcus aureus subsp. aureus N315
aaacugauugggcugauaau

SEQ ID NO: 4035843 - RNA, 23 nt, Staphylococcus aureus subsp. aureus N315
aaacuuaaauauucuuaucugua

SEQ ID NO: 4035844 - RNA, 23 nt, Staphylococcus aureus subsp. aureus N315
aaacuuacauuacauauaucaac

SEQ ID NO: 4035845 - RNA, 21 nt, Staphylococcus aureus subsp. aureus N315
aaacuuauuaauuaauagaga

SEQ ID NO: 4035846 - RNA, 22 nt, Staphylococcus aureus subsp. aureus N315
aaacuuccugcuuuuuuuauaa

SEQ ID NO: 4035847 - RNA, 22 nt, Staphylococcus aureus subsp. aureus N315
aaacuucuuguuucaaacaaag

SEQ ID NO: 4035848 - RNA, 12 nt, Staphylococcus aureus subsp. aureus N315
aaacuucuuuuc

SEQ ID NO: 4035849 - RNA, 14 nt, Staphylococcus aureus subsp. aureus N315
aaacuucuuuucuu

SEQ ID NO: 4035850 - RNA, 17 nt, Staphylococcus aureus subsp. aureus N315
aaacuucuuuucuuuga

SEQ ID NO: 4035851 - RNA, 12 nt, Staphylococcus aureus subsp. aureus N315
aaacuugauuau

SEQ ID NO: 4035852 - RNA, 16 nt, Staphylococcus aureus subsp. aureus N315
aaacuuggcaaugaaa

SEQ ID NO: 4035853 - RNA, 22 nt, Staphylococcus aureus subsp. aureus N315
aaacuuguaaauuuauuuuuaa

SEQ ID NO: 4035854 - RNA, 20 nt, Staphylococcus aureus subsp. aureus N315
aaacuuuauggguauccuuc

SEQ ID NO: 4035855 - RNA, 18 nt, Staphylococcus aureus subsp. aureus N315
aaacuuugugugcuuuau

SEQ ID NO: 4035856 - RNA, 23 nt, Staphylococcus aureus subsp. aureus N315
aaacuuugugugcuuuaucucua

SEQ ID NO: 4035857 - RNA, 17 nt, Staphylococcus aureus subsp. aureus N315
aaagaaaauaucugaaa

SEQ ID NO: 4035858 - RNA, 14 nt, Staphylococcus aureus subsp. aureus N315
aaagaaacaugauu

SEQ ID NO: 4035859 - RNA, 14 nt, Staphylococcus aureus subsp. aureus N315
aaagaaaucaccag

SEQ ID NO: 4035860 - RNA, 21 nt, Staphylococcus aureus subsp. aureus N315
aaagaaccacgcaucauguau

SEQ ID NO: 4035861 - RNA, 14 nt, Staphylococcus aureus subsp. aureus N315
aaagaacuaacaua

SEQ ID NO: 4035862 - RNA, 22 nt, Staphylococcus aureus subsp. aureus N315
aaagaacuaacauaauuuuuau

SEQ ID NO: 4035863 - RNA, 22 nt, Staphylococcus aureus subsp. aureus N315
aaagaaggggagaguuaauccu

SEQ ID NO: 4035864 - RNA, 13 nt, Staphylococcus aureus subsp. aureus N315
aaagaauaaaugu

SEQ ID NO: 4035865 - RNA, 17 nt, Staphylococcus aureus subsp. aureus N315
aaagaauaaauguuaaa

SEQ ID NO: 4035866 - RNA, 12 nt, Staphylococcus aureus subsp. aureus N315
aaagaauaugau

SEQ ID NO: 4035867 - RNA, 22 nt, Staphylococcus aureus subsp. aureus N315
aaagaauccuuaauugcucuuc

SEQ ID NO: 4035868 - RNA, 17 nt, Staphylococcus aureus subsp. aureus N315
aaagaauuucgaaaaga

SEQ ID NO: 4035869 - RNA, 20 nt, Staphylococcus aureus subsp. aureus N315
aaagaauuucgaaaagaaau

SEQ ID NO: 4035870 - RNA, 21 nt, Staphylococcus aureus subsp. aureus N315
aaagaauuucgaaaagaaauu

SEQ ID NO: 4035871 - RNA, 14 nt, Staphylococcus aureus subsp. aureus N315
aaauacuauacuga

SEQ ID NO: 4035872 - RNA, 19 nt, Staphylococcus aureus subsp. aureus N315
aaauacuauauauaaugaa

SEQ ID NO: 4035873 - RNA, 19 nt, Staphylococcus aureus subsp. aureus N315
aaauacucccuucaacaua

SEQ ID NO: 4035874 - RNA, 17 nt, Staphylococcus aureus subsp. aureus N315
aaauacuugaauuuaau

SEQ ID NO: 4035875 - RNA, 18 nt, Staphylococcus aureus subsp. aureus N315
aaauacuugaauuuaaua

SEQ ID NO: 4035876 - RNA, 14 nt, Staphylococcus aureus subsp. aureus N315
aaauacuuuugcau

SEQ ID NO: 4035877 - RNA, 12 nt, Staphylococcus aureus subsp. aureus N315
aaauagaaacua

SEQ ID NO: 4035878 - RNA, 14 nt, Staphylococcus aureus subsp. aureus N315
aaauagaaagaaau

SEQ ID NO: 4035879 - RNA, 14 nt, Staphylococcus aureus subsp. aureus N315
aaauagaauuuuug

SEQ ID NO: 4035880 - RNA, 18 nt, Staphylococcus aureus subsp. aureus N315
aaauagacaccaaaaaac

SEQ ID NO: 4035881 - RNA, 22 nt, Staphylococcus aureus subsp. aureus N315
aaauagacaccaaaaaacagag

SEQ ID NO: 4035882 - RNA, 20 nt, Staphylococcus aureus subsp. aureus N315
aaauagacugccaauaaaau

SEQ ID NO: 4035883 - RNA, 15 nt, Staphylococcus aureus subsp. aureus N315
aaauagauaauauau

SEQ ID NO: 4035884 - RNA, 19 nt, Staphylococcus aureus subsp. aureus N315
aaauagauugaaaaaauaa

SEQ ID NO: 4035885 - RNA, 17 nt, Staphylococcus aureus subsp. aureus N315
aaauagccauauucaua

SEQ ID NO: 4035886 - RNA, 20 nt, Staphylococcus aureus subsp. aureus N315
aaauagccauauucauauua

SEQ ID NO: 4035887 - RNA, 22 nt, Staphylococcus aureus subsp. aureus N315
aaauagccauauucauauuacu

SEQ ID NO: 4035888 - RNA, 13 nt, Staphylococcus aureus subsp. aureus N315
aaauagccuucaa

SEQ ID NO: 4035889 - RNA, 16 nt, Staphylococcus aureus subsp. aureus N315
aaauagcguaauuauu

SEQ ID NO: 4035890 - RNA, 17 nt, Staphylococcus aureus subsp. aureus N315
aaauagcguaauuauua

SEQ ID NO: 4035891 - RNA, 17 nt, Staphylococcus aureus subsp. aureus N315
aaauagcuauuaaaaua

SEQ ID NO: 4035892 - RNA, 18 nt, Staphylococcus aureus subsp. aureus N315
aaauagcuauuaaaauag

SEQ ID NO: 4035893 - RNA, 22 nt, Staphylococcus aureus subsp. aureus N315
aaauagcugcaaucguugaaaa

SEQ ID NO: 4035894 - RNA, 16 nt, Staphylococcus aureus subsp. aureus N315
aaauagcuguuugaua

SEQ ID NO: 4035895 - RNA, 16 nt, Staphylococcus aureus subsp. aureus N315
aaauaggcauaaugaa

SEQ ID NO: 4035896 - RNA, 18 nt, Staphylococcus aureus subsp. aureus N315
aaauaggcgcuuguaaaa

SEQ ID NO: 4035897 - RNA, 22 nt, Staphylococcus aureus subsp. aureus N315
aaauaggcgcuuguaaaauuuu

SEQ ID NO: 4035898 - RNA, 22 nt, Staphylococcus aureus subsp. aureus N315
aaauaggguaauagaucuaucg

SEQ ID NO: 4035899 - RNA, 14 nt, Staphylococcus aureus subsp. aureus N315
aaauaguaagguuu

SEQ ID NO: 4035900 - RNA, 22 nt, Staphylococcus aureus subsp. aureus N315
aaauaguagacgguaucaucug

SEQ ID NO: 4035901 - RNA, 16 nt, Staphylococcus aureus subsp. aureus N315
aaauagugaaauuaua

SEQ ID NO: 4035902 - RNA, 20 nt, Staphylococcus aureus subsp. aureus N315
aaauaguucuuuaaauuaua

SEQ ID NO: 4035903 - RNA, 19 nt, Staphylococcus aureus subsp. aureus N315
aaauauaaaaagugaagau

SEQ ID NO: 4035904 - RNA, 12 nt, Staphylococcus aureus subsp. aureus N315
aaauauaaauuu

SEQ ID NO: 4035905 - RNA, 19 nt, Staphylococcus aureus subsp. aureus N315
aaauauaauagaaauaauc

SEQ ID NO: 4035906 - RNA, 20 nt, Staphylococcus aureus subsp. aureus N315
aaauauaauagaaauaauca

SEQ ID NO: 4035907 - RNA, 12 nt, Staphylococcus aureus subsp. aureus N315
aaauauaaugau

SEQ ID NO: 4035908 - RNA, 18 nt, Staphylococcus aureus subsp. aureus N315
aaauauaauguauaaaac

SEQ ID NO: 4035909 - RNA, 17 nt, Staphylococcus aureus subsp. aureus N315
aaauauaccaaccaaaa

SEQ ID NO: 4035910 - RNA, 19 nt, Staphylococcus aureus subsp. aureus N315
aaauauaccaaccaaaacc

SEQ ID NO: 4035911 - RNA, 18 nt, Staphylococcus aureus subsp. aureus N315
aaauauacuaaauuugaa

SEQ ID NO: 4035912 - RNA, 17 nt, Staphylococcus aureus subsp. aureus N315
aaauauaguaauaaaag

SEQ ID NO: 4035913 - RNA, 17 nt, Staphylococcus aureus subsp. aureus N315
aaauauaguaauuguua

SEQ ID NO: 4035914 - RNA, 23 nt, Staphylococcus aureus subsp. aureus N315
aaauauauaaggcgcucucuuuu

SEQ ID NO: 4035915 - RNA, 20 nt, Staphylococcus aureus subsp. aureus N315
aaauauaucaacguuaauau

SEQ ID NO: 4035916 - RNA, 18 nt, Staphylococcus aureus subsp. aureus N315
aaauauaucuagccugaa

SEQ ID NO: 4035917 - RNA, 22 nt, Staphylococcus aureus subsp. aureus N315
aaauauauugcacauaaaaaau

SEQ ID NO: 4035918 - RNA, 11 nt, Staphylococcus aureus subsp. aureus N315
aaauauauuua

SEQ ID NO: 4035919 - RNA, 18 nt, Staphylococcus aureus subsp. aureus N315
aaauaucaguaauaauac

SEQ ID NO: 4035920 - RNA, 16 nt, Staphylococcus aureus subsp. aureus N315
aaauaucaucaaguuu

SEQ ID NO: 4035921 - RNA, 15 nt, Staphylococcus aureus subsp. aureus N315
aaauaucaugcaaaa

SEQ ID NO: 4035922 - RNA, 19 nt, Staphylococcus aureus subsp. aureus N315
aaauaucaugcaaaacuaa

SEQ ID NO: 4035923 - RNA, 20 nt, Staphylococcus aureus subsp. aureus N315
aaauaucgagaggguacacu

SEQ ID NO: 4035924 - RNA, 21 nt, Staphylococcus aureus subsp. aureus N315
aaauaucuaccuuuuaauuua

SEQ ID NO: 4035925 - RNA, 18 nt, Staphylococcus aureus subsp. aureus N315
aaauaugaauaaugcaau

SEQ ID NO: 4035926 - RNA, 22 nt, Staphylococcus aureus subsp. aureus N315
aaauaugacgcgugaauuaaaa

SEQ ID NO: 4035927 - RNA, 16 nt, Staphylococcus aureus subsp. aureus N315
aaauaugauguuaaaa

SEQ ID NO: 4035928 - RNA, 13 nt, Staphylococcus aureus subsp. aureus N315
aaauaugauuuaa

SEQ ID NO: 4035929 - RNA, 15 nt, Staphylococcus aureus subsp. aureus N315
aaauaugauuuaaaa

SEQ ID NO: 4035930 - RNA, 19 nt, Staphylococcus aureus subsp. aureus N315
aaauauggaauuucauaua

SEQ ID NO: 4035931 - RNA, 17 nt, Staphylococcus aureus subsp. aureus N315
aaauauguaaucagguu

SEQ ID NO: 4035932 - RNA, 23 nt, Staphylococcus aureus subsp. aureus N315
aaauauguauguuuuaucaauau

SEQ ID NO: 4035933 - RNA, 18 nt, Staphylococcus aureus subsp. aureus N315
aaauauuaauauaaaaua

SEQ ID NO: 4035934 - RNA, 22 nt, Staphylococcus aureus subsp. aureus N315
aaauauuaauauaaaauaaagu

SEQ ID NO: 4035935 - RNA, 11 nt, Staphylococcus aureus subsp. aureus N315
aaauauuauuu

SEQ ID NO: 4035936 - RNA, 12 nt, Staphylococcus aureus subsp. aureus N315
aaauauucuuau

SEQ ID NO: 4035937 - RNA, 14 nt, Staphylococcus aureus subsp. aureus N315
aaauauucuuaucu

SEQ ID NO: 4035938 - RNA, 19 nt, Staphylococcus aureus subsp. aureus N315
aaauauugaagaugcuuua

SEQ ID NO: 4035939 - RNA, 19 nt, Staphylococcus aureus subsp. aureus N315
aaauauugcguuuaauuua

SEQ ID NO: 4035940 - RNA, 16 nt, Staphylococcus aureus subsp. aureus N315
aaauauuggaauacuc

SEQ ID NO: 4035941 - RNA, 17 nt, Staphylococcus aureus subsp. aureus N315
aaauauuguaaucacua

SEQ ID NO: 4035942 - RNA, 15 nt, Staphylococcus aureus subsp. aureus N315
aaauauuuaaacuag

SEQ ID NO: 4035943 - RNA, 19 nt, Staphylococcus aureus subsp. aureus N315
aaauauuuaaccuuuaaaa

SEQ ID NO: 4035944 - RNA, 11 nt, Staphylococcus aureus subsp. aureus N315
aaauauuuaau

SEQ ID NO: 4035945 - RNA, 21 nt, Staphylococcus aureus subsp. aureus N315
aaauauuuacauugccacuuu

SEQ ID NO: 4035946 - RNA, 13 nt, Staphylococcus aureus subsp. aureus N315
aaauauuugaaaa

SEQ ID NO: 4035947 - RNA, 17 nt, Staphylococcus aureus subsp. aureus N315
aaauauuugaaaauuuc

SEQ ID NO: 4035948 - RNA, 20 nt, Staphylococcus aureus subsp. aureus N315
aaauauuugaaaauuucacc

SEQ ID NO: 4035949 - RNA, 14 nt, Staphylococcus aureus subsp. aureus N315
aaauauuugaugau

SEQ ID NO: 4035950 - RNA, 21 nt, Staphylococcus aureus subsp. aureus N315
aaauauuugaugaucccaaaa

SEQ ID NO: 4035951 - RNA, 16 nt, Staphylococcus aureus subsp. aureus N315
aaauauuuuuaauuau

SEQ ID NO: 4035952 - RNA, 22 nt, Staphylococcus aureus subsp. aureus N315
aaauauuuuuaauuauuuuaaa

SEQ ID NO: 4035953 - RNA, 15 nt, Staphylococcus aureus subsp. aureus N315
aaauauuuuuuaaaa

SEQ ID NO: 4035954 - RNA, 18 nt, Staphylococcus aureus subsp. aureus N315
aaauauuuuuuaaaauga

SEQ ID NO: 4035955 - RNA, 18 nt, Staphylococcus aureus subsp. aureus N315
aaaucaaaaauaauuaug

SEQ ID NO: 4035956 - RNA, 11 nt, Staphylococcus aureus subsp. aureus N315
aaaucaaagag

SEQ ID NO: 4035957 - RNA, 14 nt, Staphylococcus aureus subsp. aureus N315
aaaucaaagaggaa

SEQ ID NO: 4035958 - RNA, 17 nt, Staphylococcus aureus subsp. aureus N315
aaaucaaauacaucaau

SEQ ID NO: 4035959 - RNA, 16 nt, Staphylococcus aureus subsp. aureus N315
aaaugacuaccuguug

SEQ ID NO: 4035960 - RNA, 18 nt, Staphylococcus aureus subsp. aureus N315
aaaugacugaauuaauau

SEQ ID NO: 4035961 - RNA, 21 nt, Staphylococcus aureus subsp. aureus N315
aaaugacugaauuaauaucca

SEQ ID NO: 4035962 - RNA, 23 nt, Staphylococcus aureus subsp. aureus N315
aaaugacugaauuaauauccaaa

SEQ ID NO: 4035963 - RNA, 16 nt, Staphylococcus aureus subsp. aureus N315
aaaugauaauuuaaua

SEQ ID NO: 4035964 - RNA, 22 nt, Staphylococcus aureus subsp. aureus N315
aaaugauaauuuaauaauguac

SEQ ID NO: 4035965 - RNA, 20 nt, Staphylococcus aureus subsp. aureus N315
aaaugauacauuauuaaaua

SEQ ID NO: 4035966 - RNA, 20 nt, Staphylococcus aureus subsp. aureus N315
aaaugauagggcauugagau

SEQ ID NO: 4035967 - RNA, 18 nt, Staphylococcus aureus subsp. aureus N315
aaaugauauacuugaaga

SEQ ID NO: 4035968 - RNA, 19 nt, Staphylococcus aureus subsp. aureus N315
aaaugauauacuugaagaa

SEQ ID NO: 4035969 - RNA, 13 nt, Staphylococcus aureus subsp. aureus N315
aaaugauaucuau

SEQ ID NO: 4035970 - RNA, 13 nt, Staphylococcus aureus subsp. aureus N315
aaaugauuaauaa

SEQ ID NO: 4035971 - RNA, 22 nt, Staphylococcus aureus subsp. aureus N315
aaaugauucuuuauaagcuuuu

SEQ ID NO: 4035972 - RNA, 19 nt, Staphylococcus aureus subsp. aureus N315
aaaugauuuauucuaaaua

SEQ ID NO: 4035973 - RNA, 22 nt, Staphylococcus aureus subsp. aureus N315
aaaugauuuauucuaaauauau

SEQ ID NO: 4035974 - RNA, 23 nt, Staphylococcus aureus subsp. aureus N315
aaaugauuuauucuaaauauauu

SEQ ID NO: 4035975 - RNA, 18 nt, Staphylococcus aureus subsp. aureus N315
aaaugcaaagacuaaaaa

SEQ ID NO: 4035976 - RNA, 22 nt, Staphylococcus aureus subsp. aureus N315
aaaugcaauacaccuauuacac

SEQ ID NO: 4035977 - RNA, 21 nt, Staphylococcus aureus subsp. aureus N315
aaaugcaauuuuucacuuaua

SEQ ID NO: 4035978 - RNA, 21 nt, Staphylococcus aureus subsp. aureus N315
aaaugcacgagcaacaucuuu

SEQ ID NO: 4035979 - RNA, 19 nt, Staphylococcus aureus subsp. aureus N315
aaaugcacugagcaacaaa

SEQ ID NO: 4035980 - RNA, 13 nt, Staphylococcus aureus subsp. aureus N315
aaaugcauuacua

SEQ ID NO: 4035981 - RNA, 21 nt, Staphylococcus aureus subsp. aureus N315
aaaugccaacuauaccuaggg

SEQ ID NO: 4035982 - RNA, 20 nt, Staphylococcus aureus subsp. aureus N315
aaaugcgcuuccaauuuaaa

SEQ ID NO: 4035983 - RNA, 21 nt, Staphylococcus aureus subsp. aureus N315
aaaugcgcuuccaauuuaaaa

SEQ ID NO: 4035984 - RNA, 14 nt, Staphylococcus aureus subsp. aureus N315
aaaugcuaaaagua

SEQ ID NO: 4035985 - RNA, 17 nt, Staphylococcus aureus subsp. aureus N315
aaaugcuacaauuuccu

SEQ ID NO: 4035986 - RNA, 18 nt, Staphylococcus aureus subsp. aureus N315
aaaugcuuaagaaauuuu

SEQ ID NO: 4035987 - RNA, 12 nt, Staphylococcus aureus subsp. aureus N315
aaaugcuuauau

SEQ ID NO: 4035988 - RNA, 20 nt, Staphylococcus aureus subsp. aureus N315
aaaugcuuauauaaacaaaa

SEQ ID NO: 4035989 - RNA, 21 nt, Staphylococcus aureus subsp. aureus N315
aaaugcuucugguucuucaau

SEQ ID NO: 4035990 - RNA, 17 nt, Staphylococcus aureus subsp. aureus N315
aaauggacuaacgucau

SEQ ID NO: 4035991 - RNA, 23 nt, Staphylococcus aureus subsp. aureus N315
aaauggcgaauagcgauuuuaaa

SEQ ID NO: 4035992 - RNA, 20 nt, Staphylococcus aureus subsp. aureus N315
aaauggugaacuaaauugaa

SEQ ID NO: 4035993 - RNA, 23 nt, Staphylococcus aureus subsp. aureus N315
aaaugguuuucuuuuucuauaca

SEQ ID NO: 4035994 - RNA, 23 nt, Staphylococcus aureus subsp. aureus N315
aaauguaacauuaaaaauaaaag

SEQ ID NO: 4035995 - RNA, 12 nt, Staphylococcus aureus subsp. aureus N315
aaauguagauua

SEQ ID NO: 4035996 - RNA, 19 nt, Staphylococcus aureus subsp. aureus N315
aaaugucaguuuugaagaa

SEQ ID NO: 4035997 - RNA, 14 nt, Staphylococcus aureus subsp. aureus N315
aaaugucauaguau

SEQ ID NO: 4035998 - RNA, 13 nt, Staphylococcus aureus subsp. aureus N315
aaaugucauuuga

SEQ ID NO: 4035999 - RNA, 21 nt, Staphylococcus aureus subsp. aureus N315
aaauguccgacuugauaaaaa

SEQ ID NO: 4036000 - RNA, 17 nt, Staphylococcus aureus subsp. aureus N315
aaaugucguauauguaa

SEQ ID NO: 4036001 - RNA, 22 nt, Staphylococcus aureus subsp. aureus N315
aaaugugcaauuagaauauaug

SEQ ID NO: 4036002 - RNA, 18 nt, Staphylococcus aureus subsp. aureus N315
aaauguguuaaaauauau

SEQ ID NO: 4036003 - RNA, 15 nt, Staphylococcus aureus subsp. aureus N315
aaauguuaaagauua

SEQ ID NO: 4036004 - RNA, 21 nt, Staphylococcus aureus subsp. aureus N315
aaauguuaaagauuauuauua

SEQ ID NO: 4036005 - RNA, 16 nt, Staphylococcus aureus subsp. aureus N315
aaauguuaaauucuaa

SEQ ID NO: 4036006 - RNA, 19 nt, Staphylococcus aureus subsp. aureus N315
aaauguuaaugcuucguaa

SEQ ID NO: 4036007 - RNA, 22 nt, Staphylococcus aureus subsp. aureus N315
aaauguuaucaauaucuucgcc

SEQ ID NO: 4036008 - RNA, 22 nt, Staphylococcus aureus subsp. aureus N315
aaauguuauuaaccaucaugac

SEQ ID NO: 4036009 - RNA, 15 nt, Staphylococcus aureus subsp. aureus N315
aaauguuauugcuua

SEQ ID NO: 4036010 - RNA, 22 nt, Staphylococcus aureus subsp. aureus N315
aaauguuauugcuuauuuuugu

SEQ ID NO: 4036011 - RNA, 18 nt, Staphylococcus aureus subsp. aureus N315
aaauguugacuacucaau

SEQ ID NO: 4036012 - RNA, 19 nt, Staphylococcus aureus subsp. aureus N315
aaauguuuuauguauuuau

SEQ ID NO: 4036013 - RNA, 16 nt, Staphylococcus aureus subsp. aureus N315
aaauuaaaaaacaaaa

SEQ ID NO: 4036014 - RNA, 18 nt, Staphylococcus aureus subsp. aureus N315
aaauuaaaaaacaaaacu

SEQ ID NO: 4036015 - RNA, 16 nt, Staphylococcus aureus subsp. aureus N315
aaauuaaaaauuucgc

SEQ ID NO: 4036016 - RNA, 15 nt, Staphylococcus aureus subsp. aureus N315
aaauuaaaacuuuca

SEQ ID NO: 4036017 - RNA, 17 nt, Staphylococcus aureus subsp. aureus N315
aaauuaaagcaaauuau

SEQ ID NO: 4036018 - RNA, 15 nt, Staphylococcus aureus subsp. aureus N315
aaauuaaauuuuguu

SEQ ID NO: 4036019 - RNA, 14 nt, Staphylococcus aureus subsp. aureus N315
aaauuaacuuaaaa

SEQ ID NO: 4036020 - RNA, 17 nt, Staphylococcus aureus subsp. aureus N315
aaauuaacuuaaaauuu

SEQ ID NO: 4036021 - RNA, 20 nt, Staphylococcus aureus subsp. aureus N315
aaauuaacuuaaaauuuaaa

SEQ ID NO: 4036022 - RNA, 22 nt, Staphylococcus aureus subsp. aureus N315
aaauuaacuuagguuauuauaa

SEQ ID NO: 4036023 - RNA, 15 nt, Staphylococcus aureus subsp. aureus N315
aaauuaagaagaaau

SEQ ID NO: 4036024 - RNA, 16 nt, Staphylococcus aureus subsp. aureus N315
aaauuaagaagaaaua

SEQ ID NO: 4036025 - RNA, 18 nt, Staphylococcus aureus subsp. aureus N315
aaauuaagaagaaauacu

SEQ ID NO: 4036026 - RNA, 21 nt, Staphylococcus aureus subsp. aureus N315
aaauuaagaagaaauacuuga

SEQ ID NO: 4036027 - RNA, 17 nt, Staphylococcus aureus subsp. aureus N315
aaauuaauaauuuucca

SEQ ID NO: 4036028 - RNA, 15 nt, Staphylococcus aureus subsp. aureus N315
aaauuaauagagaaa

SEQ ID NO: 4036029 - RNA, 21 nt, Staphylococcus aureus subsp. aureus N315
aaauuaauaugaacaaaaaau

SEQ ID NO: 4036030 - RNA, 16 nt, Staphylococcus aureus subsp. aureus N315
aaauuaauugcuuuca

SEQ ID NO: 4036031 - RNA, 12 nt, Staphylococcus aureus subsp. aureus N315
aaauuacuaacg

SEQ ID NO: 4036032 - RNA, 19 nt, Staphylococcus aureus subsp. aureus N315
aaauuacuuagcaaacaau

SEQ ID NO: 4036033 - RNA, 21 nt, Staphylococcus aureus subsp. aureus N315
aaauuagaaccaucauucaua

SEQ ID NO: 4036034 - RNA, 22 nt, Staphylococcus aureus subsp. aureus N315
aaauuagcaagugaguaacauu

SEQ ID NO: 4036035 - RNA, 23 nt, Staphylococcus aureus subsp. aureus N315
aaauuagcaagugaguaacauuu

SEQ ID NO: 4036036 - RNA, 23 nt, Staphylococcus aureus subsp. aureus N315
aaauuagccuaauugagagaagu

SEQ ID NO: 4036037 - RNA, 18 nt, Staphylococcus aureus subsp. aureus N315
aaauuaggcauucaucua

SEQ ID NO: 4036038 - RNA, 14 nt, Staphylococcus aureus subsp. aureus N315
aaauuaguuauacu

SEQ ID NO: 4036039 - RNA, 14 nt, Staphylococcus aureus subsp. aureus N315
aaauuaguuugaua

SEQ ID NO: 4036040 - RNA, 20 nt, Staphylococcus aureus subsp. aureus N315
aaauuauagccuucauuugc

SEQ ID NO: 4036041 - RNA, 13 nt, Staphylococcus aureus subsp. aureus N315
aaauuauauaaau

SEQ ID NO: 4036042 - RNA, 15 nt, Staphylococcus aureus subsp. aureus N315
aaauuauauagaaaa

SEQ ID NO: 4036043 - RNA, 20 nt, Staphylococcus aureus subsp. aureus N315
aaauuaugacuuauuuuuca

SEQ ID NO: 4036044 - RNA, 13 nt, Staphylococcus aureus subsp. aureus N315
aaauuaugauuau

SEQ ID NO: 4036045 - RNA, 16 nt, Staphylococcus aureus subsp. aureus N315
aaauuauguaaaaaau

SEQ ID NO: 4036046 - RNA, 15 nt, Staphylococcus aureus subsp. aureus N315
aacaaauaguucaaa

SEQ ID NO: 4036047 - RNA, 14 nt, Staphylococcus aureus subsp. aureus N315
aacaaauauaauac

SEQ ID NO: 4036048 - RNA, 21 nt, Staphylococcus aureus subsp. aureus N315
aacaaauauaauguauaaaac

SEQ ID NO: 4036049 - RNA, 14 nt, Staphylococcus aureus subsp. aureus N315
aacaaauauuagaa

SEQ ID NO: 4036050 - RNA, 16 nt, Staphylococcus aureus subsp. aureus N315
aacaaauccauuaaau

SEQ ID NO: 4036051 - RNA, 20 nt, Staphylococcus aureus subsp. aureus N315
aacaaauccauuaaaucaac

SEQ ID NO: 4036052 - RNA, 16 nt, Staphylococcus aureus subsp. aureus N315
aacaaaucgauuaauu

SEQ ID NO: 4036053 - RNA, 15 nt, Staphylococcus aureus subsp. aureus N315
aacaaaucuuuuaaa

SEQ ID NO: 4036054 - RNA, 13 nt, Staphylococcus aureus subsp. aureus N315
aacaaauuuaacu

SEQ ID NO: 4036055 - RNA, 22 nt, Staphylococcus aureus subsp. aureus N315
aacaacaaauauaauguauaaa

SEQ ID NO: 4036056 - RNA, 15 nt, Staphylococcus aureus subsp. aureus N315
aacaacaucacuuua

SEQ ID NO: 4036057 - RNA, 23 nt, Staphylococcus aureus subsp. aureus N315
aacaaccguuuuaaguacagcau

SEQ ID NO: 4036058 - RNA, 18 nt, Staphylococcus aureus subsp. aureus N315
aacaaccugugauaaaaa

SEQ ID NO: 4036059 - RNA, 18 nt, Staphylococcus aureus subsp. aureus N315
aacaacuaagauauauug

SEQ ID NO: 4036060 - RNA, 23 nt, Staphylococcus aureus subsp. aureus N315
aacaacugcaauagcuauaacuc

SEQ ID NO: 4036061 - RNA, 14 nt, Staphylococcus aureus subsp. aureus N315
aacaagauucauac

SEQ ID NO: 4036062 - RNA, 14 nt, Staphylococcus aureus subsp. aureus N315
aacaagcaucauga

SEQ ID NO: 4036063 - RNA, 15 nt, Staphylococcus aureus subsp. aureus N315
aacaagcaucaugaa

SEQ ID NO: 4036064 - RNA, 18 nt, Staphylococcus aureus subsp. aureus N315
aacaagcuuuuuucaauu

SEQ ID NO: 4036065 - RNA, 18 nt, Staphylococcus aureus subsp. aureus N315
aacaagguucuaaaucuu

SEQ ID NO: 4036066 - RNA, 20 nt, Staphylococcus aureus subsp. aureus N315
aacaaguauaaaugcagcug

SEQ ID NO: 4036067 - RNA, 16 nt, Staphylococcus aureus subsp. aureus N315
aacaauaaaaaaccaa

SEQ ID NO: 4036068 - RNA, 14 nt, Staphylococcus aureus subsp. aureus N315
aacaauaacaccug

SEQ ID NO: 4036069 - RNA, 12 nt, Staphylococcus aureus subsp. aureus N315
aacaauacuacu

SEQ ID NO: 4036070 - RNA, 20 nt, Staphylococcus aureus subsp. aureus N315
aacaauauuaaauuucugaa

SEQ ID NO: 4036071 - RNA, 21 nt, Staphylococcus aureus subsp. aureus N315
aacaauauuaaauuucugaac

SEQ ID NO: 4036072 - RNA, 13 nt, Staphylococcus aureus subsp. aureus N315
aacaaucagauaa

SEQ ID NO: 4036073 - RNA, 19 nt, Staphylococcus aureus subsp. aureus N315
aacaaucagauaaguuacu

SEQ ID NO: 4036074 - RNA, 18 nt, Staphylococcus aureus subsp. aureus N315
aacaaucggaagcauauu

SEQ ID NO: 4036075 - RNA, 17 nt, Staphylococcus aureus subsp. aureus N315
aacaaugauuaaaauua

SEQ ID NO: 4036076 - RNA, 19 nt, Staphylococcus aureus subsp. aureus N315
aacaaugcagcuguauuua

SEQ ID NO: 4036077 - RNA, 19 nt, Staphylococcus aureus subsp. aureus N315
aacaaugcgaagaaaucau

SEQ ID NO: 4036078 - RNA, 21 nt, Staphylococcus aureus subsp. aureus N315
aacaaugcgguaaaaacucuu

SEQ ID NO: 4036079 - RNA, 16 nt, Staphylococcus aureus subsp. aureus N315
aacaauugcuaaucca

SEQ ID NO: 4036080 - RNA, 19 nt, Staphylococcus aureus subsp. aureus N315
aacaauugcuaauccauac

SEQ ID NO: 4036081 - RNA, 15 nt, Staphylococcus aureus subsp. aureus N315
aacaauuuauuaaaa

SEQ ID NO: 4036082 - RNA, 22 nt, Staphylococcus aureus subsp. aureus N315
aacaauuugaggauacauaaau

SEQ ID NO: 4036083 - RNA, 20 nt, Staphylococcus aureus subsp. aureus N315
aacaauuuuaaaucuuuuag

SEQ ID NO: 4036084 - RNA, 22 nt, Staphylococcus aureus subsp. aureus N315
aacaauuuuaaaucuuuuagcu

SEQ ID NO: 4036085 - RNA, 23 nt, Staphylococcus aureus subsp. aureus N315
aacaauuuuauauagacaguagu

SEQ ID NO: 4036086 - RNA, 21 nt, Staphylococcus aureus subsp. aureus N315
aacaauuuuugggaagaauaa

SEQ ID NO: 4036087 - RNA, 19 nt, Staphylococcus aureus subsp. aureus N315
aacacaaaaaugaagaaua

SEQ ID NO: 4036088 - RNA, 22 nt, Staphylococcus aureus subsp. aureus N315
aacacacuuauaaucuauaaau

SEQ ID NO: 4036089 - RNA, 23 nt, Staphylococcus aureus subsp. aureus N315
aacacagagaauuucgaaaagaa

SEQ ID NO: 4036090 - RNA, 16 nt, Staphylococcus aureus subsp. aureus N315
aacacaguacaaauaa

SEQ ID NO: 4036091 - RNA, 14 nt, Staphylococcus aureus subsp. aureus N315
aacacauaaauuaa

SEQ ID NO: 4036092 - RNA, 21 nt, Staphylococcus aureus subsp. aureus N315
aacacaucuauguggcuacuu

SEQ ID NO: 4036093 - RNA, 14 nt, Staphylococcus aureus subsp. aureus N315
aacacauucaaaua

SEQ ID NO: 4036094 - RNA, 18 nt, Staphylococcus aureus subsp. aureus N315
aacacauucuuauuugaa

SEQ ID NO: 4036095 - RNA, 12 nt, Staphylococcus aureus subsp. aureus N315
aacaccaauuga

SEQ ID NO: 4036096 - RNA, 21 nt, Staphylococcus aureus subsp. aureus N315
aacaccacacagcauuuucaa

SEQ ID NO: 4036097 - RNA, 22 nt, Staphylococcus aureus subsp. aureus N315
aacaccagauaucauaauauug

SEQ ID NO: 4036098 - RNA, 14 nt, Staphylococcus aureus subsp. aureus N315
aacaccuaauauuu

SEQ ID NO: 4036099 - RNA, 16 nt, Staphylococcus aureus subsp. aureus N315
aacaccuaauauuuua

SEQ ID NO: 4036100 - RNA, 20 nt, Staphylococcus aureus subsp. aureus N315
aacacgaacugcauagguaa

SEQ ID NO: 4036101 - RNA, 22 nt, Staphylococcus aureus subsp. aureus N315
aacacgacaaucgaauguauug

SEQ ID NO: 4036102 - RNA, 21 nt, Staphylococcus aureus subsp. aureus N315
aacacgaugagcgcauaaauu

SEQ ID NO: 4036103 - RNA, 21 nt, Staphylococcus aureus subsp. aureus N315
aacacguucuugguauuuuuu

SEQ ID NO: 4036104 - RNA, 19 nt, Staphylococcus aureus subsp. aureus N315
aacacguuuuaagccagca

SEQ ID NO: 4036105 - RNA, 21 nt, Staphylococcus aureus subsp. aureus N315
aacacucaaaauguuuaacaa

SEQ ID NO: 4036106 - RNA, 22 nt, Staphylococcus aureus subsp. aureus N315
aacacucaaaauguuuaacaau

SEQ ID NO: 4036107 - RNA, 16 nt, Staphylococcus aureus subsp. aureus N315
aacacucggaaacaug

SEQ ID NO: 4036108 - RNA, 12 nt, Staphylococcus aureus subsp. aureus N315
aacagauacuuc

SEQ ID NO: 4036109 - RNA, 17 nt, Staphylococcus aureus subsp. aureus N315
aacagcaaaaaauaaau

SEQ ID NO: 4036110 - RNA, 19 nt, Staphylococcus aureus subsp. aureus N315
aacagcaaaaaauaaaucu

SEQ ID NO: 4036111 - RNA, 18 nt, Staphylococcus aureus subsp. aureus N315
aacagcaguaagauuauu

SEQ ID NO: 4036112 - RNA, 13 nt, Staphylococcus aureus subsp. aureus N315
aacagcauaaaua

SEQ ID NO: 4036113 - RNA, 20 nt, Staphylococcus aureus subsp. aureus N315
aacagcuuuuucuacaccua

SEQ ID NO: 4036114 - RNA, 15 nt, Staphylococcus aureus subsp. aureus N315
aacaguuaauaugaa

SEQ ID NO: 4036115 - RNA, 13 nt, Staphylococcus aureus subsp. aureus N315
aacaguuagugcu

SEQ ID NO: 4036116 - RNA, 13 nt, Staphylococcus aureus subsp. aureus N315
aacauaagauaca

SEQ ID NO: 4036117 - RNA, 13 nt, Staphylococcus aureus subsp. aureus N315
aacauaauauuuc

SEQ ID NO: 4036118 - RNA, 13 nt, Staphylococcus aureus subsp. aureus N315
aacauaauuuuua

SEQ ID NO: 4036119 - RNA, 19 nt, Staphylococcus aureus subsp. aureus N315
aacauaauuuuuauuuaca

SEQ ID NO: 4036120 - RNA, 22 nt, Staphylococcus aureus subsp. aureus N315
aacauacuauaaaaauuuauuc

SEQ ID NO: 4036121 - RNA, 23 nt, Staphylococcus aureus subsp. aureus N315
aacauagauacaaaguacaguua

SEQ ID NO: 4036122 - RNA, 21 nt, Staphylococcus aureus subsp. aureus N315
aacauagcuuaauaauuaaua

SEQ ID NO: 4036123 - RNA, 14 nt, Staphylococcus aureus subsp. aureus N315
aacauauaaaucau

SEQ ID NO: 4036124 - RNA, 15 nt, Staphylococcus aureus subsp. aureus N315
aacauauaaaucauu

SEQ ID NO: 4036125 - RNA, 14 nt, Staphylococcus aureus subsp. aureus N315
aacauauucauaau

SEQ ID NO: 4036126 - RNA, 21 nt, Staphylococcus aureus subsp. aureus N315
aacauauuuaucucuuucuuc

SEQ ID NO: 4036127 - RNA, 21 nt, Staphylococcus aureus subsp. aureus N315
aacauauuuuaacuaugaaug

SEQ ID NO: 4036128 - RNA, 19 nt, Staphylococcus aureus subsp. aureus N315
aacaucaauuacucuuuuu

SEQ ID NO: 4036129 - RNA, 18 nt, Staphylococcus aureus subsp. aureus N315
aacaucacauaaaauaca

SEQ ID NO: 4036130 - RNA, 21 nt, Staphylococcus aureus subsp. aureus N315
aacaucacuuuaggguucauu

SEQ ID NO: 4036131 - RNA, 16 nt, Staphylococcus aureus subsp. aureus N315
aacaucauaaucgcca

SEQ ID NO: 4036132 - RNA, 14 nt, Staphylococcus aureus subsp. aureus N315
aacaucaucuaugc

SEQ ID NO: 4036133 - RNA, 13 nt, Staphylococcus aureus subsp. aureus N315
aacaucaucuuua

SEQ ID NO: 4036134 - RNA, 13 nt, Staphylococcus aureus subsp. aureus N315
aacaucauucaca

SEQ ID NO: 4036135 - RNA, 16 nt, Staphylococcus aureus subsp. aureus N315
aacauccccaaaaaua

SEQ ID NO: 4036136 - RNA, 22 nt, Staphylococcus aureus subsp. aureus N315
aacauccugcuuauuaauuguu

SEQ ID NO: 4036137 - RNA, 16 nt, Staphylococcus aureus subsp. aureus N315
aacaucuauaacaaaa

SEQ ID NO: 4036138 - RNA, 21 nt, Staphylococcus aureus subsp. aureus N315
aacaucuauaacaaaaucuca

SEQ ID NO: 4036139 - RNA, 15 nt, Staphylococcus aureus subsp. aureus N315
aacaucugaaaaaau

SEQ ID NO: 4036140 - RNA, 16 nt, Staphylococcus aureus subsp. aureus N315
aacaucugaaucugaa

SEQ ID NO: 4036141 - RNA, 15 nt, Staphylococcus aureus subsp. aureus N315
aacaucuugauauuc

SEQ ID NO: 4036142 - RNA, 21 nt, Staphylococcus aureus subsp. aureus N315
aacaucuuuuguuguuuuuga

SEQ ID NO: 4036143 - RNA, 17 nt, Staphylococcus aureus subsp. aureus N315
aacaugaacaaucagau

SEQ ID NO: 4036144 - RNA, 23 nt, Staphylococcus aureus subsp. aureus N315
aacaugaacaaucagauaaguua

SEQ ID NO: 4036145 - RNA, 23 nt, Staphylococcus aureus subsp. aureus N315
aacaugaccuaauauauuacuaa

SEQ ID NO: 4036146 - RNA, 13 nt, Staphylococcus aureus subsp. aureus N315
aacaugauacgua

SEQ ID NO: 4036147 - RNA, 22 nt, Staphylococcus aureus subsp. aureus N315
aacaugauacugaaauuucaua

SEQ ID NO: 4036148 - RNA, 21 nt, Staphylococcus aureus subsp. aureus N315
aacaugauucaugauauguuc

SEQ ID NO: 4036149 - RNA, 20 nt, Staphylococcus aureus subsp. aureus N315
aacaugcuuggacauauacu

SEQ ID NO: 4036150 - RNA, 23 nt, Staphylococcus aureus subsp. aureus N315
aacaugguuuucuuuuuaucaug

SEQ ID NO: 4036151 - RNA, 13 nt, Staphylococcus aureus subsp. aureus N315
aacauguacaauu

SEQ ID NO: 4036152 - RNA, 17 nt, Staphylococcus aureus subsp. aureus N315
aacauguacaauuuuua

SEQ ID NO: 4036153 - RNA, 18 nt, Staphylococcus aureus subsp. aureus N315
aacauguacaauuuuuaa

SEQ ID NO: 4036154 - RNA, 13 nt, Staphylococcus aureus subsp. aureus N315
aacaugugcaagu

SEQ ID NO: 4036155 - RNA, 13 nt, Staphylococcus aureus subsp. aureus N315
aacauguguauga

SEQ ID NO: 4036156 - RNA, 16 nt, Staphylococcus aureus subsp. aureus N315
aacauguguaugauca

SEQ ID NO: 4036157 - RNA, 22 nt, Staphylococcus aureus subsp. aureus N315
aacauguuccgcuacaaaacau

SEQ ID NO: 4036158 - RNA, 21 nt, Staphylococcus aureus subsp. aureus N315
aacauuaaaauaauuaaauaa

SEQ ID NO: 4036159 - RNA, 15 nt, Staphylococcus aureus subsp. aureus N315
aacauuaaaaugaua

SEQ ID NO: 4036160 - RNA, 17 nt, Staphylococcus aureus subsp. aureus N315
aacauuaauaaauaaua

SEQ ID NO: 4036161 - RNA, 20 nt, Staphylococcus aureus subsp. aureus N315
aacauuaaucuauauaaaaa

SEQ ID NO: 4036162 - RNA, 23 nt, Staphylococcus aureus subsp. aureus N315
aacauuaaucuauauaaaaacug

SEQ ID NO: 4036163 - RNA, 22 nt, Staphylococcus aureus subsp. aureus N315
aacauuacaugcaccuuuacaa

SEQ ID NO: 4036164 - RNA, 17 nt, Staphylococcus aureus subsp. aureus N315
aacauuagcaugauaaa

SEQ ID NO: 4036165 - RNA, 19 nt, Staphylococcus aureus subsp. aureus N315
aacauuagcaugauaaagu

SEQ ID NO: 4036166 - RNA, 14 nt, Staphylococcus aureus subsp. aureus N315
aacauuagcauuaa

SEQ ID NO: 4036167 - RNA, 14 nt, Staphylococcus aureus subsp. aureus N315
aacauuauuaaaca

SEQ ID NO: 4036168 - RNA, 18 nt, Staphylococcus aureus subsp. aureus N315
aacauuauuuauauuuag

SEQ ID NO: 4036169 - RNA, 19 nt, Staphylococcus aureus subsp. aureus N315
aacauuauuuauauuuaga

SEQ ID NO: 4036170 - RNA, 13 nt, Staphylococcus aureus subsp. aureus N315
aacauuauuuuug

SEQ ID NO: 4036171 - RNA, 19 nt, Staphylococcus aureus subsp. aureus N315
aacauucccuuaauaauaa

SEQ ID NO: 4036172 - RNA, 17 nt, Staphylococcus aureus subsp. aureus N315
aacauucuucaaaaaau

SEQ ID NO: 4036173 - RNA, 15 nt, Staphylococcus aureus subsp. aureus N315
aacauugagauuauc

SEQ ID NO: 4036174 - RNA, 14 nt, Staphylococcus aureus subsp. aureus N315
aacauuuaaaaaau

SEQ ID NO: 4036175 - RNA, 18 nt, Staphylococcus aureus subsp. aureus N315
aacauuuaucgugaagaa

SEQ ID NO: 4036176 - RNA, 20 nt, Staphylococcus aureus subsp. aureus N315
aacauuuaucgugaagaaaa

SEQ ID NO: 4036177 - RNA, 16 nt, Staphylococcus aureus subsp. aureus N315
aacauuuguccgauuu

SEQ ID NO: 4036178 - RNA, 13 nt, Staphylococcus aureus subsp. aureus N315
aacauuuugaguc

SEQ ID NO: 4036179 - RNA, 21 nt, Staphylococcus aureus subsp. aureus N315
aacauuuugccccucauucac

SEQ ID NO: 4036180 - RNA, 16 nt, Staphylococcus aureus subsp. aureus N315
aacauuuuuagaauca

SEQ ID NO: 4036181 - RNA, 20 nt, Staphylococcus aureus subsp. aureus N315
aacauuuuugugcaaaaguu

SEQ ID NO: 4036182 - RNA, 14 nt, Staphylococcus aureus subsp. aureus N315
aacauuuuuucuau

SEQ ID NO: 4036183 - RNA, 21 nt, Staphylococcus aureus subsp. aureus N315
aaccaaaaaauccaagcgcuu

SEQ ID NO: 4036184 - RNA, 15 nt, Staphylococcus aureus subsp. aureus N315
aaccaaaaccaaaug

SEQ ID NO: 4036185 - RNA, 18 nt, Staphylococcus aureus subsp. aureus N315
aaccaaaaccaaaugaac

SEQ ID NO: 4036186 - RNA, 13 nt, Staphylococcus aureus subsp. aureus N315
aaccaaauaauug

SEQ ID NO: 4036187 - RNA, 18 nt, Staphylococcus aureus subsp. aureus N315
aaccaaaucggaauaaaa

SEQ ID NO: 4036188 - RNA, 20 nt, Staphylococcus aureus subsp. aureus N315
aaccaaaucggaauaaaaua

SEQ ID NO: 4036189 - RNA, 23 nt, Staphylococcus aureus subsp. aureus N315
aaccaaaucggaauaaaauaaau

SEQ ID NO: 4036190 - RNA, 19 nt, Staphylococcus aureus subsp. aureus N315
aaccaacuuucucaaguaa

SEQ ID NO: 4036191 - RNA, 23 nt, Staphylococcus aureus subsp. aureus N315
aaccaaucaucgcaaauacauaa

SEQ ID NO: 4036192 - RNA, 19 nt, Staphylococcus aureus subsp. aureus N315
aaccaaugauuguuaauac

SEQ ID NO: 4036193 - RNA, 14 nt, Staphylococcus aureus subsp. aureus N315
aaccaauuaauugu

SEQ ID NO: 4036194 - RNA, 17 nt, Staphylococcus aureus subsp. aureus N315
aaccaauuaauuguaaa

SEQ ID NO: 4036195 - RNA, 21 nt, Staphylococcus aureus subsp. aureus N315
aaccaauuuuaacuuauauac

SEQ ID NO: 4036196 - RNA, 16 nt, Staphylococcus aureus subsp. aureus N315
aaccacgcaucaugua

SEQ ID NO: 4036197 - RNA, 22 nt, Staphylococcus aureus subsp. aureus N315
aaccacuuuuuuguucaaucac

SEQ ID NO: 4036198 - RNA, 20 nt, Staphylococcus aureus subsp. aureus N315
aaccagcuaaccaaauaauu

SEQ ID NO: 4036199 - RNA, 13 nt, Staphylococcus aureus subsp. aureus N315
aaccauaacaauu

SEQ ID NO: 4036200 - RNA, 16 nt, Staphylococcus aureus subsp. aureus N315
aaccauaacaauuuug

SEQ ID NO: 4036201 - RNA, 17 nt, Staphylococcus aureus subsp. aureus N315
aaccauaaguaaaacug

SEQ ID NO: 4036202 - RNA, 21 nt, Staphylococcus aureus subsp. aureus N315
aaccauagauaauugcuauaa

SEQ ID NO: 4036203 - RNA, 16 nt, Staphylococcus aureus subsp. aureus N315
aaccauaguaauaaaa

SEQ ID NO: 4036204 - RNA, 18 nt, Staphylococcus aureus subsp. aureus N315
aaccauaguaauaaaaug

SEQ ID NO: 4036205 - RNA, 15 nt, Staphylococcus aureus subsp. aureus N315
aaccauccauaggau

SEQ ID NO: 4036206 - RNA, 17 nt, Staphylococcus aureus subsp. aureus N315
aaccaugauuagcgcac

SEQ ID NO: 4036207 - RNA, 18 nt, Staphylococcus aureus subsp. aureus N315
aaccauucguaauaaaca

SEQ ID NO: 4036208 - RNA, 14 nt, Staphylococcus aureus subsp. aureus N315
aaccauuuuuucaa

SEQ ID NO: 4036209 - RNA, 22 nt, Staphylococcus aureus subsp. aureus N315
aaccauuuuuuuaucuguagaa

SEQ ID NO: 4036210 - RNA, 18 nt, Staphylococcus aureus subsp. aureus N315
aacccauuuucaaaacua

SEQ ID NO: 4036211 - RNA, 20 nt, Staphylococcus aureus subsp. aureus N315
aacccauuuucaaaacuagc

SEQ ID NO: 4036212 - RNA, 18 nt, Staphylococcus aureus subsp. aureus N315
aaccgauuaauauaauac

SEQ ID NO: 4036213 - RNA, 14 nt, Staphylococcus aureus subsp. aureus N315
aaccgcuguuuuuc

SEQ ID NO: 4036214 - RNA, 15 nt, Staphylococcus aureus subsp. aureus N315
aaccguuauauauua

SEQ ID NO: 4036215 - RNA, 13 nt, Staphylococcus aureus subsp. aureus N315
aaccuaaaaacaa

SEQ ID NO: 4036216 - RNA, 20 nt, Staphylococcus aureus subsp. aureus N315
aaccuaaagauaauauuaaa

SEQ ID NO: 4036217 - RNA, 16 nt, Staphylococcus aureus subsp. aureus N315
aaccuaaguuaauuua

SEQ ID NO: 4036218 - RNA, 23 nt, Staphylococcus aureus subsp. aureus N315
aaccuaaucuaccauguuuugua

SEQ ID NO: 4036219 - RNA, 12 nt, Staphylococcus aureus subsp. aureus N315
aaccuacaauau

SEQ ID NO: 4036220 - RNA, 14 nt, Staphylococcus aureus subsp. aureus N315
aagaaaauuucagu

SEQ ID NO: 4036221 - RNA, 14 nt, Staphylococcus aureus subsp. aureus N315
aagaaacauuauau

SEQ ID NO: 4036222 - RNA, 15 nt, Staphylococcus aureus subsp. aureus N315
aagaaagaaacauag

SEQ ID NO: 4036223 - RNA, 15 nt, Staphylococcus aureus subsp. aureus N315
aagaaauaauuuaaa

SEQ ID NO: 4036224 - RNA, 16 nt, Staphylococcus aureus subsp. aureus N315
aagaaaucaacaacuu

SEQ ID NO: 4036225 - RNA, 14 nt, Staphylococcus aureus subsp. aureus N315
aagaaaucaccaga

SEQ ID NO: 4036226 - RNA, 20 nt, Staphylococcus aureus subsp. aureus N315
aagaaaucaccagauuuuaa

SEQ ID NO: 4036227 - RNA, 13 nt, Staphylococcus aureus subsp. aureus N315
aagaaauguuaaa

SEQ ID NO: 4036228 - RNA, 19 nt, Staphylococcus aureus subsp. aureus N315
aagaaauucuacaggcaau

SEQ ID NO: 4036229 - RNA, 19 nt, Staphylococcus aureus subsp. aureus N315
aagaaauucuacagguaau

SEQ ID NO: 4036230 - RNA, 22 nt, Staphylococcus aureus subsp. aureus N315
aagaaauucuacagguaaugca

SEQ ID NO: 4036231 - RNA, 12 nt, Staphylococcus aureus subsp. aureus N315
aagaaauuuaau

SEQ ID NO: 4036232 - RNA, 15 nt, Staphylococcus aureus subsp. aureus N315
aagaaauuuaauaca

SEQ ID NO: 4036233 - RNA, 16 nt, Staphylococcus aureus subsp. aureus N315
aagaaauuuaauacaa

SEQ ID NO: 4036234 - RNA, 12 nt, Staphylococcus aureus subsp. aureus N315
aagaaauuuuuu

SEQ ID NO: 4036235 - RNA, 14 nt, Staphylococcus aureus subsp. aureus N315
aagaacauaaccua

SEQ ID NO: 4036236 - RNA, 20 nt, Staphylococcus aureus subsp. aureus N315
aagaacgaagaaugauacug

SEQ ID NO: 4036237 - RNA, 17 nt, Staphylococcus aureus subsp. aureus N315
aagaacguguuugaaug

SEQ ID NO: 4036238 - RNA, 16 nt, Staphylococcus aureus subsp. aureus N315
aagaacuaacauaauu

SEQ ID NO: 4036239 - RNA, 15 nt, Staphylococcus aureus subsp. aureus N315
aagaacuuuaaaaau

SEQ ID NO: 4036240 - RNA, 13 nt, Staphylococcus aureus subsp. aureus N315
aagaagaaauacu

SEQ ID NO: 4036241 - RNA, 22 nt, Staphylococcus aureus subsp. aureus N315
aagaagacauuggauuacuucc

SEQ ID NO: 4036242 - RNA, 18 nt, Staphylococcus aureus subsp. aureus N315
aagaagauuaugaaaaca

SEQ ID NO: 4036243 - RNA, 19 nt, Staphylococcus aureus subsp. aureus N315
aagaaggaugaguuuaaaa

SEQ ID NO: 4036244 - RNA, 16 nt, Staphylococcus aureus subsp. aureus N315
aagaaguaauguuaaa

SEQ ID NO: 4036245 - RNA, 15 nt, Staphylococcus aureus subsp. aureus N315
aagaaguuuccaacg

SEQ ID NO: 4036246 - RNA, 16 nt, Staphylococcus aureus subsp. aureus N315
aagaauaaaaaaguug

SEQ ID NO: 4036247 - RNA, 19 nt, Staphylococcus aureus subsp. aureus N315
aagaauaaaaaaguugauu

SEQ ID NO: 4036248 - RNA, 14 nt, Staphylococcus aureus subsp. aureus N315
aagaauaaacaaca

SEQ ID NO: 4036249 - RNA, 15 nt, Staphylococcus aureus subsp. aureus N315
aagaauaaacaacau

SEQ ID NO: 4036250 - RNA, 15 nt, Staphylococcus aureus subsp. aureus N315
aagaauacaaauauu

SEQ ID NO: 4036251 - RNA, 17 nt, Staphylococcus aureus subsp. aureus N315
aagaauacaugacucca

SEQ ID NO: 4036252 - RNA, 14 nt, Staphylococcus aureus subsp. aureus N315
aagaaucauuuaaa

SEQ ID NO: 4036253 - RNA, 15 nt, Staphylococcus aureus subsp. aureus N315
aagaaucauuuaaau

SEQ ID NO: 4036254 - RNA, 21 nt, Staphylococcus aureus subsp. aureus N315
aagaauccuaugccaaauaac

SEQ ID NO: 4036255 - RNA, 17 nt, Staphylococcus aureus subsp. aureus N315
aagaaugauuuauaaaa

SEQ ID NO: 4036256 - RNA, 20 nt, Staphylococcus aureus subsp. aureus N315
aagaaugccuuuuauuuauc

SEQ ID NO: 4036257 - RNA, 22 nt, Staphylococcus aureus subsp. aureus N315
aagaauuaacaacaaauauaau

SEQ ID NO: 4036258 - RNA, 14 nt, Staphylococcus aureus subsp. aureus N315
aagaauuaaguagu

SEQ ID NO: 4036259 - RNA, 21 nt, Staphylococcus aureus subsp. aureus N315
aagaauuaauucgccuaaaug

SEQ ID NO: 4036260 - RNA, 23 nt, Staphylococcus aureus subsp. aureus N315
aagaauuaauucgccuaaauggu

SEQ ID NO: 4036261 - RNA, 12 nt, Staphylococcus aureus subsp. aureus N315
aagaauuuaaaa

SEQ ID NO: 4036262 - RNA, 13 nt, Staphylococcus aureus subsp. aureus N315
aagaauuuaaaag

SEQ ID NO: 4036263 - RNA, 20 nt, Staphylococcus aureus subsp. aureus N315
aagaauuucgaaaagaaauu

SEQ ID NO: 4036264 - RNA, 11 nt, Staphylococcus aureus subsp. aureus N315
aagacagaaau

SEQ ID NO: 4036265 - RNA, 20 nt, Staphylococcus aureus subsp. aureus N315
aagacauacagucaauacaa

SEQ ID NO: 4036266 - RNA, 22 nt, Staphylococcus aureus subsp. aureus N315
aagacauacucacaaaaaacac

SEQ ID NO: 4036267 - RNA, 12 nt, Staphylococcus aureus subsp. aureus N315
aagacauaugca

SEQ ID NO: 4036268 - RNA, 15 nt, Staphylococcus aureus subsp. aureus N315
aagacaugagauuau

SEQ ID NO: 4036269 - RNA, 23 nt, Staphylococcus aureus subsp. aureus N315
aagaccacuauuuuuaaaugauu

SEQ ID NO: 4036270 - RNA, 19 nt, Staphylococcus aureus subsp. aureus N315
aagaccaugcaaacucauu

SEQ ID NO: 4036271 - RNA, 22 nt, Staphylococcus aureus subsp. aureus N315
aagaccaugcaaacucauuuau

SEQ ID NO: 4036272 - RNA, 15 nt, Staphylococcus aureus subsp. aureus N315
aagaccauuuuauau

SEQ ID NO: 4036273 - RNA, 19 nt, Staphylococcus aureus subsp. aureus N315
aagaccauuuuauauuuua

SEQ ID NO: 4036274 - RNA, 20 nt, Staphylococcus aureus subsp. aureus N315
aagaccauuuuauauuuuag

SEQ ID NO: 4036275 - RNA, 21 nt, Staphylococcus aureus subsp. aureus N315
aagaccauuuuauauuuuagu

SEQ ID NO: 4036276 - RNA, 17 nt, Staphylococcus aureus subsp. aureus N315
aagaccccgaaaagagg

SEQ ID NO: 4036277 - RNA, 22 nt, Staphylococcus aureus subsp. aureus N315
aagacgauuuauuaguuuuuac

SEQ ID NO: 4036278 - RNA, 21 nt, Staphylococcus aureus subsp. aureus N315
aagacggugaccuuauauuuu

SEQ ID NO: 4036279 - RNA, 11 nt, Staphylococcus aureus subsp. aureus N315
aagacugccau

SEQ ID NO: 4036280 - RNA, 22 nt, Staphylococcus aureus subsp. aureus N315
aagacuucguugcacuuuaaua

SEQ ID NO: 4036281 - RNA, 15 nt, Staphylococcus aureus subsp. aureus N315
aagagauaagaaaau

SEQ ID NO: 4036282 - RNA, 21 nt, Staphylococcus aureus subsp. aureus N315
aagagauacugguuaguaaaa

SEQ ID NO: 4036283 - RNA, 17 nt, Staphylococcus aureus subsp. aureus N315
aagagcaauuaaaguca

SEQ ID NO: 4036284 - RNA, 17 nt, Staphylococcus aureus subsp. aureus N315
aagagccacuaaugauu

SEQ ID NO: 4036285 - RNA, 22 nt, Staphylococcus aureus subsp. aureus N315
aagaggacaacuaauaacaaau

SEQ ID NO: 4036286 - RNA, 13 nt, Staphylococcus aureus subsp. aureus N315
aagaggagaaagc

SEQ ID NO: 4036287 - RNA, 13 nt, Staphylococcus aureus subsp. aureus N315
aagaggucuccaa

SEQ ID NO: 4036288 - RNA, 19 nt, Staphylococcus aureus subsp. aureus N315
aagaggucuccaauacuuu

SEQ ID NO: 4036289 - RNA, 23 nt, Staphylococcus aureus subsp. aureus N315
aagauaaauaaaaggcauucuuc

SEQ ID NO: 4036290 - RNA, 21 nt, Staphylococcus aureus subsp. aureus N315
aagauaacuagcaaaugcacu

SEQ ID NO: 4036291 - RNA, 14 nt, Staphylococcus aureus subsp. aureus N315
aagauaauauuaaa

SEQ ID NO: 4036292 - RNA, 22 nt, Staphylococcus aureus subsp. aureus N315
aagauaauuuucaauuagaaaa

SEQ ID NO: 4036293 - RNA, 15 nt, Staphylococcus aureus subsp. aureus N315
aagauaccuuuuucu

SEQ ID NO: 4036294 - RNA, 21 nt, Staphylococcus aureus subsp. aureus N315
aagauacguugauguaauucu

SEQ ID NO: 4036295 - RNA, 16 nt, Staphylococcus aureus subsp. aureus N315
aagauacuuuuaaauu

SEQ ID NO: 4036296 - RNA, 19 nt, Staphylococcus aureus subsp. aureus N315
aagauagaaugaauaauuc

SEQ ID NO: 4036297 - RNA, 16 nt, Staphylococcus aureus subsp. aureus N315
aagauaggauuuacac

SEQ ID NO: 4036298 - RNA, 20 nt, Staphylococcus aureus subsp. aureus N315
aagauaggauuuacaccuau

SEQ ID NO: 4036299 - RNA, 23 nt, Staphylococcus aureus subsp. aureus N315
aagauaggauuugcaccuauacc

SEQ ID NO: 4036300 - RNA, 17 nt, Staphylococcus aureus subsp. aureus N315
aagauagguuuauuucu

SEQ ID NO: 4036301 - RNA, 14 nt, Staphylococcus aureus subsp. aureus N315
aagauauagaauuc

SEQ ID NO: 4036302 - RNA, 15 nt, Staphylococcus aureus subsp. aureus N315
aagauauauuguaag

SEQ ID NO: 4036303 - RNA, 15 nt, Staphylococcus aureus subsp. aureus N315
aagauaucuggauua

SEQ ID NO: 4036304 - RNA, 22 nt, Staphylococcus aureus subsp. aureus N315
aagauauuuauaagaggagaaa

SEQ ID NO: 4036305 - RNA, 18 nt, Staphylococcus aureus subsp. aureus N315
aagaucauuuucaacaua

SEQ ID NO: 4036306 - RNA, 20 nt, Staphylococcus aureus subsp. aureus N315
aagaugaaaaagucuuucuc

SEQ ID NO: 4036307 - RNA, 21 nt, Staphylococcus aureus subsp. aureus N315
aagaugauuauucucuuuauu

SEQ ID NO: 4036308 - RNA, 15 nt, Staphylococcus aureus subsp. aureus N315
aaggggguaauacua

SEQ ID NO: 4036309 - RNA, 22 nt, Staphylococcus aureus subsp. aureus N315
aaggguguuuagauagcucuau

SEQ ID NO: 4036310 - RNA, 21 nt, Staphylococcus aureus subsp. aureus N315
aagguacguuguaauaguaag

SEQ ID NO: 4036311 - RNA, 22 nt, Staphylococcus aureus subsp. aureus N315
aagguacuuauuucaaaaauag

SEQ ID NO: 4036312 - RNA, 17 nt, Staphylococcus aureus subsp. aureus N315
aaggucaccuuuaaauu

SEQ ID NO: 4036313 - RNA, 15 nt, Staphylococcus aureus subsp. aureus N315
aaggucccauuaaaa

SEQ ID NO: 4036314 - RNA, 19 nt, Staphylococcus aureus subsp. aureus N315
aagguguucgggaauuuuu

SEQ ID NO: 4036315 - RNA, 19 nt, Staphylococcus aureus subsp. aureus N315
aagguuauuuuuuaugguc

SEQ ID NO: 4036316 - RNA, 17 nt, Staphylococcus aureus subsp. aureus N315
aagguuguucuauacau

SEQ ID NO: 4036317 - RNA, 12 nt, Staphylococcus aureus subsp. aureus N315
aaguaaaacugc

SEQ ID NO: 4036318 - RNA, 12 nt, Staphylococcus aureus subsp. aureus N315
aaguaaauaaua

SEQ ID NO: 4036319 - RNA, 16 nt, Staphylococcus aureus subsp. aureus N315
aaguaagcaccuguua

SEQ ID NO: 4036320 - RNA, 13 nt, Staphylococcus aureus subsp. aureus N315
aaguaauaaaaua

SEQ ID NO: 4036321 - RNA, 14 nt, Staphylococcus aureus subsp. aureus N315
aaguaauaaaauaa

SEQ ID NO: 4036322 - RNA, 18 nt, Staphylococcus aureus subsp. aureus N315
aaguaauaaguaauaauu

SEQ ID NO: 4036323 - RNA, 15 nt, Staphylococcus aureus subsp. aureus N315
aaguaauauauaaaa

SEQ ID NO: 4036324 - RNA, 21 nt, Staphylococcus aureus subsp. aureus N315
aaguaauaugagugaaaguuu

SEQ ID NO: 4036325 - RNA, 14 nt, Staphylococcus aureus subsp. aureus N315
aaguaaugauauua

SEQ ID NO: 4036326 - RNA, 17 nt, Staphylococcus aureus subsp. aureus N315
aaguaauggauugauaa

SEQ ID NO: 4036327 - RNA, 13 nt, Staphylococcus aureus subsp. aureus N315
aaguaauguuaaa

SEQ ID NO: 4036328 - RNA, 19 nt, Staphylococcus aureus subsp. aureus N315
aaguaauguuaaacacuca

SEQ ID NO: 4036329 - RNA, 14 nt, Staphylococcus aureus subsp. aureus N315
aaguaauuaaauac

SEQ ID NO: 4036330 - RNA, 15 nt, Staphylococcus aureus subsp. aureus N315
aaguaauuaaauacu

SEQ ID NO: 4036331 - RNA, 13 nt, Staphylococcus aureus subsp. aureus N315
aaguaauuuaauu

SEQ ID NO: 4036332 - RNA, 17 nt, Staphylococcus aureus subsp. aureus N315
aaguaauuuaauugguu

SEQ ID NO: 4036333 - RNA, 13 nt, Staphylococcus aureus subsp. aureus N315
aaguacaaauaau

SEQ ID NO: 4036334 - RNA, 14 nt, Staphylococcus aureus subsp. aureus N315
aaguacaaauaaua

SEQ ID NO: 4036335 - RNA, 17 nt, Staphylococcus aureus subsp. aureus N315
aaguacaaauaauacag

SEQ ID NO: 4036336 - RNA, 18 nt, Staphylococcus aureus subsp. aureus N315
aaguaccuaaaauagaaa

SEQ ID NO: 4036337 - RNA, 21 nt, Staphylococcus aureus subsp. aureus N315
aaguaccuaaaauagaaaaau

SEQ ID NO: 4036338 - RNA, 22 nt, Staphylococcus aureus subsp. aureus N315
aaguacgacgguauaaaaaaau

SEQ ID NO: 4036339 - RNA, 22 nt, Staphylococcus aureus subsp. aureus N315
aaguacgcaauuuaauauuaua

SEQ ID NO: 4036340 - RNA, 14 nt, Staphylococcus aureus subsp. aureus N315
aaguacuuacaaau

SEQ ID NO: 4036341 - RNA, 16 nt, Staphylococcus aureus subsp. aureus N315
aaguacuuacaaauau

SEQ ID NO: 4036342 - RNA, 17 nt, Staphylococcus aureus subsp. aureus N315
aaguacuuacaaauaua

SEQ ID NO: 4036343 - RNA, 22 nt, Staphylococcus aureus subsp. aureus N315
aaguacuuaccuuucaaauaua

SEQ ID NO: 4036344 - RNA, 20 nt, Staphylococcus aureus subsp. aureus N315
aaguacuuuaaaauuguaua

SEQ ID NO: 4036345 - RNA, 13 nt, Staphylococcus aureus subsp. aureus N315
aaguacuuuacca

SEQ ID NO: 4036346 - RNA, 14 nt, Staphylococcus aureus subsp. aureus N315
aaguagaagcaaaa

SEQ ID NO: 4036347 - RNA, 23 nt, Staphylococcus aureus subsp. aureus N315
aaguagcucaaaacaauuuaaaa

SEQ ID NO: 4036348 - RNA, 18 nt, Staphylococcus aureus subsp. aureus N315
aaguaguucagcaaguuu

SEQ ID NO: 4036349 - RNA, 14 nt, Staphylococcus aureus subsp. aureus N315
aaguaguuguuaua

SEQ ID NO: 4036350 - RNA, 17 nt, Staphylococcus aureus subsp. aureus N315
aaguaguuguuauauuc

SEQ ID NO: 4036351 - RNA, 13 nt, Staphylococcus aureus subsp. aureus N315
aaguaguuucauu

SEQ ID NO: 4036352 - RNA, 13 nt, Staphylococcus aureus subsp. aureus N315
aaguauaaauaua

SEQ ID NO: 4036353 - RNA, 15 nt, Staphylococcus aureus subsp. aureus N315
aaguauaauuaaacu

SEQ ID NO: 4036354 - RNA, 21 nt, Staphylococcus aureus subsp. aureus N315
aaguauacuugaagaaucagg

SEQ ID NO: 4036355 - RNA, 18 nt, Staphylococcus aureus subsp. aureus N315
aaguauagcuuuuaucca

SEQ ID NO: 4036356 - RNA, 13 nt, Staphylococcus aureus subsp. aureus N315
aaguauaugaauc

SEQ ID NO: 4036357 - RNA, 21 nt, Staphylococcus aureus subsp. aureus N315
aaguauaugaaucgauauaau

SEQ ID NO: 4036358 - RNA, 20 nt, Staphylococcus aureus subsp. aureus N315
aaguaucgccaucauucacc

SEQ ID NO: 4036359 - RNA, 16 nt, Staphylococcus aureus subsp. aureus N315
aaguaucggugauuua

SEQ ID NO: 4036360 - RNA, 20 nt, Staphylococcus aureus subsp. aureus N315
aaguaucuaugaaauuuuuu

SEQ ID NO: 4036361 - RNA, 12 nt, Staphylococcus aureus subsp. aureus N315
aaguaucuguga

SEQ ID NO: 4036362 - RNA, 20 nt, Staphylococcus aureus subsp. aureus N315
aaguaucugugaauaugcuu

SEQ ID NO: 4036363 - RNA, 21 nt, Staphylococcus aureus subsp. aureus N315
aaguaugagacgcauugcaag

SEQ ID NO: 4036364 - RNA, 16 nt, Staphylococcus aureus subsp. aureus N315
aaguauggaaguuguu

SEQ ID NO: 4036365 - RNA, 14 nt, Staphylococcus aureus subsp. aureus N315
aaguauggcaguuu

SEQ ID NO: 4036366 - RNA, 19 nt, Staphylococcus aureus subsp. aureus N315
aaguauggcgaaauguuuu

SEQ ID NO: 4036367 - RNA, 20 nt, Staphylococcus aureus subsp. aureus N315
aaguaugucaucuucaauuc

SEQ ID NO: 4036368 - RNA, 22 nt, Staphylococcus aureus subsp. aureus N315
aaguaugucaucuucaauucuu

SEQ ID NO: 4036369 - RNA, 15 nt, Staphylococcus aureus subsp. aureus N315
aaguauguugucaua

SEQ ID NO: 4036370 - RNA, 15 nt, Staphylococcus aureus subsp. aureus N315
aaguauguuuuauac

SEQ ID NO: 4036371 - RNA, 16 nt, Staphylococcus aureus subsp. aureus N315
aaguauuaugauugcu

SEQ ID NO: 4036372 - RNA, 16 nt, Staphylococcus aureus subsp. aureus N315
aaguauuuaaauaaca

SEQ ID NO: 4036373 - RNA, 23 nt, Staphylococcus aureus subsp. aureus N315
aaguauuuucuuaguuugacauc

SEQ ID NO: 4036374 - RNA, 15 nt, Staphylococcus aureus subsp. aureus N315
aagucaauaauuuua

SEQ ID NO: 4036375 - RNA, 13 nt, Staphylococcus aureus subsp. aureus N315
aagucaauuuaaa

SEQ ID NO: 4036376 - RNA, 15 nt, Staphylococcus aureus subsp. aureus N315
aagucacauuuauaa

SEQ ID NO: 4036377 - RNA, 22 nt, Staphylococcus aureus subsp. aureus N315
aagucaggaucacguuuuucuu

SEQ ID NO: 4036378 - RNA, 13 nt, Staphylococcus aureus subsp. aureus N315
aagucauuaaaug

SEQ ID NO: 4036379 - RNA, 15 nt, Staphylococcus aureus subsp. aureus N315
aagucauuaaaugua

SEQ ID NO: 4036380 - RNA, 13 nt, Staphylococcus aureus subsp. aureus N315
aagucauuuucau

SEQ ID NO: 4036381 - RNA, 16 nt, Staphylococcus aureus subsp. aureus N315
aagucauuuucauuca

SEQ ID NO: 4036382 - RNA, 17 nt, Staphylococcus aureus subsp. aureus N315
aaguccggcugaaggga

SEQ ID NO: 4036383 - RNA, 16 nt, Staphylococcus aureus subsp. aureus N315
aagucucuugucauuu

SEQ ID NO: 4036384 - RNA, 17 nt, Staphylococcus aureus subsp. aureus N315
aagucucuugucauuuc

SEQ ID NO: 4036385 - RNA, 15 nt, Staphylococcus aureus subsp. aureus N315
aagucucuuuccuca

SEQ ID NO: 4036386 - RNA, 20 nt, Staphylococcus aureus subsp. aureus N315
aagucugaugucgaaaauag

SEQ ID NO: 4036387 - RNA, 18 nt, Staphylococcus aureus subsp. aureus N315
aagucugcugguaacucu

SEQ ID NO: 4036388 - RNA, 16 nt, Staphylococcus aureus subsp. aureus N315
aagucuguauauggcg

SEQ ID NO: 4036389 - RNA, 16 nt, Staphylococcus aureus subsp. aureus N315
aagucuguugguuuau

SEQ ID NO: 4036390 - RNA, 23 nt, Staphylococcus aureus subsp. aureus N315
aagucuguugguuuaucagcuuu

SEQ ID NO: 4036391 - RNA, 19 nt, Staphylococcus aureus subsp. aureus N315
aagucuugugauaauucuu

SEQ ID NO: 4036392 - RNA, 17 nt, Staphylococcus aureus subsp. aureus N315
aagugaaaucauuuaaa

SEQ ID NO: 4036393 - RNA, 18 nt, Staphylococcus aureus subsp. aureus N315
aagugaaaucauuuaaau

SEQ ID NO: 4036394 - RNA, 15 nt, Staphylococcus aureus subsp. aureus N315
aagugaacuauuaaa

SEQ ID NO: 4036395 - RNA, 16 nt, Staphylococcus aureus subsp. aureus N315
aagugaacuauuaaaa

SEQ ID NO: 4036396 - RNA, 18 nt, Staphylococcus aureus subsp. aureus N315
aauaaaucuaucuacuca

SEQ ID NO: 4036397 - RNA, 12 nt, Staphylococcus aureus subsp. aureus N315
aauaaaucucca

SEQ ID NO: 4036398 - RNA, 16 nt, Staphylococcus aureus subsp. aureus N315
aauaaaucuccauuaa

SEQ ID NO: 4036399 - RNA, 19 nt, Staphylococcus aureus subsp. aureus N315
aauaaaucuccauuaauca

SEQ ID NO: 4036400 - RNA, 20 nt, Staphylococcus aureus subsp. aureus N315
aauaaaucuccauuaaucau

SEQ ID NO: 4036401 - RNA, 21 nt, Staphylococcus aureus subsp. aureus N315
aauaaaucuccauuaaucauu

SEQ ID NO: 4036402 - RNA, 13 nt, Staphylococcus aureus subsp. aureus N315
aauaaaucuuucc

SEQ ID NO: 4036403 - RNA, 19 nt, Staphylococcus aureus subsp. aureus N315
aauaaaugacauuuaauac

SEQ ID NO: 4036404 - RNA, 20 nt, Staphylococcus aureus subsp. aureus N315
aauaaaugcuauauuuagaa

SEQ ID NO: 4036405 - RNA, 14 nt, Staphylococcus aureus subsp. aureus N315
aauaaauguuaaag

SEQ ID NO: 4036406 - RNA, 18 nt, Staphylococcus aureus subsp. aureus N315
aauaaauugacucaaaga

SEQ ID NO: 4036407 - RNA, 23 nt, Staphylococcus aureus subsp. aureus N315
aauaaauugcacgucuuguauca

SEQ ID NO: 4036408 - RNA, 21 nt, Staphylococcus aureus subsp. aureus N315
aauaaauuuagauauuauaaa

SEQ ID NO: 4036409 - RNA, 15 nt, Staphylococcus aureus subsp. aureus N315
aauaaauuuuauaua

SEQ ID NO: 4036410 - RNA, 20 nt, Staphylococcus aureus subsp. aureus N315
aauaaauuuugcgaaaauau

SEQ ID NO: 4036411 - RNA, 21 nt, Staphylococcus aureus subsp. aureus N315
aauaaauuuugcgaaaauauc

SEQ ID NO: 4036412 - RNA, 18 nt, Staphylococcus aureus subsp. aureus N315
aauaacaaaauuaaauau

SEQ ID NO: 4036413 - RNA, 16 nt, Staphylococcus aureus subsp. aureus N315
aauaacaccaauugaa

SEQ ID NO: 4036414 - RNA, 22 nt, Staphylococcus aureus subsp. aureus N315
aauaacaccaauugaauauuuu

SEQ ID NO: 4036415 - RNA, 22 nt, Staphylococcus aureus subsp. aureus N315
aauaacacgauuugguugaacu

SEQ ID NO: 4036416 - RNA, 19 nt, Staphylococcus aureus subsp. aureus N315
aauaacaggugcuuacuuu

SEQ ID NO: 4036417 - RNA, 18 nt, Staphylococcus aureus subsp. aureus N315
aauaacaguuaauuauac

SEQ ID NO: 4036418 - RNA, 12 nt, Staphylococcus aureus subsp. aureus N315
aauaacaucuaa

SEQ ID NO: 4036419 - RNA, 12 nt, Staphylococcus aureus subsp. aureus N315
aauaacauguuu

SEQ ID NO: 4036420 - RNA, 17 nt, Staphylococcus aureus subsp. aureus N315
aauaacauguuuguggc

SEQ ID NO: 4036421 - RNA, 21 nt, Staphylococcus aureus subsp. aureus N315
aauaaccacuuugaauugguu

SEQ ID NO: 4036422 - RNA, 16 nt, Staphylococcus aureus subsp. aureus N315
aauaacccauuuucaa

SEQ ID NO: 4036423 - RNA, 18 nt, Staphylococcus aureus subsp. aureus N315
aauaaccgcacuuucuau

SEQ ID NO: 4036424 - RNA, 17 nt, Staphylococcus aureus subsp. aureus N315
aauaaccgcuuaauucu

SEQ ID NO: 4036425 - RNA, 20 nt, Staphylococcus aureus subsp. aureus N315
aauaaccuuuaaaacaucau

SEQ ID NO: 4036426 - RNA, 15 nt, Staphylococcus aureus subsp. aureus N315
aauaacguuaauaua

SEQ ID NO: 4036427 - RNA, 15 nt, Staphylococcus aureus subsp. aureus N315
aauaacugaguuaaa

SEQ ID NO: 4036428 - RNA, 23 nt, Staphylococcus aureus subsp. aureus N315
aauaacugaguuuuaaugaacuc

SEQ ID NO: 4036429 - RNA, 16 nt, Staphylococcus aureus subsp. aureus N315
aauaacuggcaaauca

SEQ ID NO: 4036430 - RNA, 19 nt, Staphylococcus aureus subsp. aureus N315
aauaacuggcaaaucaaac

SEQ ID NO: 4036431 - RNA, 15 nt, Staphylococcus aureus subsp. aureus N315
aauaacuguucuuuc

SEQ ID NO: 4036432 - RNA, 18 nt, Staphylococcus aureus subsp. aureus N315
aauaacuuaugguauuua

SEQ ID NO: 4036433 - RNA, 22 nt, Staphylococcus aureus subsp. aureus N315
aauaacuucguuuuaauaaauu

SEQ ID NO: 4036434 - RNA, 19 nt, Staphylococcus aureus subsp. aureus N315
aauaagaauguguuaauca

SEQ ID NO: 4036435 - RNA, 12 nt, Staphylococcus aureus subsp. aureus N315
aauaagauuauu

SEQ ID NO: 4036436 - RNA, 13 nt, Staphylococcus aureus subsp. aureus N315
aauaagcauuaau

SEQ ID NO: 4036437 - RNA, 17 nt, Staphylococcus aureus subsp. aureus N315
aauaagcgcaauuaaaa

SEQ ID NO: 4036438 - RNA, 20 nt, Staphylococcus aureus subsp. aureus N315
aauaagcgcaauuaaaagua

SEQ ID NO: 4036439 - RNA, 17 nt, Staphylococcus aureus subsp. aureus N315
aauaagcguaaaaucau

SEQ ID NO: 4036440 - RNA, 17 nt, Staphylococcus aureus subsp. aureus N315
aauaaguaauaauuuau

SEQ ID NO: 4036441 - RNA, 13 nt, Staphylococcus aureus subsp. aureus N315
aauaagugauaaa

SEQ ID NO: 4036442 - RNA, 15 nt, Staphylococcus aureus subsp. aureus N315
aauaagugguuguuc

SEQ ID NO: 4036443 - RNA, 20 nt, Staphylococcus aureus subsp. aureus N315
aauaagugguuguucccauu

SEQ ID NO: 4036444 - RNA, 13 nt, Staphylococcus aureus subsp. aureus N315
aauaaguuaccuu

SEQ ID NO: 4036445 - RNA, 22 nt, Staphylococcus aureus subsp. aureus N315
aauaaguugaauauaaaaaaga

SEQ ID NO: 4036446 - RNA, 23 nt, Staphylococcus aureus subsp. aureus N315
aauaaguugaauauaaaaaagau

SEQ ID NO: 4036447 - RNA, 13 nt, Staphylococcus aureus subsp. aureus N315
aauaaguugucau

SEQ ID NO: 4036448 - RNA, 19 nt, Staphylococcus aureus subsp. aureus N315
aauaaguugucaucuaauu

SEQ ID NO: 4036449 - RNA, 11 nt, Staphylococcus aureus subsp. aureus N315
aauaauaaaau

SEQ ID NO: 4036450 - RNA, 15 nt, Staphylococcus aureus subsp. aureus N315
aauaauaaguugaau

SEQ ID NO: 4036451 - RNA, 14 nt, Staphylococcus aureus subsp. aureus N315
aauaauaaucuuua

SEQ ID NO: 4036452 - RNA, 14 nt, Staphylococcus aureus subsp. aureus N315
aauaauaaugggaa

SEQ ID NO: 4036453 - RNA, 16 nt, Staphylococcus aureus subsp. aureus N315
aauaauaauugcuuua

SEQ ID NO: 4036454 - RNA, 17 nt, Staphylococcus aureus subsp. aureus N315
aauaauaccuucaauug

SEQ ID NO: 4036455 - RNA, 15 nt, Staphylococcus aureus subsp. aureus N315
aauaauacgcuugau

SEQ ID NO: 4036456 - RNA, 19 nt, Staphylococcus aureus subsp. aureus N315
aauaauacgcuugauaaaa

SEQ ID NO: 4036457 - RNA, 16 nt, Staphylococcus aureus subsp. aureus N315
aauaauagcaaaauua

SEQ ID NO: 4036458 - RNA, 18 nt, Staphylococcus aureus subsp. aureus N315
aauaauagcaguuucuga

SEQ ID NO: 4036459 - RNA, 13 nt, Staphylococcus aureus subsp. aureus N315
aauaauauaaaaa

SEQ ID NO: 4036460 - RNA, 12 nt, Staphylococcus aureus subsp. aureus N315
aauaauauauuu

SEQ ID NO: 4036461 - RNA, 14 nt, Staphylococcus aureus subsp. aureus N315
aauaauauauuuag

SEQ ID NO: 4036462 - RNA, 23 nt, Staphylococcus aureus subsp. aureus N315
aauaauaucaccuuuuuuaagau

SEQ ID NO: 4036463 - RNA, 13 nt, Staphylococcus aureus subsp. aureus N315
aauaauaugaauu

SEQ ID NO: 4036464 - RNA, 15 nt, Staphylococcus aureus subsp. aureus N315
aauaaucauccauau

SEQ ID NO: 4036465 - RNA, 16 nt, Staphylococcus aureus subsp. aureus N315
aauaaucauccauaua

SEQ ID NO: 4036466 - RNA, 15 nt, Staphylococcus aureus subsp. aureus N315
aauaauccaagauau

SEQ ID NO: 4036467 - RNA, 15 nt, Staphylococcus aureus subsp. aureus N315
aauaaucgaacagaa

SEQ ID NO: 4036468 - RNA, 22 nt, Staphylococcus aureus subsp. aureus N315
aauaaucgaacagaaaaucguu

SEQ ID NO: 4036469 - RNA, 16 nt, Staphylococcus aureus subsp. aureus N315
aauaaucggacugaug

SEQ ID NO: 4036470 - RNA, 21 nt, Staphylococcus aureus subsp. aureus N315
aauaaucgguaauuacuugua

SEQ ID NO: 4036471 - RNA, 21 nt, Staphylococcus aureus subsp. aureus N315
aauaaucguaaacacuauaaa

SEQ ID NO: 4036472 - RNA, 11 nt, Staphylococcus aureus subsp. aureus N315
aauaaugaaau

SEQ ID NO: 4036473 - RNA, 20 nt, Staphylococcus aureus subsp. aureus N315
aauaaugacgagaauuaaag

SEQ ID NO: 4036474 - RNA, 20 nt, Staphylococcus aureus subsp. aureus N315
aauaaugaugcauaagauuu

SEQ ID NO: 4036475 - RNA, 15 nt, Staphylococcus aureus subsp. aureus N315
aauaaugugaaaaau

SEQ ID NO: 4036476 - RNA, 17 nt, Staphylococcus aureus subsp. aureus N315
aauaauguuuccauuua

SEQ ID NO: 4036477 - RNA, 23 nt, Staphylococcus aureus subsp. aureus N315
aauaauguuuccugauauuucaa

SEQ ID NO: 4036478 - RNA, 12 nt, Staphylococcus aureus subsp. aureus N315
aauaauuaaaaa

SEQ ID NO: 4036479 - RNA, 16 nt, Staphylococcus aureus subsp. aureus N315
aauaauuaaauaaaaa

SEQ ID NO: 4036480 - RNA, 18 nt, Staphylococcus aureus subsp. aureus N315
aauaauuacuaaccuaaa

SEQ ID NO: 4036481 - RNA, 17 nt, Staphylococcus aureus subsp. aureus N315
aauaauuagauuuaaaa

SEQ ID NO: 4036482 - RNA, 23 nt, Staphylococcus aureus subsp. aureus N315
aauaauuagauuuaaaaugucau

SEQ ID NO: 4036483 - RNA, 19 nt, Staphylococcus aureus subsp. aureus N315
aauaauucauaaaugcuuc

SEQ ID NO: 4036484 - RNA, 14 nt, Staphylococcus aureus subsp. aureus N315
aauagccauauuca

SEQ ID NO: 4036485 - RNA, 19 nt, Staphylococcus aureus subsp. aureus N315
aauagccauucgaugcuaa

SEQ ID NO: 4036486 - RNA, 20 nt, Staphylococcus aureus subsp. aureus N315
aauagcgucaucuggaauac

SEQ ID NO: 4036487 - RNA, 21 nt, Staphylococcus aureus subsp. aureus N315
aauagcuacaauuaaagugaa

SEQ ID NO: 4036488 - RNA, 14 nt, Staphylococcus aureus subsp. aureus N315
aauagcuauauuuu

SEQ ID NO: 4036489 - RNA, 22 nt, Staphylococcus aureus subsp. aureus N315
aauagcuauauuuuuguauuua

SEQ ID NO: 4036490 - RNA, 17 nt, Staphylococcus aureus subsp. aureus N315
aauagcuauuaaaauag

SEQ ID NO: 4036491 - RNA, 20 nt, Staphylococcus aureus subsp. aureus N315
aauagcuuucguuucuuuua

SEQ ID NO: 4036492 - RNA, 21 nt, Staphylococcus aureus subsp. aureus N315
aauagcuuucguuucuuuuau

SEQ ID NO: 4036493 - RNA, 18 nt, Staphylococcus aureus subsp. aureus N315
aauaggauaugcuaaaca

SEQ ID NO: 4036494 - RNA, 16 nt, Staphylococcus aureus subsp. aureus N315
aauagguuauuugaua

SEQ ID NO: 4036495 - RNA, 13 nt, Staphylococcus aureus subsp. aureus N315
aauaguaaaguga

SEQ ID NO: 4036496 - RNA, 17 nt, Staphylococcus aureus subsp. aureus N315
aauaguaaagugaaaua

SEQ ID NO: 4036497 - RNA, 18 nt, Staphylococcus aureus subsp. aureus N315
aauaguaaagugaaauaa

SEQ ID NO: 4036498 - RNA, 20 nt, Staphylococcus aureus subsp. aureus N315
aauagugucaucaccuuguu

SEQ ID NO: 4036499 - RNA, 19 nt, Staphylococcus aureus subsp. aureus N315
aauaguuaagauuuuaacu

SEQ ID NO: 4036500 - RNA, 17 nt, Staphylococcus aureus subsp. aureus N315
aauaguuaccaaaauuu

SEQ ID NO: 4036501 - RNA, 23 nt, Staphylococcus aureus subsp. aureus N315
aauaguuaccaaaauuugaaaua

SEQ ID NO: 4036502 - RNA, 14 nt, Staphylococcus aureus subsp. aureus N315
aauaguucaaaaua

SEQ ID NO: 4036503 - RNA, 12 nt, Staphylococcus aureus subsp. aureus N315
aauaguucaaau

SEQ ID NO: 4036504 - RNA, 15 nt, Staphylococcus aureus subsp. aureus N315
aauaguuucaaugcc

SEQ ID NO: 4036505 - RNA, 19 nt, Staphylococcus aureus subsp. aureus N315
aauaguuuucuucacugcu

SEQ ID NO: 4036506 - RNA, 12 nt, Staphylococcus aureus subsp. aureus N315
aauauaaaaaac

SEQ ID NO: 4036507 - RNA, 13 nt, Staphylococcus aureus subsp. aureus N315
aauauaaaaaaca

SEQ ID NO: 4036508 - RNA, 19 nt, Staphylococcus aureus subsp. aureus N315
aauauaaaaaagaucacug

SEQ ID NO: 4036509 - RNA, 16 nt, Staphylococcus aureus subsp. aureus N315
aauauaaaaacaaaag

SEQ ID NO: 4036510 - RNA, 14 nt, Staphylococcus aureus subsp. aureus N315
aauauaaaacgaua

SEQ ID NO: 4036511 - RNA, 19 nt, Staphylococcus aureus subsp. aureus N315
aauauaaaacgauaagaau

SEQ ID NO: 4036512 - RNA, 15 nt, Staphylococcus aureus subsp. aureus N315
aauauaaaauaaagu

SEQ ID NO: 4036513 - RNA, 13 nt, Staphylococcus aureus subsp. aureus N315
aauauaaauaaaa

SEQ ID NO: 4036514 - RNA, 15 nt, Staphylococcus aureus subsp. aureus N315
aauauaaauuuugaa

SEQ ID NO: 4036515 - RNA, 18 nt, Staphylococcus aureus subsp. aureus N315
aauauaacaaguauaaau

SEQ ID NO: 4036516 - RNA, 13 nt, Staphylococcus aureus subsp. aureus N315
aauauaacaucaa

SEQ ID NO: 4036517 - RNA, 14 nt, Staphylococcus aureus subsp. aureus N315
aauauaacaucaaa

SEQ ID NO: 4036518 - RNA, 16 nt, Staphylococcus aureus subsp. aureus N315
aauauaacaucaaaua

SEQ ID NO: 4036519 - RNA, 17 nt, Staphylococcus aureus subsp. aureus N315
aauauaacaucaaauag

SEQ ID NO: 4036520 - RNA, 18 nt, Staphylococcus aureus subsp. aureus N315
aauauaacaucaaauaga

SEQ ID NO: 4036521 - RNA, 20 nt, Staphylococcus aureus subsp. aureus N315
aauauaauacuguauuuuaa

SEQ ID NO: 4036522 - RNA, 15 nt, Staphylococcus aureus subsp. aureus N315
aauauaauuauuaaa

SEQ ID NO: 4036523 - RNA, 17 nt, Staphylococcus aureus subsp. aureus N315
aauauaauuauuaaacu

SEQ ID NO: 4036524 - RNA, 15 nt, Staphylococcus aureus subsp. aureus N315
aauauaccaaccaaa

SEQ ID NO: 4036525 - RNA, 20 nt, Staphylococcus aureus subsp. aureus N315
aauauaccaaccaaaaccaa

SEQ ID NO: 4036526 - RNA, 18 nt, Staphylococcus aureus subsp. aureus N315
aauauacuaaauuugaaa

SEQ ID NO: 4036527 - RNA, 17 nt, Staphylococcus aureus subsp. aureus N315
aauauacuuaauuuaaa

SEQ ID NO: 4036528 - RNA, 20 nt, Staphylococcus aureus subsp. aureus N315
aauauacuuaauuuaaaucu

SEQ ID NO: 4036529 - RNA, 23 nt, Staphylococcus aureus subsp. aureus N315
aauauacuuuuuaaaugauuuaa

SEQ ID NO: 4036530 - RNA, 17 nt, Staphylococcus aureus subsp. aureus N315
aauauagaaaaugagua

SEQ ID NO: 4036531 - RNA, 16 nt, Staphylococcus aureus subsp. aureus N315
aauauagcugugauuu

SEQ ID NO: 4036532 - RNA, 21 nt, Staphylococcus aureus subsp. aureus N315
aauauaguaauaaaagucgau

SEQ ID NO: 4036533 - RNA, 18 nt, Staphylococcus aureus subsp. aureus N315
aauauaguaauuguuaua

SEQ ID NO: 4036534 - RNA, 21 nt, Staphylococcus aureus subsp. aureus N315
aauauaguggugguacuuuuu

SEQ ID NO: 4036535 - RNA, 15 nt, Staphylococcus aureus subsp. aureus N315
aauauaguuaaaguu

SEQ ID NO: 4036536 - RNA, 16 nt, Staphylococcus aureus subsp. aureus N315
aauauaguuaaaguua

SEQ ID NO: 4036537 - RNA, 23 nt, Staphylococcus aureus subsp. aureus N315
aauauauagcgcgcuuauugaaa

SEQ ID NO: 4036538 - RNA, 16 nt, Staphylococcus aureus subsp. aureus N315
aauauaucaucucuau

SEQ ID NO: 4036539 - RNA, 16 nt, Staphylococcus aureus subsp. aureus N315
aauauauccugccaau

SEQ ID NO: 4036540 - RNA, 18 nt, Staphylococcus aureus subsp. aureus N315
aauauaucuaauacuuuc

SEQ ID NO: 4036541 - RNA, 20 nt, Staphylococcus aureus subsp. aureus N315
aauauaugaauaagucuaau

SEQ ID NO: 4036542 - RNA, 19 nt, Staphylococcus aureus subsp. aureus N315
aauauauguauaacauuau

SEQ ID NO: 4036543 - RNA, 20 nt, Staphylococcus aureus subsp. aureus N315
aauauauguauaacauuauu

SEQ ID NO: 4036544 - RNA, 16 nt, Staphylococcus aureus subsp. aureus N315
aauauauuaauuuuac

SEQ ID NO: 4036545 - RNA, 13 nt, Staphylococcus aureus subsp. aureus N315
aauauauuuauuu

SEQ ID NO: 4036546 - RNA, 14 nt, Staphylococcus aureus subsp. aureus N315
aauauauuuuaugu

SEQ ID NO: 4036547 - RNA, 18 nt, Staphylococcus aureus subsp. aureus N315
aauaucaaaauauaaaau

SEQ ID NO: 4036548 - RNA, 14 nt, Staphylococcus aureus subsp. aureus N315
aauaucaagauguu

SEQ ID NO: 4036549 - RNA, 13 nt, Staphylococcus aureus subsp. aureus N315
aauaucaauuuuu

SEQ ID NO: 4036550 - RNA, 14 nt, Staphylococcus aureus subsp. aureus N315
aauaucaauuuuua

SEQ ID NO: 4036551 - RNA, 16 nt, Staphylococcus aureus subsp. aureus N315
aauaucauaaaugcau

SEQ ID NO: 4036552 - RNA, 17 nt, Staphylococcus aureus subsp. aureus N315
aauaucauaaaugcaua

SEQ ID NO: 4036553 - RNA, 18 nt, Staphylococcus aureus subsp. aureus N315
aauaucauaccguacaaa

SEQ ID NO: 4036554 - RNA, 19 nt, Staphylococcus aureus subsp. aureus N315
aauaucauauuugaauacu

SEQ ID NO: 4036555 - RNA, 17 nt, Staphylococcus aureus subsp. aureus N315
aauaucaucaaguuuau

SEQ ID NO: 4036556 - RNA, 20 nt, Staphylococcus aureus subsp. aureus N315
aauaucaucaaguuuaucug

SEQ ID NO: 4036557 - RNA, 22 nt, Staphylococcus aureus subsp. aureus N315
aauaucaucauuuaaauauuuc

SEQ ID NO: 4036558 - RNA, 15 nt, Staphylococcus aureus subsp. aureus N315
aauauccaaaauccu

SEQ ID NO: 4036559 - RNA, 18 nt, Staphylococcus aureus subsp. aureus N315
aauauccugcaguugauu

SEQ ID NO: 4036560 - RNA, 16 nt, Staphylococcus aureus subsp. aureus N315
aauaucugaaaaacca

SEQ ID NO: 4036561 - RNA, 14 nt, Staphylococcus aureus subsp. aureus N315
aauaucuuacugcu

SEQ ID NO: 4036562 - RNA, 13 nt, Staphylococcus aureus subsp. aureus N315
aauaucuucagcu

SEQ ID NO: 4036563 - RNA, 22 nt, Staphylococcus aureus subsp. aureus N315
aauaucuucuucuaaccacuuc

SEQ ID NO: 4036564 - RNA, 14 nt, Staphylococcus aureus subsp. aureus N315
aauaucuuuaauug

SEQ ID NO: 4036565 - RNA, 18 nt, Staphylococcus aureus subsp. aureus N315
aauaugaacaaaaaauaa

SEQ ID NO: 4036566 - RNA, 16 nt, Staphylococcus aureus subsp. aureus N315
aauaugaaucuagaau

SEQ ID NO: 4036567 - RNA, 13 nt, Staphylococcus aureus subsp. aureus N315
aauaugacacaua

SEQ ID NO: 4036568 - RNA, 18 nt, Staphylococcus aureus subsp. aureus N315
aauaugagacaauacgau

SEQ ID NO: 4036569 - RNA, 22 nt, Staphylococcus aureus subsp. aureus N315
aauaugagugaaaguuugaagg

SEQ ID NO: 4036570 - RNA, 17 nt, Staphylococcus aureus subsp. aureus N315
aauaugaguuacauggu

SEQ ID NO: 4036571 - RNA, 18 nt, Staphylococcus aureus subsp. aureus N315
aauaugaguuacaugguu

SEQ ID NO: 4036572 - RNA, 20 nt, Staphylococcus aureus subsp. aureus N315
aaucaucacacauaaauguu

SEQ ID NO: 4036573 - RNA, 14 nt, Staphylococcus aureus subsp. aureus N315
aaucauccauauau

SEQ ID NO: 4036574 - RNA, 19 nt, Staphylococcus aureus subsp. aureus N315
aaucaucgaacaugaauga

SEQ ID NO: 4036575 - RNA, 21 nt, Staphylococcus aureus subsp. aureus N315
aaucaucgaacaugaaugaua

SEQ ID NO: 4036576 - RNA, 16 nt, Staphylococcus aureus subsp. aureus N315
aaucaucgcaaauaca

SEQ ID NO: 4036577 - RNA, 21 nt, Staphylococcus aureus subsp. aureus N315
aaucaucuuaacaacuuuaau

SEQ ID NO: 4036578 - RNA, 17 nt, Staphylococcus aureus subsp. aureus N315
aaucaucuuuuugaaau

SEQ ID NO: 4036579 - RNA, 13 nt, Staphylococcus aureus subsp. aureus N315
aaucaugacauaa

SEQ ID NO: 4036580 - RNA, 15 nt, Staphylococcus aureus subsp. aureus N315
aaucaugacauaaaa

SEQ ID NO: 4036581 - RNA, 13 nt, Staphylococcus aureus subsp. aureus N315
aaucaugacauag

SEQ ID NO: 4036582 - RNA, 15 nt, Staphylococcus aureus subsp. aureus N315
aaucaugcauucuau

SEQ ID NO: 4036583 - RNA, 21 nt, Staphylococcus aureus subsp. aureus N315
aaucaugcucguuuuuauuca

SEQ ID NO: 4036584 - RNA, 15 nt, Staphylococcus aureus subsp. aureus N315
aaucauguaaugcuu

SEQ ID NO: 4036585 - RNA, 18 nt, Staphylococcus aureus subsp. aureus N315
aaucauguaaugcuuaaa

SEQ ID NO: 4036586 - RNA, 22 nt, Staphylococcus aureus subsp. aureus N315
aaucauguaaugcuuaaaaaca

SEQ ID NO: 4036587 - RNA, 18 nt, Staphylococcus aureus subsp. aureus N315
aaucauuagcgaaaaccu

SEQ ID NO: 4036588 - RNA, 18 nt, Staphylococcus aureus subsp. aureus N315
aaucauuaguuaugugcu

SEQ ID NO: 4036589 - RNA, 23 nt, Staphylococcus aureus subsp. aureus N315
aaucauuaguuaugugcuaaucu

SEQ ID NO: 4036590 - RNA, 15 nt, Staphylococcus aureus subsp. aureus N315
aaucauucaccuaaa

SEQ ID NO: 4036591 - RNA, 19 nt, Staphylococcus aureus subsp. aureus N315
aaucauucacuucaaguua

SEQ ID NO: 4036592 - RNA, 22 nt, Staphylococcus aureus subsp. aureus N315
aaucauucuuuauagaaaccaa

SEQ ID NO: 4036593 - RNA, 19 nt, Staphylococcus aureus subsp. aureus N315
aaucauuguaaaugaucau

SEQ ID NO: 4036594 - RNA, 15 nt, Staphylococcus aureus subsp. aureus N315
aaucauuguggcuuu

SEQ ID NO: 4036595 - RNA, 21 nt, Staphylococcus aureus subsp. aureus N315
aaucauuguggcuuuuuuuau

SEQ ID NO: 4036596 - RNA, 17 nt, Staphylococcus aureus subsp. aureus N315
aaucauuuaaaucaaua

SEQ ID NO: 4036597 - RNA, 21 nt, Staphylococcus aureus subsp. aureus N315
aaucauuuauguagauuuuaa

SEQ ID NO: 4036598 - RNA, 14 nt, Staphylococcus aureus subsp. aureus N315
aaucauuuguguau

SEQ ID NO: 4036599 - RNA, 19 nt, Staphylococcus aureus subsp. aureus N315
aauccaaagcugaauuuua

SEQ ID NO: 4036600 - RNA, 17 nt, Staphylococcus aureus subsp. aureus N315
aauccaagugacaacau

SEQ ID NO: 4036601 - RNA, 19 nt, Staphylococcus aureus subsp. aureus N315
aauccaguaaucaaagauu

SEQ ID NO: 4036602 - RNA, 21 nt, Staphylococcus aureus subsp. aureus N315
aaucccaaguuacaauaucau

SEQ ID NO: 4036603 - RNA, 14 nt, Staphylococcus aureus subsp. aureus N315
aaucccauaaugac

SEQ ID NO: 4036604 - RNA, 19 nt, Staphylococcus aureus subsp. aureus N315
aaucccauaaugacuauaa

SEQ ID NO: 4036605 - RNA, 23 nt, Staphylococcus aureus subsp. aureus N315
aauccguaacgaugguugcuuca

SEQ ID NO: 4036606 - RNA, 21 nt, Staphylococcus aureus subsp. aureus N315
aauccuauggcgcaauuuuua

SEQ ID NO: 4036607 - RNA, 13 nt, Staphylococcus aureus subsp. aureus N315
aauccugauucca

SEQ ID NO: 4036608 - RNA, 14 nt, Staphylococcus aureus subsp. aureus N315
aauccuucaucaau

SEQ ID NO: 4036609 - RNA, 15 nt, Staphylococcus aureus subsp. aureus N315
aauccuuuauauuua

SEQ ID NO: 4036610 - RNA, 16 nt, Staphylococcus aureus subsp. aureus N315
aaucgaaaauaucaau

SEQ ID NO: 4036611 - RNA, 15 nt, Staphylococcus aureus subsp. aureus N315
aaucgaacagaaaau

SEQ ID NO: 4036612 - RNA, 14 nt, Staphylococcus aureus subsp. aureus N315
aaucgaacauaaau

SEQ ID NO: 4036613 - RNA, 21 nt, Staphylococcus aureus subsp. aureus N315
aaucgacuuuuacaaucauca

SEQ ID NO: 4036614 - RNA, 17 nt, Staphylococcus aureus subsp. aureus N315
aaucgagugauucagga

SEQ ID NO: 4036615 - RNA, 15 nt, Staphylococcus aureus subsp. aureus N315
aaucgaguuugaaau

SEQ ID NO: 4036616 - RNA, 17 nt, Staphylococcus aureus subsp. aureus N315
aaucgaguuugaaauaa

SEQ ID NO: 4036617 - RNA, 14 nt, Staphylococcus aureus subsp. aureus N315
aaucgauaaaaugu

SEQ ID NO: 4036618 - RNA, 20 nt, Staphylococcus aureus subsp. aureus N315
aaucgauauaaugaaguuau

SEQ ID NO: 4036619 - RNA, 21 nt, Staphylococcus aureus subsp. aureus N315
aaucgauuaagaaugcaccaa

SEQ ID NO: 4036620 - RNA, 15 nt, Staphylococcus aureus subsp. aureus N315
aaucgcauuuaaaua

SEQ ID NO: 4036621 - RNA, 17 nt, Staphylococcus aureus subsp. aureus N315
aaucgcauuuaaauaua

SEQ ID NO: 4036622 - RNA, 14 nt, Staphylococcus aureus subsp. aureus N315
aaucgcauuuuguu

SEQ ID NO: 4036623 - RNA, 15 nt, Staphylococcus aureus subsp. aureus N315
aaucgccuacuauaa

SEQ ID NO: 4036624 - RNA, 16 nt, Staphylococcus aureus subsp. aureus N315
aaucggaauaaaauaa

SEQ ID NO: 4036625 - RNA, 20 nt, Staphylococcus aureus subsp. aureus N315
aaucggaucauuauuuagaa

SEQ ID NO: 4036626 - RNA, 18 nt, Staphylococcus aureus subsp. aureus N315
aaucggcuauacauugau

SEQ ID NO: 4036627 - RNA, 19 nt, Staphylococcus aureus subsp. aureus N315
aaucguaaacauaaugaca

SEQ ID NO: 4036628 - RNA, 17 nt, Staphylococcus aureus subsp. aureus N315
aaucguaauaauuuugu

SEQ ID NO: 4036629 - RNA, 16 nt, Staphylococcus aureus subsp. aureus N315
aaucguaggaugcuuc

SEQ ID NO: 4036630 - RNA, 21 nt, Staphylococcus aureus subsp. aureus N315
aaucguauuagccaauaaaau

SEQ ID NO: 4036631 - RNA, 18 nt, Staphylococcus aureus subsp. aureus N315
aaucgugcccauaugauu

SEQ ID NO: 4036632 - RNA, 20 nt, Staphylococcus aureus subsp. aureus N315
aaucguuccaacaacuaaga

SEQ ID NO: 4036633 - RNA, 15 nt, Staphylococcus aureus subsp. aureus N315
aaucguugaaaaaua

SEQ ID NO: 4036634 - RNA, 19 nt, Staphylococcus aureus subsp. aureus N315
aaucguuguggcuuuuuau

SEQ ID NO: 4036635 - RNA, 15 nt, Staphylococcus aureus subsp. aureus N315
aaucguuucaugcac

SEQ ID NO: 4036636 - RNA, 21 nt, Staphylococcus aureus subsp. aureus N315
aaucuaauacuuucaaacaaa

SEQ ID NO: 4036637 - RNA, 14 nt, Staphylococcus aureus subsp. aureus N315
aaucuacaauauua

SEQ ID NO: 4036638 - RNA, 18 nt, Staphylococcus aureus subsp. aureus N315
aaucuacgauuuucaaga

SEQ ID NO: 4036639 - RNA, 18 nt, Staphylococcus aureus subsp. aureus N315
aaucuagaauauaacaac

SEQ ID NO: 4036640 - RNA, 15 nt, Staphylococcus aureus subsp. aureus N315
aaucuagaccuucaa

SEQ ID NO: 4036641 - RNA, 14 nt, Staphylococcus aureus subsp. aureus N315
aaucuauaaauauc

SEQ ID NO: 4036642 - RNA, 21 nt, Staphylococcus aureus subsp. aureus N315
aaucuauaccauuccaaaaau

SEQ ID NO: 4036643 - RNA, 16 nt, Staphylococcus aureus subsp. aureus N315
aaucuauccuucaaaa

SEQ ID NO: 4036644 - RNA, 19 nt, Staphylococcus aureus subsp. aureus N315
aaucuauccuucaaaaguu

SEQ ID NO: 4036645 - RNA, 18 nt, Staphylococcus aureus subsp. aureus N315
aaucuauggaaaauguua

SEQ ID NO: 4036646 - RNA, 21 nt, Staphylococcus aureus subsp. aureus N315
aaucuauuaaugcucuauaua

SEQ ID NO: 4036647 - RNA, 12 nt, Staphylococcus aureus subsp. aureus N315
aaucucaaaauu

SEQ ID NO: 4036648 - RNA, 13 nt, Staphylococcus aureus subsp. aureus N315
aaucucaucuaac

SEQ ID NO: 4036649 - RNA, 20 nt, Staphylococcus aureus subsp. aureus N315
aaucucauucuuuaauauaa

SEQ ID NO: 4036650 - RNA, 12 nt, Staphylococcus aureus subsp. aureus N315
aaucucauugau

SEQ ID NO: 4036651 - RNA, 13 nt, Staphylococcus aureus subsp. aureus N315
aaucuccauuaau

SEQ ID NO: 4036652 - RNA, 16 nt, Staphylococcus aureus subsp. aureus N315
aaucuccauuaaucau

SEQ ID NO: 4036653 - RNA, 17 nt, Staphylococcus aureus subsp. aureus N315
aaucuccauuagaacua

SEQ ID NO: 4036654 - RNA, 19 nt, Staphylococcus aureus subsp. aureus N315
aaucucuuuagaugagauu

SEQ ID NO: 4036655 - RNA, 15 nt, Staphylococcus aureus subsp. aureus N315
aaucugauucauuaa

SEQ ID NO: 4036656 - RNA, 21 nt, Staphylococcus aureus subsp. aureus N315
aaucuggcacuuaagcuuuaa

SEQ ID NO: 4036657 - RNA, 17 nt, Staphylococcus aureus subsp. aureus N315
aaucuguuuaaauuuaa

SEQ ID NO: 4036658 - RNA, 21 nt, Staphylococcus aureus subsp. aureus N315
aaucuuaaagauuuuucagcu

SEQ ID NO: 4036659 - RNA, 18 nt, Staphylococcus aureus subsp. aureus N315
aaucuuaauauugauuaa

SEQ ID NO: 4036660 - RNA, 15 nt, Staphylococcus aureus subsp. aureus N315
aaugcuuuaauaaau

SEQ ID NO: 4036661 - RNA, 15 nt, Staphylococcus aureus subsp. aureus N315
aauggaugaauauau

SEQ ID NO: 4036662 - RNA, 16 nt, Staphylococcus aureus subsp. aureus N315
aauggaugaauauauu

SEQ ID NO: 4036663 - RNA, 19 nt, Staphylococcus aureus subsp. aureus N315
aauggauuauuaugccuuu

SEQ ID NO: 4036664 - RNA, 16 nt, Staphylococcus aureus subsp. aureus N315
aauggcaaucuauaua

SEQ ID NO: 4036665 - RNA, 19 nt, Staphylococcus aureus subsp. aureus N315
aauggcaaucuauauaaau

SEQ ID NO: 4036666 - RNA, 21 nt, Staphylococcus aureus subsp. aureus N315
aauggcaaucuauauaaaugu

SEQ ID NO: 4036667 - RNA, 22 nt, Staphylococcus aureus subsp. aureus N315
aauggcacuuaauauaaggaag

SEQ ID NO: 4036668 - RNA, 19 nt, Staphylococcus aureus subsp. aureus N315
aauggcagaugauuauguu

SEQ ID NO: 4036669 - RNA, 20 nt, Staphylococcus aureus subsp. aureus N315
aaugggcgugccauuaaaau

SEQ ID NO: 4036670 - RNA, 16 nt, Staphylococcus aureus subsp. aureus N315
aauggucgugcuugcg

SEQ ID NO: 4036671 - RNA, 18 nt, Staphylococcus aureus subsp. aureus N315
aauggucuaauaucaauu

SEQ ID NO: 4036672 - RNA, 17 nt, Staphylococcus aureus subsp. aureus N315
aaugguucauagugaaa

SEQ ID NO: 4036673 - RNA, 21 nt, Staphylococcus aureus subsp. aureus N315
aaugguucuauaauaaaucga

SEQ ID NO: 4036674 - RNA, 21 nt, Staphylococcus aureus subsp. aureus N315
aauguaagcaacauaugauuu

SEQ ID NO: 4036675 - RNA, 21 nt, Staphylococcus aureus subsp. aureus N315
aauguacauuguaaauauagu

SEQ ID NO: 4036676 - RNA, 21 nt, Staphylococcus aureus subsp. aureus N315
aauguaccgaauccuucauca

SEQ ID NO: 4036677 - RNA, 15 nt, Staphylococcus aureus subsp. aureus N315
aauguacuuuucugu

SEQ ID NO: 4036678 - RNA, 21 nt, Staphylococcus aureus subsp. aureus N315
aauguaggcgccauaaucauu

SEQ ID NO: 4036679 - RNA, 21 nt, Staphylococcus aureus subsp. aureus N315
aauguaguuaagauaccuuuu

SEQ ID NO: 4036680 - RNA, 15 nt, Staphylococcus aureus subsp. aureus N315
aauguauauuuaaca

SEQ ID NO: 4036681 - RNA, 17 nt, Staphylococcus aureus subsp. aureus N315
aauguauauuuaacauc

SEQ ID NO: 4036682 - RNA, 13 nt, Staphylococcus aureus subsp. aureus N315
aauguaucaccua

SEQ ID NO: 4036683 - RNA, 15 nt, Staphylococcus aureus subsp. aureus N315
aauguaugauauaaa

SEQ ID NO: 4036684 - RNA, 15 nt, Staphylococcus aureus subsp. aureus N315
aauguauuaaacauu

SEQ ID NO: 4036685 - RNA, 19 nt, Staphylococcus aureus subsp. aureus N315
aauguauucagucaguaaa

SEQ ID NO: 4036686 - RNA, 22 nt, Staphylococcus aureus subsp. aureus N315
aauguauucagucaguaaaaau

SEQ ID NO: 4036687 - RNA, 21 nt, Staphylococcus aureus subsp. aureus N315
aauguauugcuauaagaacua

SEQ ID NO: 4036688 - RNA, 22 nt, Staphylococcus aureus subsp. aureus N315
aaugucccaagcccugacaauu

SEQ ID NO: 4036689 - RNA, 18 nt, Staphylococcus aureus subsp. aureus N315
aauguccgacuugauaaa

SEQ ID NO: 4036690 - RNA, 18 nt, Staphylococcus aureus subsp. aureus N315
aaugucgaucuaacaauu

SEQ ID NO: 4036691 - RNA, 14 nt, Staphylococcus aureus subsp. aureus N315
aaugucguauaugu

SEQ ID NO: 4036692 - RNA, 15 nt, Staphylococcus aureus subsp. aureus N315
aaugucguauaugua

SEQ ID NO: 4036693 - RNA, 19 nt, Staphylococcus aureus subsp. aureus N315
aaugucucuuuucacgaau

SEQ ID NO: 4036694 - RNA, 15 nt, Staphylococcus aureus subsp. aureus N315
aaugugaccuuaugu

SEQ ID NO: 4036695 - RNA, 18 nt, Staphylococcus aureus subsp. aureus N315
aaugugauuuucuuucau

SEQ ID NO: 4036696 - RNA, 20 nt, Staphylococcus aureus subsp. aureus N315
aaugugcaauuagaauauau

SEQ ID NO: 4036697 - RNA, 21 nt, Staphylococcus aureus subsp. aureus N315
aauguggaacaugauucauga

SEQ ID NO: 4036698 - RNA, 18 nt, Staphylococcus aureus subsp. aureus N315
aauguguacuuaaaaaua

SEQ ID NO: 4036699 - RNA, 14 nt, Staphylococcus aureus subsp. aureus N315
aauguguaugguuu

SEQ ID NO: 4036700 - RNA, 23 nt, Staphylococcus aureus subsp. aureus N315
aauguguaugguuuuguacauau

SEQ ID NO: 4036701 - RNA, 14 nt, Staphylococcus aureus subsp. aureus N315
aauguguuaauacu

SEQ ID NO: 4036702 - RNA, 23 nt, Staphylococcus aureus subsp. aureus N315
aauguguuaaucaacguauauaa

SEQ ID NO: 4036703 - RNA, 16 nt, Staphylococcus aureus subsp. aureus N315
aauguuaaauucuaaa

SEQ ID NO: 4036704 - RNA, 14 nt, Staphylococcus aureus subsp. aureus N315
aauguuaauaauga

SEQ ID NO: 4036705 - RNA, 21 nt, Staphylococcus aureus subsp. aureus N315
aauguuacacaaauuaaaacu

SEQ ID NO: 4036706 - RNA, 17 nt, Staphylococcus aureus subsp. aureus N315
aauguuaggugcuuggu

SEQ ID NO: 4036707 - RNA, 17 nt, Staphylococcus aureus subsp. aureus N315
aauguuaucuugcuuau

SEQ ID NO: 4036708 - RNA, 24 nt, Staphylococcus aureus subsp. aureus N315
aauguuaucuugcuuauugauaua

SEQ ID NO: 4036709 - RNA, 16 nt, Staphylococcus aureus subsp. aureus N315
aauguuauuaaccauc

SEQ ID NO: 4036710 - RNA, 15 nt, Staphylococcus aureus subsp. aureus N315
aauguucaauuuaua

SEQ ID NO: 4036711 - RNA, 15 nt, Staphylococcus aureus subsp. aureus N315
aauguucagguucaa

SEQ ID NO: 4036712 - RNA, 18 nt, Staphylococcus aureus subsp. aureus N315
aauguucagguucaaaau

SEQ ID NO: 4036713 - RNA, 19 nt, Staphylococcus aureus subsp. aureus N315
aauguucagguucaaaauu

SEQ ID NO: 4036714 - RNA, 20 nt, Staphylococcus aureus subsp. aureus N315
aauguucagguucaaaauug

SEQ ID NO: 4036715 - RNA, 20 nt, Staphylococcus aureus subsp. aureus N315
aauguuccuuguuuuaaacu

SEQ ID NO: 4036716 - RNA, 11 nt, Staphylococcus aureus subsp. aureus N315
aauguugaaug

SEQ ID NO: 4036717 - RNA, 17 nt, Staphylococcus aureus subsp. aureus N315
aauguugauagccaccu

SEQ ID NO: 4036718 - RNA, 23 nt, Staphylococcus aureus subsp. aureus N315
aauguuggaaaaggucaaaaaau

SEQ ID NO: 4036719 - RNA, 21 nt, Staphylococcus aureus subsp. aureus N315
aauguugucguuucuagcaac

SEQ ID NO: 4036720 - RNA, 13 nt, Staphylococcus aureus subsp. aureus N315
aauguuuaacaau

SEQ ID NO: 4036721 - RNA, 22 nt, Staphylococcus aureus subsp. aureus N315
aauguuuaauuuucuaaauaua

SEQ ID NO: 4036722 - RNA, 13 nt, Staphylococcus aureus subsp. aureus N315
aauguuucuccua

SEQ ID NO: 4036723 - RNA, 19 nt, Staphylococcus aureus subsp. aureus N315
aauguuucuucaauugucu

SEQ ID NO: 4036724 - RNA, 21 nt, Staphylococcus aureus subsp. aureus N315
aauguuugaguguuuaugaaa

SEQ ID NO: 4036725 - RNA, 18 nt, Staphylococcus aureus subsp. aureus N315
aauguuugcuuuuuguaa

SEQ ID NO: 4036726 - RNA, 16 nt, Staphylococcus aureus subsp. aureus N315
aauguuuuauguauuu

SEQ ID NO: 4036727 - RNA, 16 nt, Staphylococcus aureus subsp. aureus N315
aauguuuuggaaaaau

SEQ ID NO: 4036728 - RNA, 14 nt, Staphylococcus aureus subsp. aureus N315
aauuaaaaaacaaa

SEQ ID NO: 4036729 - RNA, 14 nt, Staphylococcus aureus subsp. aureus N315
aauuaaaaaaccug

SEQ ID NO: 4036730 - RNA, 17 nt, Staphylococcus aureus subsp. aureus N315
aauuaaaacagcaaaua

SEQ ID NO: 4036731 - RNA, 22 nt, Staphylococcus aureus subsp. aureus N315
aauuaaaacagcaaauaaaauc

SEQ ID NO: 4036732 - RNA, 14 nt, Staphylococcus aureus subsp. aureus N315
aauuaaaacuauaa

SEQ ID NO: 4036733 - RNA, 18 nt, Staphylococcus aureus subsp. aureus N315
aauuaaaacuauaauaaa

SEQ ID NO: 4036734 - RNA, 20 nt, Staphylococcus aureus subsp. aureus N315
aauuaaaacuuucagagaua

SEQ ID NO: 4036735 - RNA, 12 nt, Staphylococcus aureus subsp. aureus N315
aauuaaaauaac

SEQ ID NO: 4036736 - RNA, 20 nt, Staphylococcus aureus subsp. aureus N315
aauuaaaauaagauauauaa

SEQ ID NO: 4036737 - RNA, 12 nt, Staphylococcus aureus subsp. aureus N315
aauuaaaauaca

SEQ ID NO: 4036738 - RNA, 13 nt, Staphylococcus aureus subsp. aureus N315
aauuaaaauguua

SEQ ID NO: 4036739 - RNA, 14 nt, Staphylococcus aureus subsp. aureus N315
aauuaaaauucucu

SEQ ID NO: 4036740 - RNA, 15 nt, Staphylococcus aureus subsp. aureus N315
aauuaaaauucucuu

SEQ ID NO: 4036741 - RNA, 15 nt, Staphylococcus aureus subsp. aureus N315
aauuaaaauuuguua

SEQ ID NO: 4036742 - RNA, 23 nt, Staphylococcus aureus subsp. aureus N315
aauuaaacgcucaacuauauaua

SEQ ID NO: 4036743 - RNA, 14 nt, Staphylococcus aureus subsp. aureus N315
aauuaaacuaauag

SEQ ID NO: 4036744 - RNA, 17 nt, Staphylococcus aureus subsp. aureus N315
aauuaaagauuaaaaua

SEQ ID NO: 4036745 - RNA, 20 nt, Staphylococcus aureus subsp. aureus N315
aauuaaagucaauuuaaaua

SEQ ID NO: 4036746 - RNA, 15 nt, Staphylococcus aureus subsp. aureus N315
aauuaaauaaugaua

SEQ ID NO: 4036747 - RNA, 14 nt, Staphylococcus aureus subsp. aureus N315
aauucaucuaaccu

SEQ ID NO: 4036748 - RNA, 23 nt, Staphylococcus aureus subsp. aureus N315
aauucaucuaaccuuuucaucag

SEQ ID NO: 4036749 - RNA, 20 nt, Staphylococcus aureus subsp. aureus N315
aauucaucuuaucaagaaua

SEQ ID NO: 4036750 - RNA, 21 nt, Staphylococcus aureus subsp. aureus N315
aauucaucuuaucaagaauau

SEQ ID NO: 4036751 - RNA, 16 nt, Staphylococcus aureus subsp. aureus N315
aauucauuuuauaaau

SEQ ID NO: 4036752 - RNA, 14 nt, Staphylococcus aureus subsp. aureus N315
aauuccaucaucuc

SEQ ID NO: 4036753 - RNA, 18 nt, Staphylococcus aureus subsp. aureus N315
aauucccauguauucuua

SEQ ID NO: 4036754 - RNA, 21 nt, Staphylococcus aureus subsp. aureus N315
aauuccccaaagccuucuauc

SEQ ID NO: 4036755 - RNA, 13 nt, Staphylococcus aureus subsp. aureus N315
aauucgaaaagaa

SEQ ID NO: 4036756 - RNA, 14 nt, Staphylococcus aureus subsp. aureus N315
aauucgaaaagaaa

SEQ ID NO: 4036757 - RNA, 19 nt, Staphylococcus aureus subsp. aureus N315
aauucgacucaaacaauaa

SEQ ID NO: 4036758 - RNA, 20 nt, Staphylococcus aureus subsp. aureus N315
aauucgauuaucuacuauuu

SEQ ID NO: 4036759 - RNA, 21 nt, Staphylococcus aureus subsp. aureus N315
aauucgcaagccuucuauaua

SEQ ID NO: 4036760 - RNA, 22 nt, Staphylococcus aureus subsp. aureus N315
aauucgcucacaugugaaauaa

SEQ ID NO: 4036761 - RNA, 17 nt, Staphylococcus aureus subsp. aureus N315
aauucgucuguuucaua

SEQ ID NO: 4036762 - RNA, 22 nt, Staphylococcus aureus subsp. aureus N315
aauucguuuugcuaaccaucau

SEQ ID NO: 4036763 - RNA, 15 nt, Staphylococcus aureus subsp. aureus N315
aauucuaaaagaauu

SEQ ID NO: 4036764 - RNA, 14 nt, Staphylococcus aureus subsp. aureus N315
aauucuaacugcaa

SEQ ID NO: 4036765 - RNA, 15 nt, Staphylococcus aureus subsp. aureus N315
aauucuacuaaaaau

SEQ ID NO: 4036766 - RNA, 23 nt, Staphylococcus aureus subsp. aureus N315
aauucuacuaaaaaugcuuuaac

SEQ ID NO: 4036767 - RNA, 12 nt, Staphylococcus aureus subsp. aureus N315
aauucuauaaau

SEQ ID NO: 4036768 - RNA, 13 nt, Staphylococcus aureus subsp. aureus N315
aauucuauaaaua

SEQ ID NO: 4036769 - RNA, 19 nt, Staphylococcus aureus subsp. aureus N315
aauucuauaaauagaauuu

SEQ ID NO: 4036770 - RNA, 17 nt, Staphylococcus aureus subsp. aureus N315
aauucuauaauuuuaau

SEQ ID NO: 4036771 - RNA, 14 nt, Staphylococcus aureus subsp. aureus N315
aauucuauuuuuga

SEQ ID NO: 4036772 - RNA, 17 nt, Staphylococcus aureus subsp. aureus N315
aauucuauuuuugauuu

SEQ ID NO: 4036773 - RNA, 21 nt, Staphylococcus aureus subsp. aureus N315
aauucuauuuuugauuuaaua

SEQ ID NO: 4036774 - RNA, 19 nt, Staphylococcus aureus subsp. aureus N315
aauucucgauuuuuuuaua

SEQ ID NO: 4036775 - RNA, 13 nt, Staphylococcus aureus subsp. aureus N315
aauucucuuuguu

SEQ ID NO: 4036776 - RNA, 20 nt, Staphylococcus aureus subsp. aureus N315
aauucucuuuguuggggccc

SEQ ID NO: 4036777 - RNA, 16 nt, Staphylococcus aureus subsp. aureus N315
aauucugauuauguuc

SEQ ID NO: 4036778 - RNA, 17 nt, Staphylococcus aureus subsp. aureus N315
aauucuggauuaaaccc

SEQ ID NO: 4036779 - RNA, 15 nt, Staphylococcus aureus subsp. aureus N315
aauucuuaaaaagca

SEQ ID NO: 4036780 - RNA, 16 nt, Staphylococcus aureus subsp. aureus N315
aauucuucaaauuuaa

SEQ ID NO: 4036781 - RNA, 23 nt, Staphylococcus aureus subsp. aureus N315
aauucuucaaauuuaacguguaa

SEQ ID NO: 4036782 - RNA, 16 nt, Staphylococcus aureus subsp. aureus N315
aauucuucaaccauuu

SEQ ID NO: 4036783 - RNA, 21 nt, Staphylococcus aureus subsp. aureus N315
aauucuucaaccauuuguucu

SEQ ID NO: 4036784 - RNA, 22 nt, Staphylococcus aureus subsp. aureus N315
aauucuucuuuagauugaucag

SEQ ID NO: 4036785 - RNA, 18 nt, Staphylococcus aureus subsp. aureus N315
aauucuuuucaagaaauu

SEQ ID NO: 4036786 - RNA, 15 nt, Staphylococcus aureus subsp. aureus N315
aauucuuuuguaauu

SEQ ID NO: 4036787 - RNA, 21 nt, Staphylococcus aureus subsp. aureus N315
aauucuuuuucagcuaauugu

SEQ ID NO: 4036788 - RNA, 23 nt, Staphylococcus aureus subsp. aureus N315
aauucuuuuucagcuaauugucg

SEQ ID NO: 4036789 - RNA, 11 nt, Staphylococcus aureus subsp. aureus N315
aauugaaaauc

SEQ ID NO: 4036790 - RNA, 17 nt, Staphylococcus aureus subsp. aureus N315
aauugaaauagaaacua

SEQ ID NO: 4036791 - RNA, 13 nt, Staphylococcus aureus subsp. aureus N315
aauugaacuuugu

SEQ ID NO: 4036792 - RNA, 22 nt, Staphylococcus aureus subsp. aureus N315
aauugaaggccauuuuuauuua

SEQ ID NO: 4036793 - RNA, 16 nt, Staphylococcus aureus subsp. aureus N315
aauugaagugaaauug

SEQ ID NO: 4036794 - RNA, 13 nt, Staphylococcus aureus subsp. aureus N315
aauugaauagguc

SEQ ID NO: 4036795 - RNA, 23 nt, Staphylococcus aureus subsp. aureus N315
aauugaauauuuuucaauuaaau

SEQ ID NO: 4036796 - RNA, 18 nt, Staphylococcus aureus subsp. aureus N315
aauugaaucuuuguuaua

SEQ ID NO: 4036797 - RNA, 14 nt, Staphylococcus aureus subsp. aureus N315
aauugaaugaaaau

SEQ ID NO: 4036798 - RNA, 21 nt, Staphylococcus aureus subsp. aureus N315
aauugaauuucgcacaauguu

SEQ ID NO: 4036799 - RNA, 20 nt, Staphylococcus aureus subsp. aureus N315
aauugacaguuuccauaaau

SEQ ID NO: 4036800 - RNA, 19 nt, Staphylococcus aureus subsp. aureus N315
aauugacgcauuaaugauu

SEQ ID NO: 4036801 - RNA, 17 nt, Staphylococcus aureus subsp. aureus N315
aauugacucaaagauau

SEQ ID NO: 4036802 - RNA, 19 nt, Staphylococcus aureus subsp. aureus N315
aauugacuuacauuuuaau

SEQ ID NO: 4036803 - RNA, 22 nt, Staphylococcus aureus subsp. aureus N315
aauugacuuacauuuuaauaaa

SEQ ID NO: 4036804 - RNA, 15 nt, Staphylococcus aureus subsp. aureus N315
aauugacuuuaauug

SEQ ID NO: 4036805 - RNA, 16 nt, Staphylococcus aureus subsp. aureus N315
aauugagaaguauuau

SEQ ID NO: 4036806 - RNA, 19 nt, Staphylococcus aureus subsp. aureus N315
aauugagaaguauuaugau

SEQ ID NO: 4036807 - RNA, 11 nt, Staphylococcus aureus subsp. aureus N315
aauugaguauu

SEQ ID NO: 4036808 - RNA, 14 nt, Staphylococcus aureus subsp. aureus N315
aauugaguauuaaa

SEQ ID NO: 4036809 - RNA, 23 nt, Staphylococcus aureus subsp. aureus N315
aauugaguauuaaauuugaaagu

SEQ ID NO: 4036810 - RNA, 16 nt, Staphylococcus aureus subsp. aureus N315
aauugaguuguugcaa

SEQ ID NO: 4036811 - RNA, 22 nt, Staphylococcus aureus subsp. aureus N315
aauugaguuguugcaacuugug

SEQ ID NO: 4036812 - RNA, 20 nt, Staphylococcus aureus subsp. aureus N315
aauugaucagcauuuaagcu

SEQ ID NO: 4036813 - RNA, 21 nt, Staphylococcus aureus subsp. aureus N315
aauugaucagcauuuaagcua

SEQ ID NO: 4036814 - RNA, 18 nt, Staphylococcus aureus subsp. aureus N315
aauugauuacaccacuua

SEQ ID NO: 4036815 - RNA, 22 nt, Staphylococcus aureus subsp. aureus N315
aauugauuacaccacuuaggau

SEQ ID NO: 4036816 - RNA, 16 nt, Staphylococcus aureus subsp. aureus N315
aauugauuauaaugau

SEQ ID NO: 4036817 - RNA, 13 nt, Staphylococcus aureus subsp. aureus N315
aauugauugcucu

SEQ ID NO: 4036818 - RNA, 21 nt, Staphylococcus aureus subsp. aureus N315
aauugauugcucuaagcauuc

SEQ ID NO: 4036819 - RNA, 20 nt, Staphylococcus aureus subsp. aureus N315
aauugauuguggugaaauaa

SEQ ID NO: 4036820 - RNA, 19 nt, Staphylococcus aureus subsp. aureus N315
aauugauuucuaauugaaa

SEQ ID NO: 4036821 - RNA, 18 nt, Staphylococcus aureus subsp. aureus N315
aauugauuuugaaucaca

SEQ ID NO: 4036822 - RNA, 20 nt, Staphylococcus aureus subsp. aureus N315
aauugcauacguaaauggua

SEQ ID NO: 4036823 - RNA, 18 nt, Staphylococcus aureus subsp. aureus N315
aauugcauuacuacaaac

SEQ ID NO: 4036824 - RNA, 23 nt, Staphylococcus aureus subsp. aureus N315
aauugcauuacuacaaacuugau

SEQ ID NO: 4036825 - RNA, 14 nt, Staphylococcus aureus subsp. aureus N315
aauugcguuuaaua

SEQ ID NO: 4036826 - RNA, 19 nt, Staphylococcus aureus subsp. aureus N315
aauugcuaaaaaaauuaaa

SEQ ID NO: 4036827 - RNA, 17 nt, Staphylococcus aureus subsp. aureus N315
aauugcucuuuaacaau

SEQ ID NO: 4036828 - RNA, 18 nt, Staphylococcus aureus subsp. aureus N315
aauugcucuuuaacaaug

SEQ ID NO: 4036829 - RNA, 20 nt, Staphylococcus aureus subsp. aureus N315
aauugcugacaccuauauuu

SEQ ID NO: 4036830 - RNA, 21 nt, Staphylococcus aureus subsp. aureus N315
aauugcugacaccuauauuuu

SEQ ID NO: 4036831 - RNA, 16 nt, Staphylococcus aureus subsp. aureus N315
aauugcuugaaauuau

SEQ ID NO: 4036832 - RNA, 18 nt, Staphylococcus aureus subsp. aureus N315
aauugcuuguuuuaaaug

SEQ ID NO: 4036833 - RNA, 17 nt, Staphylococcus aureus subsp. aureus N315
aauugcuuuaaacuuau

SEQ ID NO: 4036834 - RNA, 13 nt, Staphylococcus aureus subsp. aureus N315
aauuugaaauaua

SEQ ID NO: 4036835 - RNA, 16 nt, Staphylococcus aureus subsp. aureus N315
aauuugaaauauacca

SEQ ID NO: 4036836 - RNA, 17 nt, Staphylococcus aureus subsp. aureus N315
aauuugaaauauaccaa

SEQ ID NO: 4036837 - RNA, 12 nt, Staphylococcus aureus subsp. aureus N315
aauuugaaauug

SEQ ID NO: 4036838 - RNA, 21 nt, Staphylococcus aureus subsp. aureus N315
aauuugaauauacuuaauuua

SEQ ID NO: 4036839 - RNA, 18 nt, Staphylococcus aureus subsp. aureus N315
aauuugaauugacuuaca

SEQ ID NO: 4036840 - RNA, 21 nt, Staphylococcus aureus subsp. aureus N315
aauuugagccauuguuauuau

SEQ ID NO: 4036841 - RNA, 17 nt, Staphylococcus aureus subsp. aureus N315
aauuugauuaaauucau

SEQ ID NO: 4036842 - RNA, 16 nt, Staphylococcus aureus subsp. aureus N315
aauuugauuaaauucu

SEQ ID NO: 4036843 - RNA, 16 nt, Staphylococcus aureus subsp. aureus N315
aauuugcaaaaucaac

SEQ ID NO: 4036844 - RNA, 16 nt, Staphylococcus aureus subsp. aureus N315
aauuugcacaaagaua

SEQ ID NO: 4036845 - RNA, 16 nt, Staphylococcus aureus subsp. aureus N315
aauuugcauaacauug

SEQ ID NO: 4036846 - RNA, 14 nt, Staphylococcus aureus subsp. aureus N315
aauuuguaauacaa

SEQ ID NO: 4036847 - RNA, 17 nt, Staphylococcus aureus subsp. aureus N315
aauuuguauuuaaaauc

SEQ ID NO: 4036848 - RNA, 15 nt, Staphylococcus aureus subsp. aureus N315
aauuuguuuuaaaua

SEQ ID NO: 4036849 - RNA, 16 nt, Staphylococcus aureus subsp. aureus N315
aauuuguuuuaaauac

SEQ ID NO: 4036850 - RNA, 16 nt, Staphylococcus aureus subsp. aureus N315
aauuuuaacuuauaua

SEQ ID NO: 4036851 - RNA, 15 nt, Staphylococcus aureus subsp. aureus N315
aauuuuaauauauuu

SEQ ID NO: 4036852 - RNA, 22 nt, Staphylococcus aureus subsp. aureus N315
aauuuuaaugaguaguuucucu

SEQ ID NO: 4036853 - RNA, 20 nt, Staphylococcus aureus subsp. aureus N315
aauuuuaauuaauuaucaua

SEQ ID NO: 4036854 - RNA, 16 nt, Staphylococcus aureus subsp. aureus N315
aauuuuaccauguuuu

SEQ ID NO: 4036855 - RNA, 22 nt, Staphylococcus aureus subsp. aureus N315
aauuuuaccuucgcauacuuuu

SEQ ID NO: 4036856 - RNA, 20 nt, Staphylococcus aureus subsp. aureus N315
aauuuuacuaguguauauaa

SEQ ID NO: 4036857 - RNA, 19 nt, Staphylococcus aureus subsp. aureus N315
aauuuuauauagacaguag

SEQ ID NO: 4036858 - RNA, 13 nt, Staphylococcus aureus subsp. aureus N315
aauuuuauauauc

SEQ ID NO: 4036859 - RNA, 22 nt, Staphylococcus aureus subsp. aureus N315
aauuuuaugucccaaugcugaa

SEQ ID NO: 4036860 - RNA, 16 nt, Staphylococcus aureus subsp. aureus N315
aauuuucaauuagaaa

SEQ ID NO: 4036861 - RNA, 18 nt, Staphylococcus aureus subsp. aureus N315
aauuuucaauuagaaaau

SEQ ID NO: 4036862 - RNA, 11 nt, Staphylococcus aureus subsp. aureus N315
aauuuucagaa

SEQ ID NO: 4036863 - RNA, 21 nt, Staphylococcus aureus subsp. aureus N315
aauuuuccuuccaauaauaaa

SEQ ID NO: 4036864 - RNA, 13 nt, Staphylococcus aureus subsp. aureus N315
aauuuucuaaaua

SEQ ID NO: 4036865 - RNA, 15 nt, Staphylococcus aureus subsp. aureus N315
aauuuucuugccauc

SEQ ID NO: 4036866 - RNA, 20 nt, Staphylococcus aureus subsp. aureus N315
aauuuugacauaaaaaauaa

SEQ ID NO: 4036867 - RNA, 12 nt, Staphylococcus aureus subsp. aureus N315
aauuuuuaacaa

SEQ ID NO: 4036868 - RNA, 13 nt, Staphylococcus aureus subsp. aureus N315
aauuuuuaacaaa

SEQ ID NO: 4036869 - RNA, 14 nt, Staphylococcus aureus subsp. aureus N315
aauuuuuaacaaaa

SEQ ID NO: 4036870 - RNA, 23 nt, Staphylococcus aureus subsp. aureus N315
aauuuuuaguuagggaaauguag

SEQ ID NO: 4036871 - RNA, 18 nt, Staphylococcus aureus subsp. aureus N315
aauuuuuaugcauuauag

SEQ ID NO: 4036872 - RNA, 19 nt, Staphylococcus aureus subsp. aureus N315
aauuuuuaugcauuauaga

SEQ ID NO: 4036873 - RNA, 14 nt, Staphylococcus aureus subsp. aureus N315
aauuuuuauucugu

SEQ ID NO: 4036874 - RNA, 23 nt, Staphylococcus aureus subsp. aureus N315
aauuuuuauuuacacacaugaua

SEQ ID NO: 4036875 - RNA, 15 nt, Staphylococcus aureus subsp. aureus N315
aauuuuuauuuuuag

SEQ ID NO: 4036876 - RNA, 13 nt, Staphylococcus aureus subsp. aureus N315
aauuuuucauaua

SEQ ID NO: 4036877 - RNA, 19 nt, Staphylococcus aureus subsp. aureus N315
aauuuuucauuaauacaag

SEQ ID NO: 4036878 - RNA, 17 nt, Staphylococcus aureus subsp. aureus N315
aauuuuucuaaaugauu

SEQ ID NO: 4036879 - RNA, 19 nt, Staphylococcus aureus subsp. aureus N315
aauuuuuguaauacaucua

SEQ ID NO: 4036880 - RNA, 15 nt, Staphylococcus aureus subsp. aureus N315
aauuuuuuagugaaa

SEQ ID NO: 4036881 - RNA, 15 nt, Staphylococcus aureus subsp. aureus N315
aauuuuuuauuaaga

SEQ ID NO: 4036882 - RNA, 16 nt, Staphylococcus aureus subsp. aureus N315
aauuuuuuauuaagac

SEQ ID NO: 4036883 - RNA, 21 nt, Staphylococcus aureus subsp. aureus N315
aauuuuuucaucauucaaacu

SEQ ID NO: 4036884 - RNA, 17 nt, Staphylococcus aureus subsp. aureus N315
aauuuuuugugccucuu

SEQ ID NO: 4036885 - RNA, 15 nt, Staphylococcus aureus subsp. aureus N315
aauuuuuuucauaau

SEQ ID NO: 4036886 - RNA, 13 nt, Staphylococcus aureus subsp. aureus N315
acaaaaaaaccga

SEQ ID NO: 4036887 - RNA, 18 nt, Staphylococcus aureus subsp. aureus N315
acaaaaacaucuacauca

SEQ ID NO: 4036888 - RNA, 13 nt, Staphylococcus aureus subsp. aureus N315
acaaaaagaauuu

SEQ ID NO: 4036889 - RNA, 19 nt, Staphylococcus aureus subsp. aureus N315
acaaaaagaauuucgaaaa

SEQ ID NO: 4036890 - RNA, 12 nt, Staphylococcus aureus subsp. aureus N315
acaaaaagacuu

SEQ ID NO: 4036891 - RNA, 17 nt, Staphylococcus aureus subsp. aureus N315
acaaaaagacuuccaau

SEQ ID NO: 4036892 - RNA, 16 nt, Staphylococcus aureus subsp. aureus N315
acaaaaauauagcuau

SEQ ID NO: 4036893 - RNA, 17 nt, Staphylococcus aureus subsp. aureus N315
acaaaagaaaguuaauu

SEQ ID NO: 4036894 - RNA, 23 nt, Staphylococcus aureus subsp. aureus N315
acaaaagaggcgccacaacaugu

SEQ ID NO: 4036895 - RNA, 15 nt, Staphylococcus aureus subsp. aureus N315
acaaaaguaugauuu

SEQ ID NO: 4036896 - RNA, 14 nt, Staphylococcus aureus subsp. aureus N315
acaaaauaacaugu

SEQ ID NO: 4036897 - RNA, 18 nt, Staphylococcus aureus subsp. aureus N315
acaaaauacccugcuuua

SEQ ID NO: 4036898 - RNA, 15 nt, Staphylococcus aureus subsp. aureus N315
acaaaaucaccuuuu

SEQ ID NO: 4036899 - RNA, 18 nt, Staphylococcus aureus subsp. aureus N315
acaaaaucucaacagcaa

SEQ ID NO: 4036900 - RNA, 18 nt, Staphylococcus aureus subsp. aureus N315
acaaaauuaagaagaaau

SEQ ID NO: 4036901 - RNA, 23 nt, Staphylococcus aureus subsp. aureus N315
acaaacauaaauaagcaguaaga

SEQ ID NO: 4036902 - RNA, 17 nt, Staphylococcus aureus subsp. aureus N315
acaaacgcacugcugca

SEQ ID NO: 4036903 - RNA, 13 nt, Staphylococcus aureus subsp. aureus N315
acaaacuucacau

SEQ ID NO: 4036904 - RNA, 13 nt, Staphylococcus aureus subsp. aureus N315
acaaagaaauuaa

SEQ ID NO: 4036905 - RNA, 21 nt, Staphylococcus aureus subsp. aureus N315
acaaagaaccacgcaucaugu

SEQ ID NO: 4036906 - RNA, 13 nt, Staphylococcus aureus subsp. aureus N315
acaaagauauguu

SEQ ID NO: 4036907 - RNA, 17 nt, Staphylococcus aureus subsp. aureus N315
acaaagcuuccaaaugu

SEQ ID NO: 4036908 - RNA, 20 nt, Staphylococcus aureus subsp. aureus N315
acaaaggauuauuaacuuua

SEQ ID NO: 4036909 - RNA, 16 nt, Staphylococcus aureus subsp. aureus N315
acaaagucauuuucau

SEQ ID NO: 4036910 - RNA, 19 nt, Staphylococcus aureus subsp. aureus N315
acaaagugcaauuauuuca

SEQ ID NO: 4036911 - RNA, 14 nt, Staphylococcus aureus subsp. aureus N315
acaaaguuaaccau

SEQ ID NO: 4036912 - RNA, 21 nt, Staphylococcus aureus subsp. aureus N315
acaaauaaaggcaacaaauau

SEQ ID NO: 4036913 - RNA, 14 nt, Staphylococcus aureus subsp. aureus N315
acaaauaacaaaca

SEQ ID NO: 4036914 - RNA, 14 nt, Staphylococcus aureus subsp. aureus N315
acaaauaguucaaa

SEQ ID NO: 4036915 - RNA, 20 nt, Staphylococcus aureus subsp. aureus N315
acaaauauacuugccuucaa

SEQ ID NO: 4036916 - RNA, 22 nt, Staphylococcus aureus subsp. aureus N315
acaaauauaucuagccugaaau

SEQ ID NO: 4036917 - RNA, 12 nt, Staphylococcus aureus subsp. aureus N315
acaaauauguaa

SEQ ID NO: 4036918 - RNA, 18 nt, Staphylococcus aureus subsp. aureus N315
acaaauauuagaacauuu

SEQ ID NO: 4036919 - RNA, 19 nt, Staphylococcus aureus subsp. aureus N315
acaaaucgauuaauuauaa

SEQ ID NO: 4036920 - RNA, 18 nt, Staphylococcus aureus subsp. aureus N315
acaaaucguaaacauaau

SEQ ID NO: 4036921 - RNA, 19 nt, Staphylococcus aureus subsp. aureus N315
acaaaucuuuuaaauuuag

SEQ ID NO: 4036922 - RNA, 16 nt, Staphylococcus aureus subsp. aureus N315
acaauuuuuaaaaacc

SEQ ID NO: 4036923 - RNA, 19 nt, Staphylococcus aureus subsp. aureus N315
acaauuuuugggaagaaua

SEQ ID NO: 4036924 - RNA, 12 nt, Staphylococcus aureus subsp. aureus N315
acacaaagaauu

SEQ ID NO: 4036925 - RNA, 17 nt, Staphylococcus aureus subsp. aureus N315
acacaaauuaaaacucg

SEQ ID NO: 4036926 - RNA, 20 nt, Staphylococcus aureus subsp. aureus N315
acacacaugauaauuuuuag

SEQ ID NO: 4036927 - RNA, 21 nt, Staphylococcus aureus subsp. aureus N315
acacacaugauaauuuuuagu

SEQ ID NO: 4036928 - RNA, 15 nt, Staphylococcus aureus subsp. aureus N315
acacacccaaauuua

SEQ ID NO: 4036929 - RNA, 18 nt, Staphylococcus aureus subsp. aureus N315
acacacuaaggaaaauua

SEQ ID NO: 4036930 - RNA, 22 nt, Staphylococcus aureus subsp. aureus N315
acacagagaauuucgaaaagaa

SEQ ID NO: 4036931 - RNA, 21 nt, Staphylococcus aureus subsp. aureus N315
acacagcuaaacgcaauacga

SEQ ID NO: 4036932 - RNA, 16 nt, Staphylococcus aureus subsp. aureus N315
acacagguaaauuuaa

SEQ ID NO: 4036933 - RNA, 22 nt, Staphylococcus aureus subsp. aureus N315
acacaguaauucuuaaaaagca

SEQ ID NO: 4036934 - RNA, 14 nt, Staphylococcus aureus subsp. aureus N315
acacaguacaaaua

SEQ ID NO: 4036935 - RNA, 12 nt, Staphylococcus aureus subsp. aureus N315
acacauacaccu

SEQ ID NO: 4036936 - RNA, 22 nt, Staphylococcus aureus subsp. aureus N315
acacaucuauguggcuacuuga

SEQ ID NO: 4036937 - RNA, 21 nt, Staphylococcus aureus subsp. aureus N315
acacauguacguuuuuuuaaa

SEQ ID NO: 4036938 - RNA, 22 nt, Staphylococcus aureus subsp. aureus N315
acacauuauugaaauuuuuaau

SEQ ID NO: 4036939 - RNA, 17 nt, Staphylococcus aureus subsp. aureus N315
acacauucuuauuugaa

SEQ ID NO: 4036940 - RNA, 22 nt, Staphylococcus aureus subsp. aureus N315
acacauucuuauuugaaaugau

SEQ ID NO: 4036941 - RNA, 22 nt, Staphylococcus aureus subsp. aureus N315
acaccaauugaauauuuuucaa

SEQ ID NO: 4036942 - RNA, 13 nt, Staphylococcus aureus subsp. aureus N315
acaccagauauca

SEQ ID NO: 4036943 - RNA, 12 nt, Staphylococcus aureus subsp. aureus N315
acacccaaauuu

SEQ ID NO: 4036944 - RNA, 18 nt, Staphylococcus aureus subsp. aureus N315
acacccauuugucuuaau

SEQ ID NO: 4036945 - RNA, 12 nt, Staphylococcus aureus subsp. aureus N315
acaccccaacuc

SEQ ID NO: 4036946 - RNA, 14 nt, Staphylococcus aureus subsp. aureus N315
acaccccaacuugc

SEQ ID NO: 4036947 - RNA, 13 nt, Staphylococcus aureus subsp. aureus N315
acaccuacaaaua

SEQ ID NO: 4036948 - RNA, 22 nt, Staphylococcus aureus subsp. aureus N315
acaccugguacauaaauaccug

SEQ ID NO: 4036949 - RNA, 20 nt, Staphylococcus aureus subsp. aureus N315
acaccuuaucacuuggaaua

SEQ ID NO: 4036950 - RNA, 14 nt, Staphylococcus aureus subsp. aureus N315
acaccuucaauauc

SEQ ID NO: 4036951 - RNA, 14 nt, Staphylococcus aureus subsp. aureus N315
acacgauaauuaua

SEQ ID NO: 4036952 - RNA, 21 nt, Staphylococcus aureus subsp. aureus N315
acacgcgguaaaacgaaguca

SEQ ID NO: 4036953 - RNA, 20 nt, Staphylococcus aureus subsp. aureus N315
acacguucuugguauuuuuu

SEQ ID NO: 4036954 - RNA, 23 nt, Staphylococcus aureus subsp. aureus N315
acacguucuugguauuuuuuaaa

SEQ ID NO: 4036955 - RNA, 16 nt, Staphylococcus aureus subsp. aureus N315
acacuacgcugaugaa

SEQ ID NO: 4036956 - RNA, 21 nt, Staphylococcus aureus subsp. aureus N315
acacuacgcugaugaaugauu

SEQ ID NO: 4036957 - RNA, 22 nt, Staphylococcus aureus subsp. aureus N315
acacuaucauuaucaaauaacc

SEQ ID NO: 4036958 - RNA, 16 nt, Staphylococcus aureus subsp. aureus N315
acacuaucguuuuuau

SEQ ID NO: 4036959 - RNA, 15 nt, Staphylococcus aureus subsp. aureus N315
acacuuaauauauuc

SEQ ID NO: 4036960 - RNA, 21 nt, Staphylococcus aureus subsp. aureus N315
acacuucguauugaaugaauu

SEQ ID NO: 4036961 - RNA, 22 nt, Staphylococcus aureus subsp. aureus N315
acacuuggcuuaggaugaaaau

SEQ ID NO: 4036962 - RNA, 16 nt, Staphylococcus aureus subsp. aureus N315
acacuuuaguauuaua

SEQ ID NO: 4036963 - RNA, 15 nt, Staphylococcus aureus subsp. aureus N315
acacuuuucuuauca

SEQ ID NO: 4036964 - RNA, 11 nt, Staphylococcus aureus subsp. aureus N315
acagaaaaggg

SEQ ID NO: 4036965 - RNA, 13 nt, Staphylococcus aureus subsp. aureus N315
acagagaaauucg

SEQ ID NO: 4036966 - RNA, 23 nt, Staphylococcus aureus subsp. aureus N315
acagagaaauucgaaaagaaauu

SEQ ID NO: 4036967 - RNA, 22 nt, Staphylococcus aureus subsp. aureus N315
acagagaauuucgaaaagaaau

SEQ ID NO: 4036968 - RNA, 23 nt, Staphylococcus aureus subsp. aureus N315
acagagaauuucgaaaagaaauu

SEQ ID NO: 4036969 - RNA, 22 nt, Staphylococcus aureus subsp. aureus N315
acagauaagaauauuuaaguuu

SEQ ID NO: 4036970 - RNA, 23 nt, Staphylococcus aureus subsp. aureus N315
acagaucucaauccaauuaaaua

SEQ ID NO: 4036971 - RNA, 16 nt, Staphylococcus aureus subsp. aureus N315
acagauuuuaaaaauu

SEQ ID NO: 4036972 - RNA, 19 nt, Staphylococcus aureus subsp. aureus N315
acagauuuuaaaaauucau

SEQ ID NO: 4036973 - RNA, 15 nt, Staphylococcus aureus subsp. aureus N315
acagcaaaaaauaaa

SEQ ID NO: 4036974 - RNA, 16 nt, Staphylococcus aureus subsp. aureus N315
acagcaaaaaauaaau

SEQ ID NO: 4036975 - RNA, 12 nt, Staphylococcus aureus subsp. aureus N315
acagcaaauaaa

SEQ ID NO: 4036976 - RNA, 22 nt, Staphylococcus aureus subsp. aureus N315
acagcacauuuuuaguuagaaa

SEQ ID NO: 4036977 - RNA, 14 nt, Staphylococcus aureus subsp. aureus N315
acagcaguaagaua

SEQ ID NO: 4036978 - RNA, 16 nt, Staphylococcus aureus subsp. aureus N315
acagcaguaagauauu

SEQ ID NO: 4036979 - RNA, 18 nt, Staphylococcus aureus subsp. aureus N315
acagcaguaggauaauuu

SEQ ID NO: 4036980 - RNA, 22 nt, Staphylococcus aureus subsp. aureus N315
acagcaguaggauaauuucaau

SEQ ID NO: 4036981 - RNA, 22 nt, Staphylococcus aureus subsp. aureus N315
acagccgaggcaauauugaaca

SEQ ID NO: 4036982 - RNA, 17 nt, Staphylococcus aureus subsp. aureus N315
acagcggaauacagaug

SEQ ID NO: 4036983 - RNA, 22 nt, Staphylococcus aureus subsp. aureus N315
acagcguauuuuaaugauuuuu

SEQ ID NO: 4036984 - RNA, 22 nt, Staphylococcus aureus subsp. aureus N315
acagcgugauucaucuauuauu

SEQ ID NO: 4036985 - RNA, 15 nt, Staphylococcus aureus subsp. aureus N315
acagcuacaaauaau

SEQ ID NO: 4036986 - RNA, 22 nt, Staphylococcus aureus subsp. aureus N315
acaggaugguggggucauaaca

SEQ ID NO: 4036987 - RNA, 16 nt, Staphylococcus aureus subsp. aureus N315
acaggccacacuugag

SEQ ID NO: 4036988 - RNA, 21 nt, Staphylococcus aureus subsp. aureus N315
acaguacgauuauuuggauaa

SEQ ID NO: 4036989 - RNA, 20 nt, Staphylococcus aureus subsp. aureus N315
acaguaguuaauugaaugaa

SEQ ID NO: 4036990 - RNA, 23 nt, Staphylococcus aureus subsp. aureus N315
acaguaguuaauugaaugaaaau

SEQ ID NO: 4036991 - RNA, 22 nt, Staphylococcus aureus subsp. aureus N315
acagucaacugcugcuaaaaua

SEQ ID NO: 4036992 - RNA, 23 nt, Staphylococcus aureus subsp. aureus N315
acagucaacugcugcuaaaauaa

SEQ ID NO: 4036993 - RNA, 15 nt, Staphylococcus aureus subsp. aureus N315
acagugaaucuaaac

SEQ ID NO: 4036994 - RNA, 15 nt, Staphylococcus aureus subsp. aureus N315
acagugacugauuca

SEQ ID NO: 4036995 - RNA, 15 nt, Staphylococcus aureus subsp. aureus N315
acaguuacuucaguu

SEQ ID NO: 4036996 - RNA, 22 nt, Staphylococcus aureus subsp. aureus N315
acaguuacuuucgcuugcaaag

SEQ ID NO: 4036997 - RNA, 20 nt, Staphylococcus aureus subsp. aureus N315
acaguucuauagguuuauaa

SEQ ID NO: 4036998 - RNA, 19 nt, Staphylococcus aureus subsp. aureus N315
acaguuuccauaaauaaaa

SEQ ID NO: 4036999 - RNA, 13 nt, Staphylococcus aureus subsp. aureus N315
acaguuuuaaaug

SEQ ID NO: 4037000 - RNA, 23 nt, Staphylococcus aureus subsp. aureus N315
acaguuuuauuaucuuuguaaau

SEQ ID NO: 4037001 - RNA, 19 nt, Staphylococcus aureus subsp. aureus N315
acaguuuuuauauuaagac

SEQ ID NO: 4037002 - RNA, 16 nt, Staphylococcus aureus subsp. aureus N315
acauaaaacuuacauu

SEQ ID NO: 4037003 - RNA, 15 nt, Staphylococcus aureus subsp. aureus N315
acauaaaauuaacuu

SEQ ID NO: 4037004 - RNA, 12 nt, Staphylococcus aureus subsp. aureus N315
acauaaaauuua

SEQ ID NO: 4037005 - RNA, 21 nt, Staphylococcus aureus subsp. aureus N315
acauaaauauggauuuugaag

SEQ ID NO: 4037006 - RNA, 12 nt, Staphylococcus aureus subsp. aureus N315
acauaaaucaau

SEQ ID NO: 4037007 - RNA, 18 nt, Staphylococcus aureus subsp. aureus N315
acauaaaucccuaaaaaa

SEQ ID NO: 4037008 - RNA, 23 nt, Staphylococcus aureus subsp. aureus N315
acauaaaucuaauacuuucaaac

SEQ ID NO: 4037009 - RNA, 15 nt, Staphylococcus aureus subsp. aureus N315
acaugugggauaucu

SEQ ID NO: 4037010 - RNA, 19 nt, Staphylococcus aureus subsp. aureus N315
acauguuuggaugaacaaa

SEQ ID NO: 4037011 - RNA, 20 nt, Staphylococcus aureus subsp. aureus N315
acauguuuggaugaacaaaa

SEQ ID NO: 4037012 - RNA, 15 nt, Staphylococcus aureus subsp. aureus N315
acauuaaaaugauau

SEQ ID NO: 4037013 - RNA, 20 nt, Staphylococcus aureus subsp. aureus N315
acauuaaagaaaauaucuga

SEQ ID NO: 4037014 - RNA, 23 nt, Staphylococcus aureus subsp. aureus N315
acauuaaagaaaauaucugaaaa

SEQ ID NO: 4037015 - RNA, 22 nt, Staphylococcus aureus subsp. aureus N315
acauuaacaaggccugcaucac

SEQ ID NO: 4037016 - RNA, 13 nt, Staphylococcus aureus subsp. aureus N315
acauuaaguuaaa

SEQ ID NO: 4037017 - RNA, 14 nt, Staphylococcus aureus subsp. aureus N315
acauuaaguuaaac

SEQ ID NO: 4037018 - RNA, 12 nt, Staphylococcus aureus subsp. aureus N315
acauuaauauaa

SEQ ID NO: 4037019 - RNA, 19 nt, Staphylococcus aureus subsp. aureus N315
acauuaaugauagcaauga

SEQ ID NO: 4037020 - RNA, 22 nt, Staphylococcus aureus subsp. aureus N315
acauuaaugauagcaaugaauu

SEQ ID NO: 4037021 - RNA, 18 nt, Staphylococcus aureus subsp. aureus N315
acauuacauuuaguacau

SEQ ID NO: 4037022 - RNA, 17 nt, Staphylococcus aureus subsp. aureus N315
acauuagcaugauaaag

SEQ ID NO: 4037023 - RNA, 20 nt, Staphylococcus aureus subsp. aureus N315
acauuauguucuucaccagu

SEQ ID NO: 4037024 - RNA, 13 nt, Staphylococcus aureus subsp. aureus N315
acauuauuaaaua

SEQ ID NO: 4037025 - RNA, 20 nt, Staphylococcus aureus subsp. aureus N315
acauuauuguaaguuggcuu

SEQ ID NO: 4037026 - RNA, 16 nt, Staphylococcus aureus subsp. aureus N315
acauuauuuauauuua

SEQ ID NO: 4037027 - RNA, 19 nt, Staphylococcus aureus subsp. aureus N315
acauuauuuauauuuagaa

SEQ ID NO: 4037028 - RNA, 14 nt, Staphylococcus aureus subsp. aureus N315
acauucaaauaaau

SEQ ID NO: 4037029 - RNA, 22 nt, Staphylococcus aureus subsp. aureus N315
acauucaaauaaaugacauuua

SEQ ID NO: 4037030 - RNA, 20 nt, Staphylococcus aureus subsp. aureus N315
acauucauaccgaagaaacu

SEQ ID NO: 4037031 - RNA, 22 nt, Staphylococcus aureus subsp. aureus N315
acauucauaccgaagaaacuaa

SEQ ID NO: 4037032 - RNA, 17 nt, Staphylococcus aureus subsp. aureus N315
acauucauuuaguuaaa

SEQ ID NO: 4037033 - RNA, 22 nt, Staphylococcus aureus subsp. aureus N315
acauuccaaaguaccaucucua

SEQ ID NO: 4037034 - RNA, 19 nt, Staphylococcus aureus subsp. aureus N315
acauucccuuaauaauaag

SEQ ID NO: 4037035 - RNA, 13 nt, Staphylococcus aureus subsp. aureus N315
acauuccucuauu

SEQ ID NO: 4037036 - RNA, 16 nt, Staphylococcus aureus subsp. aureus N315
acauuccucuauugua

SEQ ID NO: 4037037 - RNA, 18 nt, Staphylococcus aureus subsp. aureus N315
acauucuauacuuuuaau

SEQ ID NO: 4037038 - RNA, 12 nt, Staphylococcus aureus subsp. aureus N315
acauucuaugua

SEQ ID NO: 4037039 - RNA, 21 nt, Staphylococcus aureus subsp. aureus N315
acauucugcccugcaaugcaa

SEQ ID NO: 4037040 - RNA, 14 nt, Staphylococcus aureus subsp. aureus N315
acauucuucaaaaa

SEQ ID NO: 4037041 - RNA, 16 nt, Staphylococcus aureus subsp. aureus N315
acauucuucaaaaaau

SEQ ID NO: 4037042 - RNA, 12 nt, Staphylococcus aureus subsp. aureus N315
acauugaauaaa

SEQ ID NO: 4037043 - RNA, 15 nt, Staphylococcus aureus subsp. aureus N315
acauugauaaauuuu

SEQ ID NO: 4037044 - RNA, 20 nt, Staphylococcus aureus subsp. aureus N315
acauugaugucaauuucacg

SEQ ID NO: 4037045 - RNA, 14 nt, Staphylococcus aureus subsp. aureus N315
acauugccacuuuu

SEQ ID NO: 4037046 - RNA, 19 nt, Staphylococcus aureus subsp. aureus N315
acauugccacuuuuguguu

SEQ ID NO: 4037047 - RNA, 17 nt, Staphylococcus aureus subsp. aureus N315
acauuggauuacuucca

SEQ ID NO: 4037048 - RNA, 15 nt, Staphylococcus aureus subsp. aureus N315
acauugguuuuuacu

SEQ ID NO: 4037049 - RNA, 16 nt, Staphylococcus aureus subsp. aureus N315
acauugguuuuuacua

SEQ ID NO: 4037050 - RNA, 20 nt, Staphylococcus aureus subsp. aureus N315
acauuguccguuuauagaua

SEQ ID NO: 4037051 - RNA, 13 nt, Staphylococcus aureus subsp. aureus N315
acauuuaaauaua

SEQ ID NO: 4037052 - RNA, 14 nt, Staphylococcus aureus subsp. aureus N315
acauuuaagaaacg

SEQ ID NO: 4037053 - RNA, 22 nt, Staphylococcus aureus subsp. aureus N315
acauuuaagaaacgucuuaauu

SEQ ID NO: 4037054 - RNA, 18 nt, Staphylococcus aureus subsp. aureus N315
acauuuacuuaagaacua

SEQ ID NO: 4037055 - RNA, 18 nt, Staphylococcus aureus subsp. aureus N315
acauuuaucgugaagaaa

SEQ ID NO: 4037056 - RNA, 22 nt, Staphylococcus aureus subsp. aureus N315
acauuucgguaugauauuucua

SEQ ID NO: 4037057 - RNA, 19 nt, Staphylococcus aureus subsp. aureus N315
acauuucuauacaaucauu

SEQ ID NO: 4037058 - RNA, 14 nt, Staphylococcus aureus subsp. aureus N315
acauuugauaacca

SEQ ID NO: 4037059 - RNA, 20 nt, Staphylococcus aureus subsp. aureus N315
acauuuguaaauauuuuuua

SEQ ID NO: 4037060 - RNA, 22 nt, Staphylococcus aureus subsp. aureus N315
acauuuguaaauauuuuuuaaa

SEQ ID NO: 4037061 - RNA, 14 nt, Staphylococcus aureus subsp. aureus N315
acauuuuaugucca

SEQ ID NO: 4037062 - RNA, 14 nt, Staphylococcus aureus subsp. aureus N315
acauuuuuggcuua

SEQ ID NO: 4037063 - RNA, 18 nt, Staphylococcus aureus subsp. aureus N315
acauuuuugugcaaaagu

SEQ ID NO: 4037064 - RNA, 18 nt, Staphylococcus aureus subsp. aureus N315
accaaaaaacagaggucu

SEQ ID NO: 4037065 - RNA, 15 nt, Staphylococcus aureus subsp. aureus N315
accaaaaaauccaag

SEQ ID NO: 4037066 - RNA, 16 nt, Staphylococcus aureus subsp. aureus N315
accaaaagaaauuuaa

SEQ ID NO: 4037067 - RNA, 22 nt, Staphylococcus aureus subsp. aureus N315
accaaaagaaauuuaauacaau

SEQ ID NO: 4037068 - RNA, 13 nt, Staphylococcus aureus subsp. aureus N315
accaaaauuauau

SEQ ID NO: 4037069 - RNA, 16 nt, Staphylococcus aureus subsp. aureus N315
accaaacaauacauaa

SEQ ID NO: 4037070 - RNA, 17 nt, Staphylococcus aureus subsp. aureus N315
accaaaccauaaguaaa

SEQ ID NO: 4037071 - RNA, 16 nt, Staphylococcus aureus subsp. aureus N315
accaaauaaauuaaau

SEQ ID NO: 4037072 - RNA, 18 nt, Staphylococcus aureus subsp. aureus N315
accaaauuggccauugga

SEQ ID NO: 4037073 - RNA, 12 nt, Staphylococcus aureus subsp. aureus N315
accaacaagguu

SEQ ID NO: 4037074 - RNA, 21 nt, Staphylococcus aureus subsp. aureus N315
accaacaauagguacaacuaa

SEQ ID NO: 4037075 - RNA, 20 nt, Staphylococcus aureus subsp. aureus N315
accaaccaaaaccaaaugaa

SEQ ID NO: 4037076 - RNA, 22 nt, Staphylococcus aureus subsp. aureus N315
accaacugucgguucaucuaaa

SEQ ID NO: 4037077 - RNA, 18 nt, Staphylococcus aureus subsp. aureus N315
accaacuugcacauuauu

SEQ ID NO: 4037078 - RNA, 13 nt, Staphylococcus aureus subsp. aureus N315
accaagauuccau

SEQ ID NO: 4037079 - RNA, 14 nt, Staphylococcus aureus subsp. aureus N315
accaagauuccauc

SEQ ID NO: 4037080 - RNA, 22 nt, Staphylococcus aureus subsp. aureus N315
accaagcccaugcccgauaaaa

SEQ ID NO: 4037081 - RNA, 13 nt, Staphylococcus aureus subsp. aureus N315
accaaguaaugau

SEQ ID NO: 4037082 - RNA, 14 nt, Staphylococcus aureus subsp. aureus N315
accaaguucacuaa

SEQ ID NO: 4037083 - RNA, 11 nt, Staphylococcus aureus subsp. aureus N315
accaauaauua

SEQ ID NO: 4037084 - RNA, 17 nt, Staphylococcus aureus subsp. aureus N315
accaaucaauaguuuau

SEQ ID NO: 4037085 - RNA, 24 nt, Staphylococcus aureus subsp. aureus N315
accaauuaauuguaaagcaugaau

SEQ ID NO: 4037086 - RNA, 14 nt, Staphylococcus aureus subsp. aureus N315
accaauugaauauu

SEQ ID NO: 4037087 - RNA, 19 nt, Staphylococcus aureus subsp. aureus N315
accaauugcugauauaaua

SEQ ID NO: 4037088 - RNA, 16 nt, Staphylococcus aureus subsp. aureus N315
accaauuguuucagcu

SEQ ID NO: 4037089 - RNA, 12 nt, Staphylococcus aureus subsp. aureus N315
accaauuuuuag

SEQ ID NO: 4037090 - RNA, 15 nt, Staphylococcus aureus subsp. aureus N315
accacaaauaucaau

SEQ ID NO: 4037091 - RNA, 15 nt, Staphylococcus aureus subsp. aureus N315
accacaccaugcugc

SEQ ID NO: 4037092 - RNA, 14 nt, Staphylococcus aureus subsp. aureus N315
accacauccccuuu

SEQ ID NO: 4037093 - RNA, 14 nt, Staphylococcus aureus subsp. aureus N315
accaccacuuucag

SEQ ID NO: 4037094 - RNA, 15 nt, Staphylococcus aureus subsp. aureus N315
accaccauaugcuaa

SEQ ID NO: 4037095 - RNA, 11 nt, Staphylococcus aureus subsp. aureus N315
accaccccaac

SEQ ID NO: 4037096 - RNA, 21 nt, Staphylococcus aureus subsp. aureus N315
accaccuacgcccaucaucac

SEQ ID NO: 4037097 - RNA, 17 nt, Staphylococcus aureus subsp. aureus N315
accuauuccuauuacua

SEQ ID NO: 4037098 - RNA, 12 nt, Staphylococcus aureus subsp. aureus N315
accuauuguauu

SEQ ID NO: 4037099 - RNA, 16 nt, Staphylococcus aureus subsp. aureus N315
accucuugauaaaaua

SEQ ID NO: 4037100 - RNA, 17 nt, Staphylococcus aureus subsp. aureus N315
accucuuuauuuuaucu

SEQ ID NO: 4037101 - RNA, 12 nt, Staphylococcus aureus subsp. aureus N315
accucuuuuguu

SEQ ID NO: 4037102 - RNA, 14 nt, Staphylococcus aureus subsp. aureus N315
accugauaauacaa

SEQ ID NO: 4037103 - RNA, 21 nt, Staphylococcus aureus subsp. aureus N315
accugcaauauagcaauuuuc

SEQ ID NO: 4037104 - RNA, 17 nt, Staphylococcus aureus subsp. aureus N315
accugcgccuucuuuuu

SEQ ID NO: 4037105 - RNA, 18 nt, Staphylococcus aureus subsp. aureus N315
accugcugaaguuugaac

SEQ ID NO: 4037106 - RNA, 14 nt, Staphylococcus aureus subsp. aureus N315
accugcuucuguaa

SEQ ID NO: 4037107 - RNA, 17 nt, Staphylococcus aureus subsp. aureus N315
accugcuuuuuauuauu

SEQ ID NO: 4037108 - RNA, 18 nt, Staphylococcus aureus subsp. aureus N315
accuggucguacuuucaa

SEQ ID NO: 4037109 - RNA, 12 nt, Staphylococcus aureus subsp. aureus N315
accuguuaaugu

SEQ ID NO: 4037110 - RNA, 17 nt, Staphylococcus aureus subsp. aureus N315
accuguuacuugagaac

SEQ ID NO: 4037111 - RNA, 22 nt, Staphylococcus aureus subsp. aureus N315
accuuaaauauaguugccaugu

SEQ ID NO: 4037112 - RNA, 13 nt, Staphylococcus aureus subsp. aureus N315
accuuaauaauga

SEQ ID NO: 4037113 - RNA, 22 nt, Staphylococcus aureus subsp. aureus N315
accuuaauaggauaugcuaaac

SEQ ID NO: 4037114 - RNA, 19 nt, Staphylococcus aureus subsp. aureus N315
accuuacuacgcauuauua

SEQ ID NO: 4037115 - RNA, 13 nt, Staphylococcus aureus subsp. aureus N315
accuuauauuuua

SEQ ID NO: 4037116 - RNA, 15 nt, Staphylococcus aureus subsp. aureus N315
accuuauauuuuauu

SEQ ID NO: 4037117 - RNA, 13 nt, Staphylococcus aureus subsp. aureus N315
accuucaauaucu

SEQ ID NO: 4037118 - RNA, 15 nt, Staphylococcus aureus subsp. aureus N315
accuucaguuucuac

SEQ ID NO: 4037119 - RNA, 19 nt, Staphylococcus aureus subsp. aureus N315
accuucaguuucuacugua

SEQ ID NO: 4037120 - RNA, 17 nt, Staphylococcus aureus subsp. aureus N315
accuucgcauacuuuuu

SEQ ID NO: 4037121 - RNA, 12 nt, Staphylococcus aureus subsp. aureus N315
accuucuauauu

SEQ ID NO: 4037122 - RNA, 19 nt, Staphylococcus aureus subsp. aureus N315
accuucuauauugggacuu

SEQ ID NO: 4037123 - RNA, 16 nt, Staphylococcus aureus subsp. aureus N315
accuugaaugauauua

SEQ ID NO: 4037124 - RNA, 18 nt, Staphylococcus aureus subsp. aureus N315
accuugaaugauauuaac

SEQ ID NO: 4037125 - RNA, 16 nt, Staphylococcus aureus subsp. aureus N315
accuuuaaaacaucau

SEQ ID NO: 4037126 - RNA, 14 nt, Staphylococcus aureus subsp. aureus N315
accuuuaaauuuac

SEQ ID NO: 4037127 - RNA, 13 nt, Staphylococcus aureus subsp. aureus N315
accuuuaauaucu

SEQ ID NO: 4037128 - RNA, 13 nt, Staphylococcus aureus subsp. aureus N315
accuuuaauuaca

SEQ ID NO: 4037129 - RNA, 18 nt, Staphylococcus aureus subsp. aureus N315
accuuuaucuguaacaaa

SEQ ID NO: 4037130 - RNA, 23 nt, Staphylococcus aureus subsp. aureus N315
accuuuaugugcaucauuuauau

SEQ ID NO: 4037131 - RNA, 14 nt, Staphylococcus aureus subsp. aureus N315
accuuuauuauuua

SEQ ID NO: 4037132 - RNA, 16 nt, Staphylococcus aureus subsp. aureus N315
accuuuauuauuuaau

SEQ ID NO: 4037133 - RNA, 18 nt, Staphylococcus aureus subsp. aureus N315
accuuucaaauauaucua

SEQ ID NO: 4037134 - RNA, 13 nt, Staphylococcus aureus subsp. aureus N315
accuuugucuuuu

SEQ ID NO: 4037135 - RNA, 17 nt, Staphylococcus aureus subsp. aureus N315
accuuugucuuuuuuau

SEQ ID NO: 4037136 - RNA, 19 nt, Staphylococcus aureus subsp. aureus N315
accuuuuauccccucaauu

SEQ ID NO: 4037137 - RNA, 22 nt, Staphylococcus aureus subsp. aureus N315
accuuuugauguuuaugacaaa

SEQ ID NO: 4037138 - RNA, 14 nt, Staphylococcus aureus subsp. aureus N315
accuuuuucuacca

SEQ ID NO: 4037139 - RNA, 12 nt, Staphylococcus aureus subsp. aureus N315
accuuuuuuaac

SEQ ID NO: 4037140 - RNA, 21 nt, Staphylococcus aureus subsp. aureus N315
accuuuuuuaguuaaagugau

SEQ ID NO: 4037141 - RNA, 13 nt, Staphylococcus aureus subsp. aureus N315
accuuuuuucucu

SEQ ID NO: 4037142 - RNA, 18 nt, Staphylococcus aureus subsp. aureus N315
acgaaaagucagcuuaca

SEQ ID NO: 4037143 - RNA, 18 nt, Staphylococcus aureus subsp. aureus N315
acgaaaguagaauuauuu

SEQ ID NO: 4037144 - RNA, 16 nt, Staphylococcus aureus subsp. aureus N315
acgaaauaaauuuuac

SEQ ID NO: 4037145 - RNA, 14 nt, Staphylococcus aureus subsp. aureus N315
acgaaauaguucaa

SEQ ID NO: 4037146 - RNA, 15 nt, Staphylococcus aureus subsp. aureus N315
acgaaauaguucaaa

SEQ ID NO: 4037147 - RNA, 11 nt, Staphylococcus aureus subsp. aureus N315
acgaacugcau

SEQ ID NO: 4037148 - RNA, 19 nt, Staphylococcus aureus subsp. aureus N315
acgaagcgggccucaucga

SEQ ID NO: 4037149 - RNA, 17 nt, Staphylococcus aureus subsp. aureus N315
acgaauuaaaauaacuc

SEQ ID NO: 4037150 - RNA, 22 nt, Staphylococcus aureus subsp. aureus N315
acgacaaucacagcaauaauaa

SEQ ID NO: 4037151 - RNA, 12 nt, Staphylococcus aureus subsp. aureus N315
acgacaauucca

SEQ ID NO: 4037152 - RNA, 13 nt, Staphylococcus aureus subsp. aureus N315
acgacauuuuuag

SEQ ID NO: 4037153 - RNA, 18 nt, Staphylococcus aureus subsp. aureus N315
acgacguccagcuaauaa

SEQ ID NO: 4037154 - RNA, 19 nt, Staphylococcus aureus subsp. aureus N315
acgacucuccaaauauugu

SEQ ID NO: 4037155 - RNA, 15 nt, Staphylococcus aureus subsp. aureus N315
acgacuugauagcau

SEQ ID NO: 4037156 - RNA, 19 nt, Staphylococcus aureus subsp. aureus N315
acgagcuugggacagaaaa

SEQ ID NO: 4037157 - RNA, 20 nt, Staphylococcus aureus subsp. aureus N315
acgaguguuuuaaucuuauu

SEQ ID NO: 4037158 - RNA, 20 nt, Staphylococcus aureus subsp. aureus N315
acgauaaauagugauugcuu

SEQ ID NO: 4037159 - RNA, 19 nt, Staphylococcus aureus subsp. aureus N315
acgauaacaauuuauuaaa

SEQ ID NO: 4037160 - RNA, 20 nt, Staphylococcus aureus subsp. aureus N315
acgauaacaauuuauuaaaa

SEQ ID NO: 4037161 - RNA, 16 nt, Staphylococcus aureus subsp. aureus N315
acgauaagaauuaaca

SEQ ID NO: 4037162 - RNA, 20 nt, Staphylococcus aureus subsp. aureus N315
acgauaagcacgauaaaaau

SEQ ID NO: 4037163 - RNA, 23 nt, Staphylococcus aureus subsp. aureus N315
acgauaauaacuagaacaagaau

SEQ ID NO: 4037164 - RNA, 15 nt, Staphylococcus aureus subsp. aureus N315
acgauaauaauaaga

SEQ ID NO: 4037165 - RNA, 23 nt, Staphylococcus aureus subsp. aureus N315
acgauacaucguguugcucgccu

SEQ ID NO: 4037166 - RNA, 18 nt, Staphylococcus aureus subsp. aureus N315
acgauaccggcaacuggu

SEQ ID NO: 4037167 - RNA, 20 nt, Staphylococcus aureus subsp. aureus N315
acgauauguugugcugccaa

SEQ ID NO: 4037168 - RNA, 15 nt, Staphylococcus aureus subsp. aureus N315
acgauauucuacaug

SEQ ID NO: 4037169 - RNA, 14 nt, Staphylococcus aureus subsp. aureus N315
acgaucaaauuuaa

SEQ ID NO: 4037170 - RNA, 20 nt, Staphylococcus aureus subsp. aureus N315
acgaucaacugcuucacgau

SEQ ID NO: 4037171 - RNA, 20 nt, Staphylococcus aureus subsp. aureus N315
acgaugagcgcauaaauuuu

SEQ ID NO: 4037172 - RNA, 13 nt, Staphylococcus aureus subsp. aureus N315
acgaugguugcuu

SEQ ID NO: 4037173 - RNA, 14 nt, Staphylococcus aureus subsp. aureus N315
acgauuaauaaaau

SEQ ID NO: 4037174 - RNA, 18 nt, Staphylococcus aureus subsp. aureus N315
acgauugaguugaaaaua

SEQ ID NO: 4037175 - RNA, 17 nt, Staphylococcus aureus subsp. aureus N315
acgauuuguucaaugau

SEQ ID NO: 4037176 - RNA, 23 nt, Staphylococcus aureus subsp. aureus N315
acgauuuguucaaugauuuuaua

SEQ ID NO: 4037177 - RNA, 16 nt, Staphylococcus aureus subsp. aureus N315
acgauuuuuaaaaugc

SEQ ID NO: 4037178 - RNA, 12 nt, Staphylococcus aureus subsp. aureus N315
acgcaaaacaau

SEQ ID NO: 4037179 - RNA, 17 nt, Staphylococcus aureus subsp. aureus N315
acgcaaaacaauaugaa

SEQ ID NO: 4037180 - RNA, 13 nt, Staphylococcus aureus subsp. aureus N315
acgcaauaucaua

SEQ ID NO: 4037181 - RNA, 22 nt, Staphylococcus aureus subsp. aureus N315
acgcaauuaaccuugauuuaau

SEQ ID NO: 4037182 - RNA, 19 nt, Staphylococcus aureus subsp. aureus N315
acgcacuaucaaugacauc

SEQ ID NO: 4037183 - RNA, 14 nt, Staphylococcus aureus subsp. aureus N315
acgcacuauuuuua

SEQ ID NO: 4037184 - RNA, 18 nt, Staphylococcus aureus subsp. aureus N315
acgcauuauuaagggggu

SEQ ID NO: 4037185 - RNA, 18 nt, Staphylococcus aureus subsp. aureus N315
acuaaguuuguuuucuuu

SEQ ID NO: 4037186 - RNA, 11 nt, Staphylococcus aureus subsp. aureus N315
acuaauaauug

SEQ ID NO: 4037187 - RNA, 19 nt, Staphylococcus aureus subsp. aureus N315
acuaauauauuaauuuuac

SEQ ID NO: 4037188 - RNA, 15 nt, Staphylococcus aureus subsp. aureus N315
acuaauauuucuuag

SEQ ID NO: 4037189 - RNA, 18 nt, Staphylococcus aureus subsp. aureus N315
acuaauauuucuuagaua

SEQ ID NO: 4037190 - RNA, 16 nt, Staphylococcus aureus subsp. aureus N315
acuaaucaaagaaaaa

SEQ ID NO: 4037191 - RNA, 14 nt, Staphylococcus aureus subsp. aureus N315
acuaaucaauacua

SEQ ID NO: 4037192 - RNA, 23 nt, Staphylococcus aureus subsp. aureus N315
acuaaucaauacuaaaccaauga

SEQ ID NO: 4037193 - RNA, 13 nt, Staphylococcus aureus subsp. aureus N315
acuaaucguguau

SEQ ID NO: 4037194 - RNA, 16 nt, Staphylococcus aureus subsp. aureus N315
acuaaugauaguacau

SEQ ID NO: 4037195 - RNA, 20 nt, Staphylococcus aureus subsp. aureus N315
acuaaugauaguacauuuau

SEQ ID NO: 4037196 - RNA, 22 nt, Staphylococcus aureus subsp. aureus N315
acuaauggauaugauaaccaaa

SEQ ID NO: 4037197 - RNA, 20 nt, Staphylococcus aureus subsp. aureus N315
acuaauggcacuuaauauaa

SEQ ID NO: 4037198 - RNA, 15 nt, Staphylococcus aureus subsp. aureus N315
acuaauguuaaaaua

SEQ ID NO: 4037199 - RNA, 21 nt, Staphylococcus aureus subsp. aureus N315
acuaauguuaaucaaaauuau

SEQ ID NO: 4037200 - RNA, 11 nt, Staphylococcus aureus subsp. aureus N315
acuaauuaaag

SEQ ID NO: 4037201 - RNA, 17 nt, Staphylococcus aureus subsp. aureus N315
acuaauugaucagcauu

SEQ ID NO: 4037202 - RNA, 18 nt, Staphylococcus aureus subsp. aureus N315
acuaauuuaaagcaucau

SEQ ID NO: 4037203 - RNA, 18 nt, Staphylococcus aureus subsp. aureus N315
acuaauuucuauagaaaa

SEQ ID NO: 4037204 - RNA, 20 nt, Staphylococcus aureus subsp. aureus N315
acuaauuucuauagaaaaag

SEQ ID NO: 4037205 - RNA, 23 nt, Staphylococcus aureus subsp. aureus N315
acuacaaacuugauuauguaauu

SEQ ID NO: 4037206 - RNA, 13 nt, Staphylococcus aureus subsp. aureus N315
acuacaacuuaag

SEQ ID NO: 4037207 - RNA, 19 nt, Staphylococcus aureus subsp. aureus N315
acuacacacguagaaagau

SEQ ID NO: 4037208 - RNA, 21 nt, Staphylococcus aureus subsp. aureus N315
acuacacacguagaaagaugu

SEQ ID NO: 4037209 - RNA, 19 nt, Staphylococcus aureus subsp. aureus N315
acuacacuccccuuaucaa

SEQ ID NO: 4037210 - RNA, 15 nt, Staphylococcus aureus subsp. aureus N315
acuacaguguaugau

SEQ ID NO: 4037211 - RNA, 19 nt, Staphylococcus aureus subsp. aureus N315
acuaccuauuaauaucaua

SEQ ID NO: 4037212 - RNA, 15 nt, Staphylococcus aureus subsp. aureus N315
acuacgcauuauuaa

SEQ ID NO: 4037213 - RNA, 16 nt, Staphylococcus aureus subsp. aureus N315
acuacuacauuauuac

SEQ ID NO: 4037214 - RNA, 16 nt, Staphylococcus aureus subsp. aureus N315
acuacugucaauauaa

SEQ ID NO: 4037215 - RNA, 19 nt, Staphylococcus aureus subsp. aureus N315
acuacugucucaucuucua

SEQ ID NO: 4037216 - RNA, 14 nt, Staphylococcus aureus subsp. aureus N315
acuacuuaauuaau

SEQ ID NO: 4037217 - RNA, 19 nt, Staphylococcus aureus subsp. aureus N315
acuagauaguuuauacuuu

SEQ ID NO: 4037218 - RNA, 22 nt, Staphylococcus aureus subsp. aureus N315
acuaguaauagaauagucaauu

SEQ ID NO: 4037219 - RNA, 18 nt, Staphylococcus aureus subsp. aureus N315
acuaguacgaaaugcaau

SEQ ID NO: 4037220 - RNA, 23 nt, Staphylococcus aureus subsp. aureus N315
acuaguguaccuuguuucaagcu

SEQ ID NO: 4037221 - RNA, 22 nt, Staphylococcus aureus subsp. aureus N315
acuaguucuaaguguugaccau

SEQ ID NO: 4037222 - RNA, 14 nt, Staphylococcus aureus subsp. aureus N315
acuaguuuguaaua

SEQ ID NO: 4037223 - RNA, 15 nt, Staphylococcus aureus subsp. aureus N315
acuauaaaaauuuau

SEQ ID NO: 4037224 - RNA, 17 nt, Staphylococcus aureus subsp. aureus N315
acuauaaaauucaccaa

SEQ ID NO: 4037225 - RNA, 20 nt, Staphylococcus aureus subsp. aureus N315
acuauaauaauuaacugcgg

SEQ ID NO: 4037226 - RNA, 16 nt, Staphylococcus aureus subsp. aureus N315
acuauaauuucuuaau

SEQ ID NO: 4037227 - RNA, 16 nt, Staphylococcus aureus subsp. aureus N315
acuauacugaugaaaa

SEQ ID NO: 4037228 - RNA, 22 nt, Staphylococcus aureus subsp. aureus N315
acuauagccaaaggcaaaaugu

SEQ ID NO: 4037229 - RNA, 17 nt, Staphylococcus aureus subsp. aureus N315
acuauaugugucgagua

SEQ ID NO: 4037230 - RNA, 16 nt, Staphylococcus aureus subsp. aureus N315
acuauauucaauuuaa

SEQ ID NO: 4037231 - RNA, 17 nt, Staphylococcus aureus subsp. aureus N315
acuauauucaauuuaau

SEQ ID NO: 4037232 - RNA, 14 nt, Staphylococcus aureus subsp. aureus N315
acuauauuuauuag

SEQ ID NO: 4037233 - RNA, 14 nt, Staphylococcus aureus subsp. aureus N315
acuaucaaugacau

SEQ ID NO: 4037234 - RNA, 18 nt, Staphylococcus aureus subsp. aureus N315
acuaucuguuguuauaua

SEQ ID NO: 4037235 - RNA, 15 nt, Staphylococcus aureus subsp. aureus N315
acuaucuucaucaua

SEQ ID NO: 4037236 - RNA, 16 nt, Staphylococcus aureus subsp. aureus N315
acuaugaauagaugau

SEQ ID NO: 4037237 - RNA, 14 nt, Staphylococcus aureus subsp. aureus N315
acuaugcaaaugaa

SEQ ID NO: 4037238 - RNA, 21 nt, Staphylococcus aureus subsp. aureus N315
acuaugcaaaugaaauucuuu

SEQ ID NO: 4037239 - RNA, 20 nt, Staphylococcus aureus subsp. aureus N315
acuaugcauaauaccaauug

SEQ ID NO: 4037240 - RNA, 13 nt, Staphylococcus aureus subsp. aureus N315
acuauggcauuau

SEQ ID NO: 4037241 - RNA, 12 nt, Staphylococcus aureus subsp. aureus N315
acuaugugaagu

SEQ ID NO: 4037242 - RNA, 17 nt, Staphylococcus aureus subsp. aureus N315
acuauguuacuuauaua

SEQ ID NO: 4037243 - RNA, 19 nt, Staphylococcus aureus subsp. aureus N315
acuauguuacuuauauauu

SEQ ID NO: 4037244 - RNA, 16 nt, Staphylococcus aureus subsp. aureus N315
acuauuaaaaccaaaa

SEQ ID NO: 4037245 - RNA, 21 nt, Staphylococcus aureus subsp. aureus N315
acuauuaaaaccaaaagaaau

SEQ ID NO: 4037246 - RNA, 15 nt, Staphylococcus aureus subsp. aureus N315
acuauuaaaggaaau

SEQ ID NO: 4037247 - RNA, 21 nt, Staphylococcus aureus subsp. aureus N315
acuauuaaauaaucgcccauc

SEQ ID NO: 4037248 - RNA, 17 nt, Staphylococcus aureus subsp. aureus N315
acuauuaucuauccauu

SEQ ID NO: 4037249 - RNA, 19 nt, Staphylococcus aureus subsp. aureus N315
acuauuccguuucauugau

SEQ ID NO: 4037250 - RNA, 15 nt, Staphylococcus aureus subsp. aureus N315
acuauucuuucuugc

SEQ ID NO: 4037251 - RNA, 13 nt, Staphylococcus aureus subsp. aureus N315
acuauugaaaaua

SEQ ID NO: 4037252 - RNA, 15 nt, Staphylococcus aureus subsp. aureus N315
acuauugaaaauaga

SEQ ID NO: 4037253 - RNA, 21 nt, Staphylococcus aureus subsp. aureus N315
acuauugauauucuaaaaaau

SEQ ID NO: 4037254 - RNA, 19 nt, Staphylococcus aureus subsp. aureus N315
acuauuucgcuuuuuuuau

SEQ ID NO: 4037255 - RNA, 14 nt, Staphylococcus aureus subsp. aureus N315
acuauuuguuuuag

SEQ ID NO: 4037256 - RNA, 19 nt, Staphylococcus aureus subsp. aureus N315
acuauuuuugaaaagagcg

SEQ ID NO: 4037257 - RNA, 15 nt, Staphylococcus aureus subsp. aureus N315
acuauuuuuucuaau

SEQ ID NO: 4037258 - RNA, 20 nt, Staphylococcus aureus subsp. aureus N315
acucaaaaagccaacacauu

SEQ ID NO: 4037259 - RNA, 23 nt, Staphylococcus aureus subsp. aureus N315
acucaaaauguuuaacaauaaua

SEQ ID NO: 4037260 - RNA, 16 nt, Staphylococcus aureus subsp. aureus N315
acucaaaauuaaagcu

SEQ ID NO: 4037261 - RNA, 17 nt, Staphylococcus aureus subsp. aureus N315
acucaaagauauacuua

SEQ ID NO: 4037262 - RNA, 14 nt, Staphylococcus aureus subsp. aureus N315
acucaaauaucuaa

SEQ ID NO: 4037263 - RNA, 18 nt, Staphylococcus aureus subsp. aureus N315
acucaaggaaaucauaua

SEQ ID NO: 4037264 - RNA, 15 nt, Staphylococcus aureus subsp. aureus N315
acucaauucucuaac

SEQ ID NO: 4037265 - RNA, 15 nt, Staphylococcus aureus subsp. aureus N315
acucaauuucauuug

SEQ ID NO: 4037266 - RNA, 20 nt, Staphylococcus aureus subsp. aureus N315
acucacauucugcccugcaa

SEQ ID NO: 4037267 - RNA, 22 nt, Staphylococcus aureus subsp. aureus N315
acucacauucugcccugcaaug

SEQ ID NO: 4037268 - RNA, 15 nt, Staphylococcus aureus subsp. aureus N315
acucaccugcagcau

SEQ ID NO: 4037269 - RNA, 15 nt, Staphylococcus aureus subsp. aureus N315
acucacugcacuuau

SEQ ID NO: 4037270 - RNA, 12 nt, Staphylococcus aureus subsp. aureus N315
acucacuucuua

SEQ ID NO: 4037271 - RNA, 18 nt, Staphylococcus aureus subsp. aureus N315
acucagaaucuuacauug

SEQ ID NO: 4037272 - RNA, 16 nt, Staphylococcus aureus subsp. aureus N315
acucaggcuuaauuaa

SEQ ID NO: 4037273 - RNA, 22 nt, Staphylococcus aureus subsp. aureus N315
acuuaauuaauaauuuaacuaa

SEQ ID NO: 4037274 - RNA, 12 nt, Staphylococcus aureus subsp. aureus N315
acuuacaaauau

SEQ ID NO: 4037275 - RNA, 18 nt, Staphylococcus aureus subsp. aureus N315
acuuacaaauauugugga

SEQ ID NO: 4037276 - RNA, 13 nt, Staphylococcus aureus subsp. aureus N315
acuuacaagucua

SEQ ID NO: 4037277 - RNA, 13 nt, Staphylococcus aureus subsp. aureus N315
acuuacauuacau

SEQ ID NO: 4037278 - RNA, 17 nt, Staphylococcus aureus subsp. aureus N315
acuuacauuacauauau

SEQ ID NO: 4037279 - RNA, 23 nt, Staphylococcus aureus subsp. aureus N315
acuuacauuuuaauaaaaucauc

SEQ ID NO: 4037280 - RNA, 18 nt, Staphylococcus aureus subsp. aureus N315
acuuauaaaucaaagucu

SEQ ID NO: 4037281 - RNA, 15 nt, Staphylococcus aureus subsp. aureus N315
acuuauaacugauaa

SEQ ID NO: 4037282 - RNA, 23 nt, Staphylococcus aureus subsp. aureus N315
acuuauauacguugauuaacaca

SEQ ID NO: 4037283 - RNA, 12 nt, Staphylococcus aureus subsp. aureus N315
acuuauauauuc

SEQ ID NO: 4037284 - RNA, 13 nt, Staphylococcus aureus subsp. aureus N315
acuuauauauuca

SEQ ID NO: 4037285 - RNA, 23 nt, Staphylococcus aureus subsp. aureus N315
acuuauauauucaauaauuauua

SEQ ID NO: 4037286 - RNA, 15 nt, Staphylococcus aureus subsp. aureus N315
acuuaugauacugau

SEQ ID NO: 4037287 - RNA, 18 nt, Staphylococcus aureus subsp. aureus N315
acuuauggguucaauauc

SEQ ID NO: 4037288 - RNA, 14 nt, Staphylococcus aureus subsp. aureus N315
acuuauuaauuaau

SEQ ID NO: 4037289 - RNA, 15 nt, Staphylococcus aureus subsp. aureus N315
acuuauuaauuaaua

SEQ ID NO: 4037290 - RNA, 21 nt, Staphylococcus aureus subsp. aureus N315
acuuauuaauuaauagagaca

SEQ ID NO: 4037291 - RNA, 12 nt, Staphylococcus aureus subsp. aureus N315
acuuauuucaaa

SEQ ID NO: 4037292 - RNA, 13 nt, Staphylococcus aureus subsp. aureus N315
acuuauuucaaaa

SEQ ID NO: 4037293 - RNA, 14 nt, Staphylococcus aureus subsp. aureus N315
acuuauuucuuuuc

SEQ ID NO: 4037294 - RNA, 18 nt, Staphylococcus aureus subsp. aureus N315
acuuauuugccauauaca

SEQ ID NO: 4037295 - RNA, 20 nt, Staphylococcus aureus subsp. aureus N315
acuuauuugccauauacaca

SEQ ID NO: 4037296 - RNA, 16 nt, Staphylococcus aureus subsp. aureus N315
acuuauuuuucaucau

SEQ ID NO: 4037297 - RNA, 18 nt, Staphylococcus aureus subsp. aureus N315
acuucaaacguuauguac

SEQ ID NO: 4037298 - RNA, 19 nt, Staphylococcus aureus subsp. aureus N315
acuucaacgucaucugcuu

SEQ ID NO: 4037299 - RNA, 12 nt, Staphylococcus aureus subsp. aureus N315
acuucacauuua

SEQ ID NO: 4037300 - RNA, 17 nt, Staphylococcus aureus subsp. aureus N315
acuucacgcaaaacaau

SEQ ID NO: 4037301 - RNA, 13 nt, Staphylococcus aureus subsp. aureus N315
acuucauaaguca

SEQ ID NO: 4037302 - RNA, 16 nt, Staphylococcus aureus subsp. aureus N315
acuucaucacucgcaa

SEQ ID NO: 4037303 - RNA, 11 nt, Staphylococcus aureus subsp. aureus N315
acuucaucuaa

SEQ ID NO: 4037304 - RNA, 13 nt, Staphylococcus aureus subsp. aureus N315
acuucaucuaaau

SEQ ID NO: 4037305 - RNA, 14 nt, Staphylococcus aureus subsp. aureus N315
acuuccaacauaua

SEQ ID NO: 4037306 - RNA, 14 nt, Staphylococcus aureus subsp. aureus N315
acuuccaucaaucc

SEQ ID NO: 4037307 - RNA, 20 nt, Staphylococcus aureus subsp. aureus N315
acuucccuuuggaagcaauu

SEQ ID NO: 4037308 - RNA, 16 nt, Staphylococcus aureus subsp. aureus N315
acuuccuaaaauuuac

SEQ ID NO: 4037309 - RNA, 13 nt, Staphylococcus aureus subsp. aureus N315
acuuccuuuuuau

SEQ ID NO: 4037310 - RNA, 15 nt, Staphylococcus aureus subsp. aureus N315
acuucuaauuugcaa

SEQ ID NO: 4037311 - RNA, 16 nt, Staphylococcus aureus subsp. aureus N315
acuucuaauuugcaaa

SEQ ID NO: 4037312 - RNA, 17 nt, Staphylococcus aureus subsp. aureus N315
acuucuaauuugcaaaa

SEQ ID NO: 4037313 - RNA, 22 nt, Staphylococcus aureus subsp. aureus N315
acuucuauuuuauaauaaauuu

SEQ ID NO: 4037314 - RNA, 16 nt, Staphylococcus aureus subsp. aureus N315
acuucucaauuuagua

SEQ ID NO: 4037315 - RNA, 17 nt, Staphylococcus aureus subsp. aureus N315
acuucucaauuuaguau

SEQ ID NO: 4037316 - RNA, 16 nt, Staphylococcus aureus subsp. aureus N315
acuucucuaucagucc

SEQ ID NO: 4037317 - RNA, 16 nt, Staphylococcus aureus subsp. aureus N315
acuucugauucuucac

SEQ ID NO: 4037318 - RNA, 23 nt, Staphylococcus aureus subsp. aureus N315
acuucugauucuucacuaaaaau

SEQ ID NO: 4037319 - RNA, 18 nt, Staphylococcus aureus subsp. aureus N315
acuucuuaacuugaaaug

SEQ ID NO: 4037320 - RNA, 17 nt, Staphylococcus aureus subsp. aureus N315
acuucuuguucgauaau

SEQ ID NO: 4037321 - RNA, 15 nt, Staphylococcus aureus subsp. aureus N315
acuucuuuauauuua

SEQ ID NO: 4037322 - RNA, 22 nt, Staphylococcus aureus subsp. aureus N315
acuucuuucaaaaacaguuaca

SEQ ID NO: 4037323 - RNA, 14 nt, Staphylococcus aureus subsp. aureus N315
acuucuuuugcaaa

SEQ ID NO: 4037324 - RNA, 21 nt, Staphylococcus aureus subsp. aureus N315
acuucuuuugcaaaacgcauu

SEQ ID NO: 4037325 - RNA, 16 nt, Staphylococcus aureus subsp. aureus N315
acuucuuuuguuuuac

SEQ ID NO: 4037326 - RNA, 20 nt, Staphylococcus aureus subsp. aureus N315
acuucuuuuguuuuaccauc

SEQ ID NO: 4037327 - RNA, 15 nt, Staphylococcus aureus subsp. aureus N315
acuucuuuuuuguau

SEQ ID NO: 4037328 - RNA, 22 nt, Staphylococcus aureus subsp. aureus N315
acuugaaaauagccauauucau

SEQ ID NO: 4037329 - RNA, 11 nt, Staphylococcus aureus subsp. aureus N315
acuugaagaaa

SEQ ID NO: 4037330 - RNA, 16 nt, Staphylococcus aureus subsp. aureus N315
acuugaagaaaaguau

SEQ ID NO: 4037331 - RNA, 21 nt, Staphylococcus aureus subsp. aureus N315
acuugaagaaaaguauaaaua

SEQ ID NO: 4037332 - RNA, 16 nt, Staphylococcus aureus subsp. aureus N315
acuugaauuuaauaag

SEQ ID NO: 4037333 - RNA, 22 nt, Staphylococcus aureus subsp. aureus N315
acuugaccacuuuuguuaaaaa

SEQ ID NO: 4037334 - RNA, 20 nt, Staphylococcus aureus subsp. aureus N315
acuugauaaaacuaaugaua

SEQ ID NO: 4037335 - RNA, 15 nt, Staphylococcus aureus subsp. aureus N315
acuugaugaaacuga

SEQ ID NO: 4037336 - RNA, 16 nt, Staphylococcus aureus subsp. aureus N315
acuugaugaaacugau

SEQ ID NO: 4037337 - RNA, 16 nt, Staphylococcus aureus subsp. aureus N315
acuugauucuacuuca

SEQ ID NO: 4037338 - RNA, 22 nt, Staphylococcus aureus subsp. aureus N315
acuugcacauuaucguaagcug

SEQ ID NO: 4037339 - RNA, 14 nt, Staphylococcus aureus subsp. aureus N315
acuugcgcaugcuu

SEQ ID NO: 4037340 - RNA, 18 nt, Staphylococcus aureus subsp. aureus N315
acuuggauuaccguuaaa

SEQ ID NO: 4037341 - RNA, 17 nt, Staphylococcus aureus subsp. aureus N315
acuuggauucaaaugac

SEQ ID NO: 4037342 - RNA, 19 nt, Staphylococcus aureus subsp. aureus N315
acuuggauucaaaugacau

SEQ ID NO: 4037343 - RNA, 13 nt, Staphylococcus aureus subsp. aureus N315
acuuggauuuuaa

SEQ ID NO: 4037344 - RNA, 14 nt, Staphylococcus aureus subsp. aureus N315
acuuggccuaaguu

SEQ ID NO: 4037345 - RNA, 21 nt, Staphylococcus aureus subsp. aureus N315
acuuggcgacauuuguaaaua

SEQ ID NO: 4037346 - RNA, 21 nt, Staphylococcus aureus subsp. aureus N315
acuuggcuuaggaugaaaaua

SEQ ID NO: 4037347 - RNA, 13 nt, Staphylococcus aureus subsp. aureus N315
acuugggauuuuu

SEQ ID NO: 4037348 - RNA, 16 nt, Staphylococcus aureus subsp. aureus N315
acuuggugauguaaua

SEQ ID NO: 4037349 - RNA, 15 nt, Staphylococcus aureus subsp. aureus N315
acuuguaaauuuauu

SEQ ID NO: 4037350 - RNA, 15 nt, Staphylococcus aureus subsp. aureus N315
acuuguaauauaaca

SEQ ID NO: 4037351 - RNA, 16 nt, Staphylococcus aureus subsp. aureus N315
acuuguaaucauacca

SEQ ID NO: 4037352 - RNA, 15 nt, Staphylococcus aureus subsp. aureus N315
acuuguauuguuugu

SEQ ID NO: 4037353 - RNA, 21 nt, Staphylococcus aureus subsp. aureus N315
acuuguccguuuuauauuuau

SEQ ID NO: 4037354 - RNA, 17 nt, Staphylococcus aureus subsp. aureus N315
acuugucguauucuuca

SEQ ID NO: 4037355 - RNA, 18 nt, Staphylococcus aureus subsp. aureus N315
acuugucguauucuucaa

SEQ ID NO: 4037356 - RNA, 23 nt, Staphylococcus aureus subsp. aureus N315
acuugugacaaucgcuugcuucu

SEQ ID NO: 4037357 - RNA, 22 nt, Staphylococcus aureus subsp. aureus N315
acuuguucaauacuucuuguuc

SEQ ID NO: 4037358 - RNA, 16 nt, Staphylococcus aureus subsp. aureus N315
acuuguuuguuuuugu

SEQ ID NO: 4037359 - RNA, 15 nt, Staphylococcus aureus subsp. aureus N315
acuuuaaaauuguau

SEQ ID NO: 4037360 - RNA, 22 nt, Staphylococcus aureus subsp. aureus N315
acuuuaaaauuguauagaaugu

SEQ ID NO: 4037361 - RNA, 23 nt, Staphylococcus aureus subsp. aureus N315
agaaaauuacuuagcaaacaauu

SEQ ID NO: 4037362 - RNA, 20 nt, Staphylococcus aureus subsp. aureus N315
agaaacaaaacaaaaaauau

SEQ ID NO: 4037363 - RNA, 22 nt, Staphylococcus aureus subsp. aureus N315
agaaacaaugcgaagaaaucau

SEQ ID NO: 4037364 - RNA, 16 nt, Staphylococcus aureus subsp. aureus N315
agaaacacaaggaaua

SEQ ID NO: 4037365 - RNA, 20 nt, Staphylococcus aureus subsp. aureus N315
agaaacacaaggaauauaca

SEQ ID NO: 4037366 - RNA, 13 nt, Staphylococcus aureus subsp. aureus N315
agaaacauuauau

SEQ ID NO: 4037367 - RNA, 18 nt, Staphylococcus aureus subsp. aureus N315
agaaacauuauauaacac

SEQ ID NO: 4037368 - RNA, 23 nt, Staphylococcus aureus subsp. aureus N315
agaaacuauagauaggauauuuu

SEQ ID NO: 4037369 - RNA, 16 nt, Staphylococcus aureus subsp. aureus N315
agaaacuuccaacaua

SEQ ID NO: 4037370 - RNA, 13 nt, Staphylococcus aureus subsp. aureus N315
agaaagaaauugu

SEQ ID NO: 4037371 - RNA, 16 nt, Staphylococcus aureus subsp. aureus N315
agaaagcuaauaucaa

SEQ ID NO: 4037372 - RNA, 18 nt, Staphylococcus aureus subsp. aureus N315
agaaagcuaauaucaaua

SEQ ID NO: 4037373 - RNA, 22 nt, Staphylococcus aureus subsp. aureus N315
agaaagcuaauggcuaauacaa

SEQ ID NO: 4037374 - RNA, 23 nt, Staphylococcus aureus subsp. aureus N315
agaaagcuaauggcuaauacaaa

SEQ ID NO: 4037375 - RNA, 19 nt, Staphylococcus aureus subsp. aureus N315
agaaaggcuagcuaaaauu

SEQ ID NO: 4037376 - RNA, 14 nt, Staphylococcus aureus subsp. aureus N315
agaaaguaaaaguu

SEQ ID NO: 4037377 - RNA, 17 nt, Staphylococcus aureus subsp. aureus N315
agaaagugcgguuauuu

SEQ ID NO: 4037378 - RNA, 21 nt, Staphylococcus aureus subsp. aureus N315
agaaauacauccauacuucua

SEQ ID NO: 4037379 - RNA, 13 nt, Staphylococcus aureus subsp. aureus N315
agaaauacuugaa

SEQ ID NO: 4037380 - RNA, 21 nt, Staphylococcus aureus subsp. aureus N315
agaaauacuugaauuuaauaa

SEQ ID NO: 4037381 - RNA, 17 nt, Staphylococcus aureus subsp. aureus N315
agaaauaucuaccuuuu

SEQ ID NO: 4037382 - RNA, 17 nt, Staphylococcus aureus subsp. aureus N315
agaaaucucuaucgccu

SEQ ID NO: 4037383 - RNA, 16 nt, Staphylococcus aureus subsp. aureus N315
agaaaugucaguuuug

SEQ ID NO: 4037384 - RNA, 18 nt, Staphylococcus aureus subsp. aureus N315
agaaauuagaaccaucau

SEQ ID NO: 4037385 - RNA, 21 nt, Staphylococcus aureus subsp. aureus N315
agaaauucgaaaagaaauucu

SEQ ID NO: 4037386 - RNA, 21 nt, Staphylococcus aureus subsp. aureus N315
agaaauucgcaagccuucuau

SEQ ID NO: 4037387 - RNA, 23 nt, Staphylococcus aureus subsp. aureus N315
agaaauucuacaggcaaugcaag

SEQ ID NO: 4037388 - RNA, 23 nt, Staphylococcus aureus subsp. aureus N315
agaaauucuacagguaaugcaag

SEQ ID NO: 4037389 - RNA, 17 nt, Staphylococcus aureus subsp. aureus N315
agaaauuuaauacaauu

SEQ ID NO: 4037390 - RNA, 21 nt, Staphylococcus aureus subsp. aureus N315
agaaauuuaauauuguuaauu

SEQ ID NO: 4037391 - RNA, 13 nt, Staphylococcus aureus subsp. aureus N315
agaaauuuuaaaa

SEQ ID NO: 4037392 - RNA, 15 nt, Staphylococcus aureus subsp. aureus N315
agaacaauaauugau

SEQ ID NO: 4037393 - RNA, 23 nt, Staphylococcus aureus subsp. aureus N315
agaacauuuaucgugaagaaaaa

SEQ ID NO: 4037394 - RNA, 15 nt, Staphylococcus aureus subsp. aureus N315
agaaccaaaauuaua

SEQ ID NO: 4037395 - RNA, 16 nt, Staphylococcus aureus subsp. aureus N315
agaaccaaaauuauau

SEQ ID NO: 4037396 - RNA, 15 nt, Staphylococcus aureus subsp. aureus N315
agaaccaacaauaaa

SEQ ID NO: 4037397 - RNA, 23 nt, Staphylococcus aureus subsp. aureus N315
agaaccuauauuaagcauuuguc

SEQ ID NO: 4037398 - RNA, 21 nt, Staphylococcus aureus subsp. aureus N315
agaaccuugaaugauauuaac

SEQ ID NO: 4037399 - RNA, 15 nt, Staphylococcus aureus subsp. aureus N315
agaaccuuuaaaagu

SEQ ID NO: 4037400 - RNA, 17 nt, Staphylococcus aureus subsp. aureus N315
agaacgcuuuauuacuu

SEQ ID NO: 4037401 - RNA, 13 nt, Staphylococcus aureus subsp. aureus N315
agaacuacaauuc

SEQ ID NO: 4037402 - RNA, 19 nt, Staphylococcus aureus subsp. aureus N315
agaacuaucgauacuaaac

SEQ ID NO: 4037403 - RNA, 13 nt, Staphylococcus aureus subsp. aureus N315
agaacuaugaaua

SEQ ID NO: 4037404 - RNA, 21 nt, Staphylococcus aureus subsp. aureus N315
agaacuauuuuaaauuacaac

SEQ ID NO: 4037405 - RNA, 13 nt, Staphylococcus aureus subsp. aureus N315
agaagaaauauau

SEQ ID NO: 4037406 - RNA, 18 nt, Staphylococcus aureus subsp. aureus N315
agaagaauucucuauuca

SEQ ID NO: 4037407 - RNA, 19 nt, Staphylococcus aureus subsp. aureus N315
agaagcaaaagaugaaaau

SEQ ID NO: 4037408 - RNA, 15 nt, Staphylococcus aureus subsp. aureus N315
agaagcugacgaaaa

SEQ ID NO: 4037409 - RNA, 15 nt, Staphylococcus aureus subsp. aureus N315
agaagcuuucuggaa

SEQ ID NO: 4037410 - RNA, 20 nt, Staphylococcus aureus subsp. aureus N315
agaaggggacuuaaccauuu

SEQ ID NO: 4037411 - RNA, 13 nt, Staphylococcus aureus subsp. aureus N315
agaaguauuauga

SEQ ID NO: 4037412 - RNA, 14 nt, Staphylococcus aureus subsp. aureus N315
agaaguuguuuaga

SEQ ID NO: 4037413 - RNA, 18 nt, Staphylococcus aureus subsp. aureus N315
agaaguuuccaacguuau

SEQ ID NO: 4037414 - RNA, 15 nt, Staphylococcus aureus subsp. aureus N315
agaaguuuuuugauu

SEQ ID NO: 4037415 - RNA, 13 nt, Staphylococcus aureus subsp. aureus N315
agaauaaaaaagu

SEQ ID NO: 4037416 - RNA, 12 nt, Staphylococcus aureus subsp. aureus N315
agaauaaaaggc

SEQ ID NO: 4037417 - RNA, 16 nt, Staphylococcus aureus subsp. aureus N315
agaauaaacaacauac

SEQ ID NO: 4037418 - RNA, 14 nt, Staphylococcus aureus subsp. aureus N315
agaauaaacuuuau
